United States Patent 9,290,773 (TRANSGENIC PLANTS WITH ENHANCED AGRONOMIC TRAITS) - sequence listing, part 2

SEQ ID NO: 3882 - protein, 3260 aa, Oryza sativa
MNPSARISQVAMAAILPDLATQVLVPAAAVVGIAFAVVQWVLVSKVKMTAERRGGEGSPGAAAGKDGGAASEYLIEEEEGLNEHNVVEKCSEIQHAISEGATSFLFTEYKYVGLFMGIFAVLIFLFLGSVEGFSTKSQPCHYSKDRMCKPALANAIFSTVAFVLGAVTSLVSGFLGMKIATYANARTTLEARKGVGKAFITAFRSGAVMGFLLAASGLVVLYIAINLFGIYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGINHEFTPMLYPLLISSVGIIACLITTLFATDFFEIKAVDEIEPALKKQLIISTVVMTVGIALVSWLGLPYSFTIFNFGAQKTVYNWQLFLCVAVGLWAGLIIGFVTEYYTSNAYSPVQDVADSCRTGAATNVIFGLALGYKSVIIPIFAIAFSIFLSFSLAAMYGVAVAALGMLSTIATGLAIDAYGPISDNAGGIAEMAGMSHRIRERTDALDAAGNTTAAIGKGFAIGSAALVSLALFGAFVSRAAISTVDVLTPKVFIGLIVGAMLPYWFSAMTMKSVGSAALKMVEEVRRQFNSIPGLMEGTTKPDYATCVKISTDASIKEMIPPGALVMLSPLIVGIFFGVETLSGLLAGALVSGVQIAISASNTGGAWDNAKKYIEAGASEHARTLGPKGSDCHKAAVIGDTIGDPLKDTSGPSLNILIKLMAVESLVFAPFFATHGGILFNPYWSSDFLPATRILIAATNRLLTIHLKIQTTSSLDEEELPIRNRSPFISKSNNFIVRTASPRRRTPTPSLRPSSPPTQPRNKPRGAAARGARRREVTFRDDLEAIKSMLSSLQAKLNDAERKSQTDGSVRDLLKKLKAVAYDIEDRLAVYESSSNDGHDGSLRHEWSSFPEKLKSRYNLPREMKKMRRRLEGIKKEMDLTSFKVDGATEEQDSYISRHLEPRRYSSEDTVGRIAEKGRIMDLLLSDEEHSIIPIYGLGGLGKTTLAQMAFSDCTTQIAFEMLAWVYVSEKFDLNAISLSIKQQCNSHTLQYGDSGIHNVAVESILTEKRCLIVLDDLWEENNFKLDELEAMLRLCKKGSKVIVTTRSKKVADRMNKDLQIELGLLPNEDCWTLFRKKARVPTPVPPYVEAMRETIVEKCQGLPLAVKSLGYFLGRMRPTEWEQNLHSNIWAEKDDRFPDNGVIANLKLSYYSMPCSLRLCFAYLSVFPKGSHIQKSSLIQQWIALGFIQPPESIPTEQYAEYCLQELIEMSFLQNVNAATAMSARYTEPQNVLKMHDIVHDLASVIAADEVCIFHASDCSSSNTKNCCRYMYLLNLSEFSRDPILPNTARALHFKDCRKSPKNYSETKFLRILDFSACTINELPDSISHLSLLKYLNVSGLSGTLPKSLSKLHHLQALTLSTNIDLVELPSYICEFLKLQYLDLHGCSKLKKLPDGIHKHKELQHLNLSDCTSLESLPLFSSQSGGLQKLSFLNVSHCSQLVKLSFLEEKLEKQPDHYLPNMVHLNMSFCPKLQELPTGLFKHMRKLLFLNFSGCTSLEDLPEFVEHDAGCSMLEVLDLSGCAKLPALPESSTELRELRCLNLSGCSKLQNFLKLIPRWKFGTLEYLNISGVGAKSDSEAPGTSAEDQSSQDPIKELELGMLQEDIITQGLFRLKYLSIGGFTLYSEQGIARMVDLLTLPNFNVRLQDDGRCSNILILQQILDVTHRQLNIKCLENVVFSEEAKQLELDRMRQFHSLGFEWSLSGMVSSVKQRAVLGNLRPHRNLQSLSIKGYICTEFPDWINKINDTLPDLVKLVFSDINGCNYIPISQLPNLKELEINNMPRLNKIYGTLPNLVKLILSHIERCDHIPVLGNLPNLQELEIYNMPQLHDARIGPCNKLRRLTLVGLPNEATVHLFYDICTHTEVQMVESSHGCDEEMTETGQEFNTLPGCSFRKNEVRRSEELSRGPSTEKGKVKNWFDALLLSIGGARAKKTLASALSHISLVPEESQLSPKLSHGCLEVTSAALPELDYLQIGSCHDLKLHPTPPKSKEYFVKDSSLSLPVDKEDTSSFPSRPYDQYTEGCSHSGQGTAIPPHEHAMQKSIPRLKSKLHIEGSRDQLRQWTELLSTHLDELTITDPLFYNSKYLEEESTVSEHDSLESIYGLPQSCIANLEKINLPPSHQYGLEECSNYDNIVDFVGRIDSQVPYINIGKRVGTAREQACDEKAEEWLTLAHEQAGRGAARAPSRRAASAAEERKHAGDKQAEECSRVGGEQAKERQPAAGLCLCLKMQVGTFSVKPIEEGGIFCSSNIPLLYKHYDGQSSSLVIKNLENLKGSLGEVQELAKYQQVRLVWSRSNFIEDSSMAEDKAVLQKLRPHHDLETIEIEGYRGDEFCYWMMNINSSLPNLVTVKLSNIANCQCLPPLGQLANLEVLHISDMPSVRKVDGHVYGTEKPFRKLRELELSTMKNLEEWLTTTLLLTGHNDHQLSRSEEVFPNLQVLLIANCPRMRFVPGFPRSRECTLEKSYSILLSFEQFIGSSNLALIALKINDSGSSSDIVKFLQGCVNLLYLTIDSCIDLITLPEPIKNCHCLRKLEITNCWNFSVLPEWLGELTFLQKLDIQASKLEYLPQSIQRLTALERLVLNKCNYKLRERCTSREDKEKIKHIKTIDMNEVPLMYLTPSYIMLLQQVTSSQFIDLHIGGLECMIGLREMENLELQTKKELSSLSLEWSYAYADSSDKYASSERGMQNRAVFEKLQPHDSLEILCIKNYAGVDFPRWMSLLPNLVQLKIVGMQFEYLHLDQFQNLKELFLSRVQFAHLHLNGLQNLIELSLSGLKFGHLHIDQLQNLRELKVSGVEFQHLHLERLQNITELKLSEERFERLHIDQLQNLKELKFSSVEFGHLHLERLQSITKLELCKKQFEHLHLVQLENLRQLYLFTVKFECVVLHQLQNLEELHLSQIESQKSNKPVCIECSQPLRKLQKIVMTKIINKGLQISVQGGEGDKNLFPGLQHLEMELCENLRFQPSIPRSTHYIISGEIYFDKFNYRRILGSFLFPSFKQVMGTSIPGSTSRMEIKNTSGLSSERWKSIPHLELLNITELTIDKCVDSCPVPKCILGWKSLQKLEIRRCEDIELLPEWLGEMSCLTELIVETYWMEALHPCIRRLTNLQSLTLITCLNRFKERCKSGDDWINIKHIPHIQITDRNGRTEIISPSCT

SEQ ID NO: 3883 - protein, 405 aa, Oryza sativa
MSFRSLIQEMRDEFGSISRHSLRSRSHRGGGGAPRVAAVGPAEAAAMQQSCWAQLPPELLREVLVRIEESEVWWPSRRDVVACAGVCRSWRGITKEIVRVPEASGKLTFPISLKQPGPRDGTLKCFIRRNRTTQTYYLYIGLTEVTALADDGKFLLAARKCRKPTCTDYLISLDMSDMSKGSNTYIGKLRSNFLGTKFTVYDAHPPYDGAVVSKSRSARVVGLNQVSPRVPAGNYPVSHISYELNVLGARGPRRMNCIMDSIPTSAVQEGGKAPTQTEFPLSGLDSFPSISFFRSKSARIDSATSQLSTQKEEKLVLKNKSPRWHEQLQCWCLNFRGRVTVASVKNFQLVASDENGPTNQEQDKVILQFGKIGKDLFTMDYRYPISAFQSFAICLSSFDTKIACE

SEQ ID NO: 3884 - protein, 365 aa, Oryza sativa
  unsure (1)..(365): unsure at all Xaa locations
GGFPLLFCAVICLMAQQGACNVVLIANNTTLSFDDVEATFTPEVKDSGVNGAIYAVEPLDACSPLRKKAANGPVSPFALVIRGGCQFDDKVRNAQNAGFKAVIVYDDEDSGVLVSXXSGEVLKKYSGQSDVEVWILPVYENSAWSIMAISFTSLLAMAAVLATCFFVRRHQIRRDRGRIPVTREFHGMSSQLVKAMPSLIFTKVQEDNSTSSSCAICLEDYSFGEKLRVLPCRHKFHATCVDMWLTSWKTFCPVCKRDASAGTSKPPASESTPLLSSVIHLSAESTALSSFRSTVAVSPPXANKTSSFIXQSTSRAYYTNSPYISTSRSNVDLANMSSQWSRCLPKYYFYFFYRNIFAQYYFNTX

SEQ ID NO: 3885 - protein, 477 aa, Oryza sativa
  unsure (1)..(477): unsure at all Xaa locations
MNCCSSEAVLSSKVALLNSLFCTIVLPKENCSNKMNCTKGGGFPLLFCAVICLMAQQGACNVVLIANNTTLSFDDVEATFTPEVKDSGVNGAIYAVEPLDACSPLRKKAANGPVSPFALVIRGGCQFDDKVRNAQNAGFKAVIVYDDEDSGVLVSMAGSSSGIYIYAVFLSKASGEVLKKYSGQSDVEVWILPVYENSAWSIMAISFTSLLAMAAVLATCFFVRRHQIRRDRGRIPVTREFHGMSSQLVKAMPSLIFTKVQEDNSTSSSCAICLEDYSFGEKLRVLPCRHKFHATCVDMWLTSWKTFCPVCKRDASAGTSKPPASESTPLLSSVIHLSAESTALSSFRSTVAVSPPRLRRHPSSQSTSRAYSISSAPRNYNLQRYYTNSPYISTSRSNVDLANMSSQWSHTPDQASMHSLRSGHLSLPINIRYTIPHVSRSDYGSASLGXYPMIPVHCLDSDGSLSAVTSDQSLPRC

SEQ ID NO: 3886 - protein, 336 aa, Oryza sativa
  unsure (1)..(336): unsure at all Xaa locations
XFVGAPVARGVPVXRAGGASGSCLHPVCRSQAPGELSKFSAARAVVELPARPVPGSSAWSSMALSVTPLAAARAVLATCFFVRRHQIRRDRGRIPVTREFHGMSSQLVKAMPSLIFTKVQEDNSTSSSCAICLEDYSFGEKLRVLPCRHKFHATCVDMWLTSWKTFCPVCKRDASAGTSKPPASESTPLLSSVIHLPAESTALSSFRSTVAVSSPRLRRHPSSQSTSRAYSISSAPRNYNLQRYYTNSPYISTSRSNVDLANMSSQWSHTPHQASMHSLRSGHLSLPINIRYTIPHVSRSDYGSASLGXYPMIPVHCLDSDGSLSAVTSDQSLPRC

SEQ ID NO: 3887 - protein, 1235 aa, Oryza sativa
MVFKGRFFSSRHKSSESSSPTDGSNSPRTPTSAPPAAGSPAAASSSSSSRSDKKKPKSETPRKRDKLFGGSASGSAASKGGAGAAPASASSSPSADGRKAAAAQLRDGGAGGASAAALSPILASSLGLNRIKTRSGPLPQEGHRIAAALGSSNLSRGQAQADPSAASAGGGGGGGRKAGSSWADSTSGSRGKGKAAEHPARGATATSLEGKSSAKDLFSSDSKGRTALSNSIQAPFRAYRHLNPQCAYDPCETPKESESPRFKAIMQATSAPRKRVPADIKSFSHELNSKGVRPFPFWKPRGIYNLKEVLKVIQVRFEKAKEEVNSDLAVFAGDLVGVMEKYADSHPEWKETLEDLLILARSCCVMTPGEFWLQCEGIVQDLDDHRQELPMGVLKKLYTRMLFILTRCTRLLQFHKESGFAEDEVVMDQRDKIIQSADRQILAQPGDDTTTRGSKSDVPKSYSQEQHNLKWKRSQEIKPVKFLSPLDTTDVKKEVESPTRERISSWKPFPSPVPKPPKDPTPIKEESPNKKTDTPPAVSSQAELNSPVESTSHQSLPPKHQHKTSWGHWSDQPNISEEGSIMCRICEEYVPTHYVENHSAICASADRCDQKGVSVDERLIRVAEALEKLVESYTQKDLPNAVGSPDVAKVSNSSINEESDGPSPKLSDWSRRGSADMLDYLQEADSTISLDDIKNLPSMTCKTRFGPKSDHGMATSSAGSMTPRSPLTTPRSNHIDMLLAGRSAINESDDLPQIVELADIARCIATTPLDEERALSLLVTCIEDLQEIVNRRKHEALTVQTFGTRIEKLHREKYLLLCDSVDMDKVDSASTVMDEEDDVVRSLRASPVHPVKDRTSIDDFEIIKPISRGAFGRVFLAKKRTTGDLFAIKVLRKADMIRKNAVESILAERDILITVRNPFVVRFFYSFTSRENLYLVMEYLNGGDLYSLLRNLGCLDEDVARIYLAEVVLALEYLHSMHIVHRDLKPDNLLIAHDGHIKLTDFGLSKVGLINSTDDLSGPAVSGSSLYGDDEPQMSEFEEMDHRARRQKRSAVGTPDYLAPEILLGTGHGTSADWWSVGVILFELIVGIPPFNAEHPQTIFDNILNRKIPWPHVPEEMSSEAQDLIDKLLTEDPHQRLGANGASEVKQHQFFKDISWDTLARQKAAFVPSSDSAFDTSYFTSRYSWNPSDENIYEAYEFEDSSDNGSLSGSSSCVSNHQDDMFLVSSSPTKQIHIL

SEQ ID NO: 3888 - protein, 782 aa, Oryza sativa
MNPSARISQVAMAAILPDLATQVLVPAAAVVGIAFAVVQWVLVSKVKMTAERRGGEGSPGAAAGKDGGAASEYLIEEEEGLNEHNVVEKCSEIQHAISEGATSFLFTEYKYVGLFMGIFAVLIFLFLGSVEGFSTKSQPCHYSKDRMCKPALANAIFSTVAFVLGAVTSLVSGFLGMKIATYANARTTLEARKGVGKAFITAFRSGAVMGFLLAASGLVVLYIAINLFGIYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGINHEFTPMLYPLLISSVGIIACLITTLFATDFFEIKAVDEIEPALKKQLIISTVVMTVGIALVSWLGLPYSFTIFNFGAQKTVYNWQLFLCVAVGLWAGLIIGFVTEYYTSNAYSPVQDVADSCRTGAATNVIFGLALGYKSVIIPIFAIAFSIFLSFSLAAMYGVAVAALGMLSTIATGLAIDAYGPISDNAGGIAEMAGMSHRIRERTDALDAAGNTTAAIGKGFAIGSAALVSLALFGAFVSRAAISTVDVLTPKVFIGLIVGAMLPYWFSAMTMKSVGSAALKMVEEVRRQFNSIPGLMEGTTKPDYATCVKISTDASIKEMIPPGALVMLSPLIVGIFFGVETLSGLLAGALVSGVQIAISASNTGGAWDNAKKYIEAGASEHARTLGPKGSDCHKAAVIGDTIGDPLKDTSGPSLNILIKLMAVESLVFAPFFATHGGILFKWF

SEQ ID NO: 3889 - protein, 336 aa, Oryza sativa
  unsure (1)..(336): unsure at all Xaa locations
VYVSDQVPQMLIGDPGRIRQMITNLVGNSIKFTERGHIYLTVHVVEEVMSCLEVETGIQNTGGVSGYPVANRRCSWESIRLFNSSSEKSFAPIASDSISLVISVEDTGVGIPFEAQSRVFTPFMQVGPSIARIHGGTGIGLSISKCLVGLMKGEIGFASKPHVGSTFTFTAVLMXGHTAVEMTSNHHXFKGINALVXNHRPVRAKVTKYHLQRLGVKTELTAELNQFISKLNSGSLTAKLVLIDKETWLKESHCTPLLVNKLRNNDKPDSPKLFLLGSSASSPKGGSDTSREHNLNVIIKPLRASMLQVSLRRALGGVDKVHCRNGVVGNSTLGSX

SEQ ID NO: 3890 - protein, 375 aa, Oryza sativa
MATGKVIKCKAAVAWEAGEALSIEEVEVAPPQRMEVRVKILYTALCHTDVYFWEAKGQTPVFPRILGHEAGGIVESVGEGVTELAAGDHVLPVFTGECKECDHCKSEESNMCDLLRINVDRGVMIGDGKSRFTIKGKPIFHFVGTSTFSEYTVIHVGCLAKINPEAPLDKVCILSCGFSSRFGATVNVAKPKKGQTVAIFGLGAVGLAAMEGARLSGASRIIGVDLNPAKFEQAKKFGCTDFVNPKDHSKPVQVLIEMTNGGLDRAVECTGNINAMISCFECVHDGWGVAVLVGVKDDVFKTHPMNFLNEKTLKGTLIFGNYKPRTDLPNVVELYMKKELELEKFITSVPFSEINTAFDLMLKGESLRCVMSMYE

SEQ ID NO: 3891 - protein, 379 aa, Oryza sativa
MATAGKVIKCKAAVAWEAGKPLSIEEVEVAPPQAMEVRVKILYTALCHTDVYFWEAKGQTPVFPRILGHEAGGIVESVGEGVTELAPGDHVLPVFTGECKECDHCKSEESNMCDLLRINVDRGVMIGDGKSRFTIKGKPIFHFVGTSTFSEYTVIHVGCLAKINPEAPLDKVCILSCGFSTGFGATVNVAKPKKGQTVAIFGLGAVGLAAMEGARLSGASRIIGVDLNPAKFEQAKKFGCTDFVNPKDHSKPVHEVLIEMTNGGLDRAVECTGNINAMISCFECVHDGWGVAVLVGVPTKDDVFKTHPMNFLNEKTLKGTFFGNYKPRTDLPNVVELYMKKELELEKFITHSVPFSEINTAFDLMLKGESLRCVMRMDE

SEQ ID NO: 3892 - protein, 144 aa, Oryza sativa
  unsure (1)..(144): unsure at all Xaa locations
XAASAAAGGEGAAXAGVGTAGEGRGVIRWDQILPRRSLRVLLVEHDDSTRQVVTALXRKCGYRVAAVADGMKAWGVMXGXAYXFDLVLTEVTMPTLSXIELXSRILAXDECKDIXVIMMVVQDSIXTMLKVXMQKGPVDFLVKX

SEQ ID NO: 3893 - protein, 206 aa, Oryza sativa
MAEEEAKKVEVEVTEAPPAAAAAAETEPAAKDVAEEKAVIPAPAPPAEEEKPPVDDSKALAIVEKVADEPPAEKPAQGGSNDRDVALARVETEKRNSLIKAWEENEKTKAENKASKKLSAILSWENTKKANIEAQLKKIEEQLEKKKAEYAEKMKNKVAIVHKEAEEKRAMVEAKRGEEVLKAEEMAAKYRATGHAPKKLIGCFGA

SEQ ID NO: 3894 - protein, 217 aa, Oryza sativa
  unsure (1)..(217): unsure at all Xaa locations
XDAWVHGSDGNDYAFLLKGHEDLRQDERVMQLFGLVNTLLENSRKTSEKDLSIQRYAVIPLSPNSGLIGWVPNCDTLHALIREYRDARKIFLNQEHRCMLSFAPDYDHLPLIAKVEVFQHALENSEGNDLAKVLWLKSRTSEVWLERRTNYTRSLAAMSMVGYLLGLGDRHPSNLMLDRYSGKILHIDFGDCFEASMNREKFPEKVRIRVWHFIIXM

SEQ ID NO: 3895 - protein, 1006 aa, Oryza sativa
  unsure (1)..(1006): unsure at all Xaa locations
MGFDLNELFPDHVCLDNPVDPFFTQEMDTLIRIIPADKAPGPDGFNGVFLKRCWHIIAQDFYRLAAHFHLGCTDLQSLNNSFITLVPKKNSPETVNDFRPISLMGVSLKFLTKLMADRLQGVILKVITLFWEDLWSDGLMSSKYPTLYCLVIHKEESVLAMSTRPLEDSFLLPLSALVYEEFLLLEEELNLLHLQPGQAHCAYTKQLKCIWPDIYLGNKSILPPSILALCRITSLNHKTGARQGEAPEAREVWEPPKDAGARREGEDRRPRRPHGEGSPATASICSPATHPPAVYSRRQPPAKYISSSSYLSKSMSCADCGVKKIELSPKHLEGDKPATIHGAAGVTTEDDHDPSQQVAGANNVRRIDEQLAVRLLLPGLLIGLAVIAVILPVLLLLLMVLVMVVWVRQLTGGTSVADLVVELAERPGGEHADVAVLRQTWSRTRCGTGERRGRGGRCRGGSPHVVVVVVRPGEGAVWGREGGPLYVSADTRPHAVTIAGSTCWSSHWTVSLLDLWSSSRVSWKIQAAHNAGIRIVVPGHPPWCAGPCSSSASALAPASSYSPSPPPPPASAAADSGSSPSRRALASSGGPHIFRASGASPVQGERRGRREESEEVIYLVLWLRDVIRQRGIIERGIMDLFLYSVMGLYGPICDRYVRLSTQTVVSRADRSPVHKPNQKEICIIKNELPRTTVSRRDPWSHVVISRLARPEEGPQPELSARDMSARPLGSWEAIATVIPRAGPDRGLKVFHRPIGESPGASIRTPAAMSFTGTXDKCKACDKTVHFIDLLTADGVSYHKTCFKCSHCKGTLSMCNYSSMDGVLYCKTHFEQLFKETGSFSKKFSQGGKSSEKSDQGRAPSKLSSAFSGTQDKCAACQKTVYPLEKLTLEGESYHKSCFKCSHGGCILTTSSYAALNGILYCKIHFSQLFKEKGSYNHLIQTAQSKQKESEEAAPVAATEASEKEQXSAPTRRDIEQRLGGKQNRYIYIYIYIYIDIRKILNYQLVI

SEQ ID NO: 3896 - protein, 170 aa, Oryza sativa
MPNDMQKLIAEVRQLSLNSTQVERVSGRNRSIDIMDGDGGGGWDDQGNGGGETTKYRGVRRRPSGKFAAEIRDSSRQSVRVWLGTFDTAEEAARAYDRAAYAMRGHLAVLNFPAEARNYVRGSGSSSSSRQHQQRQVIELECLDDQVLQEMLKGGDDQYRSAAGSKRNNY

SEQ ID NO: 3897 - protein, 638 aa, Oryza sativa
MVTVTIQHTFSLERNQRMQEDQSVLGRRRIYYDTNCGEALICSDSEDEAVEDEEEKKEFKDSEDCIIRMTIQECGMSDAVLETLARDIERAPDDIKARYEILQGEKPEGSSKKVSELNVKMEDVYGDKDLDAALDSFDNLFCRRCLVSKPDAIMEIDSHLLVDVEEPTSDNLKDQIGSNKKKLGSSGQKTKSQQSESSSTARVSSESSESECNSPSTRSFRKKGTLQMENNSSFVDAQSDSMEDTNNEHSATDGCDSSRKEECVDESICRQEAHGRSWKVIEQGLLLKGLEIFGKNSCLIARNLLGGMKTCTDVFQYMNYIENSSASGALSGVDSLVKGYMKGNELRTRSRFVRRRGRVRRLKYTWKTAGYHFIRKRITERKDQPCRQYTPCGCQSACGKQCPCLTNGTCCEKYCGCPKMCKNRFRGCHCAKSQCRSRQCPCFAADRECDPDVCRNCWVGCGDGTLGVPNQRGDNYECRNMKLLLKQQQRVLLGRSDVSGWGAFLKNSVGKHEYLGEYTGELISHKEADKRGKIYDRENSSFLFNLNNEYVLDAYRMGDKLKFANHSPDPNCYAKVIMVAGDHRVGIFAKERISAGEELFYDYRYEPDRAPAWARKPEGPGAKDDAQPSTGRAKKLAH

SEQ ID NO: 3898 - protein, 717 aa, Oryza sativa
MVTVTIQHTFSLERNQRMQEDQSVLGRRRIYYDTNCGEALICSDSEDEAVEDEEEKKEFKDSEDCIIRMTIQECGMSDAVLETLARDIERAPDDIKARYEILQGEKPEGSSKKVSELNVKMEDVYGDKDLDAALDSFDNLFCRRCLVFDCKLHGCSQDLVFPTEKQAPLCSSDEGTPCGIHCYKLVSKPDAIMEIDSHLLVDVEEPTSDNLKDQIGSNKKKLGSSGQKTKSQQSESSSTARVSSESSESEGQQEMSPDSNSIVNGCHWPRDMKLRSDTRSGIKDSVVSSQCNSPSTRSFRKKGTLQMENNSSFVDAQSDSMEDTNNEHSATDGCDSSRKEECVDESICRQEAHGRSWKVIEQGLLLKGLEIFGKNSCLIARNLLGGMKTCTDVFQYMNYIENSSASGALSGVDSLVKGYMKGNELRTRSRFVRRRGRVRRLKYTWKTAGYHFIRKRITERKDQPCRQYTPCGCQSACGKQCPCLTNGTCCEKYCGCPKMCKNRFRGCHCAKSQCRSRQCPCFAADRECDPDVCRNCWVGCGDGTLGVPNQRGDNYECRNMKLLLKQQQRVLLGRSDVSGWGAFLKNSVGKHEYLGEYTGELISHKEADKRGKIYDRENSSFLFNLNNEYVLDAYRMGDKLKFANHSPDPNCYAKVIMVAGDHRVGIFAKERISAGEELFYDYRYEPDRAPAWARKPEGPGAKDDAQPSTGRAKKLAH

SEQ ID NO: 3899 - protein, 748 aa, Oryza sativa
  unsure (1)..(748): unsure at all Xaa locations
MKVKVPIAKMSVHRLLLWVEIYPRGILSVRLDYQKWQHSLHIQLGYXLDRNQRMQEDQSVLGRRRIYYDTNCGEALICSDSEDEAVEDEEEKKEFKDSEDCIIRMTIQECGMSDAVLETLARDIERAPDDIKARYEILQGEKPEGSSKKVSELNVKMEDVYGDKDLDAALDSFDNLFCRRCLVFDCKLHGCSQDLVFPTEKQAPLCSSDEGTPCGIHCYKLVCILXAXMTVEKQLEPTSDNLKDQIGSNKKKLGSSGQKTKSQQSESSSTARVSSESSESEGQQEMSPDSNSIVNGCHWPRDMKLRSDTRSGIKDSVVSSQCNSPSTRSFRKKGTLQMENNSSFVDAQSDSMEDTNNEHSATDGCDSSRKEECVDESICRQEAHGRSWKVIEQGLLLKGLEIFGKNSCLIARNLLGGMKTCTDVFQYMNYIENSSASGALSGVDPKVSSYFKGNELRTRSRFVRRRGRVRRLKYTWKTAGYHFIRKRITERKDQPCRQYTPCGCQSACGKQCPCLTNGTCCEKYCGCPKMCKNRFRGCHCAKSQCRSRQCPCFAADRECDPDVCRNCWVGCGDGTLGVPNQRGDNYECRNMKLLLKQQQRVLLGRSDVSGWGAFLKNSVGKHEYLGEYTGELISHKEADKRGKIYDRENSSFLFNLNNEYVLDAYRMGDKLKFANHSPDPNCYAKVIMVAGDHRVGIFAKERISAGEELFYDYRYEPDRAPAWARKPEGPGAKDDAQPSTGRAKKLAH

SEQ ID NO: 3900 - protein, 174 aa, Oryza sativa
  unsure (1)..(174): unsure at all Xaa locations
MCGGAIISDFIPXXREAHRAATGSKRALCASDFWPSASXRKPPTSTTSPPPAPXTPDQAAEEPTKKRERKTLYRGIRRRPWGKWAAEIRDPAKGARVWLGTFATAEAAARAYDRAARRIRGAKAKVNFPNEDXRHSTTRPPTATVLRVKMNAPRNKMQFVFKKKKKKKKKKKKX

SEQ ID NO: 3901 - protein, 205 aa, Oryza sativa
MAGATQLKVGGGNGWSVPAANAESYNDWAEKMRFQIGDTLVFVYPKDKDSVLVVKPPDYNACNTSSFDQNGVDANCRAGEKLIVMVLASRNGTATATAPSPPPASSTAPPQTSPAPASPPPSSPSPPPASPPSPSSSGAARLACPIGLVPAGPAMAKRPKRPGAKKPKRKLFPPAPGKGPGAPPESAYGWGRPTTLCLKTSCINQ

SEQ ID NO: 3902 - protein, 253 aa, Oryza sativa
SMVKGTSGYSYGLGLACFALVVAMAGATQLKVGGGNGWSVPAANAESYNDWAEKMRFQIGDTLVFVYPKDKDSVLVVEPADYNACNTSSFDQKFADGNTVFTLDRAGAFFFISGVDANCRAGEKLIVMVLASRNGTATATAPSPPPASSTAPPQTSPAPASPPPSSPSPPPASPPSPSSSGAGSENAPAGLLASFHSKARLACPIGLVPAGPAMAKRPKRPGAKKPKRKLFPPAPGKGPGAPPVAGMGLPPRH

SEQ ID NO: 3903 - protein, 148 aa, Oryza sativa
  unsure (1)..(148): unsure at all Xaa locations
XGWGKGNNSFVVADPFVFSQTLLPAHFKHNNFSSFVRQLNTYGFRKVDPDRWEFAHASFLRGQTHLLRNIVRRGSAAAGGGGGGGGGKVATEVVRLKQEQRTIDDRVAAMWRRVQETERRPKQMLAFLLRVVGDRDKLHRLNTFSYXK

SEQ ID NO: 3904 - protein, 214 aa, Oryza sativa
  unsure (1)..(214): unsure at all Xaa locations
TLLPAHFKHNNFSSFVRQLNTYGFRKVDPDRWEFAHASFLRGQTHLLRNIRRRRQAQGRVGGRRRHDEVATEVVRLKQEQRTIDDRVAAMWRRVQETERRPKQMLAFLLRVVGDRDKLHRLXRRRRLXQRLRYRRRRRQRVRGRRAGGVRREAREAAARRXTTPARSARTPSTSPGSTPAPTCSPTLPSMPPPPPXXAGQPAARSLSEWTAATX

SEQ ID NO: 3905 - protein, 405 aa, Oryza sativa
  unsure (1)..(405): unsure at all Xaa locations
MEQGQGDRYWCHHCEEVIEPVEPDMKCPSCDSGFVEEMGSAGFEPSTNLRSDRISLWAPLLLGMMGGSSRRARRLRRQIMEDDDDDDDDEDDEDDSDHELEDLFRRQRRGSSLVRLLQTLRDDLRGLDDIGRDSDRDRERERRERERLRERERERERMRERERERRRERTESLILINSNNEAIILQGTFGPDDNQDDSSNTSSGVSLGDYFLGPGLDILLQHLAESDLNRSGTPPAKKEAVEALPTVNIQEVLGCSVCLEDFEMGTEAKEMPCQHKFHSQCILPWLELHSSCPICRFQLPTEXXSKNPCESAGGIVSVNDDGDDAGTSSDVDSANQPGSPIFSALSALFSNPSSSSSSSSDDNAPHSSXRAEASAGPGLAICQWSSEMGLLRGRHLYISWFLYIF

SEQ ID NO: 3906 - protein, 176 aa, Oryza sativa
CSAMLKSRFAGTIVKAQQKALLDHGKKIDPAKLQLEKERLEKRQQEEKARIEAQVKAAEAAAQLKLDEEMRMKREQERRAARLALHMMKKTVDIDNSDFLKDLENLSKKWELNPPGKLIVDFVDGIDLPPGLGSPLERLGLFMKKDLEEEVEHEMEDSVSPSTEIDVEEGEISFCQ

SEQ ID NO: 3907 - protein, 108 aa, Oryza sativa
  unsure (1)..(108): unsure at all Xaa locations
MAGTGVWVFKRDGVMQLEAXXWRGGTGRRQRRLVYVPANETMGSLQALERRLAGLGWERYYEDRAVVQLHRRAGADLISLPRDFARFRSTHMYDVVLKNRDHFKVLDN

SEQ ID NO: 3908 - protein, 156 aa, Oryza sativa
  unsure (1)..(156): unsure at all Xaa locations
MEGGSNDFPGDLLRAVLQRLPPPDLARAACVCRLWRGVASDRAVLEAAFASPWGVRRVVGEPETRAFWRAASLARFALSHTVRRGDTVPGIALKYSIQVTDIKRFNNMMSDHGIYLRERLLIPISNPEILQDGDPRAAMMEYSEDLRWERQQTGHX

SEQ ID NO: 3909 - protein, 222 aa, Oryza sativa
MEGGSNDFPGDLLRAVLQRLPPPDLARAACVCRLWRGVASDRAVLEAAFASPWGVRRVVGEPETRAFWRAASLARFALSHTVRRGDTVPGIALKYSIQVTDIKRFNNMMSDHGIYLRERLLIPISNPEILQGSTCYIEMDYNARREVAVFYPQGRPSGKAESSTNTAAAERRSRRILESVKRSLHTDDRTAAYYLSVTDGDPRAAMMEYSEDLRWERQQTGH

SEQ ID NO: 3910 - protein, 280 aa, Oryza sativa
MAAAAAAAASASSSSSSSSSAESVPLPTTTLPIDKAAAVGGGGDRAVDCGVCAICLDKIALQETALVKGCDHAYCVTCILRWASYKQTPQCPQCKHPFDFLSVHRSLDGCIHDYMFEESVCLLLRATWFEPLIVEAHEEALDEEELYHIYQYDDGVEDDLDEEAYYMSRSPSIRIGNRRWGDNGYVRGGRKEARPVSRQSLNDTDAGPSRTPKKKDVSASGSGSVSKEVAGRRAKRALKREAADKAAAEKHLKHLQRLGLRKAPEATAEATPEVEPQLNE

SEQ ID NO: 3911 - protein, 169 aa, Oryza sativa
  unsure (1)..(169): unsure at all Xaa locations
ARASXPPPPRRRRSPTASAXSATDDDPDNRLGSTATESPPSPKARVVGWPPVRAFRKNALAAKFVKVAVDGAPYLRKVDLEAYRGYDQLLAALQDKFFSHFTIXXKLADDERKLVDAVSGTEYVPTYEDKDGDWMLVGDVPWKMFVETCQRLRLMKSSEAVNLAPRAAQ

SEQ ID NO: 3912 - protein, 219 aa, Oryza sativa
  unsure (1)..(219): unsure at all Xaa locations
MSVETERSSTESSAASGLDFEDTALTRRRPGSSSSSSSSSSSSSSSSYRKRASATDDDPDNRLGSTATESPPSPKARVVGWPPVRAFRKNAXRGVGGXXSSSKAKFVKVAVDGAPYLRKVDLEAYRGYDQLLAALQDKFFSHFTIRLLGNEEMKLVDAVSGNEYVPTYEDKDGDWMLVGDVPWKMFVETCQRLRLMKSSEAVNLAPRSAXXVANLCSCL

SEQ ID NO: 3913 - protein, 200 aa, Oryza sativa
  unsure (1)..(200): unsure at all Xaa locations
MSVETERSSTESSAASGLDFEDTALTLRLPGSLAAAAAPDPDRKRSSPSSSDAADAADNSSPLAAAADAPPAPKARVVGWPPVRSFRKNALAAKFVKVAVDGAPYLRKVDLEAYSGYDQLLRALQDKFFSHFTIXXKFADDERKLVDAVNGTEYVPTYEDKDGDWMLVGDVPWKMFVETCQRLRLMKSSEAVNLAPRAAR

SEQ ID NO: 3914 - protein, 135 aa, Oryza sativa
PFSFGLVFSNVFASGSVFSPEGLALPEDALMEKFAFGVFMGAPVSLAILFPTFFFAPPLFLHGSKNVLFFFLGTQYLFPPFFKIKGFFKAPPQFFVFAPVSPPSGVVVPSAPQGEKKKEEPQGGSHGDLGMSLFF

SEQ ID NO: 3915 - protein, 311 aa, Oryza sativa
MAKHFVLNTGAKIPSVGLGTWQSDPGVVGNAVYAAVKAGYRHIDCASAYNNEKEVGLALKKLFEEGVVKREDLFITSKLWCDHHAPEDVPEALDATLNDLQLEYLDLYLIHWPFRTKKGSSIGKPESYLPPDIPSTWAAMEKLYDSGKSRAIGVSNFSSKKLGDLLAAARVPPAVDQVECHPGWQQMKLHNFCQSTGIHLSAYSPLGSPGSTFMNGNVLKEPIIISIAEKLGKTPAQVALRWNIQMGHSVLPKSVSEERIKQNLDVYDWSIPEDLLAKFSEIKQVRLLRGNFIVNPQSVYKTHEELWDREI

SEQ ID NO: 3916 - protein, 531 aa, Oryza sativa
  unsure (1)..(531): unsure at all Xaa locations
MDIMEDLWPAEAMRASSTGPGNRRRKACRFAMAVLAVATLFSSSMQLKWAAGSNVQAKTNCIPRPLAVSICSTSLIDVLPSCSVQDMNLKKRYSYYDLDAPCMQDKAGERIPCTFCSECEDEDLVPFAPSELLLHTLVTYDPRRTPTNQKTTTSPSPLLSSPPAPPPPPSPPPSPSPASPSLRHEALKSYIWLQCFDGSIQQVEEEVAMFCPMICREIVKNGTGSSKNHAIALPERVNPTSLSLILDYCRFHQVPGRSNKERKSFDEKFVRIDTERLCELTSAADSLQLKPLVDLTSRALARIIEGKTPEEIRDIFHLPDDLTEEEKLEPLKNINDDPRIRLLNRLYAKKRKELQERQKLKDVQVQEEQKDERSLDEILCFINGEGSGGGKASKNKKKNKRRKDHSKNPPKANPEPVNKXXEATRGVPFNAGTGNISRTPCQSSDVQDDVEYPFEDADLDDGLDPAMQEELDREVEDFARRLNSVWPESLGQERRIESHMIGGNGSLQRFSGNYFYILKKFCIPQSKCQRI

SEQ ID NO: 3917 - protein, 363 aa, Oryza sativa
GGVAPPPFSPVPSRRSTSSSSTVSCQTQRASSTGPGNRRVSSKMLIEFLPRFFVAERIPCTFCSECEDEDLVPFAPSELLLHTLVTYDPRPKPKMGCGIDKDSTGRVPPFRFASPKPQAHPHQPKNHNLPLSSPLLAAGAAAAAVTAAFSLSSLSFSPPRGVIPRKEFLVNFLVYCIGGFVVSLELAIMSESELAVIKPEALKSYIWLQCFDGSIQQVEEEGAQTRMFKYKKSKKMSGSGGGKASKNKKKNKRRKDHSKNPPKANPEPVNKEEATRGVPFNAGTGNISRTPCQSSDVQDDVEYPFEDADLDDGLDPAMQEELDRVQSQVRRLSARINKQKHRKFVHMQLGRELETTEQGHLFT

SEQ ID NO: 3918 - protein, 402 aa, Oryza sativa
  unsure (1)..(402): unsure at all Xaa locations
MSESELAVIKPEALKSYIWLQCFDGSIQQVEEEVAMFCPMICREIVKNGTGSSKNHAIALPERVNPTSLSLILDYCRFHQVPGRSNKERKSFDEKFVRIDTERLCELTSAADSLQLKPLVDLTSRALARIIEGKTPEEIRDIFHLPDDLTEEEKLEPLKNINDDPRIRLLNRLYAKKRKELQERQKLKDVQVQEEQKDERSLDEILCFINGDGVHFIGSGGGKASKNKKKNKRRKDHSKNPPKANPEPVNKVRCPHCTGNISRTPCQSSDVHDVEYPFEDADLDDGLDPAMQEAXLDREVEDFARRLNSVWPESLGQERRIESHMIGGNGSLQRFSGXSITGEKVKRQDQQAEAQEICAHAAWKRARDHRTGPPVYLSKCSPKKPRRPACRRCRFVCLGHFR

SEQ ID NO: 3919 - protein, 545 aa, Oryza sativa
  unsure (1)..(545): unsure at all Xaa locations
SESSMAPVSLHLLSLTRLSLPFRDTVTNPSTPRIPPSAVDQPHRRAAAAVSMPVSAVAAEAPLPPVDEKETPAAGEERFDWLDQWYPVAPVRDLDKRKPHGKMVMGISVVVWFDGGGGEWRVVDDACPHRLAPLSEGRVDGKGCLQCAYHGWCFDGHGSCQFIPQAPALGPPVKQIFLKKHQHFLXRLINRVLGSTNXQVHKNSKACVASYPSVVQNNILWFYPRSEPEYKEILQRKRPPYIRELDDPSSVINSGVRDLLYGYLSCVTDSETFDLLSTVEFDQEGGLPIKMNIEELNIAGFHSKENWGYFKFIAPVTLIGSPFRAKPVVSASDHFAIKQPEVTTVFFCIPVSPGRCRVIWANGYNLDGWFDKMIPRWWLHIKTNQVLDSDSSVLHIEERNYAAFGLDNWHKACYVPTSSDNLIIAFRNWFKKYCNNQVGWLTPMVNQLPPASTRVEVYERYWSHVMQCTSCSAALKWMRALEVALQVASVAVVGFLAAGKGTVVTSGVQRAAVVAAAVLCFAASRWLAGFIEKTFYFEDYVLADK

SEQ ID NO: 3920 - protein, 100 aa, Oryza sativa
  unsure (1)..(100): unsure at all Xaa locations
MSESXLAVIKPEXXKSYIWLXCFXGSIQQVEEEVAMFXPXICREIVKXGTXSSKXHAIALPERVNPTSLSXILDYCXFHQVPGRSNKERKSFDEXFVRIX

SEQ ID NO: 3921 - protein, 304 aa, Oryza sativa; identical to SEQ ID NO: 773

SEQ ID NO: 3922 - protein, 653 aa, Oryza sativa
MPASRNKYPPRHEQQHPQQIHNPNPETSRTQPNSPPINSPMAAAIIGVGGGGWTRLRSIGHGASGATVSLAADDASGELFVVKSAGDAVAATARQQLRREWSVMSGLSSPHVLRCLGFVQAAAGAGGEHQLLLEYAPGGSLADVVARNGDRLDESAFRAYAADVLRGLDYLHEKLVVHGDVKGSNVLVGADGRAKLADFGCARVVMPGGSKQPVLGGTPAFMAPEVARGEEQGPAADVWALGCTVIEMATGRAPWSDMDDVLAALRMIGYTDAVPDLPPWLSPEAKDFLRRCMQRRAGDRPTAAQLLQHPFVSKSCGLKKEVVKATWVSPTSALDAAAALWESETSSSTDDEEASPAKRVRAMACSPSSVPDWDSDNHGWIDVLSASPADDNGGEGNAPEEFDVVAAADQIFGEAVGSIVVGVGSEQSVVVENQEDEFISLSYCSERILLVAVHAADNNAASRKAGIKECSHDPRPSIPSRCAHNLFLSLIFIQIDNSNVLMSEAGTVPRRVAVQRGEVKDELERVLLHLSAPHGPSAWSGPGASVGPCRPDKPRPRHGRAWAVPCRVAHMTIYSWGEAATIVCQLRRGVTIYRMPPPKPIVVVVLVIMVLVIVARPQRYCATKVTKMGVARSGCHAHIATHLRSPSLCPSYY

SEQ ID NO: 3923 - protein, 540 aa, Oryza sativa
MATVTRLCVTKSVPTVNGQFPGPKLVVREGDTLVIRVTNNINNNVTFHWHGIRQVRSGWADGPAYITQCPIRSGGSYVYRFTVTGQRGTLWWHAHFSWLRATLYGPLVILPPRGVAYPFPKPHREVPLLLGEWFNADPEAVIKQALQTGGGPNVSDAYTFNGLPGPTYNCSSSNDTFKLRVRPGKTYLLRLINAALNDELFFGVANHTLMVVQADASYVKPFAATALVISPGQTMDVLLTAAANNPPSRSFAIAVAPYTNTVGTFDNTTAVAVLEYYGAATSAAALRSLPLPSLPAYNDTGAVANFSASFRSLASAQYPARVPRTVDRHFFFAVGLGADPCQSPVNGTCQGPNNTRFAASMNNVSFVMPRTSLLQAHYQRRYNGVLAANFPAAPRTPFNYTGTPPNNTFVTHGTRVVPLSFNTTVEVVLQDTSILGAESHPLHLHGYDFYVVGTGFGNYDASNDTAKYNLVDPVQRNTISVPTAGWVAIRFVADNPGVWIMHCHLDVHLSWGLSMAWLVNDGPLPNQKLPPPPSDIPMCS

SEQ ID NO: 3924 - protein, 572 aa, Oryza sativa
  unsure (1)..(572): unsure at all Xaa locations
ICSGDVKPMLVAVSRLLTMIFGCCYNMXWQVTMATVTRLCVTKSVPTVNGQFPGPKLVVREGDTLVIRVTNNINNNVTFHWHGIRQVRSGWADGPAYITQCPIRSGGSYVYRFTVTGQRGTLWWHAHFSWLRATLYGPLVILPPRGVAYPFPKPHREVPLLLGEWFNADPEAVIKQALQTGGGPNVSDAYTFNGLPGPTYNCSSSNDTFKLRVRPGKTYLLRLINAALNDELFFGVANHTLMVVQADASYVKPFAATALVISPGQTMDVLLTAAANNPPSRSFAIAVAPYTNTVGTFDNTTAVAVLEYYGAATSAAALRSLPLPSLPAYNDTGAVANFSASFRSLASAQYPARVPRTVDRHFFFAVGLGADPCQSPVNGTCQGPNNTRFAASMNNVSFVMPRTSLLQAHYQRRYNGVLAANFPAAPRTPFNYTGTPPNNTFVTHGTRVVPLSFNTTVEVVLQDTSILGAESHPLHLHGYDFYVVGTGFGNYDASNDTAKYNLVDPVQRNTISVPTAGWVAIRFVADNPGVWIMHCHLDVHLSWGLSMAWLVNDGPLPNQKLPPPPSDIPMCS

SEQ ID NO: 3925 - protein, 802 aa, Oryza sativa
MAVMTDVSTTGTALRTPAAGAVKEGDVEKLRFIDEMTTNVDAVQERVLGEILGRNAGTEYLTKCGLDGATDRAAFRAKVPVVSYDDLQPYIQRIANGDRSPILSTHPVSEFLTSSGTSAGERKLMPTIMDELGRRQLLYSLLMPVMNLYVPGLDKGKGLYFLFVKSETKTPGGLTARPVLTSYYKSDHFKNRPYDPYHNYTSPTAAILCADAFQSMYAQMVCGLCQRNDVLRLGAVFASGLLRAIRFLQLNWEQLADDIESGELTPRVTDPSVREAVAAILLPDPELAKLIRAECSKGDWAGIITRVWPNTKYLDVIVTGAMAQYIPTLEFYSGGLPMACTMYASSECYFGLNLRPMCDPSEVSYTIMPNMGYFEFLPVDESAASGDATQLVDLARVEVGREYELVITTYAGLNRFVRRKNVLLSIESDKTDEAELQRAVERASALLRPHGASVVEYTSQACTKRIPGHYVIYWELLTKGAGATVVDADTLGRCCLEMEEALNTVYRQSRVADGSIGPLEIRVVRPGTFEELMDYAISRGASINQYKVPRCVTFPPIVELLDSRVVSSHFSPALPHWTPARRTTSPAHPSRTVPSRPRVNHLPRAHHDVGPCVLVLAVVVDWAGWLPRWRHAVQVKEAGVRGFNGCSPVSRLTRTRARALRRKRGRVAETQPHRGREGGRGRGATCRGTAVPVRAGGRCAFDHKNRRFAWEIRPQGFMDTSKMVLDRNACKEVPLFPRSKRKAHIAAGARLASKVESEAHTHARRRETVRKRCGGAWFMWARPVKGEPRQSSSSRCLPDSSS

SEQ ID NO: 3926 - protein, 604 aa, Oryza sativa
MAVMTDVSTTGTALRTPAAGAVKEGDVEKLRFIDEMTTNVDAVQERVLGEILGRNASTEYLTKCGLDGATDRAAFRAKVPVVSYDDLQPYIQRIANGDRSPILSTHPVSEFLTSSGTSAGERKLMPTIMDELDRRQLLYSLLMPVMNLYVPGLDKGKGLYFLFVKSETKTPGGLTARPVLTSYYKSDHFKNRPYDPYHNYTSPTAAILCADAFQSMYAQMVCGLCQRNDVLRLGAVFASGLLRAIRFLQLNWEQLAEDIESGELTPRVTDPSVREAVAAILLPDPELAKLIRAECSKGDWAGIITRVWPNTKYLDVIVTGAMAQYIPTLEFYSGGLPMACTMYASSECYFGLNLRPMCDPSEVSYTIMPNMGYFEFLPVDESAASGDATQLVDLARVEVGREYELVITTYAGLNRYRVGDVLRVTGFHNAAPQFRFVRRKNVLLSIESDKTDEAELQRAVERASALLRPHGASVVEYTSQACTKRIPGHYVIYWELLTKGAGATVVDADTLGRCCLEMEEALNTVYRQSRVADGSIGPLEIRVVRPGTFEELMDYAISRGASINQYKVPRCVTFPPIVELLDSRVVSSHFSPALPHWTPARRSE

SEQ ID NO: 3927 - protein, 454 aa, Oryza sativa
  unsure (1)..(454): unsure at all Xaa locations
CRNSARGFSPSPPPRGRRSTLYPRRSLLEDPPPWTTPVRPIRGRAPTTCRRGSRRWCRAPRPRSTCRAPRRRRPRRRTGGSRRRSDRPRTRRRVSLRRTPRSPPXSSSAAAGSSGHHARSLSQPLFFSLDSLPPLPYADLAAPPAIPPSPPSSSSDPPPPGLPPRKGGHRRSQSDIPFGFSHLSPPLPPPAPVKREAATAAEGCRSDGDDFALYDLVNSYMDLDGMEALNSSEERHEDRDSRASGTRTGSATSSQNEAESHSXXPVERKDGGGKSRHCRSLSVDSFIEKLNFDESPKLPLPSPSGGLSRSGSGSLDGGAASLFGAEFANGEFTEAEKKKIMANERLAEIALTDPKRVKRILANRQSAARSKERKMRYIQELEHKVQVLQTEATTLSAQLTMLQRDSTGLATQNNELQIRLHALEHHAQLRDALYEALTAEVQRLILAAGEITDX

SEQ ID NO: 3928 - protein, 617 aa, Oryza sativa
  unsure (1)..(617): unsure at all Xaa locations
XVXCGGSRRSRRGGGGEEDETVRGGGGXEEEGMEVDEEEEEVGWVWRPPGGPAIVVSDAVEEARAAGYVNAAFEAATGYRADEVLGRYCRFLQFRDPRAQRRHPLVDPMVVSEIRRCLNEGIEFQGELLNFRKDGAPLYNRLRLIPMHGDDGFVTHVIGIQLFSEANIDLSNVSYPVYKQQSNHRPNIQEINPASHEHIPKIHSEYCGILQLSDEVLAHNILSRLSPRDVASIGSVCTRMHELTKNDHLRKMVCQNAWGRDVTVRLEMSTKMLGWGRLARELTPTRPATRRPTRVGTRVDTSRCNFSACAVGNRLVLFGGEGVNMQPMDDTFVLNLESAKPEWRRVKVSASPPGRWGHTLSWLNGSWLVVFGGCGQQGLLNDVFVLDLDAKQPTWREVASEGPPLPRSWHSSCTLDGSKLVVSGGCTESGVLLSDTFLLDLTKEKPAWKEIPTSWSPPSRLGHTLSVFGKTKLFMFGGLAKSGSLRLRSCDAYTMDAGEDSPQWRQLATTGFPSIXXPPPRLDHVAVSLPCGRIIIFGGSIAGLHSPSQLFLLDPAEEKPTWRILNVPGQPPKFAWGHSTCVVGGTRVLVLGGHTGEEWILNELHELCLASRPDEDE

SEQ ID NO: 3929 - protein, 243 aa, Oryza sativa
MASLFKDPTKLSAYRDRRFTGTQEEYEAALQASVTVYVGNMSFYTTEEQAYELFSRAGEIRKIIMGLDKNSKTPCGFCFILYYSREDAEDAVKYISGTMLDDRPIRVDFDWGFEEGRQWGRGRSGGQVRDEYRTDYDPGRGGYGKMVQKELEAQRELVDYGGAFQPNAPPQYDRGDRKRGYGDSYRNDRDYQRKRYRNDERSSQRAPDSEFKRDAIDSEKNPRFREKGDSDEEDDDYDKRRRR

SEQ ID NO: 3930 - protein, 356 aa, Oryza sativa; identical to SEQ ID NO: 1192

SEQ ID NO: 3931 - protein, 233 aa, Oryza sativa
MDASPSSSSSSPVAPEVVQWAGGADGFGSAAIGFACRVLCAVATCVFAAVGSVVGAVTGSAIGLATESGMLRGAGIGAISGAVFSIEVAESSRDLWHSSDSAVWCLVYMVDIISSLLSGRLVREKVGPAVQSAVQSQISAISSPFAETSDLFETGGTKGLPADTLRRLPAIKITGDNAVDSAGEPICCSVCLQDFRVGEMARRLPSCRHVFHVPCIDCWLVRHGSCPLCRRDI

SEQ ID NO: 3932 - protein, 240 aa, Oryza sativa
  unsure (1)..(240): unsure at all Xaa locations
XGCCTVTCQKNAGQRNDSCRAPRHAAXPGGRGRLRRHGRRRRVLRRRPPRRGSGAHPXREATPPPSPQDAVDCVGTGTDVECFVDGEEEDGVSASAAALVGREWWEWASLVSPFFFWGTAMVAMKGVIPKTGPFFVAALRLLPAGALLVAFAAARGRRQPSGWAAWVAVAAFGLVDAACFQGFLAEGLQKTSAGLGSVIIDSQPLTVAVLAALLFGESIGAIGVGGLVLGVVGLLLLEAX

SEQ ID NO: 3933 - protein, 384 aa, Oryza sativa
  unsure (1)..(384): unsure at all Xaa locations
XQSPRVQKRIVEKNVXKRDTWRAQKIHATPPPSPQDAVDCVGTGTDVECFVDGEEEDGVSASAAALVGREWWEWASLVSPFFFWGTAMVAMKGVIPKTGPFFVAALRLLPAGALLVAFAAARGRRQPSGWAAWVAVAAFGLVDAACFQVLPPAIAASIRLISQGFLAEGLQKTSAGLGSVIIDSQPLTVAVLAALLFGESIGAIGVGGLVLGVVGLLLLEVPALSVEGNDTAIWGSGEWWXMFLSAQSMAVGTIMVRWVSKYSDPIIATGWHMIIGGLPLLGISGLNHDPCLNGHLQELTLNDVLSLLYTSIFGSAISYGVYFYNATRSSLTTLSSLTFLTPMFASIFGFLYLGETFSPVRLGGALLTLVAIYMVNYKSIVGEK

SEQ ID NO: 3934 - protein, 368 aa, Oryza sativa
MDQRKGSGSDANGGLAEATASRLRFEDPDEVMEENPAAAAATVGAEEEGGEGGGGEEVIGSDKTSADYYFDSYSHFGIHEEMLKDVVRTKSYQNVITQNSFLFKDKIVLDVGAGTGILSLFCAKAGAKHVYAIECSQMADMAKEIVKTNGYSNVITVIKGKVEEIELPVPKVDVIISEWMGYFLLFENMLNTVLYARDKWLADGGVVLPDKASLHLTAIEDAEYKEDKIEFWNNVYGFDMRCIKKQAMMEPLVDTVDANQIVTNCQLLKLVAERNDYIHALVAYFNVSFTKCHKMMGFSTGPRSKATHWKQTVLYLEDVLTICEGETITGSMTVTPNKKNPRDIDIKLCYALSGHRCQVSRTQHYKMR

SEQ ID NO: 3935 - protein, 387 aa, Oryza sativa
MDQRKGSGSDANGGLAEATASRLRFEDPDEVMEENPAAAAATVGAEEEGGEGGGGEEVIGSDKTSADYYFDSYSHFGIHEEMLKDVVRTKSYQNVITQNSFLFKDKIVLDVGAGTGILSLFCAKAGAKHVYAIECSQMADMAKEIVKTNGYSNVITVIKGKVEEIELPVPKVDVIISEWMGYFLLFENMLNTVLYARDKWLADGGVVLPDKASLHLTAIEDAEYKEDKIEFWNNVYGFDMRCIKKQAMMEPLVDTVDANQIVTNCQLLKTMDISKMTPGDASFTVPFKLVAERNDYIHALVAYFNVSFTKCHKMMGFSTGPRSKATHWKQTVLYLEDVLTICEGETITGSMTVTPNKKNPRDIDIKLCYALSGHRCQVSRTQHYKMR

SEQ ID NO: 3936 - protein, 481 aa, Oryza sativa
  unsure (1)..(481): unsure at all Xaa locations
MYRAKRAALSPKVKRRVXGKYELGRTIGERTLCKGPVAKNTENDEPSAIKIXDREKVXKHRWVEQIRREICTMKLVKHPNVVRLFEVMGSKARIFIVLEYVTGGELFEIIATNGRLKEEEARKYFQQLINAVDYCHSRGVYHRDLKLENLLLDASGNLKVSDFGLSALTEQVKADGLLHTTCGTPNYVAPEVIEDRGYDGAAADIWSCGVILYVLLAGFLPFEDDNIIALYKKISEAQFTCPSWFSTGAKKLITRILDPNPTTRITISQILEDPWFKKGYKPPVFDEKYETSFDDVDAAFGNXIRCPVEEETGLXVEGMNAFVLISLNQALKLDILXAKTKKEYKREKRFTSQCPPKEIITKIEEAAKPLGFDIQKKNYKMRMENLKAGRKGNLNVATEVFQVAPSLHVDELKKAKGDPLEFRKLNRTLSKSTRTVVWKCDGEVDRQRRRGVNVVFAMAFGAPVLRVHSCSAIINGVFAVE

SEQ ID NO: 3937 - protein, 141 aa, Oryza sativa
  unsure (1)..(141): unsure at all Xaa locations
MTKYKGVRQRHWGSWVAEIRHPLLKTRIWLGTYGTAEDAARAYDEAARLMSGPAARTNFPLSSSGXXNARSCLSPTLRARLEKCCGAGSSAQAQQGAVAGQDNDDAAAAAAAMGVDDGDEYVEEMIQELTFYGYRDRPALX

SEQ ID NO: 3938 - protein, 119 aa, Oryza sativa
  unsure (1)..(119): unsure at all Xaa locations
CQRMTKYKGVRQRHWGSWVAEIRHPLLKTRIWLGTYGTAEDAARAYDEAARLMSGPAARTNFPLSSSGXXNARSCLSPTLRARLEKCCGAGSSALDALLLCSSSRASDHPFPSSPNVGX

SEQ ID NO: 3939 - protein, 185 aa, Oryza sativa
MRTICDVCESAPAVLFCVADEAALCRSCDEKVHMCNKLARRHVRVGLADPNKVSSCDICEHAPAFFYCEIDGTSLCLSCDMTVHVGGKRTHGRYLLLRQRVEFPGDKPGHMDDVAMQQKDPENRTDQKSDDQGNIDSKMIDLNMRPVRTHGQGSNSQTQGVDVSVNNHDSPGVVPTCNFEREANK

SEQ ID NO: 3940 - protein, 663 aa, Oryza sativa
  unsure (1)..(663): unsure at all Xaa locations
MSQQGEYHADMMAEFLRGSGGAAVIDGGLATELEANGADLKDALWSARCLFTCPDLIRKATIQGFLSKGFSQEESESFLRRSVELACEARAIYLEKCSNGSDEAKDVTKYRKRPILIAASVGSYGAYLADGSEYSGDYGNEGTLEFLKNFHLRRLQVLAEAGPDVIVFETIPNKIETQAYVELLEECKLRIPAWFGFTSKDGVNVVSGDSLIECASIADSCKEVAAVGINCTPPRFIHELVLSIRKVTSKPILIYPNSGESYDPIRKEWVDRLGVAVSPAMVARVIDACSEXGWVQGGGCCGSCPGAGRLCHRNLKFNPSALVTEAMDVLSEMRSYGVTPDASSLNILLSCLGRARRVKESYRILYLMREGKAGCSPDWVSYYLVVRVLYLTGRIIRGKRLVDDMLESGVLPTAKFFHGLIGVLCGTEKVDHGLDMFRLMKRCQLVDTHTYDLLIEKLCRNGRFENGKELWDDAKKNGFMLGCSEDLLDPLKTERVFVSTFVGRKCVIKERFSKKYRHPLLDSKLTLKRLNAEARCMTKARKLGVPTPVLYAVDPLLHTLTFEYVDGLSVKDILLGFGSNGINEEQLIDIATQIGNAVGKLHDGGLVHGDLTTSNMIIKNNTNQLVLIDFGLSFISTIPEDKAVDLYVLERALISMHSSCGDV

SEQ ID NO: 3941 - protein, 177 aa, Oryza sativa
GDVAARPARARAGPRPPPPSNGTAATSTIATNRWGPYSGAGDFASNMAVILAALLAALALALALNAAVRYLLRPAAAAAEDPEKPPVQEADPPPPPPALVYSAAGTKLAGAAECAICLAEFVDGDTVRVMPVCGHGFHARCIERWLAGGRRSSCPTCRAPAATPPGATATEPAAVAP

SEQ ID NO: 3942 - protein, 407 aa, Oryza sativa
MAPSSSSCHDAAASMLLCAEDNSSILWLEDEEGEVGERRSGGCRSMVGDLAAGGGGGGGGGGVEEDPGCCPPPPEMESHECVASLVEREQAHMPRADYGERLRGGGGDVDLRVRSEAIGWIWEVYTYYNFSSVTAYLAVNYLDRFLSQYELPEGRDWMTQLLSVACLSIAAKMEETVVPQCLDLQIGEPRFLFEVETIHRMELLVLTNLNWRMQAVTPFSYIDYFLRKLNGGNAAPRSWLLRSSELILRIAAGTGFLEFRPSEIAAAVAATVAGEATGVVEEDIAEAFTHVDKGRVLQCQEAIQDHHYSMRGSASASSSSVPESPVAVLDAGCLSYKSDDTDAATIASHGGGRRKSCFDSSPVTSKKRRKLSSLYTTHLDKGKVNWFRLQRLLERKNTGRGPKGREF

SEQ ID NO: 3943 - protein, 438 aa, Oryza sativa
MDAAAGGAPPRPAAAIRVRVPLVESVSCYCRVDGGLKTVVSARKFVPGAKLCMQPDIKPNKRKSRSSHKERCRTQAPLLPGLPDDLAITCLMRVPRLEHTNLRLVCKRWNRLLSGNYYYSLRKKLGMAEEWVFVFKRDRDRKISWHAFDPGHQVWKSLPPVPAEVSEAVGFGCAVLSGCYLYLFGGKDPVRGSMRRVVFYNARINKWLRAPDMLQKRHCFGSCVINNRLYVAGGECEGIQRTLRSAEFYDPNRNRWSYISEMSTGMVPFIGVVYDGKWFLKGLDSHRQVVSEVYMPTSNVWSVTADEMVTGWRNPSICFNGRLYSAECRDGCKLRVYDRDTRSWTRFMDSRRHLGNSRAFEAAALVSLNGKICIIRNNMSITLVDVSNTPTVIEINNAHMWDVFARKGQHRSFIANLWFTIAGRNFKTHIIHCQVLQV

SEQ ID NO: 3944 - protein, 580 aa, Oryza sativa
  unsure (1)..(580): unsure at all Xaa locations
MSENRFYQYNLMEDHFQSAPWNVLIRFLYLQQTNAYNTSPRSDFDSGRHPFMPVPGEPSPGAFPARSYVEVGHRMIMDSRCSRHDSIPKLDGVSITMDPPTPSMKLQLQLQFQLQLHQLKARSSVAGFPHSHRASSCRRPWPPYGSRGSKLQRHRDRRNPPRRQSSHSQSPSTRLKIRHADVQKCRSSLTSSPIENNVKLAYKFFKEISNTVFLKTNKLTDMYFQKRTNLKLTYTQMAYQSTDVESSINSVRVAMALKVVSFPGDLAAVSFLDSNRGGAFNQLKVDLPFQTRDRRAVSLRRTCCSMQQAPPPAWPGRAVVEPGRRSWDGPKPISIVGSTGSIGTQTLDIVAENPDKFRVVALAAGSNVTLLADQVKTFKPKLVAVRNESLVDELKEALADCDWKPEIIPGEQGVIEPTVAAIEAGKDIALANKETLIAGGPFVLPLAQKHKVKILPADSEHSAIFQCIQGLPEGALRRIILTASGGAFRDWPVDKLKEVKVADALKHPNWNMGKKITVDSATLFNKGLEVIEAHYLFGAEYDDIEIVIHPQSIIHSMIETQDRAGHLQGGGADMRRSSEX

SEQ ID NO: 3945 - protein, 317 aa, Oryza sativa
MPAFKAPAPGFSVRFSPFHEQRLLAAASQHFGLVGNGHLPPPAPAAGAPAPPPVFAFPTSDALFDCAWSESHESLCAAASGDGSVRLFDVALPPAQNPVRLLREHAREVHGLDWNPVRRDAFLSASWDDTLKLWSPDRPASVRTFRGHEYCVYAAAWSARHPDVFASASGDRTARVWDVREPAPTLVIPAHDHEVLSLDWDKYDPSILATGSVDKSIRVWDVRAPRAPLAQLAGHGYAVKRVKFSPHRQGMLMSCSYDMTVCMWDYRKEDALLARYGHHTEFVAGIDMSVLVEGLLASTGWDEMIYVWPFGSDPRAM

SEQ ID NO: 3946 - protein, 249 aa, Oryza sativa
  unsure (1)..(249): unsure at all Xaa locations
MAAASSVLRCCLLVAALMTLSAMGAEAITRQYLFDVQTTSVTRLCSTKSIVTVNGQYPGPTLFAREGDHVEVTVVNHSPYNMSIHWHGIRQLLSGWADGPSYITQCPIQPGGSYVYRFTITGQRGTLWWHAHISWLRATVHGPMVILPPAGVGYPFPAPHEEVPIMFGEWWNNDTEAVISQALQTGGGPNISDAXYTLNGLPGPLYNCSAQDTFKLKVKAGKTYMLRLINAALNDEXLFFSMANHTLTX

SEQ ID NO: 3947 - protein, 203 aa, Oryza sativa
  unsure (1)..(203): unsure at all Xaa locations
AQETGRWSLAGATALVTGGSKGIGRAIVEELASFGATVHTCARNEATLNSCLEEWSAKKLSITSSVCDVSARADREALAGRVTAMFDGKLDILVNNVGFLFLKPAVNVTPEELSRVMAGNLESCFHLSQLMHPLLKTSGKGNVVNISGISTLVRINRKIIPLLISEAMNQIKXTKSLAVEWASDRMRVNCIAPGVIATHLVDD

SEQ ID NO: 3948 - protein, 176 aa, Oryza sativa
MSGRGRGDPLVLGRVVGDVVDPFVRRVALRVAYGAREVANGCELRPSAVADQPRVAVGGPDMRTFYTLVMVDPDAPSPSDPNLREYLHWLVTDIPATTGVSFGTEVVCYESPRPVLGIHRLVFLLFEQLGRQTVYAPGWRQNFSTRDFAELYNLGLPVAAVYFNCQRESGTGGRRM

SEQ ID NO: 3949 - protein, 554 aa, Oryza sativa
  unsure (1)..(554): unsure at all Xaa locations
MKIIELGSNSXXADQTTMVASLLCTVAVAVLAVAAVGGEAGVVEHTFVVHEMNVTHLCNTTKIFVVNGQLPGPTVDVTEGDTVVIHVVNKIPHGLTIHWHGVRQLRSXCWADGAGFITECPIPPGSERTYRFNVTDQVGEWWELDLVELDRRMRDGNFDDNPLSATINGKLGDLSNCSGIVEESFVLNVKHGESYLLRVINTAFFSEYYFKVAGHTFTVVGADGNYLTPFKTDMVTVAPGEAIDVLMVADAPPAHYHMIALANQPPEPDPQIPKYISRGLVRYTGVDANNNAVPMPIMPNQHNTMPSYYFHANLTGLMHPKHRRVPMHVDERIFIILGLGTICRGRNTTCKRQRSLETIEVATMNNVSFTHPNTTALPLLRRHSRRRLHXEDFPVRPPRPYNYTNPALIPPGPLEEVLEPXTFKATKLKRFKYNTSVEIIFQSSTLLMSDSNPMHLHGYDVFLLAQGLGSFNAKRDIRKFNYHNPQLRNTILVPRGGWAAVRFITDNPGMWYLHCHFEFHIIMGMATAFIVEDGPTPETSLPPPPPEFKRCDAS

SEQ ID NO: 3950 - protein, 311 aa, Oryza sativa
MEMMVHGRRDEQYGGLGLGLGLGLSLGVAGGAADDEQPPPRRGAAPPPQQQLCGWNGGGLFSSSSSDHRGRSAMMACHDVIEMPFLRGIDVNRAPAAETTTTTARGPSCSEEDEEPGASSPNSTLSSLSGKRGAPSAATAAAAAASDDEDSGGGSRKKLRLSKDQAAVLEDTFKEHNTLNPKQKAALARQLNLKPRQVEVWFQNRRARTKLKQTEVDCELLKRCCETLTDENRRLHRELQELRALKLATAAAAPHHLYGARVPPPTTLTMCPSCERVASAATTTRNNSGAAPARPVPTRPWPPAAAQRSSA

SEQ ID NO: 3951 - protein, 342 aa, Oryza sativa
  unsure (1)..(342): unsure at all Xaa locations
MATSSAYPPPPPYYRLYKDYEKDPSSAPEPPPPVDGPYQLFGATYTTDVVLPSLEDQGVRQLYPKSPDIDFKKELRTLNRELQLHILELADILVERPSQYARRARATLIHMLENQIQRRKQAIEDIKQINLVLNVTYRSNMXXQGQRSRRGERKHWKAAHRHGSPELRQKADQTEPGKSPSPSSAARVRVSLDSPPPPLPSLRLHGRLPPPPPLRRLRRRPPAAAAAAAAASTSLPREPALVPRAVPTAVPSPRQPPFPSPAPPVGTTPPSAAAAAAAAAVWVPSLPPSDADAAAASCGGESLASSPRRCPATAAQLPAAASGPGLGQSFVGSKSWIRRAWK

SEQ ID NO: 3952 - protein, 93 aa, Oryza sativa
  unsure (1)..(93): unsure at all Xaa locations
AFSSPTRLGFAGNKVTHNXAKMHRQENVYMGKLVQQVEGHEVMAVNMEMVAXTVHXEELTAVECNLSSVAXKNVIGAHHASRDVDLFSAHYXG

SEQ ID NO: 3953 - protein, 187 aa, Oryza sativa
  unsure (1)..(187): unsure at all Xaa locations
XLFQTIIGNGYPIALLDEEKILPVGKEITAIGYIRPHKASVEISSCSEIPFFLSDLTKDEMEAELSSRAKTLFWASVVLGTMSVCLLGFATYRSWKKIKERREARQAQEVFRQTTDEVTDDQSSDEDEMGDGQLCVICLRKRRKAAFIPCGHLVCCCKCALIVERQFDPLCPMCRQDIRYMIRIYDN

SEQ ID NO: 3954 - protein, 493 aa, Oryza sativa
  unsure (1)..(493): unsure at all Xaa locations
MKDIHWAIRQADNIGCGYATAACWPTPQQAPPAIVVRRPCPGRTGEAAAHTATRLSAYPGQQDSSGFTWIVWDLVVEAFGYSCFAHAPSSSAWEKILKRGSLEECVLQVAIVYRNSVKQEQNQTCHEGFDNLGVRDEMIFSVSLFGSSHQSIHKLYRKCWSSNSHSTLNVLSLAKTVGQSMRMKRIRVKPHATDLKNRPQAHEVYKLGYXRLPENLSWLLASPEMAKXRPPSKKKLKKEEMVSSNQFGVILEWEGVVVEDDDPDLEPRVWYVLSXLEEAKSFPPDAVLKEIEGMRTDQAILEVLHWSEDPQEVQRLAARKEVIYKTLRGRFYQLRPGVLDFLNTLVDFDIPIAITTPRPRLSXLEEGIKAVGLQGYFDAXIVAAEDFCXRGKPEGEMFEVTAGQLGLEPXDVCLVLGNSNSTNXESAHTAGMRCVAVQARYPAYELXQAANHVVRWLDQLSVADLQRIANGEILGLRGRRSDMDMDMEIVIEE

SEQ ID NO: 3955 - protein, 331 aa, Oryza sativa
  unsure (1)..(331): unsure at all Xaa locations
MTTTTTRSHRLRDAAVASVVAVLPHEISPLISAASTFFFILSAYWVVLPLRDEGAISLGLSTLPGLFAGSLLLTLVAAPVASLAFSLPSIPKPRALVFIHRFFSLSLLVFFVLWFASTPGHSPSISQSSEDASNKPPGWGNHSWFYILVRISLFLWVSLLNLIAISSTWARVIDVMDNESGSRLFGFIGAGATLGQLFGSLFAATMAWLGPFLLLCSSLLMELAALSSKGICTDDTHSSMELSSTXXAEQSQNTEADDEMSSLVTSQGSPSQVSESHKTKPEIFLMFEGFWLIARSSYLMYISLFLWLSACVSFFFYFQKGAIGATTILSX

SEQ ID NO: 3956 - protein, 667 aa, Oryza sativa
HERKTIDLEQGWEFMQKGITKLKNILEGKPEPQFSSEDYMMLYTTIYNMCTQKPPHDYSQQLYEKYRESFEEYITSMVLPSLREKHDEFMLRELVKRWSNHKVMVRWLSRFFHYLDRYFISRRSLPQLSEVGLSCFRDLIDQEREGEQIDRALLKNVLDIFAEECLKREKERVAHYLHSSSEQKLLEKVQHELLTQYASQLLEKEHSGCHALLRDDKVDDLSRMYRLFSRITRGLEPVSQIFKQHVTNEGTALVKQAEDAASNKKVFVRKIIELHDKYVAYVTDCFQGHTLFHKALKEAFEVFCNKGVSGSSSAELLATFCDNILKKGGSEKLSDEAIEDTLEKVVRLLAYISDKDLFAEFYRKKLARRLLFDKSANDEHERSILTKLKQQCGGQFTSKMEGMVTDLTVARDHQAKFEEFISTHSELNPGIALAVTVLTTGFWPSYKSFDINLPAEMVKCVEVFKEFYQTRTKHRKLTWIYSLGTCNINAKFEAKTIELIVTTYQAALLLLFNGVDRLSYSEIVTQLNLSDDDVVRLLHSLSCAKYKILSKEPNNRSISPNDVFEFNSKFTDKLRRLKIPLPPVDEKKKVVEDVDKDRRYAIDASIVRIMKSRKVLGHQQLVMECVEQLGRMFKPDFKAIKKRIEDLITRDYLERDKDNPNVYRYLA

SEQ ID NO: 3957 - protein, 382 aa, Oryza sativa
  unsure (1)..(382): unsure at all Xaa locations
MAAATVEVTWDVEYVLWAPDCQQRVMIGINGRFPGPNITARAGDVISVTMNNKMHTEGVVIHWHGIRQFGTPWADGTASISQCAVNPGETFVYKFVADKPGTYFYHGHFGMQRAAGLYGSLIVLDSPEQPEPFRHQYDDGGELPMMLLSDWWHQNVYAQAAGLDGKDRHFEWIGEPQTILINGRGQFECTLGPARKSFEKLLNQERGDPASTIRRCAATRRSAXEEERVXGPYCPRSQCAPVVFNVEQGKTYRLRIASTTSLSLLNVKIQGNKMTVVEADGNHVEPFVVDDIDIYSGESYSVFFKADQKPASYWISVGVRGRHPKTVPALAILSYGNGNAAPPPLQLPAGEPPVTPAWNDTQRSKAFTYSIRARKDTNRPPP

SEQ ID NO: 3958 - protein, 201 aa, Oryza sativa
MPSRGCSCWLLSLALLCSLAAAKEQYHEFVIRETTVKRLCKSHNIMTVNGQFPGPTLEINEGDSLIINLINRGRYNMTLHWHGVRQMRTGWSDGPEYVTQCPVRPGQSYRYRFTVAAQEGTLWWHAHSSWLRATVYGALLIRPRDGTSYPFDVQPTRELAPILLDPSLLINLNSGAKLKHAHAAYAKLMLKACSMLNIPQS

SEQ ID NO: 3959 - protein, 569 aa, Oryza sativa
  unsure (1)..(569): unsure at all Xaa locations
MPSRGCSCWLLSLALLCSLAAAKEQYHEFVIRETTVKRLCKSHNIMTVNGQFPGPTLEINEGDSLIINLINRGRYNMTLHWHGVRQMRTGWSDGPEYVTQCPVRPGQSYRYRFTVAAQEGTLWWHAHSSWLRATVYGALLIRPRDGTSYPFDVQPTRELAPILLGEWWDMNPVDVVRAATRTGAAPNISDALTVNAQPGDLYSCSSHDTAVFPVTSGETNLLRFINAALNTELFVSLAGHNMTVVAADASYTKPYTTSLLLLAPGQTTDVLVTFDQPPGRYYLAARAYASAQGVPFDNTTTTAIFDYXXAANNASSAAIAMPTLPAYNDTTAATAFTTNLRGLRKAELPSRVDESLFFTVGVGLFNCTNATAQQCGGPNGTRFAASINNVSFVLPSSTSILQAHHHGAPGGVFTADFPANPPVQFDYTAQNVSRALWQPVAGTKVYKLKYGSAVQVVLQGTNIFAGENHPIHLHGYDFYILAEGLGNFDAGADTGKFNVEDPPMRNTVGVPVNGWAVIRFVADNPGVWLMHCHLDVHITWGLAMAFLVDDGVGELQSLEAPPPDLPLCY

SEQ ID NO: 3960 - protein, 578 aa, Oryza sativa
  unsure (1)..(578): unsure at all Xaa locations
MAISYLLRSSILAVAALLLFSVNLAKGDIREYQFDVKTTNVTRLCSSKSIVTVNGQFPGPTVFAREGDLVVIRVINHSPYNMSIHWHGIRQLRSGWADGPAYITQCPIQPGGSYVYKYTITGQRGTLWWHAHISWLRATVYGPIIILPKAGVPYPFPAPDKEVPVVFGEWWKADTEAVISQATQTGGGPNVSDAFTINGLPGPLYNCSAKDTFKLKVEAGKTYMLRLINAALNDELFFSIAGHTLTVVDVDAVYVKPFTVDTLLITPGQTTNVLLTTKPSYPGATFYMLAAPYSTAMSGTFDNTTVAGILEYEDPSSHSTAAFNKNLPVLRPTLPQINDTSFVSNYTAKLRSFATAEYPANVPQQVDTRFFFTVGLGTHPCAVNGTCQGPNGSRFAAAVNNVSFVLPSTALLQSHYTGRSNGVYASNFPAMPLSPFNYTGTPPNNTNVSNGTRLVVLPYGASVELVMQGTSVLGAESHPFHLHGFNFFVVGQGFGNFDPVNDPAKYNLVDPVERNTVGVPGGXGWVAIRFLVDNPGVWFMHCHLEVHVSWGLKMAWVVQDGSLPNQKILPPPSDLPKC

SEQ ID NO: 3961 - protein, 379 aa, Oryza sativa
PAGTPPPPRGLGISFPSSKPSRTRTPPPSPSPPFIPPASAAAAATHASFLPPPAPPATGKTERPVGELVRGGAPPPSPAAVEQRLQALRQKLGRKQHFEEAVADLAAAVRDHHAAASPALRDLMYSTVCRVATVLQTRYTAPGFWRAGLNLFLGTEKLVTNPSEKEQLKTFILRAREHLDEKENEESMPNNRETDTRFLFEGHLTVGPEPPPPAWLVAQNLARELSILAEPSGDQGANNNGESRAEEMAPDLEAALEESLQNVMANPKVPPASKEVVANLPVVTVTEEIIARLGKETQCAVCRESLLVDDKMQELPCKHLFHPPCLKPWLDENNSCPICRHELRTDDHVYESRKEREREEEEDRKGAANAVRGGEFMYV

SEQ ID NO: 3962 - protein, 504 aa, Oryza sativa
  unsure (1)..(504): unsure at all Xaa locations
TPSLPPLLLLPRLAYIRGVSSSSSSSSLLHHNTVDSRRTQTPVARRRIASSFFFCVCAVFLGFLAMVIGAEIKDEMEEAPPLLLDEAARPRRVALFVEPSPFAYISGYKNRFQNFIKHLREMGDEVIXVVTNHEGVPQEFHGAKVIGSWSFPCPMYGKVPLSLALSPRIISEVAKFKPDIIHASSPGIMAFGALAIAKLLGVPLVMSYHTHVPVYIPRYTFSWLVEPMWQVIRFLHRAADLTLVPSVAISKDFETAXNVISANRIRLWNKGVDSASFHPKFRSHEMRVRLSDGEPEKPLIIHVGRFGREKNLDFLKTVMDRLPGVRIAFIGDGPYRSELEKXMFEGMPAVFTGMMQGEELSQAYASGDVFVMPSESETLGQVVLESMSSGVPVVAARAGGVPDIIPEDQEGKTSFLFTPGDLEDCLGKIQLLLTDKEFRDNMGMTARAEMEKCDWRAASKKIRNEFYNAAIWYWRKKRAELIKPLQWLAQMFLPAPEVNRITQH

SEQ ID NO: 3963 - protein, 445 aa, Oryza sativa
  unsure (1)..(445): unsure at all Xaa locations
MPFXRSATRSKRRGTTVALNHRHGPCSPVPSSKKRPTEEELLKRDQLRAEHIQRKFAMNXRRRWRRRSPAVEGVXSSVPTKLGSSLDTLEYVISVGLGTPAVTQTVTIDTGSDVSWVQCNPCPKPCYAQTGALFDPAKSSTYRAVSCAAAECAQLEQQGNGCGATNYECQYGVQYGDGSTTNGTYSRDTLTLSGASDAVKGFQFGCSHVESGFSDQTDGLMGLGGGAQSLVSQTAAAYGNSFSYCLPPTSGSSGFLTLGGGGGVSGFVTTRMLRSRQIPTFYGARLQDIAVGGKQLGLSPSVFAAGSVVDSGTIITRLPPTAYSALSSAFKAGMKQYRSAPARSILDTCFDFAGQTQISIPTVALVFSGGAAIDLDPNGIMYGNCLAFAATGDDGTTGIIGNVQQRTFEVLYDVGSSTLGFRSGACXPGRAARRRRLAGRATRHT

SEQ ID NO: 3964 - protein, 325 aa, Oryza sativa
MEAQNQEVAALVEKIAGLHAAISKLPSLSPSAEVDALFTDLVTACVPASPVDVAKLGPEAQAMREELIRLCSAAEGHLEAHYADMLAAFDNPLDHLARFPYYGNYVNLSKLEYDLLVRYVPGIAPTRVAFVGSGPLPFSSLVLAAHHLPDAVFDNYDRCGAANERARRLFRGADEGLGARMAFHTADVATLTGELGAYDVVFLAALVGMAAEEKAGVIAHLGAHMADGAALVVRRHGARGFLYPIVDLEDIRRGGFDVLAVYHPDDEVINSVIVARKADPRRGGGLAGARGAVPVVSPPCKCCKMEAAAGAFQKAEEFAAKRLSV

SEQ ID NO: 3965 - protein, 549 aa, Oryza sativa
  unsure (1)..(549): unsure at all Xaa locations
MGTPRGLRNAGSSSSACRFLAAFAVLLALPTLTAGLTRHYTFNVQMTNVTRLCVTKSIPTVNGQFPGPKLVVREGDRLVVKVHNHMNYNVSFHWHGILQLRNGWADGPSYITQCPIQGGGSYVYDFTVTGQRGTLWWHAHFSWLRVHLYGPLVILPKRGEGFPFPRPYKELPPIMFGEWFNADTEAVINQALQTGAGPNISDAYTFNGLPGPTYNCSSKDTYKVKVQPGRTYLLRLINSALNDELFFGIANHTLTVVEADANYVKPFTAKTLVISPGQTMNLLLTTAPNPGSPVYAMAIAPYTNTQGTFDNTTAVAVLEXRPDSSXSATGNNNLPLPPLPRYNDTNAVANFSSKFRSLATARYPARVPRAVDRHVLFTVGLGTDPCPSNQTCQGPNGTKFAASINNNSFVRPRVALLEAHXXQRRVVPLAFNTSVELVLQGTSIQGAESHPLHMHGFNFFVVGQGFGNYDPVNDPANYNLVDPVERNTVSVPTGGWVAVRFLADNPGVWLMHCHFDVHLSWGLSMAWLVNDGPLPSQKMLPPPSDLPKC

SEQ ID NO: 3966 - protein, 573 aa, Oryza sativa
  unsure (1)..(573): unsure at all Xaa locations
NAGSSSSACRFLAAFAVLLALPTLTAGLTRHYTFNVQMTNVTRLCVTKSIPTVNGQFPGPKLVVREGDRLVVKVHNHMNYNVSFHWHGILQLRNGWADGPSYITQCPIQGGGSYVYDFTVTGQRGTLWWHAHFSWLRVHLYGPLVILPKRGEGFPFPRPYKELPPIIGEWFNADTEAVINQALQTGAGPNISDAYTFNGLPGPTYNCSSKDTYKVKVQPGRTYLLRLINSALNDELFFGIANHTLTVVEADANYVKPFTAKTLVISPGQTMNLLLTTAPNPGSPVYAMAIAPYTNTQGTFDNTTAVAVLEXRPDSSXSATGNNNLPLPPLPRYNDTNAVANFSSKFRSLATARYPARVPRAVDRHVLFTVGLGTDPCPSNQTCQGPNGTKFAASINNNSFVRPRVALLEAHCQRRYAGVLMANFPTAPPHPFNXTGTPPNNTFVTHGTRVVPLAFNTSVELVLQGTSIQGAESHPLHMHGFNFFVVGQGFGNYDPVNDPANYNLVDPVERNTVSVPTGGWVAVRFLADNPGVWLMHCHFDVHLSWGLSMAWLVNDGPLPSQKMLPPPSDLPKC

SEQ ID NO: 3967 - protein, 311 aa, Oryza sativa
MAGAAPTAVVSNGKRAFEDEVGPDGKKIRPGINPVMIDELTECNTMLSAHRKKRQVPPTLASIDAIERYTQISSHPLHKTNKPGILSMDIHPSKVEAVTVHATQKYFVTASKDNTWCFYDIPSGSCLTQVGESSGQEGYTSASFHPDGLILGTGTTEAVVKIWDVKTQSNVAKFEGHVGPVTAMSFSENGYFLATAALDGVKLWDLRKLRNFRTISPYDSDTPTNSVEFDFSGSYLAVGGSDTRVYQVANVKLEWNLVKTLPDLSGTGKVTNVKFGTDAKYIAVGSMDRNLRIFGHPGEDDQMDDAKPSEE

SEQ ID NO: 3968 - protein, 435 aa, Oryza sativa
MICAISGEVPDEPVVSKKSGLLFERRLVERYIEDHGKCPVTKEELTMDDIVAVKTNKVVKPRQLQAASIPGLLGMFQNEWDAIMLSSFALEQQLHTARQELSHALYQHDAACRVIARLKKERDEARALLAQAERQIPASMAGAAPTAVVSNGKRAFEDEVGPDGKKIRPGINPVMIDELTECNTMLSAHRKKRQVPPTLASIDAIERYTQISSHPLHKTNKPGILSMDIHPSKITSLKFVPRDELFVTGSADKVGESSGQEGYTSASFHPDGLILGTGTTEAVVKIWDVKTQSNVAKFEGHVGPVTAMSFSENGYFLATAALDGVKLWDLRKLRNFRTISPYDSDTPTNSVEFDFSGSYLAVGGSDTRVYQVANVKLEWNLVKTLPDLSGTGKVTNVKFGTDAKYIAVGSMDRNLRIFGHPGEDDQMDDAKPSEE

SEQ ID NO: 3969 - protein, 501 aa, Oryza sativa
  unsure (1)..(501): unsure at all Xaa locations
ACCEVSGEVPDEPVVSKKSGLLFERRLVERYIEDHGKCPVTKEELTMDDIVAVKTNKVVKPRQLQAASIPGLLGMFQNEWDAIMLSSFALEQQLHTARQELSHALYQHDAACRVIARLKKERDEARALLAQAERQIPASMAGAAPTAVVSNGKRAAFEDEVGPDGKKIRPGINPVMIDELTECNTMLSAHRKKRQVPPTLASIDAIERYTQISSHPLHKTNKPGILSMDIHPSKDIIATGGIDTNAVLFDRPSGQILCTLTGHSKKITSLKFVPRDELFVTGSADKVEAVTVHATQKYFVTASKDNTWCFYDIPSGSCLTQVGESSGQEGYTSASFHPDGLILGTGTTEAVVKIWDVKTQSNVAKFEGHVGPVTAMSFSENGYFLATAALDGVKLWDLRKLRNFRTISPYDSDTXXEFDFSGSYLAVGGSDTRVYQVANVKLEWNLVKTLPDLSGTGKVTNVKFGTDAKYIAVGSMDRNLRIFGHPGTLPCHXHVGSXQAQ

SEQ ID NO: 3970 - protein, 827 aa, Oryza sativa
  unsure (1)..(827): unsure at all Xaa locations
MWDRFVHARALLLRPLLVANPEASSPRPASPIANRRCPFCLIAAVPLSHVREERGGEKEESRRKGTDAKGDSKKKTPFKPPKWSIYTGFRRWWRRYSYMVLWLREIPRKTYPKNGSFWGARVAGAVVQRDGASLFGAVPPPTWRGDAEKLTGTNHVKNKLKRTKYVACGIFQSSTEKLLSSKTQSCKRNLEVLISPNPAKRGRIGCNFFCRCPCIYYLPDSESRNRNGGGGASHAGALLPGAAPAWYAGALLLPRRFACTTGSIYEISFSKGSKCKKSSPRSSPPYAITFLHVRTASSTRPGVITDKWVDVLYRTDLSVISPRIGAGITEYLFQSNVPASNQPANTVENISSTADLEPRQMDPEEIAFGEEPEPPHADGRGGGAATTRAAFLLMVSGATMIIAAVGASAGAGDRVPWPRLLAELLIWLVGLKLALKDPNRLQVPKPGSKPREKVTRTREAELEAAREMENGGGGGGDGGKSDVPADANEHCPGTQSEEAGKADACAGCPNQQICATAPKGPDPDLVGIVERMATVKHKILVLSGKGGVGKSTFSAQLSFALAEMDCQVGLLDIDICGPSIPKMLGLEGQDIHQSNLGWSPVYVESNLGVMSIGFMLPNPDDAVIWRGPRKNGLIKQFLKDVDWGEIDYLVVDVPPGTSDEHISGVQYLQATGIDGAIIVTTPQQVSLIDVRKEINFCKKVGVPILGVVENMSGLRQVLSDFRFVKQGEGGEMDATEWALNYIKEKAPELLTMVACSEVFDSSKGGAEKMCNEMGVPFLGKVPMDPQLCKAAEEGRSCFVDQKCSASAPALKSIVKKLIENQDXVNFF

SEQ ID NO: 3971 - protein, 527 aa, Oryza sativa
MICAISGEVPDEPVVSKKSGLLFERRLVERYIEDHGKCPVTKEELTMDDIVAVKTNKVVKPRQLQAASIPGLLGMFQNEWDAIMLSSFALEQQLHTARQELSHALYQHDAACRVIARLKKERDEARALLAQAERQIPASMAGAAPTAVVSNGKRAFEDEVGPDGKKIRPGINPVMIDELTECNTMLSAHRKKRQVPPTLASIDAIERYTQISSHPLHKTNKPGILSMDIHPSKDIIATGGIDTNAVLFDRPSGQILCTLTGHSKKITSLKFVPRDELFVTGSADKTVKIWQGSEEGNYNCIHTLKDHTAEVEAVTVHATQKYFVTASKDNTWCFYDIPSGSCLTQVGESSGQEGYTSASFHPDGLILGTGTTEAVVKIWDVKTQSNVAKFEGHVGPVTAMSFSENGYFLATAALDGVKLWDLRKLRNFRTISPYDSDTPTNSVEFDFSGSYLAVGGSDTRVYQVANVKLEWNLVKTLPDLSGTGKVTNVKFGTDAKYIAVGSMDRNLRIFGHPGEDDQMDDAKPSEE

SEQ ID NO: 3972 - protein, 643 aa, Oryza sativa
  unsure (1)..(643): unsure at all Xaa locations
MEINSSGEEAVVKVRKPYTITKQRERWTEAEHNRFLEALKLYGRAWQRIEEHVGTKTAVQIRSHAQKFFTKLEKEAINNGTSPGQAHDIDIPPPRPKRKPNSPYPRKSCLSSETSTREVQNDKATISNMTNNSTAQMAGDAALEKLQRKEISEKGSCSEVLNLSSFSSVNKSSSNHGASRGLEPTKTEVKDPKSNSVETTYVDWSAAKASHYQMDRNGVTGFQATGTEGSHPDQTSDQMGGASGTMNQFHPTLPVDPKFDGNAAAQPFPHNYAAFAPMMQCHCNQDAYRSFANMSSTFSSMLVSTLLSNPAIHAAARLAASYWPTVDGNTPDPNQDHAGSPPNMASIVTATVAAASAWWATQGLLPLFPPPIAFPFVPAPSAPFSTADVQRAQEKDIDCPMDNAQKELQETRKQDNFEAMKVIVSSETDESGKGEVSLHTELKISPADKADTKPAAGAETSDVFGNKKKQDRSSCGSNTPSSSDIEADNAPENQEKANDKAKQASCSNSSAGDNNHRRFRSSASTSDSWKEVSEEGRLAFDALFSRERLPQSFSPPQVAKEISKEEEDEVTTVTVDLNNQELDTADEPRASFPNELSNLKLKSRRTGFKPYKRCSVEAKENRVPXXSDEVGTKRIRLESEAST

SEQ ID NO: 3973 - protein, 429 aa, Oryza sativa
  unsure (1)..(429): unsure at all Xaa locations
MTMEKRTSPQQPPTLLPTNCSTHFLYARAPTTAGVTPRQPHQSFRSYLAQMGGTGDDGAKAPAAAAAMDVVSSSSSSPAPAPSVLKSVLLSYAYVSVWITLSFSVIVYNKYILDPKMYNWPFPISLTMIHMAFCASLAVVLVRVLRVVAVPASPPMTPSLYAASVVPIGALYALSLWFSNSAYIYLSVSFIQMLKALMPVAVYSLAVAFRTDSFRRASMLNMLGISAGVAVAAYGEARFDAFGVMLQLAAVAAEATRLVLIQILLTSKGMSLNPITSLYYIAPCCLVFLTLPWYFVELPRLRAAAGAAVRPDVFVFGTNSLCAFALNLAVFLLVGKTSALTMNVAGVVKDWLLIAFSWTVIKDTVTPVNLVGYGIAFLGVAYYNHAKLQGLKAREAERRAEDGDAEAGARLLPEKDAGEQKNXSKSNTK

SEQ ID NO: 3974 - protein, 420 aa, Oryza sativa
  unsure (1)..(420): unsure at all Xaa locations
MENTIVTSIIILERKNAQLATAGYPWNIRASSNAAAAHRTPNTGIVPTSHPATSPANRKHRWTPPTRVDLLNTWRARGGTARLHPSCRHAAPDPVEAAPSVTASTLRCRNYASPRGAHSAIHSHPPTAAATISKPTNTHSHRELERGKKSFRSERLRASSSPTSPFSFPHAFAYGGGLAQQPELSPAQMHYIQARLHLQRQAAQAGPLGPRAQPMKASSSSASAAGAAATPPRPQKLYRGVRQRHWGKWVAEIRLPRNRTRLWLGTFDTAEEAALAYDQAAYRLRGDAARLNFPDXXAASRGPLHASVDAKLQTLCQNIAAAKNAKKSSVSASAAATSSAPTSNCSSPSSDDASSCLESADSSPSLSPSSAATTAETPATXXAGDAAARLQPPWDEAAAFALTKYPSYEIDWDSLLAANX

SEQ ID NO: 3975 - protein, 243 aa, Oryza sativa
  unsure (1)..(243): unsure at all Xaa locations
MPPARLRFVPSLVPPRHSPSRTRSRTVAGWPSSQSSARPRCTTSRPASTSSARPQKLYRGVRQRHWGKWVAEIRLPRNRTRLWLGTFDTAEEAALAYDQAAYRLRGDAARLNFPDXXAASRGPLHASVDAKLQTLCQNIAAAKNAKKSSVSASAAATSSAPTSNCSSPSSDDASSCLESADSSPSLSPSSAATTAETPATXXAGDAAARLQPPWDEAAAFALTKYPSYEIDWDSLLAANXHHH

SEQ ID NO: 3976 - protein, 408 aa, Oryza sativa
  unsure (1)..(408): unsure at all Xaa locations
MASGAGELCYKRAPMASLTPPRPPFPLSPTHTPRSTAILPPPPPPSPSPRTPTATVSSSEVRKALDLSDFERLQGKVFSKPSSSSSSSGSPTCSSTVSWLGCLQRARDPGXLLDPGLPDLLFFXXSSSLCSSVRLVAKRGSFSTPHLLDLPPKSHLPTSPFSFPHAFAYGGGLAQQPELSPAQMHYIQARLHLQRQAAXXAGPLGPRAQPMKASSSSASAAGAAATPPGPQKLYRGVRQRHWGKWVAEIRLPRNRTRLWLGTFDTAEEAALAYDQAAYRLRGDAARLNFPDNAASRGPLHASVDAKLQTLCQNIAAAKNAKKSSVSASAAATSSAPTSNCSSPSSDDASSCLESADSSPSLSPSSAATTAETPATVPDSEAPWDEAAAFALTKYPSYEIDWDSLLAAN

SEQ ID NO: 3977 - protein, 99 aa, Oryza sativa
  unsure (1)..(99): unsure at all Xaa locations
XHACDHMRKMKNSAIGRYIGHFDIQIDMIYLETXRVVMRITXIKRXTDRWTFTETNTGIIGLAEGRVMNFGCATVHTSCVMSCSFTNQVIAQLELRTEK

SEQ ID NO: 3978 - protein, 171 aa, Oryza sativa
MTITREEAESKEMESLRVHASALLSLSSPAASASQPTSSSSTTEGVFECKTCSKRFPSFQALGGHRTSHTRLQAKLLSDPAAAAAAAAERDRARVHECAVCGVEFSMGQALGGHMRRHRGETGTTTVVLADADDSGGATVPQPPEPMPDLNYPPLEDAGDGSEPELLNLLV

SEQ ID NO: 3979 - protein, 143 aa, Oryza sativa
  unsure (1)..(143): unsure at all Xaa locations
XAMGILNLAIVIPQVIVSLGSGPWDQLFGGGNAPAFAVAAAASFIGGLVAILGLPRARIASRRKVTDKNIATYKLSAILCNSTHKRHSERYAVHGGIVYYLRIKKGIMLAFSMSYFCLFHAGSSYAVVHWMILCCCTLDVGHL

SEQ ID NO: 3980 - protein, 367 aa, Oryza sativa
  unsure (1)..(367): unsure at all Xaa locations
MADSGDSSPHSAAATDDAHHEGWRRRRRRRPRHRRRRXKVRLMVSYGGRIQPRPHDHQLSYVNGETKILSLERPLRFADFAARLAGLAGSPGDFCVKYQLPGEDLDALVSVTNDEDLEHLVLEYDRLHLLRPAPGSGGXARPAAVPRPGSGFSSSPSSRPRHRPRRSRPASSSPSRSNASGSSTRSPTGPDYLFGLDNGFVPPPPPTVKDNVPVEIPAKKPPHHQPRKRPXVVVSPVVSPGEFQRQIQGLEKLQFADTAAQQPPPPPAPATAAPPPAALPRNGYYLPKYQEKPAAPPPSSAPPPTAFXTGAGKVXXSVARGSGADHAPVFFIPAPPHGYXSPPPLAPAPPPSPPKKKKKPAARGSTS

SEQ ID NO: 3981 - protein, 378 aa, Oryza sativa
  unsure (1)..(378): unsure at all Xaa locations
MMVVDTVSASTSLVAHHLFDQRSKANHHLRRTLHVVSCRPLPTHFAGRRLVARAPRQHQPRLADWTVKALAMGVTKEASPHREYRGSADMGDIGITNPKTTWPPRNRADDPKLHNPLLRLERMGCGWLGVIFEWEGVIVEDDAELERQAWFTLAQEEGKSPPLAFVLKRIEGMKSEQAISEVLCWSRDPSELRRLSSRKEEIRCNLRGTVYQMRNGSREFMSTLANYKIPLAVATTRPRKVIEEAIDAVGVRSFLMPVVASXEDVYRGKPDPEMFLYAAQLLSFIPERCIVFGNSNSAVEAAHDARMKCVAVASKHPIYELNAADLVVKQLDELSVVDLKNLADIESPEFGMEPEPEMEEEEDEESPSTSVGVDDLFW

SEQ ID NO: 3982 - protein, 219 aa, Oryza sativa
  unsure (1)..(219): unsure at all Xaa locations
MALANKIGNLLKRATSSSPALYQSIRCMSSSKLFVGXXKIINDRETGRSRGFGFITYASSEEASAAITALDGKDLDGRNIRVNTANERTGGFRSGGGGYGGGGYGGGGGGYGGGGYSGGGGYGGGGYSGGGGGGGGYQGGGGGYGGNXXGGYGNRGGGGGGGDGSFGGNPAGSFGDAGGSTGGGDFSGAGGDSSARTMSSWMTSSRMTSLTTMPTSRAX

SEQ ID NO: 3983 - protein, 257 aa, Oryza sativa
  unsure (1)..(257): unsure at all Xaa locations
MALANKIGNLLKRATSSSPALYQSIRCMSSSKLFVGGLSYGTDEQSLRDTFANYGQVIEAKIINDRETGRSRGFGFITYASSEEASAAITALDGKDLDGRNIRVNTANERTGGFRSGGGGYGGGGYGGGGGGYGGGGYSGGGGYGGGGYSGGGGGGGGYQGGGGGYGGNNGGYGNRGGGGGGNGNLLEGICRCPSLESTYGXDGSFGAAGSFGDAGGSTGGGDFSGAGDDNGGVLNVCFYSISSVXNHSRXTADALX

SEQ ID NO: 3984 - protein, 1245 aa, Oryza sativa
MAGNEWINGYLEAILDSGGAAGGGGGGGGGGGGGGGAGEGGGVGGVDPRSPPTGTPSPRGPHMNFNPTHYFVEEVVKGVDESDLHRTWIKVVATRNARERSTRLENMCWRIWHLARKKKQLELEGILRISARRKEQEQVRRETSEDLAEDLFEGEKADTVGELAQQDTPMKKKFQRNFSELTVSWSDENKEKKLYIVLISLHGLVRGDNMELGRDSDTGGQVKYVVELARALAMMPGVYRVDLFTRQVSSPEVDWSYGEPTEMLTSGSTDGEGSGESAGAYIVRIPCGPRDKYLRKEALWPYLQEFVDGALAHILNMSKALGEQVSNGKLVLPYVIHGHYADAGDVAALLSGALNVPMVLTGHSLGRNKLEQIMKQGRMSKEEIDSTYKIMRRIEGEELALDAAELVITSTRQEIDEQWGLYDGFDVKLEKVLRARARRGVSCHGRFMPRMVVIPPGMDFSSVVVPEDTSDGDDGKDFEIASPRSLPPIWAEVMRFLTNPHKPMILALSRPDPKKNITTLVKAFGECRPLRELANLILIMGNRDDIDEMSAGNASVLTTVLKLIDKYDLYGSVAFPKHHKQSDVPEIYRLTGKMKGVFINPALVEPFGLTLIEAAAHGLPIVATKNGGPVDIKNALNNGLLVDPHDQHAIADALLKLVADKNLWQECRKNGLRNIQLYSWPEHCRTYLTRIAGCRIRNPRWLMDTPADAAAEEEEALEDSLMDVQDLSLRLSIDGERGSSMNDAPSSDPQDSVQRIMNKIKRSSPADTDGAKIPAEAAATATSGAMNKYPLLRRRRRLFVIAVDCYGDDGSASKRMLQVIQEVFRAVRSDSQMSRISGFALSTAMPLPETLKLLQLGKIPPTDFDALICGSGSEVYYPSTAQCVDAGGRLRPDQDYLLHINHRWSHDGAKQTIAKLAHDGSGTNVEPDVESCNPHCVSFFIKDPNKVRTIDEMRERVRMRGLRCHLMYCRNATRLQVVPLLASRSQALRYLFVRWGLSVGNMYLIVGEHGDTDHEEMLSGLHKTVIIRGVTEKGSEQLVRSSGSYQREDVVPSESPLIAFTKGDLKADEIMRALKEVTKAASGMDWQRPLCKTAYWFQSRVYTNMEEKEEMTMLSLGVGAASKHSISNRKFRLKEVTDHKFNLGDQDHNSGHVRKKLRLSEEQLTVLENMYEAGSNLDQALKQGLAEKLNIKPRQVEVWFQNRRARSKKNARTEVVGGPKQGEPKAEDGTDEGFSACFDSSRQHP

SEQ ID NO: 3985 - protein, 1066 aa, Oryza sativa
  unsure (1)..(1066): unsure at all Xaa locations
MAGNEWINGYLEAILDSGGAAGGGGGGGGVDPRSPAAGAASPRGPHMNFNPTHYFVEEVVKGVDESDLHRTWIKVVATRNARERSTRLENMCWRIWHLARKKKQLELEGILRISARRKEQEQVRRETSEDLAEDLFEGEKADTVGELAQQDTPMKKKFQRNFSELTVSWSDENKEKKLYIVLISLHGLVRGDNMELGRDSDTGGQVKYVVELARALAMMPGVYRVDLFTRQVSSPEVDWSYGEPTEMLTXPVPLTEREAVRVLVRTLCAFRAVQGTSTSVKSPVALPPRVCRRSSRAYXLNMSKALGEQVSNGKLVLPYVIHGHYADAGDVAALLSGALNVPMVLTGHSLGRNKLEQIMKQGRMSKEEIDSTYKIMRRIEGEELALDAAELVITSTRQEIDEQWGLYDGFDVKLEKVLRARARRGVSCHGRFMPRMVVIPPGMDFSSVVVPEDTSDGDDGKDFEIASPRSLPPIWAEVMRFLTNPHKPMILALSRPDPKKNITTLVKAFGECRPLRELANLILIMGNRDDIDEMSAGNASVLTTVLKLIDKYDLYGSVAFPKHHKQSDVPEIYRLTGKMKGVFINPALVEPFGLTLIEAAAHGLPIVATKNGGPVDIKNALNNGLLVDPHDQHAIADALLKLVADKNLWQECRKNGLRNIQLYSWPEHCRTYLTRIAGCRIRNPRWLMDTPADAAAEEEEALEDSLMDVQDLSLHLSIDGERGSSMNDAPSSDPQDSVQRIMNKIKRSSPADTDGAKIRQAAATATSGAMNKYPLLRRRRRLFVIAVDCYGDDGSASKRMLQVIQEVFRAVRSDSQMSRISGFALSTAMPLPETLKLLQLGKIPPTDFDALICGSGSEVYYPGTAQCVDAGGLRPDQDYLLHINHRWSHDGAKQTIANVAHDGSGTNVEPDVESCNPHCVSFFIKDPNKVRTADEMRERMRMRGLRCHLMYCRNATRLQVVPLLASRSQALRYLFVRWGLSVGNMYLIVGEHGDTDHEEMLSGLHKTVIIRGVTEKGSEQLVRSSGSYQREDVFPSESPLIAFTKGDLKADEIMRALKEVTKAASG

SEQ ID NO: 3986 - protein, 567 aa, Oryza sativa
MASSSSSRLLFLLSCSVLALLAGAEVHHHEFIVQETPVKRLCKTHNVITVNGQLPGPTLEVREGDTVVINVVNHAQYNVTIHWHGIRQFRTGWADGPEFVTQCPIKPGGSYKYRFTIEGQEGTLWWHAHSSWLRATVYGALIIRPRENKTYPFEKPAREVPLILGEWWDADPIQVIREAQRTGAAPNISDAYTINGQPGDLYNCSKEETTAVPVKPGETALLRFINAALNQELFVSIAQHKMTVVGVDASYTKPFTTSVLMIAPGQTTDVLVTMDQAPTRYYLAARAYDSAQGVAFDNTTTTAVIEYDCGCATDFGPSIPPAFPVLPAFNDTNTATAFAAGIRSPHEVKIPGPVDENLFFTVGVGLFNCEPGQQCGGPNNTRFTASMNNISFVFPQTTSLLHAHYYGIPGVFTTDFPAYPPVQFDYTAQNVPRYLWQPVPATKLYKLKFGSVVQIVLQDTSIVSPENHPIHIHGYDFYILAEGFGNFDPKKDAKKFNYVDPPQRNTVAVPTNGWAVIRFVADNPGVWLMHCHLDVHITWGLAMAFLVEDGYGKLETLEAPPVDLPMC

SEQ ID NO: 3987 - protein, 227 aa, Oryza sativa
  unsure (1)..(227): unsure at all Xaa locations
MADVEEYRCFIGNLSWSTTDESLKDAFGKFGNLTEAKVVFDKYSGRSRGFGFVTFDEKKAMEDAIEGMNGLDLDGRAITVDKAQPQGPGRDRNGDRDYDRDRGSRYDRGRDFGGGGXXAPRGSGGGGDCYKCGKPGHFARECPSGDGGGRGDRYGGRDDRYGGGGGGGGRYGSDRGGDRYSGRSRDGGGYGGGGGDRYSRDRSGPYXWPIKSLRSMFHPGMEVYLLL

SEQ ID NO: 3988 - protein, 114 aa, Oryza sativa
MPRATSDAKLLIQSLGKAYAATPTNLKIIDLYVVFAVATALIQVVYMGIVGSFPFNSFLSGVLSCIGTAVLAVCLRIQVNKDNKEFKDLPPERAFADFVLCNLVLHLVIMNFLG

SEQ ID NO: 3989 - protein, 125 aa, Oryza sativa
  unsure (1)..(125): unsure at all Xaa locations
XTYIYIYKPAAKGRKGKAGKDPNKPKRAPSAFFVFMEEFRKEFKEKNPKNKSVAAVGKAAGDRWKSLTEADKAPYVAKANKLKAEYNKAIAAYNKGEEEEEDDEEESDKSKSEVNDEDDDEGSEE

SEQ ID NO: 3990 - protein, 157 aa, Oryza sativa; identical to SEQ ID NO: 3451

SEQ ID NO: 3991 - protein, 377 aa, Oryza sativa
MASGTDEKAKMEGLTSAAAFVEGGIQDACDDACSICLEAFCESDPSTLTGCKHEFHLQCILEWCQRSSQCPMCWQPISLKDPTSQELLEAVERERNVRTNQTRNTTIFHHPALGDFEVQHLPVVGNDAELEERILQHLAAAAAMGRSHHLGRREGHRGRSGSHGRPQFLVFSSHPNMPSAGSVSSSSVQGEVDNESSPVHTTGELSLHANTHEEAGNQSPGMLTYDADQDAVVSSGNSTPTGQSTPVNNGRAGPSDLQSFSDSLKSRLNAVSMKYKESITKNTRGWKERLFSRHSSVADLGSEVRREVNAGIASVSRMMERLETRGSNGRTSDGPAISTSEVIPSTESSNERVTAAATSSGNTSASSAPCVTTTGSN

SEQ ID NO: 3992 - protein, 155 aa, Oryza sativa
  unsure (1)..(155): unsure at all Xaa locations
XDAWAATRHCVLAPLSAVMVLIVLLRYCLHQVDALXRHMSPSRDPKLEREVQAVLTADGPAIVGRXIPGKDCRWRRGYYTHHDNGXFHVPTEEAHMAQAAMFHHPNMTMGMMTTNLSMIVTQTLTFAXWMNFFFLPFVASQIPLTLTPLMSWDMX

SEQ ID NO: 3993 - protein, 303 aa, Oryza sativa
  unsure (1)..(303): unsure at all Xaa locations
AASGSLAADPARAAAAGGRFEGGEEAFGRHSLRRMVAVSTLVCVXDAKHRXFEAMSNTGVQYAIKALQXXRVAALPDVDDFFWEKDPTPILDTIDAPIHLKNLSSKELKQLAGEVRSEISFIMSRKCQXXCNTGHSVVELAIAIHYVFNAPMDKILWDAGQHTYAHKILTGRRSLLSYYXKQRKGLSGFTSRFESEYDPFGAGHGCNSLSAGLGMAVARDLGGRKNRIVTVISNWTTMAGQVYEAMGHAGFLDSNMVVILNDSRHTLLPKADSQSKMSINALSSALSKVQSNKGFRKFRKAAK

SEQ ID NO: 3994 - protein, 637 aa, Oryza sativa
MALASSSRLLHRFSSSSLPRPCRRRVPRPRGHSRFAVRWEHRAAAVVLLLPRALLGGGFQDADAAESDDEEEEDAHGVLRPLDADDVNLDLHAPPSGPERWDVLGLGQAMVDFSGMVDDEFLHRLGIQKGTRKVVNHEERGRVLRAMDGCSYKAAAGGSLSNSLVALSRLGSSRSTNYPELRIAMAGSVGSDPLGSFYRAKLRRANLHFLSKPVKDGTTGTVIVLTTPDAQRTMLAYQGTSSTLSYDSDLASLVSKSNVVIVEGYLFELPHTIEAIKQACEDAHKNGSLIAVTASDVSCIKRCYNDFWDIVTNYADILFANANEARAFCELSSTDSPMSAARYLSHSVPLVSVTDDTCGAGDAYASGILYGILRGSSDLKSIGLLASRVAAIVVAQQDSGGCLAFSDELHRRVAAPCQDRMVVATEEMAVYCFDALVSHYSGDQPPPPAFEEGIHPLFVTWKKATNGSEPRLRGCIGTLEARQIVTGFKEYALTSALRDRRFPPIQSKELPYLECTVSILTEYETALNHLDWEVGKHGLIIEFTDPDYNMRRSATYLPEVAAHEGWTHLETIDSLMRKAGYNGTITDSLRKKLRVTRYQSTLYTMHYGEYAAYVKKNRGAAPEINGAPIINGFKPGH

SEQ ID NO: 3995 - protein, 408 aa, Oryza sativa
  unsure (1)..(408): unsure at all Xaa locations
TLLPSPLVSFPPPCWASRGGASDPDARWGNSCRRSDRPPXAAAARTYSAAAKEMTVREASNSALDEEMSADPSVFLMGEEVGEYQGAYKISKGLLDKYGPDRVLDTPITEAGFTGIGVGAAYQGLRPVVEFMTFNFSMQAIDHIINSAAKSNYMSAGQINVPIVFRGPNGAAXAGVGAQHSQCYAAWYAHVPGLKVLTPYSAEDARGLLKAAIRDPDPVVFLENELLYGESFPVSAEVLDSSFCLPIGKAKIEQEGKDVTITAFSKMVGYALQAAEILSKEGISAEVINLRSIRPLDRATINASVRKTNRLVTLEEGFPQHGVGAEICMSVVEDSFEYLDAPVERIAGADVPMPYAANLERMAVPQVLTVLLCLNKNFRNSISLCQVQQLLLFHHNDLAGYSNHPHAS

SEQ ID NO: 3996 - protein, 666 aa, Oryza sativa
MGGILVPYVCGACGPGRTGGKRGFAIRGSEATKSRHDAPQSPASTVARGVGGVPGASWGWFFQAAAGSPELDPAEERISGKGAAKLLDGRLVVALRARIHADPAPEFDQFDCLPDPVVLLILNKLEDVRSLGRCAAVSKRFSGLVPLVSDVYVKIDRVVATDGDADDALNLSSAKPKNIFSHFFKLMLFTIVKPFHSMRNLNGTGRPLFPLAQHSPVHVLRNFSDVWNLRVELPSGDVGTEEGVLLKWRAEYGSTLRNCVILGGTLVDRKPIGAEHESSVEDNGSMPESFYTNGGLKLRVVWTISSLIAASTRHYLLRSIIKDHPTLRSLVLADADGQGTLYMGMEQLREFRENKLSASACSNRTQVPACNMKLKYAPYLELPGGMTLQGATLVVIKPSNDGGSGGHSSRKETEAFVSSAFDEPFRFAVKALMKRRTYLLEMNAAPVTLDSSPLDNDKYKSAFDLSLAASVLRRFRALPRRSPSSSGSSPPFPGRRDKNKDSVGVGFFRTAKETRHCQPLPRCLDIGIGLSLFVVLQVTTTRKLQVQLQPLLRLFPIRHFSRCSRYNLCADTTLRTLLVHSLDPEFDYIHLKLAFLPYGELPLVAIEGPNAVVELKKPTGQQEARDVTNQLELFNELKSTLFSMSLPVKKWLIKELLAGMPHDVVK

SEQ ID NO: 3997 - protein, 368 aa, Oryza sativa
  unsure (1)..(368): unsure at all Xaa locations
FVVGIKRCSPLSWTMHPRARIHADPAPEFDQFDCLPDPVVLLILNKLEDVRSLGRCAAVSKRFSGLVPLVSDVYVKIDRVVATDGDADDALNLSSAKPKNIFSHFFKLMLFTIVKPFHSMRNLNGTGRPLFPLAQHSPVHVLRNFSDVWNLRVELPSGDVGTEEGVLLKWRAEYGSTLRNCVILGGXXLVDRKPIGAEHESSVEDNGSMPESFYTNGGLKLRVVWTISSLIAASTRHYLLRSIIKDHPTLRSLVLADADGQGTLYMGMEQLREFRENKLSASACSNRTQVPACNMKLKYAPYLELPGGMTLQGATLVVIKPSNDGGSGGHSSRKETEAFVSSAFDEPFRFAVKALMKRRTYLLEMNGF

SEQ ID NO: 3998 - protein, 165 aa, Oryza sativa
  unsure (1)..(165): unsure at all Xaa locations
MAARPEVVSALSPPAGGGAXGGVRYHRCCPPRAXTVLQGSDALSSIREWSRSHLVTMTGLVACAVLVVPSADAVDALKTCTCLLKECRXXVGFPFFAFVPSMIPNRVHSPCRTSIQIKCGDLFENTVVDEFNECAVSRKKCVPQKSDVGEFPVPDPSALVKNFNX

SEQ ID NO: 3999 - protein, 217 aa, Oryza sativa
  unsure (1)..(217): unsure at all Xaa locations
MDVEATKDVVHEQAAAPGRGRAARWLLVALNCGMLVVGTTGGPILSRLYFSKGGHRKWLSAWLETAGWPLLLVPVSASYHSRRARDRGXXPLFLTPRRVLLAGAVLGVLTGADDFVYAYGLAYLPVSTSAILISTQLAFTVFFACLIVRQRLTAATLNAVALLTIGAVVLGLHASKDRPAGVTTGKYWMGFFLTLGAAALYGLILPLVELAYKHAAG

SEQ ID NO: 4000 - protein, 233 aa, Oryza sativa; identical to SEQ ID NO: 3688

SEQ ID NO: 4001 - protein, 194 aa, Oryza sativa
  unsure (1)..(194): unsure at all Xaa locations
XLSMLVVRTSLNXPILDKRFXNRCRETFDMLLSNIHXLVLFFQAFVHDPLINWRLFNFNEVPQVTNYGNAHSHTVVNSEEAANRELMQPPRGARERELLQAVNQLGDANEVLNERAVAVMARMSHKLTGRDFSSGSSLSGAGSSTQHGNEHLASGDTREVEPGLSVKVQVQRLILQATSHENLCQNYVGWCPFW

SEQ ID NO: 4002 - protein, 386 aa, Oryza sativa
  unsure (1)..(386): unsure at all Xaa locations
MELDSLREAFDRVIEKRASSSAKAQEVIDQIVSEVEQAITKMQMMNTDSMGTADHSSILAELKAKLNELAPLNQLEGCQKELNVALSKYLKLLEKSFSPDISKAYRNVDFEASTINSIIANHFYRQGLFDLGDSFVRECGESEAHLKLQFQEMYSILEAMQVRNLQPALSWAAKNHDQLLQNGSMLELKLHQLQFVEILTKGSRDEALKYARTHLVPFASLHKAEIQKLMACLLWADRLDQSPYAEFMSSTHWEKLAEELTHQFCSLLGQSSESPLGVAVSAGFQGLPTLLKLTTVMAAKKQEWQAMKQLPVPIDIGPEFQYHSVFVCPVLREQSSDENPPMLMPCGHVVSKQSIMKLSKSSSRXXFKCPYCPSEAVASQCKQLHF

SEQ ID NO: 4003 - protein, 190 aa, Oryza sativa
  unsure (1)..(190): unsure at all Xaa locations
MSKRQFGEMDGGIDTARVLMLLSXGGGGSTATSXHARAARVFECRTCGRRFPTFQALGGHRASHKRPRHGAERAXXRPAGDDDVGAGXRRRAPPRRRGVAGAAHGCPVCGLEFAVGQALGGHMRRHRAAAGDVAAPRVKTDDVVVGDECTGGICLDLNLTPSENCDKCRHAQLGVAVNSVQRTILLDRPL

SEQ ID NO: 4004 - protein, 150 aa, Oryza sativa
LTTVAAKLPVLPLRACGTGTTAPVPPPTASLRRELALSPNLPARGGVAGQPNAATREAPAAAVSSARRVVVVSPSLAGYLDEQFCQVEDLQDEASPNFVEEVVTLFFKDSGRLMSNIEQALEKYPRDFNRWDTYMQQLKGSCSSIGASRM

SEQ ID NO: 4005 - protein, 229 aa, Oryza sativa
MSLSLGFSAGAGVGADRLAAAPALQAAGALPPRVDVSLSLARAANGQPSSYLPLNENDSLDMVLFDVLREASAVAALSSSSSSSPELGARTTAPVVAGHPAGRKGGGGGGGGRGAAARGGAAGGRHYRGVRRRPWGKYAAEIRDPTRHGARLWLGTFGTAEEAAAAYDRAAFRMRGAKALLNFPPAVAGDGARRGAAAAAKQVGMSDGKIVIRKALDIPKWNTGNAGNL

SEQ ID NO: 4006 - protein, 377 aa, Oryza sativa
  unsure (1)..(377): unsure at all Xaa locations
MSTARVYADVNVHRPREYWDYEALAVEWGEQDDYEVVRKVGRGKYSEVFEGINVTNDERCIIKILKPVKKKKIKREIKILQNLCGGPNIVKLHNIVRDQQSKTPSLIFEYVNSTDFKVLYPTLTDYDIRFYIYELLKALDYCHSQGIMHRDVKPHNVMIDHELRKLRLIDWGLAEFYFPEKEYNVRVASRYFKGPELLVDFQSYDYSLDMWSLGCMFAGKIFRKEPSFYGHDNHDQLVKIAKVLGTDQLNAYLNKYRIALDPQLEALIGRHTRKPWSKFINPENRHLVSPEAIDFLDKLIRFDHHDRLTAREAMAHPYFEQVRAAEDCRMRTXHERNAICCCWIALEICCRFAPLFYSILLRQRKSCSMLRLRSACC

SEQ ID NO: 4007 - protein, 246 aa, Oryza sativa
MGRGKVQLKRIENKINRQVTFSKRRSGLLKKANEISVLCDAEVALIIFSTKGKLYEYATDSCMDKILERYERYSYAEKVLISAESDTQGNWCHEYRKLKAKVETIQKCQKHLMGEDLESLNLKELQQLEQQLENSLKHIRSRKSQLMLESINELQRKEKSLQEENKVLQKELVEKQKVQKQQVQWDQTQPQTSSSSSSFMMREALPTTNISNYPAAAGERIEDVAAGQPQHVRIGLPPWMLSHING

SEQ ID NO: 4008 - protein, 439 aa, Oryza sativa
  unsure (1)..(439): unsure at all Xaa locations
MATRGRIVAAVASVVVAWLAVAVGVNGGGCEAERDRVEALPGQPPVAFAQYAGYVAVSEASGRALFYWLTEAAAAAAAATKPLVLWLNGEANLLFLESPAGVGFSYSNTTSDLKTSGDERTAQDALQFLISWMSRFPQYRHRDFYIAGESYAGHYVPQLARKIVEFNKASPYPFINLKGILVGNGVTDNYYDNIGTVTYWWTHAMISDTTYKAIMSSCNFTSANVSRLCNRAMSYAMNHEFGDIDQYSIYTPSCAAAAAANATGRRRGKAAVLRFKDTFLRRRSXXGYDPCTETYAEKYYNRPDVQKAMHANITGIPYRWTACSDVLIKTWRDSEFSMLPTYKLLMKAGLRIWVFSGDTDSVVPVTATRFALSHLGLKTKIRWYPWYSAGQVGGWSEVYEGLTFASVRGAGHEVPLFQPRRAFRMFQSFLAGEPLPKSX

SEQ ID NO: 4009 - protein, 505 aa, Oryza sativa
  unsure (1)..(505): unsure at all Xaa locations
SALPSRCPAARRLPRRCRPCLPAPRTATRGRPGAAAARVVVARLAGAAGAVGAGCVALRGRVLPLPGLPPGALARGAADVAVGLACAPARGAGLAVPPAPPAAAFPLVRWFFAGPGCSSIAYGASEEIGPFRIKTNGTGLYLNKYSWNREANLLFLESPAGVGFSYSNTTSDLKTSGDERTAQDALQFLISWMSRFPQYRHRDFYIAGESYAGHYVPQLARKIVEFNKASPYAFINLKGILVGNGVTDNYYDNIGTVTYWWTHAMISDTTYKAIMSSCNFTSANVSRLCNRAMSYAMNHEFGDIDQYSIYTPSCAAAAANATGRRRGKAAVLRFKDTFLRRRSXXGYDPCTETYAEKYYNRPDVQKAMHANITGIPYRWTACSDVLIKTWRDSEFSMLPTYKLLMKAGLRIWVFSGDTDSVVPVTATRFALSXHLGLKTKIRWYPWYSAGQVGGWSEVYEGLTFASVRGAGHEVPLFQPRRAFRMFQSFLAGEPLPKSXWFPANN

SEQ ID NO: 4010 - protein, 373 aa, Oryza sativa
  unsure (1)..(373): unsure at all Xaa locations
SARACRRDRRXXXAXIISKEXEGTLLGMGNPLLDISAVVDEDFLKKYDITSNNAILAEDKHKPMYQELAEKYNVEYIAGGATQNSIKVAQWMLQVPGATSYMGGIGKDKFGEEMKKNSKLAGVNVHYYEDETTPTGTCAVCIVGGERSLVANLAAANCYKSDHLKRPENWALVEKAKYIYIAGFFLTVSPDSIQLVAEHSAANNKIFSMNLSAPFICEFFRDVQEKALPYTDFVFGNETEARTFSKVHGWETDNVEEIAVKISQWPKASGTHKRITVITQGADPICVAEDGKVKKFPVKLLPKEKLVDTNGAGDAFVGGFLSQLVQEKPIEECVRAGCYAANVIIQKVXACTVPRRTPDFLLRCFSSVSCSPL

SEQ ID NO: 4011 - protein, 184 aa, Oryza sativa
  unsure (1)..(184): unsure at all Xaa locations
MAPANKAERKAVLDAGAWMFNVVTSVGIIMVNKALMATHGFSFATTLTGLHFATTTLMTLVMKWLGHIQPSYLPLPELVKFVFFANLSIVGMNVSLMWNSVGFYQIAKLCIIPVLCILEILFDKVRYSRNTKLSIVLVLVGVAVCTVTDVSVNSKGLLAAVIAVWSTALQQHXXVFDCAHFDVF

SEQ ID NO: 4012 - protein, 646 aa, Oryza sativa
KEITRSSVADGVQEKLPPLNSPKPSSPRNPSQDAARFSISYKIPERRRRPRGVGRARRNISRRGAAMAGEVAIDSGEKRLNELGYKQELRREMTLFKTLAISFSTMTLFTGITPLYGSSLRYTGPASLVWGWVVVSFFTWFVGFAMAEICSSFPTTGSLYFWAAHLAGPVWGPLASWCCAWLEAIGLIAGIGTQAFAGSQVLQSIILLCTGTNKGGGYLTPRWLFLLMYIGLTFIWAVLNTFALEVIAFLDLISMWWQVIGGTVIVIVLPLVAKTTQPASYVFTHFETAPEATGIRSSAYATILSLLVSQYSLYGYDAAAHLTEETKGADKNGPIAILSSIGIITVFGWAYILALTFSIQDFSYLFDPSNETAGTFVPAQILFDAFHGRYGSSAGAIALLFVIWGSFFFGGLSITTSAARVVYALSRDRGVPLSSVWRRVHPRHRVPANAVWLCAAACALLGLPILWINVVFTAITSIATIGWVGGYAVPIFARMVMREEDFSPGPFYLRRASRPVCLVAFLWICYTCTVFLLPTAYPISAGNFNYAPVALGACLGLIGLWWVLDARRWFKGPVRNIDDPLKDGGGDGVHNNGNKMHYKEVMGHCEPNQCTNLLHGATQLSPVNDSGPGTSTVKLCQRSASTPGIF

SEQ ID NO: 4013 - protein, 253 aa, Oryza sativa
  unsure (1)..(253): unsure at all Xaa locations
MEAVAVHASFSSYSPPVVAGGRDDAGSSSSSSACRLACGIVTFVFATVGTILGAITGGLIGLATESGMVRGTGIGAISGAVVAMEVVDSSVAMWCSHDSGIWSVLYVLDVIWSLLTGRLVREKVDPAVQNAVDSQMNAADAPFRESAPTLAEMFDTGIPGVAAXPATGMPADASPRLPVTTFAXXPPGSGPAPAARVCLQDWRTAERARRLPECGHTFHLRCIDSWLLRHASCPLCRRTVVAAAVAVDDVVVG

SEQ ID NO: 4014 - protein, 816 aa, Oryza sativa
MGETTGERALNRLHSMRERIGDSLSAHTNELVAVFSRLVNQGKGMLQPHQIIAEYNAAIPEGEREKLKDSALEDVLRGAQEAIVIPPWIALAIRPRPGVWEYLRINVSQLGVEELSVPEYLQFKEQLVDGSTQNNFVLELDFEPFNASFPRPSLSKSIGNGVQFLNRHLSSKLFHDKESMYPLLNFLRAHNYKGMTMMLNDRIRSLDALQGALRKAEKHLAGITADTPYSEFHHRFQELGLEKGWGDCAQRVRETIHLLLDLLEAPEPSALEKFLGTIPMVFNVVILSPHGYFAQANVLGYPDTGGQVVYILDQVRAMENEMLLRIKQQGLNITPRILIVTRLLPDAHGTTCGQRLEKVLGTEHTHILRVPFRTENGTVRKWISRFEVWPYLETYTDDVAHEISGELQATPDLIIGNYSDGNLVRCLLAHKLGVTHCTIAHALEKTKYPNSDLYWKKFEDHYHFSCQFTADLIAMNHADFIITSTFQEIAGNKETVGQYESHMAFTMPGLYRVVHGIDVFDPKFNIVSPGADMSIYFPFTESQKRLTSLHLEIEELLFSDVENTEHKFVLKDKKKPIIFSMARLDHVKNLTGLVELYGRNPRLQELVNLVVVCGDHGKESKDKEEQAEFKKMFNLIEQYNLNGHIRWISAQMNRVRNGELYRYICDMRGAFVQPALYEAFGLTVIEAMTCGLPTFATAYGGPAEIIVHGVSGYHIDPYQNDKASALLVEFFEKCQEDPNHWIKISQGGLQRIEEKYTWKLYSERLMTLSGVYGFWKYVTNLDRRETRRYLEMLYALKYRKMATTVPLAIEGEASTK

SEQ ID NO: 4015 - protein, 501 aa, Oryza sativa
MQQRRKSVFASAPFAMKQAALGAGVAARRNGAPLSLAAVVFALFVFATFLYNEDIKSIADFPFGAGAPPDLHVLQETVGAAHLAAGSIAKRGEEVIRERDVTLPSVKEGGADEARRREDEEAAEKESSAKAAAATAALRTVVSVPDTCDLYRGNWVYDEVNAPVYKESQCEFLTEQVTCMRNGRRDDSYQKWRWQPTDCDLPRFDARLLLERLRNKRLMFVGDSLNRNQWESMVCLVQSVIPKGKKTLTKFTIRCMCYVQEYNATVEFYWAPFLVESNSDNPQVHSVPDRVIQWHSIAKHAHNWLGVDYLIFNTYIWWLNTLDMKVLKGSFDQGATEYVEVDRPVAYKEVLKTWAKWVDRNIDPNRTTVFFMSMSPNHITPEAWGNYGGIKCAMETLPITNRTTSLDVGTDWRLYAGAQEVLQTFRRVPVHLVDITALSELRKDAHTSVHTLRQGKLLTPEQQSDPKTYADCIHWCLPGLPDTWNQFLYARIASAPWSSDQ

SEQ ID NO: 4016 - protein, 454 aa, Oryza sativa
MASSLASASWVVLPPVQARVAAAVAVGPTCRVLLAYTPLLSGSARRRVVGRPLAPPRCSALEDPGPSDGGEGNGRVVEEGEEEVVRRKEQPRRRQRRRPVWRRILFASKKTRSIIILNALTVIYASDIPVLKEVEALTDPAVFNMVRFVVSAIPFIPFAIRAIGDRHVRNSGLELGLWVSLAYLCQAIGLISSDAGRASFLTAFTVIVVPLIDGIFGATIPKLTWFGAIVSLLGIGLLECGGSPPCVGDVLNFLAAVFFGIHMLRTEQISRSTDKKKFLALLSFEVLVVAFSSVLWFLFKDSYVDVNDTSFESWTFGMFLDTATSFPWIPALYTGVFSTVLCMWAEMVAMGDVSATETAIVYGLEPVWGAAFAWFLLGERWDNAAWVGAALVLCGSLTVQLFGSAPEKSKKVKTRSCNTLETPLKRQDYLSLSAIPVDSRKNIGSRLERKDKTL

SEQ ID NO: 4017 - protein, 279 aa, Oryza sativa
SCFSIVNYRCGITPNTVGNEMIAKLCIIPVLCILEILFDKVRYSRNTKLSIVLVLVGVAVCTVTDVSVNSKGLLAAVIAVWSTALQQHYVHHLQKKYSLGSFNLLGHTAPAQAASLLILGPFVDFWLTNRRVDTFNYTTIVTFFIVLSCTIAVGTNLSQFICIGRFTAVSFQVLGHMKTILVLTLGFLFFGKEGLNFHVVLGMMLAVIGMIWYGNASSKPGGKERQIYSVPSEKTQKSSQSELDQKPYAAMDCIQVIADIKPHTTLLTGQYVNNTTQQH

SEQ ID NO: 4018 - protein, 134 aa, Oryza sativa
SRLAGDEEVATASGGGGGDYDERKLRLLGYEPQLKRNLSLLSNFAVSFSIVSVLTGITTLFGTGLQFGGPATMVYGWPIAGAMTLVVGLAMAEICSAYPTSGGLYFWSARLCSHRRWGPFASWLTGWFLYCGNY

SEQ ID NO: 4019 - protein, 264 aa, Oryza sativa
  unsure (1)..(264): unsure at all Xaa locations
XWSLHGKMALVTGGTRGIGRAVVEELAGCWXGRPLHTWARNEAELGERLKEWEASGFRVTISVCDLSARDQRERLIGDVADRFGGKLDILVNNVGTNIRKPTTEYSADEYSFLMATNLESAYHLCQLGHPLLKASGSGSIVFISSVAGIVALFSGTIYAMTKGAMNQLTKNLACEWAKDNIRTNCVAPGYILTSLSEGILANKEFEGSVKSRTPLRRVGEPAEISSLVAFLCMPGSTYITGQTIAVDGGMTVNGLYPSXGGSHG

SEQ ID NO: 4020 - protein, 186 aa, Oryza sativa
  unsure (1)..(186): unsure at all Xaa locations
XXEAVCHLPPFVLRCLAAGLPGCRRLLSGSFCCHASIAIARPGLSIAMDPWHDVRASHFFDNSTHIIRSSLLMLLGGALAFFMVLTEYVLVSVTSAVTVTVAGIVKEAVTILVAVLFFNDTFTWLKGLGLGIIIFGVSLFNLYKYHRFKKGHRNKNCDKNPQTSSGASKYVILDXXDDMENQGNSG

SEQ ID NO: 4021 - protein, 217 aa, Oryza sativa
EGIQKKTESSNPEVRPRESHTGESLKKESLPTGSQGLLISESGNVPQINTSKGDFISRTSKEDAHMTGEKAKQSKVAASPKQNTVGGFSEDSTPTLVDVAKKHFPEHEASTSSMITTKGFADNDTGEGVIAGTSSMPISTEGVGWTAGSDEWRYDPSGAMTPYRHPHTQVMMPHEDTPAILESAELPTVGSTRFEEKIVVQETPEVIRTDGKDAELN

SEQ ID NO: 4022 - protein, 553 aa, Oryza sativa
  unsure (1)..(553): unsure at all Xaa locations
MAAWRRCRCPQALMIHESRADVHSPTVITIYPCSCRTRAPGPPVIDAMPFLSPPHSHAGGLGSREEEEEGHGMIGTSRRSPPASGEPAAAAAAMEYERIEKPXXPTQGGGFSPKRLRAMLLGVEKRRKGQEEEEEGXRRGGGRRVRRGAQVLCSMCEEYKDVDVVSTISESSSSLETGSGHRSRDTHSMGSRVNSCDSESVASNFEFHKERGASARSVTAAIVPPFSKPAPSKWDDAQKWIASPTTNRPGRAGGVPQRKMEKTSFGGGRLPATKVVLEATEEIDTKRVDPSQEKREIGWQKAVNWAPPDPYPEVETCAKSALAEEITVADSAVRSVSMRDMGTEMTPIASQEPSRTGTPVRATSPDCSRPTTRPNAIGAVIGHGECSNVELSEQELQMKTRREIMLLGTQLGKTNIAAWASNKEEEKDASLSLKGVPMDQSTQXGLSLYVFAKLSHXDRFKREEIKIQAWEDHQRAKIEAEMRKIEVDVERMRARAQDKLMSQLASARHTADEKRAAAELKRSRAAAKTAEQADHIRRTGRMPSSIGCWNWCS

SEQ ID NO: 4023 - protein, 491 aa, Oryza sativa
  unsure (1)..(491): unsure at all Xaa locations
MEYERIEKPFPTQVGGGFSPKRLRAMLLGVEKRRKGQEEEEEGXRRGGGRRVRRGAQVLCSMCEEYKDVDVVSTISESSSSLETGSGHRSRDTHSMGSRVNSCDSESVASNFEFHKERGASARSVTAAIVPPFSKPAPSKWDDAQKWIASPTTNRPGRAGGVPQRKMEKTSFGGGRLPATKVVLEATEEIDTKRVDPSQEKREIGWQKAVNWAPPDPYPEVETCAKSALAEEITVADSAGKVTFSRHDSSATLQSATTCIPPPPTVRSVSMRDMGTEMTPIASQEPSRTGTPVRATSPDCSRPTTRPNAIGAVIGHGECSNVELSEQELQMKTRREIMLLGTQLGKTNIAAWASNKEEEKDASLSLKGVPMDQSTQKVTEIRAAAWEEAEKAKYLARFKREEIKIQAWEDHQRAKIEAEMRKIEVDVERMRARAQDKLMSQLASARHTADEKRAAAELKRSRAAAKTAEQADHIRRTGRMPSSIGCWNWCS

SEQ ID NO: 4024 - protein, 489 aa, Oryza sativa
  unsure (1)..(489): unsure at all Xaa locations
MEYERIEKPXXPTQGGGFSPKRLRAMLLGVEKRRKGQEEEEEGXRRGGGRRVRRGAQVLCSMCEEYKDVDVVSTISESSSSLETGSGHRSRDTHSMGSRVNSCDSESVASNFEFHKERGASARSVTAAIVPPFSKPAPSKWDDAQKWIASPTTNRPGRAGGVPQRKMEKTSFGGGRLPATKVVLEATEEIDTKRVDPSQEKREIGWQKAVNWARAEPYPEVETCAKSALAEEITVADSAVTFSRHDSSATLQSATTCIPPPPTVRSVSMRDMGTEMTPIASQEPSRTGTPVRATSPDCSRPTTRPNAIGAVIGHGECSNVELSEQELQMKTRREIMLLGTQLGKTNIAAWASKKEEEKDASLSLKGVPMDQSTQKVTEIRAAAWEEAEKAKYLARFKREEIKIQAWEDHQRAKIEAEMRKIEVDVERMRARAQDKLMSQLASARHTADEKRAAAELKRSRAAAKTAEQADHIRRTGRMPSSIGCWNWCS

SEQ ID NO: 4025 - protein, 168 aa, Oryza sativa
FLNTKIGTNYIPVGAHFSNKACKKVCELSMSLPQIMKVTELPKLKAWPKSWEKASVPSAESIGLFFFSQNTRSNKEFDDLVKHVIDYDIVLETDVSFAKLLVFPSVVLPAEYRVFQGKHYLWGVFKRSKDMAERDALVEQNCTTCLADEDVPEQNALILCHVKPWIKK

SEQ ID NO: 4026 - protein, 206 aa, Oryza sativa
  unsure (1)..(206): unsure at all Xaa locations
MEEAEARPAPPDPNDARQRFLLELEFIQCLANPTYIHYLAQNRYFEDEAFIGYLKYLKYWQRPEYIKYIMYPHCLFFLELLQNANFRNAMAHPASKEVAHRQQYFFWKNYRNNRLKHILPRPPPEPTPXXPAPAPAAVPPSASVPSTVVPPVAAPPSALLPMSXAAGASAMSPMXQFAGTPGTNIPKNDMRNVXMGGQGGRKRKIG

SEQ ID NO: 4027 - protein, 233 aa, Oryza sativa
MEPEAMPAPDPNDARQRFLLELEFIQCLANPTYIHYLAQNRYFEDEAFIGYLKYLKYWQRPEYIKYIMYPHCLFFLELLQNANFRNAMAHPASKEVAHRQQYFFWKNYRNNRLKHILPRPPPEPTPAPAPAPAPATVPPAAPVPSTVVPPVAAPSSSLPPMSAAGASAMSPMQFAGTPGTNIPKNDMRNVMGGQGGRKRKTTAEKNKSHQNIYCWLSTRMAQGWIQGGNKPID

SEQ ID NO: 4028 - protein, 288 aa, Oryza sativa
  unsure (1)..(288): unsure at all Xaa locations
MAIGLAEDDDDTSKATVVVARSSVSARQRRMSGRRRGRTKNGAAHFAVSPELIQSRNRIYLRGTVSKELLTHKQVVHLSHKIKDGIWLQQQRSKLKEKLGNEPSYKQLAHSLKISPPELRSRMHESFLAREMLTMSNLRLVISIAQKYDNLGVELADLIQGGLIGLLRGIEKFDASRGFRISTYVYWWIRQGVSRALAENSKTFRLPTYLHERLIAIRGAKYELEDQGIAPTIENIAGSLNISEKKVLNATEYIEDQNVANDPWHGFEEWYLKEEVNKLLNSTLNERX

SEQ ID NO: 4029 - protein, 519 aa, Oryza sativa
MTATPAVIGLSAGNRLLSASFGPTDLMPDKVSLGVGGGGGGGGGGGGGDAMSFAAAPATPKLTAVAAHRLKLSPHGRAQVMRALRHHSSAAAALAPPPPPPPPPTPSPASRAAHAHDLESSLEAIVLLQRSMLEKQWELPFDDDNHAMAIGLAEDDDDTSKATVVVARSSVSARQRRMSGRRRGRTKNGAAHFAVSPELIQSRNRIYLRGTVSKELLTHKQVVHLSHKIKDGIWLQQQRSKLKEKLGNEPSYKQLAHSLKISPPELRSRMHESFLAREMLTMSNLRLVISIAQKYDNLGVELADLIQGGLIGLLRGIEKFDASRGFRISTYVYWWIRQGVSRALAENSKTFRLPTYLHERLIAIRGAKYELEDQGIAPTIENIAGSLNISEKKVLNATEAVNKVLSLDQQAFPSLNGLPGETLHSYIEDQNVANDPWHGFEEWYLKEEVNKLLNSTLNERERDIIRLYHGIGKQCHTWEDISRQFGLSRERVRQVGLIAMEKLKHAARRKNLEALLEDY

SEQ ID NO: 4030 - protein, 420 aa, Oryza sativa
  unsure (1)..(420): unsure at all Xaa locations
XLAVLSPCTDGFGNNHSPQEEAEAEAAEVRSPPAQGVESAVEATDRGEAPPEQPVAADSGASSAETPPESCDVYKGRWVYDEANAPLYKESACEFLTEQVTCMRNGRRDDDYQKWRWQPDGCDLPRFDAKLLLEKLRNKRLMFVGDSLNRNQWESMVCLVQSEAPWEKKSLVKNDSLNVFRLEEYNATIEFYWSPFLVESNSDDPNMHSIVDRIIKPTSIAKHAANWEGVDYLIFNTYIWWMNTPEMKILXGSFSKKPVKYDEMERVAAYRKVXKTWSRWVEKHVDPKRSTVFFMSVSPVHMQSEGWGKPDAIKCFSETQPAINYTKKLEVGTDWDLFSTAHHVTKAMKRVPVHFINITALSEIRKDAHTSVNTLRQGKLLTKEQKANPRKFADCIHWCLPGLPDTWNEFIYGHIVSSPQ

SEQ ID NO: 4031 - protein, 343 aa, Oryza sativa
  unsure (1)..(343): unsure at all Xaa locations
EEAEAEAAEVRSPPAQGVESAVEATDRGEAPPESCDVYKGRWVYDEANAPLYKESACEFLTEQVTCMRNGRRDDDYQKWRWQPDGCDLPRFDAKLLLEKLRNKRLMFVGDSLNRNQWESMVCLVQSEAPWEKKSLVKNDSLNVFRLEEYNATIEFYWSPFLVESNSDDPNMHSIVDRIIKPTSIAKHAANWEGVDYLIFNTYIWWMNTPEMKILRGSFSKKPVKYDEMERVAAYRKVXKTWSRWLXXHVTKAMXXRVPVHFINITALSEIRKDAHTSVNTLRQGKLLTKEQKANPRKFADCIHCMKKRQRRKTCKLMWKNIKNMKQLAAMLNFYYSFEEVNRT

SEQ ID NO: 4032 - protein, 422 aa, Oryza sativa
  unsure (1)..(422): unsure at all Xaa locations
XAMSPPEQPVAADSGASSAETPPSLLEQVTETPPPSPSSSSAAAAAAEAQVGGDHGGESCDVYRGRWVYDEANAPLYKESACEFLTEQVTCMRNGRRDDDYQKWRWQPDGCDLPRFDAKLLLEKLRNKRLMFVGDSLNRNQWESMVCLVQSEAPWEKKSLVKNDSLNVFRLEEYNATIEFYWSPFLVESNSDDPNMHSIVDRIIKPTSIAKHAANWEGVDYLIFNTYIWWMNTPEMKILRGSFSKKPVKYDEMERVAAYRKVLKTWSRWVEKHVDPKRSTVFFMSVSPVHMQSEGWGKPDAIKCFSETQPAINYTKKLEVGTDWDLFSTAHHVTKAMKRVPVHFINITALSEIRKDAHTSVNTLRQGKLLTKEQKANPRKFADCIHWCLPGLPDTWNEFIYGHIVSSPQRRPVEPIENQPQR

SEQ ID NO: 4033 - protein, 315 aa, Oryza sativa
  unsure (1)..(315): unsure at all Xaa locations
LNRTIVVQQTSQIFCANDVFHCVFXXAATTLTGLHFATTTLMTLVMKWLGHIQPSYLPLPELVKFVFFANLSIVGMNVSLMWNSVGFYQIAKLCIIPVLCILEILFDKVRYSRNTKLSIVLVLVGVAVCTVTDVSVNSKGLLAAVIAVWSTALQQHYVHHLQKKYSLGSFNLLGHTAPAQAASLLILGPFVDFWLTNRRVDTFNYTTIVTFFIVLSCTIAVGTNLSQFICIGRFTAVSFQVLGHMKTILVLTLGFLFFGKEGLNFHVVLGMMLAVIGMIWYGNASSKPGGKERQIYSVPSEKTQKSSQSELDQKV

SEQ ID NO: 4034 - protein, 324 aa, Oryza sativa
  unsure (1)..(324): unsure at all Xaa locations
LNRTIVVQQTSQIFCANDVFHCVFXXAATTLTGLHFATTTLMTLVMKWLGHIQPSYLPLPELVKFVFFANLSIVGMNVSLMWNSVGFYQIAKLCIIPVLCILEILFDKVRYSRNTKLSIVLVLVGVAVCTVTDVSVNSKGLLAAVIAVWSTALQQHYVHHLQKKYSLGSFNLLGHTAPAQAASLLILGPFVDFWLTNRRVDTFNYTTIVTVFLHSLNFQFFIVLSCTIAVGTNLSQFICIGRFTAVSFQVLGHMKTILVLTLGFLFFGKEGLNFHVVLGMMLAVIGMIWYGNASSKPGGKERQIYSVPSEKTQKSSQSELDQKV

SEQ ID NO: 4035 - protein, 192 aa, Oryza sativa
  unsure (1)..(192): unsure at all Xaa locations
PTRPDQRPGKEISRLSGALRGHQHPRLRSGFLLERQGDGXLGCSVVNXEQGRKKXXIEIRNALEMIHRGENVRFESIFYGGVDIHDRHRDMRLDIDNMSYEELLALEERIGNVSTGLSEEEVTKLLKQRKFSSWRLEASVEEEPCCICQEEYVDGDDLGTLDCGHDFHVGCVRQWLVVKNTCPICKNTALKS

SEQ ID NO: 4036 - protein, 482 aa, Oryza sativa
MAAAANGAACCGGATGPGYATPLEAMEKGPREKLLYVTCVYNGTGINKPDYLGTVDVDPNSPTYSQVIHRLPVTHVGDELHHSGWNACSSCHGDPSASRRFLILPSLLSGRVYVVDTLKDPRAPALHKVVEAEDIAEKTGLGFPHTSHCLASGEIMISCLGDKEGNAAGNGFLLLDSEFNVKGRWEKPGHSPLFGYDYWYQPRHKTMISSSWGAPAAFRTGFDLQHVQDGLYGRHLHVYDWPGGELKQTLDLGSTGLLPLEVRFLHDPSKDTGYVGCALTSNMVRFFKTADGSWSHEVAISIKPLKVRNWILPEMPGLITDFVISLDDRYLYLVNWLHGDIRQYNIEDPAKPVLAGQVWAGGLLQKGSEVVYVTEDDKEEQYSVPQVKGHRLRGGPQMIQLSLDGKRIYVTNSLFSRWDEQFYGQDLVKKGSHMLQIDVDTEKGGLSINPNFFVDFGAEPEGPSLAHEMRYPGGDCTSDIWI

SEQ ID NO: 4037 - protein, 340 aa, Oryza sativa
  unsure (1)..(340): unsure at all Xaa locations
MDHEADAYRTDLMTITRYVLNEQSRNPEARGDLTILLSHIVLGCKFVASAVNKAGLAKLIGLAGETNVQGEEQKKLDVLSNEVFVKALVSSGXRTCVLVSEEDEEATFVDPALRGKYCVCFDPLDGSSNIDCGVSIGTIFGIYMIKDKENVTLEDVLQPGKNMVAAGYCMYGSSCTLVLSTGNGVNGFTLDPSLGEFILTHPDIKIPKKGKIYSVNEGNAKNWDEPTAKFVEKCKFPKDGSSPKSLRYIGSMVADVHRTLLYGGVFLYPADKKSPNGKLRVLYEVFPMSFLMEQAGGQSFTGKERALDLVPTKIHERSPIFLGSFEDVEEIKGLYAAQAK

SEQ ID NO: 4038 - protein, 298 aa, Oryza sativa
MCDKDPGIKLFGRVIPMNNVEEKAASDSKDENEKTANDESGQDKVLKKPDKILPCPRCNSMDTKFCYYNNYNVNQPRHFCKNCQRYWTAGGTMRNVPVGAGRRKSKSSSLHYRHLLMAEQNGTNAAAVPTGENQEDNSCISSITSHNVLPENAAQVDKNSTPVYCNGVGPVPQYYLGAPYMYPWNIGWNNVPMMVPGTSMPDSPLGKHSRDSSLPLKEDKEEKSLWVPKTLRIDDPDEAAKSSIWATLGIKPGDPGIFKPFQSKGESKGQAASETRPARALKANPAALSRSQSFQETS

SEQ ID NO: 4039 - protein, 413 aa, Oryza sativa
  unsure (1)..(413): unsure at all Xaa locations
XMVSDENFEEQAARNGGIIKHGREILFQAFNWESHKHNWWSNLEEKVVDLAQSGFTSAWLPPPTQSLSPEGYLPQNLYXCLDSCYGSLHDLQALLRKMKEHNVRAMADVVINHRVGATQGSNGMYNRYDXGIPVSWDEHAVTSCSGGKGNESTGDNFDGVPNIDHTQPFVRKDIIDWLIWLRESIGFQDFRFDFTKGYAAKFVKEYIEQSKPLFAVGEYWDSCEYSPHRLNYNQDKHRQRIINWMDSTGGLCAAFDFTTKGILQEAVKGELWRLRDPEGKPPGVMGWWPSRSVTFVENHDTGSTQGHWPFPSDHIMEGYAYILTHPGIPTVFYDHFYGKDDSFHGGIAKLMEIRKCQDIHSRSAVKILEASSDLYSAIVDDKLCMKIGDGSWCPSGPEWKLAASGDRYAVWHK

SEQ ID NO: 4040 - protein, 247 aa, Oryza sativa
  unsure (1)..(247): unsure at all Xaa locations
SAADIQDFDRQTLVISWVNXLQWLIKLAIAMSKRSRSMWDMQEFVGSVDTARVLMLLAQQSQHGLLGGGGFAAGAQPVVVRGGAHDRVFECKTCNRQFPTFQALGGHRASHKRPRQQQQHALGGGAGADDAGLCLGRQPTPPRPQPAKPRVHECPVCGLEFPIGQALGGHMRRHRAEAEAAATTTTTTTKNGDVGKAAAVKACDGGGVCLDLNLTPSENRAKCRNVVGLGAGGQGVHKALAMLDCFL

SEQ ID NO: 4041 - protein, 171 aa, Oryza sativa
  unsure (1)..(171): unsure at all Xaa locations
LAIAMSKRSRSMWDMQEFVGSVDTARVLMLLAQQSQHXXVVVRGGAHDRVFECKTCNRQFPTFQALGGHRASHKRPRCLGRQPTPPRPQPAKPRVHECPVCGLEFPIGQALGGHMRRHRAEAEAAATTTTTTTKNGDVGKAVCLDLNLTPSENRAKCRNVHKALAMLDCFL

SEQ ID NO: 4042 - protein, 336 aa, Oryza sativa
  unsure (1)..(336): unsure at all Xaa locations
MAPGSKAERKAALDAGXAWMFNIVTSVGIIMVNKALMATHGFSFATTLTGLHFATTTLMTLVMKWLGYIQPSYLPVPELIKFVFFANLSIVGMNVSLMWNSVGFYQIAKLCIIPVLCFLEILFDKVRYSRDTKFSIMVVLVGVAVCTVTDVSVNSQGLIAAIIAVWSTALQQHYVHHLQRKYSLGSFNLLGHTAPAQAASLLVLGPFVDFWLTNKRVDTFNYTAIVTFFIILSCIIAVGTNLSQFICIGRFTAVSFQVLGHMKTVLVLTLGFLFFGKEGLNFHVAIGMILAVIGMIWYGNASSKPGGKERQVYSAPSEKTQKPNILSSQSELDQKV

SEQ ID NO: 4043 - protein, 209 aa, Oryza sativa
  unsure (1)..(209): unsure at all Xaa locations
XTRPANMLSISFGVAIAAYGEARFDARGVALQLAAVAFEATRLVLIQILLTSKGIPPRPITSLYYVAPCCLAFLVIPWAFVELPRLRAVGTFQPDFFIFGTNSLCAFALNLAVFLLVGKTSALTMNVAGVVKDWLLIAFSWSVIRDTVTPINLFGYGIAFLGVGYYNHVKLQALKAKEAQKKAAQADEEAGSLLQERDSHGERKSDNQA

SEQ ID NO: 4044 - protein, 203 aa, Oryza sativa
  unsure (1)..(203): unsure at all Xaa locations
MERAEDLRLSLSLSCLRGGGGSDEEDGGCGIDGSRKKLRLSKDQSAVLEDSFREHPTLNPRQKATLAQQLGLRPRQVEVWFQNRRARTKLKQTEVDCEFLKRCCETLTEENRRLQKEVQELRALKLVSPHLYMNMSPPTTLTMCPSCERVSNTNNNSXAPPPPPTAAASGLLLPQAAAASSTPPPTGASSATARSPSGRSSHX

SEQ ID NO: 4045 - protein, 138 aa, Oryza sativa; identical to SEQ ID NO: 1070

SEQ ID NO: 4046 - protein, 162 aa, Oryza sativa
  unsure (1)..(162): unsure at all Xaa locations
GLNLLRLLAQNKIAEFHVELELLSLKXLDYPCIKXYALNLEFSFMEGAYSQLFNARQTVPHEAYDFFIDLLAETIRDEIADCSAQAYDYLSISYAKKMLLFSCDQQLLKFISEAKHEWDVQNCLVLFDMAKSKPPAIPSLQQNKRSISYVKELDXPQTWTVI

SEQ ID NO: 4047 - protein, 438 aa, Oryza sativa
  unsure (1)..(438): unsure at all Xaa locations
EGGGVRRRXARLHVAMLALQLGYAGFHVVSRLALDMGVSKLVFPVYRNLIALFLLAPFAYFLEKKERPAMTASLAVQFFFLALCGITANQGFYLLGLENTSPTFASAIQNSVPAITFAMAAALRIERVRLSSRDGLAKVAGTLLCVAGASVITLFKGPAIFNTHHNHQPQPQQLAVAVAAGNKSWTLGCVFLLGHCVSWSGWLVLQAPVLKRYPARLSVTSYTCFFGLIQFLAIAAFLERDAAAWAVRSGSELFTILYAGFVASGVAFAVQTWCIHRGGPVFVAVYQPVQTLLVAVMASLLLGEQFHLGGIIGAVLIVAGLYLVLWGKSQERAIAAAKEASAAAAIADHQQQPASAAAADSCLKQPLLPASTVASENGVCTADSSCVVGDREVMHAANGERRRRRQEVGGELRRAGWHPAIDDGDRGREEAIARMVIM

SEQ ID NO: 4048 - protein, 1776 aa, Oryza sativa
MAHHVELELVAVVMKVVNLIEGHKQKGGNTRGKERKVWLHRSRAHTGSCNVRPRRGRKQPSSEAWRQPRTVWFTGESFSATCGPHQRHLARPMSRRAYGGRNPHHKPTKSTPTTNLTPTPSHSHLQEKGAGAHSGGGLEYATRGAPRYFYVFAPSFVRRETEPWTAERRRRDKWTWPRPAAADVTPGASQPRELVADEPPAPLTWTPAVRPCPSRLLFSRRSGQRLRRRRRRITVVVGLLVGEGGSRMCDKDPGIKLFGRVIPLAPEAEAAAAADGSDQPEAAAAAAAEVEPAAQDEDHHKETEERKYDEMKVDVPQEEEDNEMKVDAPQEKKDNEVTADVPEEKGNDEMRVDASESIESIEPVSRSTLDNKKEDQGQMNNVEEKAASDSKDENEKTANDESGQDKVLKKPDKILPCPRCNSMDTKFCYYNNYNVNQPRHFCKNCQRYWTAGGTMRNVPVGAGRRKSKSSSLHYRHLLMAPDCMMGSRVEISKSMNPEAFASAHSTPIQPIGRNETVLKFGPEVPLCESMASVLNIQEQNGTNAAAVPTGENQEDNSCISSITSHNVLPENAAQVDKNSTPVYCNGVGPVPQYYLGAPYMYPWNIGWNNVPMMVPGTSMPESASQSESCSTSSAPWMNMNSPMMPVASRLSAPPFPYPLVPPALWGCLSSWPATAWNIPWIRTNGGCMSPSSSSNSSCSGNGSPLGKHSRDSSLPLKEDKEEKSLWVPKTLRIDDPDEAAKSSIWATLGIKPGDPGIFKPFQSKERYRSIDEGLFASHLNPDQIFLYRSVREIPPNGVNRPPVVVVNFQGTYPRPGEEVDLHAVRNTIPCIPAHAVIYTFAQGGGRGVRHNRMLKKIASKEPQNTAELFELADRVACKEKAWTWNSSGSGAAAATPELAARNERRKKRRKKRSARSNDEGHVLAAKGVSRPQRKGKAAGGKQKDTGTSSGGRSADKWCSVHNTSHHNLADCRSVKNLAKRVKKYEQERKEGRREEKAPAAPSNTRQSEAKEKAPIEEPDDADLGFQEPQHVITTIDGGACAHASRRSFKAMKHELLATVPTHEAARWSRWSEVKLTFDQIDHPASAARGGQLALPLGHISLPVTFGGPSNFRTERIDFDVADLNLPYNAVLGRPALVKFMVAAHYAYLQLKMLGLGCPITVHGDVKIALACVELHASSLRSRGRRRKARGLNLTHARPVRQKVRRQASERQAFIREEVAHLLKASFIREVVHPEWLVNPDVVPKANDKLRMCIDYTNLQARYSQAQKMLYCATERVRGGVVKWAIELSEFDLHFELRYTIKSQALADFMAEWTPSVNPDPTLGPSAPELGDAPSHSQSTMHWVMNFNGSLTLQGAGAGVTLNSPTGDILKAAAKMGIRRLLVLGDSQLVVNQVSKEYQCFYPQMEAYIPEMGERLAHPSARLNPPAWEPDATMQPQEPDGVQAPGPAKASIDAPRQVAWMMEIQAFLQDATLPEDREGGERITRVSKRNVLVEETLFRRGANGVLLKCIPQKQGIELLTNVHEGECGAHASSRSLCRACQFHAKHAHQPAQALQTILLSWPFAVWGLDILGPFKKARRGYEYIYVAIDKFTKWPEAYPVVKIDKHSALKFIGGITARFGVPNRIVTNNGTQFTSELFGNNCDDMGIKLCFTSPAHSKSNGQVERANAEIFKGLETKTYNVLKKHGDSWIEELPAAVLPFELTLGSPRATMYAEADQDQLRRDDLNYLEEQSTGPYRMRTQLEPRPQSSRLGGSKKWVGTLRQSQNSQTYGYLDAGT

SEQ ID NO: 4049 - protein, 515 aa, Oryza sativa
MAPTASLLLSPRPLPASRRVPSLPALSASGRLRLRRARADTRLRVAAPPSVPGEADQAPGETEPSTSSADEKFVWRDHWYPVSLVEDLDPSVPTPFQLLNRDLVIWKDPKSGEWVALDDRCPHRLAPLSEGRIDETGCLQCSYHGWSFDGSGACTRIPQAAPEGPEAKAVRSPKACAIKFPTLVSQGLLFVWPDENGLPKEFEDPAFSTVTIQRDLYYGYDTLMENVSDPSHIEFAHHKVTGRRDRARPLPFKMESSGAWGYSGSNSGNPRISATFVAPCYALNKIEIDTKLPIFGDQKWVIWICSFNIPMAPGKTRSIVCSARNFFQFSMPGKAWWQLVPRWYEHWTSNLVYDGDMIVLQGQEKIFLSASKESSADINQQYTKITFTPTQADRFVLAFRAWLRKFGNSQPDWFGNPSQEVLPSTVLSKREMLDRYEQHTLKCSSCKGAYNAFQTLQKVFMGATVAFCATAGIPADVQFRLLLAAAALVSAAVAYAFYTLQKNFVFVDYVHAEID

SEQ ID NO: 4050 - protein, 150 aa, Oryza sativa
MAAFNKLGSFLRHSGLTSSASAGSSPAMFNAARLMSTKLFVGGLSWNTNDDSLKEAFTSFGDVTEARVINDRESGRSRGFGFVSFANGDDAKSAMDAMDGKELEGRSIRVNFANERPPGNRGGGGYGGGGGGYGNQGGYGDGNRGYGGQY

SEQ ID NO: 4051 - protein, 797 aa, Oryza sativa
  unsure (1)..(797): unsure at all Xaa locations
MSVRSRDVGSGDSALVRPRRRCRDVFWLVVFLLHLLVFGGALALTGLNRFGQADRFNIDRFTNLTVTPKSELTESYWPYYGAAGAVGTALAWAWLAAAAGKKDGGRVVMRAAVHSLTAYLAVVSVLCFWGKHFFWGVAFAVGGALHFLYVMSVLDRFPFTMLVLQKAVRMVWELPDVMRIAYAFVLVMLCWMALWSFGVSGILAFHIPNGGQWWALLIFSVSLFWTGAVLSNTVHVIVSGMVFLVLIHGGQXXAASMPPKPLLKSLQYAVTTSFGSICYGSLFTAAIRTLRWEIRGIRSKIGNNECLLCCVDFLFHIVETLVRFFNKYAYVQIAINGQSFNRSARDAWELFQSTGVEALVAYDCSGAVLLMSTIXXGTCTGVWTYFKQSDKAIMVGSTSMLMGMILVGVTVVVVESAVTSIYICYAEDPRLIQRWDPDFFDQMSEALHQRLQYRMKLEHSNQVKARCFAKIAVSFWTLASDSLDPRITKKQGLASQTKARRRVAGGGWGPGDDLTPVTHGATPHPAPPRGRRLDQHHQPADQSYLTPKKVPTHSTSTLVYYRSDLLRLKIRETWSLTGETIFMGSHVQIKKLLSRFGNITCFLYRADLTTVCWPVRSLLEDRSDRQCVAAMFSTFLFYYIFVDLRCKSSAVAARVVRLPLYRARATHVNTVGATRPALHHDWFSESPNKCNYPLEKLGERLRSEGIKCLTTDSSRNCVIGAEPGIAGPERLGHRNLDHLRAGKRKPPRPDLPNEEGHPVERINTPKGPPAFPQKRGDPQLTAHGNIRPYGQVVRLSF

SEQ ID NO: 4052 - protein, 504 aa, Oryza sativa
  unsure (1)..(504): unsure at all Xaa locations
PSSYSSSPSSSSPPSQARTLAPAPRGLRRRRRSGVGVGAAAWPRRRCRDVFWLVVFLLHLLVFGGALALTGLNRFGQADRFNIDRFTNLTVTPKSELTESYWPYYGAAGAVGTALAWAWLAAAAGKKDGGRVVMRAAVHSLTAYLAVVSVLCFWGKHFFWGVAFAVGGALHFLYVMSVLDRFPFTMLVLQKAVRMVWELPDVMRIAYAFVLVMLCWMALWSFGVSGILAFHIPNGGQWWALLIFSVSLFWTGAVLSNTVHVIVSGMVFLVLIHGGQXXAASMPPKPLLKSLQYAVTTSFGSICYGSLFTAAIRTLRWEIRGIRSKIGNNECLLCCVDFLFHIVETLVRFFNKYAYVQIAINGQSFNRSARDAWELFQSTGVEALVAYDCSGAVLLMSTILGGLITGTCTGVWTYFKQSDKAIMVGSTSMLMGMILVGVTVVVVESAVTSIYICYAEDPRLIQRWDPDFFDQMSEALHQRLQYRSARAHQILNSRLDQLPNTSSI

SEQ ID NO: 4053 - protein, 304 aa, Oryza sativa
  unsure (1)..(304): unsure at all Xaa locations
XTRRDLPYGYDVLVENLMDPAHVPYAHKGLMRTRKKEDPVDKEGGGPLKMEIEETNVEGFLSMLADAWVKFVAPCTFYGSPLQTPSQDDQGKEKKKKQPTVMLVFLCIPVSPGRSRLVWAFPRNVGVWMDKIIPRWYYHIGQNAILDSDIYLLHIEERNFATVGLDNWQKACYVPTSSDNMIITFRNWFRKYCKHQIGWATPITNQLPPTPSKDQLLDRYWSHVMQCTSCSGALKKMKALEVALQVASVAVVGFLAVAKGTVVTSVVQRSAVVAAAVLCFAASRWLANFIEKNFYFQDYVHAYK

SEQ ID NO: 4054 - protein, 385 aa, Oryza sativa
  unsure (1)..(385): unsure at all Xaa locations
HRHRTEGGGFLPLVAFVLSPSLGSRGGGHGRRXGDGGRQXMAGTAAALGLSVVSSVSIVVCNKALMSTLGFVFATTLTSWHLLVTFCSLHVALQMKLFENKDLDPKTIIGFGILNGISIGLLNLSLGFNSIGFYQVTKLAIIPCTVSLETILFRKTFSRRIQMALAVLLFGVGVATVTDLQLNRLGSLLSLFAVLTTCISQIMTNFIQKKFKVSSTQLLYQSCPYQALTLFIIGPFLDGFLTNQNVFAFKYTSEILVFIVLSCLISVSVNFSTFLVIGKTSPVTYQVVGHLKTCIILGFGYVLFNDPFSWRNILGILLALLGMILYSFFCLMENKQKAPELSAPFLQVKGGEAGTLLLVQNGSAKVADGVVTEGPMWRSNRDLDA

SEQ ID NO: 4055 - protein, 122 aa, Oryza sativa
MLLHNYVIPRGTNFVFSLNEKLSELKATTKGYLDEQFCQVEDLQDEANPNFAEEVVSLFFKDSTRVMLNFEQAIIGASRVKNECTSFRNFCGEENAEGCTRSFQKVKREHAVLRQKWESYFQ

SEQ ID NO: 4056 - protein, 144 aa, Oryza sativa
  unsure (1)..(144): unsure at all Xaa locations
VCWFNKSFCIXQGYLDEQFCQVEDLQDEANPNLGREVVSLFFKDSARVMLNFEQAIEKHPKDFARWDTHMQQLKGSCSSIGASRVKNECTSFRNFCGEVYAEGCTRSFQKVKREHAVLRQKWESYFQLLRQAGPAGTATRPAGK

SEQ ID NO: 4057 - protein, 374 aa, Oryza sativa
MAAAATTSSHLLLLSRQQAAASLQCGLSFRRQPGRLAGGSSAPSVRCMAAVDTASAPAATEASKKSSYEITTLTTWLLKQEQAGTIDGEMTIVLASISTACKQIASLVFSNCLKSSGRTGVIASEEEDVPVAVEESYSGNYIVVFDPLDGSSNIDAAVSTGSIFGIYSPNDECLADIADDQNLDQVEQRCIVSVCQPGSNLLAAGYCMYSSSVIFVLTIGTGVYVFTLDPMYGEFVLTQEKVQIPKAGKIYAFNEGNYALWDDKLKSYMDSLKEPGPSGKPYSARYIGSLVGDFHRTLLYGGIYGYPRDQKSKNGKLRLLYECAPMSFIVEQAGGKGSDGHQRILDIMPTEIHQRVPLYIGSVEEVEKVEKFLA

SEQ ID NO: 4058 - protein, 389 aa, Oryza sativa
MAAAATTSSHLLLLSRQQAAASLQCGLSFRRQPGRLAGGSSAPSVRCMAAVDTASAPAATEASKKSSYEITTLTTWLLKQEQAGTIDGEMTIVLASISTACKQIASLVQRAPISNLTGVQGAVFSNCLKSSGRTGVIASEEEDVPVAVEESYSGNYIVVFDPLDGSSNIDAAVSTGSIFGIYSPNDECLADIADDQNLDQVEQRCIVSVCQPGSNLLAAGYCMYSSSVIFVLTIGTGVYVFTLDPMYGEFVLTQEKVQIPKAGKIYAFNEGNYALWDDKLKSYMDSLKEPGPSGKPYSARYIGSLVGDFHRTLLYGGIYGYPRDQKSKNGKLRLLYECAPMSFIVEQAGGKGSDGHQRILDIMPTEIHQRVPLYIGSVEEVEKVEKFLA

SEQ ID NO: 4059 - protein, 230 aa, Oryza sativa
  unsure (1)..(230): unsure at all Xaa locations
XDHQRLVVPSSASSMPKGRCSEGESESDSEASDVSGSDGEDHSWISWYCSLRGNEFFCEVDDDYIQDDFNLCGLSSQVPYYDYALDLILDIESSHGDMFTEEQNELVESAAEMLYGLIHARYILTSKGLAAMLEKYKNYDFGRCPRVYCCGQPCLPVGQSDIHRSSTVKIYCPKCEDIYYPRSKYQGNIDGAYFGTTFPHLFLMTYEHLKPQKPSQRYVPRVFGFKLHKP

SEQ ID NO: 4060 - protein, 407 aa, Oryza sativa
MAAAATTSSHLLLLSRQQAAASLQCGLSFRRQPGRLAGGSSAPSVRCMAAVDTASAPAATEASKKSSYEITTLTTWLLKQEQAGTIDGEMTIVLASISTACKQIASLVQRAPISNLTGVQGAVNVQGEDQKKLDVVSNEVFSNCLKSSGRTGVIASEEEDVPVAVEESYSGNYIVVFDPLDGSSNIDAAVSTGSIFGIYSPNDECLADIADDQNVLDQVEQRCIVSVCQPGSNLLAAGYCMYSSSVIFVLTIGTGVYVFTLDPMYGEFVLTQEKVQIPKAGKIYAFNEGNYALWDDKLKSYMDSLKEPGPSGKPYSARYIGSLVGDFHRTLLYGGIYGYPRDQKSKNGKLRLLYECAPMSFIVEQAGGKGSDGHQRILDIMPTEIHQRVPLYIGSVEEVEKVEKFLA

SEQ ID NO: 4061 - protein, 372 aa, Oryza sativa
  unsure (1)..(372): unsure at all Xaa locations
MPIYLETRGTSRISLVVHHIRRRTHSSSSSRLRFQRGGGAEQRRGMAAAQGSGVPAALALSSGHTMPSVGLGVWRMDSPAIRDLIHSALRIGYRHFDCAADYQNEAEVGDALAEAFQTGLVKREDLFITTKLWNSDHGHVVEACKDSLKKLRLDYLDLYLIHFPVATRHTGVGTTASALGDDGVLDIDTTISLETTWHAMEXDLVSMGLVRSIGISNYDIFLTRDCLAYAKIKPAVNQIETHPYFQRDCLVKFCQKHGILVTAHTPLGGSTANTEWFGSVSCLDDPVIKSLAEKYGKTAEKYGKTPAQLVLRWGLQRNTVVIPKTSKEERLQENFAVFDFAISDEDMEKMRSIDRKYRTNQPAKFWGIDLFA

SEQ ID NO: 4062 - protein, 635 aa, Oryza sativa; identical to SEQ ID NO: 904

SEQ ID NO: 4063 - protein, 207 aa, Oryza sativa
  unsure (1)..(207): unsure at all Xaa locations
MALGGAVEYGQLVHGAAAPVAPAKLYRGVRQRHWGKWVAEIRLPRNRTRLWLGTYDTAEDAALAYDGAAFRMRGDAARLNFPELRRGGRHHAPXXLSASVDAKILQATTTTTADTAAADRRRRTPRRRRRRASSRPXPGCCSVSEASTTTTADAADVSSTGSSPSPTSSNQAATATPPAPRPPPPLPETFALRRYPSWEIDWDAILS

SEQ ID NO: 4064 - protein, 109 aa, Oryza sativa
  unsure (1)..(109): unsure at all Xaa locations
MALEKAXRHLASSSPVFIFSKTYCGFCDRVKXQLFKQPGASYQLLNMDKEQDGDAIQAALHEWTGQRTRPNVFIGXKHIGGCDAVTAKHSPXGQLVPLLTEALPITREI

SEQ ID NO: 4065 - protein, 273 aa, Oryza sativa
  unsure (1)..(273): unsure at all Xaa locations
MLLNKMNGGXDIMNDDWKDILDATATDSQSKSMAQPSNSAASQPAFNQSTSSHSGDICPVTSPPPNNSNASASKQRMRWTPELDESFVHAVNXLGGSEKATPKGVLKLMKVDGLTIYHVKSHLQKYRTARYKPDLSEGLXXQLGSSLTCILFIHILTSMDLTEALRLQMEVQKRLHEQLEIQRKLQLRIEEQGKYLQKMFEKQCKSSTQSVQDPSSDSEAALDPNRIGDNHPKNSTNVGANLKTAATESPDSPVIATDGSELPQEKRRRVHES

SEQ ID NO: 4066 - protein, 396 aa, Oryza sativa
  unsure (1)..(396): unsure at all Xaa locations
MSEHDFENAQNGQNGKVTKNHNAIAFQLSSRPGMEREKTTGASQQNIFTISDVRLHRRTAAYKRYIYGGTLKGMMIRTVGAPPPHPRASPATNIVSSLCSIQRSLSQREAGLWAAEAVMAGIVDFEEGWRLLATSLAKQRSIIDGXXVYNMCTQKPPHNXAQQLYERYKTDIDGYNSSXXWRNHKKIVISETRFFFYLDRYYILRKSLVPLEQLNLCSFRDQVYSELKDKITRTVVDMINDERDGKVIDRDLLKDVLDVYVQIGLGMECYEVDFENAFRESTRNYYSNKAQTSILESDSPEYMLKAVECLQAELERVSHYLHSSTEPKLMQEKTWSILVXXELRLADHDHAERRNARREDEVCNLAAPEPKHHCYRQSQSPTAQLFKQELTRDGTX

SEQ ID NO: 4067 - protein, 219 aa, Oryza sativa
  unsure (1)..(219): unsure at all Xaa locations
MAGIVDFEEGWRLLATSLAKQRSIIDGSMSKSSSEDDNMQLYMMVYNMWRNHKKIVISETRFFFYLDRYYILRKSLVPLEQLNLCSFRDQVYSELKDKITRTVVDMINDERDGKVIDRDLLKDVLDVYVQIGLGMECYEVDFENAFRESTRNYYSNKAQTSILESDSPEYMLKAVECLQAELERVSHYLHSSTEPKLMQDLQSELMITPVETHTEEADX

SEQ ID NO: 4068 - protein, 359 aa, Oryza sativa
  unsure (1)..(359): unsure at all Xaa locations
XGVGSEQRGGRGGGEAXDGGEERLRHVGVVGAQXGEASGAAIAPAEEGSSSTPPSPPPXSRGGARVQHPEELGVGVGRERRRXDDEEEEATPSPPPHHQHQQLLVTRELFPSAAPSPQHWGSSASSAPTHRAHTQTSESSPTRLPRRHRRRRRSRSXQAAKKSRRGPRSRSSQYRGVTFYRRTGRWESHIWDCGKQVYLGGFDTAHAAARAYDRAAIKFRGVEADINFNLSDYEEDMRQMKSLSKEEFVHVLRRQSTGFSRGSSKYRGVTLHKCGRWEARMGQFLGKKYIYLGLFDSEVEAARAYDKAAIKCNGREAVTNFEPSTYDGELPTDAAAQGADVDLNLRISSSSSRHHHHHX

SEQ ID NO: 4069 - protein, 314 aa, Oryza sativa
MSICSDEGYPYNLDFDYGALGQLQHFSINNLGDPFIESNYGVHSRQFEVGVLDWFARIWELEKNEYWGYITNCGTEGNLHGTTVKGAVDDLDLVIKTLEEGGFKDRFYIHCDGALFGLMIPFVKKAPKVSFKKPIGSVSVSGHKFVGCPMPCGVQITRLEHINRLSSNVEYLASRDATIMGSRNGHAPIFLWYTLNRKGYRGFQKEVQKCLRNAHYLKDRLKEAGIGAMLNELSSTVVFERPKDEEFVRRWQLACEGNIAHVVVMPSVTIDKLDYFLNELTEKRATWYQDGSCQPPCLAKDVGEENCLCSIHKK

SEQ ID NO: 4070 - protein, 378 aa, Oryza sativa
  unsure (1)..(378): unsure at all Xaa locations
XEGYPYNLDFDYGALGQLQHFSINNLGDPFIESNYGVHSRQFEVGVLDWFARIWELEKNEYWGYITNCGTEGNLHGILVGREVFPDGILYASRESHYSVFKAARMYRMDCVKVDTLISGEIDCEDFQRKLLLNRDKPAIINVNIGTTVKGAVDDLDLVIKTLEEGGFKDRFYIHCDGALFGLMIPFVKKAPKVSFKKPIGSVSVSGHKFVGCPMPCGVQITRLEHINRLSSNVEYLASRDATIMGSRNGHAPIFLWYTLNRKGYRGFQKEVQKCLRNAHYLKDRLKEAGIGAMLNELSSTVVFERPKDEEFVRRWQLACEGNIAHVVVMPSVTIDKLDYFLNELTEKRATWYQDGSCQPPCLAKDVGEENCLCSIHKK

SEQ ID NO: 4071 - protein, 383 aa, Oryza sativa
MGNNASSTVMRMATCGKPDQGYCTWWPCEHNGHFVVVMGDFKDIACVSLIEAAPAAAYPRLWLLLAAPKPISPHPPPRPLDSRASSPISIHHPSSQRRRPTACFRLKDSSEMTSSMSKSDKKKVLDFAAWSFNITTSVGIIMVNKALMATHGFSFGLSQPSHLPIPDLIKFVIFSNLSIVGMNVSLMWNSVGFYQIAKLCMIPASCLLEVVFDRVHYSRDTKLSIMVVLIGVAVCTVTDVSVNAKGLAAAVIAVWSTALQQYFFLTLSCVIAIGVNLSQFICIGRFSAVSFQVLGHMKTVLVLSLGFLFFGKEGLNFQVVLGMILAVVGMIWYGNASAKPGGKERRSVLPVRSEKPNGALDEKDGSMIYKGNLAWRLRLVLKP

SEQ ID NO: 4072 - protein, 473 aa, Oryza sativa
  unsure (1)..(473): unsure at all Xaa locations
MSGVVAGRGVTRSRRAGAATDEEKETITESRASFWEMKRCRRYAVSNCRSNHVRDSSSPLSWAVSNKYTAMGLVLGQTKEEGVPDIIGADLGESGFRCKNNKKRKEKKNKNEKAPRPRHRQPPPTSSIRRAAVAAAVLGVDLFKSGGNSSEMASSLSKSDKKKVLDFAAWSFNITTSVGIIMVNKALMATHGFSFATTLTGLHFVTTTLMTIVFRWLGLSQPSHLPLPDLIKFVIFSNLSIVGMNIAKLCMIPASCLLEVVFDHVHYSRDTKLSIMVVLIGVAVCTVTDVSVNAKGLAAAVIAVWSTALQQYYVHFLQRKYSLNSFNLLGHTAPAQAGSLLLVGPFVDFLLTGKRVDHFGFTSIALFFLTLSCVIAIGVNLSQFICIGRFSAVSFQVLGHMKTVLVLSLGFLFFGKEGLNFQVVLGMILAVVGMIWYGNASAKPGGKERRSVLPVRSEKPSGALDEKDGSEKX

SEQ ID NO: 4073 - protein, 344 aa, Oryza sativa
  unsure (1)..(344): unsure at all Xaa locations
MASSLSKSDKKKVLDFAAWSFNITTSVGIIMVNKALMATHGFSFATTLTGLHFVTTTLMTIVFRWLGLSQPSHLPLPDLIKFVIFSNLSIVGMNVSLMWNSVGFYQIAKLCMIPASCLLEVVFDHVHYSRDTKLSIMVVLIGVAVCTVTDVSVNAKGLAAAVIAVWSTALQQYYVHFLQRKYSLNSFNLLGHTAPAQAGSLLLVGPFVDFLLTGKRVDHFGFTSIALFYLTMAFLSFXQFFLTLSCVIAIGVNLSQFICIGRFSAVSFQVLGHMKTVLVLSLGFLFFGKEGLNFQVVLGMILAVVGMIWYGNASAKPGGKERRSVLPVRSEKPSGALDEKDGSE

SEQ ID NO: 4074 - protein, 342 aa, Oryza sativa
  unsure (1)..(342): unsure at all Xaa locations
MTSSMSKSDKKKVLDFAAWSFNITTSVGIIMVNKALMATHGFSFATTLTGLHFVTTTLMTIVFRWLGXLSQPSHLPIPDLIKFVIFSNLSIVGMNVSLMWNSVGFYQIAKLCMIPASCLLEVVFDRVHYSRDTKLSIMVVLIGGAGCTVTDVSVNAKGLAAAVIAVWSTALQQYYVHLLQRKYSLNSFNLLGHTAPAQAGSLLLVGPFVDFLLTGKRVDHFGFTSIALLTMVFIVPQFFLTLSCVIAIGVNLSQFICIGRFSAVSFQVLGHMKTVLVLSLGFLFFGKEGLNFQVVLGMILAVVGMIWYGNASAKPGGKERRSVLPVRSEKPNGALDEKDGSE

SEQ ID NO: 4075 - protein, 196 aa, Oryza sativa
MSRSSLAMALLLAAFAAAATANSGAAPAASDFIRKSCRATQYPAVCVQSLASYGGAAPRSPRELARAALSVSVDKARSASTYVGHICGPGGGRGGAVGAGPVRDCLENMADSVGHLRDAAQELGDMGHAGSPGFKWHLSNVQTWCSAALTDENTCLDGLSRGVDAATRSAIRGKIVEVAQVTSNALALVNRVAPAN

SEQ ID NO: 4076 - protein, 607 aa, Oryza sativa
  unsure (1)..(607): unsure at all Xaa locations
MNHNICKNIPVIMMSSNDAMGTVFKCLSKGAVDFLVKPIRKNELKNLWQHVWRRCHSSSGSGSESGIQTQKCAKSKSGDESNNNNGSNDDDDDDGVIMGLNARDGRDNGSGTEAQSSWTKRAVEIDSPQAMSPDQLADPPDSTCAQVIHLKSDICSNRWLPCTSNKNPTKQKETNDDXXKGKDLEIGSPRNLNTAYQSSPNERSIKPTDRRNEYPLQNNSKEAAMENLEESSVRAADLIGSMAKNMDAXXQAARAANAPNCSSKVPEGKDKNRXXNIMPSLELSLKRSRSTGDGANAIQEEQRNVLRRSDLSAFTRYHTPVASNQGGTGFMGSCSLHDNSSEAMKTDSAYNMKSNSDAAPIKQGSNGSSNNNDMGSTTKNVVTKPSTNKERVMSPSAVKANGHTXQHFILHSTGRLQLIQQEKKRPPQCGSSNVFDPPVEGHXXANYGVNGSNSGSNNGSNGQNGSTTAVNAERPNMEIANGTINKSGPGGGNGSGSGSGNDMYLKRFTQREHRVAAVIKFRQKRKERNFGKQVRYQSRKRLAEQRPRVRGQFVRQAVQDTTDNDSSSLADRSTTSHASGIPPPLIPSYLESGINKELLSYLSPIYI

SEQ ID NO: 4077 - protein, 103 aa, Oryza sativa
  unsure (1)..(103): unsure at all Xaa locations
XAAAAGGPSLADRFRSRFRPARFGRRRGGGAGAADCRVCLARFEPESVVNRLPCGHLFHRACLEKWLDYDHATCPLCRHRLLPATTESPSPSPATATPHFARI

SEQ ID NO: 4078 - protein, 887 aa, Oryza sativa
MAPAAHRDGAAEAVGQRVFHFGKGRSDGNKTMKDLLGGKGANLAEMASIGLSVPPGFTVSTEACQQYQAQKAMPAGLWDEILAALTWVEGNMGAVLGDPRRPLLLSVRSGAAVSMPGMMDTVLNLGLNDHVVAGLAHRSGERFAYDSYRRFLDMFGNVVMDIPHSLFEEKIEAMKAALGLRNDTELTARDLKELVAQYKNVYVEAKGEEFPSDPKKQLHLSVLAVFNSWDSARAKKYRSINQITGLKGTAVNVQCMVFGNMGDTSGTGVLFTRNPSTGERKLYGEFLVNAQGEDVVAGIRTPQDLDTMKDCMPEPYAELVENCKILESHYKEMMDIEFTVQENRLWMLQCRTGKRTGKGAVKIAVDMVNEGLIDRRSAIKMVEPRHLDQLLHPQFESQSSYGDKVIATGLPASPGAAVGQIVFTADDAEAWHAQGKSVILVRTETSPEDVGGMNAAAGILTARGGMTSHAAVVARGWGKCCVAGCSGIRVNDAEKVVLVADKVLCEGEWLSLNGSTGEVILGKLPLSPPALSGDLGEFMSWVDEVKKLKVKANADTPADALTARNNGAEGIGLCRTEHMFFSSDERIKAMRQMIMAETIEHRQIALDRLLPYQRLDFEGIFRAMDGLPVTIRLLDPPLHEFLPEGNVEDMVRLLSSGNVYTQEEILTRIEKLSEVNPMLGFRGCRLGISYPELTAMQARAIFEAAISMTEQGVKVFPEIMVPLIGTPQELAQQVDVIREVAEKVFANAETTISYKIGSMIEVPRAALIADEIAALAEFFSFGTNDLTQMTFGYSRDDVGKFLPTYLSKGILQNDPFEVFDQKGVGELVKVAVERGRKARPDLEVGICGEHGGEPSSVAFFAKVGLNYVSCSPFRVPIARLAAAQVIL

SEQ ID NO: 4079 - protein, 480 aa, Oryza sativa
MYKAKRTAAQKVRRCLGKYELGRAIGQGTFAKVRFAKNMETGDHVAIKILDKAKVQKHRLVEQIRREICTMKLIQHPNVVHLHEVMGSKTRIFIVLEYVMGGELHDIIATSGRLKEDEARKYFQQLINAVDYCHSRGVYHRDLKLENLLLDTAGNIKVSDFGLSAISEQVKADGLLHTTCGTPNYVAPEVIEDKGYDGALADLWSCGVILFVLLAGYLPFEDENIVSLYNKISGAQFTCPSWFSAEAKRLIARILDPNPATRITTSQVLQDQWFKKGYESPVFDDKYYPYFHDVYDAFGDSEEKHVKEAMEEQPTLMNAFELISLNKGLNLDNFFESDKKYKRETRFTSQCPPKEIINRIEEAANLLGFNIQKRNYRMRMENIKEGRKGHLNIATEVFQVAPSLHVVELKKAKGDTLEFQKFYQTLSTQLKDVVWELEDAAEDTSRQCQDCQLPYSSCNLLHQVFTGLCHGITLRWLLHN

SEQ ID NO: 4080 - protein, 181 aa, Oryza sativa
  unsure (1)..(181): unsure at all Xaa locations
XIFALGTVGLSVAQGAKLRGASIIIGVDTNPEKQEKGKAFGVTDFINPEELNEPVQQVVKRLTNGGADYSFECVGDTGVVSTALQSCSDGWGLTVTLGVPKAKPEVSAHYALLLSGRTLKGSLFGGWRPKSDLPLLVDKYANKEIQVDDLVTHDLSFDYINKALELMLENKCLRCVIHMPQ

SEQ ID NO: 4081 - protein, 342 aa, Oryza sativa
  unsure (1)..(342): unsure at all Xaa locations
WRRMVEEGRXTGGDADVVGGHRHHVCLQGHEPFVSYEGLEQLHRFLFILGITHVLYTFVTVVLSMIKLCFLRQFRRSIKKSDYMALRLGFITYHKLPHSYNFHKYMVRSMEDDYNGSVGISWPLWAYAIICIFVNIHGLNIYFWISFAPAILVLLVGTELQHVIAQLALEVVGATAPYVGTQLKLRDDLFWFGKPRVLWWLIQFISFQVIFFCFTPYQNAFEMATFVWSLFWCSYNTLPLNVIITQMGSKFKKSLVSESVRESLHSWCKRVKDKNRHNLASRSVCSLDTTYEETDHETATVGTLSRTVSATSLDEELTVATVEDNDDDEEMSRIEQEIDRSL

SEQ ID NO: 4082 - protein, 432 aa, Oryza sativa
  unsure (1)..(432): unsure at all Xaa locations
MLLLICLCATFCLMTQLGAANVVLMGTNLTLSFDDVEASFAPGVKGSGFEGVVYTAEPLDACSPLTSKAEKGPXXSPFALIIRGGCTFDEKVKNAQDAGFKAAIVYDNENSGVLISXXSGEVLKKFSGHTDVEVWILPAFENSAWSIMAISFISLLAMSAVLATCFFVRRHHIRRDRPRIPEAREFHGMSSQLVKAMPSLIFTKVQEDNCTSSMCAICLEDYNVGEKLRVLPCRHKFHAACVDLWLTTWRTFCPVCKRDASTGIPDPPASETTPLLSSXSSFXXSQSSSFRSSVAASPPRLSRRPSSQSISXDYAASGTPNSPNPIRSFTNSTAMSISRSNVDLSNMSSRPRASPSAHSLVGSHLSPPINIRYASPHMSHSGYASPSPHVSSRXNLAGASSGQSFRQSYLRHCADSDASLSAMASAQSLPGC

SEQ ID NO: 4083 - protein, 434 aa, Oryza sativa
  unsure (1)..(434): unsure at all Xaa locations
ICLCATFCLMTQLGAANVVLMGTNLTLSFDDVEASFAPGVKGSGFEGVVYTAEPLDACSPLTSKAEKGPXXSPFALIIRGGCTFDEKVKNAQDAGFKAAIVYDNENSGVLISMAGSSGGIHIYAVFISKASGEVLKKFSGHTDVEVWILPAFENSAWSIMAISFISLLAMSAVLATCFFVRRHHIRRDRPRIPEAREFHGMSSQLVKAMPSLIFTKVQEDNCTSSMCAICLEDYNVGEKLRVLPCRHKFHAACVDLWLTTWRTFCPVCKRDASTGIPDPPASETTPLLSSXSSFXXSQSSSFRSSVAASPPRLSRRPSSQSISXDYAASGTPNSPNPIRSFTNSTAMSISRSNVDLSNMSSRPRASHLASAHSLVGSHLSPPINIRYASPHMSHSGYASPSPHVSSSYVSNSGHCADSDASLSAMASAQSLPGC

SEQ ID NO: 4084 - protein, 74 aa, Oryza sativa
MGMFSCRGCGCTAANRNIPVPFVLVDPENMTGMVHVKLDRAMQPLPLTTVYHKLTPVDSTPYTLFQTIIGNGYP

SEQ ID NO: 4085 - protein, 205 aa, Oryza sativa
  unsure (1)..(205): unsure at all Xaa locations
MGGGGGVEADCDRIRGPWSPEEDEALRRLVERPGARNWTAIGREIPGRSGKSRRLRWCNQLSPQVERRPFTAEEDATILRAHARLGNRWAAIARLLQGRTDNAVKNHWNXCSLKRKLGHHHHHHHHRRRRRAGSGRRCRRARRAAVQAVHPHAGQPVGXSGSGSDRSDLIHGGGFGQIFRPXAMTXAFXSPXTARSAGXREEDPX

SEQ ID NO: 4086 - protein, 220 aa, Oryza sativa
  unsure (1)..(220): unsure at all Xaa locations
MDTEDTSSASSSSVSPPSSPGGGHHHRLPPKRRAGRKKFRETRHPVYRGVRARAGGSRWVCEVREPQAQARIWLGTYPTPEMAARAHDVAAIALRGERGAELNFPDSPSTLPRARTASPEDIRLAAAQAAELYRRXXPPPLALPEDPQEGTSGGGATATSGRPAAVFVDEDAIFDMPGLIDDMARGMMLTPPAIGRSLDDWAAIDDDDDHYHMDYKLWMD

SEQ ID NO: 4087 - protein, 379 aa, Oryza sativa
MGAEAEHRMSPSPAPAPAPPTPVGRTDGDAPPMVLGLQLSALIDHVARVDWSLLNRIPGDRGGSQQVCIEELNHILAEVNAQILPCRDDLSSIRTIAGGSVANTIRGLSAGFGISTGIIGACGDDSQGVLFVSNMSFSGVDLTRLRTKKGHTAQCACLVDASGNRTMRPCLSSAVKLQANEFKKEDFKGSKWLVVRYARQNMEQILEAIRIAKQEGLSVSLDLASFEMVRDYRTQLIDLLETGNIDLCFANEDEARELLGGELTFDPEEALAFLAKYCKWAVVTLASKGCIAKHGKQVVQVAATGESNAVDATGAGDLFASGFLYGLVKGLALEECCKVGACSGGSVVRALGGEVRPENWQWMYKQMNASGLLLPDLKN

SEQ ID NO: 4088 - protein, 154 aa, Oryza sativa
  unsure (1)..(154): unsure at all Xaa locations
MGRGKIVIRRIDNSTSRQVTFSKRRNGIFKKAKELAILCDAEVGLVIFSSTGRLYEYASTSMKSVIDRYGRAKEEQQHVANPNSELKVWSFVASSYIXNRELTFLNSNLREINSTEINKKSMQELASFNNRIKPSLYSNKDGSQXLQNKQPHPX

SEQ ID NO: 4089 - protein, 225 aa, Oryza sativa
MAPMKVYGWVVSPWMARVLVALEEAGAEYEVVPMSRSGGDHRRPEHLARNPFGEIPVLEDGDLTLYQSRAIARYIFRKYKPEFLGLGEGGSLEESAMVDVWLDVEAHQHEAAVRPILWHCIINKFEGRDRDQGVVDESVRKLEKVLGVYEARLSGSRYLAGDRISLADLSHFSNMRYFMATEYAGVVDAYPHVKAWWEALLARPTVQKVMAGMPPDFGFGSGNIP

SEQ ID NO: 4090 - protein, 946 aa, Oryza sativa
MDGKGKWKNIYNIIADDMLSTRDLIDRSVDYNLEVDKYRGVWLHAPTMNRRRRCPHDSIKRERERWAATGGLGVGKEQLINNTSGNSSEKSAAIAPKLQVELWCGDTEFRDIFRIEWSSDKSCETVTVQTSTRGFFRSRCPPPQMGHDGPAPATNGPDHLFPPPPSQNPKPITNFPISPTPPIPTRSNGPDLPLTQIQRLPFVFSLHKTPPHPHPPTPPPPPPPSSLPTHPLAVADPIQEELAAAAAMALSVEKTSSGREYKVKDLSQADFGRLEIELAEVEMPGLMACRAEFGPSQPFKGARISGSLHMTIQTAVLIETLTALGAEVRWCSCNIFSTQDHAAAAIARDSAAVFAWKGETLEEYWWCTERCLDWGVGGGPDLIVDDGGDATLLIHEGVKAEEEFEKSGKVPDPESTDNAEFKIVLTIIRDGLKSDPSKYRKMKERLVGVSEETTTGVKRLYQMQETGALLFPAINVNDSVTKSKFDNLYGCRHSLPDGLMRATDVMIAGKVAVVCGYGDVGKGCAAALKQAGARVIVTEIDPICALQALMEGLQVLTLEDVVSEADIFVTTTGNKDIIMVDHMRKMKNNAIVCNIGHFDNEIDMLGLETYPGVKRITIKPQTDRWVFPETNTGIIVLAEGRLMNLGCATGHPSFVMSCSFTNQVIAQLELWKEKSTGKYEKKVYVLPKHLDEKVAALHLGKLGARLTKLSKSQADYISVPVEGPYKPAHYRTLNKLIRIRGASSILMRIRIVRYKKIETEFVFDSNPVKRGWTGGGPWLVESSSFAVGMNARLVSGYMAQLVDDGDDYKVVGRDHQGAAAPIPRAIPTAKKTGLRRRTPTCRRLRRCAVRAAVPAAAHRHPHPDGEEEDRTILSVSRASIAPSRRSSTSLPLRPARSPPPYPAPSLLPPGLRCLTPASPTTHAHCPSPHRRARYERGIARERKSDR

SEQ ID NO: 4091 - protein, 485 aa, Oryza sativa; identical to SEQ ID NO: 3478

SEQ ID NO: 4092 - protein, 338 aa, Oryza sativa
MLPGVECARRRRLRQGGGEAPCGTRRPSLCLYAGGHDHALLGSSACKDNHRSDIEFEIAVFGIGIMLQQQRSACEEQQPGWWTLDSNVREAKERLDQKLRSQRESAVVVVKRHNKAQVAGTSSDGGEQSTATTAAPQWEVYTRKEGRRRMWFRRLGRRPTPEEEEECAQQLQLARRKRILQRKLSPDAVTDMWTRERWDLYYYVSIKLSVIVYFLRLTIPRSVLAATSLWSRNHSLATCLPYIIVAMVTSDVAKISKFVHVQIKLFNNDVLLKTKVVEVADATPALMLRGGKGDLSVAMDGAGEITIGSLSSLITYCSPGFLPPRDRRSRAVNSGISH

SEQ ID NO: 4093 - protein, 210 aa, Oryza sativa
MVLMAGMLPGVECARRRRLRQGGGEAPCGTRRPSLCLYAGGHDHALLGSSACKQQRSACEEQQPGWWTLDSNVREAKERLDQKLRSQRESAVVVVKRHNKAQVAGTSSDGGEQSTATTAAPQWEVYTRKEGRRRMWFRRLGRRPTPEEEEECAVCLEELRAGEAVAHLPCTHRFHWGCAVPWVQTASRCPVCRAAVYLTSPAPAASNNYN

SEQ ID NO: 4094 - protein, 192 aa, Oryza sativa
MRKAYKDSFKVLEADIQHANTLASEFPREYDGACLQMRLSYSPAAHIFLFLVQWTDCSLAGALGLLRILVYKVYVDGTTTMSTHERKASIKEFYAVIFPSLLQLQRGITDTEDKKQKAVCMERNSRSQSCPFCRDNLKKTDPGDLWIYVEDQDVVDLETVSRENLRRLFMYINKLPLIVPDVIFSIYDSHIK

SEQ ID NO: 4095 - protein, 243 aa, Oryza sativa
RMRKAYKDSFKVLEADIQHANTLASEFPREYDGACLQMRLSYSPAAHIFLFLVQWTDCSLAGALGLLRILVYKVYVDGTTTMSTHERKASIKEFYAVIFPSLLQLQRGITDTEDKKQKAVCMERYRRRDEDERNILSEIDAEREEECGICMEMNSKVLLPNCTHNMCLRCYQDWNSRSQSCPFCRDNLKKTDPGDLWIYVEDQDVVDLETVSRENLRRLFMYINKLPLIVPDVIFSIYDSHIK

SEQ ID NO: 4096 - protein, 458 aa, Oryza sativa
  unsure (1)..(458): unsure at all Xaa locations
MADTPTSRMIHPFSNIPSQNLKQFQYYSHSDSTDGSPVGASCVTEDPNDLKQKLKDLEAVMLGPDSEIVNSLENSVANQLSLEPEKWVRMMXXIPRGNLKELLIACARAVEEKNSFAIDMMIPELRKIVSVSGEPLERLGAYMVEGLVARLASSGISIYKALKCKEPKSSDLLSYMHFLYEACPYFKFGYMSANGAIAEAVKGEDRIHIIDFHISQGAQWISLLQALAARPGGPPTVRITGIDDSVSAYARGGGLELVGRRLSHIASLCKVPFEFHPLAISGSKVEAAHLGVIPGEALAVNFTLELHHIPDEXXMVKSLSPKVLTLVEMESNTNTAPFPQRFAETLDYYTAIFESIDLTLPRDDRERINMEQHCLAREIVNLIACEGEERAERYEPFGKWKARLTMAGFRPSPLSSLVNATIRTLLQSYSDNYKLAERDGALYLGWKSRPLVVSSAWH

SEQ ID NO: 4097 - protein, 469 aa, Oryza sativa
  unsure (1)..(469): unsure at all Xaa locations
MADTPTSRMIHPFSNIXEPKPEAVPVFXXSTAPLPPLCASCVTEDPNDLKQKLKDLEAVMLGPDSEIVNSLENSVANQLSLEPEKWVRMMGIPRGNLKELLIACARAVEEKNSFAIDMMIPELRKIVSVSGEPLERLGAYMVEGLVARLASSGISIYKALXXCKEPKSSDLLSYMHFLYEACPYFKFGYMSANGAIAEAVKGEDRIHIIDFHISQGAQWISLLQALAARPGGPPTVRITGIDDSVSAYARGGGLELVGRRLSHIASLCKVPFEFHPLAISGSKVEAAHLGVIPGEALAVNFTLELHHIPDESVSTANHRDRLLRMVKSLSPKVLTLVEMESNTNTAPXFPQRFAETLDYYTAIFESIDLTLPRDDRERINMEQHCLAREIVNLIACEGEERAERYEPFGKWKARLTMAGFRPSPLSSLVNATIRTLLQSYSDNYKLAERDGALYLGWKSRPLVVSSAWH

SEQ ID NO: 4098 - protein, 160 aa, Oryza sativa
MMELRKYWGVGGRRCGACEASPAAVHCRGCGGVYLCTACDARPGHARAAHERVWVCEVCEVAPAAVTCKADAAVLCAACDADIHDANPLARRHARVPVAPIGSAAAAAVIPEALLIRINPAGAQPEALENKLLHRAPKLQTGNRKNVPQPYTDCRSSQSY

SEQ ID NO: 4099 - protein, 182 aa, Oryza sativa
  unsure (1)..(182): unsure at all Xaa locations
MARPQQRYRGVRQRHWGSWVSEIRHPLLKTRIXWLGTFETAEDAARAYDEAARIMCGPRARTNFPLADATAAAAAAAASSSFLSAALVAKLHRFNLASVQATQRQREAAATAAAASSASATTPPLGNAAAADDDARTTTTYGAEWSGRFLEEQHVEQMIDELLDYFSMEICSLCDTHTHTLF

SEQ ID NO: 4100 - protein, 330 aa, Oryza sativa
  unsure (1)..(330): unsure at all Xaa locations
QVGSKLQVAARSSSSSSARDQFPVGMRVLAVDDDXVTTTNQAAIALKMLRENRDMFDLVISDVHMPDMDGFKLLELVGLEMDLPVIMLSVNGETKTVLKGITHGACDYLLKPVRIEELRNIWQHVIRRKFSTRDRANLDFYEECNKPPNADSDHVHGHVNQSGRPSKKRKEYCSEEEDEGEVNTQDIDDPSAPKKPRVVWSVELHRKFVAAVNQLGIDTLSSFTPHGLLNSPSVPSSQLASNIGAHHAMSQRWNNSSSNSSNIGARMIGRNLKWFNSYPTNEDRFPRFGRYAAAASTAFSIPXSKWRRMMLPSATTWGAAISTPLELAYX

SEQ ID NO: 4101 - protein, 151 aa, Oryza sativa
  unsure (1)..(151): unsure at all Xaa locations
MRISEEKPCTDQELDADQMNSSSFNSSSECENQTPSNDEMTGSESKSEAAQTEGGGSSEEKVLKKPDKILPCPRCNSMDTKFCYYNNYNINQPRHFCKSCQRYWTAGGSMRNLPVGADNGSTASVQWSMPPVMPVPGXLSACQLHLLQALX

SEQ ID NO: 4102 - protein, 474 aa, Oryza sativa
  unsure (1)..(474): unsure at all Xaa locations
MDDLAAASPPHPPPPPPESHVPPPPQTPEKDSCEDTGDMRISEEKPCTDQELDADQMNSSSFNSSSECENQTPSNDEMTGSESKSEAAQTEGGGSSEEKVLKKPDKILPCPRCNSMDTKFCYYNNYNINQPRHFCKSCQRYWTAGGSMRNLPVGAGRRKSKSSTANYRSILIRGSNLAAPAGDAPLYQLSIKGDQTATAVKFAPDSPLCNSMASVLKIGEQSNTSTAQPRNGETQTCPASGTTSDSPRNEPVNGAVSGHQNGIVGHSGVPPMHPIPCFPGPPFVYPWSPAWNGIPAMAPPVCTAPAEPANSSDNGSTASVQWSMXXPVMPVPGYFPVIPSSVWPFISPWPNGAWSSPWIQPNCSVSASSPTSTSTCSDNGSPVLGKHSRDSKPQGDDKAEKNLWIPKTLRIDDPDEAAKSSIWTTLGIEPGDRSMFRSFQSKPESREQISGXXARVLQANPAALSRSQSFQETT

SEQ ID NO: 4103 - protein, 137 aa, Oryza sativa
  unsure (1)..(137): unsure at all Xaa locations
MAGRGKAIGAGAAKKATSRSSKAGLQFPVGRIARFLKAGKYAERVGAGAPVYTLAAVLEYLAAEVLELAGNAARDNKKTRIVPRHIXQLAVRNDGELTKLLGGATIARGGVMPNIHQHLLPKKAGSSKASTVDDDDN

SEQ ID NO: 4104 - protein, 135 aa, Oryza sativa
MAGRGKAIGAGAAKKATSRSSKAGLQFPVGRIARFLKAGKYAERVGAGAPVYLAAVLEYLAAEVLELAGNAARDNKKTRIVPRHIQLAVRNDEELTKLLGGATIASGGVMPNIHQHLLPKKAGSSKASHADDDDN

SEQ ID NO: 4105 - protein, 229 aa, Oryza sativa
  unsure (1)..(229): unsure at all Xaa locations
MDATAIGNGALHSNGAGADTKGKPIKCKAAVAHGPGEALVMEEVEVAPPARMEVRLKVLFTSICHTDLSAWKGEDLAXXGDHVVPIFTGECGACTYCESSKSNLCKTYRVNPFKSTMVTDGGTRFTTSGARNPVYHFLNTSTFAEYTVIDSACAVKINPKAPLEKMSLLSCGVSTGVGAAWNTANVSKGSTVAIFGLGAIGLAVAEGARLRGASRIIGVDINPEKFSKX

SEQ ID NO: 4106 - protein, 266 aa, Oryza sativa
  unsure (1)..(266): unsure at all Xaa locations
MQSFVLLSGHRRPASFSCRPAGVIDDDEMTIDDDDHACAAAVAHGPGEALVMEEVEVAPPARMENELQRKFPRILGHEAAGVVESVGEGVEDLAPGDHVVPIFTGECGACTYCESSKSNLCKTYRVNPFKSTMVTDGGTRFTTSGARNPVYHFLNTSTFAEYTVIDSACAVKINPKAPLEKMSLLSCGVSTGVGAAWNTANVSKGSTVAIFGLGAIGLAVAEGARLRGASRIIGVDINPEKFSKSLEYDVTELXFLAPFSRSGSVX

SEQ ID NO: 4107 - protein, 443 aa, Oryza sativa
  unsure (1)..(443): unsure at all Xaa locations
MQTSTFLLGKSKARNTMDATAIGNGALHSNGAGADTKGKPIKCKAAVAHGPGEALVMEEVEVAPPARMEVRLKVLFTSICHTDLSAWKGRXNELQRKFPRILGHEAAGVVESVGEGVEDLAPGDHVVPIFTGECGACTYCESSKSNLCKTYRVNPFKSTMVTDGGTRFTMIDRSSGARNPVYHFLNTSTFAEYTVIDSACAVKINPKAPLEKMSLLSCGVSTGKQPXLVGVGAAWNTANVSKGSTVAIFGLGAIGLAVAEGARLRGASRIIGVDINPEKFSKGKEMGITDFINSKASGKPVHEVIMEMTDGGVDYSFECTGITDVLREAFVSTHDGWGLTVVLGIHATPRMLPLHPMELFDGRRITGCVFGDFKGKSQLPEIVEKCMQGEININFDGFITQELPFADINKAFQLLEEGKSLRCLLHVXMKLVDCKFEYTINES

SEQ ID NO: 4108 - protein, 583 aa, Oryza sativa
  unsure (1)..(583): unsure at all Xaa locations
MTYFPEEVVEHIFSFLPAQRDRNTVSLVCKVWYEIERLSRRGVFVGNCYAVRAGRVAARFPNVRALTVKGKPHFADFNLVPPDWGGYAGPWIEAAARGCHGLEELRMKRMVVSDESLELLARSFPRFRALVLISCEGVXSTDGLSXARREANCKLLRELDLQENEVEDRGPRWLSCFPDSCTSLVSLNFACIKGEVNAGSLERLVSRSPNLRSLRLNRSVSVDTLAKILLRTPNLEDLGTGNLTDDFQTESYFKLTSALEKCKMLRKLSGILXDASPVCLSFIYPLCAQLTGLNLSYAPTLDASDLTKMISRCVGAXSSSSRLSVLDCISDKGLQVVASSCKDLQELRVFPSDFYVAGYSAVTEEGLVAVSLGCPKLNSLLYFCHQMTNAALVTVAKNCPNFTRFRLCILEPGKPDVVTSQPLDEGFGAIVRECKGLQRLSISGLLTDNVFRYIGKYAKQLEMLSIAFAGDSDKGMMHVMNGCKNLRKLEIRDSPFGDAALLGNFARYETMRSLWMSSCNVTLKGCQVLASKMPMLNVEVINERDGSNEMEENHGDLPKVEKLYVYRTTAGARDDAPNFVKIL

SEQ ID NO: 4109 - protein, 182 aa, Triticum aestivum
  unsure (1)..(182): unsure at all Xaa locations
MAHGKRSRQQAESTSVSLLDLDSGDMARILLLFSGHHQHHAHYGPSSPERVFECKTCSRXFPSFQAXLGGHRASHKKPRLADGAGAEPPKPKVHGCSICGLEFAVGQALGGHMRRHRAVAAAGPGVGLGLSLGLGLGPNEDGNKKAAAAAELALDLNEPALEEEPADRAMLGLAVGFRPRGG

SEQ ID NO: 4110 - protein, 170 aa, Triticum aestivum
  unsure (1)..(170): unsure at all Xaa locations
MEIRTKDDAWRLLLVLFLGQLVAFSMAACSFASSFIANLGVDTPLAQSFCTHLLLTLVYVPILLRRRQKLRIPWYWYLVLAFVDVQGNYLVTEAYQYSSITSVTLLDCWTVVWAIILTWYRTRHEIFFXGNFWGAGTCVAGLSSLCSFQMPKTPRYLRIIKHPLLGDALC

SEQ ID NO: 4111 - protein, 159 aa, Triticum aestivum
  unsure (1)..(159): unsure at all Xaa locations
MGGGSGGGGVWPVVVMVFLNAIAAVMVSLVKVAMNGGLDPLVLVTLQQLTAAIFLGPIAYFREGKARPRMTLEIFAYLFASAALGAALRQYMIFVALRYTTATFVTAFSNVAPVLTFLLAAATRSESLKLRTATGVAKLAGTLVSLAGASVPPFYXGCP

SEQ ID NO: 4112 - protein, 166 aa, Triticum aestivum
MAAMAVLVMFFVAAALAAAGGAELVEHTFVVSQVKLNRLCNDTLVTVVNGQFPGPAIEVNEGDSVAVQVVNKSPYGLTIHWHGVKLQLNCWADGAGMITQCPIQPNKNFTYRFDVAGQKGTLWWHAHVGSLRASIHGALIIRPRSGASSYPFPKPDKEIPIVIGEW

SEQ ID NO: 4113 - protein, 207 aa, Triticum aestivum
ASQEPSRTGTPIIASSPTSTRTPTPNRSVEFGVGTIDSSKMGMSEEELQLNTRKEIMDLGERLGKTTIAAWASKEERATANFANVPADKAVEIDRETRAADWHEAEKAKYLARFQREEVKIQAWENHQRAKIEAEMKSIEAKMERKRAREDGWRAEKTTEATGRAEAKREAAEARRSQEAERTDEQAAQIRKTGHIPSSISCWCWCL

SEQ ID NO: 4114 - protein, 241 aa, Triticum aestivum
  unsure (1)..(241): unsure at all Xaa locations
MSASVKIEKKDGSVKVEKTANNDSKVQHVKVEKVSKESSRTTDTKKPSSVPXPPKLTSLVRCNDAARXKYRELLVDAFVKVSKETSEDDREEIRDLLDQVNACDPYRVAVTVESALFERIGRSTGTHKVKYRSILFNLKADNNPDFRRRVLLGEVRPGSLVDMPADEMASDARKLENQQIKEKALFDCERASAPKASTDQFKCGRCGQRKTTYYQLQTRSADEPMTTFVTCVNCNNHWKFC

SEQ ID NO: 4115 - protein, 216 aa, Triticum aestivum
HEAAAIAEEQGRKRHYRGVRQRPWGKWAAEIRDPKKAARVWLGTFDTAEDAAIAYDEAALRFKGTKAKLNFPERVQGRTDLGFVVTRGIPDRLQQQQHYPATVGAPAMRPPPHQQQTVVPYPDLMRYAQLLQGAGSAGGAVNLPFGAMSPPSMSSSSPHILDFSTQQLIRVSPTSPAAAISSSGTTGPSTSSSTTTASSPGAAWPYTGEPKNNKDS

SEQ ID NO: 4116 - protein, 249 aa, Triticum aestivum
  unsure (1)..(249): unsure at all Xaa locations
GRRALSLMRSQEDTGRHVRMLIHEIRSTLDRHTILKTTLVELGRTLGLQECAFWMPSRTGSSLELTHTMRHQXIPTGSSVEINLPVVNQVFSTNRAIIVPHTSPLARIHPVQGRHVPPEVAAVRVPLLHLPNFHPELLAKSYAIMVLMLPSDSARKWLAHELELIEVVADQVAVALSHAAILEEXSTRARDLPTEQNVALDLALREAEMAMHARNVNRVGVELVRPEDADNVATINSSASAAKVHNAEP

SEQ ID NO: 4117 - protein, 268 aa, Triticum aestivum
MGKANNLADKVFCARAGAKRVYAVDASEIATPAWVGVMPLYVAVLPGVLLARDKWLKPGGLILPSHATLFMAPITNSDRYEGSVDFWCDVYGINMSALVPLAKKFASEEPSIEIVGGENVISWPFVVKHIDCYTFTVEEFKSITTTYKVSSMMLAPIHGFGLWFEVEFNGPAESCSNLSSDSSPLDIIQKKRRRASDSTVVLSTAPEDEPTHWHQTILYFPDPIGVTQDQIIEGSVTITPSEENPRCLNIHLECSTGGQNLVKDFAMR

SEQ ID NO: 4118 - protein, 250 aa, Triticum aestivum
GSPQRPVRRDAQPRGNTDKPAESKTPCRLPWEEAAAWSPGSTSGAGSSSPRAHTTVPVTWEEAAAWSPGSTSGAGSSSPRCSSSPPPSPARYLCFLLIYIHTPNLLVLGRETAIFCVIKPAPFLTKTHHMVEERGTDEVISWSEHGRSFVVWKPVELARDLLPLHFKHCNVSSFVRQLNTYGFRKVVPDRWEFANENFRRGEQSLLSGIRRRKATGTTTPQSSKTCGTGVNVAFPPPLPALSPASVSTFG

SEQ ID NO: 4119 - protein, 557 aa, Triticum aestivum
APPRTTQRYRTPAPTTSVERPAQPPTAPSAPRARHFWVSQEAGLRGEGHPKTKPRIQQSPFGRYWYDKESGLWGKDGQKPDRIVSSNLNFSGKLHAKASNGNTQVYINGREITKSELKILKVAHVQCPRDTHFWVYDDGRYEEEGQNNIKGKIWESALTRFACALFSLPVPPGDSNGTKDEIPFVPRTVPDYLDQKRIQKLLILGSPGAGTSTIFKQAKLLYGSRFTPEELDNIKLMIQSNMFKYLGILLEGRERFEEEALAISNNPNSEDEDTQQDGNESNGLNSCIYSINAKLKKFSDWLLDIIAMGDLDAFFPAATREYAPVVDELWKHPAIQATYKRKDELYFLPDVAEYFLSRAIEVSSNEYEPSEKDVLYAEGVSQGNGLAFIDFTLDERSPMSELYIDSQEASSQPLTKYQLIRVNAKGLNEGCKWVEMFEDVRAVIFSVALSDYDLLGTPVNGNLQNKMMQSKELFEATIRQPCFCDTPFVLVLNKYDLFEEKISRAPLTACEWFGDFSPVRTQSNNQTLAQQAYYYVAMKFKEAYNDHTGRKLFVWQA

SEQ ID NO: 4120 - protein, 263 aa, Triticum aestivum
  unsure (1)..(263): unsure at all Xaa locations
MAQPAELSREENVYMAKLAEQAERYEEMVEFMEKVAKTVDSEELTVEERNLLSVAYKNVIGARRASWRIISSIEQKEESRGNEDRVTLIKDYRGKXIEVELTKICDGILKLLDSHLVPSSTAPESKVFYLKMKGDYYRYLAEFKSGTERKDAAENTMVAYKAAQEIALAELPPTHPIRLGLALNFSVFYYEILNSPDRACDLAKQAFDEAISELDSLSEESYKDSTLIMQLLRDNLTLWTSDISEDAAEEMKDAPKGESGDGQ

SEQ ID NO: 4121 - protein, 189 aa, Triticum aestivum
MTKRFAFEEKEMARMLLLVSREQAMPMPMPVAVPGDRAPERVFVCKTCDRVFPSFQALGGHRASHKKPRLDNGGDLKPKLHGCSVCGLEFAIGQALGGHMRRHRAMAAGGGGGVMAMTPPTAAIKKHGDSSDDAVVGMKRGLWLDLNHPPCDEYGAGSESDDECGHDAAAAGYTFHQFLDTGTMAVDCV

SEQ ID NO: 4122 - protein, 183 aa, Triticum aestivum
MSDADDYRCFVGSLSWNTTDVDLKDAFGKFGRVTETKVVLDKFSGRSRGFGFVTFDDKKAMEEAVEAMNGIDLDGRNITVERAQPQGSGRNRDGDRDYRGGGDRYGGGRDFGGGRGGGRGGGGDCYKCGKPGHFARECPSGDGGDRYGSRDDRYSSRDDRYSSRDDRYSSRDDRYWWQGWCKG

SEQ ID NO: 4123 - protein, 555 aa, Triticum aestivum
MAAAAAEEAAPGADAIMDGFAELERQQELLASCTRLYQQLTEHFGSLERGIKSRSDSLRARRRVVELRASRRLDAPSAPASAPSTPSVKLALSRLDALAKSPRPKRDREDGDGPPSPPPPPPSDDVAEGLAALCAAMDPAGFLAFVVERRKEVDALRAELPAALQRCVDPARFAMDAVSEVFPVDRRAVRSPTDLAWACVLILEAVVPALADPDPEIGAARPMVPQAARDRARGMAAEWKEVAERKGGVEGAKPPDAHAFLQHVATFAVAEKEDKELYKRIVLSFSWRRQMPRLALTLGLEDDMEEIIEELITKGQQLDAVNFAYEAGLLEKFSPVPLLKSYLEDSKKIYCTSDNVSTSSGQSGVNANKKEQSALRAVIKCVEDHKLEAEFPLEDLRKRLEELEMAKTEKKKAASSCSSGGPASKRIKGSAGGAMSPSKSGRLSDNTGAPSSPATATSSSTATAFIGSPASHVSYGTGSPYSYDRSAGHALYCGQSPLPMREPYAYPPAVPVPNVGLGMPYQAPPMTYPIYAGYNSGLGAYGNAMAPAFHQAYYR

SEQ ID NO: 4124 - protein, 368 aa, Triticum aestivum
GLLPPARATAARVRSIDASVKLALSRLDALAKSPAPKRDREDGDGPPSPPPPPSDDVAEGLAALCAAMDPAGFLAFVVERRKEVDALRAELPAALQRCVDPARFAMDAVSEVFPVDRRAVRSPTDLAWACVLILEAVVPALADPDPEIGAARPMVPQAARDRARGMADEWKEAAERKGGVEGAKPPDAHAFLQHVATFAVAEKEDKELYKRIVLSFSWRRQMPRLALTLGLEDDMEEIIEELITKGQQLDAVNFAYEAGLLEKFSPVPLLKSYLEDSKKIYCISDNVSTSSGQSGVNANKKEQSVLRAVIKCVEDHKLEGEFPLEDLRKRLERLEMAKTEKKKAALSCSSGGPASKRIQGSAGGTMSP

SEQ ID NO: 4125 - protein, 242 aa, Triticum aestivum
MDPSGAFARSSSNVSLASLVRSGSGGSGSSRGRGGAGGSRRMVRRVLRGVITFIFAIAGLFLGAVTGGLIGLATESGLFRGTGIGAITGALVSIEVVDSSIRLWRSRRSGIWSILYVLNVIYSLLTGRLVREKVDPAVQRVVRSQMNAVDSSQFREAPDLFEIEGTNGMPRASIEKLPEGTITEEYNRNAVGDLSGCSVCLQDFQIGEKVRSLPDCLHVFHVPCIDGWLIKHGSCPLCRRKL

SEQ ID NO: 4126 - protein, 299 aa, Triticum aestivum
QASDLSHLRRRFVRVEGRREEMAATEGVLLGMGNPLLDISAVVDDAFLTKYDIKLNNAILAEEKHLPMYDELASKSNVEYIAGGATQNSIRVAQWMLQTSGATSYMGCIGKDKYGEEMKKTAKAAGVTAHYYEDEAAPTGTCAVCVVGGERSLIANLSAANCYKSEHLKRPENWALVEKAKYIYIAGFFLTVSPESIQLVAEHAAANNKVFLMNLSAPFICEFFRDAQEKVLPYSDYIFGNETEARIFSKVRGWETENVEEIALKISQLPLASGKQKRIAVITQGADPVVVAEDGKVKT

SEQ ID NO: 4127 - protein, 347 aa, Triticum aestivum
  unsure (1)..(347): unsure at all Xaa locations
PEPGSRAAVRRRAEAGVRARAMDVDSVECLSLPDAAMDADDVGLALHPHGGILAAAAPARXAYPKAGAGAGGIVAPGSSVHELLECPVCTNSMYPPIHQCQNGHTLCSTCKARVHNRCPTCRQELGDIRCLALEKVAESLELPCKHYSLGCPEIFPYYSKIKHEAMCSFRPYSCPYAGSECSVTGDIPYLVNHLRDDHKVDMHSGCTFNHRYVKSNPREVENATWMLTVFHCFGQYFCLHFEAFQLGMAPVYMAFLRFMGDENEARNYSYSLEVGANGRKMVWEGTPRSVRDSHRKVRDSHDGLLIQRNMALFFSGGDRKELKLRITGRIWKETQTPDGACVPVLCS

SEQ ID NO: 4128 - protein, 361 aa, Triticum aestivum
  unsure (1)..(361): unsure at all Xaa locations
IHFCRIREKVKLLYPALHVERNHNSFLTYPFLSFAENDPRRTRIANAYFSLFMALGNILGYATGAYNGRSRGFPFTITESCSVSCANLKSAFLLDIIILAITTYVSVVTVQDNPTFGSDEAAPPSSHEEEAFLFELFGSFKYFTMPVWMVLIVTSLTWIGWFPFILFDTDWMGREIYRGSPEIVADTQKYHDGVRMGSFGLMLNSVVLGITSIGMEKLCRKWGAGLXWGVSNIIMALCFVAMLIITYVAQNLDYGPSGAPPTGIVAASLIVFTILGAPLSVTYSIPYAMAASRVENLGLGQGLAMGILNLSIVIPQIIVSLGSGPWDQLFGGGNAPSFWVAAAASFVGGLVAILGLPRARL

SEQ ID NO: 4129 - protein, 132 aa, Triticum aestivum
MGRSPCCEKEGLKKGPWTPEEDQKLLSYIEQQGHGCWRSLPAKAGLQRCGKSCRLRWTNYLRPDIKRGKFSLQEEQTIIQLHALLGNRWSAIATHLPKRTDNEIKNYWNTHLKKRLAKMGIDPVTHKPRSDV

SEQ ID NO: 4130 - protein, 369 aa, Triticum aestivum
  unsure (1)..(369): unsure at all Xaa locations
MLGAARRSGCVLGQLMQTLRPAATAARSYSATPKEMTVREALNSALDEEMSADPSVFLMGEEVGEYQGAYKITKGLLDKYGPDRVLDTPITEAGFTGIGVGAAYQGLRPVVEFMTFNFSMQAIDHIINSAAKSNYMSAGQISVPIVFRGPNGAAAGVGAQHSQCYAAWYAHVPGLKVLTPYSAEDARGLLKAAIRDPDPVVFLENELLYGESFPIKAEVLDSSFXLPIGKAKIEREGKDVTITAFSKMVGYALQAAEILSKEGISAEVINLRSIRPLDRAAINASVRKTNRLVTVEEGFPQHGVGAEICMSVVEDSFEYLDAPVERIAGADVPMPYAANLERLAVPQVEDIVRAAKRACYRSSSMAANA

SEQ ID NO: 4131 - protein, 103 aa, Triticum aestivum
MNHHLESSDYQKLFCRKMDSAELQTPLLHGLPDEIALLCLARVPRQYHNALRCVSRGWKALLSSEEWHSYRKRNNLAESWIYVICRGTGFKCYVLVPDPTTRS

SEQ ID NO: 4132 - protein, 214 aa, Triticum aestivum
MAAEEPKKVEVEAAPEPEAAPPAVPAAEPEAPAKDVTEEKAVIPAPAPAAEEEKPPADDSKALVVVEKVADEPVAEKPTDEKAAHGGSNDRDLALARVESEKRNSLIKAWEENEKTKAENKATKKVSAILSWENTKKANIEAQLKKIEEQLEKKKAEYAEKMKNKAAMIHKEAEEKRAMVEAKKGEELLKAEEMAAKYRATGHSPKKVMGCFGA

SEQ ID NO: 4133 - protein, 202 aa, Triticum aestivum
MSAETERSSTESSAASGLDFEDTALTLTLRLPGDPDRKRGASSSSCCSLADRSSLLAEAPPAPKARVVGWPPVRSFRKNALENVAAGSTRAACAPAKFVKVAVDGAPYLRKVNLRDYAGYDQLLRALQGKFCSHFTIRKFANDEMKLVDAVNGTEYVPTYEDKDGDWMLVGDVPWKMFEEACQRVRLMKNSEAVNIAPRAAR

SEQ ID NO: 4134 - protein, 309 aa, Triticum aestivum
MGAPKQKWTAEEEAALKAGIGKHGAGKWRTILKDPEFSNILRYRSNVDLKDKWRNMNVTVNASGTRDKVRTTTTTTPTAKKPRSAPKQENHPTAITTITSDGDDDVIDVKPIIKPIVTFTTGSGNKSLSRLENIILEAVKTLNEPTGSYKTAVANYIEEQYWPPADFDHVLSAKLNELTSSGKLMKVNRRYRIAPSSSFLEGRRSKMLLLADIKKEPTKVEKVERDGFTAHTKSQVDAELARMRNMSAEEAAAAAARAVAEADAIMAEAEAAVREAEAAEADAVAAQAFAEAAMLTLKNRSSAKLIIRG

SEQ ID NO: 4135 - protein, 130 aa, Triticum aestivum
MAAAVADAAVPAVAKANGAGAGCCAAKGPGYATPREAMEKGPREGLLYVTCVYNGTGINKPDYLATVDVYPNLATYSQVIHRLTGTHIGDELHHSGWNACSSCHGDPSTSRRFLILPSLLSGRVHVVDTA

SEQ ID NO: 4136 - protein, 321 aa, Triticum aestivum
  unsure (1)..(321): unsure at all Xaa locations
ARTLAPLVAGFACASRREIEAVLALGVQPGSIVYANPCKPDAHLEYAXEVGVNLTTYDSEEEVVKVKRCHPGCELILRIKGPDGGEARVDLGTKYGAHEDEVLPLLRADQREGLNVAGVSFHVGSGASNTDVYRGAIEAARGVFDAAAALGMPPMRVLDIGGGFMAGSAFDEAATVINAALERYFGELPCVEVIGEPGRYFAETAFTMAARVIGKRTRGEVREYWIDDGLYGTLSCIPMDHYVPHPRPLAVPRAGEKAYTSTVFGPTCDSLDTVVTGYQLPEMNVGDWLVFDDMGAYTTASGSNFNGFSTSDIKTYLAYSS

SEQ ID NO: 4137 - protein, 362 aa, Triticum aestivum
MNMNYGSMGPGAMVRCRQCSSSITAMPGARAVQCMQCSCVTRVSGRGRQQHGYGQGYGNGGGMLMPPMRPTPAFGGGRGKKRAVLIGIKYTNRRSCELRGPINDVKCMRYLLTERFGFPNDCVLILTDEERNPCRQPTKDNIRMAMHWLVQGCSYGDSLVFQFSGLGAQVPDDDGDELDGMDEALCPVDSFQQGPILDDEINEAIVRPLVHGVKLHAIVDACHSVFVLDFVCRCTFFKRYGCLRWMDERPLMAACKGTSGGKAVLISGSSNGKTQMSVLPEPNATIGALTHSFIKALECEPRTTYGHLLTSMRTTMRAGAGDCSLQGPVGCSIRKVANFSGVEEPQMSSACKFDINCEPFCM

SEQ ID NO: 4138 - protein, 210 aa, Triticum aestivum
SAVAGPDAWVWLSFAPVIIVLLVGTELQHVVAQLALEVVEATATNVGTQLKLRDDLFWFGKPRVLWWLIQFISFQNAFEMATFLWSLWELSANSCFMKNQYMVVIRLASGLLVQIWCSYSTLPLNVIISQMGSKFKKSLVSESVRDSLHSWCKRIKDRRHNPLFMRNGTLTSRSVCSLGTLSRTVSASSLDEALTVVTVDDEEEISHIEQ

SEQ ID NO: 4139 - protein, 98 aa, Triticum aestivum
  unsure (1)..(98): unsure at all Xaa locations
TDFTILLNITHYSLSIDGQYHRXVRERRSGVNSDTTTGIMRSYXVHDVGTLVFDAINFXDSVSXIEFDKLYGCRHALDDCLKTATDVMIDSRVAVVCS

SEQ ID NO: 4140 - protein, 312 aa, Triticum aestivum
MAATATKLSSGHEMPAVGLGVWRMDSAAVRGLIHSALRAGYRHFDCAADYKNEAEVGDALAEAFETGLVKREDLFITTKLWNSDHGHVVEACKDSLKKLRLDYLDLYLIHFPVATKHTGVGTTGSALGDDGVLDIDTTITLETTWHAMEDLVSMGLARSIGISNYDIFLTRDCLAYAKIKPAVNQIETHPYFQRDSLVKFCQKHGISVTAHTPLGGSTANTEWFGSVSCLDDPVIKSLAEKYGKTPAQLVLRWGLQRNTVVIPKTSKVERLEENFAVFDFDISIEDMEKIKALDRNYRTNQPAKFWGINLYA

SEQ ID NO: 4141 - protein, 409 aa, Triticum aestivum
  unsure (1)..(409): unsure at all Xaa locations
KSEMLRRGQVEHVKAERNLLAEVDSAYIVKLYYSFQDDEFLYLIMEYLPGGDMMTLLMRKDXVTEDEAKFYIAETVLAIESIHKHNYIHRDIKPDNLLLDLSGHLKLSDFGLCKPLDSSNFPNLNEPDYTPGKGAKPLPDNTSRLTNSSAPKRTQQEQLSHWQKNRRMLAYSTVGTPDYIAPEVLLKKGYGMECDWWSLGAIMYEMLVGYPPFYSEDPMSTCRKIVNWRSHLKFPEEAKLSSETKDLISKLLCNVEQRLGTKGAHEIKAHTWFRGVQWEKLYQMKAAFIPEVNGELDTQNFEKFEETGAQVQSSSKAGPWRKMLPSKDANFVGYTYKNFEIVNDDEVAGIAELKKKSSKSKRPTIKTLFESMDEDEPVHGSFLNMLPHKEGQPSSHSSAPPEQYQPRRK

SEQ ID NO: 4142 - protein, 369 aa, Triticum aestivum
  unsure (1)..(369): unsure at all Xaa locations
MVSATKLEGGYCFHSKNSPLDQPEGVKIHLYRLGIEQREHDALKSFAYAGQGSPSLLDTLILSQWGDXAQKGHMGYDVTACELKVIEGQRDFVIQMNDKWNTFPLKKHDKFGHPFGCLKPNSAKSYEELLLCIAEGEDTEPEVVPSTTPPNNGVLLIANAYPVEYGHIFLVPNATNQLSSFWDKRMFGLITKIASEVNSTAFRVFFDDGTSIVPKHMFFQACYFANPLPVESASTVALYDGATRSGICVSEIVDYPLKALVFTXTNVNALVDVVSEACLALHEKNTVHSLMMSNNGRNVFLFPQVKNLVTGCYLSAWECCGYFVYQTKVDFDRASETGISNRMASFSFQDGEFEDLKKLCCAIADDLVT

SEQ ID NO: 4143 - protein, 353 aa, Triticum aestivum
  unsure (1)..(353): unsure at all Xaa locations
MGVGGEKFQLGTVGALGLSVVSSVSIVICNKALMSSLGFTFATTLTSWHLLVTFCSLHVALWMKFFEHKAFDSRTVMGFGVLNGISIGLLNLRLGFNSVGFYQMTKLAIIPCTGILXETLFFRKXFSRTIQISLSXLFLGVGVATMTDLQLNAVGSILSLLAIITTCIAQIMTNTIQKKFKVSSTQLLYQSCPYQSLTLFLIGPFLDGFLTNQNVFAFNYTSNVVFFIVLSCLISVSVNFSTFLVIGKTSPVTYQVLGHLKTCLVLTFGYVLLHDPFSWRNILGILIAVVGMVLYSYFCSTETQPKNTDVSAQQSKEGDSAPLISDSLGKVENGGDDDEPLKVPMWSSKYPRA

SEQ ID NO: 4144 - protein, 253 aa, Triticum aestivum
  unsure (1)..(253): unsure at all Xaa locations
MAADLGFEATELRLGLPGGGEGEARSSSGKRGFAETIDLKLKLEPAGEEAPAEEDRADVAVVAAAAAENQEETATDAGGGKMKRSPSQSSVVTTAALPDPAEKPRAPKAQVVGWPPVRSFRKNILAEKSSPAAAAAFVKVSMDGAXPYLRKVDLNMYKTYQDLSKALEKMFSSFTIGNCGTPGMNGMNESKLMDLLNGSXYVPTYEDKDGDWMLVGDVPWEMFVESCKRLRIMKGSEAIGLAPRAMEKCKNRS

SEQ ID NO: 4145 - protein, 252 aa, Triticum aestivum
MAADLGFDATELRLGLPGGGEGEARSSSGKRGFAETIDLKLKLEPAGEEAPAEEDRADVAVVAAAAAENQEETATDAGGGKMKRSPSQSSVVTSAALPDPAEKPRAPKAQVVGWPPVRSFRKNILAEKSSPAAAAAFVKVSMDGAPYLRKVDLNMYKTYQDLSKALEKMFSSFTIGNCGTPGMNAMNESKLMDLLNGSEYVPTYEDKDGDWMLVGDVPWEMFVESCKRLRIMKGSEAIGLAPRAMEKCKNRS

SEQ ID NO: 4146 - protein, 148 aa, Triticum aestivum
GRKRAQVVGWPPVRSFRKNILAEKSSPAAAAAFVKVSMDGAPYLRKVDLNMYKTYQDLSKALEKMFSSFTIGNCGTPGMNAMNESKLMDLLNGSEYVPTYEDKDGDWMLVGDVPWEMFVESCKRLRIMKGSEAIGLAPRAMEKCKNRS

SEQ ID NO: 4147 - protein, 234 aa, Triticum aestivum
  unsure (1)..(234): unsure at all Xaa locations
MDTSASPGPSSSAPEPRQWAGGRPGLGSAALELACKVLCVVATCAFAAVGSLVGAVSGSVIGLATESGVVRGAGIXGAISGAVFSIEVAESSRDLWHTSDSSVWSVLFMVDIILSLLSGRLVREKVGPAVQSAVQSQISAISSPFTEPSDLFETGGARGLPAHALRRLPAIKVGADTAVDEAGEALCCSVCLQDXKVGQSARRLPXCRHVFHAPCIDRWLVXRHASCPLCRRDI

SEQ ID NO: 4148 - protein, 143 aa, Triticum aestivum
  unsure (1)..(143): unsure at all Xaa locations
ANVVSSACIWLQDNXNVPYNVLISDSGRKIFLFPQCYAEKQALGDVSQELLDTQXVNPAVWEISGHIVLKRRDDYEEASEASAWRLLAVVSLSEARFEEVKAYIFDAACLVQVPVVDLETDDAIYAPVPVGPSAVGEGCLVIP

SEQ ID NO: 4149 - protein, 209 aa, Triticum aestivum
  unsure (1)..(209): unsure at all Xaa locations
CIQRVYSLGRQARVILGNFICALQALMEGIQILTLEDVVSDADIFVTTTGNKDIIMVDHMRKMKNNAIVCNIGHFDNEIDMNGLETXPGVKRINIKPQTDRWVFPETNTGIIVLAEGRLMNLGCATGHPSFVMSCSFTNQVIAQLELWKEKATGKYEKKVYVLPKHLDEKVAALHLGKLGARLTKLTKAQSEYISIPVDGPYKPAAYRY

SEQ ID NO: 4150 - protein, 223 aa, Triticum aestivum
RPTALSRTELSQTYILQHQWPPPIPPPPPLPIPKPNPPPSQPFKGARISGSLHMTIQTAVLIETLTALGAEVRWCSCNIFSTQDHAAAAIARDSAAVFAWKGETLEEYWWCTERCLDWGVGGGPDLIVDDGGDATLLIHEGVKAEEEFEKSGKVPDPESTDNPEFKIVLTIIRDGLKTDASKYRKMKERLVGVSEETTTGVKRLYQMQESLQACGLPVLVCPA

SEQ ID NO: 4151 - protein, 377 aa, Triticum aestivum
  unsure (1)..(377): unsure at all Xaa locations
MDTSGGGDDAAGGAAQIQGTATHGGRYVLNNVYGNLSEAASXXAPPIRPIGRGAYGIVCAAVSSDTGEEVAIKKIGNAFDNHIDAKRTLREIKLLRHMDHENILAIKDLIRPPRRDDFKDVYIVTELMDTDLHQIIRSNQSLTDDHCQYFLYQLLRGLKYVHSANVLHRDLKPSNLFLNANCDLKIADFGLARTTSETDLMTEYVVTRWYRAPELLLNCSQYTAAIDVWSVGCILGEIITRQPLFPGRDYIQQLKLITELIGSPDDSSLGFLRSDNARRYMKQLPQYPRQDFRLRFRNMSDGAVDLLERMLVFDPSRRITVDEALHHPYLASLHDINEEPTCPAPFSFDFEQPSFTEEHMKELIWRETLAFNPDPPY

SEQ ID NO: 4152 - protein, 204 aa, Triticum aestivum
TTTNASPDSASAAAAAVPPPAPAVPAKVRLMVSYGGRIQPRPHDNQLSYVNGDTKILSIDRPLRFPDFYARLASLAAARGDLCVKYQLPGEDLDALVSVTNDEDLEHLVIEYDRLHLFRAPAAPGSGGSSRGGSTPRLLDALVSVTNDEDLDHLVIEYDRLHLFRAPAAPIWRVLPGSTPRLRVFLFPVAPPPRPASPPKQQHQ

SEQ ID NO: 4153 - protein, 81 aa, Triticum aestivum
MSYYNQQPPVGAPPPQGYGDKGGYPPPAQGYPPAGYPQQGYPPQYAQQPPPHQQQQQSSGPSFMEGCLAALCCCCLLDACF

SEQ ID NO: 4154 - protein, 497 aa, Triticum aestivum
SCSSHGALQASSDTDVSVHSTFASRYVRSSLPRYRMPENSIPKEAAYQIINDELMLDGNPRLNLAASGTTWMEPECDKLIMDSINKNYVDMDEYPVTTELQNRCVNMIAHLFNAPLGETETAVGVGTVGSSEAIMLAGLAFKRRWQNKMKAAGKPCDKPNIVTGANVQVCWEKFARYFEVELKEVKLSEGYYVMDPEKAVEMVDENTICVAAILGSTLNGEFEDVKMLNDLLVKKNEETGWDTPIHVDAASGGFIAPFLYPELEWDFRLPLVKSINVSGHKYGLVYAGIGWCIWRSKEDLPDELIFHINYLGADQPTFTLNFSKGSSQVIAQYYQLIRLGFEGYRNIMDNCQENAMVLKEGLERTGRFNIVSKDQGVPLVAFSLKDSSRHDEFEISEFLRRFGWIVPAYTMPPDAQHVTVLRVVIREDFSRTFAERLVIDIEKVLHELDALPSRSSGPALQHPNGDTVSEKDLARQREVVSVWKRAVAARKKTQGVC

SEQ ID NO: 4155 - protein, 407 aa, Triticum aestivum
  unsure (1)..(407): unsure at all Xaa locations
VSSFGADQFDDTDPAERIQKGSFFNWFYFXINIGALISSSFLVWVQDNLGWGLGFGIPTVFMGLAIISFFAGTSLYRFQKPGGSPITRVCQVVAATLRKWNAPVPEDSSLLYELADGVSAIEGSRQLEHTDELRCLDKAATITDLDVKEDSFNNPWRVCTVTQVEELKILVRMFPVWATTIVFSAVYAQMSTMFVEQGMVLDPTIGSFKIPPASLSTFDVVSVIIWVPIYDSILVPIARRFTGKERGFSELQRMGIGLVISILAMSAAAVLEIKRLAIAREAHLVDQNVPVPLSILWQIPQYFLVGASEVFTFIGALEFFYDQSPDAMRSLCSALQLITTALGNYLSAFILTMVAYFTTRGGRPGWIPDNLNEGRLDYFFWLLAGLSFLNFLVYVLCANRFKSKKAA

SEQ ID NO: 4156 - protein, 379 aa, Triticum aestivum
MATAGKVIKCKAAVAWEAGKPLSMEEVEVAPPQAMEVRVKILFTSLCHTDVYFWEAKGQTPMFPRIFGHEAGGIVESVGEGVTELAPGDHVLPVFTGECKECPHCKSAESNMCDLLRINTDRGVMIGDGKSRFSIDGKPIYHFVGTSTFSEYTVMHVGCVAKINPEAPLDKVCVLSCGISTGLGASINVAKPPKGSTVAIFGLGAVGLAAAEGARIAGASRIIGVDLNASRFEEARKFGCTEFVNPKDHTKPVQQVLAEMTNGGVDRSVECTGNVNAMIQAFECVHDGWGVAVLVGVPHKDAEFKTHPMNFLNERTLKGTFFGNFKPRTDLPNVVEMYMRKELEVEKFITHSVPFSEINKAFDLMAKGEGIRCIIRMEN

SEQ ID NO: 4157 - protein, 323 aa, Triticum aestivum
  unsure (1)..(323): unsure at all Xaa locations
MGPKLVEVTQLFNRFKGAFKAQPNFDVCLEPSRSQHKVVLTKFPMPYNRMFQARRPKTLARMPYACDGQIYHXVVILTCENVMPQRCIWKASFCQLKPXYYSGTTCGSKFLHXGSEASPIIGGVILLXLLVQNRNFXEFHTELELLPAKALDNAYIKHGVELEQSFMEGXAYNRVLSARQTAPHETYIYFMDLLVKTVRDEIXLGASEKGYDYLSINDAKQMFKFSSEQGTAGQYIAEEHPEWDVKDGRVLFQKVKESQXPCKEIPAASNISQALFHARSRENRVMCLPRRRSSTRPLATRGNWRGLCDLFASFFFIFGLSFP

SEQ ID NO: 4158 - protein, 105 aa, Triticum aestivum
MDPKLVEVTQLFDRFKAAFKASNFDVCSTLLSQLKVLLTKFPSLPPLFQQTPNAVEELKLAREIYEQAVILSVKMEDQDAFERDFCQLKPYYMDTCGIIPPSSEE

SEQ ID NO: 4159 - protein, 544 aa, Triticum aestivum
  unsure (1)..(544): unsure at all Xaa locations
PASAHASDNMESRSTLHKVGTDMVSESEDRPREEEIIKSSISVGTSRSKISFESAEKHTTLPSGDASETENVSTDMLLRSLGKRKVLKGPRSSDDFPYKKPRMLASDIPFASHILNKHSTSEIGDTRPDIREFGGNQLDDPNKKTSNKDSCGGSPTSPAEDAARNTNKESSANNLFSSSREHPLSHWSTLERDLYLKGIEIFGKNSCLIVRNLLCGLKTCMEVASYMYNNGAANMSKSISGDFTETEQNYMEQGMVVRTKVCRRRGRTRKHKYPSKAAGHPAIRKKVGDGKQCDRQYTPCGCQEMCNKNCPCVENGTCCEKYCGCSKSCKNRFRGCHCAKSQCRSRQCPCFAASRECDPDVCRNCWVSCGDGSLGEPPXRGDGYQCGNMKLLLKQQQRILLGKSDVAGWGAFIKNPVHKNDYLGEYTGELISHKEADKRGKIYDRANSSFLFDLNDQFVLDAYRKGDKLKFANHSSSPNCYAKVMMVAGDHRVGIYAREHIEASAELFYDYRYGPDQAPAWARRPEGAKKDEASGSHRRAHKVA

SEQ ID NO: 4160 - protein, 252 aa, Triticum aestivum
MGRGRVELKRIENKINRQVTFAKRRNGLLKKAYELSVLCDAEVALIIFSNRGKLYEFCSGQSMPKTLERYQKCSYGGPDTAIQNKENELVQSSRNEYLKLKARVENLQRTQRNLLGEDLGSLGIKDLEQLEKQLDSSLRHIRSTRTQHMLDQLTDLQRKEQMLCEANKCLRRKLEESSQQMQGQMWEQHAANLLGYDQLRQSPHQQQAPHHGGNGFFHPLDPTTEPTLQIGYTQEQINNACVAASFMPTWLP

SEQ ID NO: 4161 - protein, 252 aa, Triticum aestivum; identical to SEQ ID NO: 4160

SEQ ID NO: 4162 - protein, 369 aa, Triticum aestivum
MAMLVDPPNGMGNQGKHYYSMWQTLFEIDTKYVPIKPIGRGAYGIVCSSINRETNEKVAIKKIHNVFDNRVDALRTLRELKLLRHLRHENVISLKDIMMPVQRRSFKDVYLVYELMDTDLHQIIKSPQGLSNDHCQYFLFQLLRGLKYLHSAEILHRDLKPGNLLVNANCDLKICDFGLARTNSSKGQFMTEYVVTRWYRAPELLLCCDNYGTSIDVWSVGCIFAELLGRKPIFPGTECLNQLKLIVNVLGTMSESDLEFIDNPKARRYIKTLPYTPGVPLASMYPHAHPLAIDLLQKMLIFDPTKRISVTQALEHPYMSPLYDPSANPPAQVPIDLDIDENISSEMIREMMWQEMLHYHPEAATAVNM

SEQ ID NO: 4163 - protein, 295 aa, Triticum aestivum
  unsure (1)..(295): unsure at all Xaa locations
DAWGRFKLLFLNGILPAGTGNDLARVLSWGGGLGVVEKRGGLFSVLKDVEHAAVTVLDRWKITIKDNQGKLMCSPKFMNNYFGVGCDAKVALDIHNLREENPERFYSQFMNKVLYAKEGAKNIMDNMFYYFPWEVKLEIDGSNIEIPQDAEXILVANIRSYMGGVDLWKNEDSVSDTFQPQSMHDKTLEVVSFTGMLHLGRLQVGLSRAQRLAQGHHIKIEITTPMPIQVDGEPWSQEPCTIEVSHHAQAFMLKRVSEEPISHAASIMADILENAENSGTISASQKECSASGDSV

SEQ ID NO: 4164 - protein, 60 aa, Triticum aestivum
  unsure (1)..(60): unsure at all Xaa locations
SGKAGNGGEAVSPSEATVDDATAEEEACEEGXKEGEECMQRRLLHDAHLDYIYTQHKGRP

SEQ ID NO: 4165 - protein, 128 aa, Triticum aestivum
AYIKHGVELEQSFMEGAYNRVLSARQTAPHETYIYFMDLLVKTVRDELAGCSEKGYDYLSINDAKQMFKFSSDKELQQYIAEEHPEWDVKDGRVLFQKAKESQPCKEIPAAPVINQTLGYARELERIV

SEQ ID NO: 4166 - protein, 255 aa, Triticum aestivum
  unsure (1)..(255): unsure at all Xaa locations
MSSAAAASSSASPVPPEDDVCSVCHDRFRIPCQANCSHWFCGECIVRVWNHGAAVQPCKCPICRRLINLLVPANVSDDQNDDPQLQRVLGEIQHYNHIFGGEPRSLTQRLQDLPFFXIRRLFRNLVSPERPPPLVLRARMSLMVTVRGVCLLRPAAFPPKGVRGLLGFFDNFLILVIVFLHLAAXYRSLLLYPPGGPELGSGGRRRMNVAGSGCRGGVVRAHTRRFEGCDLNCTGSEFYAVLRRLGWIDLGLLCY

SEQ ID NO: 4167 - protein, 97 aa, Triticum aestivum
PLVHYCYFQRLQDLPFFIRRLFRELMDPQRTLPLVFRARMILMVILSGVYVLSPVDILPESVLGLFGFFDDFLILVIVFLHLAAVYRSLLLYRHGGH

SEQ ID NO: 4168 - protein, 388 aa, Triticum aestivum
MKMEIDSLREAFDRVVEKRVLSSAKVQEAIGHIVNEVEQAISKMQMMNTDTMDSCDHSSILAELKAKLNEMVPLIQLEGCQKELNVALSKYLKLLEKSFSPDIAKAYRNVDYDACTVNNIITNHFYRQGLFDLGDSFVHECGGSDETYLKLPFQEMYGILEAMKARNLEPALTWAAKNHDQLLQNSSMLELRLHSLQFAEILTKGSRDVALQYARTHLVPFASLHKAEIQKLMACLIWADRLEQSPYAEFVSSTHWEKLAEELIHQFCSLLGQSSESPLGVAISAGFQGLPTLLKLSTVMAAKKQEWQTMKQLPVPIDIGPEFQYHSVFVCPVLREQSSEDNPPMLMPCGHAVSKQSIMKLSKSSSRPFKCPYCPSEAVASQCKQLQF

SEQ ID NO: 4169 - protein, 253 aa, Triticum aestivum
  unsure (1)..(253): unsure at all Xaa locations
MAKRLREAAPWEEAPGSPVNGLDDGCLMHIFSFLSPIPDRYNTALVCHRWRFLACHPRLWLRVERPLXNVKEPGVYPNPGAPLPAARPGDTILIAAGGTYLACNIQIKKPLCIIGGGELPDDTVLTCSRGSDNALEFLSTCKIANLTIKAELGCCLLHRSGKLTIQECLLQCEPNPLDYLSFPIVSTAIEYNPLSSSLKEQQGHGVTVVRTRIEGGAKAVRTNGTLALQRVRAIYARRSVFFWFEVGEKLEPL

SEQ ID NO: 4170 - protein, 225 aa, Triticum aestivum
DKYDLYGSVAFPKHHKQADVPEIYRLTAKTKGVFINPALVEPFGLTLIEAAAHGLPIVATKNGGPVDITNTLNSGLLVDPHDQNAIADALLKLVADKNLWHECRKNGLRNIHLYSWPEHCRTYLARVAGCRVRNPRWLKDTPADAGADDEAEDSLMEFQDLSLRLSIDGERGSTNEPASSDPQDQVQKIMNKLHQSSSAAPDAATDKNPANVQAAGTVNKYPLLR

SEQ ID NO: 4171 - protein, 528 aa, Triticum aestivum
  unsure (1)..(528): unsure at all Xaa locations
MICAISGEVPDEPVVSKRSGLLFERRLIERYIEDHGKCPVTKEELSMDDIVLVKTNKVVRPRPLQAASIPGLLGIFQNEWDALMLSNFALEQQLHTARQELSHALYQHDAACRVIARLKKERDESRALLALAERQIPASMAGVAPAAVVSNGKRALEDEIGPDGKKIRPGINPVMIDELTECNXHMLSAQRKKRQVPPSLASIDELERYTQISRHPLHKTNKPGILSMDIHPSKDIVATGGIDTNAVLFDRTSGQILCTLAGHSKKITTLKFVPRDELVVTGSADKTVRIWQGGEEGNYSCIHTLKDHTAEVEAVTVHATQKYFVTAAKDNTWCFYDISTGSCLSQVGEASGQEGYTSASFHPDGLILGTGTTEAVVKIWDVKTQSNVAKFEGHAGPVTAMSFSENGYFLATAALDGVKLWDLRKLRNFRTFSPYDSDTPTNSVEFDFSGTYLAVAGSDIRVYQVANVKTEWNLIKTLPDLSGTGKVTSAKFGTDAKYIAVGSMDRNLRIFGPPGDDQMDDDAKPSAE

SEQ ID NO: 4172 - protein, 492 aa, Triticum aestivum
SPAAIMVISNASSSAGEAVYSTFSSRYVREELPRYRMPSGSIPKEAAYQIISDELMLDGNPRLNLASFVTTWMEPECGKLMMDSVNKNYVDMDEYPVTTELQNRCVNMIAHLFNAPIGEDETAIGVSTVGSSEAIMLAGLAFKRKWANKMKEQGKPCDKPNIVTGANVQVCWEKFARYFEVELKEVKLTEGYYVMDPKKAVEMVDENTICVAAILGSTLTGEYEDVKLLNDLLVAKNKETGWDVPIHVDAASGGFIAPFLQPELEWDFRLPLVKSINVSGHKYGLVYPGVGWVIWRSKADLPDELIFHINYLGTDQPTFTLNFSKGASQIIAQYYQLIRLGFEGYKHIMENCKLNAAVLKEGIDATGRFDVLSKADGVPLVAIRLKDSTNFSVFDISENLRRFGWIVPAYTMPADAEHVAVLRIVIREDFNRSLAQRLLTDINKIVGELDAHAVHAIKLSTAAAAEGASKSTVDAVTEAFKGLAGNKKAGVC

SEQ ID NO: 4173 - protein, 487 aa, Triticum aestivum
  unsure (1)..(487): unsure at all Xaa locations
MVISHASSSAGEAVYSTFSSRYVREELPRYRMPEGSIPKEAAYQIISDELMLDGNPRLNLASFVTTWMEPECGKLMMDSVNKNYVDMDEYPVTTELQNXXVNMXAHLXNAPIGEDETAIGVSTVGSSEAIMLAGLAFKRKWANKMKEQGKPCDKPNIVTGANVQVCWEKFARYFEVELKEVKLTEGYYVMDPKKAIEMVDENTICVAAILGSTLTGEYEDVKLLNDLLVEKNKKTGWNVPIHVDAASGGFIAPFLQPELEWDFRLPLVKSINVSGHKYGLVYPGVGWVIWRSKDDLPDELIFHINYLGTDQPTFTLNFSKGASQIIAQYYQLIRLGFEGYKHIMENCKLNAAVLKEGIDATGRFDVLSKADGVPLVAIRLKDSTNFSVFDISENLRRFGWIVPAYTMPADAEHVAVLRIVIREDFNRSLAQRLLADINKIVRELDAHAVHAIKLSNAAAAEGASKSTVDAVTEAFKGLAGNKKAGVC

SEQ ID NO: 4174 - protein, 178 aa, Triticum aestivum
MPKHYRPAGKKKEGNAAKYITRTKAVKYLQISLAVFRKLCILKGVFPREPKKKVEGNHKTYYHMKDIAFLAHDPLIEKFREIKVHRKKVKKAMAKKNRDLADRLLNRPPTYKLDRLIIERYPSFVDALRDLDDCLTMVHLFAALPAIEGERVQVQRIHNCRRLSHEWQAYISRTNSLR

SEQ ID NO: 4175 - protein, 694 aa, Triticum aestivum
RQASEGSQGHHWPLPPFRGDSRDTYNLLEQRPRIANRHGRLYEADARSFHALAQHDVRVAVANITAGNSPTFSAPLASGLIASRRLRLPALPSAAHAHLLRHRRLVATPLRLPTTPTPLRQPAALPLRPCLRPPRAASVASPAPVPGDAPDNSRKFLGVDALTLKKIVPLGLMFFCILFNYTILRDTKDVLVVTAKGSSAEIIPFLKTWVNLPMAIGFMLLYSKLADVLSKEALFYTVIFPFIAFFGVFGYVLYPMRDAIHPTALADRLLASLGPSFLGPVAILRVWSFCLFYVMAELWGSVVISVLFWGFANQITTVEEAKEFYPLFGLGANVALIFSGRTVKYFSNMRQNLGPGVDGWAISLKGMMSIVVVLGFVIAGIYWGVNKYVIDKTSLPVERKKKNKPKLSMGESLKVLVSSQYVRDLATLVVAYGISINLVEVTWKSKLKAQFPSPNEYSSFMGDFSTATGIATFTMMLLGRLILRKFGWGVAATITPAVLLVTGVGFFSLLLFGEPLTPLLATFGMTPLLAAVFVGALQNIFSKSAKYSLFDPCKEMAYIPLDEDMKVKGKAAIDVVCNPLGKSGGALIQQFMILSFGSLANSTPYLGGILLVIVIAWLGAVRSLDSQFSPLAKQDLEREQQLKAEVVETTAQVVGTGNGSLQENVASQSSTNGTVIKQSQEPEITAPEKSGKQS

SEQ ID NO: 4176 - protein, 138 aa, Triticum aestivum
  unsure (1)..(138): unsure at all Xaa locations
IHHSKDIIATGGIDTNAVLFDRPSGQVLCTLTDHSKKITSLKFVPRDELLITGSADKTVRVWQGNEDGSYGCRHTMRDHGAEVEAVTVHASQKYFATAFRDNTWCFYDIXTGSCLTQVGEAYGQDAYTXAAFHPGGPI

SEQ ID NO: 4177 - protein, 214 aa, Triticum aestivum
  unsure (1)..(214): unsure at all Xaa locations
MKDEHLHYISQXSPHLKXLVMPAWNRISRAGICQAIERWEELESLTMPTIGHPPYIMEGLANNCXNFKELKIMXSFDLLFASAVTTYLPKLKVLSLRCSKXTMGALQCVLNSLERPEVLNISHCLLFEMATNGRRQVIHELDNKALERASRLREFHHCQSRQCVACQRMMLDEGILRWYRYEDWFWRRDEVRSLDLKDYGRLFGAQCEMLTSVD

SEQ ID NO: 4178 - protein, 492 aa, Triticum aestivum
  unsure (1)..(492): unsure at all Xaa locations
LLGMFHTDVMIARPVTGVDGGYILVRLYAFEIAIPLRIMHQGLHIIPXSILISRLFPEDVGTTCGQRPEKVIGTEHTYILRVXPFRTENGILRKWISRFDVWPYLETYTEDVANELMREMQTKPDLIIGNYSDGNLVATLLAHKLGVTQCTIAHALEKTKYPNSDIYLDKFDSQYHFSCQFTADLIAMNHTDFIITSTFQEIAGSKDSVGQYESHIAFTLPDLYRVVHGIDVFDPKFNIVSPGADMTVYFXPYTETDKRLTAFHSEIEVLRYSGNXEQWTGFCDGGKAQGDHVSHSEDWEYEAEFRRMYSLIEEYKLKGHIRWISAHMNRVRNGELYRYICDTKGAFVQPAFYEAFGLTVIEXMTCGLPTIATCHGGPAEIIVNGVSGLHIDPYHSDKAADILVNFFEKCSEDPSYWDKMSEGGLKRIYEKYTWKLYSERLMTLTGVYGFWKYVSNLERRETRRYLEMFYALKYRSLAAAVPLAVDGESSDN

SEQ ID NO: 4179 - protein, 327 aa, Triticum aestivum
QKKKKKKKKRDRARIPAAREFHGMSSQLVKAMPSLIFTKVQEDNCTSSTCAICLEDYSVGEKIRVLPCRHKFHAACVDLWLTSWRTFCPVCKRDANAGMSNFPPSESTPLLSSAIPLPAESTALSSFRSMVAASPPRTISRHPSWQSMSRTNSNSSILHIRNPCRCCSNSPAISTSRSSVDLANMSSPWSNTLNLASGHSLGGGHFSPPISIGYTSPHVSPFGYRFSGQFIGSPHIPRSENGSPSYYPGSSGQQYPYLRHRTESGPSLFTMVPQSPQQTQLQDGGDSATSLSASASTQSLRQAYLQHCPDSDVSLSAATSAQSLPGC

SEQ ID NO: 4180 - protein, 159 aa, Triticum aestivum
EFMSTLVNYKIPLAVASRRPRKAVEAAIEAVGARGFFDAVVAAEDVYRGKPDPELFLYAAQLLGFIPERCVVFGNSNSAVEAAHDARMKCVAVASKHPVYELGAADLVVKRLDELSVVDLKNLADIDSPEFGMEPEPEMEEEEDEAPPSTAVGVDDIFL

SEQ ID NO: 4181 - protein, 511 aa, Triticum aestivum
MTATPALIGLSAGNRLLSTSFGPPNDLLSDKVNCHMSSAAGDAHGSSSVQFAPPAASKLTVAAHRLKLSPHGRAQVMRALRQSAPALAPQPPPLLPADEFSLDAIILLQRSMLEKQWQLPFEEEDDDDGGGDGHHGVPLGSAEDDDGKGRSSSVVVARSGVSARQRRMSGRRRGRSKKGSGAVHLSISPELLQSRNRIYLRGTVSKELLTHKQVVHLSKKIKDGIWLQQQRSKLKEKLGNEPSYKQMAQSLRISTPELRSRMRESFLAREVLTMSNIRLVISIAQKYDKLGVELSDLIQGGLIGLLRGIEKFDASRGFRISTYVYWWIRQGVSRALADNSKTFRLPTYLHERLIAIRGAKYALEDQGVSPTTQNIAKLLNISEKKVHNATQAVNKALSLDQQAFPSLNGLPGDTLHSYIEDQNVANDPWHGFEEWYLKEEVNKLLNSNLTERERDIIQLYHGIGKQCHTWEDISRQFGLSRERVRQVGLIAMEKLKQRARRKKLDALLQDY

SEQ ID NO: 4182 - protein, 401 aa, Triticum aestivum
ALLTLTKGNKSWSRHRGRPRVRARVRHHCNEPLASRQRRPQISLSPPCAAVVERSKKMAASNLEGVLLGMGNPLLDISAVVDEAFLAKYDVKPNNAILAEDKHLPMYDELSSKDNVEYIAGGATQNSIRVAQWMLQTPGATSYMGCIGKDKYGEEMKSAAKAAGVTAHYYEDEAAPTGTCAVCVVGGERSLIANLSAANCYKSEHLKKPENWALVEKAKYIYIAGFFLTVSPESIQLVAEHAAANNKVFLMNLSAPFICEFFRDAQEKVLPYSDYIFGNETEARIFSKVRGWETENVEEIALKISQLPLASGKQKRIAVITQGADPVVVAEDGKVKTFPVILLPKEKLVDTNGAGDAFVGGFLSQLVQGKSIEDCVKAGCYAANVIIQQSGCTYPEKPDFN

SEQ ID NO: 4183 - protein, 384 aa, Triticum aestivum
WIPRAAGIRHEGLLASRQRRPQISLSPPCAAVVERSKKMAASNLEGVLLGMGNPLLDISAVVDEAFLAKYDVKPNNAILAEDKHLPMYDELSSKENVEYIAGGATQNSIRVAQWMLQTPGATSYMGCIGKDKYGEEMKSAAKAAGVTAHYYEDEAAPTGTCAVCVVGGERSLIANLSAANCYKSEHLKKPENWALVEKAKYIYIAGFFLTVSPESIQLVAEHAAANNKVKVFLMNLSAPFICEFFRDAQEKVLPYADYIFGNETEARIFSKVRGWETENVEEIALKISQLPLASGKQKRIAVITQGADPVVVAEDGKVKTFPVILLPKEKLVDTNGAGDAFVGGFLSQLVQGKSIEDCVKAGCYAANVIIQQSGCTYPEKPDFN

SEQ ID NO: 4184 - protein, 226 aa, Triticum aestivum
MAEADITRYWCHECQQAVEEAMVEELKCPLCDGGFVEEMTVEQVEALTEQGATQWDPLDNPFEQAGSPGDSDDEENSDIGREFEGFIRRHRRASALRRVLDSIHDDLRDDRERDNSVLISAFNQALALQGAALDPDEDRGDHGNANNDDGLLDEYVLGAGLSLLLQHLAENDPSRYGTPPTKKEAVEALPTVKIEEVVSCSVCLDDLDIGSQAKQLPCEHKFHSPC

SEQ ID NO: 4185 - protein, 387 aa, Triticum aestivum
  unsure (1)..(387): unsure at all Xaa locations
MAAAASSSSPPAVITCRAAVAWGPGQALVMEDVEVAPPGPLEIRVKVVSTSICRSDVAEWQSTAQPDLFPRIFGHEASGPXVVESVGEGVTEFQVGDHALTVFIGECMSCKHCVSXXKSNMCQTLGLERKGVMHSDQTTRFSIGGKPVYHYCAVSSFSEYAVVHSGCAVKVSPTMPMDRICLLSCGASAGLGAAWNVADVSKGSSVVIFGLGTVGLSVAQGAKLRGASKIIGVDTNPAKQEKGKAFGVTDFINPAELNEPVQQVVKRLTDGGADYSFECVGDTGVVSTALQSCSDGWGLTVTLGVPKAKPEVSAHYGLLLSGRTLKGSLFGGWRPKTDIPLLXEKYANKEIQVDGLVTHDMPFSDINKALELMLQNRCLRCVIHMPK

SEQ ID NO: 4186 - protein, 166 aa, Triticum aestivum
MGKKKKRVEKVFCYYCDREFDDEKILVQHQKAKHFKCHVCHKKLSTAGGMAIHVLQVHKESVTKVPNAKPERDSTEIEIFGMQGIPSDVLAAHYGEEEDPSSKVAKVEVPTIRPPIMPNYPIGMPFPPRPYGAARPMYNPAMMVRPPIWPLQQPQLGCSTTRFSSQ

SEQ ID NO: 4187 - protein, 263 aa, Triticum aestivum
  unsure (1)..(263): unsure at all Xaa locations
HRNLVPLLGYXCKIGEERLLMYDFMKFGSLEDVLHDRKKIGIKLNWAARRKIAIGAARGLAFLHHNCIPHIIHRDMKSSNVLVDENLEARVSDFGMARMMSVVDTHLSVSTLAGTPGYVPPEYDRGFRCTTKGDVYSYGVVLLELLTGKPPTDSTDFGEDHNLVRWVKMHTKLKIADVFDPELLKDDPTLELELLEHLKIACACLDDRPSRRPTMLKVMTMFKEIQAGSTVDSKTSSVATGLSDDPGFAVMDMTLKEAKEEKD

SEQ ID NO: 4188 - protein, 87 aa, Triticum aestivum
MARATTLVLVAALAVLLLLASGPAGATAARTSPKDVATASPNEKVAAAAAEDHECEMMAGEKQRDECMARRTLAAHTDYIYTQEKHN

SEQ ID NO: 4189 - protein, 221 aa, Triticum aestivum
MAPATADAAGAAVGGRVKTALGVAACERDAEKLELIEQLTKGFDDEQQRVLAAILARNNGAEYLRRHGMEGCTDRDAFKARVPVVTYEDLRPEIERIANGDRSNIISSHPISEFLTSSGTSAGERKLMPTIEDELDRRQMLYSLLMPVMNLFVPGLDKGKGLYFLFIKSETKTPGGLPARPVLTSYYKSDHFKYRPFDAYQVYTSPTPAILCTDSFQSMYS

SEQ ID NO: 4190 - protein, 137 aa, Triticum aestivum
MAEEKHHHHLFHHKEGEDFQPAADGGVDTYGYSTETVVTATGNEGEYERITKEEKHHKHKEHLGEMGAAAAGAFALYEKHEAKKDPEHAHKHKIEEEVAAAAAVGAGGFVFHEHHEKKQDHKEAKEASGEKKHHHFG

SEQ ID NO: 4191 - protein, 184 aa, Triticum aestivum
MSFLSLSKAITIGGSYRVGRRPLVLTSTAGMLACLIGLGTGLTVVGRHPDAKVPWAIGLCIVSILAYVSFFSIGLGPLTSVYTSEVFPLRVRALGFALGASCNRVTSAAVSMSFLSLSKAITIGGSFFLYAGIAAIGWIFFFTFIAETRGLPLEEIGKLFGMTDTAVEAQDTATKDKAKVVEMN

SEQ ID NO: 4192 - protein, 120 aa, Triticum aestivum
  unsure (1)..(120): unsure at all Xaa locations
MGRKLALLVGIKYPGTKGELKGCHNDVDRMHKGLVDRIGFDEDNITVLLDRGSSGPQPTXANIRHALAKLACDCFPAPSLFFHYSGHSTMPPNETGKDDHTGYHGCXAPSDLNLITDHDS

SEQ ID NO: 4193 - protein, 211 aa, Triticum aestivum
MADEDEYRCFVGNLSWSTTDESLKDAFSKYGKVTEAKVVMDKFSGRSRGFAFVTFDEKKAMEEAIEDMNGLDLEGRAITVDKAQPQGVGRDRNGDRDFDRDRGSRGGRDYGGGRAPRGGGGGGDCFKCGKPGHFARECPDGDGGRGDRYGGRDDRYGGGRSDRGGDRSDRGGDRSDRDGDRSERGSDRYSSRSRDGGSGGDRYSCDRSGPY

SEQ ID NO: 4194 - protein, 84 aa, Triticum aestivum
  unsure (1)..(84): unsure at all Xaa locations
RQNKPCEHEKRCTGINKPDYLATVDVDPNSATYSQVIHRLPATHIGDELHHSGWNACSSCHXDXXTSRRFLILPSLLSGXVFVV

SEQ ID NO: 4195 - protein, 77 aa, Triticum aestivum
  unsure (1)..(77): unsure at all Xaa locations
MSCSFTNQVIAQLELWKEKXTGKYEKKVYVLPKHLDEKVAALHLGKLGARLTKLTKAQSEYISIPVEGPYKPAAYRY

SEQ ID NO: 4196 - protein, 286 aa, Triticum aestivum
ASGVPGAHTPPTHPTSANHPQPNHPRGYGCTPAPETRAPPIHFYPAIIFSMARLDRVKNMTGLVEMYGRNPRLQELVNLVVVCGDHGKVSKDKEEQAEFKKMFDLIEQYNLIGHIRWISAQMNRVRNGELYRYICDMKGAFVQPAFYEAFGLTVIEAMTCGLPTFATAYGGPAEIIVHGVSGYHIDPYQNDKASALLVDFFGKCQEDPSHWNKISQGGLQRIEEKYTWKLYSERLMTLSGVYRFWKYVSNLDRRETRRYLEMLYALKYRKMAATVPLAVEGETSGK

SEQ ID NO: 4197 - protein, 248 aa, Triticum aestivum
VLKDKMQPIIFSMARLDRVKNMTGLVEMYGRNPRLQELVNLVVVCGDHGKVSKDYEEQAEFKKMFDLIEQYNLIGHIRWISAQMNRVRNGELYRYICDMKGAFVQPAFYEAFGLTVIEAMTCGLPTFATAYGGPAEIIVNGVSGYHIDPYQNDKASALLVDFFGKCKEDPSHWNKISQGGLQRIEEKYTWKLYSERLMTLSGVYGFWKYVSNLDRRETRRYLEMLYALKYRKMAETVPLAVEGETSGK

SEQ ID NO: 4198 - protein, 298 aa, Triticum aestivum
VIDLITSKDVERIRSYPKLGKPSLGADGKFVVAASIGTREDDKLRLEQLIQAGANAIVIDSSQGNSTYQLDMIKYAKKTFPEVDLIGGNVVTIGQAQNLIAAGVDGLRVGMGSGSICTTQEVCAVGRGQATAVYKVASYAKDHNVPVIADGGISYSGHIVKALSLGASTVMMGSFLAGSHEAPGAYEYKDGHRVKKYRGMGSLEAMTKGSDARYLGDTLKLKVAQGVVGAVADKGSVLRFIPYTMQAVKQGFQDLGASSLQSAHDLLRAETLRLEVRTGAAQVEGGIHGLVSYEKKSF

SEQ ID NO: 4199 - protein, 298 aa, Triticum aestivum; identical to SEQ ID NO: 4198

SEQ ID NO: 4200 - protein, 328 aa, Triticum aestivum
RWKQNFKSLPMPMDTDLDTTQQDYVRTAQASGKALVSLINEVLDQAKIESGKLELEAVPFDLRLVCDDILSLFYGKAQEKGLELAVYVSDQVPQTLIGDPARMRQIITNLMGNSIKFTERGHIYLTVHVVEEVMSCLEVETEFQNTNNTYNTLSGYQVANRRQSWQSFQLFNMDLHLSEMTFAPIMPETIRLIISVEDTGVGIPPEAQSRIFMPFMQVGPSIARIHGGTGIGLSISKCLVHLMKGEIGYVSIPNVGSTFSFTAVLTKARSNANANKSPGFKGINALVVDHKPVRAKVTKYHLQRLGVKTELTTDVNQVIPKMNCASLV

SEQ ID NO: 4201 - protein, 208 aa, Triticum aestivum
MDAMEEDTPPAPPPPPPHTTGAKQPPYKDPDDGRQRFLLELEFIQCLANPIYINYLAQNRYFEDEAFIGYLKYLKYWQRPEYIKYIMYPHCLFFLELLQNANFRNAMAHPANKEVAHRQQYFFWKNYRNNRLKHILPRLPPEPTPAPAPAPAPVPTPPPVPAPPSSLPTMSAVGASAMPPMQFIGTPGTNNPKNEMRNVMGGRKRKMG

SEQ ID NO: 4202 - protein, 205 aa, Triticum aestivum
MPRSGALPLLAALVLALAAAAAASSGAAKGAPAATDFIRKSCRETQYPSVCMQSLSSYGKPPPRSPQELARAALSVSADRARSASAYVGRICGPAPRGGGGAKAAKGSPARDCGPGLRSGSGAKAKAAKELDGSLGRAGSPAFRWHLSNVQTWCSAALTDENTCLDGLSRGVDAGTRAAIRSKVVEVAQVTSNALALVNKVGSGH

SEQ ID NO: 4203 - protein, 190 aa, Triticum aestivum
  unsure (1)..(190): unsure at all Xaa locations
MLSATTSKQDRSSCGFQNAXQSSDVEAEHVPENQDQANDKTQQACCSNSSAGDMNHRRFRNISSPNDSWKEVSEEGRMAFDKLFSRGKLPQSFSPPQAEGLKVVPRGEQDEATTVTVDLNKSAAVIDHELDTLVGPRATFPIELSHLNMKSRRTGFKPYKRCSVEAKENRVPAADEVGTKRIRLDSEPST

SEQ ID NO: 4204 - protein, 448 aa, Triticum aestivum
  unsure (1)..(448): unsure at all Xaa locations
MAAAAVAADSKIDNLRDAVXRLGEISENEKAGFISLVSRYLSGEAEQIEWSKIQTPTDEVVVPYDTLAPPPEDLDAMKALLDKLVVLKLNGGLGTTMGCTGPKSVIEVRNGFTFLDLIVIQIESLNKKYGCSVPLLLMNSFNTHDDTQKIVXPFSNSNIEMHTFNQSQYPRVVTEDFLTLXAKGRSGKDGWYPPTHGGVAPSLIQKRKLXVLAVTVKGEYVRGELIDLASLADDQVSKLISHEARVILNANNLWPNVYGNKWKSNEKFKKFETIPQWVNVDGVKVLQLETAAGAAIRFFEKAIGINVPRSRFLPVKATSDFLFERYGHXVPCLGTLPATATAGMLLVQSDLYTLVDGYVIRNPARVKPSNPSIELGPEFKKVANFLARFKSIPSIVELDSLKVSGDVSFGSGVVLKGNVTIAAKAGVKLEIPDGAVLENKDINGPEDL

SEQ ID NO: 4205 - protein, 474 aa, Triticum aestivum
  unsure (1)..(474): unsure at all Xaa locations
MAAAAVAADSKIDNLRDAVAKLGEISENEKAGFISLVSRYLSGEAEQIEWSKIQTPTDEVVVPYDTLAPPPEDLDAMKALLDKLVVLKLNGGLGTTMGCTGPKSVIEVRNGFTFLDLIVIQIESLNKKYGCSVPLLLMNSFNTHDDTQKIVEKYSNSNIEIHTFNQSQYPRIVTEDFLPLPXKGQTGKDGWXYPPGHGDVFPSLNNSGKLDTLLSQGKEYVFVANSDNLGAIVDIKILNHLITNQNEYCMEVTPKTLADVKGGTLISYEGRVQLLEIAQVPDEHVNEFKSIEKFKIFNTNNLWVNLKAIKRLVDAEALKMEIIPNPKEVDGVKVLQLETAAGAAIRFFEKAIGINVPRSRFLPVKATSDLLLVQSDLYTLVDGYVIRNPARVKPSNPSIELGPEFKKVANFLARFKSIPSIVELDSLKVSGDVSFGSGVVLKGNVTIAAKAGVKLEIPDGAVLENKDINGPEDL

SEQ ID NO: 4206 - protein, 482 aa, Triticum aestivum
  unsure (1)..(482): unsure at all Xaa locations
PLPSSHLTSAPVLSSSLPPEAAASLLSARIAMAAAADSKIDNLRDAVAKLGEISENEKAGFISLVSRYLSGEAEQIEWSKIQTPTDEVVVPYDTLAPPPEDLDAMKALLDKLVVLKLNGGLGTTMGCTGPKSVIEVRNGFTFLDLIVIQIESLNKKYGCSVPLLLMNSFNTHDDTQKIVEKYSNSNIEIHTFNQSQYPRIVTEDFLPLPSKGQTGKDGWYPPGHGDVFPSLNNSGKLDTLLSQGKEYVFVANSDNLGAIVDIKILNHLITNQNEYCMEVTPKTLADVKGGTLISYEGRVQLLEIAQVPDEHVNEFKSIEKFKIFNTNNLWVNLKAIKRLVDAEXLETAAGAAIRFFEKAIGINVPRSRFLPVKATSDLLLVQSDLYTLVDGYVIRNPARVKPSNPSIELGPEFKKVANFLARFKSIPSIVELDSLKVSGDVSFGSGVVLKGNVTIAAKAGVKLEIPDGAVLENKDINGPEDL

SEQ ID NO: 4207 - protein, 203 aa, Triticum aestivum
SLAGLRRAMHPIDVAGKVCQHDEARAIACSMPKLRHLEIGYMLIATNAVVEIASRCRDLSFLDLRGCWGVDDKLLQDKYPGLKVLGPRVDDCYENSSPPPRPPPPGGVLRRLGRRPPPPPPPPPTPRGLLRRRERRRRGPVGRRPRPRGAGGEVLRRRVRRGRLRRHRLAGVSMNQDFLFINKLSREVKPACLPACLLLLLLS

SEQ ID NO: 4208 - protein, 381 aa, Triticum aestivum
MATAGKVIKCKAAVAWEAGKPLSIEEVEVAPPQAMEGQTPVFPRILGHEAGGIVESVGEGVTELVPGDHVLPVFTGECKCAHCKSKESNLCDLLRINVDRGVMIGDGESRFTIGGKPIFHFVGTSTFSEYTVIHVGCLAKINPEAPLDKVCVLSCGISTGLGATLNVAKPKKGDDPRRFCSTPCFCRLKRIMCYNQGNFRVLLSHMINPRGHGKGPRWSGASRIIGVDLNPAKHEQAKKFGCTDFVNPKDHTKPVQEVIVEMTDGGVDRAVECTGNADAMISAFECVHDGWGVAVLVGVAHKEAVFKTHPMNFLNERTLRGTFFGNYKPRTGLPGVVDMYMRKELELDKFITHSVPFSQINTAFDLMLKGEGLRCVIRMEE

SEQ ID NO: 4209 - protein, 125 aa, Triticum aestivum
MSAMETDAPDAPPPAAPAPAADAGAGSSSSSSRKPGKRFEIKKWNAVALWAWDIVVDNCAICRNHIMDLCIECQANQASATSEECTVAWGVCNHAFHFHCISRWLKTRQVCPLDNSEWEFQKYGH

SEQ ID NO: 4210 - protein, 356 aa, Triticum aestivum
YPLFGLGANIALIFSGRTVKYFSNLRKTMGPGVDGWEVSLKGMMGIVVLLGLVITARGRGGNKLVLNDPSLPKSDHKKKKNKPKLSMKESMKVLISSKYVRDLATLVVAYGISINLVEVTWKSKLKAQFPSPNEYSSFMGDFSTATGIATFTMMLLGRIIFQRFGWGVAAMITPTVLLVTGVGFFSLILFGQPLTPLLATWGMTPLLAAVYVGALQNIFSKSAKYSLFDPCKEMAYIPLDGDMKLKGKAAIDVVCNPLGKSGGALIQQFLILIFGSLANSTPYLGGILLVIVLAWLGAARSLDKQFSSLAKEDLRKEMSKEKVETAAPKEPEAATDVLVEQSNGTENSPSDSSPAQ

SEQ ID NO: 4211 - protein, 348 aa, Triticum aestivum
MENGGSKGDVPEDANAHCPGTQSEEAGKADSCAGCPNQQICATAPKGPDPDLVAIAERMATVKHKILVLSGKGGVGKSTFSAQLSFALAEMDHQVGLLDIDICGPSIPKMLGLEGQDIHQSNLGWSPIYVESNLGVMSIGFMLPNPDDAVIWRGPRKNGLIKQFLKDVDWGEIDYLVVDAPPGTSDEHISIVQYLQATEVDGAIIVTTPQQVSLIDVRKEINFCKKVGVPVLGVVENMSGLRQAFTDLKFVKPGPAGETDATEWAMNYIKEKAPELLSVVACSEVFDSSKGGAEKMCHEMGVPFLGKVPMDPQLCKAAEEGRSCFADQRCSASAPALKSIIDKLIKTK

SEQ ID NO: 4212 - protein, 379 aa, Triticum aestivum
MWGERAHHKHGHHHDNVGSRDRQPKFIADNYSSVDEVVAALREAGLESSNLILGIDFTKSNEWSGRHSFGRKSLHAISGTPNPYEQAISIIGRTLSPFDDDNLIPCFGFGDASTHDHSVFSFYQENRPCRGFEEVLDRYRQIVPHLNLSGPTSFAPLIYAAMSVVESSNCQYHVLVIIADGQVTTSTSGARLSPQEQATIQAIVDASFYPLSIVMVGVGDGPWDAMQHFDDCIPDRAFDNFQFVNFTGIMSSSKDMSKKEAAFALAALMEIPTQYKATQGLRPPERHAQNANPPRILPPPSKVLERDNIVAASHTPAATSQSTDVGYTVSDEKVCPICLTNPKDMAFQCGHLTCKECGPTLSTCPLCRAPITVRVRLFS

SEQ ID NO: 4213 - protein, 112 aa, Triticum aestivum
  unsure (1)..(112): unsure at all Xaa locations
MRIQCDACEGAAATVVCCADEAALCARCDVQIHAANKLASKHQRLPLEDAAAAGLPRCDVCQDKPAFVFCVDXRALFCRDCDDSIHVQGTLSANHQRYIATGIRVGFSSVCS

SEQ ID NO: 4214 - protein, 802 aa, Triticum aestivum
MAAKLTRLHSLRERLGATFSSHPNELIALFSRYVHQGKGMLQRHQLLAEFDELFESDKEKYAPFEDILRAAQEAIVLPPWVALAIRPRPGVWDYIRVNVSELAVEELTVSEYLAFKEQLVDEHASSKFVLELDFEPFNASFPRPSMSKSIGNGVQFLNRHLSSKLFQDKESLYPLLNFLKAHNYKGTTMMLNDRIQSLRGLQSALRKAEEYLVSIPEDTPSSEFNHRFQELGLEKGWGDTAKRVHDTIHLLLDLLEAPDPASLEKFLGTIPMMFNVVILSPHGYFAQSNVLGYPDTGGQVVYILDQVRALENEMLLRIKQQGLDITPKILIVTRLLPDAVGTTCGQRLEKVIGTEHTDILRVPFRTENGILRKWISRFDVWPYLETYTEDVANELMREMQTKPDLIIGNYSDGNLVATLLAHKLGVTQCTIAHALEKTKYPNSDIYLDKFDSQYHFSCQFTADLIAMNHTDFIITSTFQEIAGSKDSVGQYESHIAFTLPDLYRVVHGIDVFDPKFNIVSPGADMTVYFPYTETDKRLTAFHSEIEELLYSDVENDEHKFVLKDRNKPIIFSMARLDRVKNMTGLVEMYGKNAHLKDLANLVIVAGDHGKESKDREEQAEFKRMYSLIEEYKLKGHIRWISAQMNRVRNGELYRYICDTKGAFVQPAFYEAFGLTVIEAMTCGLPTIATCHGGPAEIIVNGVSGLHIDPYHSDKAADILVNFFDKCKADPSYWDKISQGGLQRIYEKYTWKLYSERLMTLTGVYGFWKYVSNLERRETRRYIEMFYALKYRSLASQVPLSFD

SEQ ID NO: 4215 - protein, 209 aa, Triticum aestivum
MRRSVAMNCGSGPAPATMVRCRQCSASVAAPPGARAVQCAQCCCVTRVGGAGRQLSVMRPIPNFGGGRGKKRAVLVGIKYTNTRACELRGPINDVKCMRYLLTERFGFANDCVLILTDEERDPCRQPTKANIRMAMHWLVQGCSSGDSLVFQFSGAGAQVPDCDGDAGNCSLQGPVGCSIRKVANFSGVEEPQMSSACKFDINCEPFCM

SEQ ID NO: 4216 - protein, 198 aa, Triticum aestivum
MRRSVAMNCGSGPAPATMVRCRQCSASVAAPPGARPARGAQCCCVTRVGGAGRQLSVMRPIPNFGGGRGKKRAVLVGIKYTNTRACELRGPINDVKCMRYLLTERFGFANDCVLILTDEERDPCRQPTKANIRMAMHWLVQGCSSGDSLVFQFSGAGNCSLQGPVGCSIRKVANFSGVEEPQMSSACKFDINCEPFCM

SEQ ID NO: 4217 - protein, 119 aa, Triticum aestivum
MGESEYRCWEELLPDALGLVFRNLPLQEVLTVVPRVCKSWGRVVAGPYCWQEIDIEEWSQQRHSRPDHLVRMLDLLLRRSSGACRRICVSGLPCDPLFSFIGDHARALMTLERPPSRAL

SEQ ID NO: 4218 - protein, 407 aa, Triticum aestivum
  unsure (1)..(407): unsure at all Xaa locations
MDAGGAQPXPDSEMAEAGAAAAAAAAAAGAAPGGAMDNIQATLTHGGRFIQYNIFGNVFEVTAKYKPPILPIGKGAYGIVCSALNSETGEQVAIKKIANAFDNKIDAKRTLREIKLLRHMDHENIVAIRDIIPPAQRTAFNDVYIAYELMDTDLHQIIRSNQALSEEHCQYFLYQILRGLKYIHSANVLHRDLKPSNLLLNANCDLKICDFGLARTTSETDFMTEYVVTRWYRAPELLLNSSEYTAAIDVWSVGCIFMELMDRKPLFPGRDHVHQLRLLMEVFPCGISSLQLIGTPNEADLDFVNENARRYIRQLPRHARQSLSEKFPHVHPSAIDLVEKMLTFDPRQRITVEGALAHPYLASLHDISDEPVCTMPFSFDFEQHALSEEQMKDLIHQEGITFNPDYQ

SEQ ID NO: 4219 - protein, 219 aa, Triticum aestivum
MDDPPPRLVDLADAEVGKEYELVITTYAGLCRYRVGDILQAAGPGNAAPQFRFVRRKNVLLSIDSDKTDEAELQAAVERAARLLAPYGASIVEYTSEADATTIPGHYVVYWELMLKDCREGLWPEAAVFERCCLEMEEALNSVYRQGRNGDAIGPLEIRVVRGGTFEEVMDYAISRGASINQYKAPRCVSFGPIIELLNSRVLSKHFSPACPKYGPPKK

SEQ ID NO: 4220 - protein, 277 aa, Triticum aestivum
MAAAAEQDYWGLFREETGWYNEIFLSAVVPGGGGWWRALPHPLRSWLRNCIGGYLLYFATGFLWCFVIYYWKRNAYIPKDAVPTVEAMKKQIIVASKAMPFYCALPSISEHMIESGWTRCFFHISEVGWPMYIVYVSLYLIFVEFGIYWMHRELHDIKPLYKHLHATHHIYNKENTLSPFAGLAYSIHCGILQAISHVIALFLLPMHFRTHIALLFIEAVWTANIHDCIHGKIWPVMGAGYHTIHHTTYRHNYGHYTVWMDWLFGTLREPEDLLKKD

SEQ ID NO: 4221 - protein, 365 aa, Triticum aestivum
MGGAGGAKAYGAVVLIRVMYSGMHIMSKIALDQGMNPFVFVFYRHTTAALVLIPIAFALERQKTKPVTLRIAGKMFVHALYGVTACGVLFNLGLNYASATSSSALYNVQPVVTFILAVIIGMESMKLKKLHGNLKVAGILCCVAGVTVLAFYEGPMSRSFNHHRLFQHGSSSSSSSGAGTYSKNQWVFGIFLMTLSNILAGLWTVLQGPLIEDTSKLMNTTLQISCASVQAFVVAVAAERDFSKWKIGWNISLAAIIYSGVIVTALSYYMQMWTIAKRGPVFLAMSMPLTLIFTIIISSFVLGEAVSLGSIIAGILLIGGLYNVLWGKSMERKDDDTNKMGGGKPGQEVQDKEQARVPDDAAAKV

SEQ ID NO: 4222 - protein, 201 aa, Triticum aestivum
MASGTDEKAKMESLTSPAAFVEGGVQDACDDACSICLEAFCESDPSALTGCKHEFHLQCILEWCQRSSQCPMCWQPVSMKDPTSQELLEAVQWERNIRTNQTQNTTIFHHPALGDFEVQHLPVVGNDAELEERILQHLAAAAAMGRSHQHGRREGQRNRSGSHGRPQFLVFSAHPNTPAGSVSSSSTQGEGADDLRILVPR

SEQ ID NO: 4223 - protein, 186 aa, Triticum aestivum
MTAPAELSREENVYMAKLAEQAERYEEMVEFMEKVAKTVDSEELTVEERNLLSVAYKNVIGARRASWRIISSIEQKEESRGNEDRVTLIKEYRGKIETELSKICDGILKLLETHLVPSSTAPESKVFYLKMKGDYYRYLAEFKSGPERKDAAENTMVAYKAAQDIALAELAPTHPIRLGLALNFSV

SEQ ID NO: 4224 - protein, 123 aa, Triticum aestivum
  unsure (1)..(123): unsure at all Xaa locations
MAEEKHHHHLFHHKKEGEDFQPAADGGVDMYGYSTETVVTATGNEGEYERITKEEKHHKHKEHLGEMGAAAAGAFALYEKHEAKKDPEHAHKHKIEEEXVAXCGXVGAGGFVFHEHHEKKQDH

SEQ ID NO: 4225 - protein, 467 aa, Triticum aestivum
MSPTPGDREPLVHSRHRAESRVDSPPDPAMDSASRVAPPPVSAGVRVRAPLVESVSCYCRLDTGLKTVVDARKFASGAKMCMQPDVKQTKRKSRGSRKERCRAQAPLLPGLPDDLAIACLIRVPRVEHPNLRTVCKRWNRLLSGNYYYSLRKKLSMAEEWVYVFKRDREGKISWHAFDPLNQLWKSLPPVPPEYSEALGFGCAVLSGCYLYLFGGKDPLRGSMRRVVFYNARTNKWHRAPDMLRKRHFFGSCVINNCLYVAGGECEGIQRTLQSAEVYDPNRNRWVCIPEMNNGMVPFIGVVYDDKWFLKGLDSHRQVTCEVYLPSSNLWSTIDDEMVTGWRNPSISFNGRLYSSDCRDGCKLRVYDANTGTWARFIDSRHHLGSSRAFEAAGLVSLNGKLCIIRNNMSITLVDILDPTMSIETDSACMWKTVARKGQHKSFVANLWSTIAGRNLKSHIIHCQVLQI

SEQ ID NO: 4226 - protein, 302 aa, Triticum aestivum
MVYIKNQKTRAYSKRFQVKFKRRRQGKTDYRARLRLTNQDKNKYNTPKYRFVVRFTNKDVTAQIVYATIAGDIVMAAAYSHELPRYGLEVGLTNYAAAYCTGLLLARRVLKNRDLDEEYEGNVEATGEDFSVEPSDERRPFRALLDVGLIRTTTGNRVFGALKGALDGGLDIPHSDKRFAGFKKDEKSLDAEIHRKYIFGGHVADYMRSLADEEPEKFQTHFSEYIKRGISADDMEAVYKKVHAAIRADPTMAKSTKAPPKTHKRYNPKKLTYEQRKASLVERLNALNNSAGAADDDEDDDE

SEQ ID NO: 4227 - protein, 257 aa, Triticum aestivum
MAANFWASSHSKQLLDPEDVDLVPAADRERGITTEEFRLVKIHMSSHIWRLAQQVKVRQRVIATAITYFRRVYTRKSMSEYDPRLVAPACLYLASKVEESTVQARLLVFYIKKMCGSDDKYRFEIKDILEMEMKLLEALDYYLVVYHPYRPLLHLLQDAGVTDLTQFAWGLVNDTYKMDLILVQPPYMIALSCIYIASVLKDKDTTSWFEELHVDMNIVKNISMEILDFYETYKVDPQRGLSDEKISPIMNKLPAKA

SEQ ID NO: 4228 - protein, 564 aa, Triticum aestivum
  unsure (1)..(564): unsure at all Xaa locations
MADLQTPLVRPKRKKVLVDYLVQFRWILVIFVVLPASALIYFNIYLGDMWSAMKSEKKRQKEHEDNVQKVVKRLKQRNPKKDGLVCTARKPWIAVGMRNVDYKRVRHFEVDLSAFRNILEIDPERMVAKVEPLVNMGQISRAXTCPMNLSLAVVXAELDDLTVGGPHQRATGIEGSSHIYGLFSDTVVALEIVLADGRVVRATKDNEYSDLFYGVPWSQGTLGFLVSAEIKLIPIKEYMRLTYTPVKGPLKEVAQAYADAVAPRDGDPAKVPDFVEGMVYSATEGVMMTGVYASKEEAKKKGNKINSVGWWFKPWFYQHAQTALKKGEFVEYIPTREYYHRHTRCLYWEGKLILPFGDQFWFRFLFGWLMPPKVSLLKATQGDAIRNYYHDNHVIQDMLVPLYKVGDALEFVHHEMEVYPLWLCPHRLFKLPVKTMIYPEPGFEHQQRQGDTSYAQMFTDVGVYYTPGXIFRGEEFDGAESVKRLEQWLIENHSYQPQYAVTELNEKDFWRMFDASHYEHCRHKYGAVGTFMSVYYKSKKGRKSEKEVQEAEAAILEPAYADEA

SEQ ID NO: 4229 - protein, 167 aa, Triticum aestivum
MSSDGGGSQMGVAGALGLSVTSSVAIVICNKYLMSTLKFYFATTLTSWHLLVTFCTLHIAQRLRFFEPKPIDAQTVISFGFLNGISIGLLNLCLGFNSVGFYQMTKLAIIPFTMLLETIFLSKKFSQSIKASLMVLLLGVGIASVTDLQLNLLGSIIAVLTIAATCV

SEQ ID NO: 4230 - protein, 129 aa, Triticum aestivum
MGTAFSSSSSTPESRAMALAKAKEIVASASVVVFSKSYCPFCVQVKKLLTQLGASFKAVEMDTESDGTEIQSALAEWTGQRTVPNVFINGKHIGGCDDTIALNKGGKMVALLTEDEAISGSSSKTNETD

SEQ ID NO: 4231 - protein, 200 aa, Triticum aestivum
KSALFHKALSALIRLFSASPQGFRKVDPDRWEFAHGSFLRGQTHLLRNIRKDAGAAGLTDDDMTMVATEVVRLKKEQSTIDDRVAAMWRRVQETERKPKQMLAFLLTIVGDRDTLQRLVGNSGNAAGGDQEPVEGGEKRARLLLDGDFGNVSAFGPDAVDFAGFYTDDAFANAPVPVEAAAGSGGGGAGCTFAFGVDSGY

SEQ ID NO: 4232 - protein, 989 aa, Triticum aestivum
  unsure (1)..(989): unsure at all Xaa locations
GALLQRNTRLENRSLCIWNPDRKKKQIGCQEALQSSKILIVSKGAKXVCGATLCYEVAHEKRGQHINESSIHAESTRGHMPRIGSTDAIDVWANQHKDKKLYIVLVSIHGLIRGENMELGRDSDTGGQVKYVVELARALGETPGVYRVDLLTRQISAPDVDWSYGEPTEMLSPRNSENLGDDMGESSGAYIVRIPFGPREKYIPKEQLWPHIQEFVDGALVHIMQMSKVLGEQVGNGQPVWPVVIHGHYADAGDSAALLSGALNVPMVFTGHSLGRDKLEQLLKQGRQTRDEVDATYKIMRRIEAEELCLDASEIVITSTRQEIDKQWGLYNGFDVIMERKLRARIKRGVSCYGREMPRMVPIPPGMEFSHIVPHDVDLDSEEANEVGSDSPDPPVWADIMRFFSNPRKPMILALARPDPKKNITTLVKAFGEHHELRNLANLTLIMGNXRDVIDEMSSTNGAVLTSVLKLIDKYDLYGQVAYPKHHKQSEVPDIYRLAARTKGVFINCAYIEPFGLTLIEAAAYGLPMVATQNGGPVDIHRVLDNGILVDPHNQNDIAEALYRLVSDKQLWAKCRQNGLDNIHRFSWPEHCKNYLSRVGTLKSRHPRWQKSDDATEVSETDXSPGDSLRDIHDISLNLKISLDSEKSGSMSKYGRSSTSDRRNLEDAVQKFSEAVSAGTKDESGEKAGATTGSNKWPSLRRRKHIVVIAVDSVQDADLVQIIKNIFQASNKEKSSGALGFVLSTSRAASEIHPLLTSGGIEITDFDAFICSSGSDLCYPSSNSEDMLSPAELPFMIDLDYHSQIQYRWGGEGLRKTLIRWAAEKNSESGQEAVVEDDECSSTYCISFKVKNTEAVPPVKDLRKTMRIQALRCHVLYSHDGSKLNFIPVLASRSQALRYLYIRWGVELSNMTVVVGESGDTDYEGLLGGVQKTIILKGSFNSAPNQLHAARNYSLEDVVSFDKPGIASVDGYAPDILKSALQQFGALQG

SEQ ID NO: 4233 - protein, 302 aa, Triticum aestivum
RPTRPRTRGRTRGRTRGFWYQPRHKTMISSSWGAPAAFKTGFDLQHVQDGLYGRHLHVYDWPGGELKQTLDLGSTGLLPLEVRFLHDPSKDTGYVGCALTSNMVRFFKTADGSWSHEVAISIEPLKVRNWMLPEMPGLITDFVISLDDRYLYLVNWLHGDIRQYNIEDPAKPVLAGQVFVGGLLQKGSDVVYVTDDDKEEQYAVPEVKGHRLRGGPQMIQLSLDGKRVYVTNSLFSRWDEQFYGPDLLKKGSHMLQIDVDTEEGGLAVNPNFFVDFGTEPEGPSLAHEMRYPGGDCTSDIWI

SEQ ID NO: 4234 - protein, 118 aa, Triticum aestivum
MSYYGQQQPPVGVPPPQGYPGKEEYPPAGYPPAGYPPPGQGQGYPPQGYPPQQGGYPPQQGGYPPQQGGYPPQQGYPQQGYPPQYAQQPPRQQQSSGPSFMEGCLAALCCCCLLDACF

SEQ ID NO: 4235 - protein, 135 aa, Triticum aestivum
  unsure (1)..(135): unsure at all Xaa locations
EWWEWVSLVSPFFFWGTAMVAMKGVIPKTGPFFVAALRLLPAGALVVAFAAARGRKQPSGWAAWGAIAAFGLIDAACFQGFLTEGLQKTSAGLGSVIIDSQPLXVAILAALFFGESIGAIXAGGLVLGVVGLFAP

SEQ ID NO: 4236 - protein, 322 aa, Triticum aestivum
  unsure (1)..(322): unsure at all Xaa locations
MEGETNKRLATLVGCNYVGTRYELRGCINDVDAVRAALVARFGFAPADVAVLTDGRGAEVLPTGANIRRALADMVARAAPGDVLFFHSHIXRLEAIGSRRHRERSKIHPRRVVASKIERERKEREGTEEQSDSEGAGDRCRARRHLVDSASPTLVLRLPPPPAEASTPPHGPTTTAPTTGTAIAHAXRAAGRARGLAGPIGSSQSTTPAPAPTPPRPDEGILLSGCQTNETSADVPAYEASGGKACGAFSSAVQSVLAAHPAPLSNRELVAKARAVLEEQGFEQHPCLYCTDANAEAPFLSQDKKEETAVGAASPAMSAALL

SEQ ID NO: 4237 - protein, 78 aa, Triticum aestivum
  unsure (1)..(78): unsure at all Xaa locations
MEMKLTIRRVPTVVSNYQEDADKPRAGCGRNCLGDCCLPASKLPLYAFKLTPAKGSQEDAASTKLLVDILLNEXGGGG

SEQ ID NO: 4238 - protein, 161 aa, Triticum aestivum
  unsure (1)..(161): unsure at all Xaa locations
YFTNEGQIIRSPILNHAVTKISRWGYEDSVYLAKLAEQAERYEEMVENMKQVASEXDQELSVEERNLLSVAYKNVIGARRXXSWRIVTSIGQKXRDPKGNSSSRVVWIKDYRQEIEGKLAKICEDILQVLNKHLIPSAKSXXESXGFYHKMKGXXQRYPCK

SEQ ID NO: 4239 - protein, 128 aa, Triticum aestivum
  unsure (1)..(128): unsure at all Xaa locations
MANGGDGDGDVPENANEHCPGTQSEAAGKAESCAXGCPNQQICATAPKGPDPDLLAIIERMNTVKHKILVLSGXGGVGKSTFSAQLSFALVEMDYQVGLLDIDICGPSXPKMLGLXEGQDIHQSNVWL

SEQ ID NO: 4240 - protein, 147 aa, Triticum aestivum
  unsure (1)..(147): unsure at all Xaa locations
MALSVEKTSSGREYKVKDLSQADFGRLEIELAEVEMPGLMACRAEFGPSKPFAGARISGSLHMTIQXTAVLIETLTALGADVRWCSCNIFSTQDHAAAAIARDSAAVFAXKGETLEEYWWXCTXRXLDWGEAGGPTHRREPRCYHKV

SEQ ID NO: 4241 - protein, 340 aa, Triticum aestivum
MEPGRLIFNTSGSGNGQMLFMDCGAGGIAGAAGMFHRGVRPVLGGMEEGRGVKRPFFTSPDDMLEEEYYDEQLPEKKRRLTPEQVHLLERSFEEENKLEPERKTELARKLGLQPRQVAVWFQNRRARWKTKTLERDFDRLKASFDALRADHDALLQDNHRLRSQVVTLTEKMQDKEAPEGSFGAAADALEPEQAAAEAKASLANAEEHAAAAEAFEVVQQQLHVKDEERLSPGSGGSAVLDARDALLGSGCGLAGVVDSSVDSYCFPGGAGGDEYHECVMGPVAGGIQSEEDDGAGSDEGCSYYPDDAAVFFAAAQGHGHHHTDDDDQQDDGQISYWMWN

SEQ ID NO: 4242 - protein, 192 aa, Triticum aestivum
  unsure (1)..(192): unsure at all Xaa locations
GLAYLHEECEDCIIDXDIKPENILLDAEFCPKIADFGMAKLLGREFNSALTTIRGTMGYLAPEWISGLPITKKADVYSFGIVLFEIISGRRSTEVVKFGNHRYFPVYAAAQVSEGEVLCLLDARLEGDANVKELDVTCRVACWCIQDEENDRPSMGQVVRMLEGVLDTEMPPIPASFQNLMEGDNSVIYSDF

SEQ ID NO: 4243 - protein, 243 aa, Triticum aestivum
  unsure (1)..(243): unsure at all Xaa locations
GTRVPFSSGNPRIEETRGVVLLHPDPPTAAAAASSSSSHLPAERKPQVFVPAVPNHMTYADFCRFCGSFVPHMLEMRIVRIDGAEDQYSVLIKFDTLSSTDSFYKHFNGKQFSSLEGDVSRIRFVEDVHYTQLIEHAHSSITSSAEQPTCPVCLERLDQDPGGILTTICNHSFHCSCISKWTDSSCPVCRYCQQQPEKSMCSVCGTSENLWICVICGTXGGHAIEHWKETEHCYSLELETQKW

SEQ ID NO: 4244 - protein, 212 aa, Triticum aestivum
WPVRRSPVPGGTMRAHNGEVTAIATPIDNSPFIVSASRDKSVLLWDLENPVHSTPESGVTADYGVPKRRLTGHSHFVQDVVLSSDGMFALSGSWDGELRLWDLSTGATTRRFVGHGKDILSVAFSVDNRQIISASRDKTIKLWNTLGECKYTIGGDLGGGEGHNGWVSCVRFSPNTFQPTIVSGSWDRTVKVWNLTNCKLRCTLDGHGGYVN

SEQ ID NO: 4245 - protein, 336 aa, Triticum aestivum
MECGVLGGPGRHATPPCPPIRPAPSARHRRGPSRRGGLRRGPGGGRRASGGGSAGRLVAPVIPPPTSVHDLLWCPVCTTSMYPPIHQCQHGHTLCSTCKARVHNRCPTCRQELGDIRCLALEKVAESLELPCKYYSLGCPEIFPYYSKLKHESQCNFRPYSCPYAGSECSVVGDIPFLVSHLRDDHKVDMHSGCTFNHRYVKSNPREVENATWMLTVFHCFGQYFCLHFEAFQLGMAPVYMAFLRFMGDENDARNYSYSLEVGANGRKMIWEGTPRSIRDSHRKVRDSHDGLIIQRNMALFFSGGERKELKLRVTGRIWKEQQNPDSGACIPNLFS

SEQ ID NO: 4246 - protein, 252 aa, Triticum aestivum
MGRGRVELKRIENKINRQVTFAKRRNGLLKKAYELSVLCDAEVALIIFSNRGKLYEFCSGQSMPKTLERYQKCSYGGPDTAVQNKENELVQSSRNEYLKLKARVENLQRTQRNLLGEDLGSLGIKDLEQLEKQLDSSLRHIRSTRTQHMLDQLTDLQRKEQMLCEANRCLRRKLEESSQQMQGQMWEQHAANLLGYDQLRQSPHQQQATHHGGNGFFHPLDPTTEPTLQIGYTQEQINNACVAASFMPTWLP

SEQ ID NO: 4247 - protein, 373 aa, Triticum aestivum
ARDAATAPVTALGPCDTRRPLSAGRPAPPAKAPLTAAVPGRPGTSGRAASPGCRSASPTTLGGTAPSTTGPQPAFLHAFAVTANYAIFPEIQIVMNPMGMVVGGGSPVGAASGMVPCLGAIPYYTSHESQMRRFQVAGLVSVHSVVGWEAAVGPQIGVMAKYVADNSDTLERKELIYAFVELVRINLRTGNVTRTPLAAANLDFGVIKPGMEVIHASDGLFGVDDPMPNIGGVPKLDFDRAGHGDCTVGAPGLHGSGCFAGEPPFAPRRASRGPETRTTGHWCATCTTRAPATTGSWGEPFFVPDDVEGNGDEDDGYVVCYVHDEGTGDNRFVVMDAQSPDLEIVSEVQLPSRVPYGFHGIIVTQAELRSQHQ

SEQ ID NO: 4248 - protein, 380 aa, Triticum aestivum
  unsure (1)..(380): unsure at all Xaa locations
MDRRKGSGSRDANGGLAEATASRLRFEDADEVAGEVGMEVEESPAAPGEEVIGNDKTSADYYFDSYSHFGIHEEMLKDVVRTRSYQNVITQNNFLFKDKIVLDVGAGTGILSLFCAKAGAKHVYAXECSQRADMAKEIVKTNGFSEVITVIKGKVEEIDLPVPKVDVIISEWMGYFLLFENMLDTVLFARDKWLADDGVVLPDKASLHLTAIEDAEYKEDKIEFWNNVYGFDMSCIKKQAMMEPLVDTVDQNQIVTNCQLLKTMDISKMSSGDASFTVPFKLVAERNDFIHALVAYFNVSFTKCHKLMGFSTGPRSKSTHWKQTVLYLEDVVTICEGETLSGSMTVANNKKNPRDIDITLKYAINGNRCKVSRTQHYKMR

SEQ ID NO: 4249 - protein, 426 aa, Triticum aestivum
  unsure (1)..(426): unsure at all Xaa locations
MALSVEKTSSGREYKVKDLSQADFGRLELELAEVEMPGLMACRTEFGPSQPFKGARISGSLHMTIQTAVLIETLIVDDGGDATLLIHEGVKAEEEFEKSGKVPDPESTDNPEFKIVLTIIRDGLKTDASKYRKMKERLVGVSEETTTXGVKRLYQMQESGTLLFPAINVNDSVTKSKFDNLYGCRHSLPDGLMRATDVMIAGKVAVVCGYGDVGKGCAAALKQAGARVIVTEIDPICALQALMEGIQILTLEDVVSDADIFVTTTGNKDIIMVDHMRKMKNNAIVCNIGHFDNEIDMNGLETYPGVKRITIKPQTDRWVFPETNTGIIVLAEGRLMNLGCATGHPSFVMSCSFTNQVIAQLELWKEKATGKYEKKVYVLPKHLDEKXVAALHLGKLGARLTKLTKAQSEYISIPVEGPYKPAAYRY

SEQ ID NO: 4250 - protein, 485 aa, Triticum aestivum
  unsure (1)..(485): unsure at all Xaa locations
MALSVEKTASGREYKVKDLSQADFGRLELELAEVEMPGLMACRAEFGPSQPFKGARISGSLHMTIQTVVLIETLTALGAEVRWCSCNIFSTQDHAAAAIARDSAAVFAWKGETLEEYWWCTERCLDWGAGGGPDLIVDDGGDATLLIHEGVKAEEEFEKSGKVPDPESTDNPEFKIVLTIIRDGLKTDARKYRKMKERLVGVSEETTTGVKRLYQMQESGTLLFPAINVNDSVTKSKFDNLYGCRHSLPDGLMRATDVMIAGKVAVVCGYGDVGKGCAAALKQAGARVIVTEIDPICALQALMEGIQILTLEDVVSDADIFVTTTGNKDIIMVDHMRKMKNNAIVCNIGHFDNEIDMNGLETYPGVKRITIKPQTDRWVFPXTNTGFIVLAXGRLMNLGCATGHPSFVMSCSFTNQVIAQLELWKEKATGKYEKKVYVLPKHLDEKVAALHLGKLGARLTKLTKAQSEYISIPVEGPYKPAAYRY

SEQ ID NO: 4251 - protein, 446 aa, Triticum aestivum
  unsure (1)..(446): unsure at all Xaa locations
MALSVEKTASGREYKVKDLSQADFGRLELELAEVEMPGLMACRAEFGPSQPFKGARISGSLHMTIQTAVLIETLEEYWWCTERCLDWGAGGGPDLIVDDGGDATLLIHEGVKAEEEFEKSGKVPDPESTDNPEFKIVLTIIRDGLKTDARKYRKMKERLVGVSEETTTGVKRLYQMQESGTLLFPAINVNDSVTKSKFDNLYGCRHSLPDGLMRATDVMIAGKVAVVCGYGXDVGKGCAAALKQAGARVIVTEIDPICALQALMEGIQILTLEDVVSDADIFVTTTGNKDIIMVDHMRKMKNNAIVCNIGHFDNEIDMNGLETYPGVKRITIKPQTDRWVFPETNTGIIVLAEGRLMNLGCATGHPSFVMSCSFTNQVIAQLELWKEKASGKYEKKVYVLPKHLDEKVAALHLGKLGARLTKLTKAQSEYISIPVEGPYKPAAYRY

SEQ ID NO: 4252 - protein, 486 aa, Triticum aestivum
  unsure (1)..(486): unsure at all Xaa locations
MALSVEKTASGREYKVKDLSQADFGRLELELAEVEMPGLMACRAEFGPSQPFKGARISGSLHMTIQTAVLIETLTALGAEVRWCSCNIFSTQDHAAAAIARDSXAVFAWKGETLEEYWXWCTERCLDWGAGGGPDLIVDDGGDATLLIHEGVKAEEEFERSGKVPDPASTDNPEFKIVLTIIRDGLKTDARKYRKMKERLVGVSEETTTGVKRLYQMQESGTLLFPAINVNDSVTKSKFDNLYGCRHSLPDGLMRATDVMIAGKVAVVCGYGDVGKGCAAALKQAGARVIVTEIDPICALQALMEGIQILTLEDVVSDADIFVTTTGNKDIIMVDHMRKMKNNAIVCNIGHFDNEIDMNGLETYPGVKRITIKPQTDRWVFPETNTGIIVLAEGRLMNLGCATGHPSFVMSCSFTNQVIAQLELWKEKATGKYEKKVYVLPKHLDEKVAALHLGKLGARLTKLTKAQSEYISIPVEGPYKPAAYRY

SEQ ID NO: 4253 - protein, 485 aa, Triticum aestivum
MALSVEKTASGREYKVKDLSQADFGRLELELAEVEMPGLMACRAEFGPSQPFKGARISGSLHMTIQTAVLIETLTALGAEVRWCSCNIFSTQDHAAAAIARDSAAVFAWKGETLEEYWWCTERCLDWGAGGGPDLIVDDGGDATLLIHEGVKAEEEFERSGKVPDPDSTDNPEFKIVLTIIRDGLKTDARKYRKMKERLVGVSEETTTGVKRLYQMQESGTLLFPAINVNDSVTKSKFDNLYGCRHSLPDGLMRATDVMIAGKVAVVCGYGDVGKGCAAALKQAGARVIVTEIDPICALQALMEGIQILTLEDVVSDADIFVTTTGNKDIIMVDHMRKMKNNAIVCNIGHFDNEIDMNGLETYPGVKRITIKPQTDRWVFPETNTGIIVLAEGRLMNLGCATGHPSFVMSCSFTNQVIAQLELWKEKATGKYEKKVYVLPKHLDEKVAALHLGKLGARLTKLTKAQSEYISIPVDGPYKPAAYRY

SEQ ID NO: 4254 - protein, 94 aa, Triticum aestivum
MPSVSRAVCLQRPTTSGGGRSREAARSVASPRARHAKSKTMIHPARGRHCSPPNAVAAPMPATKKRVFHFGKGKSEGNKAMEDLLGWKGANLAE

SEQ ID NO: 4255 - protein, 501 aa, Triticum aestivum
  unsure (1)..(501): unsure at all Xaa locations
TEYGEASQYQIQEVVGKGSYGVVAAAIDTRTGERVAIKKINDVFEHVSDATRILREVKLLRLLRHPDVVEIKHIMLPPSRREFQDIYVVFELMESDLHQVIRANDDLTAEHYQFFLYQLLRALKYIHGANVFHRDLKPKNILANADCKLKICDFGLARVSFNDAPSAIFWTDYVATRWYRAPELCGSFFSKYTPAIDIWSIGCIFAELLTGRPLFPGKNVVHQLDIITDLLGTPSSETLSRIRNEKARRYLSCMRKKXHPVPLTQKFPNADPLAVRLLGRLLAFDPKDRPSAEEALADPYFASLANVEREPSRHPISKLEFEFERRKVTKDDVRELIYREILEYHPQMLEEYMKGGDQISFLYPSGVDRFKRQFAHLEEHYSKGERGSPLQRKHASLPRQRVGASNDGNNEQHISDQEMSAEPDAHGAVSPQKSQDAPSVGPNGLSPTSLSSRTYLKSASISASKCVVVNPNKQPEYDDAISEETEGAVDGLSEKVSKMHA

SEQ ID NO: 4256 - protein, 156 aa, Triticum aestivum
  unsure (1)..(156): unsure at all Xaa locations
RAEFATTKEYALLCLENPLLDIQAQGNEDLLKKYGLEANNAILAENELHKSIFEDLLKNYSAKLIAGGGAQNTARGAQYLLPPKSVVFLXWGWGLDKYADILKDAVKDARTXRAEYRVDAKQPTGRCGVVITGHNPSMVTDLGAANHYDLDHLKSP

SEQ ID NO: 4257 - protein, 164 aa, Triticum aestivum
FLRRGSGINRSPEETTSQNTDVQGSTSRVNPMKTRLADYQERPRYLHGSYKYASSNVMSGSPSKFPKNFPLRKFGEEKRRQTLLEGADVAESSRRKSDAGCLEGSKKTIVENQSSDAPQTGTEGLTAKDHELIAPDPEVSHPAGSSGMHAHTAESLGKECFTKF

SEQ ID NO: 4258 - protein, 338 aa, Triticum aestivum
  unsure (1)..(338): unsure at all Xaa locations
YFAQANVLGYPDTGGQVVYILDQVRAMENEMLLRIKQQGLDITPKILIVTXRLLPDAHGTTCGQRLEKVLGTEHTHILRVPFKTEDGIVRKWISRFEVWPYLEAYTDDVAHEIAGELQATPDLIIGNYSDGNLVACLLAHKLGVTHCTIAHALEKTKYPNSDLYWKKFEDHYHFSCQFTADLIAMNHADFIITSTFQEIAGNKDTVGQYESHMAFTMPGLYRVVHGIDVFDPKFNIVSPGADMSIYFPYTEQQKRLTSLHTEIEELLFSDIENAEHKFVLKDKKKPIIFSMARLDRVKNMTGLVEMYGRESRLQELVNLMVVWGXDHGRVPRAKGEPA

SEQ ID NO: 4259 - protein, 196 aa, Triticum aestivum
  unsure (1)..(196): unsure at all Xaa locations
KFDNLYGCRHSLPDGLMRATDVMIAGKVAVVCGYGDVGKGCAAALKQAGXARVIXVTEIDPXCALPGPGWEGIQVLTXWEDVVSWMLTSFVTTNWGNKDTXMXDHIRKDERTMPLSCNIGHFXDNEFXXERLGTYPGVKXTTTTSKRPLVSPTDMCRLLVCAPNVCQNKANWIKKARKRVPTLTKPLEGQAPITGS

SEQ ID NO: 4260 - protein, 253 aa, Triticum aestivum
  unsure (1)..(253): unsure at all Xaa locations
MAGLGFEETELRLGLPGGSNEAEEAAAAVRSSGKRGYAETIDLVLKLEPASAAAPPSEDGEQVADGVAEAQPSPAAADGQLKRSPSQSSVVTTPQPDADPEKPRAPKAQXVGWPPVRSFRRNMLAXRREGGAALVKVSMDGAPYLRKVDMGTYKSYQELSKALEKMFSSFTIGNDCSQAQAQGMTGMNESKLVDLLSGSDYVPTYEDKDGDWMLVGDVPWEMFVASCKRLRIMKGSEAIGLAPRAMEKCKSRS

SEQ ID NO: 4261 - protein, 118 aa, Triticum aestivum
  unsure (1)..(118): unsure at all Xaa locations
MSPSEPTREESVYMAKLAEQAERYEEMVEFMERVARYAGPPGGGEXKLSVGXXRNLLSVAYKNVIGARRASWRIISSIEQKEEXRGNEAHAASIRAYRSKIEAXLPASTLALSILSIR

SEQ ID NO: 4262 - protein, 194 aa, Triticum aestivum
APSMGYSFSYCLPTSSSSSGYLSIGSYNPGQYSYTPMAKSSLDDSLYFIKMTGITVAGKPLSVSASAYSSLPTIIDSGTVITRLPTDVYSALSKAVAGAMKGTPRASAFSILDTCFQGQASRLRVPQVSMAFAGGAALKLKATNLLVDVDSATTCLAFAPARSAAIIGNTQQQTFSVVYDVKNSKIGFAAGGCS

SEQ ID NO: 4263 - protein, 330 aa, Triticum aestivum
  unsure (1)..(330): unsure at all Xaa locations
LHEKRKTSIPYEQGLDIVGSSLSALDGVDYSPIFGGGDASNCDEKVFSFYPENQPCNGFEEXLERYREIVPTTSISXGPTSFAPIIETAIGIADSTGGQYHVLLIIADGQVTRSVDTQSGQLSPQERDTIDAIVKASHFPLSIVLVGVGDGPWDMMHKFDDNIPARSFDNFQFVNFTEIMSKSIAADRKEAEFALSALMEIPTQYKATLDLQLLGRRQGIPPRVPLPPPTRTPYSRSTSFDQQSGVYSRSSSFGQQTSGYSSESSQPAASRIPDTYASESSESTLSCAICMDKSKDLAFGCGHQTCYDCGKNLVRCPMCHHHITTWIRLY

SEQ ID NO: 4264 - protein, 164 aa, Triticum aestivum
GESGDDMSEQYVAVTKQEKRRRRRRMACNRCGKRKWESKEACIVCDARYCGYCVLRMMGSMPEGRKCVSCIGGPIDESKRSKLGKSSRTLARLLSPLEVRQILKAEKECQANQLRPEQLIVNGCPLRPEELTDLLSCSRPPQKLKPGRYWYDKESGLWGKDGQK

SEQ ID NO: 4265 - protein, 314 aa, Triticum aestivum
  unsure (1)..(314): unsure at all Xaa locations
AALAVQSGGQEDSEVMRKSWKGQXSEVFEGINVNNNEKXLFKSLKPVKEEXIEREVKILQESRVGSFQIIVKLLDIVRDQHSKTPSLIFEYINNTDFKVLYPTLTDYDIRYYIYELLKALDYCHSQGIMHRDVKPHNVMIDHELRKLRLIDWGLAEFYHPGKEYNVRVASRYFKGPELLVDLQDYDYSLDMWSLGCMFAGMIFRKEPFFYGHDNHDQLVKIAKVLGTDGLNAYLNKYRIELDPQLEALVGRHSRKPWSKFINADNQHLVSPEAIDFLDKLLRYDHQDRLTAREAMAHPYFLQVRAAENSRTRAQ

SEQ ID NO: 4266 - protein, 143 aa, Triticum aestivum
SLIAASARHYLLQPIIADHTTLESLDLTDADGQGVLTMDKWQLQELRVKPVSASGGSHRTLMPALSMRLWYAPHIELPGGLVLNGATLVAIKPTEEATRDTVGTGIAGSAGGCWVSDAFEEPYRTAVGMLLKRRTYSLEMNSF

SEQ ID NO: 4267 - protein, 93 aa, Triticum aestivum
DKEQNPLKRLLRNRVSAQQARERKKAYMTELEVKAKDLELRNAELEQKVSTLQNENNTLRQILKNTTAHAGKKPSGGKGGDSGKKHHHHFGKG

SEQ ID NO: 4268 - protein, 232 aa, Triticum aestivum
EGEDRLLVYDYMKFGSLEDVLHDRKKIGKKLNWEARRKIAVGAARGLAFLHHNCIPHIIHRDMKSSNVLIDEQLEARVSDFGMARLMSVVDTHLSVSTLAGTPGYVPPEYYQSFRCTTKGDVYSYGVVLLELLTGKPPTDSADFGEDNNLVGWVKQHTKLKITDVFDPELLKEDPSVELELLEHLKIACACLDDRPSRRPTMLKVMAMFKEIQAGSTVDSKTSSAAAGSIDE

SEQ ID NO: 4269 - protein, 369 aa, Triticum aestivum
  unsure (1)..(369): unsure at all Xaa locations
PDLIVDDGGDATLLIHEGVKAEEDYEKTGKIPDPESTDNAEFKIVLTIIRDGLKADPKKYRKMKERLVGVSEETTTGVKRLYQMQETGALLFPAINVNDSVTKSKFDNLYGCRHSLPDGLMRATDVMIAGKVAVVCGYGDVGKGCAAALKQAGARVIVTEIDPICALQALMEGFRSFPWEDVVSXADIFXVTTTGNKDIIMGDHMRKMKNNAIVCNIGHFDNEIDMLGLETYPGVKRITIKPQTDRWVFPETNTGIIVLAEGRLMNLGCATGHPSFVMSCSFTNQVIAQLELWKEKSSXGKYEKKVYVLPKHLDEKVAALHLGKLGAKLTKLTKSQADYISVPIXGPYKPAHYRVLSTRLAAHSGRCVL

SEQ ID NO: 4270 - protein, 495 aa, Triticum aestivum
  unsure (1)..(495): unsure at all Xaa locations
MVLSHAASAGSSDDSVHSTFASRYVRASLPKFRMPENSIPKEAAYQIINDELMLDGNPRLNLASFVTTWMEPECNKLMMDSINKNYVDMDEYPVTTELQNRYVNMIAHLFNAPLGETETAVGVGTVGSSEAIMLAGLAFKRRWQNKMKAAGKPCDKPNIVTGANVQVCWEKFARYFEVELKEVKLSEGYYVMDPEKAVEMVDENTICVAAILGSTLNGEFEDVKMLNDLLVKKNEETGWDTPIHVDAASGGFIAPFLYPELEWDFRLPLVKSINVSGHKYGLVYAGIGWCIWRSKEDLPDELIFHINYLGADQPTFTLNFSKGSSQVIAQYYQLIRLGFEGYRNIMDNCQENAMVLKEGLERTGRFNIVSKDQGVPLVAFSLKDSSRHDEFEISEFLRRFGWIVPAYTMPPDAQHVTVLRVVIREDFSRTFAERLVIDIEKVLHELDALPSRSSGARPAAPQRXTVSEKDLARQREVVSVWKRAVAARKKTQGVC

SEQ ID NO: 4271 - protein, 527 aa, Triticum aestivum
MICAISGEVPDEPVVSKRSGLLFERRLIERYIEDHGKCPVTKEELSMDDIVLVKTNKVVRPRPLQAASIPGLLGIFQNEWDALMLSNFALEQQLHTARQELSHALYQHDAACRVIARLKKERDESRALLALAERQIPASMAGVDPAAVVSNGKRAMEDEIGPDGKKIRPGINPVMIDELVRPRVRLSAQRKKRQVPPSLASIDELERYTQISSHPLHKTNKPGILSMDIHPSKDIVATGGIDTNAVLFDRTSGQILCTLAGHSKKITTLKFVPRDELVVTGSADKTVRIWQGGEEGNYSCIHTLKDHTAEVEAVTVHATQKYFVTAAKDNTWCFYDISTGSCLSQVGEASGQEGYTSASFHPDGLILGTGTTEAVVKIWDVKTQSNVAKFEGHAGPVTAMSFSENGYFLATAALDGVKLWDLRKLRNFRTFSPYDSDTPTNSVEFDFSGTYLAVAGSDIRVYQVANVKTEWNLIKTLPDLSGTGKVTSAKFGTDAKYIAVGSMDRNLRIFGLPGDDQMDDDAKPSAE

SEQ ID NO: 4272 - protein, 141 aa, Triticum aestivum
DYDALRALDTDNSPHALSMTEEEINTLPVFRYKLQAQQRSTPYRNSDGPSEPLVSSPESGKEKKQDADATSKMTEDELTCSVCLEQVVAGDLLRSLPCLHRFHVNCIDPWLRQQGTCPICKHQVSDVWRGAGSGGEMDAMV

SEQ ID NO: 4273 - protein, 304 aa, Triticum aestivum
RSLGGFDTAHAAARAYDRAAIKFRGLEADINFNLSDYEEDLKQMRNWTKEEFVHILRRQSTGFARGSSKYRGVTLHKCGRWEARMGQLLGKKYIYLGLFDSEVEAARAYDRAAIRFNGREAVTNFESSSYNGDAPPDAENEAIVDADALDLDLRMSQPTAHDPKRDNIIAGLQLTFDSPESSTTMISSQPMSSSSSQWPVHQHGTAVAPQQHQRLYPSACHGFYPNVQVQVQERPMEARPPEQPSSFPGWGWQAQAMPPGSSHSPLLYAAASSGFSTAAAGANLAPPPPYPDHHRFYFPRPPDN

SEQ ID NO: 4274 - protein, 178 aa, Triticum aestivum
  unsure (1)..(178): unsure at all Xaa locations
LWLHKITXRWFDHIGVNAILDSDMYLLHIEERNFAKAGIENWQKSVYVPTSSDGTVVAFRNWFRKYCRFQVGWAAPTVDQLPATPTKDKLMDRYWSHVAQCTSCSAALKAMKALEVALQVASIAVVGLLAVAKGTLLTSVVQRAVIVSAAVLCFAASRWLADFIQKNFYFEDYVHAYK

SEQ ID NO: 4275 - protein, 138 aa, Triticum aestivum
  unsure (1)..(138): unsure at all Xaa locations
VILETLFFRKKFSRNIKLSLSVLLLGVGVATITDLQLNLVGSVLSLLAIITTCIAQIMTNTIQKKFKVSSTQLLYQSCPYQALTLFLRRPFLXDGFLTNQNVFAFDYTTQXLFLIVLSCLISARXKLNTSXVIGKTRL

SEQ ID NO: 4276 - protein, 166 aa, Triticum aestivum
  unsure (1)..(166): unsure at all Xaa locations
RKSSHRPERAVRRRRLPQHKHRHPSKRRGQEVPEAAGDAKLLIQSLTKAYAPTPTNLKIIDLYVVFAVATALVQVVYMGIVGSFPFNSFLSGVLSCIGTXAVLGVCLRITTSTIGSKQGIQWHPSPARWAHLLNFVLVAIWCSTLVDHELPWMSNCHTSCRDFVVS

SEQ ID NO: 4277 - protein, 136 aa, Triticum aestivum
  unsure (1)..(136): unsure at all Xaa locations
RASWRIISSIEQKXENRGNQAHVASIKEYRTKIETELNKICDXILKLLDSHLVPSXTAAXSKXFYLKMKGXYHXXLAGFKXGAXRKEAPENTLXAYXSAXDIALADLXXTHPXXGWLSTSVVLLRNEQRLPLPQIF

SEQ ID NO: 4278 - protein, 145 aa, Triticum aestivum
  unsure (1)..(145): unsure at all Xaa locations
GKKDCPPRISFHRALDCLHGGEWIMFRVWVAGKMVPFHWHQGLQGECCNMGIGMSTVNVNXLACRSWFFLNLYGLRGVVSXLSVGKTMSTDDAQKMMSMRXGGMHFNPAMILSAEKDSLGIIQHVWPLTKMERHAEGVLRKLLKN

SEQ ID NO: 4279 - protein, 356 aa, Triticum aestivum
  unsure (1)..(356): unsure at all Xaa locations
MGVGKKVLNDVKPYMMMILLQIGYAGMYIVSVASLKRGMSHYVLVTYRNLAATLVMLPFALFFEKGIRPKMTLRIFIKILGLALLEPVLDQNLYYVGNKLTSASFSSALVNILPAGARVTHVRFLRSQCMVKSILLLRVDARKELLPYVTLIIGPAYDAHACVVLLRSAIXRWKSIKINHKSYTAALTLTTLICAMGTGINGSMALVAERHDMSAWVIGLDTRLFTVVYSGVVCSGVAFFVQGIVTETRGPVFVTAFQPLCMIITAVLGSVILKEETTLGSVIGAAIIVLGLYSLIWGKSNDIIDKPVHSVAEKLALPLTSVNGNGTNGTNGGRHVNGGQVAHDVETPAVKGAICH

SEQ ID NO: 4280 - protein, 220 aa, Triticum aestivum
MARFQETKPDLLNSGSDTRMMAEARLPKARKPYMITKQREKWTEEEHKLFLEAMQLHGRAWRRIQEHIGTKTAVQIRSHAQKFFSKVTRDSSGDSGGSSSGAGPPIQIPPPRPKRKSVHPYPCNLRSAQPGKHAHAALLRVDKPQLSMCEQGNGSPTSVVTTSQIGLGSESFDSDTSTIDVEERCPTPSTGTAEVAVQAPPTNDAKKSKGSSSTSEEVGL

SEQ ID NO: 4281 - protein, 503 aa, Triticum aestivum
MVATAKIPQRQLFIDGDWRAPALGRRLPVINPTTEASIGEIPAGTSEDVDAAVAAARAALRRNRGRDWARAPGAVRAKYLRAIAAKMIERKSDLARLEALDCGKPLDEAAWDMDDVAGCFEFFAGHAEALDKRQNAAVALPENFKCHLKKEPIGVVALITPWNYPLLMAVWKVAPALAAGCTAVLKPSELASVTCLELGDVCKEIGLPSGVLNIVTGLGHEAGAPLSSHPDVDKVAFTGSYATGQKIMVAAAPTVKPVTLELGGKSPIVVFDDVDIDKAVEWTLFGCFWTNGQICSATSRLLIHKNIAKEFVDRMVAWSKNIKVSDPLEEGCRLGPVVSEGQYEKIKKFVANAKSEGATILTGGVRPKHLEKGFFIEPTIITDINTSMEIWREEVFGPVLCVKEFSTEEEAIELANDTHYGLAGAVISGDRDRCQRLAEEIDAGCIWVNCSQPCFCQAPWGGNKRSGFGRELGEGGIDNYLSIKQVTEYTSDAPWGWYKAPAN

SEQ ID NO: 4282 - protein, 250 aa, Triticum aestivum
  unsure (1)..(250): unsure at all Xaa locations
MDPLRLLLPRAQAQPLLPLPAGVPAPSVRPRLVPRRRARRHRNGAARMLPASAVASESPWTEQEPASGEKEERFDWLDQWYPFAPVEDLDLGAPHGKMVLGIRVVAWYDRGAGEWRVFDDACPHRLAPLSEGRIAGEGPLQGVYHAWSSAGPGACKFIPQAPALGPPVPNNXSKACLASYPCVVRDHIPVVYPRXQQEHRDLWQRSARHHSRDRDPSFARIRGRDLPTVQCVGENLLTCPYLNTRGYGKH

SEQ ID NO: 4283 - protein, 234 aa, Triticum aestivum
  unsure (1)..(234): unsure at all Xaa locations
MSDAENYRCFVGSLPWNKHKWWRSKDAFGKFGRVTETKVVLDKFSGRSRXGFGFVTFDDKKAMEEXLLSAMNXFDMEWKVYLLYERAQAQGXAGIENGDLXMVGGGWRYGGGRDFGGGRGGGRGGGGDCYKCGKPGHFARECPSGDGGDRYGSRDDRYSSRDDRYSSRDDRYGGRDGGRDDKYGGSNGSSRYGPDRGGDRYSGSRDGGSRSSGGGDRYSRDRSGPYDRRSRDEY

SEQ ID NO: 4284 - protein, 220 aa, Triticum aestivum
  unsure (1)..(220): unsure at all Xaa locations
PAGERSSPDSRAMSKRGRDVWDMELGGLDTARLLMLLAQQHQQHQHQRAVAGAAQAMGGGRVFECKTCNRQFPTFQALGGHRASHKRPRLQQHPQKPHAIDSIDDGAALCLGRRAPQAPPLPAKPRAHECPVCGLEFAVGQALGGHMRRHRVEAEAAXTPLAARRREPEMVVASCDAGGICLDLNLTPSENCTKCRSAAXLSAAARQGVHKALAMLDCSL

SEQ ID NO: 4285 - protein, 97 aa, Triticum aestivum
  unsure (1)..(97): unsure at all Xaa locations
MATSEPVQESLVVHYSQPSRPRVLLAASGSVAAIKFETFAXYFSEWADVRXCGTTPSLHSLIXISTKWXLLYTDDDEWPTWKKIGDXILHIELPEWA

SEQ ID NO: 4286 - protein, 166 aa, Triticum aestivum
  unsure (1)..(166): unsure at all Xaa locations
LRWASYKENPLCPQCKHPFEFLSVHRSLDGCLHDYLFEESVCLLLRAAWFEPLIVEAHEEALEEEEFXHQQYQYDDDEDDLDEESYYMNRSPSIRIGNRRWGXDNGXIKGKAGKEARXVNTDXVXGHPRXXKKKEKPNFGSPVRFGPRIPEGKRGKTERNAKTLTS

SEQ ID NO: 4287 - protein, 173 aa, Triticum aestivum
  unsure (1)..(173): unsure at all Xaa locations
RHQRELSREENVYMXXLAEQAERYEEMVEFMEKVAKTVDSEELTVEERNLLSVAYKNVIGSRRASWRIISSIXPRRRKSRXNEDRXVTLIKGXRXKFETGLSKXCDGSSKLLRNHXLPLSTAPXPRLLLKXXGDYXKILADXRWAXRXELLXNXVXSRMLAWSIHKVGGITSS

SEQ ID NO: 4288 - protein, 321 aa, Triticum aestivum
MASPRGLAGLLCFALAAAAASAAQYRVGEQRGWSVPAAGAEPLNTWSSRMRFIIGDQLLFVYPKDTDSVLLVDQAAYNACNTTTYVSKFQGGSTVFTLDRSGPFFFISGNEASCKAEQKLIVVVLSVDHTPPGLLPPPPPPSMPPSSAPPMPSPTSPPSMTPPSAAPMPSPMSPPSMTPPSAAPMPSPMSPPSMMPPSAAPMPSPMFPPSMTPPAAAPMPTPMFPPSMTPPSAAPMPSPMSPAAAPGATPDSPQSPTGPAPSPGTPGGGSSPGTPGSDASSPPAPGADGANSTTPGSAAAPVTAGLIGTLAAGIGYAMLAI

SEQ ID NO: 4289 - protein, 96 aa, Triticum aestivum
  unsure (1)..(96): unsure at all Xaa locations
MEDDKKEGKYRGVRKRPWGKFAAEIRDPERXGSRVWLXTFDTAXEXAARAYDRAAFAQKGANAILNFPGEGGEEWGVFFRAAQRGPRKGRPLKRGG

SEQ ID NO: 4290 - protein, 108 aa, Triticum aestivum
LQLFVVLSCIIAIGVNLSQFICIGRFSAVSFQVLGHMKTVLVLFLGFLFFGKEGLNLHVVLGMILAVLGMMWYGNASAKPGGKERRSVLPVRSDRHNGGSEDKDGGDK

SEQ ID NO: 4291 - protein, 119 aa, Triticum aestivum
  unsure (1)..(119): unsure at all Xaa locations
MDPKMTEVTQMFARFKAAYARNDLDACVTLLSXQLKVHLTQFPSLPPSFEQTPNAVEELKXARDIYEHAVVLXSVNLEDQGACRRVAAGLXSCFVSCALSPPQPRGVPIXGLNLLKVVG

SEQ ID NO: 4292 - protein, 122 aa, Triticum aestivum
  unsure (1)..(122): unsure at all Xaa locations
MLPSHLNGHSPLARRRPQLPAAGDAALEAHDRVYFQSYSHIGIHESMIKDRVRTDAYREAIMLHQKFIEGKVVMDVGCGTGILSVFCARAGAKRVYAVDASEIATQASEIXKAXNLADKIVV

SEQ ID NO: 4293 - protein, 137 aa, Triticum aestivum
GSIPESLYTNGGLKLRVVWTISSLIAAATRHYLLREIVKEHPTLERVALTDAGGQGTLSMGRDQLREFRDRPLAAAPAAAANRTQVPACNMKLRYAPLLELSDGTRIHGATLVVIKARRRRRRERTRTSGAGAFDGP

SEQ ID NO: 4294 - protein, 231 aa, Triticum aestivum
  unsure (1)..(231): unsure at all Xaa locations
MDHAADAQRTDLMTITRHALNEQGRHPESRGDFTILLSHIVLGCKFVASAVNKAGLAKLIGLAGETNVQCVLVSEENEAAIFVDAPLRGKYCVCFDPLDGSSNIDCGVSIGTIFGIYMIKDKDNATLEDVLQPGTDMIAAGYRMYRSSCTLVLSTGNGVNGFTLDPSLGEFILTHPNIKIPNKGKIYSVNEGNARNWDAPTANQHXYVERCKFPQDGSSPKSLRYIGSLVA

SEQ ID NO: 4295 - protein, 337 aa, Triticum aestivum
  unsure (1)..(337): unsure at all Xaa locations
SASTRRVLKERCRHPGTRGDRTSRLSRIVLXGRKLVAPGLPRKAGLAKLTGLAGETNVRGGRQQNXLDVLTNEVFDNTLDGGGRTCVVVXAADDISRLXDPKLQLGKYCVCLKTLEMDPPSTRAAASSNEGTLALGSHRXSNEANDTRGLVEQGTDPLGKGACITPCSHSVIRMPASFTRNPTTADFVKAIRLARAPKVLGNDXDKQDVLSNEVTDQAQGRRGNCRYPTDGSSPKSXLKYIGSMVADDHRTLLYGGIFLYPADKKSPSGKLRVMYEVFPMSFLMEEAGGQSFTGKGRSLDLIPTDIHERSPIFLGSSDDVEEIKALYAEEAKKEGSA

SEQ ID NO: 4296 - protein, 155 aa, Triticum aestivum
MVPAHTALPADLSVKDERELKREKRKQSNRESARRSRLRKQAETEELATQVESLTTENTSLRSEIGRLTESSEKLRLENSALMVKLKDTAALTPAEPSPHTAVTSSSSPGAAAENFLSMIDSAKAAGVSRHTEHGEPKLRQLLDSSPATDVAAVS

SEQ ID NO: 4297 - protein, 139 aa, Triticum aestivum
FVSLAHWEKLAEELIHQFCSLLGQSSESPLGVAISAGFQGLPTLLKLTTVMAAKKQEWQTMKQLPVPIDIGPEFQYHSVFVCPVLREQSSDENPPMLMPCGHAVSKQSITKLSKSSSRPFKCPYCPSEAVASQCKQLHF

SEQ ID NO: 4298 - protein, 117 aa, Triticum aestivum
  unsure (1)..(117): unsure at all Xaa locations
MASLPNGGGAAASGSCGARPVDKEVDFANYFCTYAYLYHQKEMLCDRVRMDAYHSAVFRNAPHFQGKVVLDVGTGSGILAIWSAQAGARXVYAVXATNMAEHXRELARAXXVTDIVE

SEQ ID NO: 4299 - protein, 167 aa, Triticum aestivum
  unsure (1)..(167): unsure at all Xaa locations
EVGWLLLPHRFVFRFWFVGEREEMAASDVEYRCFVGGLAWATDDHSLNNAFSTYGEVLESKIILDRETQRSRGFGFVTFSTEDAMRSAIEGMNGKELDGRNITVNEAQSRGGRGGGGGGYGGGRRDGGGYGGGGGGYGGGRGXYGGRGGYVVQTRGGGXNNDGNWRN

SEQ ID NO: 4300 - protein, 91 aa, Triticum aestivum
  unsure (1)..(91): unsure at all Xaa locations
MSSQDYYGGQQPHYPPQSHPPQGGYYPPQQPGYGPPPPQGYPPQGXKQPPPPQQYQQEQRGGRDHGCLGACLATMCCCFLCEENCECCFDW

SEQ ID NO: 4301 - protein, 379 aa, Triticum aestivum
  unsure (1)..(379): unsure at all Xaa locations
MVKAKLLAVLALVAVAAPFLRAAGQEEGEGGARPSELLPFAVGAAPAGCDVGQGEWVYDEAAAPAYDEEACPYIPAELTCQAHGRPDKSYQHWRWQPRGCSLPSFNATVMLEMLRGKRMLFVGDSLNRAQYVSLLCLLHRAXPEGSTSFETVDALSIFRAQAYDATIEFYWAPLRGKRHADVRVPPRRAHAVVPGAVGAAHQGAARRPQELRRLHQLGHPRRARRMDRAALLEARLQLLRPDPLRRHQRRRRSNMSSTVSWTWACCTRGCWTATKKSRVFFVSQLWGDVFRCGSEGSNCHGQTKPIADASYWGSTSKAMLRVTGEVLGAGTQWAPPTXKQLADPKSYADCTHWCLPGVPDAWNELLYWKLFFPANDQAL

SEQ ID NO: 4302 - protein, 142 aa, Triticum aestivum
  unsure (1)..(142): unsure at all Xaa locations
ETGRHVRMLTHEIRSTLDRHTILKTTIVELGRTLGLEECALWMPSRSGSSLQLSHTLRHQITVGSSISINLPVINXVSSSNRTIIYRTXPLWHGSXLAGQFFHQKLAAMXNTLXKLXNXQIKDGQXXXKXYAXPELQKMQGT

SEQ ID NO: 4303 - protein, 183 aa, Triticum aestivum
  unsure (1)..(183): unsure at all Xaa locations
MAAEGEKKMITLKSSDGEEFEVEEAVAMESQTIRHMIEDDCADNGIPLPNVNSKILSKVIEYCNKHVHAAAAAAAASKAGSDDVGAASANSTAASGEDLKNWDADFVKVDQATLFDLILAANYLNIKGLLXDLTCQTVADMIQGQTXRRISQDFNIKNDFTLXEEEEIXRXENXWPSNKEVWY

SEQ ID NO: 4304 - protein, 115 aa, Triticum aestivum
GRYAAEIRDPVRKARVWLGTFDTPEQAARAYDAAARRLRGPRATTNYPGDVVREAPCTAPALAASASGSTESSSSSSSRDDGHPPPPLPTAPSSLRPGPRVFPGDGGHPAVPFLR

SEQ ID NO: 4305 - protein, 157 aa, Triticum aestivum
  unsure (1)..(157): unsure at all Xaa locations
LPMAIGFMLAYSKLSDVLSREALFYTVIFPFIAFFGLFGFVLYPLRDAIHPTALADKLLAALGPSFLGPVAILRIWSFCLFYVMAELWGNVVVSVLFWGFANQVDEAKRILTSIWAWGKILXLIFSGGNCEIIPNLXEXXGXRIXXWGRIXLKXXMG

SEQ ID NO: 4306 - protein, 202 aa, Triticum aestivum; identical to SEQ ID NO: 4133

SEQ ID NO: 4307 - protein, 170 aa, Triticum aestivum
MGAIMCCLRGRGPGDDAPGCCCLPWPFLNNDRNNDNNNTNHNSGPPAPQRANTRVAPVQGRVPPAGSRQDDSMNTFRCPPRPLPYDDPQFRHQTERHPLVAGRDKASTQSQKSNLLEESNDADTRSTCADEKADGSSLKAESGGKKLGGAKVCVPSDCEDDCPICLEEYD

SEQ ID NO: 4308 - protein, 266 aa, Triticum aestivum
  unsure (1)..(266): unsure at all Xaa locations
GQSCGFLQFPTFGLKAWKQTFFFDFSLTYVGAGMICSHLVNLSTLFGAVLSWGIMWPLISKQKGIWYPANVPESSMTSLFGYKSFMCVALIMGDGLYHFIKLTGITAKSLHAQSNRKHVKRAANEDTVSFHDLQRNEVFTREYIPNWLAYAGYASLSIIAIIVIPTMFRQAKWYYVVVAYVLAPVLGFSNAYGAGLTDMSMSYNYGKIALFIFAAWGGKDDGVIAGLVGCAIVNTSEVSADLXHDYKTGICTDITEILLSGSHQYG

SEQ ID NO: 4309 - protein, 103 aa, Triticum aestivum
  unsure (1)..(103): unsure at all Xaa locations
VRGRVGDEGVETLIPELLRGVSDNQAFMRRGSPYLIGFLLRHXKVAWADEAPDMMTTLISLLSDTDNATVLAAREAFLRVVGSATEEQFPTHIKLVRDAFFTA

SEQ ID NO: 4310 - protein, 347 aa, Triticum aestivum
  unsure (1)..(347): unsure at all Xaa locations
MQRSASMNCGSGPAPATMVRCRQCSASVAAPPGARAVQCMQCCCVTRVGGGGRQHGAMVPAMRPIPGFGGGRGKKRAVLVGIKYTNTPRXELRGPINDVKCMRYLLTEHFGFANDCVLILTDEERDPCRQPTKNNIRMAMHWLVQGCSSGDSLVFQFSGAGVQVLDCSGEERDGMDEAICPLDSFQQGPILDDEINQAIVRPLVHGVKLHAIVDACHSATVLDLPYQCTFSKQYGCLRWRDERPLNGAFKGTSGGQAVLISGSSNGKTQMNMMPGPDATVGAMTHSFIRAVECEPRTTYGHLLTSMRTIMREGGGNCNLQGPAGGCIRKVGQLSRVGGASAVFCLQV

SEQ ID NO: 4311 - protein, 224 aa, Triticum aestivum
MLSLVGCLHGLVQGCSYGDSLVFQFSGLGAQVPDDDGDELDGMDEALCPVDSFQQGPILDDEINEAIVRPLVHGVKLHAIVDACHSATVLDLPYQCTVSKQTGRWRWRDERPMTGACKGTSGGQAVLISGSSNGKSNMSVLPEPYATIGAMTHSFIRAVECEPRTTYGRLLTSMRAIMRDSSGNCNLQGPIGGSIRKVANFSGVEEPQLSSAYKFDVEREPFCM

SEQ ID NO: 4312 - protein, 346 aa, Triticum aestivum
MNCGRGPAPATMVRCRQCSASVAAPAGARAVQCAQCCCVTRVSGAGRQLSVMRPIPNFGGGRGKKRAVLVGIKYTKTRACELRGPINDVKCMRYLLTERFGFANDCVLILTDEERDPCRQPTKANIRMAMHWLMQGCSSGDSLVFQFSGAGAQVPDCDGDERDGMDEAICPVDSFQQGPILDDEINQAIVRPLVHGAKLHAIVDACHSATVLDLPYRCTFSKQYGCLRWMDERPLNGACKGTSGGKAVLISGSSNGKTQMSVLPEPNATIGALTHSFIKALECEPRTTYGHLLTSMRTTMRAGAGNCSLQGPVGCSIRKVANFSGVEEPQMSSACKFDINCEPFYM

SEQ ID NO: 4313 - protein, 550 aa, Triticum aestivum
  unsure (1)..(550): unsure at all Xaa locations
LRASLSVFSLPLDPNRARRRRLQPPRPPAPANSSPLGPGLASHHFARRPQTLPPSPPAPPAPSTSPVAIVGPPVACRYGLYFLFVKSETKTPSGLTARPVLTSYYKSEQFKNRPYDPYHNYTSPTAAILCADAFQSMYAQMVCGLCQRHEVLRVGAVFPSGLPRAVRSLPALLQXLPAPLRARPRAPGVAHPALPAAGPGLPRRLPPGAXAAAEHGVKADXAAVGSRGRPDTRVLRAGASGALAQYIGTLKYYSGDLPMACTMYASSECYFGLNLRPLCDPSEVSYTIMPNMGYFEFLPVDSATGAASCVDAGNLVDLARVEAGREYELVITTYAGLNRYRVGDVLRVTGFHNAAPQFQFVRRKNVLLSIESHKTDEAELQRAVERASALLRPHGASVAEYTSQACTKSIPGHYVIYWELLTTGAGAATAVDKGTLDACCLEMEEALNTVYRQSRVADGSIGPLEIRVVRGGTFEELMDYAISRGASINQYKAPRCVTFPPIIELLDSRVVSSHFSPALPHWNPGPALRLERRRSPHEARRRLRLNRFTR

SEQ ID NO: 4314 - protein, 241 aa, Triticum aestivum
  unsure (1)..(241): unsure at all Xaa locations
MATKIFSLLMLLALSACVANATIFPQCSQAPIASLLPPYLPSMIASVCENPALQPYRLQQAIAASNIPLSPLLFQQSPALSLXVQSLVQTIRAQQLQQLVLPVINQVALANXSPYSQQQQFLPFNQLSTLNRAAYLQQQLLPFSQLATAYSQQQQLLPFNQLAALNPAAYLQQQILLPFNQLAAASRASFLTQQQLLPFYQQFAANPATLLQLQQLLPFVQLALTNPAASYQQHIIGGALF

SEQ ID NO: 4315 - protein, 449 aa, Triticum aestivum
MYRAKRAALSPKVKRRVGKYELGRTIGEGTFAKVRFAKNTETMEPVAIKILDKEKVQKLRLVEQIRREICTMKLIKHPNVVRLHEVMGSKARIFIVLEYITGGELFDTIYTNGRLKEEEARKYFQQLINAVDYCHSRGVYHRDLKLENLLLDAAGNLKVSDFGLSALTEQVKADGLLHTTCGTPNYVAPEVIEDRGYDGAAADIWSCGVILFILLAGFLPFEDENIIALYKKISEAQFTCPSWFSTGAKKLITRILDPNPATRITIPQILEDPWFKKGFKPPVFDDKYETSFDDVYAAFGDSEDQHVKEETEHKPTSMNAFELISLNQGLNLDNLFEAKEEHKRETRFTSQCPPKEIISKIAEAARPLGFDIQKKNYKMRMENPKAGRKGNLNVATEVFQVAPSLHVVELKKAKGDTLEFQMFYRSLSTQLKDVVWKCGGEVEDNSTAA

SEQ ID NO: 4316 - protein, 436 aa, Triticum aestivum
GLTARPVLTSYYKSEQFKNRPYDPYHNYTSPTAAILCADAFQSMYAQMVCGLCQRHEVLRVGAVFASGLLRAIRFLQLNWKELAADIEAGALSPRVTDASVREAVAGILRPDPELAQFVRDECCNDDWAGIVRRIWPNTKYLDVIVTGAMAQYIGTLKYYSGDLPMACTMYASSECYFGLNLRPLCDPSEVSYTIMPNMGYFEFLPVDSATGAASCVDAGNLVDLARVEAGREYELVITTYAGLNRYRVGDVLRVTGFHNAAPQFQFVRRKNVLLSIESHKTDEAELQRAVERASALLRPHGASVAEYTSQACTKSIPGHYVIYWELLTTGAGAATAVDKGTLDACCLEMEEALNTVYRQSRVADGSIGPLEIRVVRAGTFEELMDYAISRGASINQYKAPRCVTFPPIIELLDSRVVSSHFSPALPHWTPARRSD

SEQ ID NO: 4317 - protein, 356 aa, Triticum aestivum
LLTPDITIMSVGTVIAYGQEMTPDVGWEEFLNNKWDRDIVVQETAKFPHLKPQPERNQGPGEVSFFVDKQGAQEVINYLPQKLEQLGLDVKIIYSSGEALDVLPRGAGKGQALIYLLEKFSSSGKPPSNVLVCGDSGNDADLFSVPSAYGVMVSNAQEELLQWYEENGKDNLKLLHATERCASGIMQAIGHFKLGPSFSVRDLEFPYLKVDTIKPADVVVKFYVLYEKWRRGEVQKSPSVVQYLKSITFQNGTLIHPCGMERSLHASIDALSSCYGDKQGQKFRAWVDRLFTSPISTSNWLVRFDNWEMEGDVQYCCRTTLLLNTKPETPEGLELTHIHKTWLEGYSAGNDHTFIL

SEQ ID NO: 4318 - protein, 160 aa, Triticum aestivum
  unsure (1)..(160): unsure at all Xaa locations
VGGYHLTVCPPAIMALAEEAATKNKTFIFSLSAPFISQFFKGPLDETSPYWDYVIGNETEALAYAESHDLNTKDIKEIAKALAALPKXNTQRKRTAIITQGTDPTIVAVDGEEPLTFPVHVIDKNLINDTTGAGDAFATGFVAGLVSKTIPSSDLTKDNG

SEQ ID NO: 4319 - protein, 95 aa, Triticum aestivum
  unsure (1)..(95): unsure at all Xaa locations
NKENTLXSPFXGLAVHPXDGIXQAISHVXALFLLPXHFRXHIALXFRXAXWTANIHDCIHGKXWPVXGXGDHTSHHTTYRHNXXXYTVWXDWXXG

SEQ ID NO: 4320 - protein, 127 aa, Triticum aestivum
  unsure (1)..(127): unsure at all Xaa locations
GKGCAAALKQAGARVXVTKIDPICALXALMEGIQXLTLEDVVSEADIFVTTTGNKDIIMVHHMRKMKNXNAIVCKIGHFXDNEIRHETGFRPNPGCXSAINIXAPKTDRWVLPXNKEESIVSCRVVN

SEQ ID NO: 4321 - protein, 79 aa, Triticum aestivum
  unsure (1)..(79): unsure at all Xaa locations
CAPLLARVLCAHVSSQQYVRAFTGKGXSEKXSXEEXNLLSVAYXNGIXXRRASWRXISSIEQKEKSXGNEDRVTLIKDY

SEQ ID NO: 4322 - protein, 378 aa, Triticum aestivum
  unsure (1)..(378): unsure at all Xaa locations
MLQSEIKTQDPHNTRPADFNGRNPPDTTPYLHVHQLMLQDAGASENANIFMQIKPLFPTGFDEVELKNHTPVIHANVFQTIKILYDGAKELAQLETESSKNVISPDNQEIGEKLSEIGGRLDYPLLNKELVQDVRKLWEDPAIQETYSCGSVLQVPDCAHYFMENLDRLAEPDYIPTKEDVLHARVRTNGVVEIQFSPLGESKRGGEVYRLYDVGGQRNERRKWIHLFEGVDAAIFCAASSKYDQMLFEDGTRDRMVXDKXLVDWVLKQGCLEKTSFSLYLNKLDIFEEEIPRVSLTGGEGFKEYKTNAPGKVQDKVDTYEFKMKKVDVIYFQRSKEXRVNRVCKNYGTTALERQLGRKMMKPISESTRRSMEGTCTR

SEQ ID NO: 4323 - protein, 126 aa, Triticum aestivum
  unsure (1)..(126): unsure at all Xaa locations
MKMAASNLEGVLLGMGNPLLDISAVDDKAFLANYDVKPNNAILAEDKHLPMYDEWRRQDIVEYIAGGATRNCIMDGQWMLQTPGATSYMGGIEKDKYGEEMKSANETAXVTDHYYEDDAATTCTCA

SEQ ID NO: 4324 - protein, 156 aa, Triticum aestivum
  unsure (1)..(156): unsure at all Xaa locations
GGEACDVFDGAWVPDDTGRHPLYNSSECPFAERGFDCLANGRNDTGYLKWRWKPRRCEVPQFAARTALERLRGKRVVFVGDSMSRTQWXSFICMLMAGVDDPRTVXXVNGNEXXKTIRHLAVRFASXRLTVXFFRSCPRARPPQRPQKKSLGGDDI

SEQ ID NO: 4325 - protein, 200 aa, Triticum aestivum
MALSVEKTSSGREYKVKDLSQADFGRLELELAEVEMPGLMACRTEFGPSQPFKGARISGSLHMTIQTAVLIETLTALGAEVRWCSCNIFSTDNPEFKIVLTIIRDGLKTDASKYRKMKERLVGVSEETTTGVKRLYQMQESGTLLFPAINVNDSVTKSKFDNLYGCRHSLPDGLMRATDVMIAGKVAVVCGYGDVGKGCA

SEQ ID NO: 4326 - protein, 429 aa, Triticum aestivum
  unsure (1)..(429): unsure at all Xaa locations
MALSVEKTSSGREYKVKDLSQADFGRLELELAEVEMPGLMACRTEFGPSQPFKGARISGSLHMTIQTAVLIETLTALGAEVRWCSCNIFSTQDHAAAAIARDSAAVFAWKGETLEEYWWCTERCLDWGVGGGPDLIVDDGGDATLLIHEGVKAEEEFEKSGKVPDPESTDNPEFKIVLTIIRDGLKTDASKYRKMKERLVGVSEETTTGVKRLYQMQESGTLLFPAINVNDSVTKSKFDNLYGCRHSLPDGLMRATDVMIAGKVAVVCGYGDVGKGCAAALKQAGXARVIVTEIDPICALQALMEGIQILTLEDVVSEADIFVTTTGNKDIIMVDHMRKMKNNAIVCNIXGHFDNEIDMNGFETXPGVKAHQHQAQTDRWVFPQNKDWQSIVXWXGGXLMXPGXXPMGQPNFXNVLAQFKTKLAQLRVG

SEQ ID NO: 4327 - protein, 485 aa, Triticum aestivum
  unsure (1)..(485): unsure at all Xaa locations
MALSVEKTSSGREYKVKDLSQADFGRLELDLAEVEMPGLMACRTEFGPSQPFKGARISGSLHMTIQTAVLIETLTALGAEVRWCSCNIFSTQDHAAAAIARDSAAVFAWKGETLEEYWWCTERCLDWGAGGGPDLIVDDGGDATLLIHEGVKAEEEFEKSGKVPDPESTDNPEFKIVLTIIRDGLKTDAHKYRKMKERLVGVSEETTTGVKRLYQMQESGTLLFPAINVNDSVTKSKFDNLYGCRHSLPDGLMRATDVMIAGKVAVVCGYXDVGKGCAAALKQAGARVIVTEIDPICALQALMEGIQILTLEDVVSEADIFVTTTGNKDIIMVDHMRKMKNNAIVCNIGHFDNEIDMNGLETYPGVKRITIKPQTDRWVFPETKTGIIVLAEGRLMNLGCATGHPSFVMSCSFTNQVIAQLELWNEKATGKYEKKVYVLPKHLDEKVAALHLGKLGARLTKLTKSQSDYISIPVEGPYKPAAYRY

SEQ ID NO: 4328 - protein, 106 aa, Triticum aestivum
  unsure (1)..(106): unsure at all Xaa locations
LAEGRLMNLGCATGHPSFVMSCSFTNQVIAQLELWNEKATGKYEKKVYVLPKHLYEKVAXLHLGQAPAPRLTKLTNPNPDYIYTQFEGRTTCGLTVLMCPTRLTVA

SEQ ID NO: 4329 - protein, 89 aa, Triticum aestivum
PRAEFGTREILITAEEGSIGGFGSHVAHYLSLNGLLDGPLKLRSMFLPDRYIDHGAAEDQMEAAGLTPRHIAATVLSLVGRPVEALRLK

SEQ ID NO: 4330 - protein, 147 aa, Triticum aestivum
  unsure (1)..(147): unsure at all Xaa locations
MPVPLAPYPTPPVPFTPPAPNXRGFKANLVCSGCRNLLMYPAGATSVCCAVCSTVTAVPAPGTEMAQLVCGGCHTLLMYIRGATSVQCSCCHTVNLAMEANQVAHVNCGSCRMLLMYQYGARSVKCAVCSFVTSVGASSGAEQKPSN

SEQ ID NO: 4331 - protein, 230 aa, Triticum aestivum
  unsure (1)..(230): unsure at all Xaa locations
MKARNLEPALSWAAKNHDQLLQNGSMLEFKLYQLQFVEILSKGSRGEAKDEALLYARTHLVPFAAVHKEEFQKLMACLLWVGXLDQSPYSELMSSAHWEKLAEELTHQFCSLLGQSRESPLSVAVSAGFQGLPTLLKLTQVMAAKKQEWQVMKQLPVPLDLAPVFQPPSVPGRPVLREPPRGAFPPTPLPCGHVVSKQSIMKLSKSSSRPFKCPYCPSEAVASHCKQLHF

SEQ ID NO: 4332 - protein, 224 aa, Triticum aestivum
QICMAGGLSTGWIEWDGERFEFENAPSYSEKNWGGGFPRKWYWIQCNVFSGASGEVSLTAAGGLRKIGLGDTYESPSLIGIHYEGQFFEFVPWTGTVSWDIALWGRWKMSGENKTHLVEIEATTTEPGTALRAPTIEAGLVPACKDTCYGDLRLQLWEKKYDGSKGAMILDATSNMAALEVGGGPWFNGWKGTTVTNEAVNNIVGTPIDVESLFPIPFLKPPGL

SEQ ID NO: 4333 - protein, 311 aa, Triticum aestivum
MSFTGTQDKCKTCDKTVHFIDLLTADGVSYHKTCFKCSHCKGTLSMCNYSSMDGVLYCKTHFEQLFKETGNFSKNFTPGGKSAEKGEAKAPSKMSSAFSGTQDKCAARRKTGDKTVHFIDLLTADGVSYHKTCWKCSHCKGTLSMCNYSSMDGVLYCKTHFEQLFKETGNFSKNFTPGGKSAEKSEAKAPSKMSSAFSGTQDKCAACQKTVYPLEKLTLEGECYHKSCFKCSHGGCILTTSSYAALNGILYCKIHFSQLFKEKGSYNHLIKTAQTKKENVEAAAAAEAGAEAAAAAAAAAAEPEAPPQDEE

SEQ ID NO: 4334 - protein, 180 aa, Triticum aestivum
  unsure (1)..(180): unsure at all Xaa locations
ETGRHVHMLTHEIRSTLDRHTILRTTLVELGRTLGLAECALWMPSRSGTALHLSHTIHNSAPIGLVVPINLPVVSKVFNKXIRAESIPHTSPLGXQIKADTSRYVXPPEVRSCPEFHWLHLTISEINDWPELSAKSXIMVLMLPPDSARNGXPMIGXVEIVAXQGGIARPSAIWIMRAVN

SEQ ID NO: 4335 - protein, 497 aa, Triticum aestivum
  unsure (1)..(497): unsure at all Xaa locations
MAAAVVDAAVPVAAKANGAGARCCAAKGPGYATPREAMEKGPREGLLYVTCVYNGTGIDKPDYLATVDVDPNSATYSQVIHRLQATHIGDELHHSGWNACSSCHGDPSTSRRFLILPSLLSGRLYVVDTAKNPRAPALHKVVQAEDIAEKTGLGFPHTSHCLATGDIMISCLGDKEGNAAGNGFLLLDSEFNVKGRWEKPGHSPLFGYDFWYQPRHKTMISSSWGAPAAFRTGFDLQXHVQDGLYGRHLHVYDWPGWVSSSRHWIXGSTGLLPLEVRFLHDPSKDTGYVGCALTSNMVRFFKTADGSWSHEGXAISIKPLKVRNWILPEMPGLITDFVISLDDRYLYLVNWLHGDIRQYNIEDPAKPVLAGQVFVGGLLQKGSDVVYVTDDDKEEQYAVPEVKGHRLRGGPQMIQLSLDGKRVYVTNSLFSRWDEQFYGPDLLKKGSHMLQIDVDTEEGGLAVNPNFFVDFGTEPEGPSLAHEMRYPGGDCTSDIWI

SEQ ID NO: 4336 - protein, 123 aa, Triticum aestivum
  unsure (1)..(123): unsure at all Xaa locations
MADVHEPLVRRKRKKVLXVDYLVKFRWILVIFVVLPISTLIYFNIFLGDMWSAMKSEKXRQKQHDENVQKVVKRLKQRNPKKDGLVCTAKEAWIAVGMRNVDYKRAXIXRSTFSLXEILEIDK

SEQ ID NO: 4337 - protein, 148 aa, Triticum aestivum
  unsure (1)..(148): unsure at all Xaa locations
IAKXDKFPVREASTKTLGRLLCYQLQFGGSTLQLVQLLILALRDSSTEVRRRSLSCIKAAAKINHSALATHISILGPAIGDTLKDSSSPVRIAAERCAVHVFQLTKGADYVTTAQKHLTNMTGLEVRRLAKLPVESDDSESSDDDRRA

SEQ ID NO: 4338 - protein, 216 aa, Triticum aestivum
  unsure (1)..(216): unsure at all Xaa locations
MADLQTPLVRPKRKKALIYFNIYLGDMWSAMKSEKKRQKEHEDNVQKVVKRLKQRNPKKDGLVCTARKPWIAVGMRNVDYKRVRHFEVDLSAFRNILEIDPERMVAKVEPLVNMGQISRATCPMNLSLAVVAELDDLTVGGLINGYGIEGSSHIYGLFSDTVVALEIVLADGRVVRATKDNEYSDXLFYGXPWSQGTLGFLVSAEIKLIPIKEYMR

SEQ ID NO: 4339 - protein, 380 aa, Triticum aestivum
MADRANHPSVMQKFGGQFHLASSFSEGVRARNICPSVPSYERRFTTSSYMTQNLGISVPIMSSSPMFANAPPEKKGVKNFAIDFLMGGVSAAVSKTAAAPIERVKLLIQNQDEMIKAGRLSEPYKGIGDCFGRTIKDEGFGSLWRGNTANVIRYFPTQALNFAFKDYFKRMFNFKKDKDGYWKWFGGNLASGGAAGASSLFFVYSLDYARTRLANDAKASKGGGERQFNGLVDVYRKTLKSDGIAGLYRGFNISCVGIIVYRGLYFGLYDSLKPVLLTGTLQDNFFASFALGWLITNGAGLASYPIDTVRRRMMMTSGEAVKYKSSLDAFQQILKKEGAKSLFKGAGANILRAIAGAGVLSGYDQLQILFFGKKYGSGGA

SEQ ID NO: 4340 - protein, 306 aa, Triticum aestivum
FSLVALRKVMVIDYKLTYPSGTATAMLINSFHTTSGAELAEKQVSCLGKYLSISFVWNCFKWFFSGVGDSCGFDNFPSLGLAAFKNTFYFDFSPTYIGCGLICPHIVNCSTLLGAIISWGFLWPYISTKAGEWYPAGLGSNDFKGLYGYKVFISVSVILGDGIYNLIKIIYATIKEIMNARSKQGRLPLVRAQDDDESSELSSEEKLLNDVFVRDSIPPWLAGSGYVGLAAISTATVPMMFPQLKRYLSLSAYVGGPLLAFCNLYGTGLTDWNLAFTYGKDGPFIFALWVGQHGGVIAYNLWGHES

SEQ ID NO: 4341 - protein, 93 aa, Triticum aestivum
  unsure (1)..(93): unsure at all Xaa locations
HSFFFAKANTPTWGGALSVEKTSSGREYKVKDLSQDSLGXLELELREVEMPGLMDCRTEFSPLQPLKVARIFGXLHMTIQTADLMETLTGLGT

SEQ ID NO: 4342 - protein, 131 aa, Triticum aestivum
  unsure (1)..(131): unsure at all Xaa locations
DVITMTRFVMEEGRRAKGTGEFTQLLNSLCTAVKAISTAVRKAGIANLYGIAGSTNVTGDQVKKLDILSNDLVINMLKSSFSTCVIVSEENKDAVIVEADRRGKYIVCIDPPGWXSNIDCPVSNWDIFGIL

SEQ ID NO: 4343 - protein, 111 aa, Triticum aestivum
  unsure (1)..(111): unsure at all Xaa locations
AVNHVHALAILVATFHYEKQPPALDQDTFADYTARTSFERPLLSGVAYAQRVMHADREAFERQQGWIIKTMKHEPSPXKDXYXPVIYSXGEXSYIEGLXIIPRRKDPEENP

SEQ ID NO: 4344 - protein, 125 aa, Triticum aestivum
  unsure (1)..(125): unsure at all Xaa locations
VARAMFACCALDGKIIVAGGFTNCRKSISEAEIYDPEADTWESLPDLRQAHPSACSGLVIKDKMHVLHKGISTVQILEDGGNYWAVEDYSWLQGPMAMVGGXLYVLSNSCIRKQHGENFPDKWSL

SEQ ID NO: 4345 - protein, 202 aa, Triticum aestivum
MGFLSLVGNSFGCSASGERLVSAARDGDLQEARALLEYNPRLARYSTFGGRNSPLHYAAAQGHHEIVSLLLESGVEINLRNYRGQTALMQACQYGHWEVVQTLMLFNANIHRTDYLNGGTAIHFAALHGHARCLRLVLADYVPSIPNFLNQTNHRSTEEVSDADFDDDGLVKMVNWKADGGLTPLHMAALNGHVECVQLLLD

SEQ ID NO: 4346 - protein, 345 aa, Triticum aestivum
  unsure (1)..(345): unsure at all Xaa locations
MISSISLLDSSHQLIHKLYRKCWPSNSNAKLNMHSTAKSGGKSMRLKMALLKPHATDFKRNHQAHEEDNVFYKLVYRLPESLSCLYPSQNPVRKKKQQKQXTVPSNRFGVILEWEGVVGEDHDPDLEPRAWDVLSLEEAKSFPPDEMLKEVEEMRTDQADKNLXGRSSDAMEGATSAARLEALGLFLRATVYLLRPGGLDSLNALVPSDRPRAAAASRPKMNLEEGIKAVGLQGYFDVVVAAEDFRRGKPEGEMFEVAAEQLGLEPDVCLVMGSSNLTTESAHTAGMRCVAVASRHPAYELHAANHVVRWLDQLSVVDLQRLANGEVLGRRGRRSDMDMEIVIEE

SEQ ID NO: 4347 - protein, 117 aa, Triticum aestivum
SVVAAEVLGGIPLLVISVLNHDPALNGHIQELTWSDIAALGYTSIFGSAVSYGVYFYNATRGSLTTLSSLTFLTPMFASIFGFLYLGETFAPEQIGGALLTLVAIYMVNYKSIIGEK

SEQ ID NO: 4348 - protein, 132 aa, Triticum aestivum
  unsure (1)..(132): unsure at all Xaa locations
MALKASFPGELAGATILESPSSGAFRHLRQAVDFTFRKTDKRAAFLRRTCCSMQQGPSPAWPGRAVADPARRSWDSPKPISIIGSTGSVGTQTLAIVAENPDKFRVVALXAGSNVTLLADQVKMFKSGRNRK

SEQ ID NO: 4349 - protein, 265 aa, Triticum aestivum
  unsure (1)..(265): unsure at all Xaa locations
MAQPAKLSREENVYMAKLAEQAERYEEMVEFMEKVAKTVDSEELTVEERNLLSVAYKXNVIGARRASWRIISSIEQKEESRGNEDRVTLIKDYRGKIEVELTKICDGILKLLDSHLVPSSTAPESKVFYLKMKGDYYRYLAEFKSGTERKDAAENTMVXAYKAAQEIALKELPPTHPIRLXGLALNFSVFYYEILNSPDRACDLAKQAFDEAISELDSLSEESYKDSTFIMQLLRDNLTLWTSDISEDAAEEMKDAPKGESGDGQ

SEQ ID NO: 4350 - protein, 132 aa, Triticum aestivum
  unsure (1)..(132): unsure at all Xaa locations
GCVLLGGGAGRRRHGGGEEAAGVSDVGAWAMNVVSSVSLIMANKQLMSSSGYXFAFATTLTGFHFTVTALVGWISNATGYSVSKHVPLWXLVWFSLVANTSIXGMNLSLMXNSVXLPDLRFGGCYEWCNRTH

SEQ ID NO: 4351 - protein, 185 aa, Triticum aestivum
MAEEKHHHHHLFHHKKDEEQLAAGGYGESAEYTEATVTEVVSTGENEYDEYKKEEKEHKHKQHLGEAGAIAAGAFALYEKHEAKKDPEHAHRHKIEEEVAAAAAVGSGGFAFHEHHEKKKDTRRRRGRGEKNTLLRLIDLPISPPFAILLYNTSSPLFPVLFPLAPGSTLAATHLVTYQVLTRQN

SEQ ID NO: 4352 - protein, 123 aa, Triticum aestivum
  unsure (1)..(123): unsure at all Xaa locations
LTSPHLASSAPRENPRPSFRLPEVSRRGRRPDEAPGSASASASVAPPVGPRCAVCRGVDISVPHQANCSHWFXCGHCIVGVWLQGSVLRPXNCPVCRRPITLPVPSEDVALLPDEMKLETRLI

SEQ ID NO: 4353 - protein, 317 aa, Triticum aestivum
  unsure (1)..(317): unsure at all Xaa locations
MSEGAAAAAAAEDGATRAGRAWAFRRDLAAGALMXGXVHTVVAPIERVKLLLQTQDGNAALLGRSRRFRGFADCVARTVRDEGVLSLWRGNGTAVIRYYPSVALNFSLKDLYRSILKDAGTSADNKFASIALTNFIAGAAAGCTTLVIIYPLDIAHTRLAADIGQTDARQFKGIRHFIQTIYKKNGIRGIYRGLPASLHGMVVHRGLYFGGFDTAKDTLVPLDSPLWQRWVTAQAVTSTAGLISYPLDTVRRRMMMQSGMEAQMYSGTLDCWRKIYRAEGVRSFYRGALSNMFRSTGAAAILVLYDEVKKFMNGGRL

SEQ ID NO: 4354 - protein, 99 aa, Triticum aestivum
  unsure (1)..(99): unsure at all Xaa locations
KIPFPLTHRSTXMLHNVIHLSTDDVSYVSTRSXYFLNSFGLRELVSLIIVEDXATDDAQNMMFMYAEMRLSPALFLIAEIDSLDIIQHDWSLPEMNLHA

SEQ ID NO: 4355 - protein, 147 aa, Triticum aestivum
MAAFNKLGSLLRHSALASGVAASSSPAVFNAARLMSTKLFVGGLSWGVDDMKLREAFSGFGDVTEARVITDRDTGKSRGFGFVNYTSSDAANAAISGMDGKEIDGRPVRVNIANDRPAGNRGGGGYGGGGFGGGGYGGGNQSYGGGY

SEQ ID NO: 4356 - protein, 247 aa, Triticum aestivum
MEKNTALPKKTRKNSLLTGPSSSPSPYPSRRRRRGPAGSMDAMEEDTPPALPPPPPPTTGAKQPPYKDPDDGRQRFLLELEFIQCLANPIYINYLAQNRYFEDEAFIGYLKYLKYWQRPEYIKYIMYPHCLFFLELLQNANFRNAMAHPANKEVAHRQQYFFWKNYRNNRLKHILPRPPPEPTPAPAPAPAPVPTPPPVPAPPSSLPTMSAVGASAMPPMQFIGTPGANNPKNEMRNVMGGRKRKMG

SEQ ID NO: 4357 - protein, 235 aa, Triticum aestivum
MADKENSAYAAAAAPRTTRASAKRAAAVTAVAVAAKRKRVALSEIPTLPNGAPQPQTKPKKSSSQVAKPKKRSVSSLSLSLPAPKPAPGAADETGDPQLCAPYASDIYSYLRSMEVQARRRPAADYIERVQVDVTPNMRGILVDWLVEVAEEYKLVSDTLYLTVSYIDRFLSANSLNRQKLQLLGVSAMLIASKYEEISPPNVEDFCYITDNTYMKLRLGQSDRHVLPHPVHKIW

SEQ ID NO: 4358 - protein, 161 aa, Triticum aestivum
MHPKARIHADPAAPEPDRIDGLPDSLVLLILNKLEDVHSLGRCSAASKRFNGLVPHVHDVCVKIDRVVAVDGDGEDALNLISPKPRNILSHFLKLMLFTIIKPFHSARGPNGAGRPLFPQLAHHSPAQVLRSFTHVRNLHIELPSGDVGTEDGVLLKWRAE

SEQ ID NO: 4359 - protein, 394 aa, Triticum aestivum
  unsure (1)..(394): unsure at all Xaa locations
METVAAAGYARGAATRSPACCAAMSFSQSYRPKAARPATSFYGESLRANTARTSFPAGRQSKAASRAALTTRCAIGDSLEEFLTKATPDKNLIRLLICMGEAMRTIAFKVRTASCGGTACVNSFGDEQLAVDMLADKLLFEALEYSHVCKYACSEEVPELQDMGGPVEGGFSVAFDPLDGSSIVDTNFTVGTIFGVWPGDKLTGVTGGDQVAAAMGIYGPRTTFVVALKDCPXGTHEFLLLDEGKWQHVKDTTSIGEGKMFSPGNPRARFDNPDYDKLVNYYVKEKYTLRYTGGMVPDVNQIIVKEKGIFTNVTSPTAKAKLRLLFEVAPLGFLIEKAGGHSSDGKQSVLDKVISVLDERTQVAYGSKNEIIRFEETLYGSSRLAASATVGATA

SEQ ID NO: 4360 - protein, 102 aa, Triticum aestivum
  unsure (1)..(102): unsure at all Xaa locations
HIILLAEGRLVNLGCATGHSSFVMSCSPPNHVLAQILLFKAEDPXIRAKKYVDSGRPQKLEXVYYVLPKXXLVETCSFYFHLAHVNAELSKLTHVQAEYPRP

SEQ ID NO: 4361 - protein, 151 aa, Triticum aestivum
MEVSNQASWPDDFLCPISLEVMTDPVILPSGHTFERRSIQRWLDGGHRTCPVTNLPLPPDPTLIPNHALRRLIAAVSVSPAAVSADKVLAGDCQEQGVAPPSSSSVLGMLRLVSGPAGRGGASPARSRCCSRRPPDAKGVLFSLRRPSGLG

SEQ ID NO: 4362 - protein, 421 aa, Triticum aestivum
  unsure (1)..(421): unsure at all Xaa locations
MAHDEAVAARKTGEXDSPPKDQPAPSPDPDWSAMQAYYSSGVMPPAYFAPAIAXGHPPPSYMWGPQHMMPPPFGTPYAMYSHGGAYPHALLPTMARPVGMDPAKSANSKDKSSNKKLKNLLSAAASTALGSTNPTPSSGAICGLDYCGVNGLKLXGKTAESTGSGNSKKKSSSGDYSGEGSSDVNDLKVSGTPRKRSLDGGFDAEHRGRIKXVVASSPIIRNGAILSNQCFPAPVIKPSVTNVANSRAIGTPVSPLPGVMGPIHTGISTELSSKDEREVKREKRKQSNRESARRSRLRKGXVATEELATQPVECAYQLRTRRLKSXEIGKLTXQSSEKLRIENSALVMKLTXAPQHRPAQKLPLDKSAVAAPSSSPRVGENFLSMIDDTSKSGVKNHMEHSEPKLRQLLGSSATTDVVAAN

SEQ ID NO: 4363 - protein, 102 aa, Triticum aestivum
MSTAKAKVEQIINDHAVAVFSKSYCPHCDHTKNLLESMGAKYTAIELDQIDDGSTIQAALKEINGQSTVPNIYINKVHIGGNSDLQSKKSTLPSLLKDAGAL

SEQ ID NO: 4364 - protein, 127 aa, Triticum aestivum
GPNVAQSQLVCTGCRNLLMYPAGATSVCCAVCSTVTAVPAPGTEMAQLVCGGCHTLLMYLRGATSVQCSCCHTVNLAMEANQVAHVNCGNCRMLLMYQYGARSVKCAVCNFVTSVGASPGAEQKPSS

SEQ ID NO: 4365 - protein, 211 aa, Triticum aestivum
MRTICDVCESAVAVLFCAADEAALCRPCDEKVHMCNKLASRHVRVGLADPNKLVRCDICESSPAFFYCDIDGTSLCLSCDMAVHVGGKRTHGRYLLLRQRVEFPGDKPGHMDDVAMQQMESENPRDQNNAHSVAKEQMVNHHHNAYDPASDGNCNGQGAIDSKMFDLNMRPARNNGQGSSSQTHGVDHSHNNNHDSSGVVPTCNYDGATDK

SEQ ID NO: 4366 - protein, 110 aa, Triticum aestivum
MAAGGVWVFRKDGVMELKSAGVEPSAAAPGKKALVYVPANETLRSLEALERRLGALGWERYYENRDVVQLHRPGGGVDLIAPPRDFAGFRSTQMYDVVVKNRHHSKVVDI

SEQ ID NO: 4367 - protein, 141 aa, Triticum aestivum
MSSRAGDRALPASSPTEPDPEAPSAVSGGDFPADLLRAVLHRLPPADVARAACVCRLWRAVASDRAVLEAAFRAPCGVRRVLGDPATRAFWRAASLARFALSHAVRRGDTVPGVALKYPVQVTDIKRFNNMMTGPGIKFYQ

SEQ ID NO: 4368 - protein, 205 aa, Triticum aestivum
MSDADDYRCFVGSLSWNTTDVDLKDAFGKFGRVTETKVVLDKFSGRSRGFGFVTFDDKKAMEEAVEAMNGIDLDGRNITVERAQPQGSGRDRDGDRDYRGGGDRYGGGRDFGGGRGGGRGGGGDCYKCGKPGHFARECPSGDGGDRYGSRDDKYGGSNGSSRYGPDRGGDRYSGSRDGGSRSSGGGDRYSRDRSGPYDRRSRDEY

SEQ ID NO: 4369 - protein, 183 aa, Triticum aestivum
  unsure (1)..(183): unsure at all Xaa locations
MSDADDYRCFVGSLSWNTTDVDLKDAFGKFGRVTETKVVLDKFSGRSRGFGFVTFDDKKAMEEAVEAMNGIDLDGRNITVERAQPQGSGRDRDGDRDYRGGGDRYGGGRDFGGGRGGGRGGGGDCYKCGKPGHFARECPSGDGGDRYGSRDDRYSSRDDRYSSRDDRYSSRDDRXWWQGWCKG

SEQ ID NO: 4370 - protein, 912 aa, Triticum aestivum
  unsure (1)..(912): unsure at all Xaa locations
LALFSPCCSPARAQFCKIHLQPVLPALVXGLADENETVRDAALSARHIFVGCCATTSLPLLLPAIEDGLFSDNWRIRQCAVELLGDLVFTGPGSSTXAFLESRCHIKGTGPQAWGHSTSFSIXVDLLKDSLXACHVPCSGSRLDVSGKASLLPVTIRAQPPATRSMVLPVLMDTLISSLASSSSVRRQVAGRALGELVRKLGERVLPSIIPILSQGLKDPNASRRQGVCIGLSEVMGSAGKHQLLSFMGELIPTIRTALCDSTQEVRESAGLAFSTLYKSAGLQAIDEIVPTLLRAMEDDETSATALDGLKQILSVRTAAILPHILPKLVQPPLSSFNAHALGALAEVAGPGLSSHIGTILPTLILAMDDEDVDVQSTAKKAAETIVLVIDDEGVETLIPELLRGVNDNQASMRRGAAYLIGFLFKNSKLYLADEAPDMMSTLITLLSDTDNATVLAAWEAFSRVVGSVPKEQLPTHIKLVRDAVSTARDKERRRRKGVPVLLPGLCLPKALQPFLPIFQQGLISGSAETKEQAAEGLGELIDVTSEKTLREVVVPITGPLIRILGDRFPWQVKSAILSTLTIIIAKGGLALKPFLPQLQTTFVKCLQDSNRSVRTRAASALGKLSALSTRIDPLVSDLLSMLQSGDDAVKESVLSALKGVVRHAGKSVSSAIRSRGCTLLKDLLQADADDVRSSAAKAIGTLSQYMDETETTDLVQTLLSMGTLPDWCTRHGALLTFSSISRHCPTKLCHSTSFPSIVDLLKDSLKDDKFPVREASTKTLGRLLCYQLQFGGSTLQLVQLLILALRDSSTEVRRRSLSCIKAAAKINHSALATHISILGPAIGDTLKDSSSPVRIAAERCAVHVFQLTKGADYVTTAQKHLTNMTGLEVRRLAKLPVESDDSESSDDDRRA

SEQ ID NO: 4371 - protein, 366 aa, Triticum aestivum
  unsure (1)..(366): unsure at all Xaa locations
AAFSAPLGRPLQTSHGAVGEAGIASGPSLTVLTVGRRLRVRLGSLSRRNFEAKVSGVPSLSGLHRGKSLESATDLQDSLVTNLQGNWASLPPELLRDVMKRLEEDDSNWPSRKDVVACASVCTTWREMCKDIVRNPEFCGKLTFPVSLKQPGSRDGLIQCFIKRDKSKLTYRLYLSLTSAVLDDNGKFLLSAKRSRRTTYTDYAISMDPKNISRSSSGYIGKLRSNFLGTKFIIYDTQPPYNASKLCPQERTSRRFSSRKVSPKVPAATGSYPIAQVNYELNVLGTRGPRRMQCTMNSIPTSAVDPDGVVPGXQPKELLPRLFEESFRTTAIPGTHGLQQCPFGKGPLRGGDENGDKENPLVLKEQ

SEQ ID NO: 4372 - protein, 340 aa, Triticum aestivum
MEPGRLIFNTSGSGNGQMLFMDCGAGGIAGAAGMFHRGVRPVLGGMEEGRGVKRPFFTSPDDMLEEEYYDEQLPEKKRRLTPEQVHLLERSFEEENKLEPERKTELARKLGLQPRQVAVWFQNRRARWKTKTLERDFDRLKASFDALRADHDALLQDNHRLRSQVVTLTEKMQDKEAPEGSFGAAVDALEPEQAAAEAKASLANAEEHAAAAEAFEVVQQQLHVKDEERLSPGSGGSAVLDARDALLGSGCGLAGVVDSSVDSYCFPGGAGGDEYHECVMGPVAGGIQSEEDDGAGSDEGCSYYPDDAAVFFAAAQGHGHHHTDDDDQQDDGQISYWMWN

SEQ ID NO: 4373 - protein, 182 aa, Triticum aestivum
MRLWSSRPRRRPTGSLQAAFCNALEEAINTLVDPPVLRPSVDPRHVLSANFAPVDELPPTPCPVVRGVIPRCLAGGAYIRNGPNPQHLPRGPHHLFDGDGMLHSLLLPTAPDSDPVLCSRYVQTYKYIVERNAGEPVLPNVFSGFHGLAGMARGAVTAARVLTGQMNPMEGVGLANTSLAVF

SEQ ID NO: 4374 - protein, 197 aa, Triticum aestivum
  unsure (1)..(197): unsure at all Xaa locations
SSSIIATLAWASLFILQAHTLKQYSAPLSLTTLICFVGTLQAIVVTLAMEHRPSVWTIGFDMNLLAAAYAGIVTSSIAYYVQGLVIQKTGPVFASAFSPLMMIVVAVMGSFILSEKIYLGGVLGSVLIVIGLYSVLWGKHKETQAESAALREALPMAMASYTSKVTGDAXVGRHDPECEKANGAAKPSSNGHGASAV

SEQ ID NO: 4375 - protein, 113 aa, Triticum aestivum
  unsure (1)..(113): unsure at all Xaa locations
MHPSAVSFDSGDGRRRGGAQMLLFGGGGSANSNGFFRGVPMAVLAMDDATRVGKRPFFTTHXELLEEEYYDEQAPEKKRRLTAEQVQLLERSFKKRTAGXERKTNWXXLGMXP

SEQ ID NO: 4376 - protein, 775 aa, Triticum aestivum
  unsure (1)..(775): unsure at all Xaa locations
MVAAAILPELATQLVVPVAAAVGIAFAVLQWVLVSKVKVAPEPRGEGGSAAGGGTGAGAKDGASEYLIEEEEGLNDHNVVLKCAEIQTAISEGATSFLFTEYKYAGGFMTVFAVLIFVFLGSIEGFSTKSQPCHYSVGKTCKPALANAAFSTIAFVLGAVTSLVSGFLGMKIATYANARTTLEARKGVGKAFTVAFRSGAVMGFLLAASGLFVLYVAINLFGLYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGINREFTPMMYPLLISSVGIIACLITTLFATDFFEVKEVDQIEPALKKQLIISTAVMTVGIALVSWLGLPYTFTIFNFGAQKTVHSWQLFLCVAVGLWAGLVIGFITEYYTSNAYSPVQDVADSCRTGAATNVIFGLALGYKSVIIPIFAIAFSXFLSFSLAAMYGVAVAALGMLSTIATGLAIDAYGPISDNAGGXAEMXGMSHRIREXTDALDAAGNTTAAIGKGFAIGSAALVSLALFGAFVSRAGITTVDVLTPNVFIGLLVGAMLPYWFSAMTMKSVGSAALKMVEEVRRQFNTIPGLMEGTAKPDYATCVKISTDASIKEMIPPGALVMLTPLIVGTFFGVETLSGVLAGALVSGVQIAISASNTGGAWDNAKKYIEAGASEHAKSLGPKGSDCHKAAVIGDTIGDPLKDTSGPSLNILIKLMAVESLVFAPFFATYGGILFKYL

SEQ ID NO: 4377 - protein, 148 aa, Triticum aestivum
  unsure (1)..(148): unsure at all Xaa locations
MASPTQGQVITCKAAVAYEPNKPLVIEDVQVAPPQAGEVRVKILFTALCHTDHYTWSGKDPEGLFPCILGHEAAGIVESVGEGVTDVQPGDHVIPCYQAECKECKFAKSGKXNLCGKARSXTGVGVMMNDMKAGPVMESHFHSGGQQH

SEQ ID NO: 4378 - protein, 175 aa, Triticum aestivum
  unsure (1)..(175): unsure at all Xaa locations
SADTPFRRVHTRNGMSEYDPRLLXPTXLYLPSKADHCTAQAGLLVFYLYKMCRXNDPDRSAVIDILELHMKILEALDYXYLAVYHPYRPLLQILHVAHITDLTQVAWDLVNETSEMDLLLIYPPYMAELRCVXLGAFLKIKGPILXSEELRVDMSIVTTILMEILEFDDTCEIDS

SEQ ID NO: 4379 - protein, 204 aa, Triticum aestivum
  unsure (1)..(204): unsure at all Xaa locations
MGRGPVQLRRIENKINRQVTFSKRRSGLLKKAHEISVLCDAEVALIVFSTKGKLYEYSSQDSSMDVILERYQRYSFEERAVLDPSIGNQANWGDEYGSLKIKLDALQKSQRQLLGEQLDPLTTKELQQLEQQLDSSLKHIRSRKNQLLFESISELQKKEKSLKDQNGVLQKHLVETEKEXXNVXSNIHHRSVAASNNLYQSPLS

SEQ ID NO: 4380 - protein, 207 aa, Triticum aestivum
METEVGSPATATAAPINFSLPVDSEHKAKSIKIFSFGNPHMRAFHLGWMSFFTCVVSTFAAAPLIPIIRDNLNLTKADIGNAGVASVSGAIFSRLAMGAICDLLGPRYGCAFLVMLSAPAVFCMSVIDGPGGYITIRFLIGVSLATFVSCQYWISTMFNSKIIGTVGGLTAGWGDMGGGATQLIMPLVFDGILACGATRFTAWRIAY

SEQ ID NO: 4381 - protein, 129 aa, Triticum aestivum
SSGRPGRYLYDTEQPTGRCGVIITGHDRSMCTDLAAANCYKIEHLKENWSVVEKAKAYYVGGYHLTVCVPAAPALGKEAAEKNKPYIFSLSAPFIPQFFKDQLDQVAPYWDYVVGNETEAAAYLGRDHA

SEQ ID NO: 4382 - protein, 277 aa, Triticum aestivum
  unsure (1)..(277): unsure at all Xaa locations
MLPQPGPRTALVLGQHPGSTSWSTRRPRRRRGPEARRQRPAYCRSASFGSLVADQWRESLPFRAAASDAMAASGAPRRRXSSCGWLPRWPPLPPATRPPSCLPPVLCPTRATARPXLRFPRAGGAAPPTAARGKDFRRVRQRXPSGTFGAEIRDAAKNRARVWLGTFASAEDAAVAYDRAAYRMRGSRALLNFPLRIGSEIAAAAGQKRPSPQPASPVSPPPSSSAPGSSKRRKRGEAAAESMSMALVPPPPVQAPVQLTLPVQPWLATGAVQQLVS

SEQ ID NO: 4383 - protein, 270 aa, Triticum aestivum
KRGSAGGGAGAGDGGMVAPFVAKTYAMVDDPATDAVVGWGPASNSFVVADPFAFSHALLPAHFKHANFSSFVRQLNTYGFRKVDPDRWEFAHASFLRGQTHLLPRIVRRRSGGKGGKEDADEEEEDDISNKDMTMVATEVVRLKKEQSTIDDRVAAMWRRVQEAERKPKQMLAFLLTVVGDRDALRRLVGNSGNAAGGDQEPVEGGEKRARLLLDGDFGQVSAFGPDAVDFTGFYTDDGFGDGPVPVDAAAGSGGGGTRCTYAFGMDGGY

SEQ ID NO: 4384 - protein, 147 aa, Triticum aestivum
  unsure (1)..(147): unsure at all Xaa locations
KQVKWYYVVIAYVVAPMLGFANSYGTGLTDINMGYNYGKIALFVFAGWAGKDNGVIAGLVAGTLVKQLVLISADLMQDFKTGXLTQTSPKXMMIAQXFGTXMGCITPPHFMLFYKHLILGTIXTWGGPYXXYTAIXXLGXEGSNVTE

SEQ ID NO: 4385 - protein, 363 aa, Triticum aestivum
  unsure (1)..(363): unsure at all Xaa locations
VDGLYDLTKNEDLWRMVCRNAWGSETTRALETVPAAKRLGWGRLARELTTLEAVAWRKLTVGGAVEPSRCNFSACAVGNRVVLFGGEGVNMQPMNDTFVLDLNASNPEWXLVVFGGCGRQGLLNDVFMLDLDAKHPTWREIPGVAPPVPRSWHSSCTLDGNKLVVSGGCADSGVLLSDTFLLDVSMDKPVWREVPASWTPPSRLGHSMSVYDGRKILMFGGLAKSGPLRLRSSDVFTMDLSEEEPCWRCLTGSGMPGAGNPAGAGPPPRLDHVAVSLPGGRVLIFGGSVAGLHSASQLYLLDPTEEKPTWRILNVPGRPPRFAWGHSTCVVGGTKAIVLGGQTGEEWMLTEVHELSLASSNSV

SEQ ID NO: 4386 - protein, 151 aa, Triticum aestivum
MAEEAAKKVEVEVTKDKEPEAAPAEAVPEAAAKEDVAEEKAVIPATEPPAAEEKPPADDSKALAIVEKVADEPAPEKPAAEKQGGSNDRDLALARVETEKRNSLIKAWEENEKTKAENKAAKKVSAILSWENTKKANIEAQLKKIEEQLEK

SEQ ID NO: 4387 - protein, 133 aa, Triticum aestivum
VLSYADYIFGNETEAKIFAKVRGWETENIEEIALKISQLPLASGKQKRIAVITQGADPVVVAEDGKVKTFPVILLPKEKLVDTNGAGDAFVGGFLSQLAQGKSIEDSVRAGCYAANVIIQRPGCTYPEKPDFN

SEQ ID NO: 4388 - protein, 54 aa, Triticum aestivum
MSSHRVKWNEDNLYEIESNKPVRQKITEPKTPYHPMIDDDGSLSPTLLSDKCPG

SEQ ID NO: 4389 - protein, 130 aa, Triticum aestivum
SFPWIPALYTGVLSTVLCMWAELVAMGDVSATETAIVYGLEPVWGAAFAWFLLGERWDNTTCIGAALVLCGSLTVQLFGSAPKKYKKVKKRSSNALETPVKQQDYLSLSPIPVDSGKFIGRQLERRNKTL

SEQ ID NO: 4390 - protein, 384 aa, Triticum aestivum
PTRPPTRPDHTTRTNLSPFANRPQISLSPPCAAVVESSKKMAASNLEGVLLGMGNPLLDISAVVDEAFLAKYDVKPNNAILAEDKHLPMYDELSSKDNVEYIAGGATQNSIRVAQWMLQTPGATSYMGCIGKDKYGEEMKSAAKAAGVTAHYYEDEAAPTGTCAVCVVGGERSLIANLSAANCYKSEHLKRPENWALVEKAKYIYIAGFFLTVSPESIQLVAEHAAANNKVFLMNLSAPFICEFFRDAQEKVLPYSDYIFGNETEARIFSKVRGWETENVEEIALKISQLPLASGKQKRIAVITQGADPVVVAEDGKVKTFPVILLPKEKLVDTNGAGDAFVGGFLSQLVQGKSIEDCVKAGCYAANVIIQQSGCTYPEKPDFN

SEQ ID NO: 4391 - protein, 156 aa, Triticum aestivum
ELMAFYMNLRRSKNNETAMELFGDCSLTFDDDQPTLSCNLFDSMRVDISLTCSVCLDPMFDPVSLSCGHIFCYLCCCSAASVTIVDGLKSADHRSKCPLCRQAGVFPNAVHLDELNMLLSYSCPEYWEKRMQMERVERVRLAKEHWESQCRAFLGV

SEQ ID NO: 4392 - protein, 229 aa, Triticum aestivum
  unsure (1)..(229): unsure at all Xaa locations
SADAWADAWVWLSFAPVIIVLLVGTELQHVIAQLALEVVEATATNVGTQLKLRDDLFWFGKPRVLWWLIQFISFQNAFEMATFLWSLWELSANSCFMKNQYMVVIRLASGLLVQIWCSYSTLPLNVIISQMGSKFKKALVSESVRDSLHSWCKRIKDRRHNPLFMRNGTLTSRSVCSLDTTIYETDHETNTVCTLSRTVSASSLXEALTVVTVDVDEEISHIEQDIRHP

SEQ ID NO: 4393 - protein, 171 aa, Triticum aestivum
  unsure (1)..(171): unsure at all Xaa locations
ADERGESSAPAMAGVQREVYSKKGVMRRLMRWSRPRWAAAEQAECAVCLDEFRAGDVLAHLRCGHRXHWACALPWLEGXTCPFCRAAVDPAPPPPPTAPKNGRSSVLLGLAWLGTRRAPPVRQLRYPMCTLAIANGVCNGDRLHLPDREETHTLCLEFDLAKTLILLALAS

SEQ ID NO: 4394 - protein, 165 aa, Triticum aestivum
  unsure (1)..(165): unsure at all Xaa locations
MEGPSTNLIEFIDLSQKSFAIAAGSILFNPTFWNIVARKEYHDKVXLLNLSGGNARLXLVIILAVTIPCCGGCRDFLYERALRDQPTMPLLLTTPFQLXALVLVISGNILVISSMWALGITGTYLGDYFGILMDEMVTGFPFNVTDAPXYYXSTMSFPRTALILG

SEQ ID NO: 4395 - protein, 126 aa, Triticum aestivum
  unsure (1)..(126): unsure at all Xaa locations
EGDEVLHIELRKWADIMVIAPLSANTLAKIAGGLCXTTLLTCIVRAWDYSKPLFVAPAMNTLMWNNPFTERHLQTINQLGIILIPPVTKRLACGDHGNGAMVETSQIYTSVRLAWKTQPHDASSSL

SEQ ID NO: 4396 - protein, 177 aa, Triticum aestivum
  unsure (1)..(177): unsure at all Xaa locations
MLDDIGYFQRKYNIGSYELLSKSAAIQXAVSRMILGPFVVYYIDGRXVLSFSCSAGATLFVLLSCSLAVFCIMTQYLCIGRLWSTSLQVXLAHMRSVXVMILGWVLLVSALTIKNILGMVLAIMGMLVYSWAMECAKKNTSAITGTKTDMLDGEDLPLKSRTSGIPLSFDDLEEGPM

SEQ ID NO: 4397 - protein, 340 aa, Triticum aestivum
  unsure (1)..(340): unsure at all Xaa locations
MVVKSGGGGGAEEGAAGAAVRRWVEAGGGRLVLDGGLATELEAHGADLNDPLWSAKCILSSPHLIRKVHLALXKAGANIIITASYQATIQGFESKGFSKEXQGENLLTKGVEIAHEAREMFLKQHPDQSTALRPILVAASIGSYGAYLADGSEYSGDYGEAGTLEFLKDFHRRRLQVLAEARPDLIAFETIPNKLEAQAYVELLEECNINIPSWFSFNSKDGVNVVSGDSLIECAKIANECAKVGAVGINCTPPRFIHSLILSIRKVTDKPILIYPNSGERYDAEKKEWVESTGVSDGDFVSYVGEWCKDGAALIGGCCRTGPNTIRAIIRSLNQYYPAS

SEQ ID NO: 4398 - protein, 226 aa, Triticum aestivum
  unsure (1)..(226): unsure at all Xaa locations
MSVETERSSXESSGASGLDFEDTALTLTLRLPGSAPSAAAAAAASLSLSSSSSSAFPDPDRKRASSDADPGRSSPLAASSDAAPAPKARVVGWXPPVRSVPQERARRRRGSQQGRQFVKVAVDGAPXLRKVDLQAYAGYXQLLRALQDXFFSNLHQEFADDXRNWWDAVNGTXYVPRYEDKDGDWXLVGDSPGNFRGNWQRFRLMKQKPLIWTKTARLGTPLAWNH

SEQ ID NO: 4399 - protein, 388 aa, Triticum aestivum
  unsure (1)..(388): unsure at all Xaa locations
MAFFSHHHLQQPHPAAPPPQQQQQQPAPLSFRNALPVPVDGQIPAPLAFFNAPPAFPDQAGQPQIVDAAGLTAAAGMGWRQPREQELLGENSQMSSIDFLQTGSAVSTGLALSLEDRRHGGGGAGAGNSSGDSPLLLLPMLDDDISREVQRLDADMDRFIRAQSERMRQSILEKVQAKQFEALASVEDKILRKIRDKESEVQNINKRNLELEDQIKQMAGEVGAWQQRAKYNESMISALKYNLVPVCAHQXKKAKATARDTKRDDAASCCNGGAVNLQLMPKENNLPKDLTACRVCKSSEGCMLLLPCRHLCLCKECESKLSFCPLCQSSKVLCTERYIYDVEYNFMYCWSILSFGDPDVLGLQCIVNGGPPGPEDSPISGRVTAENF

SEQ ID NO: 4400 - protein, 111 aa, Triticum aestivum
  unsure (1)..(111): unsure at all Xaa locations
YGYTVSCAQCLCTCSLTYMLIGGVIFCKECAHGVAYVYISQGVRRAPPESKCPVYREIGVFVHIVHIRELVLFIXNRCKDFWRDRVCEERAEILKHYKEYWECQSILWMGV

SEQ ID NO: 4401 - protein, 441 aa, Triticum aestivum
  unsure (1)..(441): unsure at all Xaa locations
MDKLKGSARLMIVSXDLDHTMVDHHDEEEPCLCLGFGALWESVYCQDSLLVFSTGRSPTLYKELRKEKPMLTPDITILSVGSEITYGEAMVPDHGWEEYLNNKWDRNIVLEETAKFSELKLQVETEQRPHKVSFLVDKKNAQGVIKSLSEKFEKRGVDAKIIYSGGQDLDILAQGAGKGQALAYLLKKLGSCGKTPNNTLACGDSGNDAELFSIPGVHGVMVSNAQEELLQWHAENAKDNPKIIHATERCAAGIATERCAAGIIQAIGHFKLGPNVSPRDVEFPYIKEDPFKPTVAIVKFYVLYEKWRRADVPKADSVIKYFKNTTDANGVIIHPSGVELSIHSSIDELASCYGDKQGKKYRSWVDRLVILQTASDSWLVRFDLWEAEGGAWVCCFTTLALNVKPESLWGFVVTHIHKTWRKEFPGVEKSSKLETGTHILA

SEQ ID NO: 4402 - protein, 240 aa, Triticum aestivum
  unsure (1)..(240): unsure at all Xaa locations
MSAPAIKYKVADLSRAAFGPREIELAENEMPGLMATRAKYAGDQPLKGARIAGCLHMTIQTAVLIETLTSLGAEVTWXSSCNIFSTQDHAAAAIAAVGIPVFAWKGETEEEYQWCLEQQLLAFKDGNTLNLILDDGGDLTALVHKKYPEMLKGCFGXVSEETTTGXVHHLYKMLKNKTLLVPAVNVNDSVTKSKFDNLLGRRPSLVDXTIRATDGVXLGVVAVVAGFGDVGKGCAMAPPR

SEQ ID NO: 4403 - protein, 173 aa, Triticum aestivum
  unsure (1)..(173): unsure at all Xaa locations
LIWELRYRIAFGIARGLAYLHEECEDCIIHCDMKPDNVLLDAHFCPKIADFGMAKLLGRDFNRALTTMRGTIGYLAPEWISGLPITHKSDVYSYGMTLLEIISGRRNAEKIKEGRFTYFPIFAAVKVXERDVMCLLDNWLDGLYQCRAXELSXKIXCWCIQDDETGNDGQSSI

SEQ ID NO: 4404 - protein, 192 aa, Triticum aestivum
  unsure (1)..(192): unsure at all Xaa locations
PGWGVLPVPPGGTTSCSLLPRPASGFPCQSNCSRWLCGECIVRVWIQGVAVQXCKCSICRRVINLLVPASVSGDQNDDPQXQRVLGEIQHYNHIFGGAPRSLSQRLQDLPFFIRRLFRELMDPQRTLPLVFRARMILMVILSGVYVLSPVDILPESVLGLFGFFDDFLILVIVFLHLAAVYRSLLLYRHGGH

SEQ ID NO: 4405 - protein, 84 aa, Triticum aestivum
TRCLEEGADEFFLKPVRLSDMNKLKPHILKSRCNQEQHQQSDSHSGERRNPTIGSSSDSINNRKRKGAGTEEILPQLANSSRHS

SEQ ID NO: 4406 - protein, 114 aa, Triticum aestivum
  unsure (1)..(114): unsure at all Xaa locations
SGRVTGGRTGSLGSEREAHAAALQDELWSDRXLVFVPRMIRKVHLAYLDAGDNIICXACSQATLQGFQSRGVSREQGEALIRRTRQIAHEPRVIFVEERSKVLNTIKLELEGGK

SEQ ID NO: 4407 - protein, 118 aa, Triticum aestivum
ALPQHCLQLCAAFFAFAVLANLARDFPAGAGVVYTVPRPRPRAMAVPFLVGASFAIDMCVGSLVVFLWHWLDGKKAALLIPAVASGLICGDGIWIFPSSLLALAKIKPPMCMKFTPGS

SEQ ID NO: 4408 - protein, 119 aa, Triticum aestivum
  unsure (1)..(119): unsure at all Xaa locations
AHRRRPFLNRPPSPAALVAPGQRGVIAARGTPARAQRSLPKGLPGPRKFYKXXAILRPWRVXHVXSGLLQMGXXGVTVSDVRGYGGAXRGXRERYQGSEFSXDTFIAKVKMAKSQRSVC

SEQ ID NO: 4409 - protein, 124 aa, Triticum aestivum
  unsure (1)..(124): unsure at all Xaa locations
RGRTSRGHGTGSWQKKKNLMDNAPCYYCHRXFHYENSQVQHHNAKYFECHDCLKKLSTDCEMDMHDLSAHKEYDPTDANAKPEMYSADIDIIGMPAIPSDVITVHYAEEVDPSSEEVEGSWTST

SEQ ID NO: 4410 - protein, 97 aa, Triticum aestivum
MEGGEGSGGGGEPTKYRGVRRRPWGKFAAEIRDSSRHGVRMWLGTFDTAEEAAAAYDRSAYSMRGRRRCSTSPDRGALQRPMPRPPGFFFPGRVHVS

SEQ ID NO: 4411 - protein, 135 aa, Triticum aestivum
  unsure (1)..(135): unsure at all Xaa locations
RWEFANEEFLRGQRHLLKNIRRRKPPHSSPNQQSLGSYLEVGHFGYEEEIDQLKRDKQXLMAEVVKLRQEHQNTSSVLQAMEEKLQDTXSKKQQQMMAFXARVMQNPDSCVSCLPAGEMRKGLPGSISEXRKRRI

SEQ ID NO: 4412 - protein, 141 aa, Triticum aestivum
  unsure (1)..(141): unsure at all Xaa locations
MSTAEATREENVYMAKLAEQAERYEEMVXFMEKVAKTADVGELTVEERNLLSVAYKNVIGARRASWXRIISSIEXKEESRGNEAYVXSIXEYRTKDXXPELIXIRDXXXKAFWXPNXSPSAXXSKSPXGFLFLKXKGTQPF

SEQ ID NO: 4413 - protein, 345 aa, Triticum aestivum
  unsure (1)..(345): unsure at all Xaa locations
MGKKKKRVEKVFCYYCDREFDDEKILVQHQKAKHFKCHVCHKKLSTAGGMAIHVLQVHKESVTKVPNAKPERDSTEIEIFGMQGIPSDVLAAHYGEEEEPSKVAKVEVPTIRPPIMPNYPLGMPFPPRXMVQPRPMYNPAMMVRPPIWPLQQPQPWFAQQPPVSVPPMIXLGQAPQQPLFPIQNMPNPMMTSAPANLLQTSYPMATTGVPSPVAPQASQPLFPVNTTGNGAANSSFSSSISPATIAANSPASVGTAGYGYVANNHGTGGPAVGHPPAPATNSKTSATQPATSEVYLVWDDEAMSMEERRLALPMYQVHDETSQMSSVDAAFDRRISDITFSRQST

SEQ ID NO: 4414 - protein, 366 aa, Triticum aestivum
  unsure (1)..(366): unsure at all Xaa locations
TRIARRIEAEETGLDTAEMVVTSTKQEIEEQWGLYDGFDLMVERKLRVRQRRGVSSLGRYMPRMAVIPPGMDFSFVDTQDTADGDGADLQMLIDPVKANKALPPIWSEVLRFFTNPHKPMKEAGTRPGXRRRPGRLRRADXAAAALRELTRLTLILGTRDDIAEMAGGGAAVPTALLCRGSGRLRTRRRPTPPPHCPPAACTATPTPPPTKGVFINPALVEPFGLTIIEAAAYGLPVVATKNGGPVDILKALHTGLLVDPHCAEAITGALVSLLADKGQWLESLLPGLRNILSLPGMDSRGSEQLLRGEYGDATPARPGARPPPPPARLVEHGLCRLPLRLCREPIARTLRDLGRKMTAEFAYKVV

SEQ ID NO: 4415 - protein, 346 aa, Triticum aestivum
  unsure (1)..(346): unsure at all Xaa locations
KRFRTWPLPPSAAPHSASAKPQARVSASTRRARHGCRRPQEIPAGVRQRRPQTGNARETSGKRSRESESQQTGLSSKSKPCTKFFXTVGCPFGEGCHFAHFVPGGYQAVSKSHSLGHAAVSAASRAPADHAASGVKTRMCTKYNTAEGCKFGDKCHFAHGERELGRPTILLHVXESSYAPPMGGRYGGRHEPPLPASMGPPAGNFGASSTCKVSVDAALAGGIIGKGGVNTKQICRITGVKLSIRDHESNPDLKNIELEGSFDQIKQANDMVRDLIASISASTPSKNPASAAAPAGRGGGGGGGGPGGRSNYKTKICENFLKGTCTFGERCHFAHGETEQRKGAAV

SEQ ID NO: 4416 - protein, 107 aa, Triticum aestivum
  unsure (1)..(107): unsure at all Xaa locations
MTXPTELSREENVXMXKLXXQAERYXEMVEXMEXVGXTVXSEEITVXERNLLSVCXKKVIXARRALKGQQSPPFAKRRRSPWPRTRSLNKGVPWRRLKLKICDGNPN

SEQ ID NO: 4417 - protein, 158 aa, Triticum aestivum
  unsure (1)..(158): unsure at all Xaa locations
ETEPSGPLAVLKGFKNLPTGMPSVLLVTGLTWLSWFPFILYDTDWMGREIYHGDPKGSNAQISAFRRKASRVGSVPGCCSTRFVLGFSPFLDRAMCRKXXPKVVWXTNNFMXCVAMAATXADXFWPSKDYNGYVXDPSPPDIKASARLFASWVSSRIL

SEQ ID NO: 4418 - protein, 337 aa, Triticum aestivum
MEPAEKKPPAVSDLGAWGMNVVSSVGLIMANKQLMSSAGYAFSFATTLTGFHFTVTALVGWISKATGYSASKHVPLWELVWFSLVANASITGMNLSLMLNSVGFYQISKLSMIPVVCLMEWVLNSKHYTTKVISAVVVVAAGVGICTVTDVEVNAKGFICACVAVFCTSLQQITIGSFQKKYNIGSFELLSKTAPIQAVSLIILGPFVDYYLNGRWLLNYSFSTGATFFILLSCSLAVFCNMSQYLCIGRFSATSFQVLGHMKTVCVLILGWVLFDSALTIKNILGMLLAIMGMVVYSWAMESEKKATSAIPRNKSDMLDGAGRAPQVENERHSAVL

SEQ ID NO: 4419 - protein, 184 aa, Triticum aestivum
TRPHSLLRVTTDDILKVTKNFSKEHIIGDGGFGTVYKAALPEGRRVAIKRLHDGHQFQGDREFLAEMETIGKVKHPNLVPLLGYCVCGDERFLIYEYMENGSLETWLRNRADAVEALGWPDRLKICLGSAHGLAFLHEGFVPHIIHRDMKSSNILLDVNFEPRVSDFGLARIISACETHVSTDI

SEQ ID NO: 4420 - protein, 157 aa, Triticum aestivum
  unsure (1)..(157): unsure at all Xaa locations
ANPSQVASHEHELRLHGSWRDGAVQAVQLELRGPINDVKCMRYLLTXRFGFPNDCVLILTDEERNPCXXPTKDNIRMAMHWLVXGVQXXDSLVFKFSGLGAXVPDDNGDXLDGMDEGLCPVXSFNKGPILXDEXTKAIXRPXXXRGLKLKXXLRRPW

SEQ ID NO: 4421 - protein, 128 aa, Triticum aestivum
  unsure (1)..(128): unsure at all Xaa locations
VKCMRYLLTERFGFPNDCVLILTDEERNPCRQPTKDNIRMAMHWLVQGCSYGDSLXYSKFSGLGAQVPDDDGDELDGMDEALCPXDSFQQGPILDDEINEAIVRPLVHGVKLHAIVDACHNAXVLELP

SEQ ID NO: 4422 - protein, 364 aa, Triticum aestivum
  unsure (1)..(364): unsure at all Xaa locations
MNMNYGSMGPGAMVRCRQCSSSITAMPGARAVQCMQCSCVTRVSGRGRQQHGYGQGYGGNGGGMLMPPMRPTPAFGGGRGKKRAVLIGIKYTNRRSCELRGPINDVKCMRYLLTERFGFPNDCVLILTDEERNPCRQPTKDNIRMAMHWLVQGCSYGDSLVFQFSGLGAQVPDDDGDELDGMDEALCPVDSFQQGPILDDEINEAIVRPLVHGVKLHAIVDACHSATVLDLPYQCTVSKQTGRWRWRDERPMTGACKGTSGGQAVLISGSSNGKSNMSVLPEPYATIGAMTHSFIRAVEXSPRTTYGRLLTSMRAIMRDSSGNCNLQGPIGGSIRKVANFKRRGGASSCPLPTSFDVEREPFCM

SEQ ID NO: 4423 - protein, 176 aa, Triticum aestivum
MASHGSHPTLLEHMGRTGAPADLAVLVAHIQAACKRIAALVASPGNADLSRAKPAAAGAASAAGRDAPKPLDELSNEIILSSLQSSGKVAVVASEENDLPVWLCDDGPYVVVTDPLDGSRNIEVSIPTGTIFGIYDRLVELDQLPVEEKAQLNSLQSGSRLVAAGYVLYSSATIFC

SEQ ID NO: 4424 - protein, 183 aa, Triticum aestivum
  unsure (1)..(183): unsure at all Xaa locations
MSDEAASPPGGGGGGGGGGSDDGGGGGGFGGVREQDRFLPIANISRIMKKAIPANGKIAKDAKETVQECVSEFISFITSEASDKCQREKRKXTINGDDLLWAMATLGFEEYIEPLKVYLQKYRETEGDSKLAGKSGDVSVKKDALGPHGGASGTSAQGMGQQVAYNPGMVYMQPQYHNGDMSN

SEQ ID NO: 4425 - protein, 171 aa, Triticum aestivum
  unsure (1)..(171): unsure at all Xaa locations
DISVVSLPRIAPMDRTCLLGCGITTGYGAAIETAKIEQGSTVGIFGAGCVGLSVVQGAVXSXASRIIVIDINPDKKGWAEKFGATDFLNPTELKNXXIVEKLIEMTDGGCXYTFDCTGNVGVMRAALEACHXGWGXSIIIGVAAAGQXISTPPFQLVTERVWXGCAFGGNX

SEQ ID NO: 4426 - protein, 117 aa, Triticum aestivum
MSGVWVFRNGVVKLVENHPASAAGPPGGGAVRRKALLHTPTGEVVASYASLERKLVALGWERYYAGGGGAAGDCMLRFHKRSSVDLISLPKDFGQFSSVHMYDVVIKNRDAFRVIDV

SEQ ID NO: 4427 - protein, 230 aa, Triticum aestivum
  unsure (1)..(230): unsure at all Xaa locations
MGRGKIEIKRIENATNRQVTYSKRRSGIMKKARELTVLCDAQVXAIIMFSSTGKYHEFCSTGTDIKGIFDRYQQAIGTSLWIEQYENMQRTLSHLKDINRNLRTEIRQRMGEDLDALEFEELRDLEQNVDAALKEVRQRKYHVITTQTETYKKKVKHSQEAYKNLQQELGMREDPAYGFVDNPVAGGWDGVAAVAMGGGLAADMYAFRVVPSQPNLHGMAYGGSHDLRLG

SEQ ID NO: 4428 - protein, 450 aa, Triticum aestivum
  unsure (1)..(450): unsure at all Xaa locations
IWLPISGRPVSAVPVPIFTFRFRFQSGSFLPSPSPYSLLLPPPPTPLTDGTRPSSCLPLPPPPPRRRLPPPGTGSATNCGRGKEKGRVFPGHLSAGPQPTREPDWDGVGGRRRAGRSMRAVLAILQWWGFNVTVIXIINKWIFXQKLDFKFPLTVSCVHFICSSIGAYVAIHVLKAKPLIQVEPEDRWKRIFPMSFVFCMNIVLGNVSLRYIPVSFMQTIKSFTPATTVILQWLVWSKHFEWRIWASLVPIVGGILLTSMTELSFNIFGFCAAMIGCLATSTKTILAESLLHGYKFDSINTVYYMAPFATMILALPAMLLEGXGVIDWFYTHDYVFSSLIIILGSGVLAFCLNFSIFYVIPSTTAVTFNVAGNLKVAVAVLVSWLIFRNPISPMNAIGCAITLVGCTFYGYVRHLISQQQAAAPLGSQGTNSPRSRVEMLPLVGDKEDKV

SEQ ID NO: 4429 - protein, 209 aa, Triticum aestivum
MGRGKIEIKRIENQSNRQVTFSKRKNGILKKAKEISVLCDAEVGVVVFSSAGKLYDFCSPKTSLSRILEKYQTNSGKILWDEKHKSLSAEIDRIKKENDNMQIELRHLKGEDLNSLQPKELIMIEEALDNGLTSLHEKQMEHYDRLVKHGKMLEDENKLLAFKVHQHDIALSGSMRDLELGYHPDRDFAAQMPITFRVQPSHPNLQEDS

SEQ ID NO: 4430 - protein, 546 aa, Triticum aestivum
  unsure (1)..(546): unsure at all Xaa locations
AGARAGERHARPSGLPRRGGNGGVQVSXVGVGGGGGGAPGRAGSTPXVDITPRHGTSLAAMVSRRACSTEWALQPLPVLNPYVPLLWGLSHALTSFMWXLCGPIAGLVVQPGVGLYCDSXTSRWGRRKPXFLTGCILICIADAVVGFXSDDIEAEQGESKEDCRFYXGHGATVENSIFCSWMALGNILGYSSGSTNNWHKWFPFLRTRACREACANLKGAFLVAVLFLAFCLVRTVFFPIVRTRACCEACANLKGAFLVAVLFLAFCLVITVIFAKEIPYKAIAPLPTKANGQVEVEPTGPLAVFKGFKNLPPGMPSVLLVTGLTWLSWFPFILYDTDWMGREIYHGDPKGTPDEANAFQAGVRAGAFGLLLNSVVLGFSSFLIEPLCKRLGPRVVWVSSNFLVCLSMAAICIISWWATQDLHGYIQHAITASKEIKXIVSLALFAFLGIPLAILYSVPFAVTAXQLAAKRGGGQGLCTGVLNIAIVIPQVFIAVGAGPWNELFGKGNIPAFGMASAFALIGGIVGIFLLPKISRRQFRAVGGGGH

SEQ ID NO: 4431 - protein, 568 aa, Triticum aestivum
  unsure (1)..(568): unsure at all Xaa locations
MLTCPRGTAAAGRVTGSPSPEGAKLPHPRVQFLGAPRGAPFFRGLVLCFGSGGEVRGFKNFPTLGLEAYKNRFYFDFSPTYIGVGMICPHIVNVSVMLGGIISWGIMWPLMGKKKGSWYPASLPESSLHGLQAYRVFISIALILGDGLYNFVKVLIRTIAGFISMVHKNSKAMLPVSDNGSPTAEAMSFDDERRTELFLKDQIPMAVAYGGYAVVASISIGTLPQIFPQLKWYYILVAYVVAPVLAFCNAYGSGLTDWSLASTYGKLAIFVFGAWAGLANGGVLVGLAACGVMMSIVSTASDLMQDFKTGYLTLASPKSMFISQVIGTSMGCVISPCVFWLFYKAFSDIGISGSEYPAPYAIVYRNMAILGVDGFNTLPKNCLTLCYIFFAAAIAINLIRDLTPHKFSRFIPLPMAMAIPFYIGSYFAIDMFLGSFILFVWEKVNKAKADAFGPAVASGLIXVGNGIWTLPQSILALAKVNPPFCMKFLTRRRQWSKWTKFLGLSHGPFYGRTRGQRQATATHQHPACNYSHFPGHLFCRKARTWVHARENYPYESSFRNDCSCSFTM

SEQ ID NO: 4432 - protein, 366 aa, Triticum aestivum
MLGAARRSGCVLGQLMQTLRPAASAATAARSYSATPKEMTVREALNSALDEEMSADPSVFLMGEEVGEYQGAYKITKGLLDKYGPDRVLDTPITEAGFTGIGVGAAYQGLRPVVEFMTFNFSMQAIDHIINSAAKSNYMSAGQISVPIVFRGPNGAAAGVGAQHSQCYAAWYAHVPGLKVLTPYSAEDARGLLKAAIRDPDPVVFLENELLYGESFPIKAEVLDSSFSVPIGKAKIEREGKDVTITAFSKMVGYALQAAEILSKEGISAEVINLRSIRPLDRAAINASVRKTNRLVTVEEGFPQHGVGAEICMSVVEDSFEYLDAPVERIAGADVPMPYAANLERLAVPQVEDIVRAAKRACYRSS

SEQ ID NO: 4433 - protein, 374 aa, Triticum aestivum
MLGVARRRLGSGCALGQLMQALRPAAAAAAARTYSAAAKEMTVREALNSALDEEMSADPSVFLMGEEVGEYQGAYKISKGLLDKYGPDRVLDTPITEAGFTGIGVGAAYQGLRPVVEFMTFNFSMQAIDHIINSAAKSNYMSAGQINVPIVFRGPNGAAAGVGAQHSQCYAAWYAHVPGLKVLTPYSAEDARGLLKAAIRDPDPVVFLENELLYGESFPIKAEVLDSSFSVPIGKAKIEREGKDVTITAFSKMVGYALQAAEILSKEGISAEVINLRSIRPLDRAAINASVRKTNRLVTVEEGFPQHGVGAEICMSVVEESFEYLDAPIERIAGADVPMPYAANLERLAVPQIEDIVRAARRACYRALPMAATA

SEQ ID NO: 4434 - protein, 355 aa, Triticum aestivum
  unsure (1)..(355): unsure at all Xaa locations
MAGGGGAGGLSESVMRKVLLSYCYVAVWIFLSFAVIVYNKYILDPKMYNWPFPISLTMVHMSFCSSLAVGLVRVLRVVEPPSSPPMTPQLYTSSVVPIGALYAMSLWFSNSAYIYLSVSFIQMLKALMPVAVYSIGVLFKKETFRSSSMLNMLSISFGVAIAAYGEARFDLRGVALQLAAVAFEATRXLVLIQILLTSKGISLNPITSLYYVAPCCLCFLLVPWIFVELPRLRAVGTFQPDFFIFGTNSLCAFALNLAVFLLVGKTSALTMNVAGVVKDWLLIAFSWSVIRDTVTPINLFGYGIAFLGVGYYNHIKLQALKAKEAQKKSAQADEEAGSLLQERDSHSDRKSENQA

SEQ ID NO: 4435 - protein, 192 aa, Triticum aestivum
  unsure (1)..(192): unsure at all Xaa locations
GEAQDSTLRGVALQLAAVAFEATRLVLIQILLTSKGISLNPITSLYYVAPCCLCFLLVPWIFVELPRLRAVGTFQPDFFIFGTNSLCAFALNLAVFLLVGKTSALTMNVAGVVKDWLLIAFSWSVIRDTVTPINLFGYGIAFLGVGYYNHIKLQALKAKEAQKKSAQADEEAGXSLLQERDSHSDRKSENQA

SEQ ID NO: 4436 - protein, 275 aa, Triticum aestivum
  unsure (1)..(275): unsure at all Xaa locations
MAPATADAAGVGAGPAVGRVKTALGVAACERDAEKLELIEQLTKGFDDEQQRVLAAILARNNGAEYLRRHGMEGCTDRDAFKARVPVVTYEDLRPEIERIANGDRSNIISSHPISEFLTSSGTSAGERKLMPTIEDELDRRQMLYSLLMPVMNLFVPGLDKGKGLYFLFIKSEIKSPGGLGALPVLTVYYRYDKSKYRTYRPFDAYQVYTSPTPAILCTDSFQSMYSQMLCGLLVRTEVLRVGAVFASGLLRAIRFLQLHXXELARDIETGTLSA

SEQ ID NO: 4437 - protein, 251 aa, Triticum aestivum
ITLVFFANLSIVGMNVSLMWNSVGFYQIAKLSIIPLLCIMEVLFENFRYSRDTKLSIVVVLVGVGVCTVSDVSVNAQGLVAAVIAVCGTALQQHYVNYLQRKYSLNSLKLLGHTAPAQAASLLILGPFVDFWLTRNRIDTFHYTSTVTFFIVLSCVISVGTNLSQFICIGRFTAVTFQVIGHMKTILVLTLGFLLFGKEGLNFHVAFGMILAIVGMIWYSSASSKPGGKERQGLASEKAQKSPQSELDDKV

SEQ ID NO: 4438 - protein, 288 aa, Triticum aestivum
  unsure (1)..(288): unsure at all Xaa locations
KNTPFSPLSAGDLERGARVFYCRVDGGLKTVVNARKFVPGARLCMQPDVKPNKRKTRSSRKERCRNQAPLLPGLPDDLAISCLMRVSRAEHPNLRLVCKKWSRLLSGNYYYSLRKKFGXAEECVYVFKRDRDQKLSWHAFDPAHQLWRSLPPVPPEYPEAVGFGCAVLSGCYLYLFGGKNPVRGSMRHVVYYNTRTNKWYRAPDMLRKRHLFGSCVINNCLYVAGGECEGTQRTLRSAEVYNPNRTRWSCITEMNTGMVPFTGAASDGDRFPKGEGTRRQGGSEVKLT

SEQ ID NO: 4439 - protein, 261 aa, Triticum aestivum
  unsure (1)..(261): unsure at all Xaa locations
MSTAEATREENVYMAKLAEQAERYEEMVEFMDKVAKTADVGELTVEERNLLSVAYKNVIGARRASWRIISSIEQKEESRGNEAYVASIKEYRTRIETELSKICDGILKLLDSHLVPSATAAESKVFYLKMKGDXHRYLAEFKAGAERKEAAENTLVAYKSAQDIALADLPTTHPIRLGLALNFSVFYYEILNSPDRACNLAKQAFDEAIAELDSLGEESYKDSTLIMQLLRDNLTLWTSDNAEEGGDEIKEAASKPEGEGH

SEQ ID NO: 4440 - protein, 125 aa, Triticum aestivum
  unsure (1)..(125): unsure at all Xaa locations
MSTAEATREENVYMAKLAEQAERYEEMVEFMEKVAKTADVGELTVEERNLXLSVAYKNVIWCPEGSWRIISSIEQKEEXLGNEPICFNQGYSRFKPTQQICGWTSTLDPTFPSALNKSKFLSEMK

SEQ ID NO: 4441 - protein, 400 aa, Triticum aestivum
MSMLACALQTMGSSCSRPHSVNEAEAADNTRSADIDRRILQETKADQHVHKLLLLGAGESGKSTIFKQIKLLFRTGFDEAELKGYMPVIHANVFQTIKVCQYWERILYDGAKELAQLETESLKHVISPDNQEIGEKLSEIGGRLDYPLLNKELVQDVRKLWEDPAIQETYSCGSVLQVPDCAHYFMENLDRLAEPDYIPTKEDVLHARVRTNGVVEIQFSPLGESKRGGEVYRLYDVGGQRNERRKWIHLFEGVDAVIFCAAISEYDQLLFEDETQNRMMETKELFDLVLKQRCFEKTSFMLFLNKFDIFERKIQKVPLTVCEWFKDYEPIAPGKVQDVEHAYEFVKKKFEEVYFQSSKPERVDRVFKIYRTTALDQKLVKKTFKLIDESMRRSREGTGT

SEQ ID NO: 4442 - protein, 252 aa, Triticum aestivum; identical to SEQ ID NO: 4145

SEQ ID NO: 4443 - protein, 234 aa, Triticum aestivum
  unsure (1)..(234): unsure at all Xaa locations
TSPSTPPLPTPTRLRSSPPTHRASPPTRPAAPPPTPDAARHCTCERASESPAHPAQPTRGERGHMGEIGEHAERYEEIAGCAARVAKGAAGAGHGVDLAVQERHPVSEAYMNGIRPRRASWXILSTIEQKDEGRTNTPQAAALRAYSCKINAELAETCNGPCALPASYXVPICRSCRVQTFYLKGLGRVPYSTLHRCEVTMKADESTTPGYHRWIGIQPLLQGLRPTQIWSRIP

SEQ ID NO: 4444 - protein, 353 aa, Triticum aestivum
EQGIQVIAPCATKVMPGELGFVAQLNEGRLLKKRPTEFRVDRALQPFDSAKFNFTKVGQEAVLFRFEKGGGDSSYFLENAPSTEGDHAPSVVAINVSPIEYGHVLLIPRVLDRLPQQIDPESFLLALHMAAEAASPYFRLGYNSLGAFATINHLHFQAYYLSVPFPVEKAPTKKIPLAKCALNSGVKVSKLTNFPVRGLVFERGNTLKDLADVVTNACIWLQENNVPFNVLISDSGRRIFVFPQCYAEKQALGEVSQDLLDTQVNPAVWEISGHIVLKRRTDFEEASEASAWRLLAEVSLSEERFEEVKACIFEATGLTESDEEEESSESPYASSSSVPQASSHMSEGCLVLQ

SEQ ID NO: 4445 - protein, 239 aa, Triticum aestivum
ESACIGGLGRCLAVASELGACKVLVKYARSSEEADGVSEEFEAAGGQAITFGGDVSKEADVESMMKAALDKWGTIDILVNNAGITRDTLLMRMKKSQWQDVIDLNLTGVFLCTQAATKVMMKKKKGRVINIASVVGLTGNAGQANYSAAKAGVIGFTKTVAREYASRNINVNAIAPGFIASDMTAELGEEVEKRILSTIPLGRYGQPEEVAGLVEFLALNPAASYITGQVLTIDGGMVM

SEQ ID NO: 4446 - protein, 132 aa, Triticum aestivum
  unsure (1)..(132): unsure at all Xaa locations
DDALTARNNGAQGIGLCRTEHMFFASDERIKAVRQMIMAPTLELRQQALDRLLPYQRSDFEGIFRAMDGLPVTIRLLDPPLHEFLPEGNIEDIVSEYCLRRDQQEXMPSRELKAFRINPMLGFRGCSLGNRT

SEQ ID NO: 4447 - protein, 220 aa, Triticum aestivum
  unsure (1)..(220): unsure at all Xaa locations
RRQAVVAAGAVSGRRGRKNGTLGCVYLIGHCLSWSGWLVLQAPVLKKYPARLSVTSYTCFFGVIQFLIIAAFXERDAGRMXVFHSGFRKFFXNPFTPGFIASGVAFXAVQIWCIDRGGPVFVAVYQPVQTLVVAIMASLTLGEKFYLGGIIGAALIITGLYLVLWGKSEERSRIGKEAAVMAAPSAGSSGGAGRELRSAELASSITQPLLPPSSTTSDNV

SEQ ID NO: 4448 - protein, 205 aa, Triticum aestivum
  unsure (1)..(205): unsure at all Xaa locations
MPESDNDSGGPSNTGGEGELSSPREQDRFLPIANVSRIMKKALPANAKISKDAKETVQECVSEFISFITGEASDKCQREKRKTXNGDHASXLLWAMTTLGFEDYVDPLKHYLHKFREIEGERAAATSTSTSTTPDMPRNNNNNATGYADAPGGMMMMGQPMYGSPPPPQQQQQHQHQIAMGGRAGFPYLGGGGGSSSSSGFGRKE

SEQ ID NO: 4449 - protein, 182 aa, Triticum aestivum
LIGHGLLESQNLYHHRGSGIVHDLIENIHKSQTGIFSDTHTCTDMMKKSLSIIFSHTLTLARVRFFSSGFVAHTISFPQTHRFRGMLQNGIDLSAVDVRYVSTRSWCFFNIYGLRGLFSVILGEENIIDDTQKMMSMGGGMGFNPPMRLRAEKDTLDIIQHVWAFSKMESHIEDVLRKILKN

SEQ ID NO: 4450 - protein, 157 aa, Triticum aestivum
MRTICDVCESAPAVLFCAADEAALCRSCDEKVHMCNKLASRHVRVGLADPNKLARCDICENSPAFFYCEIDGTSLCLSCDMTVHVGGKRTHGRYLLLRQRVEFPGDKPGHMDDVPMENVPMETKDPENQRDQKKAPKEQMANHHNGDHPACDGNCDD

SEQ ID NO: 4451 - protein, 107 aa, Triticum aestivum
  unsure (1)..(107): unsure at all Xaa locations
NRRWGDNGYIRGGRKEARPVNTDVAAGPSRTPKKKEKAASSSASVSVSGPGSGSGSVSKXVAGGXAKRAQKREAADKAAAENTLNTCKRFGAAEIPQTCICRRKFHR

SEQ ID NO: 4452 - protein, 173 aa, Triticum aestivum
  unsure (1)..(173): unsure at all Xaa locations
MAHELVLDTAIRDXSYIPFCEVMVLICQLYFLDFKXMRSHPSGFPSHDRKNVKEXRTASRHRNLRNGAHLIAANAFKDRKLFTPTGIPDLLHVPKEDAHKAHAAMXSDPNMRVDMMXKNLSMMGSQTLTFAWXVNLFFASSAAVNTHFPVTXRLKRMLQQGIDLISEAVSYVS

SEQ ID NO: 4453 - protein, 235 aa, Triticum aestivum
RYKNKRLPLDLRPKKTRAIRRRPTKHQLSLKTEREKKREKYEEMVEFMEKVTKTVDSEELTVEERNLLSVAYKNVIGARRASWRIISSIEQKEESRGNEDRVTLIKDYRGKIEVELTKICDGILKLLDSHLVPSSTAPESKVFYLKMKGDYYRYLAEFKSGTEILNSPDRACDLAKQAFDEAISELDSLSEESYKDSTLIMQLLRDNLTLWTSDISEDAAEEMKDAPKGESGDGQ

SEQ ID NO: 4454 - protein, 262 aa, Triticum aestivum
MAQPAELSREENVYMAKLAEQAERYEEMVEFMEKVAKTVDSEELTVEERNLLSVAYKNVIGARRASWRIISSIEQKEESRGNEDRVTLIKDYRGKIEVELTKICDGILKLLDSHLVPSSTAPESKVFYLKMKGDYYRYLAEFKSGTERKDAAENTMVAYKAAQEIALAELPPTHPIRLGLALNFSVFYYEILNSPDRACDLAKQAFDEAISELDSLSEESYKDSTLIMQLLRDNLTLWTSDISEDAAEEMKDAPKGESGDGQ

SEQ ID NO: 4455 - protein, 258 aa, Triticum aestivum
  unsure (1)..(258): unsure at all Xaa locations
MAANFWASSHSKQLLDPEDVDLVPAADRERGITTEEFRLVKIHMSSHIWRLAQQVKVRQRVIATAITYFRRVYTRKSMSEYDPRLVAPACLYLASKVEESTVQARLLVFYIKKMCGSDDKYRFEIKDILEMEMKLLEALDYYXLVVYHPYRPLLHLLQDAGVTDLTQFAWGLVNDTYKMDLILVQPPYMIALACIYIASVLKDKDTTSWFEELHVDMNIVKNISMEMLDFYETYKVDPQRGLSDEKISPIMNKLPAKA

SEQ ID NO: 4456 - protein, 142 aa, Triticum aestivum
  unsure (1)..(142): unsure at all Xaa locations
HAFMEGAYDRLLSARLTAPHDTYIYFLDLLVETXRDQIAGCSPKGYDYLSINDSPSMPKVSSDQELPQYLAQDHPEWDVTDGRVLFQKANESQSCXEIPAAPGINHTLGYSRELKRIEGFACLFFLHLWTEFPMKRCIIVLP

SEQ ID NO: 4457 - protein, 140 aa, Triticum aestivum
  unsure (1)..(140): unsure at all Xaa locations
AKLDRAVLAMKLVMCLCIFIVLVITASPIAVSGDRPLMLGRRCLQDAVVIGGSPTPTGASTTGTLPRDAEPDISVDRSKRLSPGGSNPQHHXSHHRDQXHACLSDGVICQHSLSTSQTRXLTTVNAVRRLILSFSLLXCS

SEQ ID NO: 4458 - protein, 315 aa, Triticum aestivum
  unsure (1)..(315): unsure at all Xaa locations
MAATKLSSGHEMPAVGLGVWRMDSAAVRGLIHSALRAGYRHFDCAADYKNEAEVGDALAEAFQTGLVKREDLFITTKLWNSDHGHVVEACKDSLKKLRLDYLDLYLIHFPVATKHTGVGTTGSALGDDGMLDIDTTISLARTXHATVSXLRQGLIRSMRIFKCDIFLTRDFSAYANLRPAALPIQTHPYFPRDSIVKVXLHHGKLRHEDSPAVCWRRPPNRTTVGSGSVLKAVDDPVMKSLAEKYGKTPAQLVLRWGLQRNTVVIPKTSKVERLEENFAVSDFDISGEDMEKIKALDRRYRTNQPAKFWGIDLYA

SEQ ID NO: 4459 - protein, 250 aa, Triticum aestivum
  unsure (1)..(250): unsure at all Xaa locations
MDPSGAFARSSGNVSRASLMRSGSGVSGKGPAGGAGPAGAGGGWAGIRRGVIRFIFAIAALFLASPGPSRVTGTGGREGPPPAAAASGAITGALVHXALVDSAVRLWRSRRSRSRPXGICSMRYVLNVSYSLPAGRLVREXVGPAVQRVVRSQMNAVDSSQFREAPDLFEIEGTNGMPRASIEKLPEGTITEEYNRNAVGDLSGCSVCLQDFQIGEKVRSLPDCLHVFHVPCIDGWLIKHGSCPLCRRKL

SEQ ID NO: 4460 - protein, 374 aa, Triticum aestivum
  unsure (1)..(374): unsure at all Xaa locations
MTPPPLSSAITLVLTVFLYAGIVVLLWLLFCWRLPVGRGGMPAVLLAFXVRAMPGSPRWLVTKGQXADAQVVLXRTSDAPEVAAERLADIKXAAGIPLDLDGDVVTVPRNKGSSEEKRVWKDLILSPTKAMRHILIAGIGIHFFQQSSGIDAVVLYSPRVFKSAGITGDNRLLGTTVAVGATKTVFILVATFLLDRIGRRPLLLSSTGGMIVSLVGLATGLTVVDRHPDEKIPWAVVLCVASVLGYVAFFSIGLGPISGVYSTEIFPLRVRALGCALGVGRQTAWSSGAISMTFLSLSSAITLRGAPSPSAAGTRLAWVXFFTCLPETRGRTLEEMGSLFGVTDTGAEAEDAAPATQDASCWARLGASPGPRVD

SEQ ID NO: 4461 - protein, 303 aa, Triticum aestivum
  unsure (1)..(303): unsure at all Xaa locations
AKLLLENXRTKELMILGDSLSXDKWAAVLCTDQSVPPWXRKSLSKNGSLNVFRLHEYNATIEFYWAPFLVESNSDDPYIKPGTDRMITPTSIAKHAANWIGVDYLIFNTYIWWMNTPKMKIVPDGSFTRKPVKYDELDRVVAYRQILETWSGWVEENVDPKRTMVLFMSVSPVHMQSEGWGSPDNIKCFSETQPVLNYTKTLDVGTDWDLFTESHEVTKAMKKVPVHFINITALSEIRKDAHTSVHTLRQGKLLTKEQQANPRKFADCIHWCLPGLPDTWNEFIYGHIVSSPLQRQIENQSAR

SEQ ID NO: 4462 - protein, 359 aa, Triticum aestivum
  unsure (1)..(359): unsure at all Xaa locations
MLGGGVSFSFGDVLTICGLLAVQCIFGLYMMFLNRLLVAGVPSLFIIVVACAASSVVVLPFAIALERKKWPKRWSPVLIIQLVMISLGGVSIYQVLMMLGVERTSPAIASAMPNLGPGFIFVIAACLRFERFEWKCKYTRAKILGTLVCISGAMCVSFLKNPDPGRVPESVPRDQELSGMKIDRDWVLGCVYLLTGVTVFACNTVLQAATLKRFPAPLSICVITAMMGXIFSAIIQVIMDGKLGAGTAGHIPRIIAEIVLVGGVVIGLCTTFQVSSIGRKGPVLVSMFSPFQTAFSAFISFIFFGQWIGTGCLVGIALMFAGLYVVLWAKNREDKMFAELALPSDSDATESDIERPFLQ

SEQ ID NO: 4463 - protein, 146 aa, Triticum aestivum
  unsure (1)..(146): unsure at all Xaa locations
VRTADVXELTVDERNLLSVAYENVIGARRASLTIILCIELNEESRWIXAYVASIKEFRPRIETELIMICDGILKLLXDSHLDPSATATESKASYLEMKGDYHRYLAGVKSGAERKEAAVNTLXVAYKSAHDIXASLDLPTTHPIRV

SEQ ID NO: 4464 - protein, 144 aa, Triticum aestivum
  unsure (1)..(144): unsure at all Xaa locations
MPSQSTHTSSSLSSSTAPILPCSSAXALFRSVMAAVATETPFHVLAVDDSLPDRKLIERLLKTSSFQVTTVDSGSKALQFLGLHDQDSTVPPVHTHQLDVAANQDVAVNLIITDYCMPGMTGYDLLKKIKESSXLRDIPVVICL

SEQ ID NO: 4465 - protein, 457 aa, Triticum aestivum
  unsure (1)..(457): unsure at all Xaa locations
MRLIAEQAGGKGSGGRQRVLDVMPTEGHHHGAREDKAGERNSSIRSTKAMAAATTTTSRPLLLSRQQAAASSLQCRLPRRPGSSLFAGQGQASTPNVRCMAVVDTASAPAPAAARKRSSYDMITLTTWLLKQEQEGVIXTTRIITTACQQIASLVQRAPISNLTGVQGATNVQGEDQKTLDVISNEVFSNCLRWSGRTGVIASEEEDVPVAVEESYSGNYIVVFDPLDGSSNIDAAVSTGSIFGIYSPSDECHIGDDATLDEVTQMCIVNVCQPGSNLLADGYCMYSSSDSSSVIFVLTIGTGVYVFTLDPMYGEFVLTQEKVQIPKSGKIYSFNEGNYALWDDKLKKYMDSLKEPGTSGKPYSARYIGSLVGDFHRTMLYGGIYGYPSDQKSKNGKLRLLYECAPMSFIAEQAGGKGSDGHQRVLDIMPTAVHQRVPLYVGSVEEVEKVEKFLSSE

SEQ ID NO: 4466 - protein, 376 aa, Triticum aestivum
MLGAARRQLGSGPMLGQLLRRLRPAAAASTEAARGYSSAAKEITVRDALNSALDEEMSADPSVFLMGEEVGEYQGAYKITKGLLDKYGPDRVLDTPITEAGFTGIGVGAAYQGLRPVIEFMTFNFSMQAIDHIINSAAKSNYMSAGQINVPIVFRGPNGAAAGVGAQHSQCYAAWFAHVPGLKVLAPYSSEDARGLLKAAIRDPDPVVFLENELLYGESFPVSDEVLDSSFALPIGKAKIEREGKDVTITAFSKMVGYALQAAEILSKEGISAEVINLRSIRPLDRAAINASVRKTNRLVTLEEGFPQHGVGAEICMSVVEESFEYLDAPIERIAGADVPMPYAANLERLAVPQIEDIVRAARRACYRALPMTATA

SEQ ID NO: 4467 - protein, 315 aa, Triticum aestivum
  unsure (1)..(315): unsure at all Xaa locations
TFRTEPPNYGTRCSYPIVPRTGLTLVPELIAASLGLRCWTALMLQHSILDMLGLGSRERALRKTADXLDREMSLMRSQEETGRHVRMLIHEIRRTLDRHTILKTTLVELGSDAGSAGMAFWMPSRSGSSLDLTHTMRHHIPGSSXVEINLPVVNQVFSTNRAIIVPHTSPLARIHPVQGRHVPPEVAAVRVPLLHLSNFHPELLAKSYAIMVLMLPSDSVRKWLAHELELIEVVANQVAVALSQAEILXEESMRARDLLTEQNVALDLALREAEMAIHARNVNRVGVELVGPEDTDNVATINSSASAAKVHNAEP

SEQ ID NO: 4468 - protein, 119 aa, Triticum aestivum
REEPAEASVYAIQAASGSNGSKARVRPAGAAPVVGWPPVRSFRRNLAASSSRPSSGKHTRQEGSAKDGLFVKINMDGVPIGRKVDLTAYGGYADLSAAVGKLFRGLLAAQRDRAATAWR

SEQ ID NO: 4469 - protein, 618 aa, Triticum aestivum
  unsure (1)..(618): unsure at all Xaa locations
LQRGPPRALXLMRPRCSGEAVDCCRDSSFLPAFRSPVQLWGVWSRVVVLLHFSAGPSPVGVFVTGAMLTRRILGEENDKAMESPDRDQIDRYITSSVKSAFMKIAHFVEIKADTSHEHVLASLAEETKKLLKIETNIFSPVLSRWHPQAAVLSRELHDKLYAYKLGPFLEHSEHLTRCVALVSVGSFSLEQYIMSVMASVVGDDGLDSLCRQKLVPYEIESKSGTVVLRWVNGQLERVETWVKRAAEQETWDPISPQQRHGGSIVEVYRIIEETADQFFAFKVPMRIGELNSFCRGIDKAFQIYTQLVTQPIVDKEDLVPPVPVLTRYKKELGIKAFVKKEIQEVRPVDERKSSEIVQLTMSKLCVRLNSLYYAISQLGKLEDSISERWAKRQSDKINIRRSMNGKSKGVVSNQKNQFDGSRKEINAAIDRVCEFTGLKVIFWDLQQPFIDNMYKNNVLQARLDTIVEVLDLVLAQLCDVIVEQLRDRVVTGLLQASLDGLVRVILDGGPTRVFSPNDAPLLEEDLEILKEFFISGGDGLPRGTVENLVSRVRPVINLIKQETRVLIDDLREVTQGGKSKFGSDSKTLLRVLCHRNDSEASHYVKKHFKIPSSAPPST

SEQ ID NO: 4470 - protein, 268 aa, Triticum aestivum
  unsure (1)..(268): unsure at all Xaa locations
MAVPSSPSLLLVAALLLCATATLAAAQAVTTRKYQFDVQMTSVTRLCGTKSIATVNGQFPGPTLHAREGDHVEVNVVNNSPYNMSIHWHGVRQLLSGWYDGPSYVTQCPIQPGQSYVYRFQIVGQRGTLWWHAHISWLRATVHGPIVILPPAGVPYPFPAPEAEVPLMFGEWWRNDTEAVIAQALRTGGGPNVSDAYTMNGLPGPLYACSXAKDTFRLKGEAXGKTYMLRLINAALNDELFFXXASPTRPVVLLVPPLVVPAXLVHPL

SEQ ID NO: 4471 - protein, 726 aa, Triticum aestivum
MAVGDPGALLQEKTGGSMSIVRASEEQLHELSRQASEGSQGHHWPLPPFRGDSRDTYNLLEQRPRIANRHGRLYEADARSFHALAQHDVRVAVANITAGNSPTFSAPMESGLVASHRLRLPALPSAAHAHLLRHRRLVATPLRLPTTPTPLRQPAALPLRPCLRPPRAASVASPAPVPGDAPDNSRKFLGVDALTLKKIVPLGLMFFCILFNYTILRDTKDVLVVTAKGSSAEIIPFLKTWVNLPMAIGFMLLYSKLADVLSKEALFYTVIFPFIAFFGVFGYVLYPMRDAIHPTALADRLLASLGPSFLGPVAILRVWSFCLFYVMAELWGSVVISVLFWGFANQITTVEEAKEFYPLFGLGANVALIFSGRTVKYFSNMRQNLGPGVDGWAISLKGMMSIVVVLGFVIAGIYWGVNKYVIDKTSLPVERKKKNKPKLSMGESLKVLVSSQYVRDLATLVVAYGISINLVEVTWKSKLKAQFPSPNEYSSFMGDFSTATGIATFTMMLLGRLILRKFGWGVAATITPAVLLVTGVGFFSLLLFGEPLTPLLATFGMTPLLAAVFVGALQNIFSKSAKYSLFDPCKEMAYIPLDEDMKVKGKAAIDVVCNPLGKSGGALIQQFMILSFGSLANSTPYLGGILLVIVIAWLGAVRSLDSQFSPLAKQDLEREQQLKAEVVETTAQVVGTGNGSLQENVASQSSTNGTVIKQSQEPEITAPEKSGKQS

SEQ ID NO: 4472 - protein, 1068 aa, Triticum aestivum
QLPGAILDAGGAAGDITAASVASAAPGGGAGSAAAEKRRDKASLMLLERGRFNPARYFVEEVISGFDETDLYKSWVRRSAMRSPQERNTRLENMSWRIWNLARKKKQIEGEEASRSSKKRLEREKARRDAAADLSEDLSDGEKGEHINESSIHAESTRGHMPRIGSTDAIDVWANQHKDKKLYIVLVSIHGLIRGENMELGRDSDTGGQVKYVVELARALGETPGVYRVDLLTRQISAPDVDWSYGEPTEMLSPRNSENLGDDMGESSGAYIVRIPFGPREKYIPKEQLWPHIQEFVDGALVHIMQMSKVLGEQVGNGQPVWPVVIHGHYADAGDSAALLSGALNVPMVFTGHSLGRDKLEQLLKQGRQTRDEVDATYKIMRRIEAEELCLDASEIVITSTRQEIDKQWGLYNGFDVIMERKLRARIKRGVSCYGREMPRMIPIPPGMEFSHIVPHDVDLDSEEANEVGSDSPDPPVWADIMRFFSNPRKPMILALARPDPKKNITTLVKAFGEHHELRNLANLTLIMGNRDVIDEMSSTNGAVLTSVLKLIDKYDLYGQVAYPKHHKQSEVPDIYRLAARTKGVFINCAYIEPFGLTLIEAAAYGLPMVATQNGGPVDIHRVLDNGILVDPHNQNDIAEALYRLVSDKQLWAKCRQNGLDNIHRFSWPEHCKNYLSRVGTLKSRHPRWQKSDDATEVSETDSPGDSLRDIHDISLNLKISLDSEKSGSMSKYGRSSTSDRRNLEDAVQKFSEAVSAGTKDESGEKAGATTGSNKWPSLRRRKHIVVIAVDSVQDADLVQIIKNIFQASNKEKSSGALGFVLSTSRAASEIHPLLTSGGIEITDFDAFICSSGSDLCYPSSNSEDMLSPAELPFMIDLDYHSQIQYRWGGEGLRKTLIRWAAEKNSESGKEAVVEDDECSSTYCISFKVKNTEAVPPVKDLRKTMRIQALRCHVLYSHDGSKLNFIPVLASRSQALRYLYIRWGVELSNMTVVVGESGDTDYEGLLGGVQKTIILKGSFNSAPNQLHAARSYSLEDVVSFDKPGIASVDGYAPDILKSALQQFGALEG

SEQ ID NO: 4473 - protein, 394 aa, Triticum aestivum
AASLPGAPALIEKPPTRPESAARAPPRLPPRAPQSAGGAPPRSPPRHTPEPGSRAAVRRRAEAGVRARAMDVDSVECLSLPDAAMDADDVGLALHPHGGILAAASRPAAYPKAGAGAGGIVAPGSSVHELLECPVCTNSMYPPIHQCQNGHTLCSTCKARVHNRCPTCRQELGDIRCLALEKVAESLELPCKHYSLGCPEIFPYYSKIKHEAMCSFRPYSCPYAGSECSVTGDIPYLVNHLRDDHKVDMHSGCTFNHRYVKSNPREVENATWMLTVFHCFGQYFCLHFEAFQLGMAPVYMAFLRFMGDENEARNYSYSLEVGANGRKMVWEGTPRSVRDSHRKVRDSHDGLLIQRNMALFFSGGDRKELKLRITGRIWKETQTPDGACVPVLCS

SEQ ID NO: 4474 - protein, 326 aa, Triticum aestivum
  unsure (1)..(326): unsure at all Xaa locations
MERITTNPFYTSGIPVTVPSPLPSTTMDESFTRLPDAQNVLLERELRRTPLPPHQSTVAPICGQFHPSTGXSVGPLRSPPAVRFSSVPNPEQYNGANPYISQTPSTGSSSAMIYGSHHEGFEPTFNDFPRDVGPTWCPDPVESMLGFSDDVPVGNNLTGISPIAATDELAKHTEWWTDFMNDDWKDIADNAGAAKTQPQAGPPVQSSISVHQSASQQAGTTSVHQPALQQIVTTQPIESSVVAAPSPSASSNTSKTRMRWTPELHERFXWDAVNLLGGSXKATPKGVLKXLMKADNLTXLHVKSHPXKXRTADIDRISEGHRKVGG

SEQ ID NO: 4475 - protein, 303 aa, Triticum aestivum
WVLDAIEKQKFEAPPPVAILPAGTGNDLARVLSWGGGLGVVEKRGGLFSVLKDVEHAAVTVLDRWKNTIKDNQGKLMCSPKFMNNYFGVGCDAKVALDIHNLREENPERFYSQFMNKVLYAKEGAKNIMDNMFYYFPWEVKLEIDGSNIEIPQDAEGILVANIRSYMGGVDLWKNEDSVSDTFQPQSMHDKTLEVVSFTGMLHLGRLQVGLSRAQRLAQGHHIKIEITTPMPIQVDGEPWSQEPCTIEVSHHAQAFMLKRVSEEPISHAASIMADILENAENSGTISASQKSALLQEIASRLL

SEQ ID NO: 4476 - protein, 187 aa, Triticum aestivum
  unsure (1)..(187): unsure at all Xaa locations
MAPNYEMAASILLCAEDSSSIFGFGDGEEAAAGARAEGSPYCGGDDEFAAGFPLPSEECVARWVATEAEHMPREDYAERLRAGGVDLRVRMDAVDWIWKVHTYYGFGPVTACXLAVNYMDRFLSLYQIPEGKAWMTLLLSCACLSLAMEMDDAPQPQAIEVPGGDARFVEAKTTIXKMELLVLSTLK

SEQ ID NO: 4477 - protein, 346 aa, Triticum aestivum
  unsure (1)..(346): unsure at all Xaa locations
MDHAADTFRTDLMTITRHVLNEQSRHPESRGDLTILLSHIVLGCKFVASAVNKAGLAKLTGLAGETNVQGEEQKKLDVLSNEVFVNALVSSGRTCVLVSEEDEKATFVDPKLRGKYCVCFDPLDGSSNIDCGVSIGTIFGIYMIKNQDTVTLEDXVLQPGKDMIAAXGYCMYGSSCTLVLSTGNGVNGFTLDPSLGEFIMTHPDIKIPPKGKIYSVNEGNAKNWDTPTAKYVEKCKYPTDGSSPKSFRYIGSMVADVHRTLLYGGIFLYPADKKSPSGKLRVMYEVFPMSFLMEEAGGQSFTGKGRSLDLIPTDIHERSPIFLGSSDDVEEIKALYAEEAKKEGSA

SEQ ID NO: 4478 - protein, 257 aa, Triticum aestivum
MDHAADTFRTDLMTITRHVLNEQSRHPESRGDLTILLSHIVLGCKFVASAVNKAGLAKLTGLAGETNVQGEEQKKLDVLSNEVFVNALVSSGRTCVLVSEEDEKATFVDAPLRGKYCVCFDPLDGSSNIDCGVSIGTIFGIYMIKDKDNATLEDVLQPGTDMIAAGYRMYRSSCTLVLSTGNGVNGFTLDPSLGEFILTHPNIKIPNKGKIYSVNEGNARNWDAPTANQHCRYVERCKFPQDGSSPKSLRYIGSLVA

SEQ ID NO: 4479 - protein, 316 aa, Triticum aestivum
  unsure (1)..(316): unsure at all Xaa locations
MDHAADAQRTDLMTITRHALNEQGRHPESRGDFTILLSHIVLGCKFVASAVNKAGLAKLIGLAGETNVQCVLVSEENEAAIFVDAPLRGKYCVCFDPLDGSSNIDCGVSIGTIFGIYMIKDKDNATLEDVLQPGTDMIAAGYCMYGSSCTLVLSTGNGVNGFTLDPSLGEFILTHPNIKIPNKGKIYSVNEGNARNWDAPTAKYVERCKFPQDGSSPKSLRYIGSMVADVHRTLLYGGIFLYPADKKSPNGKLRALYEVFPMSFLMEQAGGQSFTGKHRALEIVPXEIHQRSPIFLGSYDDVEEIKSLYAAESSTA

SEQ ID NO: 4480 - protein, 264 aa, Triticum aestivum
MALVNKLGNLLKKATSSNPTLYQAIRCMSSSKLFVGGLSFNTDEGSLRDAFSHYGEIIDAKIIVDRDTGRSRGFGFITYAAEEQASSAIMALDGKDLHGRNLRVSAATERTAGFRNGAGYGGGGGGFGGGGYGGGGYGGGGYGGNSGGGGGFAPAGGDNFAAGNFGGDRGFGGNPAGNHGAPAGSTSGDEFSLGTPGSSFESAKNDDVIGGNPAGNHGAPAASTGGDEFSLGTPGSTFESTKNDDVMDDLFKDDEPDKYASKNV

SEQ ID NO: 4481 - protein, 231 aa, Triticum aestivum
  unsure (1)..(231): unsure at all Xaa locations
MALVNKLGNLLKKATSSNPTLFQAIRCMSSXKLFVGGLSFNTDEGSLRDAFSHYGEIIDAKIIVDRDTGRSRGFGFITYAAEEQASSAIMALDGKDLHGRSLRVSAATERTAGFRNGAGYGGGGGSFGGGGYAGGGYGGGGYGGTGAGGAGGYPPPVGNDAFSGGSFAPAGSGNFAAGNFGGNHGAPAGSPSGDEFSLGPPGSSFESPKNDDVMAPLFKDDDPAKYPTKNV

SEQ ID NO: 4482 - protein, 259 aa, Triticum aestivum
MAPSSPAAAAVAEGDEQQQQQIVAAAAAAKKGGGKRGRREMRRIEDATSRQVTFSKRRSGLLKKAFELGVLCDAEVALIVFSPRGRLYEYASAPDLQKTIDRYLNHTKGTSANEKTVEQPAAGVQMCRSEATALKHKIDAIEAYQRKLSGEGLGSCSAHELQELELQLEKSLSCIRQKKQQKMLDKILELKEKERKLLTENVVLREEYKALPLLELATAAAAERSPDGAGAEEAEEDERRLHYMEVETELVIGRPGSSS

SEQ ID NO: 4483 - protein, 193 aa, Triticum aestivum
  unsure (1)..(193): unsure at all Xaa locations
MEVDTLKNEFDRVVKKQKLASSRTIDLINQIEKEIEQAIGAIQENGTDRDAASNLNHEILTNLKNTLKELVPVKQLESCQKEMNTALGKWVKTTEKFFINDISKAYKNVDMEPHVLNEIIANHLYPFLEXASCLASIKLKQLFQEMYEIFGALRTEKSEPALSWAMKNHDALLQNDSCLELKLHQLQFVEILK

SEQ ID NO: 4484 - protein, 44 aa, Triticum aestivum
RTRIEGGAKAVRTNGTLALQRVRAIYARRSVFFWFEVGEKLEPL

SEQ ID NO: 4485 - protein, 232 aa, Triticum aestivum
  unsure (1)..(232): unsure at all Xaa locations
MAAARPGSPAPRRLPPSTLLLLAAVLLAASPPARALRFDLESGHTKCISDEIKVDSMAVGKYSVVAPDPSYPDAQLPESHRVSLRVTSPYGNSMHYSEXNVQSGHFAFTAVETPGTTRTVAFWAPXDHKPPVTVTFEFXRMSGVTAKDWSNVAKKGKVDMMELELKKLEDTIKSIHEEMFYLREREEEMQNINRQTNSRMGWLSFLSLGICLSVAGLQLWHLKTFFERKKLL

SEQ ID NO: 4486 - protein, 511 aa, Triticum aestivum
MTATPSLIGLSAGNRLLSTSFGPPNDLLSDKDNSHMTSAAGDAHGSSSLQFAPPAASKLTVAAHRLKLSPHGRAQVMRALRQSAPALAPQPPPLLPADEFSLDAIILLQRSMLEKQWQLPFEEEDDDDGGGDGHHVEAIGSAEDDDGKGRSSSVVVARSGVSARQRRMSGRRRGRSKKGSGAVHLSISPELLQSRNRIYLRGTVSKELLTQKQVVHLSKKIKDGIWLQQQRSKLKEKLGNEPSYKQMAQSLRISTPELRSRMRESFLAREVLTMSNIRLVISIAQKYDKLGVELSDLIQGGLIGLLRGIEKFDASRGFRISTYVYWWIRQGVSRALADNSKTFRLPTYLHERLIAIRGAKYALEDQGVSPTTQNIAKLLNISEKKVHNATEAVNKALSLDQQAFPSLNGLPGDTLHSYIEDQNVANDPWHGFEEWYLKEEVNKLLNSNLTERERDIIQLYHGIGKQCHTWEDISRQFGLSRERVRQVGLIAMEKLKQRARRKKLDALLQDY

SEQ ID NO: 4487 - protein, 254 aa, Triticum aestivum
  unsure (1)..(254): unsure at all Xaa locations
VIAYLLXPVXGFCNAYGXGLTDMNMGYNYGKVAXXVFXAWAGKDNGVVAGLVTXGLVXQLVXVSADLMHDPKTAHLTLTSPRSMLVGQAAGTLMGCVVAPLTFFLFYEAFDVGNPDGYWKAPYALIYRNMAILGVEGFSALPQHCLQLCAAFFAFAVLANLARDXLPRRLGRFVPLPMAMAVPFLVGASFAIDMCVGSLVVFLWHWLDGKKAALLVPAVASGLICGDGIWIFPSSLLALAKIKPPMCMKFTPGS

SEQ ID NO: 4488 - protein, 100 aa, Triticum aestivum
  unsure (1)..(100): unsure at all Xaa locations
MAGGVADAGVPTLAKANGSGAGCCPVKGPVYATPREVMEMGPREGLLYMTCVYNGTGXINKPDYLATGGVYPNVATYSXVIHRVPGTHNCDELDHYGWDR

SEQ ID NO: 4489 - protein, 123 aa, Triticum aestivum
FAWVNFFFSGFVAAKIPFPLTQRFRGMLQNGIDLSTVDVSYVSSRSWYFLNLFGLRGLFSLILGEENATDDAQKMMAMGGGMGFNPAMSLSAEKDSLDIIQHDWALPKMERHAEEVLRKLLKN

SEQ ID NO: 4490 - protein, 252 aa, Triticum aestivum
MAEELVLDTAIRDWVLIPLSVVMVLIGVLRYFVSKLMRSPPSASPSPDPKTVKEGQVVIRARNLRNGAQFIPAKAFKARKLYYTNGEAGLLHVPKEDAQKAQAAMFSDPNMAMDMMKKNLSMIVPQTLTFAWVNFFFSGFVAAKIPFPLTQRFRGMLQNGIDLSTVDVSYVSSRSWYFLNLFGLRGLFSLILGEENATDDAQKMMAMGGGMGFNPAMSLSAEKDSLDIIQHDWALPKMERHAEDVLRKLLKN

SEQ ID NO: 4491 - protein, 288 aa, Triticum aestivum
  unsure (1)..(288): unsure at all Xaa locations
ASGVPGAHTPPTHPTSANHPQPNHPRGYGCTPAPETRAPPIHFYPAIIFSMARLDRVKNMTGLVEMYGRNPRLQELXNLVVVCGDHGKVSKDKEEQAEFKKMFDLIEQYNLIGHIRWISAQMNRVRNGELYRYICDMKGAFVPXAFYEAXGLTVIQSXMTCGLPTFATAYGGPAEIIVNGVSGYHIDPYQGDKASXTLLVEFFEKCQVDPSHWTKISQGGLQRIEEKYTWKLYSERLMTLTGVYGFWKYVSNLERRETRRYLEMLYALKYRTMASTVPLAVEGDSASK

SEQ ID NO: 4492 - protein, 143 aa, Triticum aestivum
MAMQPGGEGETLMQRCKPYVAMISLQFGYAGMNVITKVSLNHGMSHYVLVVYRHAFATLSIAPFALFLERGKARPPRMTPLVFLNIFLLALMGPVIDQNFYYAGLKYTSPTFSCAMSNMLPAMTFVMAVIFRMEKVDLKRPGA

SEQ ID NO: 4493 - protein, 279 aa, Triticum aestivum
MAPWGLGGERSKGLRPKMTITIFLKIMGLAFLEPVIDQNLYFMGAKLTSAGFATARGDILPFFTFVLALLLRMEKVRRRSLHSQAKIAGTVLTVAGAVLMVLYHGPMVQFPWTKGQHHATASGQGVGGAANARDWLNGTIMVIIACVAWACFFILQSNTLRSYPAELSLTVLICGMGSLMSGAIALVAERANTQAWVIGFDMRLFTAVYAGIVCSGVAYYVQGIVSRQRGPVFVTAFNPLCMIITAVMGSIILKEEINLGSVIGAAIIVGGLYFLIWGK

SEQ ID NO: 4494 - protein, 238 aa, Triticum aestivum
AGSMFAAKAGAKHVIGVDMSTIIFKAREIVKINGLSDKITLLQGKMEEVELPFPKVDIIISEWMGYFLLYESMLDTVLYARDTYLQKDGLIFPDKATIFFAGIEDGDYKEDKIEFWNDVYGFDYTPLKATALSEPLVDTVEVKAAVTDPAPVLTLDLYTCTVADLAFQVPFKLSAKRDDFIHALVSWFDIDFTACHKPIRFSTGPHTKYTHWKQTVFYFEDVLTVQQGEEITLNLDVR

SEQ ID NO: 4495 - protein, 185 aa, Triticum aestivum
  unsure (1)..(185): unsure at all Xaa locations
QXGSRLVAAXYVLYSSATIFCISFGAGTHGFTLDRSTGEFVLTHPSMQIPPRGQIYSVNDARYFDWPEGLKKYIDTIRQGKGQHPKKYSARYVCSLVADFHRTIIYGGVAMNPRDHLRLVYEANPLSFLAEQAGGRGSDGKTRILSIQPVKLHQRLPLFLGSMEDMLELESYGDVQQKVNPGYDV

SEQ ID NO: 4496 - protein, 303 aa, Triticum aestivum
  unsure (1)..(303): unsure at all Xaa locations
MVFVKNQKTRAYSKRFQVKFKRRRQGKTDYRARLRLTNQDKNKYNTPKYRFVVRFTNKDVTAQIVYATIAGDIVMAAAYSHELPRYGLEVGLTNYAAAYCTGLLLARRVLKCRDLDQEYEGNVEATGEDFSVEPADERRPFRALLDVGLIRTTTGNRVFGXPLRGALDGGLDIPHSDKRFAGFKKDEKQLDAEIHRKYIYGGXHVADYMKSLADEEPEKYQSHFSEYIKKGIEADNMEALYKKVHAAIRADPTMAKSTKEPPKTHKRYNPKKLTYEQRKASLVERLNALNSSAGADVDEDDDE

SEQ ID NO: 4497 - protein, 598 aa, Triticum aestivum
  unsure (1)..(598): unsure at all Xaa locations
MSLHWTIASTRQEIEEQWNLYDGFEVILARKLRARVKRGANCYGRKKRRGSPIXPSTTVSILDGNADFVCRXVNHGPASEDPPIWSQIMRFFTNPRKPMILAVARPYPEKNITTLVKAFGECRPLRELANLTLIXGNREAISKMHNTSASVLTSVLTLIDEYDLYGQVAYPKHHKHSEVPDIYCLATRTKGAFVNVAYFEQFGVTLIEAAMNGLPVIATKNGAPVEIHQVLNNGLLVDPHDQNAIADALYKLLSEKQLWSRCRENGLKNIHQFSWPEHCKNHLSRILTLGMRSPAVGSEEERSKAPISGRKHIIVISVDSVNKENLVRIIRNAIEAAHTENTPASTGFVLSTSLTISEICSLLVSVGMHPAGFDAFICNSGSSIYYPSSAAWAPSNSKVTHVIDRNHQSHIEYRWGGEGLRKYLVKWATSVVERKGRIERQMIFEDSEHSSTYCLAFKVVNPNHLPPLKELRKLMRIQSLRCNALYNHSATRLSVTPIHASRSQAIRYLFVRWGIELPNIVVMVGESGDSDYEELLGGLHRTIILKGDFNIAANRIHTVRRYPLQDVVALDSSNIIEVQGCTTEDIKSALRQIGVPTQ

SEQ ID NO: 4498 - protein, 176 aa, Triticum aestivum
MTRHTPDEPRRLGRPQTNPAVSGLLLPAPRPRPRPRRRRSQMASTTFRRFSVAAAAAAFIALAAFGSASASKTAFVKSTVKAHDVVIFSKSYCPYCKRAKAVFKELELKKDPYVVELDQREDGGEIQDALSDMVGRRTVPQVFIRGKHLGGSDDTVDAYESGELAKLLNISVKDDL

SEQ ID NO: 4499 - protein, 246 aa, Triticum aestivum
  unsure (1)..(246): unsure at all Xaa locations
MAKTCTLALLGALLVLSLLVSPIACSRKLAKVGGHDKSAPVKGHKNQTTTNPSSSAAYGGGWLPAGATYYGNPNGDGSDGGACGYQTAVGHRPFSSMIAAGSSPLFMAGKGCGACYDVKCTSNSACSGKPXVTIVITDLSPGNLYPGEPCHFDMSGTALGAMAKPGMADKLRAGGVIRMQYKRVPCKYPGVNIAFRVDQGANPFYFKTLIEFEDDDGDLKAVALKEAGSGAXTPMAQDWGALWRLN

SEQ ID NO: 4500 - protein, 201 aa, Triticum aestivum
MTTVASLSLVPHLLIKPSLRCLSRKGVGRYGGIKVYAVLRDDSADYLKDNHHWEALFHVDDPGPRVPIEKGQYLEAKQALDVVRFDIQYCDWRARQDLLTIMVLHNKVVEVLNPLARDFKSVGNLRKDLDGLQEELAKAHNQLYLSESRVSSALDKLAQMETVVNERLLSDGSPFANTADCAFFVPRTFFDTTTLLYSPSA

SEQ ID NO: 4501 - protein, 269 aa, Triticum aestivum
MSLSTASRRALSRIGGALRRSFSSSSSSVPDASGYHVSGGPSFMRAAVFWEPGRPLTMEEFRMPRPKAGEVLVKTKACGVCHSDLHVMKGELPFASPCVVGHEITGEVVDHGMHTPAEIVNRFPVGSHVVGAFIMPCGNCFYCVKGQEDLCESFFAYNRAKGTLYDGETRLFLRSNGKPVYMYSMGGLAEYCVVPANALAILPNSLPYTESAILGCAVFTAYGALRHAAEMRAGDSVAVIGVGGVGSSCLQIARAFGASEVIAVDVLDE

SEQ ID NO: 4502 - protein, 304 aa, Triticum aestivum
RSLGGFDTAHAAARAYDRAAIKFRGLEADINFNLSDYEEDLKQMRNWTKEEFVHILRRQSTGFARGSSKYRGVTLHKCGRWEARMGQLLGKKYIYLGLFDSEVEAARAYDRAAIRFNGREAVTNFESSSYNGDAPPDAENEAIVDADALDLDLRMSQPTAHDPKRDNIVAGLQLTFDSPESSTTMISSQPMSSSSSQWPVHQHGTAVAPQQHQRLYPSACHGFYPNVQVQVQERPMEARPPEQPSSFPGWGWQAQAMPPGSSHSPLLYAAASSGFSTAAAGANLAPPPPYPDHHRFYFPRPPDN

SEQ ID NO: 4503 - protein, 181 aa, Triticum aestivum
  unsure (1)..(181): unsure at all Xaa locations
NYFSEGNFPCEDPPPGVTARRVSVPLFPRSPESELRPPESRSATALPCHLEQAREMSLIRIAFSLVLLLAAAESAAATRSPSAFVQNAIYSNRITIFSKSYCPYCMRTKRIFKDLNENPYVVELDLREDGRDIQGVLLDLVGRNTVPQVFVNGHHVGGSDDTKTALSDGQLQKLXGQSQSQ

SEQ ID NO: 4504 - protein, 360 aa, Triticum aestivum
  unsure (1)..(360): unsure at all Xaa locations
HNQTHAPPPPPPPAQPPVAKKSRRGPRSRSSQYRGVTFYRRTGRWESHIWDCGKQVYLGGFDTAHAAARAYDRAAIKFRGVDAGAVPTWACKGEPPSSNTTHATLLVVIVRXASSGFSKTAAAAAPGAPSASFRFXPARAGQFLGKKYIYLGPLVNEVQAARAYDKAAIKCNGREAVTNFEPSTYDAELLNEVAAEGADVDLNLSISQPTSQSPKRDKSSLGLQLHHGSYEGSELKRPKVDAPPEMVAIPHRYPLLTEHPPIWHGQSYPLFLNNEEAARDHSRRPEVATGAVPTWAWRVSHPPPTQPMPLFSSSSSAAASSGFSKTAAAAAPGAPSASFRFDPMAPSSSSSNQHHHHHPR

SEQ ID NO: 4505 - protein, 431 aa, Triticum aestivum
MEMKLTIKRVPTVLSNYQEEGGGGCGRNCLGDCCLPASKLPLYAFKADPKKPAQDDELPTEFFLNSLLLAQWEDTVPRGLFRYDVTACETKVIPGELGFVAQLNEGRHLKKRPTEFRVDRVLQPFDSAKFNFTKVGQEEVLFRFEKGGGDSSYFLENAPSTEGDHAPSVVAINVSPIEYGHVLLIPRVLDRLPQQIDPESFLLALHMAAEAASPYFRLGYNSLGAFATINHLHFQAYYLSVPFPVEKAPTKKIPLAKCALNSGVKVSKLTNFPVRGLVFERGNTLKDLADVVTNACIWLQENNVPFNVLISDSGRRIFVFPQCYAEKQALGEVSQDLLDTQVNPAVWEISGHIVLKRRTDFKEASEASAWRLLAEVSLSEERFEEVKACIFEATGLTESDEEEESSESPYASSSSVPRASSHMSEGCLVLQ

SEQ ID NO: 4506 - protein, 262 aa, Triticum aestivum
EFGTSEDNKASMMSSGAVPRVDHVLNNGSMEARKNAAATLFSLSVVDEYKVMIGGTGAIPALVVLLSEGSQRSKKDAATALFNLCIYQGNKRRAIRAGLVPLIMGLVTNPTGALMDEAMAILSILSSHQEGKAAIGAAEPVPALVELLGSGSPRNRENAAAVMLHLCSGEQQLVHLARAHECGIMVPLRELALNGTERGKRKAVQLLERMSRFMVQQQEEQESNSRLQAAVAQVLPQAPEQVQEREIPDQLESPASQYPTLL

SEQ ID NO: 4507 - protein, 322 aa, Triticum aestivum
MAAATAAAVSSPAVTAPLPRAASSAARRGFVSFSGAAARPSALRSDRLRAAAAGFSSGVRTHVAAVEQAVVQDATEVEAPVVVVTGASRGIGKAVALALGKAGCKVLVNYARSSKEAEAVSEEIEASGGQAITFGGDVSKEADVESMMKAALDKWGTIDILVNNAGITRDTLLMRMKKSQWQDVIDLNLTGVFLCTQAATKVMMKKKKGRVINIASVVGLTGNAGQANYSAAKAGVIGFTKTVAREYASRNINVNAIAPGFIASDMTAELGEEVEKRILSTIPLGRYGQPEEVAGLVEFLALNPAASYITGQVLTIDGGMVM

SEQ ID NO: 4508 - protein, 214 aa, Triticum aestivum
MAAEEPKKVEVEAAPEPEAAQPAVPAAEPEAPAKDVTEEKAVIPAPEPAAEEEKPPADDSKALVVVEKVADEPVAEKPTDEKAAHGGSNDRDLALARVESEKRNSLIKAWEENEKTKAENKATKKVSAILSWENTKKANIEAQLKKIEEQLEKKKAEYAEKMKNKAAMIHKEAEEKRAMVEAKKGEELLKAEEMAAKYRATGHSPKKVMGCFGA

SEQ ID NO: 4509 - protein, 467 aa, Triticum aestivum
PRAIDLRGKSEGTSKRRKTRKKDGRANSTEIGSASDKESSGTGGSNEMLYALPDGLDGCQIGKLRVHKKEIGKGSNGTVVFEGSYDGREVAVKRLLRSHTDIAQKEIQNLIASDRDPNIARLYGCDQDDNFVYISLERCCCSLADLIQQHTDPSFSDVEKIDVELWTQDGLPSPQLLKLMRDVVAGIVHLHSLGIIHRDLKPQNVLISKEGSLSAKLSDMGISKRLQEDMSPLSHHGTGYGSSGWQAPEQLRRASQTRAMDLFSLGCLIFYCITKGKHPFGEYYERDINIINGHFDLFVVDHIPEAVHLISLLLQPKPDERPTAVYAINHPLFWSPELRLLFLRDTSDRIEKTTETDLLNALESIGHQAFGGKWREKLDDGLVADVGRYRKYNFESTRDLLRLIRNKSGHYRELPADLKELLGSLPEGFDRYFSSRFPKLLIEVYKVMSVYCKDEEDFRKYFIGISV

SEQ ID NO: 4510 - protein, 294 aa, Triticum aestivum
MEQYEKVEKIGEGTYGVVYKARDRTTNETIALKKIRLEQEDEGVPSTAIREISLLKEMQHGNIVKLHDVVHSEKRIWLVFEYLDLDLKKFMDSCPEFAKSPALIKSYLYQILRGVAYCHSHRVLHRDLKPQNLLIDRRTNALKLADFGLARAFGIPVRTFTHEVVTLWYRAPEILLGARQYSTPVDVWSVGCIFAEMVNQKPLFPGDSEIDELFKIFRVLGTPNEQTWPGVSSLPDYKSAFPRWQAEDLATVVPNLEPVGLDLLSKMLRFEPNKRITARQALEHEYFKDMEMVQ

SEQ ID NO: 4511 - protein, 431 aa, Triticum aestivum
  unsure (1)..(431): unsure at all Xaa locations
MTTVASLSLVPHLLFKPSVRCLSRKGVGRYGGIKVYAVLRDESADYLKDNHHWEALFHVDDPGPRVPIEKGQYLEAKQALDAVRLHGQYXDWRARSDLLTIMVLHNKVVEVLNPLARDFKSVGNLRKDLDGLQEELAKAHNQLYLSESRVSSALDKLAQMETVVNERLLSDGSAFANTADCASLDPSTSLDTTTSTSSTVRLGAKNPGRRSLPVAGPGTPFGADLGNFRDPVAPARHLKDHTLLPFVCFGEPCVRFRXKXDKRPGCVQNTCAHRACPLDLGSVNEGRITCPYHGWEYSTDGKCEKMPSTKMLNVRIRALPCFEQEGMVWIWPGDDTPTPTIPSLLPPSGFTIHAEIVMELPVEHGLLLDNLLDLAHAPFTHTSTFAKGWSVPSFVKFLTPTSGLQGYWXPYPIDNGVTDPPXHWFLSNHLG

SEQ ID NO: 4512 - protein, 245 aa, Triticum aestivum
MASMAVARIAAVLTVAALFAAAGAADPQPAKGAHCWRYYSSCMHKCDGYRDAAARSVNRTQPAVHTTVDDGAAAASIPVNSIDGTAAITHSTDGTLAAVDKTDGAVAHIADGYDDRDDDDKGDKKDDDDYGDKNDKDDDDKDDQDDDDDDKDNKDDDDNDDDKDDDDENDDNDDDDDDYYDDSRSDWRKYFKCKKMCIVDCYRSLPPVCYKMCISETCLNHPPYKQADCYKSCGHKCLDHHHHHH

SEQ ID NO: 4513 - protein, 439 aa, Triticum aestivum
MAWCALRSRLLPLSPSSSAAAAAATPHRLLLCLLSTAAPRHSHGHHHRRRHSPAAYAAAAEESPRPMPPIGRATRHPAGATPIARFYADANSQRPKEYWDYEALDIEWGEQDGYEVLRKVGKGKYSEVFEGLRTGSEERCVIKILKPVRKKKIKREIKILQNLYGGPNIIKLLDVVRDDDSKTPSLIFEYVNNTDFRVLYPTLSDYDIRYYIFELLKALDFSHSRNIMHRDVKPHNIMIDHEKRQLRLIDWGLAEFYHPRMEYNVRVASRCYKGPELLVDLLDYDYSLDLWSLGCMFAAMIFRVDPFFHGQANYQQLVKITKVLGTEDFHRYLEKYGLRLDPQLEMLVGRHRKKPWEKFVDSGNRHLVSPEAIDFLDKLLRYDHQERLTAKEAMAHPYFGPVRSSESTRRMFNSDLLHHHCSKNMAYLTILKQHVEHID

SEQ ID NO: 4514 - protein, 375 aa, Triticum aestivum
  unsure (1)..(375): unsure at all Xaa locations
MALWRRSSSWLTSLLARAGRHRRREXAKGPPRVAPQDAAEQIHEEAEDEERWSRLLPELLTDIVRRVDAGAERWPPRRDVVACACVCRRWRDAAVAVVRPPLECGRITFPSSLKQPGPRDAPMHCFIRRNKSTSTFYLYLSLTQALTDKGKXLLAARRFRRPXGAHTEYIISYDSDDLYPGSNSGVGKLRSDFLGTKFVMYDNQKPYDGAKSLKSRSSRRFATKQISPHVSGDNLEVGQVSYRFNFLKSRGPRRMHCSIQCPVGQGTASDPSKEKPPSTSSSLSLKNKAPRWHDHLQCWCLNFHGRVTVASVKNFQLVAPAGTSDPWGVGDEETVILQFGKIEDDAFTMDFRHPLSAYQAFAICLTSFGTKLACE

SEQ ID NO: 4515 - protein, 217 aa, Triticum aestivum
  unsure (1)..(217): unsure at all Xaa locations
STTRPAAGASGGLIVPKKEKKREXRHRLMRKLGRSKSESAESQTHRQPGLVGLLEILRAQLEITESMDIRTRQGLLNAMVGKVGKRMDNLLIPLELLCSISRAEFSDMKAYLRWQKRQLNMLEEGLINYPVVGFGELGRKVNELRNLFRKIEESESLSPSAAEVQRTECLRSLREVATSFSERPARGDLTGEVCHWADGYHLNAACMKKCFAVFLTP

SEQ ID NO: 4516 - protein, 326 aa, Triticum aestivum
  unsure (1)..(326): unsure at all Xaa locations
MSSCECLVVEKVSEDHAGGGEATGARRGGGRAPRSEAMFPIYVMGSSRARAVLLDPSAAGDPIWEAVKAEARSEAEKEPILSSFLYASVLSHDCLERALSFVLANRLEDPTLLATQLIDIFNDVMMNDVDIRRSIRLDAQAFKGRDPSCAQYSWALLYLKGYHSLQSYRIAHVLWNQGRKVLALALQSRISEVFAVDIHPAAKIGEGILLDHGTGLVIGETAVVGNWVSLMQGVTLGGTGKEHGDRHPKIGQGALLGAGATILGNITVGEGAMIAAGSLVLKHVPPHSMAVGNPAKXIGYTEKEDPSLTMKHDARRXXFEHVPVVS

SEQ ID NO: 4517 - protein, 345 aa, Triticum aestivum
PVHKNSKACVASYPSRLQNNILWFYPRADEEHRDVLQRKRPPFIPEIDDPSFVTVYGVRDLPYGYDGLVGKLRKKEDPGRVESDLQGGGPVKMKIEEADIAGFLSEQDNSGYFRYVAPCTFYGSPLPKEEKGEEKKKKPPQFMLVFMCVPVSPGKSRVIWAFPRNVGVWLDKVIPRWYYHIGQNAILDSDIYLLHIEERNFAAAGVENWQKAVYVPTSSDNMVIAFRNWFRKHCKSQVGWAAPTIGQLPETPTKDKLMERYWSHVAQCRSCSAALKTMKALEVALQVASVAVVGFLAVAKGTLVTSVVQRAAVVSLAVLCFAASRWLASFIEKKFYFQDYVHAYK

SEQ ID NO: 4518 - protein, 276 aa, Triticum aestivum
RPLVLFTVEFDIEGGGPIKMKTKEANVDGFLTEQQENRGYFRYVAPCTFYGSPLPREVAPFAEKGQEKKKKKPPQFMLVFMCVPVSPGKSRVIWAFPRNVGVWLDKVIPRWYYHIGQNAILDSDIYLLYIEERNFAAAGVENWQKAVYVPTSSDNMVIAFRNWFRKHCKSQVGWAAPTIGQLPETPTKDKLMERYWSHVAQCRRPGGPFDFSAVVHLLVALAVEEVAELLAVALVTSVVQRAAVVSLAVLCFAASRWLASFIEKNFYFQDYVHAYK

SEQ ID NO: 4519 - protein, 129 aa, Triticum aestivum
GIKSAVPKTIMQLMNVEGLTRENVASHLQKYRLYVKRMQGLSNEGPSASDHIFASTPVPPSLREPQVPHAAAMAPAMYHHHPAPMGGVAAGHGGYYQQQHSGHAVYNGYGGHGHGGGVSTYPHYHHGDQ

SEQ ID NO: 4520 - protein, 263 aa, Triticum aestivum
  unsure (1)..(263): unsure at all Xaa locations
MAAGGMSREERWSLAGATALVTGGSKGIGHAIVEELAGHGARVHTCARSAAELEECRRRWEAKGLPVTVSVCDVSLRAHREQLVETAKQVFDGKLDILVNNAAQILAKAGVEWTSEEYSHLMATNLESCFHLSQLAHPLLLGASIAGGGSIVNISSLGGTLGFPGLTIYSMTKGXINQLTRSLATEWAHNKIRVNCVGPGXTKSDMLNSVPPEIKENELAKNPMRRAGEPEEVAAVVSFLCMPAASFVTGQVITVDGGRTISA

SEQ ID NO: 4521 - protein, 270 aa, Triticum aestivum
MAAADDIGASAGRWSLHGRRALVTGGTRGIGRAVVEELAALGAAVHTCSRKEAELGERLKEWEAKGFRVTGSVCDVSVRDQRELLLQDVAGRFAGKLDILINNVGTNHRKPTTEYSADEYSFIMATNLESAYHLCQLAHPLLKASGVASIVFISSVSGVVAISSGSIYGMTKGAMNQLAKNLACEWAKDNIRINSVAPWYIKTSLVEEDLAKEDFVDSIARRTPMRRVGEPEEVSSLVAFLCMPGSSYITGQTISVDGGMTINGMYPTEN

SEQ ID NO: 4522 - protein, 84 aa, Triticum aestivum
DSDMNKPKMRHYVHCYALHCLDEEASNALRSVFKERGENVGAWRQACYKPLVTIAGTQGWDIDAIFNAHPRLAIWYVPTSLSHV

SEQ ID NO: 4523 - protein, 237 aa, Triticum aestivum
  unsure (1)..(237): unsure at all Xaa locations
MGRGKIEIKRIENATNRQVTYSKRRSGIMKKARELTVLCDAQVAIIMFSSTGKYHEFCSTGTDIKGIFDRYQQAIGTSLWIEQYENMQRTLNHLKDINRNLRTEIRQRMGEDLDALEFEELRDLEQNVDAALKEVRQRKYHVITTQTETYKKKVKHSQEAYKNLQQELGMREDPAYGFVDNPAAGGWDGVAAGGWDGVAPVAMGGGXAADMYAFRVVPSQPNLHGMAYGGSHDLRLG

SEQ ID NO: 4524 - protein, 230 aa, Triticum aestivum; identical to SEQ ID NO: 4427
  unsure (1)..(230): unsure at all Xaa locations

SEQ ID NO: 4525 - protein, 197 aa, Triticum aestivum
MIVFVLDLDAQTPAWREIASDGPPLPRSWHSSCTLDGSKLVVSGGCAESGVLLSDTFLLDLTKEKPTWKEIPTSWSSRLGHTFSVYGKTKIFMFGGLAKSGSLRLRSSDAYIMDFGEENPQWRQLATTGFPSVGPPPRLDHVTVSLPCGRIIIFGGSIAGLHSPAELFLLDPAEEKPTWRILNVPGQPPKFAWGHST

SEQ ID NO: 4526 - protein, 258 aa, Triticum aestivum
MPDVWYFLLDWIWKVIEHFNFAPLTAVLSVNYLDRFFSVYPLPEGKAWVTQLLAVACLSLASKMEETYVPLPVDLQVVEATSAFEGRTIKRMELLVLSTLKWRMQAVTACSFIDYFLRKFNDHDAPSMLAFSRSTDLILSTAKGADFLVFRPSEIAASVALAAFGERNTSVVERATTTCKYINKERVLRCYELIQDKIAMGTIVLKSAGSSMFSVPQSPIGVLDAAACLSQQSDDTAVGSPATCYQASSASKRRRIGR

SEQ ID NO: 4527 - protein, 116 aa, Triticum aestivum
IAPLSANTLAKIVGGLCDNLLTCIVRAWDYKKPIFAAPAMNTFMWNNPFTARHIETINQLGISLVPPTTKRLACGDYGNGAMAEPSQIHTTVRLACKSHTFGTGNSPAIPSSSHPV

SEQ ID NO: 4528 - protein, 354 aa, Triticum aestivum
  unsure (1)..(354): unsure at all Xaa locations
MAKEAGGEGAMSESVLRKVLVSYCYVAVWIFLSFTVIVYNKYILDPKMYNWPFPISLTMVHMAFCSSLAVALVRVFRVVDLPSSPAMTTQLYTSSVLPIGALYSLSLWFSNSAYIYLSVSFIQMLKALMPVAVYSIGVLFKKETFRSSSMLNMLSISFGVAIAAYGEARFDLRGVALQLAAVAFEATRLVLIQILLXQGISLNPITSLYYVAPCCLCFLLVPWIFVELPRLRAVGTFQPDFFIFGTNSLCAFALNLAVFLLVGKTSALTMNVAGVVKDWLLIAFSWSVIRDTVTPINLFGYGIAFLGVGYYNHIKLQALKAKEAQKKSAQADEEAGSLLQERDSHSDRKSENQA

SEQ ID NO: 4529 - protein, 130 aa, Triticum aestivum
MISLFAGYGIAGFMFYTITPFVLEMSGATLLNLSLLTSDMWAVAIRVFFYQQQINWLYYLAFAVVAIGLIIYSLNESSSADATAHKHRSSSSLCTTSQVRIPPQEVVLFWTEKKGSSKKLTSVKGATRSD

SEQ ID NO: 4530 - protein, 320 aa, Triticum aestivum
MAIKRTKAEKKIAYDQKLCQLLEEYTKVLIAVADNVGSKQLQEIRKGLRGDSIVLMGKNTLIRRCIKVHSEKTGNKDFLELSNLLVGNVGLIFTKGDLKEVREEVAKYKVGAPARVGLVAPVDVVVPPGNTGLDPSQTSFFQVLNIPTKINKGTVEITIPVELIKKGDKVGSSESALLAKLGIRPFSYGLVICNVYDSGSVFSPEVLDLTEEDLMDKFASGVSMVASLSLAISYPTMAAAPHMFLNAYKNVLAVALETDYSYDHADKIKEYLKDPSKFAVAAPAAAASGGAAAAAPKEEEKKDEPEEESDGEMGFSLFDD

SEQ ID NO: 4531 - protein, 107 aa, Triticum aestivum
MPKAAGDAKLLIQSLTKAYAATPTNLKIIDLYVVFAVATALVQVVYMGIVGSFPFNSFLSGVLSCIGTAVLGVCLRIQVNKDNKEFKDLHQYKLFDVLFLCNMLFFL

SEQ ID NO: 4532 - protein, 388 aa, Triticum aestivum
  unsure (1)..(388): unsure at all Xaa locations
MPVPQHWAELGFFRPAAPPPDMRILQLQQQQAHAPPPPPPPAQPPVAKKSRRGPRSRSSQYRGVTFYRRTGRWESHIWDCGKQVYLGGFDTAHAAARAYDRAAIKFRGVDADINFNLSDYEDDMKQMKGLSKEEFVHVLRRQSTGFSRGSSKYRGVTLHKCGRWEARMGQFLGKKYIYLGLFDNEVEAARAYDKAAIKCNGREAVTNFEPSTYIAELLNEVAAEVXDVDLNLSISQPNXQSPKRDKSSLGLQLHHGSYDGSELKRPKVDAPPEMVAIPHRYPLLTEHPPIWHGQSYPLFLNNEEAARDHSRRPEVATGAVPTWAWRVSHPPPTQPMPLFSSSSSAAASSGFSKTAAAAAPGAPSASFRFDPMAPSSSSSNQHHHHHPR

SEQ ID NO: 4533 - protein, 323 aa, Triticum aestivum
  unsure (1)..(323): unsure at all Xaa locations
MVPFQGLQDRPRRQVRTPRRHLRRVGDSVDLGGIVTGSAFEQHETQLHAALPAVRRNYDVARHVSAGRPPKQEVSDCWCRVSRETPRERAFVLYHLKNFFLDKTEKDREEAMDPGSICSYWSEPRIQLYFLLVHMDAAVTPLLLPFILEFFALGYVXVYRHHIINVYHQRYESGGAVXSNVHLRIIVALIASQLLLLGLLSTKGLEEATPVLLVLPILTFWFHKYCTHRYKPAFVRNPLQEAMRKDTLEHAREPNFDLKSYLADSYLHPVFKSDDVDKFYVAEDPGAEEVIVATKRQSRRTTPVQSKYDGSDRLSVPDSIPER

SEQ ID NO: 4534 - protein, 257 aa, Triticum aestivum
  unsure (1)..(257): unsure at all Xaa locations
SGRPAPKRIAPACAAFSSPIFPHSPLLTPPPFSPLHPPLPARAPYIRASAPGRAVGRGGSPPGGGGAGEAGGGGGRRRCRRIMKKAVPANGKIAKDAKETVQECVSELISFANGITSDTSAASDKCHKEKRKTINGDDPLWAMATLGFEESEVPRQIPLQRERNLSPXTQEASISGEGTVENDVHSEPIKAYLPKDRETEGDRGYAQGTCYXSVKKDALGPHGGASGTSAQGMGQQVAYNPGMVYMQPQYHNGDISK

SEQ ID NO: 4535 - protein, 215 aa, Triticum aestivum
MATSEPVQESWELEPSRPRVLLAASGSVAAIKFESLCRVFSEWAEVRAVATKSSLHFIERSSLPSDVILYTDDDEWSTWTKIGDEVLHIELRKWADIMVIAPLSANTLAKIAGGLCDNLLTCIVRAWDYKKPIFAAPAMNTFMWNNPFTARHIETINQLGISLVPPTTKRLACGDYGNGAMAEPSQIHTTVRLACKSQTFGMGISPVNPSSSRPV

SEQ ID NO: 4536 - protein, 175 aa, Triticum aestivum
KLLGMVTSRDIDFLEGKQNHNIKLENVMTKREDLVVASAGVTLTEANDIIEKSKKGKLPIVNDSDELVALIARTDLKKARSYPDASKDDNKQLLVGAAIGTRENDKERLRLLAAAGVDVVVLDSSQGNSTYQIDMIRYIKQTYPELQVVGGNVVTAAQAKNLIDAGVDGLRVGMG

SEQ ID NO: 4537 - protein, 524 aa, Triticum aestivum
  unsure (1)..(524): unsure at all Xaa locations
MARGGGNGEVELSVGVGGGGGGAAGGGEQPAVDISLGRLILAGMVAGGVQYGWALQLSLLTPYVQTLGLSHALTSFMWLCGPIAGLVVQPCVGLYSDKCTSRWGRRRPFILTGCILICIAVVVVGFSADIGAALGDSKEECSLYHGPRWHAAIVYVLGFWLLDFSNNTVQGPPRALMADLSAQHGPSAANSIFCSWMALGNILGYSSGSTNNWHKWFPFLRTRACCEACANLKGAFLVAVLFLAFCLVITVIFAKEIPYKAIAPLPTKANGQVEVEPTGPLAVFKGFKNLPPGMPSVLLVTGLTWLSWFPFILYDTDWMGREIYHGDPKGTPDEANAFQAGVRAGAFGLLLNSVVLGFSSFLIEPLCKRLGPRVVWVSSNFLVCLSMAAICIISWWATQDLHGYIQHAITASKEIKIVFLALFAFLGIPXLAILVSGPFAVTAQLAAKRGGGQGLCTGVLNIAIVIPQVIIAVGAGPWDELFGKGNIPAFGMASAFALIGGIVGIFLLPKISRRQFRAVSGGGH

SEQ ID NO: 4538 - protein, 372 aa, Triticum aestivum
MMELRKYWGVGGRRCGACEGAAPAAVHCRDCAGYLCTGCDARPAHARAGHERVWVCEVCEVSPAAVTCKADAAVLCAVCDADIHHANPLAERHVRVPIAPICSPEAAAVAAEAMMFCGAGDGEARADQDDVPEQLHQHGGMLNLNVEAGKEGRKMDYLFSDLVDPYLAVDFTRFAHADSVVPSGVATGAVPAVVDLDFACGIGAKPPATYSSSYTANASGAHSGSSSEVSVVPEAICGGVGSFEIDFTRPKPQPYMPAYTAAPPSHGVSAQQAWPVDMGYLTVPERPVAVTGEGRVARLMRYREKRKNRRFEKTIRYASRKAYAESRPRVKGRFAKRTDQDADGDDVDAEAHAVPSSTSYLLDFGYGVVPSF

SEQ ID NO: 4539 - protein, 173 aa, Triticum aestivum
MANDSLTRAQIVGDVLDPFVSSVPLTVMYDGRPVFNGMEFRSPAVSLKPSVEIGGDDFRVAYTLVMVDPDAPNPSNPTLREYLHWMVTDVPSSTNDSFGKEIVPYESPSPTMGIHRMVLVLYQQLGRGTVFAPQARQSFNSRSFARRFNLGKPVAAVYFNCQRPTGTGGRRFT

SEQ ID NO: 4540 - protein, 263 aa, Triticum aestivum
  unsure (1)..(263): unsure at all Xaa locations
MAAAGVSREQRWSLAGATALVTGGSRGIGHAIVEELVGLGARVHTCSENAAELEESRRRWEEMKLPVTVSVCDVSVRAEREKLMETATQTFDGKLDILVNNVGRNVAKASVECTAEEYSHLMSTNLEAAFHLSQLAHPFLRDASIAGGGSVVNISSVASSLGYSTLALYCISKGGVNQLTRSLAAEWAQDKIRVNSVAPGGINTELQNSVDPKVIENTLLRTPMHRXGEPVEVASMVSFLCMPAASFVTGQVMYVDGGRTISG

SEQ ID NO: 4541 - protein, 209 aa, Triticum aestivum
  unsure (1)..(209): unsure at all Xaa locations
MASNQNQASYHAGETKARXQEMTGQVMGATKDMAGQTTEATMQMAGETTEAAKQMAGETAEATKQMAAEAKDKTAQTAQAAKEKTYETAQSAKERAAQGKDXTASTLGEKTEAAKQKAAETTEAARQKAAEATEAAKQKASXTAQYTKESAVAGKDKXGSVLQQAGETXVVNAVXVGAKDAVANTLGMGXGDHTNTTKDTTTEKITRDH

SEQ ID NO: 4542 - protein, 350 aa, Triticum aestivum
  unsure (1)..(350): unsure at all Xaa locations
ASILHWFRSYISIIDKTLVLNSYISMVCSKNTVGQYESHTAFTLPGLYRVVHGIDVFGPRGNIVSPGADMSIYFPFTEKDKRLTALHGSIESLIYAREQNDVHIGHLDDRSKPILFSMARLDRVKNMTGLVEAYSKNAKLRSLVNLVVVAGYNNVKKSKDREEIAEIEKMHELIKTYNLFGQFRWISAQTNXRARNGELYRYIADTHGAFVQPALYEAFGLTVVEAMTCGLPTFATLXHGGPAEIIEHGISGFHIXPYHPDQAATLMADFFEKCKPDPSPGDEPCDRGVRRSQGEETWQRGTERRKTLAGATGSRRHVPKRAGRGARAYLETFYTARAARGFVCARYVHE

SEQ ID NO: 4543 - protein, 281 aa, Triticum aestivum
  unsure (1)..(281): unsure at all Xaa locations
MEGCACIEQFRQTDGLLIKYQYISDFFIALAYFSIPLELIYFAKKSSSFPYRWVLIQFSAFIVLCGATHLINLWTFTMHTRTVAIVMTVAKVSTAVVSCAXTALTLVHIVPDLLGVKTRELFLKXKADELDREMGLVRTQEETGRHVRMLXHEIRSTLDRHTNLXTTLVELGRALGLEECAFWMPPXSGSSLQLTHTLRHPLPGGSSVQINLPVGNQVFSPTRAIIGPHTSPLARIRPVQGRYVPPEVAAVRVPLLAPFNFPNYDWPELSXKSYAIMVLML

SEQ ID NO: 4544 - protein, 201 aa, Triticum aestivum
HSPPLLAAPTTVSSSPLPSLPSAPPPPRARFLRVSGRGMADDDSGSPRGGGGVREQDRFLPIANISRIMKKAVPANGKIAKDAKETLQECVSEFISFVTSEASDKCQKEKRKTINGDDLLWAMATLGFEEYVDPLKIYLQKYRDMEGDSKLTSKSGEGSVKKDIIGAHSGATSSNAQAMVQHGAYAQGMGYMQPQYHNGDT

SEQ ID NO: 4545 - protein, 363 aa, Triticum aestivum
MNHHLESGDYQKLFCRKMESAELQTPLLHGLPDEIALLCLARVPRQYHNALRCVSRGWKTLLCSEEWHSYRKRNNLDESWIYVICRGTGFKCYVLVPDPTTRCLKVIQVMEPPCSGREGVSIETLDRRLFLMGGCSWLKDATDEVYCYDAASNHWSKAAPMPTARCFFVTAALNNKIYVTGGLGLTDKSPNSWDIYDKATDSWFSHKNPMLTPDIVKFVALDDELVTIHKASWNRMYFAGIYDPVDQSWRGKENEIALCWSGPTVVVDGTLYMLDQSLGTKLMMWINETKEWVMVGRLSDKLTRPPCELVAIGRKIYVIGKGLSTVTIDMDMAARVDGFLVSSSTGPLMEHDFSPEKCSVITI

SEQ ID NO: 4546 - protein, 363 aa, Triticum aestivum
MNHHLESGDYHKLFCRKMESAELQTPLLHGLPDEIALLCLARVPRQYHNALRCVSRGWKTLLCSEEWHSYRKRNNLDESWIYVICRGTGFICYVLVPDPTTRCLKVIQVMEPPCSGREGVSIETLDRRLFLMGGCSWLKDATDEVYCYDAASNHWSKAAPMPTARCFFVTAALNNKIYVTGGLGLTDKSPGAWDIYDKATDSWFSHENPMLTPDIVKFVALDDELVTIHKASCTRMYFAGIYDPVDQSWRGKENEIALCWSGPTVVVDGTLYMLDQSLGTKLMMWLNETKEWVMVGRLSDKLTRPPCELVAIGRKIYVIGKGLSTVTIDMDMAARVDGFLVSSSTGPLMEHDFSPEKCSVITI

SEQ ID NO: 4547 - protein, 378 aa, Triticum aestivum
  unsure (1)..(378): unsure at all Xaa locations
MDTSGGGGGAAGGAAQIQGMATHGGRYVLYNVYGNLFEVASKYAPPIRPIGRGAYGIVCAAVSSDTGEEVAIKKIGNAFDNHIDAKRTLREIKLLRHMDHENILAIKDLIRPPRRDDFKDVYIVTELMDTDLHQIIRSNQSLTDDHCQYFLYQLLRGLKYVHSANVLHRDLKPSNLFLNANCDLKIADFGLQRTTSETDLMTEYVVTRWYRAPELLLNCSQYTAAIDVWSVGCILGEIITRQPLFPGRDYIQQLKLITELIGSPDDSSLGFLRSDNARRYMKQLPQYPRQDFRLRFRNMSDGAVDLLERMLVFDPSRRITVDEALHHPYLASLHDINEEPTCPAXPFSFDFEQPSFTEEHMKELIWRETLAFNPDPPY

SEQ ID NO: 4548 - protein, 358 aa, Triticum aestivum
MAEADITRYWCHECQQAVEEAMVEELKCPLCDGGFVEEMTLEQVEALVSQLSEQGPTQWDPLDNPFEQAGSPGDSDDEDNSDIGREFEGFIRKHRRASALPLLDIGREFEGFIRRHRRASALRRVLDSIHDDLRDDRERDNSVLISAFNQALALQGAALDPDEDRGDHGNANNDDGLLDEYVLGAGLSLLLQHLAENDPSRYGTPPTKKEAVEALPTVKIEEVVSCSVCLDDLDIGSQAKQLPCEHKFHSPCILPWLELHSSCPVCRFELPSDETKDLSEPSNVDRIESSHEEARADGPGNNGEDSNTNDREDSNRPWALVPWFNGLFSTPEPQTVRATLTDQQLPPASGTNPNAGHS

SEQ ID NO: 4549 - protein, 371 aa, Triticum aestivum
  unsure (1)..(371): unsure at all Xaa locations
MAEADITRYWCHECQQAVEEAMVEELKCPLCDGGFVEEMTLEQVEALVSQLSEQGPTQWDPLDNPFEQAGSPGDSDDEDNSDIGREFEGFIRRHRRASALRRVLDSIHDDLRXQGNDIGREFEGFIRRHRRASALRRVLDSIHDDLRDDRERDNSVLISAFNQALALQGAALDPDEDRGDHANANNDDGLLDEYVLGAGLSLLLQHLAENDPSRYGTPPTKKEAVEALPTVKIEEVVSCSVCLDDLDIGSQAKQLPCEHKFHSPCILPWLELHSSCPVCRFELPSDETKDLSEPSNVDRIESSHEEARADGPGNNGEDSNTNDREDSNRPWALVPWFNGLFSTPEPQTVRATLTDQQLPPASGTNPNAGHS

SEQ ID NO: 4550 - protein, 101 aa, Triticum aestivum
MAAGGVWVFKNGVMELEQEAASRKALVYMPANETMRSLEALERRLGSLGWERYYEDRAIVQLHKRGGVDLISIPRDFSRLRSIHMYDVVVKNRDHFKVVDL

SEQ ID NO: 4551 - protein, 372 aa, Triticum aestivum
  unsure (1)..(372): unsure at all Xaa locations
GRNRGRPAPRRDGGAYFYTDTARAARAAGGAPARLEMAPMAANAAWHMGEWDQMSEYVSRLDDGDENKLRSLGNTTASGDGSSNGAFFRAVLSVRCKKYEEARVYVERARRCLATELAPLVLESYERAYNNMVRVQQLSELEEVIDYCTLLMESPIADGRRELIRADAWERIKGTKRNVEVWQALLAVRELVLPPNEDRDTWIKFAKLCWKSGRISQAKSTLVKLLQFDPESSPELTLYHGHPQVVLAYLKYQYAVGDELKRKDAFSRLQDLAVQIATATNSYSGMLASHGAITSAGVPLTARVYLTLASWKRALSPGLDDDAIQEILVSYKNATLSAKDWGKAWHSWALXXTEVMSRYTLRXRPXIXXXYV

SEQ ID NO: 4552 - protein, 245 aa, Triticum aestivum
  unsure (1)..(245): unsure at all Xaa locations
MDPSGAFARSSSNVSLASLVRSGSGGSSGSSGSSRGRGGSRRMVRRVLRGVITFIFAIAGLFLGAVTGGLIGLATESGLFRGTGIGAITGALVSIEVVDSSIRLWRSXRRSGIWSILYVLNVIYSLLTGRLVREKVDPAVQRVVRSQMNAVDSSQFREAPDLFEIEGTNGMPRXASIEKLPEGTITEEYNRNAVGDLYGCSVCLQDFQIGEKVRSLPDCLHVFHVPCIDGWLIKHGSCPLCRRKL

SEQ ID NO: 4553 - protein, 245 aa, Triticum aestivum
  unsure (1)..(245): unsure at all Xaa locations
MDPSGAFARSSSNVSLASLVRSGSGGSGSSRGRGGAGGSRRMVRRVLRGVITFIFAIAGLFLGAVTGGLIGLATESGLFRGTGIGAITGALVSIEVVDSSIRLWRSRRSGIWSILYVLNVIYSLLTGRLVREKVDPAVQRVVRSQMNAVDSSQFREAPDLFEIVXFLSISRAFIDKSVPRALSPEEYNRNXAVGDLSXGCSVCLQDFQIGEKVRSLPDCLHVFHVPCIDGWLIKHGSCPLCRRKL

SEQ ID NO: 4554 - protein, 348 aa, Triticum aestivum
  unsure (1)..(348): unsure at all Xaa locations
MRGSLWLLLLLLSHQISKYFRPYLIISLGGHTGARAWFPGSADGLSDYRDNIPASGSQIQNGGPAVTSDVVAKQNEWWAEIMNDDWRDILDATAADPQSKXAVNQPASSHGGEICNVASPPNSNSAAKQRMRWTPELHECFVDSVNKLGGSEKATPKGVLKLMKVDGLTIYHVKSHLQKYRTARYKPDLTEGTAEKRTTTEELTLDLKSSMDLTEALRLQMEVQKRLHEQLETQRKLQLRIEEQGKYLQMMFEKQSKSNTEKVQDLSSGATTTLSSEPSHPATRNRGDDAADDLNRTGENPVSAEIGETLMHAGGNQEMAESESSDPLANTNDGSKAPQEKPRRVHDS

SEQ ID NO: 4555 - protein, 359 aa, Triticum aestivum
  unsure (1)..(359): unsure at all Xaa locations
MRGSLWLLLLLLSHQISKYFRPYLIISLGGHTGATWFPGSADGLSDYRDNIPASGSQIQNGGPAVTSDVVAKQNEWWAEIMNDDWRDILDATAADPQSKSMVQPSNSAASQPAVNQPASXHGGEICNVASPPNSNSAAKQRMRWTPELHECFVDSVNKLGGSEKATPKGVLKLMKVDGLTIYHVKSHLQKYRTARYKPDLMEGTAEKRTTTEELTLDLKSSMDLTEALRLQMEVQKRLHEQLETQRKLQLRIEEQGKYLQMMFEKQSKSNTEKVQDLSSGATTTLSSEPSHPATRNRDNDAADDLNRTGENPVSAEIGETLMHAGGNQEMAESESSDPLANTNDGSKAPQEKRRRVHDS

SEQ ID NO: 4556 - protein, 194 aa, Triticum aestivum
MRTDVRRGAAAAGRDQFPVGMRVLAVDDDPVCLKVLETLLRRCQYHVTATNQAVIALRMLRENRDMFDLVISDVHMPDMDGFKLLELVGLEMDLPVIMLSVNGETKTVMKGITHGACDYLLKPVRIEELRNIWQHVVRRKFSTRDSVNLDTYEECNKPPSADSDYVYGQVTCGSPDQSGRPSKERKEYQYEEED

SEQ ID NO: 4557 - protein, 391 aa, Triticum aestivum
  unsure (1)..(391): unsure at all Xaa locations
MSSTDADAVPVAVAPAKRPPINKYAFACALLASMNSVLLGYDISVMSGAQLFMKEDLKITDTQIEILAGIISIYSLLGSLMAGLTSDWLGRRYTMVLAAAIFFTGALLMGLAPNYAFLMAGRFVAGIGVGYALMIAPVYTAGVLPTAPRGFLTTFPEVLXNFGILLGYVSNFAFARLPVHLSWRAMFLVGAVPPVFLGFAVLAMPESPRWLVMRGRIEDARRVLLRTSDSPEEAEERLLDIKKVVGIPADATDADDVVAIVRANEAARGQGVWKELLINPSRPVRRMLVAGLGLMFIQQATGVDCVVMYSPRVFEKAGMKNRTNSLGASMAVGXCKTFFIPIATLLLDRVGRRPLLLASXAGMAIFLFTLATSLLMLDRRPESEGEGAGAR

SEQ ID NO: 4558 - protein, 183 aa, Triticum aestivum
MKKLKKCAEAADVAKSQFLATVSHEIRTPMNGVLGMLQMLMDTDLDTTQQDYVRTAQASGKALVSLINEVLDQAKIESGKLELEAVPFDLRLVCDDILALFWGKAHEKGLELAVYVSDQVPQTLIGDPGRMRQIITNLMGNSIKFTERGHIYLAVHVGEEVVTGFQVASDFQNTNNTYNTLSG

SEQ ID NO: 4559 - protein, 431 aa, Triticum aestivum
  unsure (1)..(431): unsure at all Xaa locations
MDATTAKQLRRLRTLGRGASGAVVWLASDDASGQLLAVKSAGAGAADTLRREGSVMAGLCSPHIVPCLGSRAAPGGEYQLFLEFAPRGSLADEAARSGGSLAERAIQGYAADVARGLAYLHGNSLVHGDVKARNVMVGADGRAKLADFGCARAADSDRTIGGTPAFMAPEVARGEEQGLAADVWALGCTVIEMATGRAPWSGMDDVFAAVHRIGYTDAVPEXPASLSPQAKDFLRKCFARNPRHRSTAAQLLEHPFLASAFRDVDAEPAKQDWVMSPESTLNADFWEXSDEESETEDMLTSAAERIXSLASPCSALPDWESDDGWIVVHGGRPEASETTTPTAIAGTDFGPWSEEGLEAEVDVHFAGADAGRWYDLVRNVDGAHYFGWYERDLGVSVVTDRPLCLIVSHGRKIVKFGCHCDRERTMHFDFA

SEQ ID NO: 4560 - protein, 214 aa, Triticum aestivum
  unsure (1)..(214): unsure at all Xaa locations
SHPHHTPHTTTALSPAPIEHHTRRRGEAHGGALTCPASSNGRRRQDYILRPYEQCSRLGARARARSGLTYVHTRRRPYERSVIMAGMLPGVECARRRRMWQGGGAGADQAAAGTRRLSFCLYAAGHGAAHAVGTGNSGNKQRSGAMDGWALDSNAREAKERLDQKLKSKSTGPDTVIKRHHSTGSIKLGXXNGXGGGGGXXGSSAXXAXXVXXE

SEQ ID NO: 4561 - protein, 171 aa, Triticum aestivum
IAAKVDEYARGMISGSGSSLFEELGLYYIGPVDGHNIDDLITILREVKGTKTTGPVLIHVITEKGRGYPYAERASDKYHGVAKFDPATGKQFKVPAKTLSYTNYFAEALIAEAGQDSKIVAIHPAMGGGTGLNYFLRRFPNRCFHVGIAEQHAATFPPRLACEGLKPFCAI

SEQ ID NO: 4562 - protein, 133 aa, Triticum aestivum
MEMKLTIKRVPTVLSNYQEEGGGGCGRNCLGDCCLPASKLPLYAFKADPKKPAQDDELPTEFFLNSLLLAQWEDRVARGLFRYDVTACETKVIPGELGFVAQLNEGRHLKKRPTEFRVDRVLQPFDSAKFNFT

SEQ ID NO: 4563 - protein, 177 aa, Triticum aestivum
PSGTATAALINGFHTPQGDKNARQQVRGFLKYFGISFFWSFFQWFYTGGDVCGFLHFPTFGLRAWKQTFFFDFSLTYVGAGMICSHLVNLSLLFGAVLSWGVMWPLMSKQEGKWYSAKASASSMTGLYGYKVCVSVCVTEFMHNSLDCPLHPCPGLPLHCAAHWRRLLQLPQSHPRH

SEQ ID NO: 4564 - protein, 126 aa, Triticum aestivum
  unsure (1)..(126): unsure at all Xaa locations
NARQQVRXGFLKYFGISFFWSFFQWFYTDGNVCGFRRFPTFGLKTXKXTFFFDFSLTYVGAGMICSHLVNLSLLFGAVLSWGVMWPLMSKXEGKWYSAKASASSMPGLSTVYDIIVPELASFVSLN

SEQ ID NO: 4565 - protein, 134 aa, Triticum aestivum
  unsure (1)..(134): unsure at all Xaa locations
MEGESFSGMGNGGGGGGGGGHHQVVDGKXIQTFHKSFVQVQSILDQNRMLISEITQNHESRAPDSLTRNVGLIRELNNNIRRVVGLYADLSASFAHRGAAMDGGSSEGDSSGTLRSSDAAGRAAAAGQKRVRPG

SEQ ID NO: 4566 - protein, 273 aa, Triticum aestivum
MDAQYNPRTVEEVFRDYKGRRNGLARALTTDVEEFFRQCDPEKENLCLYGFPNEHWEVNLPAEEVPPELPEPALGINFARDGMQEKDWLSMVAVHSDAWLLSVAFYFGARFGFDKSDRKRLFGMINELPTIFDVVSGKSKTKAPTNNNHSNSKSKSNNKMKTSEPRAKQPKPQLKEEDHEDEAPDAGEDGGGAAGGGGGGGEEHGDTLCGACGDNYGQDEFWIGCDMCEKWFHGKCVKITPAKAEHIKQYKCPSCMGANGGGSGSNKRARPSS

SEQ ID NO: 4567 - protein, 179 aa, Triticum aestivum
MASNQNQASYAAGETKARTEEKTGQMVGATKDKAGQATEATKQKAVETAGATKQKAGEAKDKTAQTAQAAKDRAAESKDQTGSFLGEKTEAAKQKAAETAEAAKQKASEAAQYAQERSSDAAQYTKESAVAGKDKTGSVLQQAGETVVGAVVGAKDAVANTLGMGGDNATTKDTTTRNH

SEQ ID NO: 4568 - protein, 155 aa, Triticum aestivum
MASNQNQASYMAGETKARTEEKTGQMMDKAGQATEATKQKAGETAEATKQKAGEAKDKTAQTAQAAKDRAAESKDQTGSFLGEKTEAAKQKASETAQYAQDRSSDAAQYTKESAVAGKDKTGSVLQQAGETVVSAVVGAKDAVANTLGMGGDYTT

SEQ ID NO: 4569 - protein, 211 aa, Triticum aestivum
  unsure (1)..(211): unsure at all Xaa locations
MASNQNQASYMAGETKARTEEKTGQMMDKAGQATEATKQKAGETAEATKQKAGEAKDKTAQTAQAAKDRAAESKDQTGSFLGEKTEAAKQKAAEATEAAKQKTSETAQYAQERSSDAAQYTKESAVAGKDKTSGVLQQASETVVNAVVGAKDAVANTLGMGGDNTNTAKDTTTEXDHQGSLANLLPLLVWSFAGLLHNCRFPSCVISAHLV

SEQ ID NO: 4570 - protein, 217 aa, Triticum aestivum
  unsure (1)..(217): unsure at all Xaa locations
MASNQNPASYHAXGETKARTEEKTGQVMGATKDKAGQTTEATKQKAGQTTEATKQKAGETAEATKQKAGQATEATXQKAGETAEATKQKAAEAKXKTAQTAQAAKERAAETXDQTGSNLGEKTEMAKQKAAETTEAAKQKASETAQYTKESAVAGKDKTGXSVLQQAGETRWPNGRRAGAKEASVANTLGMGGDNATKDTTTGATTKDTTTTTTRNH

SEQ ID NO: 4571 - protein, 212 aa, Triticum aestivum
MASNQNQASYHAGETKARTEEKTGQVMGATKDKAGQTTEATKQKAGQTTEATKQKAGETAEATKQKAGQATEATKQKAGETAEATKQKAAEAKDKTAQTAQAAKERAAETKDQTGSYLGEKTEMAKQKAAETTEAAKQKASETAQYTKESAVAGKDKTGSVLQQAGETVVNAVVGAKDAVANTLGMGGDNATKDTTTGATTKDTTTTTTRNH

SEQ ID NO: 4572 - protein, 224 aa, Triticum aestivum
MASNQNQASYHAGETKARNEEKTGQVMGATKDKAGQTTEATKQKAGETTEATKQKAAETTEAAKQKASETAEATKQKAAEAKDKTAQTAQAAKEKTYETAQSAKERAAQGKDQTASTLGEKTEAAKQKAAETTEAARQKAAEATEAAKQKASETAQYTKESAVTGKDKTGSVLQQAGETVVNAVVGAKDAVANTLGMGGDNTITTKDNTTGATTKDTTTTTRNH

SEQ ID NO: 4573 - protein, 300 aa, Triticum aestivum
KNNNKFIIDFLMGGVSAAVSKTAAAPIERIKLLIQNQDEMIKQGRLSTPYKGIGDCFARTMKDEGAISLWRGNTANVIRYFPTQALNFAFKDKFKRMFNKDKNRDGYWAWFAGNLASGGAAGAASLFFVYSLDYARTRLANDAKSAKKGGERQFNGLVDVYKKTLKSDGIAGLYRGFNISCVGIIVYRGLYFGMYDSIKPLMPQNLQDSFLATFALGWAVTTGSGLASYPIDTVRRRMMMTSGAAVKYDSSLHCFREILANEGAKSLFKGAGANILRAIAGAGVLSGYDYLQVWMFGKKY

SEQ ID NO: 4574 - protein, 473 aa, Triticum aestivum
  unsure (1)..(473): unsure at all Xaa locations
MAAAAVAADSKIDNLRDAVAKLGEISENEKAGFISLVSRYLSGEAEQIEWSKIQTPTDEVVVPYDTLAPPPEDLDAMKALLDKLVVLKLNGGLGTTMGCTGPKSVIEVRNGFTFLDLIVIQIESLNKKYGCSVPLLLMNSFNTHDDTQKIVEKYSNSNIEIHTFNQSQYPRIVTEDFLPLPSKGQXGKDGWYPPGHGDVFPSLNNSGKLDTLLSQGKEYVFVANSDNLGAIVDIKILNHLITNQNEYCMEVTPKTLADVKGGTLISYEGRVQLLEIAQVPDEHVNEFKSIEKFKIFNTNNLWVNLKAIKRLVDAEALKMEIIPNPKEVDGVKVLQLETAAGAAIRFFEKAIGINVPRSRFLPVKATSDLLLVQSDLYTLVDGYVIRNPARVKPSNPSIELGPEFKKVANFLARFKSIPSIVELDSLKVSGDVSFGSGVVLKGNVTIAAKAGVKLEIPDGAVLENKDINGPEDL

SEQ ID NO: 4575 - protein, 114 aa, Triticum aestivum
  unsure (1)..(114): unsure at all Xaa locations
PTRPPTRPRTRGRRATTPAARPKHYRPGGKKKEGNAVKYITRTKAVKYLQISLAVFKKLCILRGVFPRRPKRKXGGDHQTYYHIEDLGFPGHGPLVEKVKGIKGHKKEGKKAMA

SEQ ID NO: 4576 - protein, 106 aa, Triticum aestivum
HLHQLHVCLPSSTNKTRLLYRMSLDFAPWMKHMPFMHLLWSHFAEKVLNEDLRLVLGQQDRMNNGANVWNWPVSYDKLGIRYRLWRDAVERGVDRLPFSNEIESGS

SEQ ID NO: 4577 - protein, 113 aa, Triticum aestivum
VEKCMRNAHHLVSRLREKGVSAYLNDLTNTVVFERPRNEAFVHKWQLACERGIAHVVVMPSVRVEKLDVFVEELAVGRRMWHEGGGFSMSCVAEDTGEGNCLCDVHAKKSIAA

SEQ ID NO: 4578 - protein, 217 aa, Triticum aestivum
  unsure (1)..(217): unsure at all Xaa locations
EMRYLLAIWKAGRXSTXGEGRARRRRDRGEGWGRFYGILLGGILLMYELHNFLRPLLFLMYSFWIPQIVTNVIRDTRKPLHPQYILGMTATRVAIPLYIFGCPSNFMRIEPDKKWCIAVTAFMGIQAAVLLLQHYLGSRCFIPRQILPEKYCYHRKVEDSTNQPIDCVICMTTIDLSQRTSEYMVAPCEHIFHSGCLQRWMDIKMECPTCRRSLPPA

SEQ ID NO: 4579 - protein, 215 aa, Triticum aestivum
MWGMARIDEWKPVIAMLIFDLISAVTTALIKAALEEGLDRLVLITLRQLVATVFLSPIAFFKERNTRPKLTLEILVYLFFSAALGAALSQYTFFYGLQYTTATFAITFTNLAPVLTFLIAVLLRVESLNMKNKAGAAKIIGTLMSFAGVMLLTLYKGVALTHQAEPSGQHAEAAAAAESGKKSWTLGTLALLANCLCFSFWLLLQSKLTKKYPAL

SEQ ID NO: 4580 - protein, 379 aa, Triticum aestivum
  unsure (1)..(379): unsure at all Xaa locations
MATAGKVIKCKAAVAWEAGKPLSMEEVEVAPPQAMEVRVXILFTSLCHTDVYFWEAKGQTPMFPRIFGHEAGGIVESVGEGVTELAPGDHVLPVFTGECKECPHCKSAESNMCDLLRINTDRGVMIGDGKSRLSIEGVPACLFVVTXTFNELPSGSKVCVPSMYPSSALSVCVIICSYLHGLRGAINLQTAIGXRSVAIFGAYELFEFAAAEGARIEMANGSSGAHVFAGRCKEDANLDCTEFENPQGHTQRGRQVPAERTQGGVDRNDECTGNGNAMKQAFECVHDGWGVAVLVGVPHKDAEFKTHPMNFLNERTLKGTFFGNFKPRTDLPNVVEMYMRKELEVEKFITHSVPFSEINKAFDLMAKGEGIRCIIRMEN

SEQ ID NO: 4581 - protein, 372 aa, Triticum aestivum
  unsure (1)..(372): unsure at all Xaa locations
YKCTAAVACEARKPLSMXEVEVAPPQALXVRVKILFTSLCHTDVYFWEAKGQTPMFPRIFGHEAGGIVESVGEGVTXLAPGDHVLPVFTGECKECPHCKSAESNMCDLLRINTDRGVMIGDGKSRFSIDGKPIYHFVGTSTFSEYTVMHVGCVAKINPEAPLDKVCVLSCGISTGLGASINVAKPPKGSTVAIFGLGAVGLAAAEGARIAGASRIIGIDLNASRFEEARKFGCTEFXNPKDHTKPVQQVLAEMTNGGVDRSVECTGNVNAMIQAFECVHDVXLAKTLIIHSSMIILHCLFSLDENLNSVIYIQGWGVAVLVGVPHKDAEFKTHPMNFLNERTLKGTFFGNFKPRTDLPNVVEMYMRKVNRNR

SEQ ID NO: 4582 - protein, 405 aa, Triticum aestivum
  unsure (1)..(405): unsure at all Xaa locations
LHFDDALSLDPSAVAAAVAWEAGKPLSMEEVEXVAPPQXAMEVRVKILFTSLCHTDVYFWEAKGQTPMFPRIFGHEAGGIVESVGEGVTELAPGDHVLPVFTGECKECPHCKSAESNMCDLLRINTDRGVMIGDGKSRFSIDGKPIYHFVGTSTFXEYTVMHVGXCXAKINPEAPLDKVCVLSCGISTGXLGASINVAKHQRVRPVAIYGXGAVGLAAAERCRIAGASRIIWCXLXTPADFERSXKTLACHGIVNPEDHTSQXQQVLAEXMTNGLXFGTAXFXRCPGGHTVTVVVTHKAXGTCVFHXNGXGVYDIDAGWVMPHKDARIIKNPPDXTSVNERTLEGTFFGNFKPRTDLPXVVEMYMRKELEVEKFITHSVPFSEINKAFDLMAKGEGIRCIIRMEN

SEQ ID NO: 4583 - protein, 153 aa, Triticum aestivum
RKQKWTSEEEAALRAGIARYGVGSWRLILKDDDFRSILSCRSNVDLKDKWRNINVFFTESGSMDKGRTAMKKNRATPRRNDHPMAKSTVASDVDDEIVDEQPIASVSSELWNVSIPKKSRSRLNNIILESGKNLNEPTRSHSTTIAKYIEEEF

SEQ ID NO: 4584 - protein, 186 aa, Triticum aestivum
MDRHDLGASGEIEKTPREAAAPDMESEPAAARAAERVPPWREQVTVRGMVAALLIGVVYTVIVMKLSLTTGLVPTLNVSAALLAFLALRGWTHALHRLGIACRPFTRQENTVVQTCAVACYTIGFGGGFGSFLLGLDKKTYELSGVNTPGNVPGSYKDPGIGWMMGFLLAISFVGLLTLLPLRKVL

SEQ ID NO: 4585 - protein, 164 aa, Triticum aestivum
  unsure (1)..(164): unsure at all Xaa locations
GQRACRXSFYTNGGLKLRVVWTISSLIGGSTRHYLLRSIIKERPTLVSLVLTDADGQGTLTMGAEQLKEFRENQLSASACSNRTQVPACNMKLKYAPYLELPGGIALQGATLVAIKPSTEGSNGGHISRKETDAFISGAFDGPFKFALKALMKRRTYLLEMNGF

SEQ ID NO: 4586 - protein, 239 aa, Triticum aestivum
  unsure (1)..(239): unsure at all Xaa locations
AAQTVTVLVRNIPPDPDESIGELAEHFFLVNILTLSTHQVVYNANKLAKLVKEKKKMQNWLDYYQLKYERNTSKRPTVKTGFXLGCFGSKVDAVEHCASEIERIEKEEAEEREKIXEGXKLVVPAAFVSFRTRWGAXVCAQTQQTSNPTXWLTEWAPEPRDVYWDXNLSIPIVHLTVRKVDXFAVAFFFLNFFXVIPIAXXVQSLAILKGIEKGSSXFLKPIIEMPTIKIVIXKGSFPG

SEQ ID NO: 4587 - protein, 164 aa, Triticum aestivum
GCRLTAIFDSCHSGTVLDLPYVYSTKGEIKENNLFKHAGMGILSAGIQYARGDKDGALSSIMSLGKQLLESRQISDGVRERNTTLADVIMFSGCKDDQTSADAKEAGRATGAMSYALTTSLRQDPYQSYHQLLNSLRQILRDKYSQRPQMSASHPIDVNLPFKC

SEQ ID NO: 4588 - protein, 452 aa, Triticum aestivum
  unsure (1)..(452): unsure at all Xaa locations
MSPTPGDREPLVHSRHRAESRVDSPPDPAMDSASRVAPPPVSAGVRVRAPLVESVSCYCRLDTGLKTVVDARKFASGAKMCMQPDVKQTKRKSRGSRKERCRAQAPLLPGLPDDLAIACLIRVPRVEHPNLRTVCKRWNRLLSGNYYYSLRKKLSMAEEWVYVFKRDREGKIAWQAFDPLNQLWKSLPPVPPEYSEKRWGFGCAXVLSGCYLYLFGGKDPLRGSMRRVVFYNARTNKWHRAPDMLRKRHFFGSCVINNCLYVAGGECEGIQRTLQSAEVYDPNRNRWVCIPEMNNGMVPFIGVVYDDKWFLKGLDSHRQVTCEVYLPSSNLWSTIDDEMVTGWRNPSISFNGRLYSSDCRDGCKQXHPGRARASEAAGLVSLNGKLCIIRNNMSITLVDILHPTMSIETDSACMWETVARKGQHXSFVANLWSTIAGRNLKSHIIHCQVLQI

SEQ ID NO: 4589 - protein, 538 aa, Triticum aestivum
MGYQVVAAQLARLSGALGTSDHASVVSITLFVALLCACIVLGHLLEENRWLNESITALIIGLCTGVVILMTTKGKSSHVLVFSEDLFFIYLLPPIIFNAGFQVKKKQFFRNFMAITLFGAVGTMMSFFTISLAAIAIFSRMNIGTLDVSDFLAIGAIFSATDSVCTLQVLNQDETPFLYSLVFGEGVVNDATSVVLFNALQNFDPNQIDAIVILKFLGNFCYLFVSSTFLGVFTGLLSAYVIKKLYIGRHSTDREVALVMLMAYLSYMLAELLDLSGILTVFFCGIVMSHYTWHNVTESSRVTTKHAFATLSFIAETFLFLYVGMDALDIEKWKFASDSPGKSIGISSILLGLVLVGRAAFVFPLSFLSNLTKKTELEKISWRQQIVIWWAGLMRGAVSIALAYNKFTRSGHTQLHGNAIMITSTITVVLFSTMLFGILTKPLIRFLLPASSNGAASDPASPKSLHSPLLTSQLGSDLEAPLPIVRPSSLRMLITKPTHTIHYYWRKFDDALMRPMFGGRGFVPYSPGSPTDPNVLVE

SEQ ID NO: 4590 - protein, 409 aa, Triticum aestivum
MAAATTTASRPLLLSRQQAAASSLQCRLPRRPGSSLFAGQGQASTPNVRCMAVVDTPSAPAVAPARKRSSYDMITLTTWLLKQEQEGVIDNEMTIVLSSISTACKQIASLVQRAPISNLTGVQGATNVQGEDQKKLDVISNEVFSNCLRWSGRTGVIASEEEDVPVAVEESYSGNYIVVFDPLDGSSNIDAAVSTGSIFGIYSPSDECHIGDDATLDEVTQMCIVNVCQPGSNLLAAGYCMYSSSVIFVLTIGTGVYVFTLDPMYGEFVLTQEKVQIPKSGKIYSFNEGNYALWDDKLKKYMDSLKEPGTSGKPYSARYIGSLVGDFHRTMLYGGIYGYPSDQKSKNGKLRLLYECAPMSFIAEQAGGKGSDGHQRVLDIMPTEVHQRVPLYVGSVEEVEKVEKFLSSE

SEQ ID NO: 4591 - protein, 481 aa, Triticum aestivum
MGSYSPISVSYALVGVAAAAAAQTAAQMLPRQCFKHVFPAEGSSSSILHGPGSRGAGSRGRTTLNFHRCCVRASLWRTDHLHISTARSSEIKVHTLLQVPDVFNTIKSWSKLQLVTVTGLAACVVLLVPSAGATDALKTCTCLLKECRIELAKCIANPSCAANVACLNTCNNRPDETECQIKCGDLFENSVVDEFNECAVSRKKCVPKKSDVGEFPVPDPSALVKNFNMADFRGKWYISSGLNPTFDTFDCQLHEFRLEGDRLVANLAWRIPTPDTGFFTRGAVQRFVQDSSQPAILYNHDNEYLHYQDDWYILSSKIENKDDDYIFVYYRGRNDAWDGYGGAVVYTRSKELPETIVPELERATKSVGRDFSTFIRTDNTCGAEPPLADRIERTVEKGEKLIVDEVKEIEGEIEGEVKELEREEETLVKRLADGIMEVKQDVMNFFQGLSKEEMEILDQLNLEATEVEELFSRSLPIRKLR

SEQ ID NO: 4592 - protein, 241 aa, Triticum aestivum
  unsure (1)..(241): unsure at all Xaa locations
PRVRGRVGSSKNAWEDAVPLSRKTEASPADAQARHDDDDIDEDMDGEGDGAVYYLSKSGDVMVSSTQRSAARQYSSAVTCRSDGGEAVAYFLSHSGAVVACDLARRVFTELPRILPVHFEYSIDVVACDGRAYVVVLSEYLDTASLRXLWEFSDGAWRHVAAMPPAMSHALYGKKADVNCVGHGGRVMVCVSSGDAGANGCFMCDVGSNAWEELPRCAGGDGEAMDFVAAFSFEPRMEAAV

SEQ ID NO: 4593 - protein, 208 aa, Triticum aestivum
MTFYGTQDKCKACDKTVHFIDLLTADGIPYHKYCFKCSHCKGTLSMCSYSSMDGVLFCKTHFEQLFKETGSFKKNFPTCAKANNEQSKVPNKYGSVFCGTQDKCAACKKTVYPLEKMTLEGEPYHKTCFKCAHGGCILTTASYASLNGILYCQNHFWQLFKETGSYSNLLKPASAKNADEPEAAKEEEQAPEAVEDQVPEAVEDQEHS

SEQ ID NO: 4594 - protein, 113 aa, Triticum aestivum
MALAKAKEIVASAPVVVFSKSYCPFCVQVKKLFTQLGASFKAIELDTESDGTEIQSALAEWTGQRTVPNVFINGKHIGGCDDTIALNKGGKLVALLTEAGAISGSSSKTTVTA

SEQ ID NO: 4595 - protein, 129 aa, Triticum aestivum
  unsure (1)..(129): unsure at all Xaa locations
MGTAFSSSSSTPESRAMALAKAKEIVASAPVVVFSKSYCPFCVQVKKLFTQLGASFKAIELDTESDGPEIQSALAEWTGQRTVPNVFINGKHIGGCDDTVALNKGGKLIXLLTEAGAISGSSSKTTVTP

SEQ ID NO: 4596 - protein, 664 aa, Triticum aestivum
TRIARRIEAEETGLDTAEMVVTSTKQEIEEQWGLYDGFDLMVERKLRVRQRRGVSSLGRYMPRMAVIPPGMDFSFVDTQDTADGDGADLQMLIDPVKANKALPPIWSEVLRFFTNPHKPMILALSRPDPKKNVTTLLKAYGESRKLRELANLTLILGNRDDIDDMAGGGGTVLTAVLKLIDRYDLYGQVAYPKHHKQTDVPHIYRLAAKTKGVFINPALVEPFGLTIIEAPAYGLPLVATKNGGPVDILKALHTGLLVDPHSREAITGALLSLLADKGQWLESRRNGLRNIHRFSWPHHCRLYLSHVAAYCDHPSPHQRLRVPGVPAASASMGGDDSLSDSLRGLSLQISVDASNDLNAGDSAALIMDALRRRPAADRREGSGRALGFAPGRRQRLLVVAVDCYGDDGKPDVEQLKKAIDAAMSASDGAGGRQGYVLSTGMTIPGTPHAPKACGADPAGFDALICSSGAEICYPWKELTADEEYSGHVAFRWPGDHVKTVVPRLGKAEDAQASDLAVDVSAGSVHCHAYAATDASKVKKVDSIRQALRMRGFRCNLVYTRACTRLNVIPLSASRPRALRYLSIQWGIDLAKVAVLVGETGDTDREKLLPGLHRTLILPGMVSRGSEQLVRGEDGYATQDVVAMDSPNIVTLAQGQAVSDLLKAM

SEQ ID NO: 4597 - protein, 199 aa, Triticum aestivum
TCNTWLGAFLSVLGVGILELSGSPPCVGDLLTLLSAFCFGIHMLRTEHISRKMKKENFLPLVGCQVVVVAVVSAVSFIVKCFLQNVVPWNLKSGTPTELFSMMSSFPWLAILYTGIIATTFCLWAEIVAMRDVSATETAIIYGLEPVWGDTFAWAIHGERWGITGLIGAIFIIAGSLMVQVLGSFLDIDVSEDSYQMNS

SEQ ID NO: 4598 - protein, 495 aa, Triticum aestivum
MVLSHAASAGSSDESVHSTFASRYVRASLPRFRMPENSIPKEAAYQIINDELMLDGNPRLNLASFVTTWMEPECNKLMMDSINKNYVDMDEYPVTTELQNRCVNMIAHLFNAPLGETETAVGVGTVGSSEAIMLAGLAFKRRWQNKMKAAGKPCDKPNIVTGANVQVCWEKFARYFEVELKEVKLSEGYYVMDPEKAVEMVDENTICVAAILGSTLNGEFEDVKMLNDLLVKKNEETGWDTPIHVDAASGGFIAPFLYPELEWDFRLPLVKSINVSGHKYGLVYAGIGWCIWRSKEDLPDELIFHINYLGADQPTFTLNFSKGSSQVIAQYYQLIRLGFEGYRNIMDNCQENAMVLKEGLERTGRFNIVSKDQGVPLVAFSLKDSSRHDEFEISEFLRRFGWIVPAYTMPPDAQHVTVLRVVIREDFSRTFAERLVIDIEKVLHELDALPSRSSGPALQHPNGDTVSEKDLARQREVVSVWKRAVAARKKTQGVC

SEQ ID NO: 4599 - protein, 252 aa, Triticum aestivum
  unsure (1)..(252): unsure at all Xaa locations
MAAAAEQDYWGLFREETGWYNEIFLSAVVPGGGGWWRALPHPLRSWLRNCIGGYLLYFATGFLWCFVIYYWKRNAYIPKDAVPTVEAMKKQIIVASKAMPFYCALPSISEHMIESGWTRCFFHISEVGWPMYIVYVSLYLIFVEFGIYWMHRELHDIKPLYKHLHDCNPIYNKENTLSPFAGLAFHPLDGILQAISHVIALFLLPMHFRTHIALLFIEAVCRXYRHNYGHYTVWMDWLVAALREPEDLLKKD

SEQ ID NO: 4600 - protein, 231 aa, Triticum aestivum
  unsure (1)..(231): unsure at all Xaa locations
MGHEDAVYLAKLAEQAERYEEMVENMKIVAGEDRDLTVEERNLLSVAYKNVIGARRASWRIVTSIEQKEESKGNSSQVTLIKEYRQKIEAELAKICEDILEVLDQHLIPSAKSGESKVFYHKMKGDYHRYLAEFAIGDRRKDSADKSLEAYKAATEVAPDPSFLPPTPSRLGLALNFSVFYYEILNAPDQACHLAKQAFDDAIAELDTLSEESYRDSTLIMQLLREXLTLW

SEQ ID NO: 4601 - protein, 225 aa, Triticum aestivum
RNHTHAARAASTGELRELAAFTHTPPLLLAGGGEGSVVTRRRRRRRRWWGAACSAGPPLVVGRVIGDVVDPFVRRVALRVGYASRDVANGCELRPSAIADPPRVEVGGPDMRTFYTLVMVDPDAPSPSDPSLREYLHWLVTDIPGTTGVSFGTEVVCYEGPRPVLGIHRLVFLLFQQLGRQTVYAPGWRQNFSTRDFAELYNLGLPVAAVYFNCQRETGTGGRRM

SEQ ID NO: 4602 - protein, 271 aa, Triticum aestivum
  unsure (1)..(271): unsure at all Xaa locations
MTRADDGGGSSTAPCFVEAVYNVRLRPTIKEQQLEPVNFAYDAGLRAKFSPLPLIKSSREDSKKIYYISDNXSQSSGQSGVNANKKEQSALRAVIKCVEDHKLEAEFPLEDLRKRLEDLEMAKTEKKKAASSCSSGGPASKRIKGSTGGAMSPSKSGRLSDNTGAPSSPATATSSSTATAFIGSPASHVSYGTGSPYSYDRSAGHALYCGQSPLPMREPYAYPPAVPVPNVGLGMPYQAPPMTYPIYPGYNSGLGAYGNAMAPAFHQAYYR

SEQ ID NO: 4603 - protein, 711 aa, Triticum aestivum
  unsure (1)..(711): unsure at all Xaa locations
DMMSGEEDRXNILRSRATGKAVLTRPFRLMSNHLGVVLTFPVYLVDLPPDAKVEDRVAATAGYLGGAFDVESLVENLLRQLAGNQELVVNVYDVTNHSNPLVMYGSEVPLGAPAPSHARRRVGGDPFRNHHMICRYRSEPHVPWSAITTPSGVFVILMLIGYIIYAAWNRYDSVTEDCRKMEALKKRAEAADVAKSQFLATVSHEIRTPMNGVLGMLDMLLDTELKSTHRDFAQTAQILGKALISLINEVLDRAKIEAGKLELESVPFDLRSILDEVVSLFSSKSREKGIELAVYASERVPEILLGDPGRFRQIITNLVGNSIKFTERGHIFVQVHLADHSNLATEPKVESVANGINGHIDETSVVSTSVPHNTLSGFEAADSRNSWENFKXLLSYDTNXMAYGSDSGNVTLVVSVEDTGIGIPIHAQGRVFMPFMQADSSTSRNYGGTGIGLSISKCLVELMSGQINFVSRPNVGSTFTFTAVLQRCERNAINVSKSALLHPLPSSFQGLSTLLVDKRPVRATVTEYHLQRLGIASKSVHTIEQALSVLLGRNGTSLPRKQLSMLLVESDSWGLKMDVPLRTRFLEMKQNGCESVFPQVILLSLADSDKMKAEYGVHSVITKPLKASTLAACLFQSLGISITQANNEKKHHGPDSLYGLLLGKNILVVDDNKGNLRVAAGTLKKYGAKVECVESGXDALELLKSPQFDLC

SEQ ID NO: 4604 - protein, 197 aa, Triticum aestivum
MTLTREEAHESKEMESLRVHADALLSLSSPAASSTAPAGSKPVTAATTTVAGRRALAAEGVFECKTCSRRFTSFQALGGHRTSHTRLQARMLLHDQAADVPGAAERDRARVHECAVSGLEFSMGQALGGHMRRHRGEAPPGPSTSSAAVHGDASSGATQQQEVMPDLNYPPMDDCGGDGQETSADRSSGHQLLDLLV

SEQ ID NO: 4605 - protein, 321 aa, Triticum aestivum
MGESKWMGKRWEEMDTDVLVKIFKELNLVELSPVSQVCRLWRLACSDPLIWGTLDFGLLKSNFIQTRASPYIWVDDRSDKRLAKILRVAMAISRGNVNCMIFHYNLYMKDEHLHYISQRSPNLKRLVMPAWNRISRAGICQAIERWGELESLTMPTIGHPPYIMEGLANSCKNFKELKIMGSFDLLFASAVTTYLPKLKVLSLRCSKVTMGALQCVLNSLEHLEVLNISHCLLFEMATNGRRQVIHELDNKALERASRLREFHHCQSRQCVACQRMMLDEGILRWYRYEDWFWRRDEVRSLDLKDYGRLFGAQCEMLTSVD

SEQ ID NO: 4606 - protein, 223 aa, Triticum aestivum
MNASKTRVCRNILGKLMDHPGGWLFHKPVDPDLFGIPDYFDVIRNPMDLGTVKKKLTNKNYSSTDEFAADVRLTFSNAMTYNPPGNQVHTVAEQLNIMFNSEWTSYERKWSDRNLKPVQLPMKVIKARVAVNSKPVVSGGLVACSNSSAKKTLTNAISSKVKIKFCVRGSGQTLSKETPLQAAGSKEGSLNHSIPCTKESANTTKVQSSEHRVQSIGMLMNSI

SEQ ID NO: 4607 - protein, 488 aa, Triticum aestivum
  unsure (1)..(488): unsure at all Xaa locations
MVISHASSSAGEAVYSTFSSRYVREELPRYRMPEGSIPKEAAYQIISDELMLDGNPRLNLASFVTTWMEPECGKLMMDSVNKNYVDMDEYPVTTELQNRCVNMIAHLFNAPIGEDETAIGVSTVGSSEAIMLAGLAFKRKWANKMKEQGKPCDKPNIVTGANVQVCWEKFARYFEVELKEVKLTEGYYVMDPKKAVEMVDENTICVAAILGSTLTGEYEDVKLLNDLLVAKNKETGWDVPIHVDAASGGFIAPFLQPELEWDFRLPLVKSINVSGHKYGLVYPGVGWVIXWRSKADLPDELIFHINYLGTDQPTFTLNFSKGASQIIAQYYQLIRLGFEGYKHIMENCKLNAAVLKEGIDATGRFDVLSKADGVPLVAIRLKDSTNFSVFDISENLRRFGWIXPAYTMPADAEHVXVLRIVIREDFNRSLAQRLLADINKIVGELDAHAIHAIKLSTAAAAEGASKSTVDAVTEAFKGLAGNKKAGVC

SEQ ID NO: 4608 - protein, 341 aa, Triticum aestivum
  unsure (1)..(341): unsure at all Xaa locations
MGVEGCCNKKVMEEEALVKKITGLAAAIGELPSLTPSPAVNALFTELVTSCIPASTVDVDALGPEAQEMRARLIRLCADAEGHLEAHYSDLLAAHDNPLDHLTLFPYFNNYIKLSQLEHGLLARHVPGPAPARVAFLGSGPLPLSSLVLAARHLPDASFDNYDISGEANERASRLVRNDADAGARMAFRTADVADVTTELAGYDVVFLAALAARAAEEKARLVEHLGRHMAPGAALVVRSAHGARGFLYPVVDPEEIRRGGFEVLTVHHPEDEVINSVIIARKAAAPAAVAADRXDVPVNNGGMPAAWADAXSRPCLGCACELGTRAHQKMKEMAMEEMEA

SEQ ID NO: 4609 - protein, 257 aa, Triticum aestivum
  unsure (1)..(257): unsure at all Xaa locations
HQKACGVILAISRQQHSCWSKSRSFCGESAQGKHIGSPPSMASGVAATGAAASAWWATQGLLPLFAPHMAFPFVPVPTACFATADVQRATENFPVDNAPKDCQVAQEQGQPEAMIVVASSVSDESGKGEVSPHTELNISPADKADTTPPTGAETSDAFGNKIKQDRSSCGFQHAXSSSDVXAEHVPENQDQANDKTQQACCSNSSTGDMNHRRXEHFKPNDSWKXEVSEKGRMAFDKLVNKXKSFPKSFSSSQAEGL

SEQ ID NO: 4610 - protein, 362 aa, Triticum aestivum
  unsure (1)..(362): unsure at all Xaa locations
STLSNMLVSTLLSNPSVHAAGRLAASYWPEAHSNIHVGPNQEVFEENAQGNDSGFHTSIALVLACMLMAASPRWATLDLLLLFAPSIAFRXGPVPTASCPEADFQRATENWPVDNDSKQRQVVQEQGQPEAMIVVASSGSDESGKGEVSPHTELNISPADKVETTPPTGAETSDAFGNKKKQDRSSCGSNTPSSSDVEAEHVPENQDQANDKTQQACCSNSSAGDMNHRRFRNISSPNDSWKEVSEEGRMAFDKLFSRGKLPQSFSPPQAEGLKVVPRGEQDEATTVTVDLNKSAAVMDHELDTLVGPRATFPIELSHLNMKSRRTGFKPYKRCSVEAKENRVPAADEVGTKRIRLDSEPST

SEQ ID NO: 4611 - protein, 234 aa, Triticum aestivum
MEAAVARADTAAFFSGQEDAAGGSISRLPARVAGSIVRGVITFIFATVGTILGAITGGMIGLATESGLVRGAGIGAISGAVVAMEVVDRSMAMWRSDECGIWSVLYVLDVIWSLLTGRLVREKVDPAVQNAVDSQMNAAGDGFSDSPPTLSEMFDMGSASFKGMAADAIAELPATTITEQQAAVQDGGCSVCLQEFEAGEAARSLPECRHTFHMSCIDGWLCRHASCPLCRRAV

SEQ ID NO: 4612 - protein, 324 aa, Triticum aestivum
  unsure (1)..(324): unsure at all Xaa locations
MAGAQESLVYAGVMRGHNDVVTAIATPIDNSPFIVSSSRDKSLLVWDLTNPIQATQDSSSEYGVPFRRLTGHGHFVQDVVLSSDGQFALSGSWDGELRLWDLSTGVTTRRFVGHEKDVLSVAFSIDNRQIVSASRDRTIKLWNTLGECKYTIGGDLGGGEGHTGWVSCVRFSPNNFAPTIVSGSWDRSVKVWNLTNCKLRCTLDGHGGYVSAVAVSPDGSLCASGGKDGVTLLWDLTEGKRLYSLDAGSIINSLCFSPNRYWLCAATQDSIKIWDLXESKHIVQXLGPRVPVSNPSRCSHCTCLSWSAYGSTRDAGNTDGTIRN

SEQ ID NO: 4613 - protein, 401 aa, Triticum aestivum
  unsure (1)..(401): unsure at all Xaa locations
MCGGAILKDLKVPAPTRKVTAAVLWPEKNKPKRADGVARRLAGLGRRGGLGLDDGDVDFEADFEEFEADSGDSDVELGRAGVAGKDGHDVVVEIKPLFAVKRSLSQDDLSTMTTAGFDGPAQRSAKRKRKNEFRGIRXQRPWGKWAAEIRDPSKGVRVWLGTFNSXKEAARAYDVRKHEGFRGKKAKVNFPQXELTVPQKRRACPAAPKVPKSSVAQEPTVIPAVNNLANPNAFVYPSADFASKQPLVQPDNMPFVPAINSAASVEAPVMNMYSDQGSNSFGCSDLGWEYDTKTPDISSIAPISTIAEGTESALLQSNTYNPAVIAEGAESAPVQSNTYNSVVPPVMENNAVDFEPWMRFLLDDGVDEPIDSLLNFDVPQDVVGNMDLWSFDDMPICGEIF

SEQ ID NO: 4614 - protein, 178 aa, Triticum aestivum
NVFSGTSGGVALTAAGGLRKIGLGDTYESPSLIGVHHEGKFYEFVPWTGTVSWDIAPWGHWRMSGENKNHLVEIEATTKEPGTALRAPTMEAGLVPACKDTCYGDLKLQMWEKKYDGSKGKIILDTTSNMAAVEVGGGPWFNGWKGTTASPELVNNIVGTQIDVESLFPIPFLKPPGL

SEQ ID NO: 4615 - protein, 399 aa, Triticum aestivum
  unsure (1)..(399): unsure at all Xaa locations
PFYLLLSLYSSALPLSEGRRGDETKAEFPRSLARSPQIPRPLCAALHDEENAPMYKESDCEFLTEQVTCMRNGRRSDEYQKWRWQPDACDLPRFDAKLLLEKLRNKRMMFVGDSLNRNQWEAMVCPVQSVAPWDKKKLVKNGSLNVFRLHEYNATIEFYWAPFLVESNSDDPDIRSITDRMITPTSIAKHAANGIGVDYLIFNTYIWWRNTPKMKIVPDGSSTRKPVKYDELDRVVAYRQILETWSGWVEENVDPKRTMVLFMSVSPVHMQSEGWGSPDNIKCFSETQPVLNYTKTLDVGTDWDLFTESHEVTKAMKKVPVXFMNIXQCSETRKDAXHTSVHTLRQGKLLTKEQQANPRKFAACIHWCLPGLPDTWNEFIYGHIVSSPPQRQIENQSAR

SEQ ID NO: 4616 - protein, 121 aa, Triticum aestivum
MGALCDYCGEHRSMVYCRSDAASLCLSCDRNVHSANALSRRHTRTLLCDRCASQPAMVRCLEENTSLCQNCDWNGHSAGSSAAGHKRQNINCYSGCPSSAELSRMWSFILDIPNVAPELNC

SEQ ID NO: 4617 - protein, 453 aa, Triticum aestivum
  unsure (1)..(453): unsure at all Xaa locations
MLQELKLDKCSGFSTDALRLVARSCRSLRTLFLEECVITDEGGEWLHELAVNNSVLVTLNFYMTELKVVPADLELLAKNCKSLLSLKISECDLSDLIGFFEAANALQDFAGGSFNEVGELTKYEKVKFPPRVCFLGLTFMGKNEMPVIFPFSASLKKLDLQYTFLSTEDHCQLISKCPNLFVLEVRNVIGDRGLEVVGDTCKKLRRLRIERGDDDPGLQEEQGGVSQLGLTAVAVGCRDLEYIAAXVSDITNGALESIGTFCKNLYDFRLVLLDRQKQVTDLPLDNGVRALLRSCTKLRRFALYLRPGGLSDIGLDYIGQYSGNIQYMLLGNVGESDHGLIRFAIGCTNLRKLELRSCCFSEQALSLAVLHMPSLRYIWVQGYKASPAGLELLLMARRFWNIEFTPPSPEGLFRMTLEGEPCVDKQAQVLAYYSLAGQRQDCPDWVTPLHPAA

SEQ ID NO: 4618 - protein, 498 aa, Triticum aestivum
MDTITVVENVFGEVERKVQKSYWEEHSKDLTVESMMLDSRAKDLDKEERPEVLAILPSYAGKTVLELGAGIGRFTGELAKEAGHVIALDFIDSVIKKNEEINGDIYKNITFMCADVTSPELKIEDNSIDIVFSNWLLMYLNDEEVEKLIGRIVKWLKPGGHIFIRESCFHQSGDSKRKVNPTHYREPRFYTKVFKECHSYDQDGNSFELSLVTSKCIGAYVKSKKNQNQICWLWEKVKCTEDKGFQRFLDNVQYKSTGILRYERVFGEGYVSTGGFETTKEFVDKLDLKAGQKVLDVGCGIGGGDFYMAETYDVHVLGIDLSINMVSFAIERAIGRSCSVEFEVADCTTKEYAENTFDVIYSRDTILHIQDKPALFRNFFKWLKPGGKVLISDYCRSPGTPSEEFAAYIKQRGYDLHDVKTYGKMLEDAGFHDVVAEDRTDQFLRVLERELGETEKNKEAFLADFTQEDYDDIVNGWSAKLKRSSAGEQKWGLFIATK

SEQ ID NO: 4619 - protein, 95 aa, Triticum aestivum
MAAAVVDAAVPVAAKANGAGARCCAAKGPGYATPREAMEKGPREGLLYVTCVYNGTGIDKPDYLATVDVDPNSATYSQVIHRLQATHIGDELHHS

SEQ ID NO: 4620 - protein, 125 aa, Triticum aestivum
MAPTHTQHVQARPRLLRPQAGLPPRAQPMKTAAAAPAAVKLYRGVRQRHGCKWVAEIRLPRNQTRLWLGTFDTAEEAAHAYDQAACRLHGDAARLNFPDKAASSRPPLNAAVDAKLQVISRTIAA

SEQ ID NO: 4621 - protein, 408 aa, Triticum aestivum
  unsure (1)..(408): unsure at all Xaa locations
MSPPISLCVFVLLSSLLAAARAEDPYRFYTWNVTFGDIYPLGVKQQGILINGQFPGPQIDAVTNDNIVINVFNNLPAPFLLSWQGIQQRRSSWQDGVYGTNCPIPPGGNFTYNMQFKDQIGSYYYFPSLAFHKAAGGYGGIRVLSRPRIPVPFDPPAGDFTILAGDWFNXNHTDLKGILDSGNDLPFPDGLLINGHGSNGNRFTVDQGKTYRFRVSNVGISTSVNIRIQGHSLLLVEVEGSHTMQNTYSSLDVHLGQSYSFLVTTNQPPQDYTIVVSTRFTNPVLTNTAMLHYSNSNGVPAALPPPPGPTIEIDWSLNQARSIRWNLTASGPRPNPQGSYHYGQVNTTRTMRLANSRVSINGKLRYAVNSVSFVPADTPLKVADFYNIQGGVHXGSMPDAPSGGPAYL

SEQ ID NO: 4622 - protein, 662 aa, Triticum aestivum
  unsure (1)..(662): unsure at all Xaa locations
MPFILLWEGQCYMDSWLVTYLLPCPLSYDYVLLVCRKLIMTFVPIKKIVPEHGYTXQDGTPWPGNNVRDHPGMIQVFLGQSGGLDVEGNELPRLVYVSREKRPGYNHHKKAGAMNALVRVSAVLTNAPYMLNLDCDHYVNNSKAVKEAMCFMMDPLVGKKVCYVQFPQRFDSIDRHDRYANKNVVFFDINMKGLDGIQGPIYVGTGCVFRRQALYGYDAPKTKKPPSRTCNCWPKWCVCCFCFGNRKNKKKVTKPKTEKKKRLFFKKEENQSPAYALSEIDEAAAGAETQKAGIVNQQKLEKKFGQSAVFVASTLLENGGTLRCDSPASLLKEAIHVIGCGYEDKTDWGKEIGWIYGSVTEDILTGFKMHCHGWRSIYCIPKRPAFKGSAPLNLSDRLNQVLRWALGSIEIFFSNHCPLWYGYGGGLKFLERFSYINSIVYPWTSIPLLAYCTLPAICLLTGKFITPELSNLASIWYMSLFICIFATGILEMRWARVAVDDWWRNEQFWVIGGVSAHLFAVFQGLLKVIAGVDTSFTVTTKAGDDEEFSELYTFKWTTLLIPPTTLLLLNFIGVVAGISNAINNGYESWGPLFGKLFFAFWVIVHLYPFLKGLLGRQNRTPTIVIVWSILLASIISLLWVRVNPFLAKTDGPLLEECGLDCT

SEQ ID NO: 4623 - protein, 85 aa, Triticum aestivum
  unsure (1)..(85): unsure at all Xaa locations
LVFMLAXAALYMPFMMITVLNLGLYXKVVAGLSVRSGDRFAYYLYRRFLDMFWVVVMDIGNALIEEKLAVMNAVTVIYNDIFSHC

SEQ ID NO: 4624 - protein, 112 aa, Triticum aestivum
  unsure (1)..(112): unsure at all Xaa locations
RSDIITAVMIAVLFAFGYDCRGCAKGLKLALTQVIATEIDPICALIALIEGMQILTLKDTLYDADIFATTTGNTNIIMDXHMGNQMKNIIICTIGYFIIQIDMNILKIYPGV

SEQ ID NO: 4625 - protein, 199 aa, Triticum aestivum
CNRIIAFRYTDLQQATTKFTDKLGAGSFGSVFKGFLNGSVAIAVKRLDGAYQGEKQFRAEVSSIGAVQHVNLVKLVGFCCEGSKRLLVYEHMSNRSLDVHLFRNNSMILSWTIRYQIALGVARGLAYLHESCRDCIIHCDIKPENILLDDSLIPKVADFGMAKLLGREFSRVLTTTRGTPGYLAPEWISGVAITPKVDV

SEQ ID NO: 4626 - protein, 213 aa, Triticum aestivum
TRLYVAGGECEGTQRTLRSAEVYNPNRTRWSCITEMNTGMVPFTGVVYDGKWFLKGLDSHRQVVSEVYLPTSNTWSTTGNALVAALRNPTISFNGRLYSADCRDACKLRVYDGDIGSWTRFMDSRRHLGSSRAFEAVALVSLNGKICVIRNNMGMTLVDVCDPTKVIEMESARVWETFARKGHQHRSLMANLWSAIAGRNLKAHIIHCQVLQA

SEQ ID NO: 4627 - protein, 50 aa, Triticum aestivum
VCNAALVAVHRSGRVYVVDTAKDPRAPALHTVVQAEDIAENTGLGFPHTS

SEQ ID NO: 4628 - protein, 139 aa, Triticum aestivum
MGRGKIAIERIDNATNRQVTFSKRRGGLMKKARELAILCDADLALIVFSSTGRLYDFASSSGMEAILERYQEAKQEHCGVLNPTSEAKLWQREVTTLRQQVQNLQHNNRQLLGEELSGSTVRDLQFLVNQVEMSLHSVR

SEQ ID NO: 4629 - protein, 208 aa, Triticum aestivum
MVSALSHVIRATPDQQQAYYPAGSAAVSGEQQHQHDAAAAAAIAEEQGRKRHYRGVRQRPWGKWAAEIRDPKKAARVWLGTFDTAEDAAIAYDEAALRFKGTKAKLNFPERVQGRTDLGFVVTRGHSRQIAATTNTTPPPWGRRQCGHRRTSCRPWCRTLTSCGMHGCCRALAVPGALSTCRSAPCRPRRCPRRRRTYSTSRHSSSSE

SEQ ID NO: 4630 - protein, 258 aa, Triticum aestivum
KPRSPGARRSNARLIALVMAPPQERDYIGLSPAAAAAATELRLGLPGTEDAAGDGGGAASEAPLTLELLSKGGAKRGFAGAVAEEEDEKKKAQPPAAKAQVVGWPPIRSYRKNTMATNLSAPRSKDEAEAKQAPVPDCLYVKVSMDGAPYLRKVDLKMYKNYKDLSLELEKKFSGFTVGHGESTGKSGRDGLSDCRLMDLKSGTELVLTYEDKDGDWMLVGDVPWRMFTDSCRRMRIMKGSDAVGLAPRAAEKSKNQK

SEQ ID NO: 4631 - protein, 223 aa, Triticum aestivum
MAPAVKVYGWAVSPFVARPLLCLEEAGVEYELVPMSREAGDHRQPDFLARNPFGQVPVLEDGDLTLFESRAIARHVLRKHKPELLGSGSPESAAMVDVWLEVEAHQYNPAAGAIVMQCILFPLLGGARDQAVVDENVAKLTKVLEVYEARLSASRYLAGDSLSLADLSHFPLMRYFMETEYASLVEERPHVKAWWEELKARPAARKVTEFMPPDFGLGKKAEQ

SEQ ID NO: 4632 - protein, 225 aa, Triticum aestivum
MAHHENHECNLAVFLQLARFSYVSFQEFFRRPRAERCGEVRAVIFSVALSDYDQLGAPASGTSRRLENKMIQSKDLFEATIRHPSFRDTPFVLVLNKFDIFEEKIGRSPLTACEWFSDFDPLRTHNNQSMAQQAFFYVAMKFKNLYAAHTGDRKLFVWQARARDGPTVDEAFRYIREVLRWEDEKEYGGFCPDESFYSTTELSSSRLVEQDWQQHPAADQRQGST

SEQ ID NO: 4633 - protein, 147 aa, Triticum aestivum
RVVWTISSLIAASTRHYLLRSIIKEHPTLRSLVLADADGQGTLCMGAEQLAEFRESRLSASACSNRTQVPACSMKLKYAPYLELPGGLGLQGATLVVIKPSGDGAGGCHVGRKETEAFVSGAFDGPFRFAAKALMKRRTYLLEMNGF

SEQ ID NO: 4634 - protein, 202 aa, Triticum aestivum
MKQRKCMENAAENQRRSVVEGKEALGSGNLNQYSKNHKQVKKQRSIEAEEDENASVRNPNAGCSRMPVISECIGGQPLDIPYWTGIMKINNNYIPLAAHLSTKAGKKVQELSRSLPPIMKVAKLSTSKSCPHFEASIPTADSIGLYFFSGDIRPNKELDELVKHLADSGSVLEAVVGLRKLFLFPSGVLPVEHQTFQGKPYL

SEQ ID NO: 4635 - protein, 304 aa, Triticum aestivum
MPQRHSKNNNDLAFFTYEEKRKLGYGTQRERLGKDSIKPFDACCLCLKPLIDPLACPKGHTFCKECILECLLAQKKDIKRKLIAHDSQKKQEKEEEEEKLVLQKSKELDAFDQQNHGAVPQYYDRSGSQDKNGFHGANSVKTTSFEEEALRTMKAFWLPSATPEATVKVDAPSTDTICPEGQEKLKLKSLFPISFTEENARQKSSKSVEKSYICPSCKSNLTNTMSLVAISTCGHVFCKKCSDKFIATDKVCLMCSKPCKERNLINLEKGGTGFAAHDDHLEAKNFKHLGSGSGLGLVKPAPKA

SEQ ID NO: 4636 - protein, 94 aa, Triticum aestivum
  unsure (1)..(94): unsure at all Xaa locations
VGVFASVSADGSVRVFDLRDKEHSTIVYESPRPDTPLLRLAWNRYDLRYMAALLMDSNAVVVLDIRAPGVPVAELHRXGGCVNAVAWAPQAARH

SEQ ID NO: 4637 - protein, 422 aa, Triticum aestivum
MDKLKGSARLMIVSDLDHTMVDHHDEENLSLLRFGALWESVYCQDSLLVFSTGRSPTLYKELRKEKPMLTPDITILSVGSEITYGEAMVPDHGWEEYLNNKWDRNIVLEETAKFSELKLQVESEQRPHKVSFLVDKKNAQGVIKSLSEKFEKRGVDAKIIYSGGQDLDILAQGAGKGQALAYLLKKLGSCGKTPNNTLACGDSGNDAELFSIPGVHGVMVSNAQEELLQWHAENAKDNPKIIHATERCAAGIIQAIGHFKLGPNVSPRDVEFPYIKEDPFKPTAAIVKFYVLYEKWRRADVPKADSVIQYFKNITDANGVIIHPSGVELSIHSAIDELASCYGDKQGKKYRSWVDRLVILQTASDSWLVRFDLWEAEGAAWACCFTTLALNVKPETPGGFVVTHIHKTWRKEYPGVEQSCKL

SEQ ID NO: 4638 - protein, 182 aa, Triticum aestivum
MSDAPASPPGGGGGGGGGGSDDGGGGGGFGGVREQDRFLPIANISRIMKKAIPANGKIAKDAKETVQECVSEFISFITSEASDPGRREKRKTINGDDLLWAMATLGFEEYIEPLKVYLQKHRETEGDSKLPGKSGDVSVKKDALGPHGGASGTSAQGMGQQVAYNPGMVYMQPQYHNGDISN

SEQ ID NO: 4639 - protein, 470 aa, Triticum aestivum
MCREVEQKPHTPRGIPRASDLLAALHTVARARATPRETVTYHAELGSHCLSEIFTVASVVEMVGSSPMQAVLVAPGVKDKKVLAFRQDALKEKDAVAALMRTIAAGGVRSAFYVFDLALGRRPVTAGWRRALPGVRACYAAKSNPEPALLGALAALGAGFDCASRREIEAVLALGVQPGSIVYANPCKPEAHLEYAAEVGVNLTTYDSEEEVVKVKRCHPGCELILRIKGPDGGEARVDLGTKYGAHEDEVLPLLRAAQREGLNVAGVSFHVGSGASNTDVYRGAIEAARGVFDAAAALGMPPMRVLDIGGGFMAGSAFDEAATVINAALERYFGELPCVEVIGEPGRYFAETAFTMAARVIGKRTRGEVREYWIDDGLYGTLSCIPMDHYVPHPRPLAVPRAGEKAYTSTVFGPTCDSLDTVVTGYQLPEMNVGDWLVFDDMGAYTTASGSNFNGFSTSDIKTYLAYSS

SEQ ID NO: 4640 - protein, 76 aa, Triticum aestivum
HMQQLRGSCFSIGASKMNNECTSFRNSCGEENAEGCRRTFQKVKREHAILRQKLESYFQLLRQAGPARTATRPGSM

SEQ ID NO: 4641 - protein, 222 aa, Triticum aestivum
  unsure (1)..(222): unsure at all Xaa locations
MADEDEYRCFVGNLSWSTTDESLKDAFSKYGKVTEAKVVMDKFSGRSRGFAFVTFDEKKAMEEAIEDMNGLDLEGRAITVDKAQPQGAGRDRNGDRDXDRDRGSRGGRDYGGGRAPRGGGGGDCFKCGKPGHFARECPDGDGGRGDRYGGRDDRYGGGRSDRGGDRSDRGGDRSDRDRSDRGGDRSDRDGDRSERGSDRYSSRSRDGGSGGDRYSRDRSGPY

SEQ ID NO: 4642 - protein, 329 aa, Triticum aestivum
TCTSTTPARTRSAPPPLPSDQELMKALEPFITIASSSSSHYPYHYYSSPSMTQDSYMATPSSSSYASSFAASPLPTTAPASPSFSQPPPLASAPSAVNGSMGLAQLGPAQIQQIQAQFFVQQQQQQRGLAGGSFLGPRAQPMKQSGSPPRASAAALALAGVAPAQSKLYRGVRQRHWGKWVAEIRLPKNRTRLWLGTFDTAEDAALAYDKAAFRLRGDLARLNFPSLRRGGAHLAGPLHASVDAKLTAICESLAAPSSKNSAEAEPESPKCSASTEGEDSASAGSPPPPTPPVPEMEKLDFTEAPWDESETFHLRKYPSVEIDWDSILS

SEQ ID NO: 4643 - protein, 205 aa, Triticum aestivum
  unsure (1)..(205): unsure at all Xaa locations
RRSMAVSRSGAAGVAGGGDTTDDADRARLHQLGYKQELKRGLSLMSNFAFSFSIISVMAGVTTTYNGGLRYGGPASMTLGWLVVAFFNGCVALSMAEICSAYPTSGGLYYWSAKLAGEEWAPLASWVTGWFNIVGQWAATKSTDFSLAQLVQVIVLLGTGGANGGGYTAXKYVVLAIHGFFLVLHGLINRLPIRGLACFGKLGAF

SEQ ID NO: 4644 - protein, 216 aa, Triticum aestivum
  unsure (1)..(216): unsure at all Xaa locations
NRFRGCHCAKSQSRSRQCPCFAADRECDPDVCRNCWVGCGDGSLGVPSQRGDNYECXNMKLLLKQQQRVLLGRSDVSGWGAFLKNTVSKHEYLGEYTGELISHKEADKRGKIYDRENSSFLFNLNNEFVLDAFRMGDKLKFANHSPDPNCYAKVIMVAGDHRVGIFAKERIGSGEEIFYDYRYEPDRAPVWARKPDAPGAKDPGQPSSGRAKKLAH

SEQ ID NO: 4645 - protein, 157 aa, Triticum aestivum
METGAKAPKKAGRRAGGGGPKKKSVSRSVKAGLQFPVGRIGRYLKHGRYAKRVGSGAPVYLAAVLEYLAAELLELAGNAARDNKKNRIIPRHVLLAIRNDEELGKLLAGVTIAYGGVLPNINPVLLPKKAAAAASKEPKAGTTKSPRKSPAKKAADA

SEQ ID NO: 4646 - protein, 318 aa, Triticum aestivum
  unsure (1)..(318): unsure at all Xaa locations
MAATATKLSSGHEMPAVGLGVWRMDSAAVRGLIHSALPRLRLPATSTDPADYKNRXEAGRLSSRQALRTVGLVXRGEDLFITTKLWNSDHGHVVEALPHSLKKLRLDYLDLYLIHFPVATKHTGVGTTGSALGDDGVLDIDTTITLETTXWHAMEDLVSMGLVRSIGISNYDIFLTRDCLAYAKIKPAVNQIETHPYFQRDSLVKFCQKHGISVTAHTPLGGSTANTEWFGSVSCLDDPVIKSLAEKYGKTPAQLVLRWGLQRNTVVIPKTSKVERLEENFAVFDFDISLEDMEKIKALDRSYRTNQPGELWGTNLYA

SEQ ID NO: 4647 - protein, 156 aa, Triticum aestivum
MAATKLSSGHEMPAVGLGVWRMDSAAVRGLIHSALRAGYRHFDCAADYKNEAEVGDALAEAFQTGLVKREDLFITTKLWNSDHGHVVEACKDSLKKLELDNLDLYLIHFPVATKHTGVGTTGSALGDDGVLDIDTTISLETTWHAMEDLVSMGLVR

SEQ ID NO: 4648 - protein, 422 aa, Triticum aestivum
MDKLKGSARLMIVSDLDHTMVDHHDEENLSLLRFGALWESVYCQDSLLVFSTGRSPTLYKELRKEKPMLTPDITILSVGSEITYGEAMVPDHGWEEYLNNKWDRNIVLEETAKFSELKLQVETEQRPHKVSFLVDKKNAQGVIKSLSETFEKRGVDAKIIYSGGQDLDILAQGAGKGQALAYLLKKLGSCGKTPNNTLACGDSGNDAELFSIPGVHGVMVSNAQEELLQWHAENAKDNPKIIHATERCAAGIIQAIGHFKLGPNVSPRDVEFPYIKEDPFKPTVAIVKFYVLYEKWRRADVPKADSVIQYFKNITDANGVIIHPSGVELSIHSSIDELASCYGDKQGKKYRSWVDRLVILQTASDSWLVRFDLWEAEGAAWVCCFTTLALNVKPESPGGFVVTHIHKTWRKEYPGVEQSSKL

SEQ ID NO: 4649 - protein, 182 aa, Triticum aestivum
MDPLRLLLPRAQAQPLLPLPAGVPAPSVRPRLVPRRRARRHRNGAARMLPASAVASESPWTEQDPASGEKEERFDWLDQWYPFAPVEDLDPGAPHGKMVLGIRVVAWYDRGAGEWRVFDDACPHRLAPLSEGRIDDKGRLQCVYHGWCFDGRGACKFIPQAPALGPPVLNNFKACVASYPCV

SEQ ID NO: 4650 - protein, 292 aa, Triticum aestivum
  unsure (1)..(292): unsure at all Xaa locations
MELGLSLGEAMADAGRELVLGLGVGVGVGPGAAREGEGRRDHDVAAAARGGLALGCGSSPEPAMRLALLPMVPSLGFPWPSESRHLEASTRGFDVNQAPSSGGSAWGACAAAEEEQEDTAAAARAAVSSSPNDSGGSFPMDFSARGASDAAPGAGGSRGSDEDDGRSARKKLRLSKEQAAFLEESFKEHSTLNPRQKVALAKQLNLRPRQVEVWFQNRRAXTKLKQTEVDCEYLKRCCETLTEENRRLQKXLAELRALKTVHPFYMHLPATTLSMCPSCERVASNSAPASAA

SEQ ID NO: 4651 - protein, 457 aa, Triticum aestivum
  unsure (1)..(457): unsure at all Xaa locations
HAQGKSAILVRTETSPEDVGGMHAAAGILTARGGMTSHAAVVARGWGKCCVSGCSSMRVNEIEKVVAIEDKMLYEGDWISLNGSTXGEVILGKQPLSPPALSADLETFMSWVDEVRQLKVMANADTPGDALAARKNGAEGIGLCRTEHMFFASDERIKAVRQMIMAPTVELRQKALDRLLPYQRSDFEGIFRAMDGLPVTIRLLDPPLHEFLPEGHVEDIVRELCAETGAAEDDVLARMEKLSEVNPMLGFRGCRLGISYPELTEMQARAIFEAAISMTNQGIQVFPEIMVPLVGTPQELGHQVALIRQIANNVFTNMGKTIDYKVGTMIEIPRAALVADEIAEQAEFFSFGTNDLTQMTFGYSRDDVGKFLPIYLAQGILQHDPFEVLDQRGVGELVKIATERGRKARPNLKVGICGEHGGEPSSVAFFAKAGLDYVSCSPFRVPIARLAAAQVLV

SEQ ID NO: 4652 - protein, 120 aa, Triticum aestivum
  unsure (1)..(120): unsure at all Xaa locations
YFSNLRRTLGPGIDGWEVSLKGMMSIVVLLGLVITSIYWGVNKYVLNDPSLSKADRKMKKELPKLGMKESLKVLLSSRYVRDXLSTLVVAYGIXXNLVEFTWKSILRHSSLCPKEFLFFH

SEQ ID NO: 4653 - protein, 589 aa, Triticum aestivum
MEKLSMAATMFCAMVLAALAAAAGGEAAVVEHTFVVHEMNQKHLCNTTKIYVVNGQLPGPTIDITDGDTVVVHVVNRLPHGLTIHWHGVRQMRSCWSDGAGFVTECPIPPGGEHMYRFNVTGQVGTLWWHAHVTCLRATVAGAFIVRPKGGRYPFPTPAKDVPIIIGEWWELDLVELDRRMHDGNFDDNPLSATINGRLGDLSNCSGKPEESFVLDVVRGDTYLLRIVNTALFSEYYFKVAGHTFTVVGADGYYLTPYKTDMVTVAPGEAIDVLMAADAQPAHYHMVALANQPPEPDPQIPGFVSRGLVRYAGSTHNNNGLPVPTPLMPSQHNTMPSYYFHSNLTGLAHPDRHRVPMHVDERLFFTLGLGSICRGTNKTCERGRSPETIVVATMNNVSFRHPTNASLLERYYDGRTSGLYTEDLPDHPPHPYNYTDRSLIPPGPLEKALEPTFKATKLRRFRYNTSVEIIFQSTALLQSDSNPMHLHGYDFFVLATGLGNYNPKTDPKKFNYHNPQLRNTVHVPRTGWAAVRFVTDNPGMWYLHCHFEFHIIMGMATAFIVENGPTSETSLPPPPPEFKRCGANGLTQP

SEQ ID NO: 4654 - protein, 816 aa, Triticum aestivum
  unsure (1)..(816): unsure at all Xaa locations
MGEAAGDRVLSRLHSVREXRIGDFLFAHPNELVGGFTRLVNLGNGMLQSHQIIAEYNTAIPEAEREKLKDGAFEDVLRAAQEAIVISPWVALAIRPKPGVWEYVRVNVSELAVEELSVPEYLQFKEQLVEGSNKDFVLELDFEPFNASFPRPSLSKSIGNGVQFLNRHLSSKLFHDKESMYPLLNFLRAHNYKGMTMMLNDRIRSLSALQGALRKAEEHLSGLPADTPYSDFHHRFQELGLEKGWGDCAKRAQETLHLLLDLLEAPDPSTLEKFLGTIPMVFNVVILSPHGYFAQANVLGYPDTGGQVVYILDQVRAMENEMLLRIKQQGLDITPRILIVTRLLPDATGTTCGQRLEKVLGTEHTHILRVPFRTESGIVRKWISRFEVWPYLETFTEDVAHEISGELQANPDLIIGNYSDGNLVACLLAHKMGVTHCTIAHALEKTKYPNSDLYWKKFEDHYHFSCQFTTDLIAMNHADFIITSTFQEIAGNKDTVGQYESHMAFTMPGMYRVVHGIDVFDPKFNIVSPGADMSIYFPYSESQRRLTSLHPEIEELLYSDVDNNEHKYVLKDRNKPIIFSMARLDRVKNLTGLVELYGKNPRLQELVNLVVVCGDHGNPSKDKEEQAEFKKMFDLIEQYNLNGHVRWISAQMNRVRNAELYRYICDTKGAFVQPAFYEAFGLTVIEAMTCGLPTFATAYGGPAEIIVNGVSGYHIDPYQGDKASTLLVEFFEKCQVDPSHWTKISQGGLQRIEEKYTWKLYSERLMTLTGVYGFWKYVSNLERRETRRYLEMLYALKYRTMASTVPLAVEGESASK

SEQ ID NO: 4655 - protein, 238 aa, Triticum aestivum
  unsure (1)..(238): unsure at all Xaa locations
RTRGRRRARPGDRVSPPGDWGEWRERGVVAQGDQPASLERVFADQRVPSWREQLTVRAFVASFFLAVMFNIIVMKLNLTIGVIPSLNVSAGLLGFFFVRLWTSAIERMGLLKQPFTRQENTVIQTCVVAAYGIPYSGGFGNYLLAMSGRIASQATEANNPQNIKNPHLGWIIGFLFLVSFIGLFGLVPLRKIMIIDYKLTYPSGTATAYLINGFHTPQGAKIAEKQVKKLGKXLGSQL

SEQ ID NO: 4656 - protein, 344 aa, Triticum aestivum
MGKKKKRVEKVFCYYCDREFDDEKILVQHQKAKHFKCHVCHKKLSTAGGMAIHVLQVHKESVTKVPNAKPERDSTEIEIFGMQGIPSDVLAAHYGEEEEPSKVAKVEVPTIRPPIMPNYPLGMPFPPRPYGAARPMYNPAMMVRPPIWPLQQPQPWFAQQPPVSVPPMIAGQAPQQPLFPIQNMPNPMMTSAPANLLQTSYPMPTTGVPSPVAPQASQPLFPVNTSGNGAANSSFSSSISPATIAANSPASVGTAGYGYVANNHGTGGPAIGQPPAPATNSKTSATQPATSEVYLVWDDEAMSMEERRLALPMYQVHDETSQMSSVDAAFDRRISDITFSRQLT

SEQ ID NO: 4657 - protein, 322 aa, Triticum aestivum
  unsure (1)..(322): unsure at all Xaa locations
MENGGSKGDVPEDANAHCPGTQSEEAGKADSCAGCPNQQICATAPKGPDPDLVAIAERMATVKHKILVLSGKGGVGKSTFSAQLSFALAEMDHQVGLLDIDICGPSIPKMLGLEGQDIHQSNLGWSPXYVESNLGVMSIGXFMLPNPDDAVICKGXPRKNGLISNFACKDVDWGXEIDYLVVDAPPGTSDEHISIVQYLQATEVDGAIIVTTPXQQVSLIDVRKEINFCKKVGVPVLGVVENMSGLRQAFTDLKFARVFDSSKGGAENMCHEMGVPFLGKVPMDPQLCKAAXEGGRSCSANQWCXAGAPALGRIIDELIDAK

SEQ ID NO: 4658 - protein, 161 aa, Triticum aestivum
RPETFERQHGWIMRTMNREAAPLQDEYAPGIFSHDTVSYLARMDMMSGEEDRENILRARETGKPVLTNPFRLLGSNHLGVVLTFAVYRPDLPADASVEQRVEATAGYLGGAFDVESLVENLLSKLAGNQDILVNVYDVTNASEPMAMYGSQTPDNKVDLLH

SEQ ID NO: 4659 - protein, 139 aa, Triticum aestivum
KKHGGGVPKFFKNLEVVPVLQLPSPPSPSASPSLDGRRYSFSQSARAMARSRDTRLRLRLTLLLVTLLLLVDMASVSHGRRTPDVDAMALVGGGPPPAKAYSSEQSSSSTSREHTARVYRRMHRVSKRLVPQGPNPLHN

SEQ ID NO: 4660 - protein, 352 aa, Triticum aestivum
  unsure (1)..(352): unsure at all Xaa locations
MGLAGEKFQLGTVGALSLSVVSSVSIVICNKALMSALGFIFATTLTSWHLLVTFCSLHVALCMKLFEHKPFDARTVMGFGVLNGISIGLLNLSLGFNSVGFYQMTKLAIIPCTVILETLFFRXKFSRYIQLSLSVLLFGVGVATVTDLQLNAMGSVLSLLAIVTTCIAQIMTNTIQKKFKVSSTQLLYQSCPYQALTLFLIGPFLDGFLTNQNVFAFNYTSNVVFFIVLSCLISVSVNFSTFLVIGKTSPVTYQVLGHLKTCLVLTFGYVLLHDPFSWRNILGILIAVVGMVLYSYFCSIETQPKNNDVSGQQSKEGDSAPLISDSLGKVENGGDDDEPLKVPMWSSKYPRA

SEQ ID NO: 4661 - protein, 252 aa, Triticum aestivum
  unsure (1)..(252): unsure at all Xaa locations
MDPLSLLVPRARPSLPLPLRAAAPAISSARAAAPAPRRWRQRARLSSPVSAVAAEAPSAPSPFGGEEKEKEKEEGQFEWLDQWYPLAPVCDLDPGAPHGKTVLGLXXVAWYDRAVDEWRVFDDACPHRLAPLSEGRIDDKGRLQCVYHGWCFDGRGACQFIPQAPALGPPVHKNXKACLAXYPSVVRDHIPVVYPRXQQEHRDLWQRSARHHSRDRDPSFARIRGRDLPTVQCVGENLLTCPYLNTRGYGKH

SEQ ID NO: 4662 - protein, 203 aa, Triticum aestivum
  unsure (1)..(203): unsure at all Xaa locations
MAAAVASSGGRKRKCEELSAPELGQLHEDMLERVLARLPPASFFRLRGVCRRWREAAGVALPSSAACARVPARDPXGFLMLSDQQGGGGSRALPCPAVGFDAARKTWAQCRAAPGPVPVAAAGGLVLYRAPETGALTVANPLSGVSRALPPPPPAATDALYAVAMYGSPYRVVLILGELPNLSMAVFNSSKNAWEDALPLARK

SEQ ID NO: 4663 - protein, 502 aa, Triticum aestivum
MVATAKIPQRQLFIDGDWRAPALGRRLPVINPTTEASIGEIPAGTSEDVDAAVAAARAALKRNRGRDWSRAPGAVRAKYLRAIAAKMIERKSDLARLEALDCGKPLDEAAWDMDDVAGCFEFFAGHAEALDKRQNAAVALPENFKCHLKKEPIGVVALITPWNYPLLMAVWKVAPALAAGCTAVLKPSELASLTCLELGDVCKEIGLPSGVLNIVTGLGHEAGAPLSSHPDVDKVAFTGSYATGQKIMVAAAPTVKPVTLELGGKSPIVVFDDVDIDKAVEWTLFGCFWTNGQICSATSRLLIHKNIAKEFVDRMVAWSKNIKVSDPLEEGCRLGPVVSEGQYEKIKKFVANAKSEGATILTGGVRPKHLEKGFFIEPTIITDINTSMEIWREEVFGPVLCVKEFSTEEEAIELANDTHYGLAGAVISGDRERCQRLAEEIDAGCIWVNCSQPCFCQAPWGGNKRSGFGRELGEGGIDNYLSIKQVTEYTSDAPWGWYKAPA

SEQ ID NO: 4664 - protein, 384 aa, Triticum aestivum
  unsure (1)..(384): unsure at all Xaa locations
MAAAASSPSPPAVITCRAAVAWGPGQALVMEDVEVAPPGPLEIRVKVVSTSICRSDVTQWQSTAQPDLFPRIFGHEASGVVESVGEGVTEFQVGDHALTVFIGECMSCKHCVSGKSNMCQTLGLERKGVMHSDQTTRFSIGGKPVYHYCAVSSFSEYAVVHSGCAVKVSPTMPMDRICLLSCGASAGLGAAWNVADVSKGSSVVIFGLGTVGLSVAQGAKLRGASKIIGVDTNPAKQEKGKAFGVTDFINPAELNEPLQQVVKRLTDGGADYSFECVGDTGGLCLXGWRPKSDIPLLVXSTQTRKSKLMALSHMICHSVTSTKRSLFGGWRPKCDIPXYVEKYANKEIQVDGLVTHDMPFSDINKALELMLQNRCLRCVIHMPK

SEQ ID NO: 4665 - protein, 395 aa, Triticum aestivum
  unsure (1)..(395): unsure at all Xaa locations
SRQHASSTAATPPHAQRRPEPNPPTKSHPRLPPPPAAGEMMMLVNCSGCRTPLQLPHGAPCIRCSICGAVTNVAAPPAPGPVVDPARGAQAPAPAWGPPPPAAHGRKRAVICGISYRFSRHELKGCINDAKCMRHLLTTRFRFPDDSIIMLTEEQXDPYKIPTKHNIRMAMYWLLQGCQPGDSLVFHYSGHGAQQRSYSGDEVDGMDETLCPLDFETQGMIVDDDINAVLDTPLPHGAKLHALIQACHSGTALDLPFLCTMTKTGQYVWEDRRPRSGVWEGTXGGEAISFSGCDDNQTSADTSALSKITSTGAMTFCFIQAIEQGQATTYGSILNSMRSTIRNTGSGASMAGGGAVTSLISMLLTGGSASTGGLRQEPQLTACSTFDVYAKPFSL

SEQ ID NO: 4666 - protein, 329 aa, Triticum aestivum
MGLAGEKFQLGTVGALSLSVVSSVSIVICNKALMSALGFIFATTLTSWHLLVTFCSLHVALCMKLFEHKPFDARTVMGFGVLNGISIGLLNLSLGFNSVGFYQMTKLAIIPCTVILETLFFRKKFSRYIQLSLSVLLFGVGVATVTDLQLNAMGSVLSLLAIVTTCIAQIMTNTIQKKFKVSSTQLLYQSCPYQALTLFIGGPFLDGFLTNKNVFAFAYTPQVLFFIVLAGLISDSVNFSTFLVIGKTSPVTYQVLGHLKTCLVLAFGYVLLHDPFSWRNILGILIAVVAMGLYSYFCTREAPKPTEASPQVIQVKEGESDPLIADSLN

SEQ ID NO: 4667 - protein, 366 aa, Triticum aestivum
  unsure (1)..(366): unsure at all Xaa locations
CGQTALMHACRHGHWEVVXMLLLFRCNVTRADYLSGRTALHFAAHDGLVRCVRLLLADFIPSGPLEDTASSVADGGDSQMNSGSSPTSSLGLKFNEPARVRYINKPADGGVTALHMAALNGHFDCMQLLIELGANVSAVTFPYGTTSNLIGAGSTPLHYAAGGGSLECCQVLLSKGASRLTLNCNGWLPMDVARIFGRRCLEPLLSPNSHTIIPAIQPSSYLALPLMSILNIAREFGLQHTVSSVDESDLCAVCLERSCSVAAEGCGHEFCIKCALYLCSTSNVRVEFTGPAGSIPCPLCRNGIMSFTKLPSTPTEGLKSSSALTFCNPCILNTRSVDSPATVCKAEIRRNRVAALSSELVCPLTC

SEQ ID NO: 4668 - protein, 123 aa, Triticum aestivum
MSAMETDAPDAPPPAAPAPAADAGASSSSSRKPGKRFEIKKWNAVALWAWDIVVDNCAICRNHIMDLCIECQANQASATSEECTVAWGVCNHAFHFHCISRWLKTRQVCPLDNSEWEFQKYGH

SEQ ID NO: 4669 - protein, 125 aa, Triticum aestivum; identical to SEQ ID NO: 4209

SEQ ID NO: 4670 - protein, 193 aa, Triticum aestivum
  unsure (1)..(193): unsure at all Xaa locations
NIEQQIINSNCSDCRDRALEACGKNCXSLAGLRRAMHPIDVAGKVCQHDEARAIACSMPKLRHLEIGYMLIATNAVVEIASRCRDLSFLDLRGCWGVDDKLLQDKYPGLKVLGPRVDDCYENSFLEECSDDSDDDSIYSWEEFMDDEDYFAAGSDDDEALWDDGHALEGLEVRFYGGGFGEGAFAGFDWPESP

SEQ ID NO: 4671 - protein, 306 aa, Triticum aestivum
  unsure (1)..(306): unsure at all Xaa locations
CRVSCHRQSGPVFDPKXSSSYAAVSCSTPQCNDLSTATLNPAACSSSDVCIYQASYGDSSFSVGYLSKDTVSFGSNSVPNFYYGCGQDNEGLFGRSAGLMGLARNKLSLLYQLAPTLGYSFSYCLPSSSSSGYLSIGSYNPGQYSYTPMVSSTLDDSLYFIKLSGMTVAGKPLAISSSEYSSLPTIIDSGTVITRLPTTVYDALSKAVAGAMKGTKRADAYSILDTCFVGQASSLRVPAVSMAFSGGAALKLSAQNLLVDVDSSTTCLAFAPARSAAIIGNTQQQTFSVVYDVKSNRIGFAAGGCR

SEQ ID NO: 4672 - protein, 343 aa, Triticum aestivum
  unsure (1)..(343): unsure at all Xaa locations
MESAAGGGLGSMRAVLAILQWWGFNVTVIIINKWIFQKLDFKFPLTVSCVHFICSSIGAYVAIHVLKAKPXLIQVEPEDRWKRIFPMSFVFCMNIVLGNVSLRYIPVSFMQTIKSFTPATTVILQWLVWSKHFEWRIWASLVPIVGGILLTSMTELSFNVFGFCAAMIGCLATSTKTILAESLLHGYKFDSINTVYYMAPFATMILALPAMLLEGGGVIDWFYTHDSVSSSLIIILGSGVLAFCLNFSIFYVIHSTTAVTFSVAGNLKVAVAVLVSWLIFRNPISPMNAIGCAITLVGCTFYGYVRHLISQQQAAAPLGSQGTNSPRSRVEMLPLVGDKEDKV

SEQ ID NO: 4673 - protein, 348 aa, Triticum aestivum
  unsure (1)..(348): unsure at all Xaa locations
VRPRVRLSAQRKKRQVPPSLAXIDELERYTQISSHPLHKTNKPGPRARDIHPSKDIVATGGIDTNAGLFDRTSGQILCTLAGHSKKITTLKFVPRDELVVTGSADKTVRIWQGGEEGNYSCIHTLKDHTAEVEAVTVHATQKYFVTAAKDNTWCFYDISTGSCLSQVGEASGQEGYTSASFHPDGLILGTGTTEAVVKIWDVKTQSNVAKFEGHAGPVTAMSFSENGYFLATAALDGVKLWDLRKLRNFRTFSPYDSDTPTNSVEFDFSGTYLAVAGSDIRVYQVANVKTEWNLIKTLPDLSGTGKVTSAKFGTDAKYIAVGSMDRNLRIFGLPGDDQMDDDAKPSAE

SEQ ID NO: 4674 - protein, 561 aa, Triticum aestivum
  unsure (1)..(561): unsure at all Xaa locations
MADTPTSRMIHPFSNMQGQNPKQDPGSMYSDNPQHPCXPLAALSSHPRSSHMHHYIPQVPSPHEAGAXCENQVAQKTHSLDPPGAAGCMRDVSPSRHSFTPPPIRSGGGSPSSHHDSHSDSTNGSPVSASCVTVTTEDPNDLKQKLKDLEAEMLGPDAETVNSLEASVAKQLSLEPDXWAQMMDFPRGDLKELLLACARAVEEKNMYAVDVMVPELRKMVSVSGTPLERLGAYMVEGLVARLAHSRHYLYKSLXGAKEPKSSDLLSYMHFLYEACPYFKFGYMSANGAIAEAVKGEDRIHIIDFHIAQGAQWISLLQALAARPGGPPTVRITGLDDSVSAYARGGGLDLVGRRLSHIAGLCKVPFEFHSVAMAGEEVEEGHLGVIPGEALAVNFTLELHHIPDETVSTANHRDRILRLVKSLRPKVLTLVEQESNTNTAPFPQRFAETLEYYTAIFESIDLTLPRDDKERVNMEQHCLAREVVNLIACEGAERVERHEVFGKWKARLTMAGFRPSPLSSLVNATISTLLQSYSENYKLAERDGALYLGWKNKPLVVSSAWH

SEQ ID NO: 4675 - protein, 494 aa, Triticum aestivum
MAAAVADAAVPAVAKANGAGAGCCAAKGPGYATPREAMEKGPREGLLYVTCVYNGTGINKPDYLATVDVDPNSATYSQVIHRLPATHIGDELHHSGWNACSSCHGDPSTSRRFLILPSLLSGRVYVVDTAKDPRAPALHKVVQAEDIAEKTGLGFPHTSHCLATGDIMISCLGDKEGNAAGNGFLLLDSEFNVKGRWEKPGHSPLFGYDFWYQPRHKTMISSSWGAPAAFRTGFDLQHVQDGLYGRHLHVYDWPGGELKQTLDLGSTGLLPLEVRFLHDPSKDTGYVGCALTSNMVRFFKTADGSWSHEVAISIEPLKVRNWMLPEMPGLITDFVISLDDRYLYLVNWLHGDIRQYNIEDPAKPVLAGQVFVGGLLQKGSDVVYVTDDDKEEQYAVPQVKGHRLRGGPQMIQLSLDGKRVYVTNSLFSRWDEQFYGPDLLKKGSHMLQIDVDTEEGGLTVNPDFFVDFGTEPEGPSLAHEMRYPGGDCTSDIWI

SEQ ID NO: 4676 - protein, 275 aa, Triticum aestivum
MSGAAYRDRGFGGAAEMDRKRIKEALEKHTERPSPSTSRGASREKELLAAGKITTQIGKVPKVSDVEEFETDSEDSDVSGSEGEDTSWISWFCSLRGNEFFCEIDDDYIQDDFNLCGLSSQVPYYDYALDLILDIESSNGDVFTEEQNELIESSAEMLYGLIHARYILTSKGLAAMLEKFKNYDFGRCPRVYCCGQPCLPAGQSDIPRSSTVKVFCPKCEDLHYPRSKYQGNIDGAYFGTTFPHLFLMTYPHLKPQKPSQQYVPRVFGFKLHKQS

SEQ ID NO: 4677 - protein, 236 aa, Triticum aestivum
MRRFQESVKALEADIQHANALASEFMRDYDGSVIQMRMAYSAVAHVLVQWTDCRLASALGLLKIMIYKVYAEDGTTTLPSWEREASIREFYGVIFPSLLQLPSGITELDDRKQRRLCVDKFKRRDGDFSQLDLEREVECGICLEVNAKIVLPDCTHSLCLRCFEEWNAKSKSCPFCRACLQKVKPSSLWVYTDDRDVVDMDALTSENIRRLLMYINKLPLVVLHVVDLDIYEYHSK

SEQ ID NO: 4678 - protein, 214 aa, Triticum aestivum
  unsure (1)..(214): unsure at all Xaa locations
MPVLAMPSASLPLLSPRHRPLLRPSTLPASRLGSGILRVAAPTSVPGEAERAEEPTTSASTSPESXGEKFVWRDHWYPVSLVEXDLDPRVPTPFQLLNRDLVIWNDPNSGDWVALDDRCPHRLAPLSEGXIDKTGGRQAPHGWSFXXXGACTKIXSRPXGPEXRAVRSPGLTIPTLFPGLFADKMVKARPQPSMLRGLMTGFSRKGTFWLKIKS

SEQ ID NO: 4679 - protein, 393 aa, Triticum aestivum
MVLIVTSLTWIGWFPFILFDTDWIGREIYRGSPEIVADTQKYHDGVRMGSFGLMLNSVVLGITSIGMEKLCRKWGAGLVWGVSNIIMALCFGARVFPFTITESCTVSCANLKSAFLLDIIILAITTYVSVVTVQDNPTFGSEEAAPPSSHEEEAFLFELFGSFLYLTIRSSRGLIAAPGTSISAEAFILSSADWMHPQIYRGCPEILGDREPGSGRRRKPPNDDDSSEYTETLSSIGMEKLCRKWGAGLVCGVSNIIMALCFVAMLIITYVAQNLDYGPSGAPPTGIVAASLIVFTILGAPLSVTYSIPYAMAASRVENLGLGQGLAMGILNLSIVIPQIIVSLGGGPWDQLFGGGNAPSFWVAAAASFVGGLVAILGLPRARLGPKKKTTQR

SEQ ID NO: 4680 - protein, 296 aa, Triticum aestivum
SRVDRLRKATEGYISVAFIQMLKALMPVATFIMAVLCGTDKLRRDLFLNMVLVSVGVVVSSYGEIHFNVIGTLYQVTGIVAEALRLVLTQVLLQKKGLTLNPITSLYYIAPCSFIFLFGPWYLLEKPEMDISPIQFNYWIFFSNALAAFALNISIFLVIGRTGAVTVRVAGVLKDWILIALSTVIFPESTITSLNIIGYAVALSGVVMYNYLKMKDVTAIQLPIDNTADRATKEKKVVNIYKPDSSIDSIDETVVGGVAVGSMATEAAAVDEEAPLIPSSRISHVTRTQTGGLSSR

SEQ ID NO: 4681 - protein, 89 aa, Triticum aestivum
GYVGKHRLSAAIQRLDQELQSLQDELNELETMEPASAACREVITSTEGKPDPLLPITSSPENSSWDRWFQRVRSSRSNKWWQSKGSDFA

SEQ ID NO: 4682 - protein, 274 aa, Triticum aestivum
  unsure (1)..(274): unsure at all Xaa locations
MGRGKVQLKRIENKINRQVTFSKRRNGLLKKAHEISVLCDAEVAXIVFSPKGKLYEYATDSSMDKILERYERYSYAEKALISAESESEGNWCHEYRKLKAKIETIQKCHKHLMGEDLDSLNLKELQQLEQQLESSLKHIRSRKSHLMMESISELQKKERSLQEENKALQKELVERQKAAASRQQQQQQQQMQWEHQAQTQTHAHTQNQPQAQTSSSSSSFMMRDQQAHAPQQNICSYPPVTMGGEAAAAAAAPGQQAQLRIGGLPPWMLSHLNA

SEQ ID NO: 4683 - protein, 424 aa, Triticum aestivum
  unsure (1)..(424): unsure at all Xaa locations
MGVGKKVLNDVKPYMMMILLQIGXAGMYIVSVASLKRGMSHYVLVTYRNLVATLVMLPFALFFEKGTRPKMTLRIFIKILGLALLEPVLDQNLYYVGNARASASFSSALVNILPAVTFIMAIVLRMEKLRLRSSHSQAKVAGTICTVIGAVLMIMYHGPVVQFPWARGAHHVDQAASAAAAQSSATWLKGTIAIITSCVAWAGFFVLQSNTLNSYPAALTLTTLICAMGTGINGSMALVAERHDMSAWVIGLDTRLFTVVYSGVVCSGVAFFVQGIVTETRGPVFVTAFQPLCMIITAVLGSVILKEETTLGSVIGAAIIVLGLYSLIWGKSNDIIDKPVHSVAEKLALAHLRQRQRQRHQRHQRDQRRQARQRRPGRPRRRDAGGEGRDLPLATTRRHLARAPTYVLRAFLRSRVWSRNLLYV

SEQ ID NO: 4684 - protein, 538 aa, Triticum aestivum
  unsure (1)..(538): unsure at all Xaa locations
PAEPASHVKDPGKPPVNDAPSSATKLMVPAAKQYIENHYKTQMKSLQDRKERRWMLERKLXNAEVPAEEQNNILKHLEKKETEYMRLQRHKMGVEDFELLTIIGRGAFGEVRLCREKTSKSVYAMKKLKKSEMLRRGQVEHVKAERNLLAEVDSAYIVKLYYSFQDDEFLYLIMEYLPGGDMMTLLMRKDTLTEDEAKFYIAETVLAIESIHKHNYIHRDIKPDNLLLDLSGHLKLSDFGLCKPLDSSNFPNLNEPDYTPGKGAKPLPDNTSRLTNSSAPKRTQQEQLSHWQKNRRMLAYSTVGTPDYIAPEVLLKKGYGMECDWWSLGAIMYEMLVGYPPFYSEDPMSTCRKIVNWRSHLKFPEEAKLSSETKDLISKLLCNVEQRLGTKGAHEIKAHTWFRGVQWEKLYQMKAAFIPEVNGELDTQNFEKFEETGAQVQSSSKAGPWRKMLPSKDANFVGYTYKNFEIVNDDEVAGIAELKKKSSKSKRPTIKTLFESMDEDEPVHGSFLNMLPHKEGQPSSHSSAPPEQYQPRRK

SEQ ID NO: 4685 - protein, 528 aa, Triticum aestivum
  unsure (1)..(528): unsure at all Xaa locations
VRSPANSSVASTPARGGFKRPFPPPSPAKHIRALLARRHGSVKPNEASIPEGGEPELGLDKSFGFSKHFFAKYELGEEVGRGHFGYTCAAKAKKGEHKGQDVAVKVIPKAKMTTAIAIEDVRREVRILSSLTGHSNLVQFYDAFEDEDNVYIVMELCKGGELLDKILARGGKYSEEDAKVVMLQILSVVSFCHLQGVVHRDLKPENFLFSSKEENSPLKVIDYWLXSTFVKPDQRLNDIVGSAYYVAXPEVLHRSYGTEGXCWSIGVIAYXLLCGSRPFWARTESGIFRAVLKAEPSFDEAPWPTLSAEAKDFVKRLLNKDYRKRMTASQALSHPWIRDAQQVKIPLDMIIYKLIRAYISSSSLRKSALRALAKTLTANQLFYLKEQFELLGPNKSGFISLQNLKSALVKNSTDAMKDSRVIDFVNTVCTLQYRKLDFEEFAASAISVYQMEALETWEQHARRAYELFDKEGNRPIVIEELASELGLGPSVPLHVVLQDWIRHADGKLSFLGFIKLLHGVSSRSIPKA

SEQ ID NO: 4686 - protein, 203 aa, Triticum aestivum
MGLMAGMLPGVEFARRRRLRPAPEAPCAGARRPALMGVFGHDHAHLGSAGFAKQRSGVCEEAWATQLDSIAREAKERLDHKLRSQRESVVKRRHSTGSLRLPVPSSTTSDHPAKDTAGAASTLQREVFTKRGGGRRFSWGRRKEQQQQAECAVCLEEFRAGDVLAHLPCAHRFHWACAVPWVQAASRCPFCRAAVRLADHQLL

SEQ ID NO: 4687 - protein, 478 aa, Triticum aestivum
MEVVTSQWMNCSKLAKSITCQMLFLMMSLKKLTGTMMGASTICKSISKRKLITKEDIDDVRREIQIMHHLSGHLNVVAIKGAYEDQLYVHIVMELCAGGELFDRIIQRGHYSERKAAELTRIIVGVVEACHSLGVMHRDLKPENFLLANKDDDLSLKAIDFGLSVFFKPGQIFTDVVGSPYYVAPEVLCKKYGPEADVWTAGVILYILLSGVPPFWAETQQGIFDAVLKGVIDFDSEPWPVISDSAKDLITRMLNPRPAERLTAHEVLCHPWIRDQGVAPDRPLDTAVLSRIKQFSAMNKLKKMALRVIAESLSEEEIAGLKEMFQTMDADNSGAITYDELKEGLRKYGSTLKDTEIRDLMDAADVDNSGTIDYIEFIAATLHLNKLEREEHLVAAFSYFDKDGSGYITVDELQQACQEHNMPDAFLDDVIKEADQDNDGRIDYGEFVAMMTKGNMGVGRRTMRNSLNISMRDAPGAI

SEQ ID NO: 4688 - protein, 280 aa, Triticum aestivum
LIFLQQKDKERVAPFLRPVIEVKVVKSFLQGFLPGLALKLFLYILPTVLMIMSKVEGYVSLSSLERRTASKYYYFMLVNVFLGSIIAGTAFEQLDSFFHDPPSQIPRTIGVAVPMKATFFMTYIMVDGWAGIANEILRVKPLVIYHLKNMFIVKTERDRERAMDPRSISLGENLPSLQLYFLLGLVYAVVTPILLPFIIVFFAFAYLVYRHQIINVYNQEYESAAAFWPQVHSRIIASLLISHVTLFGLMSTMKAAYPEGLLTFLSVVDKWVRSTITELV

SEQ ID NO: 4689 - protein, 166 aa, Triticum aestivum
MIMGALCDFCGEQRPTIYCRSDAASLCLSCDRNVHSANTLSQRHMRTLLCDRCASQPAAVRCLEENTSLCQNCDWNGHAATSLAAGHLRQTINCYSGCPSSEELARIWSFDADAPSAAAEPNCEEGISMMSINDSGVSNHCGAQQDSSLLDMANTSLISDPHTGEK

SEQ ID NO: 4690 - protein, 380 aa, Triticum aestivum
MADRANHPSVMQKFGGQFHLASSFSEGVRARNICPSVPSYERRFTTSCYMTQNLGISVPMMSSSPLFANAPPEKKGVKNFAIDFLMGGVSAAVSKTAAAPIERVKLLIQNQDEMIKAGRLSEPYKGIGDCFGRTIKDEGFGSLWRGNTANVIRYFPTQALNFAFKDYFKRMFNFKKDKDGYWKWFGGNLASGGAAGASSLFFVYSLDYARTRLANDAKASKGGGDRQFNGLVDVYRKTLKSDGIAGLYRGFNISCVGIIVYRGLYFGLYDSLKPVLLTGTLQDNFFASFALGWLITNGAGLASYPIDTVRRRMMMTSGEAVKYKSSLDAFQQILAKEGAKSLFKGAGANILRAIAGAGVLSGYDQLQILFFGKKYGSGGA

SEQ ID NO: 4691 - protein, 380 aa, Triticum aestivum
MADRANHPSVMQKFGGQFHLASSFSEGVRARNICPSVPSYERRFTTSSYMTQNLGISVPMMSSSPLFANAPPEKKGVKNFAIDFLMGGVSAAVSKTAAAPIERVKLLIQNQDEMIKAGRLSEPYKGIGDCFGRTIKDEGFGSLWRGNTANVIRYFPTQALNFAFKDYFKRMFNFKKDKDGYWKWFGGNLASGGAAGASSLFFVYSLDYARTRLANDAKASKGGGERQFNGLVDVYRKTLKSDGIAGLYRGFNISCVGIIVYRGLYFGLYDSLKPVLLTGTLQDNFFASFALGWLITNGAGLASYPIDTVRRRMMMTSGEAVKYKSSLDAFQQILAKEGAKSLFKGAGANILRAIAGAGVLSGYDQLQILFFGKKYGSGGA

SEQ ID NO: 4692 - protein, 229 aa, Triticum aestivum
  unsure (1)..(229): unsure at all Xaa locations
PRVRPRVRPRVRPRVRFKRMFNFKKDKDGYWKWFGGNLASGGAAGASSLFFVYSLDYARTRLANDAKASKGGGDRQFNGLVDVYRKTLKSDGIAGLYRGFNISCVGIIVYRGLYFGLYDSLKPVLLTGTLQDNFFASFALGWLITNGAGLASYPIDTVRRRMMMPSGEAVKYKSSLDAFQQILAKEGAKSLFKGAGANILRAIAGXGVLSGYDQLQILFFGKKYGSAGA

SEQ ID NO: 4693 - protein, 380 aa, Triticum aestivum; identical to SEQ ID NO: 4691

SEQ ID NO: 4694 - protein, 90 aa, Triticum aestivum
TCEDRDGFSAVSFQVLGHMKTVLVLFLGFLFFGKEGLNLHVVLGMILAVLGMMWYGNASAKPGGKERRSVLPVRSDRHNGGSEDKDGGEK

SEQ ID NO: 4695 - protein, 359 aa, Triticum aestivum
  unsure (1)..(359): unsure at all Xaa locations
MGQKDSKPSYNSADSGNSSNGYNSRYANTPSSYSPRYASSAGNNVQQPEAQARLQRKYSRIGDDYRSVSQVTEALAQAGLESSNLIVGIDFTKSNEWTGKISYNRRCLHDIGNTPNPYEQAISIIGRTLSAFDEDNLIPCFGFGDASTHDQEVFSFYPENQPCNGFEEALERYREIVPTLRLAGPTSFAPIIETAIGIADSTGGQYHVLLIIADGQVTRSVDTQSGQLSPQERDTIDAIVKASHFPLSIVLVGVGDGPWDMMHKFDDNIPARSFDNFQFVNFTEIMXKSIAADRKEAEFALXALMEXPTQYKATRRSSWPRNVAQKYLLPTGSYTVYFTTLLRLNLHNRVNILTGSGPR

SEQ ID NO: 4696 - protein, 210 aa, Triticum aestivum
TDMRFRYQDTASHAADMAGDMIDRAKDTADDAAYRASRMTDIAKHDINDMASHAADKAGDMMDMAKDTTGHAIDRAIDTAGAANDITAEVAEGAMDIAGDAIDRATDGTRIAGDIVADMTNDGASIVADTAQALGDIAIQAAQGAWEATYEAAQGVNDIVGSYITADDHSTWDDVDAATKDMDRIAHDDAVMHAMDNGAGLPYDDDGCLA

SEQ ID NO: 4697 - protein, 406 aa, Triticum aestivum
MDPPPPPPPQPAHGGYAARFSPAGLIHAPLSALLEYSSGVLRAQAGGGGPQRGEPAAGADGEVSIRIAGPDDAPGAGAGDAGGQQPADEEAPAARGDEAGAGGGSGRGDSPYQGYDVQRLARWVEHALPFSLLLLGVFIRQHLQGFFVMIWIAAVMFKSNDILRKQTALKGERKMPMLIGIVTVFTIHVFGVYWWYRNDDLVRPLVMLPPKEIPPFWHAIFFIAVNDTMVRQAAMVVKCVLLMYYKNSKGRHYRRQGQMLTVVEYSLLLYRALLPAPVWYRFFLNKEYGSLFSSLTTGLYLTFKVASMVEKVRSLLASVNALSHKDLHYGSHATTEQVLAAGDLCAICQEKMHTPILLQCKHIFCEDCASEWLERERTCPLCRALVKPGDIRSFSDGSTTLFFQLF

SEQ ID NO: 4698 - protein, 261 aa, Triticum aestivum
MAKAAAAGTREEMVYLAKLAEQAERYEEMVEFMEKVVAAAGTVELTIEERNLLSVAYKNVIGARRASWRIVSSIEQKEEGRGAAGHAAAARGYRALVEAELSNICAGILRLLDERLVPAAAAVDAKVFYLKMKGDYHRYLAEFKSAAERKDAADSTLGAYQAAQDIAMKELPPTHPIRLGLALNFSVFYYEILNSPDRACSLAKQAFDEAIAELDSLGEDSYKDSTLIMQLLRDNLTLWTSDMQDDAGDEMRDSSKPEDEQ

SEQ ID NO: 4699 - protein, 339 aa, Triticum aestivum
  unsure (1)..(339): unsure at all Xaa locations
MAFFSHHHLQQPHPAAPPPQQQQQQPAPLSFRNALPVPVDGQIPAPLAFFNAPPAFPDQAGQPQIVDAAGLTAAAGMGWRQPREQELLGENSQMSSIDFLQTGSAVSTGLALSLEDRRHGGGGAGAGNSSGDSPLLLLPMLDDDISREVQRLDADMDRFIRAQSERMRQSILXEVQAKQFEALASVEDKILRKIRDKESEVQNINKRNLELEDQIKQMAGEVGAWQQRAKYNESMISALKYNLEQVCAHQSKDFKEGCGDSEVDDTASCCNGGAVNLQLMPKENNHPKDLTACRVCKSSEACMLLLPCRHLCLCKECESKLSFCPLCQSSKILGMEIYM

SEQ ID NO: 4700 - protein, 239 aa, Triticum aestivum
  unsure (1)..(239): unsure at all Xaa locations
DAELKRRKIPRNKQVLKETFDEWEEAYPHDAXQRKTDELFLKEALXEAQRAADIWEVPVGAVLVHNGEIIARXGCNLVEDLRDSTAHAEIVCIREASSXLKTWRLADTTLYVTLEPCAMCAGAILQARVDTVVWGAPNKLLGADGSWVRLFPGDGQTSTLDPANQKQTAGPVHPFHPKIIVRRGVLSTECSEIMQQFFQLRRKKKRAESPPRAHYSGHRHHPIKFFTKMQHMFGTVFCL

SEQ ID NO: 4701 - protein, 360 aa, Triticum aestivum
  unsure (1)..(360): unsure at all Xaa locations
MGRGDGHDDALRRWLREAGGWLVVDGALGTELEAHGADLQDELWSARCLVSAPHLIRKVHLDYLDAGANIITTASYQATLQGFQSRGVSREQGEALLRRSVQIAQEARAIFVEGRSKGPYAARDEYDGVASRARRPVLVAASVGSYGAYLADGSEYTGDYGRSVTKEALKNFHRRRLQVLAXQGPDLIAFETIPNKLEAQAYAELLEENDISIPAWFSFTSKDGANAASGDPITECAAIADSCRRVAAVGINCTAPRLIHGLVISISKVASKPIVVYPNTGETYVAETKEWVDSAAAGGGAAGTDFVSCVGKWRQAGASLVGGCCRTGPATVRAIARALREADAASDADADDDYPAVAVL

SEQ ID NO: 4702 - protein, 235 aa, Triticum aestivum
MAANVGESAAVGGSSSDAAGGSFECNICFELPQEPIVTLCGHLFCWPCLYRWLHMHANTPECPVCKAIVEEDKLVPLYGRGKDRVDPRSKNTPGVDIPQRPAGQRPATAQQADPNNNFGNAHANPWFMGMGGAGAGAGVPLANGRWGNYAFSAAFGGLFPMLSFQMHGFPDPAAYAQPAGFHYGFGHGHGFHGGQHAHGVPRQGPLGQQQQQADVYLKALLIMVGVLVIASLLAA

SEQ ID NO: 4703 - protein, 620 aa, Triticum aestivum
  unsure (1)..(620): unsure at all Xaa locations
MEWDSDSDGSGEEDEEEEEGEEGSGPRGADGCRRGRGFSLAIEGVLGGACGLVLSDALEPDFPIIYVNRGFEDATVYHAEEVLGRNCRFLQCRXPFAQRRHPLVDAVVSTEIQRCLXEGTEFQGDLLNFRKDGSPFMTSLQLKPIYGDDETITHYMGIQFFNDCNVDLGPLPGSMAKEVVRSIWITPDNTLRPSPTGKGNFCSEYSHLFQLSDEVLCQKILSRLSPRDIASVNSVCKRLYHMTKNDHLWRMVCQNAWGNDATRALENVAGTKSLAWGRLARELTTLEAVTWKKLTIGGSVEPSRCNFSACAVGNRVVLFGGEGVNAQPMNDTFVLDLSASKPEWRHINVGLAPPGRWGHTLSCLNGSLLVLFGGCGGQGLLNDVFILDLDAKHPTWREIFGLTPPVPRSWHSSCTLDGSKLVVSGGCADSGVLLSDTHLLDVTMERPVWREIPAPWTPPSRLGHSLSVYDGRKILMFGGLAKSGPLRLRSGDVFTMDLSDAAPSWRCITGSGMPGACNPAGVGPPPRLDHVAVSLPGGRIMIFGGSVAGLHSASQLYLLDPTEEKPTWRILNVPGRPPRFAWGHSTCVMEGSKAIVLGGQTGEEXWTLTEIHELSAGQLL

SEQ ID NO: 4704 - protein, 181 aa, Triticum aestivum
DTIDHTHQETRQIKKTRGGRENQMAFSEAQEELVLRSWKAMKPDSESIALKFFLRIFEIAPAAKPMFPFLRDAGEDAPLESHPKLKAHAVTVFVMACESATQLRKTGDVKVREATLRRLGATHVRAGVADAHFEVVKTALLDTIEGAVPEMWTPEMKAAWEEAYDQLAAAIKEEMKLAAAA

SEQ ID NO: 4705 - protein, 288 aa, Triticum aestivum
MGGTHFADDDLAHEATGDGDVGRRDVGKMEHGCEHYRRRCKIVAPCCKEVFPCRHCHNDATALGDRHNICRQDVEKVVCVLCDTEQPVSQVCVRCGVNMGEYFCDVCKFYDDDTEKGQYHCHDCGICRVGGKENYFHCAKCGSCYAVALRDNHQCVEDSMRQNCPICYEYLFDSLKGTRVLNCGHTMHMDCFAEMVDHNKYTCPICSKTALDMTVHWGMLDQEIEATIMPPVYRYKVWVLCNDCNKVSEVDFHVIGHKCSHCNSYNTRSTSRPADLSGSSSPSTTDSS

SEQ ID NO: 4706 - protein, 240 aa, Triticum aestivum
VWVQRGLRRHIHNLRVSTVGVGAMGYIGNKGSISVSMSIYQTPFCFVCCHLTSGEKDGNLTKRNADVEEILRRTIFNPVHRVSMPKGIHDHEKIIWFGDLNYRINLSYERTHELISRQEWDLLFDNDQLKWELMSGRAFYGWIKGVMSFPPTYKYEFNSDKYAGDEPISARRRPAWCERILSYGKGIRLDSYRRVELNLSDHRPVSAVYMAEVEVLCHRKFQKAVTFTNVEVEDHLLLER

SEQ ID NO: 4707 - protein, 143 aa, Triticum aestivum
  unsure (1)..(143): unsure at all Xaa locations
SISQRWPEEKHHHHLFHHKKEGEDXRPAADGGVDMYGYSTETVVTATGNEGEYERITKEEKHHKHKEHLGEMGAAAAGAFALYEKHEAKKDPEHAHKHKIEEEVAAAAAVGAGGFVFHEHHEKKQDHKEAKEASGEKKHHHFG

SEQ ID NO: 4708 - protein, 138 aa, Triticum aestivum
  unsure (1)..(138): unsure at all Xaa locations
MAEEKHHHHLFHHKEGEDFQPAADGGVDTYGYSTETVVTATGNEGEYERITKEEKHHKHKEHLGEMGAAAAGXAFALYEKHEAKKDPEHAHKHKIEEEVAAAAAVGAGGFVFHEHHEKKQDHKEAKEASGEKKHHHFG

SEQ ID NO: 4709 - protein, 173 aa, Triticum aestivum
MEINSSGEETVIKVRKPYTITKHRERPTGPEHKRFLEALKLYGRAWQRIEEHVGTKTAVQIRSHAQKFFTKLEKEAINNGTSPGQAHDIDIPPPRPKRKPNCPYPRKGCLSSETPTREVPKSSVSLSNSNAEMASNGTLQLTCIRKLQRKELSENGSCSKVINIFREAPSASF

SEQ ID NO: 4710 - protein, 281 aa, Triticum aestivum
  unsure (1)..(281): unsure at all Xaa locations
MAVDYGSREERWSLAGTTALVTGGSKGIGHAIVEELAGFGARVHTCSRNGAELEECRRRWEEKNLQVNASVCDVSIRADREKLMETVRETFNGKLDILCRLWGRYRPCLXGVLMVEVNNAGQLLFKPTTECTVKEYSNLLTTNLESSFHLSQLAHPLLIHASIAGGGSIINMSSIGGSIGYAGSAIYATTKGAMNQLTRSLATEWAPTQIRVNAIAPGFVTTDMLKDIDTEFVKGEHLKTPLGRSGKPVEIATAVSFLCMPAASFITGQVICIDGGRTISS

SEQ ID NO: 4711 - protein, 232 aa, Triticum aestivum
  unsure (1)..(232): unsure at all Xaa locations
RSLRIELPAGELGMDDGVLLKWKADFGSTLAPGGILGAASASASPSSAAKDGATAAPPPPTADCAESDDSGSIPESFYTNGGLKLRVLWTISSLIAASARHYLLQPIISDHALLESLDLTDADGQGALTMDKWQLQELRVRPXSASGDSHRTLMPALXMRLWYAPHIELPGGTVLCGATLLAVGPSEEAMMDAVGNATAGSAGGILGFKMLLRTISDGRVLLLKAEDVIPLR

SEQ ID NO: 4712 - protein, 271 aa, Triticum aestivum
  unsure (1)..(271): unsure at all Xaa locations
MAPQSLDLGLSLGLGLVSRPSQPSFWYSGGNVAADQEVGPTPTAAAVEERRCSPGSPASSGSGSGLKRGAERSAGSGDEDQDDDGGNARKKLRLSKDQAAVLEECFKTHHTLTPKQKLALANSLGLRPRQVEXVWFQNRXGARTKLKQTXEVDCEYMKRXWCEQLAEQNRRLEKEVAELRALKAAPAGAXTAPRRGPFTTLTMCLSCKRVASTSSASACTVPSFSANAGIGMPMPSPVAQPEHRQFFCGFRDTGAAYGGPAGLTKVVKAAR

SEQ ID NO: 4713 - protein, 99 aa, Triticum aestivum
GVAAARPLPANTAPHPGIGVVRGKTEDAGATDGRVVLKEERGKAGNGGEAVSPSEATVDDATAEEEACEEGKEGEECMQRRLLHDAHLDYIYTQHKGRP

SEQ ID NO: 4714 - protein, 91 aa, Triticum aestivum
HALPFSLLPLGVFIRQHLQESFFVMIWITAVMFKSNDILRKQTALKQATRLGERPCHCHDGCSFWPDRGMKTCGIPSFGRTSSSGGLHVMS

SEQ ID NO: 4715 - protein, 75 aa, Triticum aestivum
  unsure (1)..(75): unsure at all Xaa locations
PQEVVGPVPPKGSVLGFFPXPMQAVKQGFQDLGAPPWRPAHDLFRAGTFRLKVGPGPPQVEGGTPGLVSAEKKSF

SEQ ID NO: 4716 - protein, 186 aa, Triticum aestivum
  unsure (1)..(186): unsure at all Xaa locations
CRRRRLLEADSRTLDAFEATASDDADRSEDVETPPPVAKAQLVGWPPLGSDRKSXFQAAASNSKGNKADEASSNNTPSAAAPASTNGSFVKVSMDGAPYLRKVDMRMYKGYRELREALEAMFVCFSGADGGASNGGGANPAEYAITYEDKDGDLMLVGDVPFDMFSGTCKKLRIIKRSEATGLGSK

SEQ ID NO: 4717 - protein, 272 aa, Triticum aestivum
  unsure (1)..(272): unsure at all Xaa locations
MWRSERGSMAVDYGSREERWSLAGTTALVTGGSKGIGHAIVEELAGFGARVHTCSRNGVELXEECRRRWGEKNLRVTVSVCDVSIRADREKLMETVRETFNGKLDILVNNAGQLLFKPTTECTVEEYSNLLTTNLESSFHLSQLAHPLLIHASIAGGGSIINMSSIGGSIGYAGSAIYATTKGAMNQLTRSLATEWASDKIRVNGIAPGFVTTDMLKDIDTEYVKEEHSKTPLGRSGKPVEIASAVSFLCMPAASFITGQIICIDGGRTISV

SEQ ID NO: 4718 - protein, 355 aa, Triticum aestivum
  unsure (1)..(355): unsure at all Xaa locations
MGVAAEKFQLGTLGALGICVVAPVSFVICNKALMSTLGFLFATTLTSWHLLVTFCSLHVALCMKLFEHKPFDARTVMGFGVLNGISIGLLNLSLGFNSVGFYQMTKLAIIPCTVILETLFFRKKFSRYIQLSLSVLLFGVGVATVTDLQLNAMGSVLSLLAIVTTCIAQIMTNTIHKKFKVSSTQLLYQSCPYQALTLXIVGPFLDGFLTNKNVFAFAYTPHVLFFIVLSCLISVSVNFSTFLVIGKTSPVTYQVLGHLKTCFVLTFGYVLLHDPFSWRNILGILIAVVGMGLYSYFCTREAPKPTEASPQVTQVKEGESDPLIADSLNAAENGAAATTDEPLKVPMWSSKYARA

SEQ ID NO: 4719 - protein, 158 aa, Triticum aestivum
MPWIHLGCRSAQGYRWMLQWSPMRRGWVSILEALKLYGRSWRQIQEHIGTKTAVQIRSHAQKFFSKVVREPGAKIEIEIPPPRPKRKPLHPYPRKRANSCNGANAANGQSKLAHMSSSSGSDQENGSPVSVISAMQSDAFGSSMSNPSSRSAFPESSD

SEQ ID NO: 4720 - protein, 310 aa, Triticum aestivum
MGAPKQKWTAEEEAALKAGIGKHGAGKWRTILKDPEFSNILRYRSNVDLKDKWRNMNVTVNASGTRDKVRTTTTTTTPTAKKPRSAPKQETHSTAITTITSDGDDDLVDVKPIIKPIVTFTTGSPIVSLSTRAGIIPLPRQALNEPTGSYKTAVANYIEEQYWPPADFDHVLSAKLNELTSSGKLMKVNRRYRIAPSSSFLEGRSSKMLLLDDIKKEPTKVEKVERDGFTAHTKSQVDAELARMRNMSAEEAAAAAARAVAEADAIMAEAEAAVREAEAAEADAVAAQAFAEAAMLTLKNRSSAKLIIRG

SEQ ID NO: 4721 - protein, 253 aa, Triticum aestivum
  unsure (1)..(253): unsure at all Xaa locations
LKKADKLDRELSLMRSQEETGRHVRMLIHEIRSTLDRHTILKTTLVELGRTLGLQECAFWMPSRSGSSLELTHTMRHHIPTGSSVEINLPVVNQVFSTNRAIIVPHTSPFARIHPVQGRHVPPEVAAVRVPLLHLPNFHPELLAKSYAIMVLMLPSDSARKWLAHELELIEVVADQVAVALXHAAILEESMXARDLLTEQNVALDLALREAEMAIHARNVNRVGVELVGPEDADNVATINSSASAAKVHNAEP

SEQ ID NO: 4722 - protein, 258 aa, Triticum aestivum
MRIQCDACEGAAATVVCCADEAALCARCDVQIHAANKLASKHQRLPLEDAAAAAGLPRCDVCQDKPAFVFCVDDRALFCRDCDDSIHVQGTLSANHQRYIATGIRVGFSSVCSAHGAGHDADHHAPPKVACEPYPPAQPAARAQQVPSPPQFLPQDWAVDELLQFSDYESNDKLHKDSPLAFKELEWFTADMELFHDHAPKGGRATMEVPEFFASQAADDAAYYRPSRVAATAGLRQSKKARVEIPDDEDFFIVPDLG

SEQ ID NO: 4723 - protein, 338 aa, Triticum aestivum
STASSACRRRTAWRTTTPCPPTCPAPSSRPRRRPSRRPGIGVVPGGGGGASGAGAAVGIALPPLPTATSVHELLDCPVCTNSMYPPIHQCQNGHTLCSTCKARVHNRCPTCRQELGDIRCLALEKVAESLEPPRRYSALGCPEIFPYYSKLKHESQCNFRPYSCPYAGSECSVVGDIPFLVSHLRDDHKVDMHSGCTFNHRYVKSNPREVENATWMLTVFHCFGQYFCLHFEAFQLGMAPVYMAFLRFMGDENDARNYSYSLEVGANGRKMIWEGTPRSIRDSHRKVRDSHDGLIIQRNMALFFSGGERKELKLRVTGRIWKEQQNPDSGACIPNLFS

SEQ ID NO: 4724 - protein, 140 aa, Triticum aestivum
  unsure (1)..(140): unsure at all Xaa locations
MGEDKHHHHLFHHRKEGEDFQPAADGGVNXTSYSTDTAVTATGYXGEVPFGSPSEEKHHKHKDHLRQMGAVAVGAFALYQKHNAKKDPEHAHKHKIEEEVAXAAAFVGAGGFVFHEHHEKKQDHKEATEASGEKKHHHFG

SEQ ID NO: 4725 - protein, 320 aa, Triticum aestivum
MPSFKAPAPGFSVRFSPFHEHRLLAATSQHFGLVGNGHLLVLDLSAAGPGGPGLTPLFSFPTSDALFDCAWSESHDSLCAAASGDGSVRLFDVTLPPAQNPVRLLREHAREVHGIDWNPVRRDAFLSASWDDTLKLWSPDRPASVRTFRGHEYCVYAAAWSARHPDVFASASGDHTARVWDVREPGPTLVIPAHDHEVLSLDWDKYDPSILATGSVDKSIRIWDVRSPQAPLAQLAGHGYAVKRVKFSPHRQGMLMSCSYDMTVCMWDYRKEDALLQRYGHHTEFVAGIDMSVLTDGLLASTGWDEMIYVWPFGSDPRAM

SEQ ID NO: 4726 - protein, 143 aa, Triticum aestivum
  unsure (1)..(143): unsure at all Xaa locations
PPHGTGVRVRAPLVESVSCYCRLDTGLKTVVEARKFVPGAKMCMQPEVKQNKRKSRGSKKEWCRTQAPLLPGLPDDLAIACLIRVPRLEQPKLMMGCKRWNRLLSGNYFYSLRKKIGVAEEWVYVFXRGPGRKNSWDAFYPLH

SEQ ID NO: 4727 - protein, 498 aa, Triticum aestivum
  unsure (1)..(498): unsure at all Xaa locations
PRVRKTCYVQFPQRFDGIDLHGRRANRNIVFFDINMKGLDGIQGPMYVXGTGCCFNRQALYGYDPVLTEADLEPNIVVKSCCGGRKKKSKSYMDNKNRMMKRTESSAPIFNMDDIEEGIEGYEDERSMLMSQKRLEKRFGQSPIFTASTFMTQGGIPPSTNPASLLKEAIHVISCGYEDKTEWGKEIGWIYGSVTEDILTGFKMHARGWISIYCMPPRPCFKGSAPINLSDRLNQVLRWALGSVEILFSRHCPIWYNYGGRLKLLERVAYINTIVYPLTSLPLIAYCVLPAICLLTNKFIIPEISNYAGMFFILMFASIFATGILELRWSGVGIEDWWRNEQFWVIGGTSAHLFAVFQGLLKVLAGIDTNFTVTSKANDEDGDFAELYVFKWTSLLIPPTTVLVINLVGMVAGISYAINSGYQSWGPLFGKLFFSIWVILHLYPFLKGLMGKQNRTPTIVIVWSILLASIFSLLWVKIDPFISDTQKAVAMGQCGVNC

SEQ ID NO: 4728 - protein, 427 aa, Triticum aestivum
  unsure (1)..(427): unsure at all Xaa locations
MSLKSIVRELKEMRDRIGSMSRRXRRLRRARRPRPRGGSRHSWPSLWPEPQPQRPGQEPQQQGXQWANLPPELLIDVIQRVEASEVAGPARRHVVACAAVCRSWREVTKDVVKTLEECSRITFPISLKQPGPRDCPVQCFVRRDRATSTYLLYLGLSPSLHGENDKLLLAARKIRRAARTSFVISLISDDFSHSSSTYVGKLKPNFLGTKFTIFDSQPPCDAAVLPNNKPSKRHSKQVSPRLPLGNYNVATVSYELTVLRNRGPRRMQCTMHSIPAVCIQEGGKAPTPTGMVHSLDEQVSTLSTSSKGKEPNIEFLSTSLSADLSGPISTSEAPLLLKNKAPRWHEQLQCWCLNFRGRVTVASVKNFQLVASVDPSLGVPAAEQEKVILQFGKIGKDIFTMDYRYPLSAFQAFAICLTSFDTKPACE

SEQ ID NO: 4729 - protein, 243 aa, Triticum aestivum
  unsure (1)..(243): unsure at all Xaa locations
MRKAYRDSLKVLEADIQHANTLATEFPREYDGACLQMRLSFSPAAHIFLFLVQWTDCSLAGALGLMRILIYKVYVDGTTTMSTHERKASIKEFYAVIFPSLLQLQRGITDMEDKKQKAVCMERYRRRDEDETSSLSDVDAEREEECGICMEMNSKVXVLPNCTHAMCLRCYQDWNSRSQSCPFCRDNLKKTDPGDLWIYVEDDDVVDMETVSRENLRRLFMYINKLPLIVPDVIFSVYDSHIK

SEQ ID NO: 4730 - protein, 426 aa, Triticum aestivum
  unsure (1)..(426): unsure at all Xaa locations
AMAMDESPQLFLCPISMELMEDPVTVSTGVTYDRRSIERWFFKYGKTTCPATMQRVASLDLTPNHTLKRVIASWQDRASTSSSPSSPAGAFKPMARERLPSVLARHXGHALQGHRAQGPEAFKVTALKSMRSCMAGDVAMQIIFVASGGVEAVGRVMAQALAESGAGGDFSAFTVCEEAAAVLAALPLSDKASVGLVLAPECLRPVMALLQRGSAEARLHAMDILTKISSAGAGDHWTAGIDVDDVLKSLLELLSDEVSARLSSRALDVLLDVVERSPSGRAKAVEVGAVHVLVELLVVDADDRHVAERILLLLKRLCKCPEGRLAFAEHDLSVAAVARTMLRVSDLATQLAVKVLWLVSMVAQSEKVLEDMVLTGAVAKLLGLLHVESAPSTKQKTVRMVRIHGVFWRQYPCFPTDLKDYLRLLD

SEQ ID NO: 4731 - protein, 171 aa, Triticum aestivum
  unsure (1)..(171): unsure at all Xaa locations
MSSHRVKWNEDNPVXELNQTKPGEARRITEAQDNQYHPMMXREDGSLSPTRPFDKCLERPVSAEAILTALNGVASSSKNDSKDDEWASSDDDADAMEQDGDSEADRSSVSFKEHRRNHYDEFRKVKELMRTGSLVEDEARANERAANNVEDKTAGEKATGDKSESSASPQV

SEQ ID NO: 4732 - protein, 104 aa, Triticum aestivum
  unsure (1)..(104): unsure at all Xaa locations
PGHPLRAPTMQGGLVPACKGACYGDSDLPMXKQIQGSKGKFMLCSATNMPAVEVGGGPWFNGXKGSVVSPEPVNNIVGLXIYVESLFPIPFFQPPGLLVYSEDL

SEQ ID NO: 4733 - protein, 405 aa, Triticum aestivum
MGRKLALLVGINYPGTKAELKGCHNDVDRMHKCLVDRFGFDEENITVLLDRGSSGPQPTGANIRHALAKLVGDARRGDFLFFHYSGHGTRLPAETGQDDDTGYDECIVPSDMNLITDQDFRDLVQKVPDGCIFTIVSDSCHSGGLLDKAKEQIGNSTRQNQTQSREPEEERSHSGGGFRSFLKETVRDAFESHSRHGGEDQDEQPTGDGLTKNRSLPLSTLIEMLKEQTGKDDIEEGSIRLTLFNVFGDDASPKIKKFMKVMLDKFHEGGSGEQGGVMGMVGSLAHQFLKAKLEGTEEETFKPAIEQDMGSAEEAYAGTKSWAPNNGILISGCQTSQTSADATIPGGTSFGAMSNAIQAILASDDGKITNKDLVMKARAALSKQGYTQQPGLYCSDEHVHVAFIC

SEQ ID NO: 4734 - protein, 494 aa, Triticum aestivum
MAAAVADAAVPAAARANDAGAGCCAAKGPGYATPREAMEKGPREGLLYVTCVYNGTGIDKPDYLATVDVDPNSATYSQVIHRLPATHIGDELHHSGWNACSSCHGDPSTSRRFLILPSLLSGRVYVVDTAKDPRAPALHTVVQAEDIAEKTGLGFPHTSHCLATGDIMISCLGDKEGNAAGNGFLLLDSEFNVKGRWEKPGHSPLFGYDFWYQPRHKTMISSSWGAPAAFRTGFDLQHVQDGLYGRHLHVYDWPGGELKQTLDLGSTGLLPLEVRFLHDPSKDTGYVGCALTSNMVRFFKTADGSWSHEVAISIEPLKVRNWMLPEMPGLITDFVISLDDRYLYLVNWLHGDIRQYNIEDPAKPVLAGQVFVGGLLQKGSDVVYVTDDDKEEQYAVPQVKGNRLRGGPQMIQLSLDGKRVYVTNSLFSRWDEQFYGPDLLKKGSHMLQIDVDTEEGGLAVNPNFFVDFGTEPEGPSLAHEMRYPGGDCTSDIWI

SEQ ID NO: 4735 - protein, 75 aa, Triticum aestivum
RTPKKKEGSASGSGSGSVSKDVAGRRARRAQKREAADKAAAEKHLKLLQRLGRGKTPEAPPEALESLEVGPPVIE

SEQ ID NO: 4736 - protein, 176 aa, Triticum aestivum
  unsure (1)..(176): unsure at all Xaa locations
SGLVWLVCSCQAAAVGGGVGGDRAAGGCGVCAICLDRIPLQETALVKGCDHAYCVTCILRWASYKQTPVCPQCKHPFEFLSVHRSLDGCLHDYMFDESVCLLLRXTWFKPLVVEAHEEAQEEEDIYRSYQYDDGDEDDLYEEYISRSPSIRIGNRRWGDNGYVRGGRREARPVVIP

SEQ ID NO: 4737 - protein, 76 aa, Triticum aestivum
  unsure (1)..(76): unsure at all Xaa locations
MKFGSIYEEYLRAEQDKYLAKCSHVEYKRLKKXLKRCRLDRSLQADGTNGDXXQEDRSDDSSDACDCNSCTCMLSL

SEQ ID NO: 4738 - protein, 284 aa, Triticum aestivum
MAAAIDLSGEDLVRALEPFIREASAPLPLHSHLSPTSPFSFPHAAYSGYPYGVQAQAQTELSPAQMHYIQARLHLQRQTGQPGQLGPRSQPMKPASVAAATPPRPQKLYRGVRQRHWGKWVAEIRLPRNRTRLWLGTFDTAEEAALAYDQAAYRLRGDAARLNFPDNAASRGPLHASVDAKLQTLCQNITASKNAKKSASVSASTAAATSSTPTSNCSSPSSDEASSSLESAESSPSPATTTAAEVPEMQQLDFSEAPWDEAACFALTKYPSYEIDWDSLLAAN

SEQ ID NO: 4739 - protein, 568 aa, Triticum aestivum
  unsure (1)..(568): unsure at all Xaa locations
LRRSSRQEFVALGRVLALHTGAADQDVNDKNIAVQFQYVTWQLQAALTNLPHSCFQISDEVQEEVDLXRGQLKREMEKKGALDLNIFSEIHDILAHHVDHVGSQSEEPHCLPETFPLENLRSDHLELQHVALLISEISGISKSDIKKITSELIEGLENARVDDSAKPTNGDSKTSDEAKDSPDSVKKPDTVAMPEDFRCPISLELMRDPVIVSTGQTYERAFIQRWIDGGNRTCPKTQQKLLNLTLTPNYVLRSLILQWCEEKGIEPPTRSKYEGSSTRGRXDRLAIEALVRNLSCSSLDERKSAAAEIRSLAKKSTDNRMLLAESGAIPALVKLLSSKDPKTQEHAVTSLLNLSIYDQNKELIVVGGAIVPIIQVLRTGSMEARENAAAAIFSLSLIDDNKIMIGSTPGAIEALVELLKSGSSRGRKDAATALFNLCIYQANKVRAVRAGILSPLVQMLQDSSSAGATDEALTILSVLVSHHECKTAIAKAHTIPFLIDLLRSSQARNKENAAAILLALCKKDAQNLACIGRLGAQIPLTELSKTGSDRAKRKATSLLEHLSKLQVL

SEQ ID NO: 4740 - protein, 371 aa, Triticum aestivum
  unsure (1)..(371): unsure at all Xaa locations
MAMLEGMPVDMVNQVKDYYLIRQTLFDIDTQYVPNKPQGLGAYGILCSSINRETDEKVAIKKIHNVFDNGVCELRTLRELKLLRHLRHENVMXLKDIMMPVQRRSFKDVYLVYELMDTDLHQIIKSPQGLSNDHCQYFLFQLLRGLKYLHSAEILHRDLKPGNLLVNANCDLKICDFGLARTNSSKGQFMTEYVVTRWYRAPELLLCCDNYGTSTDVWSVGCIFAELLGRKPIFPGTESLNQLELIVNVLGTMSESDLEFIXDNPKARRYIKTLPYTPGVPLASMYPHAHPLAXIDLLQKMLIFDPTKRISVTQALEHPYMSPLYDPSANPPAQVPIDLDIDENISSEMIREMMWQEMLHYHPEAATAVNM

SEQ ID NO: 4741 - protein, 183 aa, Triticum aestivum
MGRKRAVLVGINYAGTKAELKGCHNDVARMRRCLVDRFGFDDDGAGIRVLSDADPAAPLQQPTGANIRRELARLVADARPGDSLFFHYSGHGTRLPAETGQDDDTGFDECIVPSDMNLITDQDFTELVQKVPDGCLFTIVSDSCHSGGLLDKAKEQIGHSTKQNKAQQGKREERSDSGSGGFR

SEQ ID NO: 4742 - protein, 103 aa, Triticum aestivum
  unsure (1)..(103): unsure at all Xaa locations
SEELTVGERSLISGGYKNVNGDSRASRRIMSSIEETEERPGIHDRVRLIKEEHRKIXTELNRICDSIINLLETHLIPSSTAPESTVPYRSMGDDYYSYRAQFM

SEQ ID NO: 4743 - protein, 384 aa, Triticum aestivum
MSTAGKTITCKAAVAWEAGKPLSIEDIEVAPPKANEVRIQIYYTGVCHTDAYTLSGKDPEGAFPIVLGHEGAGIVESIGEGVTNVKVGDHVVALYTPECKECKFCKSGKTNLCGKIRATQGKGLMPDGTSRFKCKGKDLLHFMGTSTFSQYTVVADISVVAIEHDAPMDRTCLLGCGITTGYGAATITANVQAGDNVAIFGAGCVGLSVVQGAAARKAGKIIVVDVNPSKKEWGEKFGATDFVNPTELGDQSIQDKLIEMTDGGCDYTFDCTGNVGVMRAALEACHKGWGESIVIGVAAAGQEISTRPFQLVTGRVWRGCAFGGVKGRSQLNDLVADYKKGDLKVDEFITHRKTLGEINNAFDTMKQGDCIRAVVDMQKLEPKI

SEQ ID NO: 4744 - protein, 193 aa, Triticum aestivum
LFLWLSAAVSSFFYFQKVTIVATTISSPTARRRTFALINSFIAVFILAGQLTLTGHILTVAGVTVAICASPFIAASNLVALAVWPTWVAVAVTETIRKVTTYVLTRPGRELLFTVVSQDEKYTAKVCIDVIVQRLGDATAAGIYTLLFSSFEKKISIVNLYALPLCFGWLLIAFHLGRLQTNLARLQAASDPS

SEQ ID NO: 4745 - protein, 564 aa, Triticum aestivum
  unsure (1)..(564): unsure at all Xaa locations
MVGNDNWINSYLDAILDAGKSAVGGDRPSLLLRERGHFSPARYFVEEVITGYDETDLYKTWLRANAMRSPQERNTRLENMTWRIWNLARKKKELEKEEACRLLKRHPETEKTRIDATADMSEDLFEGEKGEDAGDPSVAYGDSTTGVSPKTSSVDKLYIVLISLHGLVRGENMELGRDSDTGGQVKYVVEFAKALSSSPGVYRVDLLTRQILAPNFDRSYGEPAEMLVSTTFKNSKQEKGENSGGYIIRIPFGPRDMYLTKERLWPFIQEFVDGALSHIVRMSKTISEEIGCGHPVWPAVIHGHYASAGIAATLLSGALNLPMAFTGHFLGKDKLEGLLKQGRQSREEINMTYKIMRRIEAEELSLDASEIVIASTRQEIEEQWNLYDGFEVILARKLRARVKRGANCYGRYMPRMVIIPPGVEFGHIIHDFDIDGEEENHGPASEDPPIWSQIMRFFTNPRKPMILAVARPYPEKNITTLVKAFGECRPLRELANLTLIMGNREAISKMHNXASVLTSVLTLIDEYDLYGQVAYPKHHKHSEVPDIYRLATRTKGVITCNLYK

SEQ ID NO: 4746 - protein, 333 aa, Triticum aestivum
MSKARVYADVNVVRPKEYWDYEALAVQWGEQDDYEVVRKVGRGKYSEVFEGINVNNNEKCVIKILKPVKKKKIKREIKILQNLCGGPNIVKLLDIVRDQHSKTPSLIFEYINNTDFKVLYPTLTDYDIRYYIYELLKALDYCHSQGIMHRDVKPHNVMIDHELRKLRLIDWGLAEFYHPGKEYNVRVASRYFKGPELLVDLQDYDYSLDMWSLGCMFAGMIFRKEPFFYGHDNHDQLVKIEKVLGTDGLNVYLNKYRIELDPQLEALVGRHSRKPWSKFINADNQHLVSPEAIDFLDKLLRYDHQDRLTAREAMAHPYFLQVRAAENSRTRAQ

SEQ ID NO: 4747 - protein, 286 aa, Triticum aestivum
  unsure (1)..(286): unsure at all Xaa locations
MLAGGEDGNGHLPRPRRPRRVGGMGSPSGQAASALPHPAPPPCTDYDMAYFKAYSHIGVHEEMLKDHVRTNTYRNAIMHHKDLISGKVVLDVGCGTGVLSIFCAFAGATRVYAVDASDIALQAMEIVRENELSDKVIVLHGRIEDVKIEEKVDVIISEWMGYMLLYESMLGSVIFARDKWLKPGGLILPSHASLYLAPITNSHRYQDSIYFWRDVYGIKMSCMMPLAKQCTFMEPSVETISGENVLTWPTVVAQVDCYTIQAPDLETITAAYKFTSMLQAPLHGXA

SEQ ID NO: 4748 - protein, 505 aa, Triticum aestivum
MHSWMVQKVCSVHYVGENLPEVKDPASHEGSGETREREKYKNRSIASLDIQASLSFRCLRRLVVTLSCQLRSEGPAPTLARRSSFMFVAIRLGRRAIPESGGCEPLEVPRSGFSLCQMASGTVEKAKMESLTSPAAFVEGGVQDACDDACSICLEAFCESDPSTLTGCKHEFHLQCILEWCQRSSQCPMCWQPVSMKDPTRQLLEAVERERNIRTNQTRNTTIFHHSALGDFEVRHLPVVANDAEIEERILQHLAAAAAMGRSHQHGRREGQRNRSGSHGSPQFLVFSAHPNTPAGSVSSSSAQGEGADDLRILVPRVGDLPPHANPIEEAGNQSPGVLTYDAEQDAVVSSGNSTPVSSPRFFNRRHSSGQSTPVGNDRAGPSDVQSFSDSLKLRLNAVSSKYKESITKSTRGWKERLFSRNSSVSDLGSEVRREVNNGIASVSRMMERLETRGSGRPSYSPTTSTSEVCLTTEPSNERVTESNSNTTTSTSNTSTPCVTMSGSN

SEQ ID NO: 4749 - protein, 380 aa, Triticum aestivum
MDRRKGSGSRDANGGLAEATASRLRFEDADEVAGEVGMEVEESPAAPGEEVIGNDKTSADYYFDSYSHFGIHEEMLKDVVRTRSYQNVITQNNFLFKDKIVLDVGAGTGILSLFCAKAGAKHVYAIECSQMADMAKEIVKTNGFSEVITVIKGKVEEIDLPVPKVDVIISEWMGYFLLFENMLDTVLFARDKWLADDGVVLPDKASLHLTAIEDAEYKEDKIEFWNNVYGFDMSCIKKQAMMEPLVDTVDQNQIVTNCQLLKTMDISKMSSGDASFTVPFKLVAERNDFIHALVAYFNVSFTKCHKLMGFSTGPRSKSTHWKQTVLYLEDVVTICEGETLSGSMTVANNKKNPRDIDITLKYAINGNRCKVSRTQHYKMR

SEQ ID NO: 4750 - protein, 507 aa, Triticum aestivum
  unsure (1)..(507): unsure at all Xaa locations
MEVQAGSHADAAASKFTLPVDSEHKAKSFRLFSFANPHMRTFHLSWISFFTCFVSTFAAAPLVPIIRDNLNLAKADIGNAGVASVSGSIFSRLAMGAICDLLGPRYGCAFLVMLSAPTVFCMAVIDDASGYIAVRFLIGFSLATFVSCQYWMSTMFNSKIIGTVNGLAAGWGNMGGGATQLIMPLVFHAIQKCGATPFVAWRIAYFVPGMMHIVMGLLVLTMGQDLPDGNLASLXKKGDMAKDKFSKVLWGXVTNYRTWIFVLLYGYCMXVELTXDNVIAEYYYDHFHLDLRXXGTIXAXXGMANXVARPMXGYLXDLGARYFGMRARLWNIWIXQXAGGAFCIWLGRASALPASVTAMVLFSICAQAACGAVFGVAPFVSRRSLGIIXGLTGAGGNVGXGLTQLLFFTSSQYSXGRGLEYMGIMIMACTLPVALVHFPQWGSMFFPASADATEEEYYASEWSEEEKNKGLHIAGQKFAENSRSERGRRNVILATSATPPNNTPQHV

SEQ ID NO: 4751 - protein, 299 aa, Triticum aestivum
CLPVHLRSSVRRTDKHRIRRERRVVGRWLAAEPSGSSQPGAPGRWSLHGKTALVTGGTRGIGRAVVEELAALGAAVHTCSRKEAELGERLKEWEARGFRVTTSVCDLSVREQRERLIGDVAERFGGKLNILVNNVGTNIRKPTTEFSAEDYSFLMATNLESAYHLCQLAHPLLKASGLGSIVFISSVCGLVAVFSGTLYAMTKGAINQLTKNLACEWAKDGIRTNSVAPWYITTSLTEGLLANKEFEASVVSRTPLGRVGEPGEVSSLVAFLCMPGSTYITGQTISVDGGMSVNGLYPA

SEQ ID NO: 4752 - protein, 506 aa, Triticum aestivum
MAAPPAIPRRGLFIGGGWREPTLGRRIPVINPATEDTIGDIPAATAEDVELAVAAARSAFLLDGGSRWARASGATRAKYLNAIATKIKEKISYLALLETVDSGKPKDEAVADMDDVAACFEFYAGLAEALDGKQHAPISLPMEEFKTYVLKEPIGVVGLITPWNYPLLMATWKVAPALAAGCTAVLKPSELASLTCLELGAICEEVGLPSGVLNIITGLGPDAGAPIASHPHVDKIAFTGSTATGKTIMTAAAQMVKPVSLELGGKSPLVIFDDVADIDKAVEWAMFGCFFNSGQVCSATSRLLLHEKIAERFLDRLVEWAKNIKISDPLEEGCRLGSVISKGQYEKIKKFISTARSEGATILHGGDRPKHLGKGFFIEPTIITDVSTSMQIWREEVFGPVICVKVFKTESEAVELANDTHYGLAGGVISDDLERCERIAKVIHSGIVWINCSQPTLVQAPWGGNKRSGFGRELGEWGLENYLSVKQVTRYCKDELYGWYQRPSKL

SEQ ID NO: 4753 - protein, 313 aa, Triticum aestivum
MPVVSGINLQYQHPGNVVPGIPQTAHRFTGHGASSSRAGSLDNIILGREEVTGRNLVAPSYPNASAPLAAVDMRHLVPELSNWNSDNPGATIPGNVSSVSRANASSTISRPAGSTSLAHQNLHRRHPRNLSEDIGRLSGALRGPQHPRLRSGFLLERQGDGVWGVPLPMRNTREGRRLMEIRNALEMIQRGENVRFESIFYGGVDIHDRHRDMRLDIDNMSYEELLALEERIGNVSTGLTENDVMKLLKQRKFSSWRLSSVEYEPCCICQEEYVDGDDLGTLHCGHDFHASCIRQWLVVKNLCPICKSPALKT

SEQ ID NO: 4754 - protein, 434 aa, Triticum aestivum
MGAGAEPREEEPLEAEEGSGGKEEKAAVSCSICLDAVVAASAERSMARLQCGHEFHLDCIGSAFNAKGVMQCPNCRKIEKGNWLYANGSRPSHDINMDEWAHEEDLYDVSYSEMPFRFHWCPFGRLAQLPSFFEEGESPPPVTFHDFMGQHVFPENLSVSAAPGAHPCPYVAYLHPLPSLASSSSSHVPERTMDGSAYHDHWNHLAGPSHGWPLQTVQPTDFHHNHWAHLPHSYVQSNSNNGVTEQPGVPFGSMRAARVDGDSQRRGSVVSPSYFSNGSGSRSRAPNVPPLVPQFMRAHGNINEQYTQSSSSSLFAGAHRSGGMRPAPPPPQPENPTFCLFPPGSSGHSSMDTDEAGGSRFYAWERDRFAPYPLMPVDCETSWWSSQQSHGASESTPAPAPRRLFGQWIGLGRSSPENRSPEGSSYRQMHSPRM

SEQ ID NO: 4755 - protein, 259 aa, Triticum aestivum
MGRGRVELKRIENKINRQVTFSKRRNGLLKKAYELSVLCDAEVALIIFSSRGKLYEFGSAGTTKTLERYQHCCYNAQDSNGALSETQSWYQEMSKLKAKFEALQRTQRHLLGEDLGPLSVKELQQLEKQLECSLSLARQRKTQLMMEQVEELRRKERQLGDINRQLKHKLDAEGSNSNNYRAMQQITWAAGTVVDEGAAAYHMQQQQQQHPNHSAAMDCEPTLQIGYPHQFAAPDQAANNIPRSSGPGGENNFMLGWVL

SEQ ID NO: 4756 - protein, 240 aa, Triticum aestivum
MGRGKIVIRRIDNSTSRQVTFSKRRNGIFKKAKELGILCDAEVGLVIFSSTGRLYEYASSSMKSVIDRYGRAKEEQQLVANPNSELKFWQREAASLRQQLHNLQENHRQLTGQDLSGMGVKELQTLENQLEISLRCIRTKKDQILIDEIHELNHKGSLVHQENMELYRKINLIRQENAELQKKLSETEAATEVNRDSRTPYNFAVVEDANVSVDLELNSPQQQNDVEHTAPPKLGLQLHP

SEQ ID NO: 4757 - protein, 139 aa, Triticum aestivum
  unsure (1)..(139): unsure at all Xaa locations
QLGRTDMRLPILYXLXWPERVYCXEITWPRLDLCELGSLTFKAVDNVKYPSVDXAYAAGRAGGTMPGVXSAANEKAVELFINEKISYLDXFKVVEMTCNAXRNELVTSPSLEEIIHYDQWARKFSAXLQPXSRRSIVLA

SEQ ID NO: 4758 - protein, 134 aa, Triticum aestivum
TPATDHAVGHIGDANDDDNKDYDKDDDKDDGDDKDDKDDDDKDDKDDDDKDDDDDDDKDDDDDDDKDDDDDDDDDDDDSGGSDWGKYFKCKKKCIMDCYRSLRHHRRRRRRHRPSPGPKPPSPKPPKPKKFPPN

SEQ ID NO: 4759 - protein, 490 aa, Triticum aestivum
  unsure (1)..(490): unsure at all Xaa locations
MALKAASFPGELSSLLDSGTTRSRSRRGAAAPFHQRKVDFTFQRRDKRAAYLRTCCSMQQGPPPAWPGRAVIEPERRSWEGPKPISIVGSTGSIGXTQTLDIVAENPDLTSSGVVALAAGSNVTLLADQVKTFKPKLVAVRNESLLXELKEALAGCEXEMPEIIPGEQGVIEXVARHPDAVTVXVTGIVGSCRTASQTVAAIECSEKILRWQVVVSHSSGRRSRFVLPLAHNRTMXKIPADSEHSAIFQCIQGLSEGSLRRVILTASGGAFRDWPVEKLKDVKVADALKHPNWSMGKKITVDSATLFNKGLEVIEAHYLFGAEYDDIEIVIHPQSIIHSMIETQDSSVLAQLGWPDMRLPILYTLSWPDRVYCSEVTWPRLDLCKLGSLTFKAPDNVKYPSVDLAYAAGRAGGTMTGVLSAANEKAVELFIDEKISYLDIFKVVEMTCDAHRNELVTRPSLEEIIHYDQWARKFAANLQPSSSGRSPVLA

SEQ ID NO: 4760 - protein, 206 aa, Triticum aestivum
  unsure (1)..(206): unsure at all Xaa locations
RWRPPPAPAAARAPAAVVPAASGARLGRGPVGLAVAQGCRMRGAKQIIGVDLNPEKRDIGKRLGITDFVNPNDTGEKAVSEVVKEMTGGGADYCFECIGSTSVMAEAFQSSRKGWGKTVVLGVSSGGAPMSIPPHDILXGERSVVGSLFGGLKPKADIPILAQKYVDQELELDEFVTHEMGFHDINAAFELLTHRKCLRCIIWMDG

SEQ ID NO: 4761 - protein, 222 aa, Triticum aestivum
MAPAVKVYGWAVSPFVARPLLCLEEAGVEYELVSMSRAAGDHRQPDFLARNPFGQVPVLEDGDLTLFESRAIARHVLRKHKPELLGCGSPEAEAMVDVWLEVEAHQYNPAASAIVVQCIILPLLGGARDQAVVDENVAKLKKVLEVYEARLSASRYLAGDDISLADLSHFPFTRYFMETEYAPLVAELPHVNAWWEGLKARPAARKVTELMPPDLGLGKKAE

SEQ ID NO: 4762 - protein, 195 aa, Triticum aestivum
  unsure (1)..(195): unsure at all Xaa locations
VRPFTSVQQESEVKLEAERSEAGRSGKRARGGXAGLLDKAKGFVADKIAHMPKPEASLDKVSFKGMTREAITVHSHVNVTNPYSHRIPICDIAFTLKCGGKEVASGTIPDPGWIEDSGEVTKLEVPAKVPYDFLISLMNDLGRDWDIDYELLVKLTIDLPIIGNFTIPLQTAGEFKLPTLSDFFGGSAKTEEATA

SEQ ID NO: 4763 - protein, 163 aa, Triticum aestivum
MASLMDKAKGFVADKIAHMPKPEASLDKVTFKGMTREAITVHSHVNVTNPYSHRIPICDIAFNLKCGGKEVASGTIPDPGWIEDSGEVTKLEVPAKVPYDFLISLMKDLGRDWDIDYELLVKLTIDLPIIGNFTIPLQTAGEFKLPTLSDFFGGSAKTEEATA

SEQ ID NO: 4764 - protein, 205 aa, Triticum aestivum
GHVFPFYFWKITSLYPVVTSGDYGEAGTLEFLKDFHRRRLQVLAEARPDLIAFETIPNKLEAQAYVELFEECSINIRRPGSGNSKDGVNVVSGDSLIECAKIANGCAKVGAVGIYCTPPRFIHSWILSIRKVTDKPILIYPNSGERYDAERKEWVESTGVSDGDFVSYVSEWCKDGAALIGGCCRTTPNTIRAISRSLNQYSPAP

SEQ ID NO: 4765 - protein, 300 aa, Triticum aestivum
MLLAAEIDDEEEHSVRRPRAVVQKFMCERKAVGDGFALRRSIGRPELQSLDPFISLDEFEFSRPAGFSDHPHRGFENVTYMLEGGLSYHDFSGHKGTINTGDVQWMTAGRGVVHAEMPGGEGVQRGLNLWLNLSSTDKMVAPRYQELRSRDVPTAEKDGASIKVIAGEALGARSPIQTRTPAMWLDVTMRPGARLRQPVPAGWSACAYVIDGEASFGQPGDEAAGAHHCVVFGGDGDGVDVRSEGAGTRFLLLAARPHGEAVALDGPFVMNTSEEVQQAREDYLNRRNGFEMAAGWTSGQ

SEQ ID NO: 4766 - protein, 338 aa, Triticum aestivum
  unsure (1)..(338): unsure at all Xaa locations
MANMQESLGLVGTMRGHNDVVTAIAAPIDNSPYIVSGSRDKSLLVWDLTNPVQSLGDGTVGTDYAVPFRRLTGHGHFVQDVVISSDGQFALSGSWDGELRLWDLSTGLTTRRFVGHAKDVISVAFSVDNRQIVSXPSRDNTIKLWNTLGECKYTIGGDMGGGEGHTGWVSCVRFSPNIQQPTIVSGSWDKTVKVWNLTNCKLRSTLAGHGXGYVNAVAVSPDGSLCASGGKDGVTLLWDLSEGKRLYQLEAGSIIHALCFSPNRYWLCAATEESVKIWDLESKHVVQDLKPEVQVSKNQMLYCTSLSWSAXDGSTLYTGYTDGTIRVFKIQAGFAGYA

SEQ ID NO: 4767 - protein, 600 aa, Triticum aestivum
MPKHYRPAGKKKEGNAAKYITRTKAVKYLQISLAVFRKLCILKGVFPREPKKKVEGNHKTYYHMKDIAFLAHDPLIEKFREIKVHRKKVKKAMAKKNRDLADRLLNRPPTYKLDRLIIERYPSFVDALRDLDDCLTMVHLFAALPAIEGERVQVQRIHNCRRLSHEWQAYISRTNSLRKTFISVKGIYYQAEVQGQKITWLTPHALQQVLTDDVDFNVMLTFLEFYETLLGFVNFKLYHSINVNYPPILDPRLEALAAELYALSRYMSSGRLPGNPESNGLIEDKETENNKESSKTDESELRLAQLQHQLPANEPGALMHLVEESTADDTEEESVKECRTLFKDLKFYLSREVPRESLLFIIPAFGGTVSWEGEGAPFDETDQDITHQIVDRPTQSHVFLSRHYVQPQWIFDCVNILKVIPTDDYIVGRVPPPHISPFVDNDKEGHIPDYAVTLEGYKSAGQNQVMPLPGLGDEDLGNSIVEAKSEHNEFAKKKKELEMQEKKYHEELKMEIEGTTFSNLSNKKADSAADVTDEDDETQAAMEQAEKDADDIAKSVVSRKKRGLMEAMKISNDRKKSKVELLKQRKKAAESSASAKAKRR

SEQ ID NO: 4768 - protein, 255 aa, Triticum aestivum
MVSPDAIRTVIGVIGNGTALVLFLSPVPTFISIWKKKTVEQYSAVPYLATLLNCMMWVLYGLPLVHPHSMLVITINGTGMLIELTYIALFLTFSVGAARRRVLLLLVAEVAFVAGVAALVLSLAHTHDRRSMVVGILCVLFGTGMYAAPLSVMKMVIQTKSVEYMPLFLSVASLVNGICWTAYALIKFDLYITIPNGLGVMFAVGQIILYAIYYKSTQQILEARKRKADQVPMTEVVVDGKSGSATNSGAANGHY

SEQ ID NO: 4769 - protein, 167 aa, Triticum aestivum
EHSTIIYESSSGGGSNSAATDGGAVSPTPLVRLGWNKQDPRYMATIIMDSPKVVVLDIRYPTLPVVELHRHHAPVNAMAWAPHSSCHICTAGDDSQALIWDLSSMGTGNNSGGNGNGNAAAAAAAEGGLDPILAYTAGAEVEQLQWSATQPDWVAIVFANKLQILRV

SEQ ID NO: 4770 - protein, 313 aa, Triticum aestivum
  unsure (1)..(313): unsure at all Xaa locations
MGQLTAAPGGGGDCLIKLFGKTIPVPDAGDKDLQHRGSSATAEPKVQEIAPQDSTGSPPQQPEVVDVEDPSLXKNSAADQQDEEQGDTANQKEKLKKPDKILPCPRCSSMDTKFCYYNNYNINQPRHFCKNCQRYWTAGGAMRNVPVGAGRRKSKSVSAASHFLQRVRAALPGDPPLHAPVNTNGTVLSFGSDPSTLDLXEQMKHLKDKLIPATRTENTDAPPVGSSAEGWAKAEESXQTNPKERVAAERSXNGAQHPCMNGGAMWPLGAPPPPARLTPTIALPLRPAAAAAGAAAGRRGAPRAGRAPCNYTS

SEQ ID NO: 4771 - protein, 334 aa, Triticum aestivum
TRASRRNPAQSQRGLLLPPPLRIRVFWRPSSLPFLQFSLHNATAAASHLPSPRTESQTLSRRPGAHQPPYLAPPGGRSPPTVADHQAHACGGAAGRRLTRGPVRRRHADAGGAQGAPQRLRLGHRELPIVSNGGVVLRQPSKPAKPAAAAEGEEQHGGLSRCASTSPTPVGEEVSGGGGITQLSGSYASDIYTYLRTMEVEAPRRPAADYIEAVQTDVTANMRAILIDWLVEVAEEYKLVADTLYLTVSYVDRFLSANPLGRNRLRLLGAAACPIASKGGESCPPRVGVACGCSHDARARLGPLTMESDILKLLNFEIGSPTIKTFLRRFTRSG

SEQ ID NO: 4772 - protein, 332 aa, Triticum aestivum
MAGAQESLVYAGVMRGHNDVVTAIATPIDNSPFIVSSSRDKSLLVWDLTNPIQATQDSSSEYGVPFRRLTGHGHFVQDVVLSSDGQFALSGSWDGELRLWDLSTGVTTRRFVGHEKDVLSVAFSIDNRQIVSASRDRTIKLWNTLGECKYTIGGDLGGGEGHTGWVSCVRFSPNNFAPTIVSGSWDRSVKVWNLTNCKLRCTLDGHGGYVSAVAVSPDGSLCASGGKDGVTLLWDLTEGKRLYSLDAGSIINSLCFSPNRYWLCAATQDSIKIWDLESKHIVQDLRPEVPVSTKQMLYCTCLSWSADGSTLYAGYTDGTIRIYKISGFSYSS

SEQ ID NO: 4773 - protein, 110 aa, Triticum aestivum
MSGSGSGSGVWVFKNGVMQLQPEQPAAGRKALLYVPTGERMTSLELLERRLGAHGWERYYENRDIVQLHRRDGGIDLISLPRDFTKFRSTHMYDVVLKNRDSFKVVDVPS

SEQ ID NO: 4774 - protein, 219 aa, Triticum aestivum
  unsure (1)..(219): unsure at all Xaa locations
NLTSPVVLDDFRCPISLDLMKDPVIVSTGQTYERGCIERWLEAGHNTCPKTQQKLLNKSLTPNYVLRSLIAQWCEANGVEPPKRPAQPNNTPATCTASEHSKVIELLQKLSSQNLADQRGAAGMLRQLAKRSAENRACIGEAGAIPILVSLLPTTDVSTQEHVVTALLNLSIYEENKARIITSGAVPGIVHVLKRGSMEARENSAAXTLFSLSLVDXNK

SEQ ID NO: 4775 - protein, 448 aa, Triticum aestivum
FVAAVNHLGIDKAVPKRILELMNVEKLTRENVASHLQKYRLYLRRLSAVASQQAGIVAALGGRDPFLRMDAFEGLQGYQAFTSPAALSTFSAHGLLNSPRNNQTAVVIQGVATSRSIPTGSSSCTTNPLIGDAAKYHLSLPGNQHGNLGQGLATSLGQAQLQQKWMNEGSGDLSTILSGNSRANGMPRMLPSVTSSPLLPPDLVECTQAKVAIQPSVRAPSASVELLEGAIGASSGPLESRVSQQSALPSSGFSANMLPVHGSFNNNGASFSSNGATRLGDAFSASFRPTNDLTVARGTKVGAGSFGGTIHLSPDTEQKYLSFGSSDSLLDPKLVWSSSQLPSNIGAHYHSMSQRSNNCSIDSSHGGRMFGQTSASASTAAPQTKFDILFSGDTSMARNASESGPQRLQSELSFSTCSFDGFNSMIKVEKDDAAFGDDLGDYSLGACI

SEQ ID NO: 4776 - protein, 199 aa, Triticum aestivum
MSPATSSAVGTLSGGLLPHAAHRRRPFPTARLLPPRWSRLQVNAARHRRLATPARAQSAPSPGYLPDSEFYKIEAILRPWRVSHVSSGLLEMGIRGVTVSDVRGYGAQGGSTERYEGSEFSEDTFIAKVKMEIVVCKEQVEPVIDKIIEKARTGEIGDGKIFLIPVADVVRVRTGERGVHAERMIGGLSDKLPPVITIS

SEQ ID NO: 4777 - protein, 192 aa, Triticum aestivum
MDRKDKSRKSSSAASMAALAAAAAAGDVARADGMSGEEDQKLKLVNVPVVSVGGSSSSAAAVAVRRGSGAAGAVATGAAGAGGPSCQAERCGADLSEAKRYHRRHKVCEAHAKAAVVVVAGLRQRFCQQCSRFHELLEFDDQKRSSRRRLAGHNERRRKSSAEANGGDGCRHADQDGRTHPGNPPLNHFQIR

SEQ ID NO: 4778 - protein, 197 aa, Triticum aestivum
MAQLLWLALGVLLLASSVADAATANYTFTVQSMKINQLCNSTDIIAVNGQLPGPTIDVFEGDEVVVDVINASPYNLTIHWHGILQKLTPWADGPSMVTQCPIQPNGSYTYRFNVTGHEGTLWWHAHSSFLRATVYGALIIRPRNGTAYPLPAPDQEVPGVLGGSGAHYVVPVAQGPPRALHKGYGYKKRGGQTKLWG

SEQ ID NO: 4779 - protein, 439 aa, Triticum aestivum
MSFRSIVRDVRDGFGSLSRRGFDVRFLGHRRGKSHSAVHELHDPAPVIQSSCWANLPPELLHDVIERLEASEATWPSRKHVVACAAVCRTWREMCQEIVKNPEFCGKITFPVSLKQPGPRDGTIQCFIKRDKSTQTYYLYLCLTSAVVAENGKFLLLAKRHSRPTCTEYTIFMNTDNTSRSSNMYIGKLRSNLLGTKFVIYDTQHPCNIPNVSQSGKTSRRFYSRKVSPKASPSTYSIAQVSYELNVLGTRGPRRMNCVMNSIPASSLVAGGTVLCQPDSAVAHSLDESFGSISFSKSSIRDRSIRFSSTRFSGISIGGSRNGGQALGDNDECKEWPLTLRNKAPRWHDQLQCWCLNFKGRVTVASVKNFQLVAATESTAEAPTPSQPAPPPPSEHDKVILQFGKGAKDMFTMDYRYPLSAFRAFAICLSSFDTKLACE

SEQ ID NO: 4780 - protein, 116 aa, Triticum aestivum
GVVNQMSGLRKGFSALKFVKSGLSGEIFPPKWVIFYIKEKAPEFFSVVASNEVFVTSKGGAEKMSHKMGVPFLGKVPMDPQLCKAPKEGRSCFPDQRCSASAPAFKSIMAKLFKPK

SEQ ID NO: 4781 - protein, 66 aa, Triticum aestivum
  unsure (1)..(66): unsure at all Xaa locations
RRPPAATPSWPPRNRADDPSLHNPLLRLERMGCGWVGVIFEWEGVVVEDDXRXERQAGRGANPRPE

SEQ ID NO: 4782 - protein, 214 aa, Triticum aestivum
MAAAMSYVHADVENLKATELRLGLPGVEESDKMPSPPSTPRAGTKRALAGEHREEEPKAAPPAAKAQVVGWPPVRSYRKSCFQQASSKTKEAAPAPVVVKQEEAAVAAAPPAAAAAGGSLYVKVSMDGAPYLRKIDLKMYKGYRELREALEAMFLGFSGDAGSVNPSDFAVTYEDKDGDLMLVGDVPFGMFMSTCKRMRIMKGSEARGLGSSKE

SEQ ID NO: 4783 - protein, 213 aa, Triticum aestivum
SKGIILAAIDNPSNAVEWALAEMVNNPELLAKAVEEMDRVVGRERLVQESDIMQLNYLKACIREAFRLHPIAPFNLPHVAIADTIVAGYHIPKGSNVILSRLALGRNPTVWDEPLHFKPERHMGDNINVVLTESELRFISFSTGRRGCIAASLGTTMSVMLFGRLLHGFTWTKPAGVSAINLSESKHDLFIEQPLVLHAEPRLPVHLYPLMHC

SEQ ID NO: 4784 - protein, 351 aa, Triticum aestivum
  unsure (1)..(351): unsure at all Xaa locations
MKKCASELEFEAFIRQHLAAAEAEAEAQRGRPGHGNDDGGFGGDPGARADVFSPGSGLPGLCFGDSQNALELEGSNPGHLWWSEGLRAPPHHAAPAPTQSQTPAVSASPRETISGNQALETESDSDSESLVEIQGGRCKRSGKSSDTRRIRRMVSNRESARRSRRRKHAQLTDLELQVEQLKSESATLFKQLTEANQQFTTAVTDNRILKSDVETLRIKVKMAEDMVARGAVSCGLGQQLGLAPFLNSRKMXQSLGERSHRHRVELEREPCTLQRFLALALQVQTSAARSTASLECSNNRMPACPARRPDVWMPCGPEIHTKAGPLCIVTNTGCCIPDICACLAGCKGTKL

SEQ ID NO: 4785 - protein, 264 aa, Triticum aestivum
MEAAVGGSWTRVRTLGRGASGAVVSLAADDLSGALFAVKSAPAAAADQLRREGDILSGLSSPHVLPCLGFRAAAGECQLFLEFAPGGSVADVAARSGGRLEECAVRAYAADVARGLAYLHGRSLVHGDVKARNVVVGADGRAKIADFGCARAVGSSDRPVGGTPAFMAPEVARGEEQGPAADVWALGCTVVEMATGRAPWSDMDDVLTAMHRIGYTDAVPEVPAWLSAEAKRFLAMCFARDARDRCTAAQLLEHPFLASAGCGV

SEQ ID NO: 4786 - protein, 243 aa, Triticum aestivum
  unsure (1)..(243): unsure at all Xaa locations
GIISAIGISIVVGWGYILGVTFAVKDIPSLLSPDNEAGGYAIAQVFYQAFKSRYGSGVGGIVCLGIVAVAIYFCGMSSVTSNSRMAYAFSRDGAMPLSSVWHKVNEHEVPINAVWLSAFVSLCMALPSXLGSLVAFQAXVSIATIGLYIAYALPIFFRVTLARKHFVPGPFNLGRYGVLVGWVAVLWVVTITVLFSLPVMYPVTRDTLNYTPVAVGGLFILVLTSWVVSARHWFKGPVTNLSG

SEQ ID NO: 4787 - protein, 389 aa, Triticum aestivum
MASGTDEKAKMESLTSPAAFVEGGVQDACDDACSICLEAFCESDPSTLTGCKHEFHLQCILEWCQRSSQCPMCWQPVSMKDPTSQELLEAVERERNIRTNQTRNTTIFHHPALGDFEVQHLPVVANDAEIEERILQHLAAAAAMGRSHQHGRREGQRNRSGSHGSPQFLVFSAHPNTPAGSVSSSSAQGEGADDLRILVPRVGDLPPHANPIEEAGNQSPGVLTYDAEQDAVVSSGNSTPVSSPRFFNRRHSSGQSTPVGNDRAGPSDVQSFSDSLKLRLNAVSSKYKESITKSTRGWKERLFSRNSSVSDLGSEVRREVNNGIASVSRMMERLETRGSGRPSYSPTTSTSEVCLTTEPSNERVTESNSNTTASTSNTSTPCVTMSGSN

SEQ ID NO: 4788 - protein, 315 aa, Triticum aestivum
  unsure (1)..(315): unsure at all Xaa locations
MELAGAAHPQPPESDVAPPRTPPQAPVEDSCKDTGDTRITEENSCTPPDLNLSQPNNSGLNSSSACENQTSNGDEMTEPESTLEAAKTEGDGSNKEKVLKKPDKILPCPRCNSMDTKFCYYNNYNIHQPRHFCRGCQRYWTAGGSMRNLPVGAGRRKSKSSSTNCNGILIPGDSLSAPGGDASVIPLPIKENQPAVKFGSDSTLPNSMASLLRVEEQNKNSTPASTAHPRNGENQTCPPSATTSDNPRIESVKAAVGVHXNGIPGFMGXPPMPPIPVSGPFMTMESTGMVCCQPDLLSKPGGLMEFPWAFFPPVF

SEQ ID NO: 4789 - protein, 358 aa, Triticum aestivum
  unsure (1)..(358): unsure at all Xaa locations
VRPRVRPRVRPRVRAGVGFSYSNTSSDLKTXGDERTAQDSLQFLISWMGRFPQYRHRDFYIAGESYAGHYVPQLARKIVEYNKASPSPFINLKGILHGNAVTDNYYDNIGTVTYWWTHAMISDSTYRAILKLCNFTSANVSNACNRAMSYAMNHEFGDIDQYSIYTPSCHATSDSSAASGNSTAPRKHRRAVLKFKDTLIRRRSNSYDPCTETYAEKYYNRXDVQRGHARQHXTRIPYRWTACSDVLIKTWNDSELSMLPTYRMLIKAGIRIWVFSGDTDSVVPVTATRFSLSHLGLKTKIRWYPWYSAGQVGGWSEVYEGLTFASVRGAGHEVPLFQPRRAFRMFVSFLAGKPLPKS

SEQ ID NO: 4790 - protein, 217 aa, Triticum aestivum
MGELVVARRYWCHMCAAAVSPVAADAGVEIKCPYCGSGFLEEMETARSSVAAGTAHAHASGTYPSADNAISIWAPIIDSMVGDPVRRRRSNRRTVDAVAAAEDELDNVDFSRRRRRATAFLRLLQAIRERQLQRLESAAALGNGGGLETEHYSPFGRSIFAAAPLGEHGMALGDYFLGPGLDALMQQLADSDAGRQGTPPAKKGAVEALPTVEVVGG

SEQ ID NO: 4791 - protein, 527 aa, Triticum aestivum
NCYAAAPRDAVDRFPSVRAAEVKGKPHFADFGLVPPAWGAEAAPWVAAAADGWPLLEELSFKRMVVTDECLDMIASSFRNFQVLRLVSCEGFSTAGLAAITEGCRNLRELDLQENYIEDCSSHWLSYFPESFTSLETLNFSCLEGEVNFAVLERLVSRCRNLKTLKLNNAIPLDKVASLLRKAPQLVELGTGKFSAEYHSDLFAKLEAAFAGCKSLRRLSGAWDAVPDYLPAFYCVCEGLTSLNLSYATVRGPELIKFISRCKNLQQLWVMDLIEDHGLAVVAGSCSKLQELRVFPSDPFGAGQVLLTERGLVDVSASCPMLESVLYFCGQMTNEALITIAKNRPNFTCFRLCILEPRTPDYVTRESLDAGFSAIVESCKGLRRLSVSGLLTDLVFKSIGANGNCLEMLSIAFAGNSDLGLHYILSGCKSLKKLEIRDCPFGNKPLLANAAKLETMRSLWMSSCSLTLGACRQLAEKMPRLTVEIMNDPGRTCPVESLPDDSPVETLYVYRTIAGPRSDTPDYVQIV

SEQ ID NO: 4792 - protein, 164 aa, Triticum aestivum
  unsure (1)..(164): unsure at all Xaa locations
MVRGGQGQEGGLGEREVVNVVDQDGREEEVRRALPMMPVRVLLAEGDDSTRHVISALLRKCGYHVSAASDGVKAWELLKEKSFKIDLVLTEVELPLMSGFLLLSTIMEHDXCKNIPVIMMSSNDAVSMVFKCMLEGAXADFLVKPIRXRNEVXELVGNXVWXKL

SEQ ID NO: 4793 - protein, 140 aa, Triticum aestivum
  unsure (1)..(140): unsure at all Xaa locations
RGRVGNGTGINKPDYLATVDLDPSSPTYSQVIHRLPVTHIGDELHHSGWNSCSSCHGDPSAKRRFLILPSLLSGRVYVVDTATDPRAPSLHKVVESEDIAENTGLGFPHTSHCLASGDIIISCLVDKEGNAAXNGFLLVD

SEQ ID NO: 4794 - protein, 255 aa, Triticum aestivum
MFPPGLIHHRTDGPGPGEVPRSGGAPSLVLTADPKPRLRWTADLHERFVDAVAQLGGPEKATPKTILRTMGVKGLTLFHLKSHLQKYRMGKQTGKETPEQSKDGSYLLDAQGGMSLSPRVSTQDAKESQEVKEALRAQMEMQRSLHEQVEVQKHVDIRMDAYTTYINTLLEKACKIVSEQFASSGFSVSDQSLPELSSGGVMCGTATDALSSSVFHQLSVSSINMHSPGGKPSPSGMEGQLLLQRSPEFKRKSSC

SEQ ID NO: 4795 - protein, 255 aa, Triticum aestivum
MFPPGLIHHRTDGPGPGEVPRSGGAPSLVLTADPKPRLRWTADLHERFVDAVAQLGGPEKATPKTILRTMGVKGLTLFHLKSHLQKYRMGKQTGKETPEQSKDGSYLLDAQGGMSLSPRVSTQDAKESQEVKEALRAQMEMQRSLHEQVEVQKHVDIRMDAYTTYINTLLEKACKIVSEQFASSGFSVSDQSLPELSSGGIMCGTATDALSSSVFHQLSVSSINMHSPGGKPSPSGMEGQLLLQRSPEFKRKSSC

SEQ ID NO: 4796 - protein, 182 aa, Triticum aestivum
MSDEAASPPGGGGGGGGGGSDDGGGGGGFGGVREQDRFLPIANISRIMKKAIPANGKIAKDAKETVQECVSEFISFITSEASDKCQREKRKTINGDDLLWAMATLGFEEYIEPLKVYLQKYRETEGDSKLAGKSGDVSVKKDALGPHGGASGTSAQGMGQQVAYNPGMVYMPPQSHNGDIST

SEQ ID NO: 4797 - protein, 369 aa, Triticum aestivum
MAMMVDPPNGMGNHGKHYYTMWQTMFEIDTKYVPIKPIGRGAYGIVCSSINQETNEKVAIKKINNVFDNRVDALRTLRELKLLRHLRHENVIALKDIMMPIHRRSFKDVYLVSELMDTDLHQIVKSSQPLSNDHCQYFLFQLLRGLKYLHSAGILHRDLKPGNLLVNANCDLKICDFGLARTNNTKGQFMTEYVVTRWYRAPELLLCCDNYGTSIDVWSVGCIFAELLGRKPIFPGTECLNQLKLIVNVLGTMSETDLAFIDNPKARNYIKSLPYTPGMPLSSMYPHAHPLAIDLLQKMLVFDPSKRISVTQALEHPYMSPLYDPSANPPAQVPIDLDIDENIGTDMIREMLWQEMLQYHPEAARMVNM

SEQ ID NO: 4798 - protein, 507 aa, Triticum aestivum
MEVEASAHGDTAASKFTLPVDSEHKAKSFRLFSFANPHMRTFHLSWISFFTCFVSTFAAAPLVPIIRDNLNLAKADIGNAGVASVSGSIFSRLAMGAICDLLGPRYGCAFLVMLSAPTVFCMAAIDDASGYIAVRFLIGFSLATFVSCQYWMSTMFNSKIIGTVNGLAAGWGNMGGGATQLIMPLVFHAIQKCGATPFVAWRIAYFVPGMMHIVMGLLVLTMGQDLPDGNLASLQKKGDMAKDKFSKVLWGAVTNYRTWIFVLLYGYCMGVELTTDNVIAEYYYDHFHLDLRAAGTIAACFGMANIVARPMGGYLSDLGARYFGMRARLWNIWILQTAGGAFCIWLGRASALPASVTAMVLFSICAQAACGAVFGVAPFVSRRSLGIISGLTGAGGNVGAGLTQLLFFTSSQYSTGRGLEYMGIMIMACTLPVALVHFPQWGSMFFPASADATEEEYYASEWSEEEKGKGLHITGQKFAENSRSERGRRNVILATSATPPNNTPQHV

SEQ ID NO: 4799 - protein, 165 aa, Triticum aestivum
CIASISSMGFAFLRYRLIPLSRVWLRVSKNEVPLNVVWLSVVVAFVMALTSLGSAVAFQAMVSIATLGQYIAYALPIFFRVTTARRSFVPGPFHLGRYGVVVGWAAVLWVAFLTVLFSLPVAYPVAKDNFNYTPVAVGGVLLLSVGAWVVNARFWFEGPITNVDL

SEQ ID NO: 4800 - protein, 92 aa, Triticum aestivum
  unsure (1)..(92): unsure at all Xaa locations
RALFFKTVKKKKIGSTKKEYYFLSINPPKQIFKFSSPKKLQQXFPKEPPKWDLKDGRVFFQKGKKSHPSKKIPGGRVINQTLGYPRELKRNG

SEQ ID NO: 4801 - protein, 494 aa, Triticum aestivum
  unsure (1)..(494): unsure at all Xaa locations
MAAAVADAAVPAVAKANGAGAGCCAAKGPGYATPREAMEKGPREGLLYVTCVYNGTGINKPDYLATVDVDPNSATYSQVIHRLPATHIGDELHHSGWNACSSCHGDPSTSRRFLILPSLLSGRVYVVDTAKDPRAPALHKVVQAEDIAEKTGLGFPHTSHCLATGDIMISCLGDKEGNAAGNGFLLLDSEFNVKGRWEKPGHSPLFGYDFWYQPRHKTMISSSWGAPAAFRTGFDLQHVQDGLYGRHLHVYDWPGGELKQTLDLGSTGLLPLEVRFLHDPSKDTGYVGCALTSNMVRFFKTADGSWSHEVAISIEPLKVRNWMLPEMPGLITDFVISLDDRYLYLVNWLHGDIRQYNIEDPAKPVLAGQVFVGGXLQKGSDVVYVTDDRREEQYAVPQVKGNRLRGGPQMIQLSLDGNGVYVTNSLFSRWDEQFYGPDLLKKGSHMLQIDVDTEEGGLAVNPNFFVDFGTEPEGPSLAHEMRYPGGDCTSDIWI

SEQ ID NO: 4802 - protein, 657 aa, Triticum aestivum
  unsure (1)..(657): unsure at all Xaa locations
MLAQTVQLCLMLDMRAPPFHQSAGPKRGSSDRLSAESNLYSRSLNGIAPTTNRSGGKCSQEGRRCSLQYVAHVLVGNHAHPAGRPAVRGRTGEKVAIKKIHDIWEHISDAARILREXRLMYVCCXSETVKLVVLVRPPSAADVDGVVVVFELMESDLHQVIKANDDLTKEHYQFFLYQLLRALKYIHTANVYHRDLKPKNILANSNCKLKICDFGLARVAFNDTPTTIFWTDYVATRWYRAPELCGSFFSKYTPAIDVWSIGCIFAEVLTGKPLFPGENVVHQLDLMTDLLGTPSMDTISRVRNEKARRYLSSMRKKELISFSHKFPNADPLALDLLQRLLAFDPKDRPTAEEALSHPYFKGLAKVEREPSCQPITKMEFEFERRRVTKEDIRELIFREILEYHPQLLKDYTNGTERTTFLYPSAVDQFRKQFAHLEENSENGPVVPMDRKHTSLPRSTIVHSAPIHGKEQPRIGPSRDKPSPDESYKNHRDSEKYSGNVQRTSQAPQRVPTARPGRVVGPVLPYENGGMKDTYDPRRVAAMNSGYPPQQQIPQIYGYYQTPAKSACSEPSQAEMYTLHQQAYACANSSTVPDVALDMRAPPFHQSAGPKRGSSDRLSAESNLYSRSLNGMAPTTTGVAASAHRKVGVVPYGMSQMY

SEQ ID NO: 4803 - protein, 345 aa, Triticum aestivum
  unsure (1)..(345): unsure at all Xaa locations
RRCTRETHCEFLTEQVTCMRNGRRDDSYQKWRWQPTDCDLPRFDARLLLEPPRGVRRRLGGAARVRCPGESXVCLVQSAIPKGHKTLTKFVNNGSSNVFYAHDYNATVEFYWAPFLVESNSDNPKVHSVPDRVIQWHSIAKHAKNWVGVDYLVFNTYIWWLSALDMKVLKKGSFDEGATEYEEVDRPVAYSEVLKTWAKWVDRNIDPNSTTVFFMGMSPNHITPEAWGNXXGIKCAMETQPIANRSATLDVGTDWRLYAGAQDVLKTFRRVPVHFVDITALSELRKDAHTSVHTLRQGKLLTPEQQANPKTYADCIHWCLPGLPDTWNQFLYARIVSSASTQRQE

SEQ ID NO: 4804 - protein, 246 aa, Triticum aestivum
MAGLGFEETELRLGLPGGGNEAEEAAAAVRSSGKRGYAETIDLVLKLEPASAAAPPSGDDEEVADGVAEAQPPSPAAVDGQLKRSPSQSSVVTTAQPDADPEKPRAPQEPAVGWPPVRSFRRNMLAAALVKVSMDGAPYLRKVDMGTYKSYQELSKALEKMFSSFTIGNDCSQAQGMTGMNESKLVDLLNGSDYVPTYEDKDGDWMLVGDVPWEMFVASCKRLRIMKGSEAIGLAPRAMEKCKSRS

SEQ ID NO: 4805 - protein, 219 aa, Triticum aestivum
TRGLAACGVMMSIVSTAADLMQDFKTGYLTLASPRSMFISQIIGAGMGSVVAPRDFWQFHPAVGGTGLRGGGPPAPAAVGYRNMAILGVDGFSSLPKHCLTLCYVFFAGAIIINLVRPTRPAKVARFIPLPMAMAIPFYIGSYFAIDMFVGTVIVFVWGIVNKAKADAFAPAVASGLICGDGIWTLPQSILALAKVKPPICMKFLSRSVNANVDAYLGN

SEQ ID NO: 4806 - protein, 192 aa, Triticum aestivum
  unsure (1)..(192): unsure at all Xaa locations
MSTAEATLEENANMANLLNQAKRYEEMCEMMEKAVKTANVVELTADERILLSVAYKNAIGAPRASCTIISSIEQNEETRANEVYVASIKEYRTTIETELSMICDGILNLMDSHLALSDTATESMVFYLKTNGDYHRYLAEFMAGAKRKETLXNTPVAYKTSHYDALVDLTTTHSIRLGLALNFSVIYYEILN

SEQ ID NO: 4807 - protein, 384 aa, Triticum aestivum
  unsure (1)..(384): unsure at all Xaa locations
MDPPGGRLEKVLGTENTQNPRVPFKTEDGIVRKWISRFEVWPYLEAYTDDVAHEIAGELQATPDLIIGNVRDGNLVACLLAHKLGVTHCTIAHALEKTKYPNSDLYWKKFEDHYHFSCQFTADLIAMNHADFIITSTFQEIAGNKDTVGQYESHMAFTMPGLYRVVHGIDVFDPKFNIVSPGADMSIYFPYTEQQKRLTSLHTEIEELLFSDVENAEHKFVLKDXKKPIIFSMARLDRVKNLTGLVELYGKNPRLQELVNLVVVCGDHGNPSKDKEEQAEFKKMFDLIEQYNLNGHVRWISAQMNRVRNAELYRYICDTKGAFVQPAFYEAFGLTVIEAMTCGLPTFATAYGGPAEIIVNGVSGYHIDPYQGDKAFALLVEFFE

SEQ ID NO: 4808 - protein, 165 aa, Triticum aestivum
  unsure (1)..(165): unsure at all Xaa locations
YKAEIQNLMACLIWXLTGLEQPPYAEFVPSTHWEKLTQELIHQFCSLLGQSSNSPLSVAISAGFQGLPTLLKLTTVMAAKKQEWQTMKQLPVPIDIGPEFQYHSVFVCLVLRAQSSDEYHPMLMPCTHAVXDQSIMKLSKSSSRPFKKPFCPSNRHASQFKQPNF

SEQ ID NO: 4809 - protein, 408 aa, Triticum aestivum
MDDSGGADPGRQHLSPEGGGGGQPPVPRSPTPLDLAAGSAYHHRRLSPSLRPPAHPHVRLPSAYGPTPALSTDIPFGFSQLSPPLPPPAPVKREAATGQGGGRLEGDDAALYDLVNAYMDLDGMDALNSSEDRHDDRDIHSRASGTRAASAAESSENEAESQSTSAERKDGAKSRHCRSLSMDSFMGKLNYATGDESPKLPPPSPSGGLSRSGSGSLDGGGAASLFGTEFTNGEFTEAEKKKIMANERLAEIALTDPKRVKRILANRQSAARSKERKMRYIQELEHKVQVLQTEATTLSAQLTMMQRDSGGLATQNNELKIRLQAMEQQAQLRDALNEALTGEVQRLKLATGEITDARMSKAGLQQQMNSQLIQMQQLQIQQQQQQQSSQTQQAQQQHQQQQQSQQSA

SEQ ID NO: 4810 - protein, 294 aa, Triticum aestivum
  unsure (1)..(294): unsure at all Xaa locations
MLNIVPHGADLSCQLEXAERLKRLPARHTXVDDTVLCDEENDERKLMPKDKIERDIFQMISLDQIKKMTGIVQLYGWNSRDQALVNPAVVCGDHXKAVLEQGGAFRVKKMSDLIEQYNLMGHIRWISAQMNRVRNGELYRYICDMKGAFVQPAFYEAFGLTVIEAMTCGLPTFATAYGGPAEIIVHGVSGYHIDPYQNDKASALLVDFFGKCQEDPSHWNKISQGGLQRIEEKYTWKLYSERLMTLSGVYGFWKYVSNLDRRETRRYLEMLYALKYRKMAATVPLAVEGETSGK

SEQ ID NO: 4811 - protein, 396 aa, Triticum aestivum
STHASDSLILSYNQLSGAIPAEICVGFENEVHPDSEFVQHNGLLDLSYNRLTGQIPAAIKKCSMLMVLNLQGNLLNGTIPSELGELTNLTSINLSSNGLVGPMLPWSAPLVQLQGLILSNNHLNGTIPVEIGQVLPKISMLDLSGNVLTGSLPQSLLCNKYLNRLDVNNNNLSGKILFFCPMDGESSSSLLFFNSSSNHFSGTLDESISNFTQLSSLDIHNNSLTGSLPSALSDLSFLNYLDLSSNDFYGVIPCGICNIFGLTFANFSGNHIDMYSSSDCAAGGVCSTNGTGRRVAHPSHRVRRLGIICILSLAVIIVLVLLVFYLRHKLSRNSSLVIVPAGKAKATVEPTSTDELLGRKSREPLSINLATFQHSLLRVTIDDILKATKNFSKEHI

SEQ ID NO: 4812 - protein, 249 aa, Triticum aestivum
TRPGYDQVVHDVDLQKLPVRFAMDRAGLVGADGPTHCGAFDVAFMACLPNMVVMAPSDEAELLNMVATAAAIDDRPSCFRYPRGNGIGVPLPENYKGTAIEVGKGRIMIEGERVALLGYGSAVQYCMAASSIVAHHGLRVTVADARFCKPLDHALIRSLAKSHEVIITVEEGSIGGFGSHVAQFMALDGLLDGKLKWRPVVLPDKYIDHGSPADQLVEAGLTPSHIAATVFNILGQAREALAIMTVQNA

SEQ ID NO: 4813 - protein, 369 aa, Triticum aestivum
  unsure (1)..(369): unsure at all Xaa locations
GRVGNYVNIDDCWSYVKRGNKGQLLPDPKTFPSGIKSLADYVHGKGLKLGIYSDAGVFTCQVRPGSLHHENDDAALFASWGVDYLKYDNCYNLGIPPKERYPPMRDALNSTGRQIFYSLCEWGQDDPALWAGKVGNSWRTTDDIQDTWKSMTDIADKNNKWASYAGPGGWNDPDMLEVGNGGMTFAEYRAHFSIWALMKAPLLIGCDVRNMTSETIEILSNKEVIQVNQDPXLGVQGRRILGQGKGGCREVWAGPRSGNRLAVALWNRCSETVNITMSLPAVGLDGSSAYSVRDLWKHETLSANVVGTFGAQVAVHDCKMYIFTPSRRFFCKLVIEKRAKPRHAVYICLETNFGQSSNFQVTRYIYVSA

SEQ ID NO: 4814 - protein, 234 aa, Triticum aestivum
  unsure (1)..(234): unsure at all Xaa locations
EERWSLAGKTALVTGGTKGIGRAIVEELAGFGVRVHTCARSDADVQERLRGWAADADAGRLSGRVTASXCDVSVRGDREALMATARAELGGKLDILVNNAGQTFFXAGHAETAEDYARLMATNLESCFHLAQLAHPLLVAAGGGSVVNISSVASAIAYPXLSVYSATKAAMNQLSRNLAVEWASDGIRVNCVAPGGIRSDILQSSGIXRLTWRALLAMGKERRTSRVALGRMGE

SEQ ID NO: 4815 - protein, 217 aa, Triticum aestivum
MPSSRYFIKKSQDKSCGTLVRDRPMAAAAASVGGGAAPFVWKTYRMVEDPGTDGVIGWGKGNNSFVVADPFVFSQTMLPAHFKHNNFSSFVRQLNTYGFRKVDPDRWEFAHGSFLRGQTHLLRNIVRRGTAVGGGGGGKRKDAVAAGLTDDDMTMVATEVVRLKKEQNTIDDRVAAMWRRVQETERKPKQMLAFLLTVVGDRDTLQRLVGNSGNAAG

SEQ ID NO: 4816 - protein, 145 aa, Triticum aestivum
  unsure (1)..(145): unsure at all Xaa locations
KKESEVQNTNKRNXNLRDQIKQMPGKVGGWHQRXAKSNESMISALKYNLEQVCAHQSKDFKKGCGASEVDDTASCCNGGAVNLQLMPKENNHPKDLPACRVCKSSKGCMLLLPCRHLCLCKEWESKLSFCPPPPPSKILGKKKNM

SEQ ID NO: 4817 - protein, 205 aa, Triticum aestivum
MEHLPVEVIGNILAHLSAARDVMVSSAVCRKWREACRKHLHSLSFNSDDFPRDMTTRQLEIIITQTIFQTMGLQCLSIHIDNTHEFSAAPVIAWLMYTRETLRCLYYNIQTNPNVNILEKCGRQKLEVLDLDHNTITGVEPSYQRFTCLKSLYLRHVSISALDLSLLVAACPKIESLALDVLEIVTSDSQSTMELTSHTLKKHLC

SEQ ID NO: 4818 - protein, 165 aa, Triticum aestivum
KIAGASRIIGIDIDAKKFDVAKNFGVTEFVNPKDHDKPIQQVLVDLTDGGVDYSFECIGNVSIMRAALECCHKGWGTSVVVGVAASGQEIATRPFQLVTGRVWKGTAFGGFKSRSQVPWLVEKYMNKEIKVDEYITHNMNLTDINKAFDLLHEGGCLRCVLAMEH

SEQ ID NO: 4819 - protein, 381 aa, Triticum aestivum
MASSTQGQVITCKAAVAYEANKPLVVEDVQVAPPQAGEVRIKILSTALCHTDYYTWSGKDPEGLFPCILGHEAAGIVESVGEGVTDVQPGDHVIPCYQAECRDCKMCNSGKTNLCGKVRGATGVGVMMSDRKSRFSVNGKPIYHFMGTSTFSQYTVVHDVSVAKINPQAPLDKVCLLGCGVSTGLGAVWNTAKVEAGSIVAVFGLGTVGLAVAEGAKSAGASRIIGIDIDTKKFDVAKNFGVTEFVNPKDHDKPIQQVLVDLTDGGVDYSFECIGNVSIMRAALECCHKGWGTSVVVGVAASGQEIATRPFQLVTGRVWKGTAFGGFKSRSQVPWLVEKYMNKEIKVDEYITHNMNLTDINKAFDLLHEGGCLRCVLAMEH

SEQ ID NO: 4820 - protein, 278 aa, Triticum aestivum
GTSLSLSLSLSLSCQAHTPPALTLPSLLSPHSILLHQAKHTFALSSPMAVAIAEAPFHVLAVDDSVLDRKLIERLLKTSSFQVTTVDSGTKALEFLGLHDEDASISSVHADQLDVEVNVNLIITDYCMPGMTGYDLLKKIKESSSFRDIPVVIMSSENIPSRINRCLEEGANEFFLKPVRLSDMSKLKPHIMKSRCKEHCHQDEDLLSNSETNPTNNSSSSSDTITISSSNPMDNSSGDTISSSNPTDNSSGDSSNIRKRKAADDEILTKTSRPNHNC

SEQ ID NO: 4821 - protein, 112 aa, Triticum aestivum
NGDEVDGYDEALCPHDFEDRGVILDDEINETIVRPLGAGVKLHAIIDTCHSGTILDLPYLCRISRCVCTPSNLLPVNFQYTDGSFALVKNNFLLCGIKNWVLAMGEPQPSTG

SEQ ID NO: 4822 - protein, 382 aa, Triticum aestivum
  unsure (1)..(382): unsure at all Xaa locations
MASPPNGAAAAAAASSAAGGAPPVDKEVDFANYFCTYAYLYHQKEMLCDRVRMDAYHSAVFRNPHHFRGKVVLDVGTGSGILAIWSAQAGARKVYAVEATNVAEHARELVRANGVADIVEVIQGTMEDIVLPEKVDVIISEWMGYYLLRESMFDSVICARDRWLNPGGVMYPSHARMWLAPIRSGLGDKKMEDFEIAMNDWNHFVXEDTQAYYGVNMNALTKAYRAEHEKFYLKSSIWNNLHPNQLIGQPAVVKEMDCLTATVEEIREVRAQVTLPINQDRTRLAALAGWFDVHFRGSKQNPAVEEVELNTAPDENGGTHWGQQVFLMTPAPRVNEGDSINVSFSMVRSKENHRLMDMDITYELHEASGRKLPAVATKIFLE

SEQ ID NO: 4823 - protein, 561 aa, Triticum aestivum
MADLQTPLVRPKRKKVLVDYLVQFRWILVIFVVLPASALIYFNIYLGDMWSAMKSEKKRQKEHEDNVQKVVKRLKQRNPKKDGLVCTARKPWIAVGMRNVDYKRVRHFEVDLSAFRNILEIDPERMVAKVEPLVNMGQISRATCPMNLSLAVVAELDDLTVGGLINGYGIEGSSHIYGLFSDTVVALEIVLADGRVVRATKDNEYSDLFYGVPWSQGTLGFLVSAEIKLIPIKEYMRLTYTPVKGPLKEVAQAYADAVAPRDGDPAKVPDFVEGMVYSATEGVMMTGVYASKEEAKKKGNKINSVGWWFKPWFYQHAQTALKKGEFVEYIPTREYYHRHTRCLYWEGKLILPFGDQFWFRFLFGWLMPPKVSLLKATQGDAIRNYYHDNHVIQDMLVPLYKVGEALEFVHHEMEVYPLWLCPHRLFKLPVKTMIYPEPGFEHQQRQGDTSYAQMFTDVGVYYTPACIFRGEEFDGAESVKRLEQWLIENHSYQPQYAVTELNEKDFWRMFDASHYEHCRHKYGAVGTFMSVYYKSKKGRKSEKEVQEAEAAILEPAYADEA

SEQ ID NO: 4824 - protein, 386 aa, Triticum aestivum
VDGLYDLTKNEDLWRMVCRNAWGSETTRALETVPAAKRLGWGRLARELTTLEAVAWRKLTVGGAVEPSRCNFSACAVGNRVVLFGGEGVNMQPMNDTFVLDLNASNPEWRHVNVSSAPPGRWGHTLSCLNGSWLVVFGGCGRQGLLNDVFMLDLDAKHPTWREIPGVAPPVPRSWHSSCTLDGNKLVVSGGCADSGVLLSDTFLLDVSMDRPVWREVPASWTPPSRLGHSMSVYDGRKILMFGGLAKSGPLRLRSSDVFTMDLSEEEPCWRCLTGSGMPGAGNPAGAGPPPRLDHVAVSLPGGRVLIFGGSVAGLHSASQLYLLDPTEEKPTWRILNVPGRPPRFAWGHSTCVVGGTKAIVLGGQTGEEWMLTEVHELSLASSNSV

SEQ ID NO: 4825 - protein, 176 aa, Triticum aestivum
MELELGLAPPTNAGRPPLGSGKRGFGEAFGEDEEQRRTSTTTLPLFDDGSSSSSSCDSGSGGGVGGSKKALVGWPPVSSARSRACGRHVKVWKEGAAIGRKVYLPFHGSYADLLATLARMFPDPAGDRAGCLGGAAGKGEGEMVVTYEDADGDWMLVGDVPWEDFARSVKRLKILL

SEQ ID NO: 4826 - protein, 159 aa, Triticum aestivum
AASFTSWTLPCAGAAVASLSEPPCPLRDLLEEYAAAVRRMACGVLELMAEGLGVAPADALSRLVSDAESDSMVRVNHYPPRPELQGRLLTGFGEHTDPQVISVLRSNGTSGLEICARDGSWTAVPPDADSFFVNVGDALQVLTNGRFTSVRHTVVVSSE

SEQ ID NO: 4827 - protein, 228 aa, Triticum aestivum
NPDVGPGISSELRFYDNGTIQLVDRLSESPLWQFSTGPPLSKHITTTNSDLSYLIYPLDESDLVEVHNGTGVKLPWELEEFIARTPYIRDSVVTIGSKASTTFAVDADSGEIIYKHSLPAALNELAVPAGEAPSKLDVGRSSNIIVVVRTDYSLSASDLGVHLFNWTRSSFSANYYVKQSHPNMLEQSSCLQENIPCIRTDGVPIKLTLPDSSTANALVLQDVNKVTT

SEQ ID NO: 4828 - protein, 475 aa, Triticum aestivum
MAHDGASHGATTAPLLASTEKPPRNMYAFGCATLASMTTILMGYNLALMSGAQLFIREDLGLTDEQVEVLAGSMNVYMLVSILAAGWAADLLGRRGTLVLANGFLMAGALAMSLGGSYAALMAARFITSIGVGFSLVVAPVYNAEISPASARGVLSSLLDIFVNVGILLSYVSNYALAGLPVHLSWRVMYAIGVLPPVLLAAGVLAMPESPRWLAMRGREADARAVLVGTSDTAAEAELRFEEIKRVVEAPREADSGVWRELIFRPSAMVRRILVFVVGLNFLQQALGVDAILLYSPLMFKKAGMSSNSAILGATVAIGVVKTCFILVVSLFSDRFGRRPLLLASAGGVAASLTGLALTLCIGETSPASTAACVAFTLATVAAFSVGWGSLPSTYTAEITPLRLRAQGSSLGMAVNRLTCGVVSMSFISLAGWITMPGCFFLYASMAATAYVFVFLRLPETKGRTLEEMDVLFSK

SEQ ID NO: 4829 - protein, 320 aa, Triticum aestivum
MKVEEQTVVGGGGGGLWGLAGRPCDTCAVDAARLYCRSDGAYLCAGCDARAHGAGSRHARVWLCEVCEHAPAAVTCRADAAALCATCDADIHSANPLASRHERLPVTPFFGALADPPQPAPSPSSAAATQEDADDDGSNEAEAASWLLPEPGDSPEDSTATFFADSDAYLDLDFVRSMDGIKAIGVPVAPSELDLAGGALFYPEHSMNHSMSTSEVAVVPDALSAGGAPAPAPSVAVVASKGKERQARLMRYREKRKNRRFQKTIRYASRKAYAETRPRIKGRFAKRTAEDDALERDGPFSPASSAHLASDGDYGVVPSF

SEQ ID NO: 4830 - protein, 363 aa, Triticum aestivum
  unsure (1)..(363): unsure at all Xaa locations
MSNLSEPSKEDGSVEKTGAWNNTWSTLMRHASVYGVAAGYCLSASLLSIINKWAIMKFPYPGALTALQYLTSVAGVLLCGQLKLIEPDRLNLRTMWKFLPAAVMFYISIFTNSELLMHANVDTFIVFXSAVPIFVAIGETLYLHQPCPSFKTWLSLSTILGGSVIYVFTDNQFTLTAYSWAIAYLASMSIDFVYIKHVVMTIGLNTWGLVLYNNLEALLLLPLELLIMGGFFQTKVDSSKMTTNWLSFDVVLPVALSCLFGLSISFFGFSCRRAISATGFTVLGIVNKLLTVVINLLIWDKHASLVGTIGLLICMSGGVLYQQSATKPKVPKIEPKEEDDEEGQNLLQIQPGHESNPSQKHSS

SEQ ID NO: 4831 - protein, 252 aa, Triticum aestivum
MAEELVLDTAIRDWVLIPLSVVMVLIGVLRYFVSKLMRSPPSASPSPDPKTVKEGQVVIRARNLRNGAQFIPAKAFKARKLYYTNGEAGLLHVPKEDAQKAQAAMFSDPNMAMDMMKKNLSMIVPQTLTFAWVNFFFSGFVAAKIPFPLTQRFRGMLQNGIDLSTVDVSYVSSRSWDFLNLFGLRGLFSLIVGEENATDDAQNMMGMGGRMGFNPAMSLSPDKVSLAIIQHKWALFKMERHAIKVFSRLLKN

SEQ ID NO: 4832 - protein, 268 aa, Triticum aestivum
PTRPQPSFLRVRPVTEHYAIFPEIQIVMNPMGMVVGGGSPVGADPGMVPRLGVIPKYAADESEMRWFEVPGFNMMHSVNAWEEAGGDEIVMVAPNILSIEHTLERMELIHASVELVRINLRTGNVTRTPLAAANLDFGVINPGCLGRRNRYGYFGVGDPMPKIGGVAKLDFDRAGHGDCTVARRDFGPGCFAGEPFFVPDDVEGNGDEDDGYVVCYVHDEGTGDNRFVVMDAQSPELDIVAEVQLPSRVPYGFHGLFVTQAELRSQHQ

SEQ ID NO: 4833 - protein, 496 aa, Triticum aestivum
  unsure (1)..(496): unsure at all Xaa locations
MASLADDGFSAARLFSQGVSYTYDDVIFLPGFIDFPADAVDLSTRLSRRVPLSIPCVASPMDTVPEAAMAAAIGSLGGXAVVHSNTEPRXQASIVRAAKSRRLPFVSSVPIFSPASAPTLNDFAGHDYALGTGQGYSHSMLLGVAVASNAASLEAPAPVSEYMRPAPRSASASFDFEQAAAFLADEGMDYAPLLSEDGEVIDLITSKDVERIRSYPKLGKPSLGADGKLVVAASIGTREDDKLRLEQLIQAGANDSVIDCSQGNSTCLLYLCLRAASQLVRVGGAIDLPLPLXGCNIIIFPPWPWLKTFGHRNGCNNKSDVSVCXKKKTCPGGRASYAKDHNVPVIADGGISYSGHIVKALSLGASTVMMGSFLAGSHEAPGAYEYKDGHRVKKYRGMGSLEAMTKGSDARYLGDTLKLKVAQGVVGAVADKGSVLRFIPYTMQAVKQGFQDLGASSLQSAHDLLRAETLRLEVRTGAAQVEGGIHGLVSYEKKSF

SEQ ID NO: 4834 - protein, 302 aa, Triticum aestivum; identical to SEQ ID NO: 4226

SEQ ID NO: 4835 - protein, 303 aa, Triticum aestivum
  unsure (1)..(303): unsure at all Xaa locations
MVYIKNQKTRAYSKRFQVKFKRRRQGKTDYRARLRLTNQDKNKYNTPKYRFVVRFTNKDVTAQIVYATIAGDIVMAAAYSHELPRYGLEVGLTNYAAAYCTGLLLARRVLKNRDLDEEYEGNVEATGEDFSVEPSDERRPFRALLDVGLIRTTTGNRVFGALKGALDGGLDIPHSDKRFAGFKKDEKSLDAEIHRKYIFGGHVADYMRSLADEEPEKFQTHFSEYIKKGXISADDMEAVYKKVHAAIRADPTMAKSTKAPPKTHKRYNPKKLTYEQRKASLVERLNALNNSAGAXDDDEEDDE

SEQ ID NO: 4836 - protein, 368 aa, Triticum aestivum
  unsure (1)..(368): unsure at all Xaa locations
ARSNDFKGLYGYKVFVSISLILGDGIYNLVKIIYSTIKETMNARSNQGRLPLVWVQEGDKISKLPAKEKLLNEVFVKDNIPPWLAASAYVGLAAISTAIVPIMFSQLKWYLVLSAYVVAPLLAFCNSYDTGLTNWSLASTYGKIGLXFIFASWVGQRGGVIAGLAACGVMMSIVSTAADLMQDFKTGYLTLSSPRSMFVSQLIGTALGCVIAPLTFWLYWSAFDVGNPDGMFKAPYAVIFREMAILGVEGFSALPQHCLAICSFFFFAAIAINLLRDVTPDSVSKFIPLPMAMAVPFYIGAYFAIDMFVGTVILFVWEKINRKESEDFAGAVASGLICGDGIWSVPSAILSIMRIDPPMCMYFKPSLA

SEQ ID NO: 4837 - protein, 322 aa, Triticum aestivum
  unsure (1)..(322): unsure at all Xaa locations
MAIKRTKAEKKIAYDQKLCQLLEEYTKVLIAVADNVGSKQLQEIRKGLRGDSIVLMGKNTLIRRCIKVHSEKTGNKDFLELSNLLVGNVGLIFTKGDLKEVREEVAKYKVGAPARVGLVAPVDVXVVPPGNTGLDPSQTSFFQVLNIPTKINKGTVEITIPVELIKKGDKVGSSESALLAKLGIRPFSYGLVICNVYDSGSVFSPEVLDLTEEDLMDKFASGVSMVASLSLAISYPTMAAAPHMFLNAYKNVLAVXALETDYSYDHADKIKEYLKDPSKFAVAAPAAAASGGAAAAAPKEEEKKDEPEEESDGEMGFSLFDD

SEQ ID NO: 4838 - protein, 348 aa, Triticum aestivum
  unsure (1)..(348): unsure at all Xaa locations
FWLLLVHTEKNSSALVGAVGGRSPASELPPLGSEIIRVLTNPRKXLILAVARPYPEKNITTLVKAFGECRPLRELANLTLIMGNREAISKMSNMSAAVLTSVLTLIDEYDLYGQVAYPKHHKHSEVLDIYRLAARTKGAFVNVAYFEQFGVTLIEAAMHGLPVIATKNGAPVEIHQVLDNGLLVDPHDQHAIADALYKLLSDKQLWSRCRENGLKNIHRFSWPEHCKNYLSRILTLSPRYPAFPGNEDQIKAPIKERKCIIVIAVDSASKKDLVCIIKNSIEATRKETLSGSTGFVLSTSLTMSEIHSLLISAGMAPTDFDAFICNSGSDLFYPSRAGDSPSTSRVTF

SEQ ID NO: 4839 - protein, 154 aa, Triticum aestivum
MECGHCGEGLSIPRGARAVQCAHCRGVTRVGRRHGFVGFVVNMITNMAGGGRTRPATPPRLREAVYPRVQGDKRALLVGISYAGTHLPELSGPVTDVKSMSFLLTQKYGFPSQCILVLTDEERDPYRTPTKSNILLAMRWLVHGCSSGDSLVFH

SEQ ID NO: 4840 - protein, 214 aa, Triticum aestivum
  unsure (1)..(214): unsure at all Xaa locations
TTTNASPDSASAAAAAVPPPAPAVPAKVRLMVSYGGRIQPRPHDHPLSYRHGDTSVATRDTAAPLPXLYARLASLAAARGDLCVKYQLPGEDLDALVSVTNDEDLEHLVIEYDRLHLFRAPAAPGSGGSSRGGSTPRLRVFLFPVAPPPRPAFPPKPPQQELQREWYLDLKSASPPPLPQALPPQMQNQQMQQPQVMMKQEAVPVQSPPSAAPM

SEQ ID NO: 4841 - protein, 368 aa, Triticum aestivum
MDRDAGCYYLGGGGGNDWDLNAVVRFACRGRVLPPPPSEDPFSSFFPPPAPVVEDHGMPDAAALLPDPPVDGGSAAVDELSIAFFAPSAALPSSPQPPPPPQQQQQPAAPTNQEMVPMQQDEAVPPPMLLTAGGQGPVGEGSRSKRKKKVVKKVVKRVAADGTSADPWAWRKYGQKPIKGSPYPRGYYRCSTDKACEARKMVERCRDDPNSFILTYTGGEHSHPAPAHRNSLAGTTRNRQQAPEPAAGQSAPAAKAKEESSSAAAEPSPAQSTSGGMSPTTPLRTPSMEEYNQDSEFDEAAGGASQPPMDVEKDREDELLKILEGCVHGGQLPHCRRGDVRGHAVGHGPRRRGRVELTPPLPSVHCHI

SEQ ID NO: 4842 - protein, 418 aa, Triticum aestivum
  unsure (1)..(418): unsure at all Xaa locations
MADQSPAPIRCKAAVSRAKGAPLVIEDIVVDPPKAYEIRMKVICTSLCHTDITFWRGKEDFPLPPVFPRILGHEAYGVVESVGERVEGFAVGDTVVPTFLGQCDSCAGCASAGSNMCSALPFVVGPGMRRDGTTRFRDSQGEPLHDFLAVSSFSQYTVVDVXQVVKVDPAVPPKLACLLGCGAGTGVGAAWRLAKVQPGSSVVIFGLVLXTIKXXXXXXQGAKMCGAAKIIGVDLNPDKEELGKSSFLRGTRHGENIWLISKCYLLVLQAXKFGVTDFVNPSKLGESPLSQVIIEMTGGGADYCFECIGVASVMTEAFRSAKQGNGKTVILGLEKDGKPISLPSIEFLFGKCVMGSLFGGIKPKTDIPILAKKFMIKELELEKLITHEVGLQEINTAFDLLLQGKSLRCIIWMDKLAA

SEQ ID NO: 4843 - protein, 225 aa, Triticum aestivum
TGPEFPGRPTRPANLKYPQRLRRLHIFPTNKAENMQPVDRFVVEEYILDVLLFFNGCRKECAFYLVSLPVSFRYEYLMAETIFSQLLLLPNPPFRPIYYTLVIIDLCKALPAAFPSVVGAAVHALFDRISNMDTECRTRLILWVSHHLSNFQFIWPWQEWANVKGLPKWAPQRVFVQEVLEREIRLSYFEKIKHSIEDAAELEGLLPPKAGPNFRYLTHESKEST

SEQ ID NO: 4844 - protein, 613 aa, Triticum aestivum
MPEAPSAQPAPASGYAPGAHREALDFIEHVTANAGKVQQRVLAEILAQNETAEYLRRYGVSSSSSPLDPVDAFRRCVPLVTYEDLQPDILRIANGDSSPILSGKPISEFLTSSGTSGGERKLMPTIADELDRRSLLYSLLMPVMSQSLPGLDKGKAMYLLFVKAESRTPGGLAARPVLTSYYRSRQFLDRPHDPSSAYTSPNKAILCVDSYQSMYAQLLCGLVHRTDVLRVGAVFASGLLRAIRFLEKHWPLLCHDIRTGELDPEITDHAVRDAVGRLLHANPALASEIEAECSKPSWEGIIRRLWPRTKYIDVIVTGAMSQYIQTLEFYGGGLPLICTMYASSECYFGLNLNPMCKPGDVAYTLIPTMCHFEFLPVHCSNANAEPSHRDLVDLVDVKLGHDYELVVTTFSGLCRYRVGDVLRVAGFKNEAPMFSFVRRRNVALSIDSDKTDETELHTAVSSAVQHLAPFGASLVEYTSYADTAAIPGHYVLFWELREGSTAVPASVFEECCLSVEEALNSVYRQCRACDRSIGPLEIRVVSEGTFEKLMDYALSQGASINQYKAPRCVRPGPVVELLDARMQASYFSPKCPKWSPGNKQWNTSKELLSIGDA

SEQ ID NO: 4845 - protein, 182 aa, Triticum aestivum
  unsure (1)..(182): unsure at all Xaa locations
MSASVLDYTKALEVLKEYKQRDGLDIHELMDTTKHGGLTYNDFLLLPGYIGFAASEVTLDSPITKRITLRTPFVSSPMDTVTEHEMAIHMALQGGLGVIHHNCSPEAQADMVRKVKRYENGFINDPIVIDQNTTVGEAKALKEKWGFGGFPVTEDGKLGSKLVGIVTNRDLQFEEDLDQAVX

SEQ ID NO: 4846 - protein, 393 aa, Triticum aestivum
  unsure (1)..(393): unsure at all Xaa locations
MLPSHLNGHSPLARRRPHLPAATPPAPAAGDPPAAGPAGDAALEAHDRVYFQSYSHIGIHESMIKDRVRTDAYREAIMLHQKFIEGKVVMDVGCGTGILSVFCARAGAKRVYAVDASEIATQASEIVKANNLADKIVVILPPRDEVVLGVKVDVIISEWMGYMLLYESMLPSVLFARDKWLKPGGLILPSXATLFMAPITNSDRYEGSVDFWCDVYGINMSALVPLAKKFASEEPSIEIVGGENVISWPFVVKHIDCYTFTVEEFKSITTTYKVSSMMLAPIHGFGLWFEVEFNGPAESCSNLSSDSSPLDIIQKKRRRASDSTVVLSTAPEDEPTHWHQTILYFPDPIGVTQDQIIEGSVTITPSEENPRCLNIHLECSTGGQNLVKDFAMR

SEQ ID NO: 4847 - protein, 175 aa, Triticum aestivum
MATNGYSNGGSTKGKPIKCKAAVAWGPGEPLVMEEVEVAPPARMEVRVRILYTSICHTDLSFWRGENERQRRFPRILGHEAAGVVESVGEGVEDLAPGDHVVPIFNGECGTCAYCHSSATNLCGTYRVDAFKSTMVSDDGTRFSVVNTSGDTVPVYHFLNTSTFAEYTVLDAACA

SEQ ID NO: 4848 - protein, 808 aa, Triticum aestivum
MAAKLTRLHSLRERLGATFSSHPNELIALFSRYVHQGKGMLQRHQLLAEFDALFESDKEKYAPFEDILRAAQEAIVLPPWVALAIRPRPGVWDYIRVNVSELAVEELTVSEYLAFKEQLVDEHASSKFVLELDFEPFNASFPRPSMSNSIGKRVQFLNRHLSSQLFQDKESLYPLLNFLKAHYYKGTTMMLNDRIQSLRGLQSALRKAEEYLVSIPEDTPSSEFNHRFQELGLEKGWGDTAKRVHDTIHLLLDLLEAPDPASLEKFLGTIPMMFNVVILSPHGYFAQSNVLGYPDTGGQVVYILDQVRALENEMLLRIKQQGLDITPKILIVTRLLPDAVGTTCGQRLEKVIGTEHTDILRVPFRTDNGILRKWISRFDVWPYLETYTEDVANELMREMQTKPDFIIGNNSDGNLVATLLAHKLGVTQCTIAHALEKTKYPNSDIYLDKFDSQYHFSCQFTADLIAMNHTDFIITSTFQEIAGSKDSVGQYESHIAFTLPDLYRVVHGIDVFDPKFNIVSPGADMTVYFPYTETDKRLTAFHSEIEELLYSDVENDEHKFVLKDRNKPIIFSMARLDRVKNMTGLVEMYGKNAHLKGFGKLVIVAGDHGKESKDREEQAEFKRMYSLIEEYKLKGHIRWISAQMNRVRNGELYRYICDTKGAFVQPAFYEAFGLTVIEVHECGLPTIATCHGGPAEIIVNGVSGLHIDPYHSDKAADILVNFFEKCSEDPSYWDKMSEGGLKRIYEKYTWKLYSERLMTLTGVYGFWKYVSNLERRETRRYLEMFYALKYRSLAAAVPLAVDGESSDN

SEQ ID NO: 4849 - protein, 366 aa, Triticum aestivum
  unsure (1)..(366): unsure at all Xaa locations
PPPTCDLAHGRWVFDNESLPLYREKECNFLTKQLTCLANGRNDDLWQYWQWQPNNCSLPTFDARRFMERMRGKRLMFVGDSLNRNQFYSLVCMVQSILSKGRKKVVKRGSNTIFHAKEYRATLEFYWAPFLVESNSDDPNIHSIEHRIIRPERIEGHAQYWRGVDYLIFDTYIWWMNTADIKVRRPDSRSWSEHDEVPRIEAYGRVLKTWSDWLNENIDPARTSVFFMTISPIHISPDKWGNPXGIKCAKETLPVLNYTEPLDLNHDMRLYDMVASTARSMKKVPVTLIDITRMSDYRKDAHTSVYSVRRGYLLTPKQKNDPEKFADCIHWCLPGVPDVWNTVLYTRIFSKSPPSSPPALALPPPQ

SEQ ID NO: 4850 - protein, 358 aa, Triticum aestivum
CFHSKNPPLDQPEGVKIHLYRLGIEQREHDALKSFACAGEGSPSLLDTIILSQWENFAQKGQLGYDVTTCELKVIEGQRDFVIQMNDKWNSFPLKKYDKFGHPFGCLKPNSARSYEELLLCIAEGENNEPEVVPSITPPNNGVLLIANAYPVEYGHIFLVPNATNQLSSFWDKRMFGLITKIASEVNSTAFRVFFDDGTSIVPKHMFFQACYFANPLPVESSSTVALYDGATRSGICVSEIVDYPLKALVFTSTNVNALVDVVSEACLALHENNTVHSLMMSNNGRNVFLFPQVKNLVTGCCLSAWECCGYFVYHTKVDFDRASETGISNRMASFSFQDGDFEDLKKLCCAIADGLVT

SEQ ID NO: 4851 - protein, 321 aa, Triticum aestivum
  unsure (1)..(321): unsure at all Xaa locations
MAIKRTKAEKKIAYDQKLCQLLEEYTKVLIAVADNVGSKQLQEIRKGLRGDSIVLMGKNTLIRRCIKVHSEKTGNKDFLELSNLLVGNVGLIFTKGDLKEVREEVAKYKVGAPARVGLVAPVDVVVPPGNTGLDPSQTSFFQVLNIPTKINKGTVEITIPVELIKKGDKVGSSESALLAKLGIRPFSYGLVICNVYDSGSVFSPEVLDLTEEDLMDKXFASGVSMVASLSLAISYPTMAAAPHMFLNAYKNVLAVALETDYSYDHADKIKEYLKDPSKFAVAAPAAAASGGAAAAAPKEEEKKDEPEEESDGEMGFSLFDD

SEQ ID NO: 4852 - protein, 815 aa, Triticum aestivum
MGETAGGRALSRIHSVRERIGDSLSAHTNELVAVFSRLVNQGKGMLQPHQITAEYNAAIPEAEREKLKDTAFEDLLRGAQEAIVIPPWVALAIRPRPGVWEYVRVNVSELGVEELNVLNYLQFKEQLANGSIDNNFVLELDFEPFNASFPRPSLSKSIGNGVQFLNRHLSSKLFHDKESMYPLLNFLRAHNYKGMTMMLNDRIRSLGTLQGALRKAETHLSGLPADTPYSEFHHRFQELGLEKGWGDCAQRASETIHLLLDLLEAPDPSSLEKFLGTIPMVFNVVILSPHGYFAQANVLGYPDTGGQVVYILDQVRAMENEMLLRIKQQGLDITPKILIVTRLLPDAHGTTCGQRLEKVLGTEHTHILRVPFKTEDGIVRKWISRFEVWPYLEAYTDDVAHEIAGELQATPDLIIGNYSDGNLVACSLAHKLGVTHCIAHALEKTKYPNSDLYWKKFEDHYHFSCQFTADLIAMNHADFIITSTFQEIAGNKDTVGQYESHMAFTMPSLYRVVHGIDVFDPKFNIVSPGADMSIYFPYTEQQKRLTSLHTEIEELLFSDVENAEHKFVLKDKKKPIIFSMARLDRVKNMTGLVEMYGRNPRLQELVNLVVVCGDHGKVSKDKEEQAEFKKMFDLIEQYNLIGHIRWISAQMNRVRNGELYRYICDMKGAFVQPAFYEAFGLTVIEAMTCGLPTFATAYGGPAEIIVHGVSGYHIDPYQNDKASALLVDFFGKCQEDPSHWNKISQGGLQRIEEKYTWKLYSERLMTLSGVYRFWKYVSNLDRRETRRYLEMLYALKYRKMAATVPLAVEGETSGK

SEQ ID NO: 4853 - protein, 261 aa, Triticum aestivum
MATSAITSPAAPAATLPLAGRVAIVTGASRGIGRGIATHLSSLGASLVLGYASSSQQADALAAELPRAVAVKADVSDEAGVRSLFDAAESAFGGAAHILVACAGLGIGTYPSLANTSTADFDNVFAVNTRGAFLCLREAANRLRRGGGGRIVAVSSTLAATLLPGYAAYAASKAAVEAMVRVAAKELGSARVTVNCVAPGPVATELFFDGKSQEAVERFRAGHPMGRLGEVGDIAPAVGFLCTDAAEWVNGQVIRVNGGIA

SEQ ID NO: 4854 - protein, 250 aa, Triticum aestivum
NSARAAALWRGNQANVIRYFPTQACNFAFKGYFKSFFGYDKEKDGKWKWLAGNVACGSAAGATTSSLLYHLDYARTRLATDAIESRANKRQFRGLLDVYKKTLATDGIRGLYRGFSVSIVGITLYRGLYFGIYDTMKPIVLVGPLEGNFLASFALGWTITTFSGACAYPFDTLRRRMMLTSGQPFKYRSAFHAVKQIVSTEGFFTLFRGVGANILSGMAGAGVLAGYDQLQRFAGQHDYKIENKMKGALK

SEQ ID NO: 4855 - protein, 210 aa, Triticum aestivum
  unsure (1)..(210): unsure at all Xaa locations
MAGTSSWSSSSSCASSSGSPDHDVVCVTEPDSVGAAGAVADAEGSVKFLCSYGGRILPRRTDGTLRYVGGDNRVLSVDRPIRFYVLQRKLRELCGGWEAXLRCQLPTEDLDALISVTCDDDLAKLLEEYDEASKDRLQSLKIRAFLFPTRTPAPSILQRRSPPSIAHLHWQNTSPPPAAAGVSLTCAPRWWAAPQASRQAQNYDRHSLGE

SEQ ID NO: 4856 - protein, 110 aa, Triticum aestivum
MASSKLQAFWNHPAGPKTIHFWAPTFKWGISIANIADFAKPPEKISYPQQVAVACTGIIWSRYSMVITPKNWNLFSVNVAMAGTGLYQLSRKIRKDYFADEKEVAASLEG

SEQ ID NO: 4857 - protein, 538 aa, Triticum aestivum
  unsure (1)..(538): unsure at all Xaa locations
MPVVAMPSASLPLLSPRHRPLLRPSTLPASRLGSGLLRPRRGRAGSTRLRVAAPTSVPGEAQRAEEPTTSASTSPESPGEKFVWRDHWYPVSLVEXDLDPRVPTPFQLLNRDLVIWNDPNSGEWVALDDRXCPHRLAPLSEGRIDETGGLQCSYRPGAALASAARTRIPQAAPEGPEARAVRSPRACATKFPTLLSQGLLFVWPDENGWDKAKATKPPMLPKEFDDPAFSTVTIQRDLFYGYDTLMENVSDPSHIEFAHHKVTGRRDRAKPLPFKMESSGAWGYSGANTGNPRITATFEAPCYALNKIEIDTKLXPIVGDQKWVIWICSFNIPMAPGKTRSIVCSARNFFQFTMPGKAWWQLVPRWYEHWTSNLVYDGDMIVLQGQEKVFLSASKESSADVNQQYTKLTFTPTQADRFVLAFRAWLRKFGNSQPDWYGSPSQDALPSTVLSKREMLDRYEQHTLKCSSCRGAHKAFQTLQKVFMGATVVFGATSGIPADVQLRILLGAGALISAALAYVFYDRQKHFVFVDYVHADID

SEQ ID NO: 4858 - protein, 340 aa, Triticum aestivum
  unsure (1)..(340): unsure at all Xaa locations
MASADMFPNVSFSDVNAAASQEAAGKAVFGPDPASGAARLSLVRPGAEQAFQIDLSDAQIFKLGPMEWLCVSGETEAKAGVEEKLFSRAIKVVLRTEAESKAFSLAFQRWKQQTISGKAGESLENGSIVACKSKFDTKIEASSAQMYFHYYGQLLHQQNMLQDFVRTGTYYAAVMENRADFEGKVVVDVGAGSGILSLFAAQAGAKHVYAVEASEMVEHAQRLISGNPSFGQRITIIKGKVEEVELPEKADILISEPMGTLLVNERMLESYVIARDRFLAPDGKMFPTTGRIHMAPFSXEYLYVXMAXXSLFWEQHXFFXVDLTXLHGSAFDXYFHXPXX

SEQ ID NO: 4859 - protein, 561 aa, Triticum aestivum
  unsure (1)..(561): unsure at all Xaa locations
MADLQTPLVRPKRKKVLVDYLVQFRWILVIFVVLPASALIYFNIYLGDMWSAMKSEKKRQKEHEENVQKVVKRLKQRNPKKDGLVCTARKPWIAVGMRNVDYKRARHFEVDLSAFRNILEIDPERMVAKVEPLVNMGQISRATCPMNLSLAVVAELDDLTVGGLINGYGIEGSSHIYGLFSDTVVALEIVLADGRVVRATKDNEYSDLFYGVPWSQGTLGFLVSAEIKLIPIKEYMRLTYTPVKGPLKEVAQAYADAVAPRDGDPAKVPDFVEGMVYSATEGVMMTGVYASKEEAKKKGNKINSVGWWFKPWFYQHAQTALKKGEFVEYIPTREYYHRHTRCLYWEGKLILPFGDQFWFRFLFGWLMPPKVSLLKATQGDAIRNYYHDNHVIQDMLVPLYKVGDALEFVHHEMEVYPLWLCPHRLFKLPVKTMIYPEPGFEHHQRQGDTSYAQMFTDVGVYYTPACIFRGEEFDGAXPVKRLEQWLIENHSYQPQYAVTELNEKDFWRMFDASHYEHCRQKYGAVGTFMSVYYKSKKGRKSEKEVQEAEAAILEPAYADEA

SEQ ID NO: 4860 - protein, 91 aa, Triticum aestivum
ARVDGAESVKRLEQWLIENHSYQPQYAVTELNEKDFWRMFDASHYEHCRQKYGAVGTFMSVYYKSKKGRKSEKEVQEAEAAILEPAYADEA

SEQ ID NO: 4861 - protein, 348 aa, Triticum aestivum
  unsure (1)..(348): unsure at all Xaa locations
MAVGNEWINGYLEAILDAGSKLRVQGVSLPPLEPAPALASEESSAAYNPTRYFVEEVVRSFDDQALHKTWTKVVAXRNSQERNNRLENLCWRIWNVARHKKQVERDYSQEVARRKQEQELGSLEAAEDLXAELSEGEKETVPKPDGAAPHLSADEQRPQQRTRLAWINSEVRLVSDDEDEQSKDRNLYIVLVSIHGLVRGENMELGRDSDTGGQVKYVVELARALAATAGVHRVDLLTRQISCPDVDWTYGEPVEMLERLSSGDDDGDESGGGGAYIPSAAPARPRLRIRPPGGCSWPLCPSSRWTGALSRGSLTRPPPPPLLSSKPPPSQPRHAAPDAPGFCTLWYP

SEQ ID NO: 4862 - protein, 355 aa, Triticum aestivum
  unsure (1)..(355): unsure at all Xaa locations
GQTYERSCIQKWLDSGHKTCPKMQLALTHTSLTPNFVLKSLIAQWCEANGIELPKNKANSHDKKAVKSSDYDNAGLVSLMNRLRGGNQDEQRAAAGEIRLLAKRNVNNRICIAEAGAIPLLVNLLSSSDPRTQEHAVTALLNLSIHENNKASIVDSNAIPKIVEVLKTGSMEARENAAATLFSLSVVDENKVTIGAAGAIPPLINLLCDGSPRGKKDAATAIFNLCIYQGNKVRAVKAGIITHLMNFLVDPXGGMIDEALTLLSILAGNQEGKSVITQSEPMPPLVEVIKTGSPRNRENAAAILWALCSADAEQTMAAKAAGGEDALKELSETGTDRAKRKASSLLELMRQSEEA

SEQ ID NO: 4863 - protein, 255 aa, Triticum aestivum
RKRPSTDFLETIQKDVNPSMRAILIDWLVEVAEEYRLVPDTLYLTVNYIDRYLSGNEINRQRLQLLGVACMLIAAKYEEICAPQVEEFCYITDNTYFKDEVLDMEASVLNYLKFEMTAPTAKCFLRRFVRAAQVCDEDPPLHLEFLANYVAELSLLEYSLLAYPPSLVAASAIFLSKFILQPAKHPWNSTLAHYTQYKPSELCDCVKALHRLFSVGPGSNLPAIREKYSQHKYKFVGKKQCPTSVPAEFFRDAAC

SEQ ID NO: 4864 - protein, 229 aa, Triticum aestivum
SADAWADAWVWLSFAPVIIVLLVGTELQHVIAQLALEVVEATATNVGTQLKLRDDLFWFGKPRVLWWLIQFISFQNAFEMATFLWSLWELSANSCFMKNQYMVVIRLASGLLVQIWCSYSTLPLNVIISQMGSKFKKALVSESVRDSLPSWCKRIKDRRHNPLFMRNGTLTSRSVCSLDTTTHQTERDTHAVGALPPPLAAAARVGALPVGAADGGHGRPHIEQDIQHP

SEQ ID NO: 4865 - protein, 202 aa, Triticum aestivum
MSAETERSSTESSAASGLDFEDTALTLTLRLPGDPDRKRGASSSSSCSLADRSSLLAEAPPAPKERVVGWPPVRSFRKNALENVAAGSTRAAAAPAKFVKVAVDGAPYLRKVNLRDYAGYDQLLRALQGKFCSHFTIRKFANDEMKLVDAVNGTEYVPTYEDKDGDWMLVGDVPWKMFEEACQRVRLMKNSEAVNVAPRAAR

SEQ ID NO: 4866 - protein, 446 aa, Triticum aestivum
  unsure (1)..(446): unsure at all Xaa locations
SLQLSHTLRHQITVGSSRPSCLPGPFLVVSSSRAFRLPHSPPGAPPRPLAGRSVPPGGAPXATVVVALALPFAGGLXALGAARLAGLGRSRPSLRARIRHARAAEPAAPAPVRGAGPLSRALILEXSMRARDLLMEQNVALDLARREAEMAIRARNDFLAVMNHEMRTPMNAIIALSSLLLETELTPEQRLLGVALLGRRIPLASLGTAPSGRAQLQVRSPDLQISAFRLPAVFIAVLGFIRPIAAIKRLSMSVMLAPDLPLCAIGDEKRLMQTILNISGNAVKFTKEGHITLLASVLKPDSLREFRTPDFDPAASDDHFYLKVQLKDTGCGISPQDLPHVFTKFAQTQPGGNQGYSGSGLGLAICRRFVTLMGGHIWLDSEGAGRGCTATFIIRLGVSDNTDAYQQQLAPLAWPGSANVESAGPKALHEETWPPSSLKPRYQRSV

SEQ ID NO: 4867 - protein, 392 aa, Triticum aestivum
ANEYSDGEPYGIPSDEAELDDDTQDADNIAVKSARQSERRARRTRATMKAATIVRSSPKLAASSKKKRSKGPSTMNPLGSLWKMTGRKLLTAKEEVELSNGIQDLLKLEAIQGELAEYNGGQPTFPQWAAAAGTDENTLRKRLDHGIHCKNRMVTSNVRLVISIAREFEGPGLELYDLIQEGMQGLIRGAEKFDASKGFRFSTYSHWWIKQAMRKSVSEQTQIFRLPTTAHMVEASYRVKECTKRLRRKLKRRPSNEEIAVDTGMPVKRVEAAVNLPKYSVSLGSKIGSTDMTYQEVTADPSAETAEEMLNRMSMKKDVHQALDTLSPRDRQVVKLRFGIDDGRIRTLQEIGNIMGVSRERIRQIESGAFRKLRGKKKVKCLMDYLVPVGNW

SEQ ID NO: 4868 - protein, 529 aa, Triticum aestivum
  unsure (1)..(529): unsure at all Xaa locations
FRTSLSVFSLPLDPNRARRRRLQPPRPPAPANSSPLGPGLASHHFARRPQTLPPSPPAPPAPSTSPVAIVGPPVACRYGLYFLFVKSETKTPSGLTARPVLTSYYKSEQFKNRPYDPYHNYTSPTAAILCADAFQSMYAQMVCGLCERPGLPRAGAVPAPGLLRAVRLLPRAGAAPAADAAPGARCPRVADAPVPVAGPGSLPPGPVRPLVVRVRXAHAPGARGLRRLPPRPQHLDVIVTGAMAQYIGTLKYYSGDLPMACTMYASSECYFGLNLRPLCDPSEVSYTIMPNMGYFEFLPVDSATGAASCVDAGNLVDLARVEAGREYELVITTYAGLNRYRVGDVLRVTGFHNAAPQFQFVRRKNVLLSIESHKTDEAELQRAVERASALLRPHGASVAEYTSQACTKSIPGHYVIYWELLTTGAGAATAVDKGTLDACCLEMEEALNTVYRQSRVADGSIGPLEIRVVRGGTFEELMDYAISRGASINQYKAPRCVTFPPIIELLDSRVVSSHFSPALPHWTPARRSD

SEQ ID NO: 4869 - protein, 182 aa, Triticum aestivum
MARVYVGSLDPAVTARELEDEFRVFGVLRSVWVARKPPGFAFVDFDDRRDAQDAIKDLDGKNGWRVELSRNASSGRGGRDRSGGSEMKCYECGESGHFARECRLRIGSGGLGSGRRRSRSRSRSRSRSPRYRRSPSYSRRSYSRSPRRRSVSPARGRSVSRSPVRGRDESPAYGNGYRRSRS

SEQ ID NO: 4870 - protein, 369 aa, Triticum aestivum
MDGAPVAEFRPTMTHGGRFLLYNIFGNQFEITAKYQPPIMPIGRGAYGIVCSVMNFETREMVASKKIANAFDNNMDAKRTLREIKLLRHLDHENIVGLRDVIPPAIPQSFNDVYIATELMDTDLHHIIRSNQELSEEHCQYFLYQLLRGLKYIHSANVIHRDLKPSNLLLNANCDLKICDFGLARPSSESDMMTEYVVTRWYRAPELLLNSTDYSAAIDVWSVGCIFMELINRAPLFPGRDHMHQMRLITEVIGTPTDDDLGFIRNEDARRYMRHLPQFPRRSFPGQFPKVQPAALDLIERMLTFNPLQRITVEEALEHPYLERLHDVADEPICTDPFSFDFEQHPLTEDQMKQLIFNEALELNPNFRY

SEQ ID NO: 4871 - protein, 209 aa, Triticum aestivum
  unsure (1)..(209): unsure at all Xaa locations
AFPTPPRSANHRLLLPPPFSPLRSSPPARAFFIRVSGRGMADDDSGSPRGGGGVREQDRFLPIANISRIMKKAVPANGEIAKDAKETLQECVSEFISFVTSEASDKCQKEKRKTINGHDLLWAMATLGFEEYVDPLKIDLQKNRDMEGDSKLTAKSGVGSMKKERIGEQSRATSSNGQAMSNAQAMVQHGGYAQGMGYIQPXQYHNGDT

SEQ ID NO: 4872 - protein, 352 aa, Triticum aestivum
  unsure (1)..(352): unsure at all Xaa locations
MRRSVAMNCGSGPAPATMVRCRQCSASVAAPPGARAVQCAQCCCVTRVGGAGRQLSVMRPIPNFGGGRGKKRAVLVGIKYTNTRACELRGPINDVKCMRYLLTERFGFANDCVLILTDEERDPCRQPTKANIRMAMHWLVQGCSSGDSLVFQFSGAGAQVPDCDGDERDGMDEAICPVDXSSRGPILDDEINQAIVRPLVHGVKLHAIVDACHSATVLDLPYRCTFSKQYGCLRWMDERPLNGACKGTSGGKAVLISGSSNGKTQMSVLPEPNATIGALTHSFIKALECEPRTTYGHLLTSMRTTMRAGAGNCSLQGPVGCSIRKVANFSGVEEPQMSSACKFDINCEPFCM

SEQ ID NO: 4873 - protein, 346 aa, Triticum aestivum
MNCGRGPAPATMVRCRQCSASVAAPPGACAVQCAQCCCVTRVGGAGRQLSVMRPIPNFGGGRGKKRAVLVGIKYTKTRACELRGPINDVKCMRYILTERFGFANDCVLILTDEERDPCRQPTKANIRMAMHWLVQGCSSGDSLVFQFSGAGAQVPDCDGDERDGMDEAICPVDSFQQGPILDDEINHAIVRPLVHGVKLHAIVDACHSATVLDLPYRCTFSKQYGCLRWMDERPLNGACKGTSGGKAVLISGSSNGKTQMSVLPEPNATIGALTHSFIKALECEPGTTYGHLLTSMRTTMRAGAGDCSLQGPVGCSIRKVANFSGVEEPQMSSACKFDINCEPFCM

SEQ ID NO: 4874 - protein, 346 aa, Triticum aestivum
MNCGRGPAPATMVRCRQCSASVAAPAGARAVQCAQCCCVTRVGGAGRQLSVMRPIPNFGGGRGKKRAVLVGIKYTKTRACELRGPINDVKCMRYLLTERFGFANDCVLILTDEERDPCRQPTKANIRMAMHWLVQGCSSGDSLVFQFSGAGAQVPDCDGDERDGMDEALCPVDSFQQGPILDDEINEAIVRPLVHGVKLHAIVDACHSATVLDLPYQCTVSKQTGRWRWRDERPMTGACKGTSGGQAVLISGSSNGKSNMSVLPEPYATIGAMTHSFIRAVECEPRTTYGRLLTSMRAIMRDSGGNCNLQGPIGGSIRKVANFSGVEEPQLSSAYKFDVEREPFCM

SEQ ID NO: 4875 - protein, 166 aa, Triticum aestivum
  unsure (1)..(166): unsure at all Xaa locations
IFVTTTGNKDIIMVDHMRKMKNNAIVCXXGHFDNEIDMNGLETYPGVKRITIKPQTDRWVFPETNTGIIVLAEGRLMNLGCATGHPSFVMSCSFTNQVIAQLELWKEKATGKYEKKVYVLPKHLDEKVAALHLGKLGARLTKLTKAQSEYISIPVEGPYKPAAYRY

SEQ ID NO: 4876 - protein, 127 aa, Triticum aestivum
  unsure (1)..(127): unsure at all Xaa locations
SCRIRHEVKRITIKPQTDRWVFPETNTGIIVLAEGRLMNLGCATGHPSXVMSCSFTNQVIXQLELWKEKATGKYEKKVYVLPKHLDEKVAALHLGKLGARLTKLTKAQSEYISIPVDGPYKPAAYRY

SEQ ID NO: 4877 - protein, 485 aa, Triticum aestivum
MALSVEKTSSGREYKVKDLSQADFGRLELDLAEVEMPGLMACRTEFGPSQPFKGARISGSLHMTIQTAVLIETLTALGAEVRWCSCNIFSTQDHAAAAIARDSAAVFAWKGETLEEYWWCTERCLDWGAGGGPDLIVDDGGDATLLIHEGVKAEEEFEKSGKVPDPESTDNPEFKIVLTIIRDGLKTDAHKYRKMKERLVGVSEETTTGVKRLYQMQESGTLLFPAINVNDSVTKSKFDNLYGCRHSLPDGLMRATDVMIAGKVAVVCGYGDVGKGCAAALKQAGARVIVTEIDPICALQALMEGIQILTLEDVVSEADIFVTTTGNKDIIMVDHMRKMKNNAIVCNIGHFDNEIDMNGLETYPGVKRITIKPQTDRWVFPETKTGIIVLAEGRLMNLGCATGHPSFVMSCSFTNQVIAQLELWNEKATGKYEKKVYVLPKHLDEKVAALHLGKLGARLTKLTKSQSDYISIPVEGPYKPAAYRY

SEQ ID NO: 4878 - protein, 342 aa, Triticum aestivum
  unsure (1)..(342): unsure at all Xaa locations
MTAGLQLGVIGSLALSVASSVAIVICNKALISTLGFPFATTLTSWHLMVTYCTLHVAQRLHFFEPKAIDGHTVILFGFLNGTSIGLLNLSLGFNSIGFYQMTKLAIIPFTVLLETIFLNKRFSETIKLSLMVLLLGVGIASVTDLELNLLGSVLSGLAIXLGTTCVGQILTNTIQKKLKVSSTQLLYQSAPYQAAILFATGPFVDRLLTNRSVFAHKYTTPVVGFIILSCLIAVSVNFSTFLVIGTTSPVTYQVLGHLKTCLVLSFGYTLLHDPFTMKNILGILVAIFGMALYSFFSVRESKKKSTNDALPVSQMPDKETEPLLATKDGSDIKKANGVSHGC

SEQ ID NO: 4879 - protein, 240 aa, Triticum aestivum
MAPPPEGERGGGGCRARWLRREVLLALALGQLVSLLITSTGFSSSELARRGINAPTSQSLLNYILLALVYGGILLYRRQPLTTKWYYYLILGIIDVEANYIVVKSYQYTSLTSVMLLDCWSIPCVIVLTWIFLKTKYGFRKFFGVGVCVAGLILVVFSDVHASDRAKGPKPLKGDLLVIVGSMLYACSNVTEEYLVKKNNRIELMAMLGIFGAVISGIQISILEREELHSIKWNAGRGVP

SEQ ID NO: 4880 - protein, 212 aa, Triticum aestivum
  unsure (1)..(212): unsure at all Xaa locations
RPPTRAVQQDSSLLDIANTSLMSDPPTVEKLKSXDEMNLRPLPTHQPAQSVSMAPKVPSVTDDDMFNDGRVYENFCVDDNDLTFENYEELFGTPHVQTEQLFDDAGIDSFFEMKEMPAADCDQQLNPVRPECSNAVSADSSLCVPARQAISTISLSFSGLTGESNAGDHQDCEVSPLLLMGEQPWLPPGSEGSSAGGSRGSALSRYLGRDHA

SEQ ID NO: 4881 - protein, 350 aa, Triticum aestivum
  unsure (1)..(350): unsure at all Xaa locations
MNCGRGPAPATMVRCRQCSASVAAPAGARAVQCMQCCCVTRVGGAGRQLSVVRPIPNFGGGRGKKRAVLVGIKYTNTRACELRGPINDVKCMRYILTERFGFANDCVLILTDEERDPCRQPTKANIRMXAMHWLVQGCSSGDSLVFQFSGAGAQVPDCDGDERDGMDEAICPVDSFQQGPILDDEINQAIVRPLVHGVKLHAIVDACHSATVLDLPYQCTFSKQYGCLRWMDERPLNGACKGTSGGQGRAHQWQQQWKDPDEACCLSRMQRLGALTHSFLKXSGRXEPRTTYGSLLTSMRTTMRAGAGNCNLQGPVGLLHPQGRQLSVAWREPQMSSACKFDINREPFCM

SEQ ID NO: 4882 - protein, 197 aa, Triticum aestivum
MSSAAAAASSSASPVPPEDDVCSVCHDRFRIPCQANCSHWFCGECIIRVWNHGAAVQPCKCPICRRLINLLVPANVSDDQNDDPQLQRVLGEIQHYNHIFGGAPRSLTQRLQDLPFFIRRLFRELMDPQRTLPLVFRARMILMVILSGVYVLSPVDILPESVLGLFGFFDDFLILVIVFLHLAAVYRSLLLYRHGGH

SEQ ID NO: 4883 - protein, 299 aa, Triticum aestivum
MGAVQLESVAAQHAQAKLNVESLPQGPSLFDGNDTARINGSESDEYEKFDKGLMQYGCAHYRRRCRIRAPCCNEIFDCRHCHNESKNSIKIDTPTRHELPRHELQQVICTLCGTEQEVRQVCINCGVCMGKYFCEVCKLFDDDVSKQQYHCHACGICRIGGRENFFHCSKCGCCYSKVLKNSHACVEGAMHHDCPICFEYLFESRNDVSVLPCGHTIHEKCLREMKEHCQFACPLCSKSVCDMSKAWERLDAELATLSNSFDDKMVRILCNDCGAVSEVQFHLIAHKCHNCKSYNTRQI

SEQ ID NO: 4884 - protein, 233 aa, Triticum aestivum
  unsure (1)..(233): unsure at all Xaa locations
INMFWSPFLVRAREPDHDDPAHTGHYSLYLDEPDDKWVSQVPRFDYVLVSAANWFSRPXSLFYEKRRLIGCSFCSRQYGVPDLTLYYSQRKAWRVALRAINALDGKVKGRVIVRMLSPMSHFENGXTWDQGXGNCKRTEPVRSNQTVMEGRDLQFYTAQMEEYRAAEKAARTKGLRLMLMDATAAMLMRPDGHPSRYGHWPNEKVQLYNDCIHWCLPGPIDIWNDLLFQMMLV

SEQ ID NO: 4885 - protein, 400 aa, Triticum aestivum
MVKAKLLAVLALVAVAAPFLRAAGQEEGEGGARPSELLPFAVGAAPAGCDVGQGEWVYDEAAAPAYDEEACPYIPAELTCQAHGRPDKSYQHWRWQPRGCSLPSFNATVMLEMLRGKRMLFVGDSLNRAQYVSLLCLLHRAMPEGSTSFETVDALSIFRAKAYDATIEFYWAPLLAESNADDGVEHQLNDRVIRGAPMDRHSRFWKGADVLVFNSSLWWMTGDKIQILRGADNDMSKDIVEMGAEEAYRLVLHQVVRWLDGNVDPKKSRVFFVTASPTHASGQLWGDEAEGSNCHGQTKPIADASYWGSTSRAMLRVTGEVLAASARVPVGVVNVTQMSEYRRDAHTQVYREQWAPPTKEQLADPKSYADCTHWCLPGVPDAWNELLYWKLFFPANDQAL

SEQ ID NO: 4886 - protein, 185 aa, Triticum aestivum
  unsure (1)..(185): unsure at all Xaa locations
MAGRYARSLFVDSLMGRLNFACPGGAVNGAGGMFSLEFGSGEISPDEMNKIMVDEKLAEMVLADPKRVKRVLANRQSAARSNERKMLYIEELEQKVQILQTEDTTLAEQIKLLQRDSSAVATXNNELRFQLQAMEHHAHLRDALNDALTGEVHRLKIAAVELGIXDSCSFNAMGQQHNLMFKHQQ

SEQ ID NO: 4887 - protein, 246 aa, Triticum aestivum
  unsure (1)..(246): unsure at all Xaa locations
PRLPTTFPEVFNNFGILLGYVSNFAFARLPVHLSWRAMFLVGAVPPVFLGFAVLAMPESPRWLVMRGRIEDARRVLLRTSDSPEEAEERLLDIKKVVGIPADATDADDVVAIVRANEAARGQGVWKELLINPSRPVRRMLVAGLGLMFIQQATGVDCVVMYSPRVFEKAGMKNRTNSLGASMAVGXCKTFFIPIATLLLDRVGRXPLLLASGGGDGHLPVHASPRPCSCSTGARSRRAKALGRGEH

SEQ ID NO: 4888 - protein, 325 aa, Triticum aestivum
  unsure (1)..(325): unsure at all Xaa locations
MKDFPGVFPRIFGHEAFGVVESTGEHVEGFAAGDAVVPTFLAQCSECADCRSSRSNVCSKYRFAVRPGMPRDGTTRFRDGDGNPIHHLSSADAWGEYTVVDVTQVVKVDPAVPPATACLLSCGATTGVGAAWKLAKVEPGSSVAIFGLGAXGLAVAEGARICGASKIIGVDLNPDKEELGKKSRASHFINPKELGEKTVSQVIIEMTDGGADYCFECIGLAALMNDAFQSSRAGWGKTIILGVERHGAPLTISSLEILHGKCVMGSLFGGVKPKQDIPILADKYLNKELELDKFITHEVGLKDINTAFDLLLQGKSLRCTIWMDK

SEQ ID NO: 4889 - protein, 256 aa, Triticum aestivum
MAGLGFEETKLRLGLPGGSNEAEEAAAAVRSSGKRGFAETIDLKLKLEPAGEEAPAEEDRADVAVVAAAAAENQEETATDAGGGKMKRSPSQSSVVTTAALPDPAEKPRAPKAQVVGWPPVRSFRKNILAEKSSPAAAAAFVKVSMDGAPYLRKVDLNMYKTYQDLSKALEKMFSSFTIGNCGTPGMNGMNESKLMDLLNGSEYVPTYEDKDGDWMLVGDVPWEMFVESCKRLRIMKGSEAIGLAPRAMEKCKNRS

SEQ ID NO: 4890 - protein, 156 aa, Triticum aestivum
  unsure (1)..(156): unsure at all Xaa locations
MADQSLAAPIRCKAAVSRAKGAPLVIEDIVVDPPKAYEIRMKVICTSLCHTDITFWRGKEDFPLPPVFPRILGHEAYGVVESLGEHVEGFAVGDTVVPTFLGQCDSCGGCASAGSNMCSALPFVVGPGMRRDGTTRFRDSXGEPLHDFLAVSSFSQ

SEQ ID NO: 4891 - protein, 462 aa, Triticum aestivum
MEMGGRIRTSCYTEHPHRIPLFPFPVPESSSVPHLIRSLESCSGGMGGGGAAGDADGWADQDQGNGGSRGGGEAKRSEIYTYEAGWHIYGMNWSVRRDKKYRLAIASLLEQLVNRVEVVQLDESTGDIAPVLSFDHPFPPTKSMFVPDPQGLRPDLLATSADLLRIWRITDDDAAAPGAADSNNGSVRCNGVGRPAGQQPGVKLCCELNGHRNSDSAPPRLSRLSAGDAADPRRIGTSSIDTTCTIWDVEREVVDTQLIAHDKEVYDIAWGGAGVFASVSADGSVRVFDLRDKEHSTIIYESSSGGGSNSAATDGGAVLPTPLVRLGWNKQDPRYMATIIMDSPKVVVLDIRYPTLPVVELHRHHAPVNAIAWAPHSSCHICTAGDDSQALIWDLSSMGTGNNSGGNGNGNGNAAAAAAAEGGLDPILAYTAGAEVEQLQWSATQPDWVAIVFANKLQILRV

SEQ ID NO: 4892 - protein, 535 aa, Triticum aestivum
  unsure (1)..(535): unsure at all Xaa locations
YFGEHNIDGMLAVLEPLHAMLERGAETIKENTFIQAYGHELLEAHECCLKYRATGEDAELTKAWDLYYHVFRRIDKQLPSLTTLDLHSVSPELLKCRKLELAVPGTYSADSPLVTIEYFVPQLIVITSKQRPRKLTIHGSDGEDYAFLLKGHEDLRQDERVMQLFGLVNTLLENSRKTSEKDLSIQRYAVIPLSPNSGLIGWVPNCDTLHALIREYRDARKIFLNQEHRLMLAFAPDYDHLPLIAKVEVFQHALQNTEGNDLAKVLWLKSRTSEVWLERRTNYTRSLAVMSMAGYLLGLGDRHPSNLMLDRFSGKILHIDFGDCFEASMNREKFPEKVPFRLTRMLVKAMEVSGIXKGTFRTTCENVMQVLRTNKDSVMAMMEAFVHDPXINWRLFNFNEVPQVSNYGNAHTHTVVSSEEAAPSEELMQPPRGAREKELLQAVNQLGDANEVLNERAVAVMARMSHKLTGRDFSSGSALSGAGGSSQHGSEHLASVDAREVEPGLSVKVQVQKLILQATSHENLCQNYVGWCPFW

SEQ ID NO: 4893 - protein, 167 aa, Triticum aestivum
MGAHRLALLVFLATLPQLLLAGTTRYYTFNVTMQKVTRLCTTRAIPTVNGKFPGPKIVTREGDRVVVKVVNNVKHNVTIHWHGVRQLRTGWSDGPAYITQCPIQTGQSYVYNFTITGQRGTLFWHAHVSWMRATLYGPIVILPKSGVPFPFPKPYKDVPVVFGEWFN

SEQ ID NO: 4894 - protein, 267 aa, Triticum aestivum
MDPKLVEVTQLFDRFKAAFKASNFDVCSTLLSQLKVLLTKFPSLPPLFQQTPNAVEELKLAREIYEQAVILSVKMEDQDAFERDFCQLKPYYMDTCGIIPPSSEEYPIMGANLLRLLVQNRIAEFHTELELLPAKALDNAYIKHGVELEQSFMEGAYNRVLSARQTAPHETYIYFMDLLVKTVRDEIAGCSEKGYDYLSINDAKQMFKFSSDKELEQYIAEEHPEWDVKDGRVLFQKVKESQPCKEIPAAPVINQTLGYARELERIV

SEQ ID NO: 4895 - protein, 267 aa, Triticum aestivum; identical to SEQ ID NO: 4894

SEQ ID NO: 4896 - protein, 262 aa, Triticum aestivum
MAQPAELSREENVYMAKLAEQAERYEEMVEFMEKVAKTVDSEELTVEERNLLSVAYKNVIGARRASWRIISSIEQKEESRGNEDRVTLIKDYRGKIEVELTKICDGILKLLDSHLVPSSTAPESKVFYLKMKGDYYRYLAEFKSGTERKDAAENTMVAYKAAQEIALKELPPTHPIRLGLALNFSVFYYEILNSPDRACDLAKQAFDEAISELDSLSEESYKDSTLIMQLLRDNLTLWTSDISEDAAEEMKDAPKGESGDGQ

SEQ ID NO: 4897 - protein, 287 aa, Triticum aestivum
LQDNRLIFNKNGAIYSANLSSTSWSFYDKSGSLLSQLIIAQKGDANTTLAAVLGEDGSIAFYMLQSGNGKTNLPTPIPQDSCDTPTHCKPYSICSSGTGCQCPSALGSSPNCDPGLISPCKSKEAFQLAQLDSGVGYIGTSFTSPVPKTNITGCKNTCMGNCSCIAVFFDQKTGNCFIFDQIGSLQQKGASKTNFSSFIKVSSSGSRQAGSGSDSGNHNIIIVVIIVVTLAVIGGLSYVGFFIYRRKRYPPSSQDEAGSSEDDGYLQTISGAPVRFTYRELQDATNN

SEQ ID NO: 4898 - protein, 331 aa, Triticum aestivum
MSTRARTNPVTAKGGASPAPGGAGAAANGRFFTVGLVTAWYSSNIGVLLLNKYLLSNYGFKYPIFLTMCHMSACALFSYAAIAWLRIVPMQLVRSRVQLAKISALSLVFCGSVVSGNVSLRYLPVSFNQAVGATTPFFTAVFAYIMTVKRESWITYLTLVPVVTGVVIASGGEPSFHLFGFIMCIGATAARALKTVLQGILLSSEGEKLNSMNLLLYMAPIAVILLLPATLFMEDNVVGVTIELAKKDFTIVWLLLFNSCLSYFVNLTNFLVTKHTSALTLQVLGNAKGAVAVVVSILIFKNPVSVTGMLGYTLTVIGVILYSESKKRSKP

SEQ ID NO: 4899 - protein, 170 aa, Triticum aestivum
SVVLGIGSFLIDPLCRMIGARLVWAISNFIVFACMLATTILSWISYDLYSSKLQHIVGADKTVKTSALILFSLLGLPLSITYSVPFSVTAELTAGTGGGQGLATGVLNLAIVAPQIVVSLGAGPWDKLLGGGNVPAFALASVFSLAAGVLAVIKLPKLSNNYQSAGFHMG

SEQ ID NO: 4900 - protein, 359 aa, Triticum aestivum
MSSDGGGSQMGVTGALGLLVTSTVAIVICNKYLMSTLNFYFATTLTSWHLLVTFCTLHIAQRLRFFEPKPIDAQTVISFGFLNGISIGLLNLCLGFNSVGFYQMTKLAIIPFTMLLETIFLSKKFSQSIKASLMVLLLGVGIASVTDLQLNLLGSIIAVLTIAATCVCQILTNQIQRRLKVSSTQLLYQSSLYQSAVLLITGPFVDKLLTKKDVFAFEYTFEVVVFILMSCGIAVSVNFSTFLVIGTTSPVTYQVLGHLKTCLILSFGYVLLKDPFTLRNLAGILIAIFGMGLYSFFSVSESRKKTEGATLPVNTQMSEKDSAPLLGTKTSPWQESNGVENFDDVPRTAKSAFSRQLNP

SEQ ID NO: 4901 - protein, 585 aa, Triticum aestivum
MAEAGDPTLEQGLLADPEESNQLTYTGDGSVDFSGNPVVKEKTGRWKACPFILGNECCERLAYYGISTNLVTYLTKKLHDGNSSAARNVTTWQGTCYLTPLIGAILADAYWGRYWTIATFSTIYFIGMSVLTLSASVPMLMPPSCEGVICPEASPLQYTVFFLGLYLIALGTGGIKPCVSSFGADQFDDTDPAERIQKGSFFNWFYFSINIGALISSSFLVWVQDNLGWGLGFGIPTVFMGLAIISFFAGTSLYRFQKPGGSPITRVCQVVAATLRKWNAHVPEDSSLLYELPDGVSAIEGSRQLEHTDELRCLDRAATITDLDVKEDSFNNPWRVCTVTQVEELKILVRMFPVWATTIVFSAVYAQMSTMFVEQGMVLDPTIGSFKIPPASLSTFDVVSVIIWVPIYDSILVPIARRFTGKERGFSELQRMGIGLVISILAMSAAAVLEIKRLAIAREAHLVDQNVPVPLSILWQIPQYFLVGASEVFTFIGAPEFFYDQSPDAMRSLCSALQLITTALGNYLSAFILTMVAYFTTRGGRPGWIPDNLNEGRLDYFFWLLAGLSFLNFLVYVLCANRFKSKKAA

SEQ ID NO: 4902 - protein, 359 aa, Triticum aestivum
  unsure (1)..(359): unsure at all Xaa locations
MATAGKVIKCKAAVAWEAGKPLSIEEVEVAPPQAMEGQTPVFPRILGHEAGGIVESVGEGVTELVPGDHVLPVFTGECKDCAHCKSEESNLCDLLRINVDRGVMIGDGQSRFTIGGKPIFHFVGTSTFSEYTVIHVGCLAKINPEAPLDKVCVLSCGISTGLGATLNVAKPKKGSTVAIFGLWSCGPLLPWRGAKMAGASRIIGVDLNPAKYEQAKKFGCTDFVNPKDHTKPVQEVLVEMTNGGVDRAVEXPGHVDTMISAFECVHDGWGVAVLVGVPHKEAVFKTHPMNFLNERTLKGTFFGNYKPRTDLPEVVEMYMRKELDVEKFITHSVPFSQINTAFDLMLKGEGLRCVMRMDE

SEQ ID NO: 4903 - protein, 379 aa, Triticum aestivum
MATAGKVIKCKAAVAWEAGKPLSMEEVEVAPPQAMEVRVKILYTALCHTDVYFWEAKGQTPVFPRILGHEAGGIVESVGEGVTELVPGDHVLPVFTGECKECAHCMSEESNLCDLLRINVDRGVMIGDGQSRFTIDGKPIFHFVGTSTFSEYTVIHVGCLAKIDPEAPLDKVCLLSCGISTGLGATLNVAKPKKGMTVAIFGLGAVGLAAMEGARMSGASRIIGVDLNPAKHEQAKKFGCTDFVNPKDHTKPVQEVIVEMTDGGVDRAVECTGNADAMISAFECVHDGWGVAVLVGVAHKEAVFKTHPMNFLNERTLRGTFFGNYKPRTDLPGVVDMYMRKELELDKFITHSVPFSQINTAFDLMLKGEGLRCVIRMDE

SEQ ID NO: 4904 - protein, 399 aa, Triticum aestivum
  unsure (1)..(399): unsure at all Xaa locations
MATAGKVIKCKAAVAWEAGKPLSIEEVEVAPPQAMEVRVKILYTALCHTDVYFWEAKGQTPVFPRILGHEAGGIVESVGEGVTELVPGDHVLPVFTGECXCAHCKSEESNLCDLLRINVDRGVMIGDGQSRFTIDGKPIFHFVGTSTFSEYTVIHVGCLAKINPEAPLDKVCVLSCGISTGLGATLNVAKPKKGDDPRRFCSTPCFCRLKRIMCYNQDXLPCASVSDHAAVEGAKMSGASRIIGVDLNPAKHEQAKKFGCTDFVNPKDHTKPVQEVIVEMTDGGVDRAVECTGNADAMISAFECVHDGWGVAVLVGVAHKEAVFKTHPMNFLNERTLRGTFFGNYKPRTGLPGVVDMYMRKELELDKFITHSVPFSQINTAFDLMLKGEGLRCVIRMEE

SEQ ID NO: 4905 - protein, 186 aa, Triticum aestivum
MATAGKVIKCKAAVAWEAGKPLSIEEVEVAPPQAMEVRVKILYTALCHTDVHFWEAKGQTPVFPRILGHEAGGIVESVGEGVTELVPGDHVLPVFTGECKDCAHCKSEESNLCDLLRINVDRGVMIGDGQSRFTIGGKPIFHFVGTSTFSEYTVIHVGCLAKINPEAPLDKVCVLSCGISTGLGAT

SEQ ID NO: 4906 - protein, 379 aa, Triticum aestivum
MATAGKVIKCKAAVAWEAGKPLSIEEVEVAPPQAMEVRVKILYTALCHTDVYFWEAKGQTPVFPRILGHEAGGIVESVGEGVTELVPGDHVLPVFTGECKDCAHCKSEESNLCDLLRINVDRGVMIGDGQSRFTINGKPIFHFVGTSTFSEYTVIHVGCLAKINPEAPLDKVCVLSCGISTGLGATLNVAKPKKGSTVAIFGLGAVGLAAMEGAKMAGASRIIGVDLNPAKYEQAKKFGCTDFVNPKDHTKPVQEVLVEMTNGGVDRAVECTGHIDAMIAAFECVHDGWGVAVLVGVPHKEAVFKTSPMNLLNERTLKGTFFGNYKPRTDLPEVVEMYMRKELDVEKFITHSVPFSQINTAFDLMLKGEGLRCVMRMDE

SEQ ID NO: 4907 - protein, 314 aa, Triticum aestivum
MALASTTASRLISRRLAAPLPPPPSSSCAAPRGGARPGPRRFAVRWEGRPRALLGGFSDAGEDASDDEDEEDGPGALSGGPPRQEKGCEDVIELAAAAFSGPERWDVLGLGQAMVDFSGMVDDEFLERLGIEKGTRKVVNHEERGRVLRAMDGCTYKAAAGGSLSNSLVALAWLGSSRASHCYSKLRVAMAGSVGSDPLGSFYRQKLHRANVQFLSKPVKDGTTGTVIVLTTPDAQRTMLAYQGTSSTLAYDSDLAEIVSKSNLLIVEGYLFEFSHTIEAIKQACEDAKKNGALIAVSASDVSCIKRCHSDFWD

SEQ ID NO: 4908 - protein, 226 aa, Triticum aestivum
MVRGKTQMKRIENPTSRQVTFSKRRGGLLKKAFELSVLCDAEVALVVFSPRGRLYEFASSSMKNTIERYKTVTKDNMSRQTVQQDMEKIKADAEGLSKKLDALEACKSKLLGQNLEECSIEEPNEELQSLEVKIEKSLLGIRAMKTRRFEEQLSTLRQKEMTLRQHNEELYSQCQKEQHLALEAAAPPAPATLAALPAPVTLEEQGQQMVDVETDLFLGLPGTGRS

SEQ ID NO: 4909 - protein, 363 aa, Triticum aestivum
  unsure (1)..(363): unsure at all Xaa locations
MGGAGGAKAYGAVVLIRVMYSGMHIMSKIALDQGMNPFVFVFYRHTTAALVLIPIAFALERQKTKPVTLKIAGKMFVHALYGVTACGVLFNLGLNYASATSSSALYNVQPVVTFILAVIIGMESMKLKKLHGNLKVAGILCCVAGVTVLAFYEGPMFRSFNHHRLFQHGSSSSSSGAGTYSKNQWVFGIFLMTLSNILAGLWTVLQGPLIEDTSKLMNTTLQISCASVQAFVXVAAERDFSKWKIGWNISLAAIIYSGVIVTALSYYMQMWTIAKRGPVFLAMSMPLTLIFTIIISSFVLGEAVSLGSIIAGILLIGGLYNVLWGKSMERKDDDTNKMGGGKPAQELQDKEQARVPDDAAAKV

SEQ ID NO: 4910 - protein, 244 aa, Triticum aestivum
MGRGKVQLKRIENKINRQVTFSKRRSGLLKKAHEISVLCDAEVGLIIFSTKGKLYEFSTESCMDKILERYERYSYAEKVLVSSESEIQGNWCHEYRKLKAKVETIQKCQKHLMGEDLESLNLKELQQLEQQLESSLKHIRSRKNQLMPESISELQKKERSLQEENKVLQKELVEKQKAQAAQQDQTQPQTSSSSSSFMMRDAPPAAGTSIHPAATGERAEDAAVQPQAPPRTGLPQWMVSHING

SEQ ID NO: 4911 - protein, 244 aa, Triticum aestivum
MGRGKVQLKRIENKINRQVTFSKRRSGLLKKAHEISVLCDAEVGLIIFSTKGKLYEFSTESCMDKILERYERYSYAEKVLVSSESEIQGNWCHEYRKLKAKVETIQKCQKHLMGEDLESLNLKELQQLEQQLESSLKHIRSRKNQLMHESISELQKKERSLQEENKVLQKELVEKQKAHVAQQDQTQPQTSSSSSSFMLRDAPPAANTSIHPAATGERAEDAAVQPQAPPRTGLPPWMVSHING

SEQ ID NO: 4912 - protein, 544 aa, Triticum aestivum
  unsure (1)..(544): unsure at all Xaa locations
PASAHASDNMESRSTLHKVGTDMVSESEDSNREEEIIKSSISVGTSRSKISFESAEKHTTLPSGDASETENVSTDMLLRRLGKRKGLKGPRASDDFPYKKPRMLASDIPFASHILNKHSTSEIGDTRPDIREXGALDFDDPNKKTSNKDSCGGSPTSPAEDAARNTNKESSANNLFSSSREHPLSHWSTLERDLYLKGIEIFGKNSCLIVRNLLCGLKTCMEVASYMYNNGAANMSKSISGDFTETEQNYMEQGMVVRTKVCRRRGRTRKHKYPSKAAGHPAIRKKVGDGKQCDRQYTPCGCQEMCNKNCPCVENGTGRAANRGXSGRLEQQVXGSRRGPSQGGSRECARDAGRRGWERGGGGTRGERRGGGAGGEARKRGAGPQSGTKELARKQQRRRMGCVPDEAGWGAFIKSPVHKNDYLGEYTGELISHKEADKRGKIYDRANSSFLFDLNDQFVLDAYRXLLQPQLLYHGASPNWYAKVMMVAGDHRVGIYAREHIEASAELFYDYRYGPDQAPAWARRPEGAKKDEASGSHRRAHKVA

SEQ ID NO: 4913 - protein, 146 aa, Triticum aestivum
  unsure (1)..(146): unsure at all Xaa locations
HVCGCRQARDAAFECSCINRSVVNEYVEAVKQLACDILDLLGEGLGLEDPXLFSKLITETDSDSLLRINHYPPSCTVHKLDHDDQCKLKGVARTKAGSGGNPAAGGRIGFGEHSDPQLLSLLRANDVDGLQVLLPDINGKDTWIQV

SEQ ID NO: 4914 - protein, 325 aa, Triticum aestivum
MSKVEGLTSVSSLERRSAPKYYIFLFFNVFLASIIAGSALEQLQTYLHQSANQIPRTIGVAIPMKATFFITYVMVDGWAGVAGEILRLKPLVIFHLKNFFLVKTEKDRDEAMDPGSIGFDSNEPQIQLYFLLGLVYAVVTPFLLPFILVFYVLAYVVYRHQIINVYNQEYESAAAFWPSVHGRIITALIVSQLLFLGLLSTKGAGQSTPVLLVLPVVTFYFHKYCKNRYEPAFVEYPLQEAMRKDTLERAREPGFDLKTYLASAYIHPVFKGDDDDEKFSMMDEAEADQVLVATKRQSRRNTPVPSRHNGSEAPSLPEIVNDQRL

SEQ ID NO: 4915 - protein, 190 aa, Triticum aestivum
MYSKVQILLEWSKAQMLLEWCKEQTLLEWRKVQILLEWCKAANQAGMVQGPNPSGMVQDQLYKGSLTLVHQTAIATMSTFYDAIHLIDQQWDMGLEIDGMTYEELLSLQEHIGDVNTGLSEKYICQNMRVHWYVVPTGNRGSDQSVEKDACIICQEEVEARDLVRTLDCGHKCHEVCIRQRLMEKNLYPI

SEQ ID NO: 4916 - protein, 319 aa, Triticum aestivum
  unsure (1)..(319): unsure at all Xaa locations
NTWTTHPAKXIADGVPHWAYNNAVLNPSGQFAHGTMGMPNGSLQDYQAGPSANFHGPLPHFNQIPMHSMQTPAMLNHIQMQGPQRQSNVVQGANPSGVVQGANPSGVVQGANPAGMVQGANPAGMVQGANQAGMVQGPNPSGMVQGANRSRRAFTWDPCLPFSGSGHTNGPPVHAFFTDQVYNGSLRLLQQAAMATMSTFYDAIHLIDEQWDMGLDIDGMTYEELLALQEQIGDVNTGLPERYICQNLRVHWYVVPRAARGSDQSVEKDACIICQEEFEARDLVGALDCGHKYHEVCIRQWLMVKNLCPICKATALPAE

SEQ ID NO: 4917 - protein, 228 aa, Triticum aestivum
  unsure (1)..(228): unsure at all Xaa locations
CFQLLLMYMSQFEGLISQSSLERRTASKYFIFLFFNVFLGSIVTGSALEQLDTYLHASANDIPRIIGVAIPMKATFFITYVMVDGWAGVSLEILRIRAFVLYHLKNFFLVKTEKDREEAMDPGSICFYWSEPRIQLYFLLGLVYAAVTPLLLPFILVFFALGYXVVYRHQIIXNVYHQRYESGAAXWPNVHLRIIVALIASQLLLLGLLSQKVWEEATPSEDLPFEQL

SEQ ID NO: 4918 - protein, 559 aa, Triticum aestivum
  unsure (1)..(559): unsure at all Xaa locations
LATTQQADVRTAQASGKALVSLINEILDQAQLEPGKLEREAVPFNLTLVSDEIPSPVCGXSLXKGLELVASVTDQLAQAHIGEPARIRQIITNLMGNSIKFTERGHIYLTVHVVEEVMSCLEVETEFQNTNNTYNTLSGYKVANRRHSWQSFQLFNMDLHLSEMTFAPIMPETIRLIISVEDTGVGIPPEAQSRIFMPFMQVGPSIARIHGGTGIGLSISKCLVHLMKGEIGYVSIPNVGSTFSFTAVLTKARSNANANKSPGFKGINALVVDHKPVRAKVTKYHLQRLGVKTELTTDVNQVIPKMNCASLVTRLVLVDKETWLKESHSMPHLLSKLRSKDQSDPPKLFLLENPTNSIKSSSNISREHNLNVIMKPLRASMLQASLRRALGGVDKVHGKNGVVGNSALGSLLHKRQIIVVDDNVVNLKVAAGALKKYGAEVICADSGKKAIALLKPPHSFDACFMDIQMPEMDGFEATKRIRMMERELNERIERGEAPPECAKVRRWRTPILAMTADVIQATYEQCLKCEMDGYVSKPFEGEQLYREVTRFFQSHDHVQ

SEQ ID NO: 4919 - protein, 472 aa, Triticum aestivum
  unsure (1)..(472): unsure at all Xaa locations
MAARKDNAVLIACQAPNGRVTRAQAANRGRFGVPHPAPVPVRTERKPATKGKAKRGASDENTCASALTSAPPPKRRAALKDVTNISCANSFRNCTAVTKLQSRPTQKVGRNPSKNKQCTKKAPKPPLPAVSGTSFVVNDSHNVEESQKAELLPPKEEPTALLENKGSLSLWNIARNRESGVHEPFFQGRNTRDKSETADSNTGYYVGLNVIDIDKDNGNPQMCASYAAEIYRNLMAAELIRRPKSNYMETLQRDITKGMRGILIDWLVEVSEEYKLVPDTLYLTVYLIDQFLSRKYIERQKLQLLGITSMLIASKYEEICAPRVEEFCFITDNTYTKNQVLKMECEVLNDLGFHLSVPTIKTFLRRFLRAAHASQKAPCATLGYLGNYLAXELTLTDYSFLKFHPSVVAASAVFLAKWTLDQSDLPWNSTLEHYTSYKSSDIQGCVRDLWELQQGNTSGSPPLNAIREKYRQ

SEQ ID NO: 4920 - protein, 211 aa, Triticum aestivum
RHQITSYTVYHKLIPVEQNSYTLFQTIVGNGYPIALLDEEKILPIGKEITAIGLCRLKNRSVEISLCPELPYFLSDLTKGEMEAEMSSRARFFFWVTVALGTVSVGLLGHAIYRLWERVKRHREAREAQERFHEADNEDDAGENGSDDEPGEMGDGQLCVICLRKRRRAAFVPCGHLVCCCNCAKRVELMDEPLCPVCRQDIQYMLRVYDS

SEQ ID NO: 4921 - protein, 370 aa, Triticum aestivum
  unsure (1)..(370): unsure at all Xaa locations
MASNRGMVAGSHNRNEFVMIRHDGDAPAPGKEVKGAGGQGCQICGDTVGVSATGDVFVACNECAFPVCRPCYEYERKDGVKCCPQCKTRYKRPKGSPRVPGDEEEEDVDDLDNEFNYKQGNGKGPEWQLQGQGEDIDLSSSSRHEPNHRIPRLTSGQQXIPDASPDRHSIRSPTSSYVDPSVPVPVRIVDPSLVSSSSGLSSLAGEDPVDSGSGXLADDGSPVSTFEPLAETAEFARKWVPFCKKHNIEPGAPECRLQLTLGYLEVCTPPPLGIGGRAVWSLDLESPLRLGALAARAPHVPGRGRTSALGTAWPGNNPRDHPGMIQVFLGHSGGLDTDGNELPRLVYVSREKRPGFQHHKKAGAMNARKT

SEQ ID NO: 4922 - protein, 237 aa, Triticum aestivum
  unsure (1)..(237): unsure at all Xaa locations
MARGGSAVAVLSFLLGLPLLSVLVAGEDPYRFFTWNVSYGDIYPLGVKQQGILINGQFPGPQIEAVTNDNLVVNVFNKLNEPFLLSWSGVQQRRNSFEDGVAGTTCPIPPGANFTYILQAKDQIGTYFYFPSLAFHKAAGGFGGIRVLSRPRIPVPFPPPAADYTVLIGDWYKTNHTDLRYMLDSGKALGFPDGLLINGRGXXGYTFXVQPGMTYRFRITNVGLATSLNIRFQGPPP

SEQ ID NO: 4923 - protein, 340 aa, Triticum aestivum
MVVKSGGGGGGAEEGAAGAAVRRWVEAGGGRLVLDGGLATELEAHGADLNDPLWSAKCILSSPHLIRKVHLDYIEAGANIIITASYQATIQGFESKGFSKEQGENLLTKSVEIAHEAREMFLKQHPDQSTPLRPILVAASIGSYGAYLADGSEYSGDYGEAGTLEFLKDFHRRRLQVLAEARPDLIAFETIPNKLEAQAYVELLEECNINIPSWFSFNSKDGVNVVSGDSLIECAKIANECAKVGAVGINCTPPRFIHSLILSIRKVTDKPILIYPNSGERYDAEKKEWVESTGVSDGDFVSYVGEWCKDGAALIGGCCRTTPNTIRAITRSLNQYYPAS

SEQ ID NO: 4924 - protein, 134 aa, Triticum aestivum
MSEEKHHHLLHHMEGEDFQPAADCGVYTYGYSTVTVVTVTGNHSEYERITKEEKHHTHTEHLSEMGAAWGGAFYLYEKHEANKDPEHAHKHKIEEEVVADIAVGAGGFVFHEHHEMKHDHMEAKEASGEKKHHH

SEQ ID NO: 4925 - protein, 296 aa, Triticum aestivum
  unsure (1)..(296): unsure at all Xaa locations
MAHDEAVAAQKTGKSGSPPKDQPAPSPYPDWSAMQAYYSSGVMPPAYFAPAMAAGHPPPPYMWGPQHMMPPPFGTPYAMYPHGGAYPHPLVPMMASPLSVEPAKSANSKDKSSNKKLKEIDGSAVSTGSGNSKKTSSSXRSTGEGSSDVNDLKVSATPRKRSWDGGFDAQATAAAWNKDVVASSPIIRNGAILSNQCFPAPVIKPSVTNVANSRAIGTPASPLPGFTAPIHTGISTELSSKDEREVKREKRKQSNRESARRSRLRKQAETDELATHVRSLTAENTCVICEIGKLTK

SEQ ID NO: 4926 - protein, 336 aa, Triticum aestivum
KLKPQSNRKPSAMSATAGDEAAVAERLEALRRKLGKKQHFEEAVADLAATLRDRYAGASPALRESMYSTVCRVATVLQTRYTAPGFWRAGLNLFVATEKLLTNPAEKERLKTCILRAREHLDEKENEESMPTNREPDTRFLFEGHLTVGQEPPPPAWLVAQNLTRELNILGGTFWRSKTGNNTRTELRPEEMTPAIMNFLNTISGDAELESALEASLQGITVQPKVPPASKEVVANLPVVTVTEEVIARLGSETECAVCRENLVVDDKMQELPCKHLFHPPCLKPWLDENNSCPICRHELRTDDHAYESRKEREREEEEDRKGAANAVRGGEFMYI

SEQ ID NO: 4927 - protein, 286 aa, Triticum aestivum
MADLQTPLVRPKRKKVLVDYLVQFRWILVIFVVLPASALIYFNIYLGDMWSAMKSEKKRQKEHEDNVQKVVKRLKQRNPKKDGLVCTARKPWIAVGMRNVDYKRVRHFEVDLSAFRNILEIDAERMVAKVEPLVNMGQISRATCPMNLSLAVVAELDDLTVGGLINGYGIEGSSHIYGLFSDTVVALEIVLADGRVVRATKDNEYSDLFYGVPWSQGTLGFLVSAEIKLIPIKEYMRLTYTPVKGPLKEVAHAYADSVAPRDGDPAKVPDFLEGMVYSATEGSMMT

SEQ ID NO: 4928 - protein, 672 aa, Triticum aestivum
  unsure (1)..(672): unsure at all Xaa locations
CDKRYXGYCLLRAMGSMPEGRKCITCIGRPIYEGRRSKLGKSSRILSRLLSSLEVRQILKAEKECQANQLRPEQLIVNGFPLCQEEMSDLLSCPRPPQNLKPGRYWYDKESGLWGKEGEKPNRVVSTNLNFNGKIQPNASNGNTQVYMNGREITSIERKILKFAQVQCPRDTHFWVYDDGRYEEEGQNNIKGKIWESALTRFACALFSLPVPPGDSNGTKDEIPFVPRTVPEYLDQKRIQKLLILGSPGAGTSTIFKQAKLLYGSRFTPEELDNIKLMIQSNMFKYLGILLEGRERFEEEALAIHQTNSEDEDTQQDGNESNGLNSCIYSINAKLKKFSDWLLDIIAMGDLDAFFPAATREYAPVVDELWKHPAIQATYKRKDELYFLPDVAEYFLSRAIEVSSNEYEPSEKDVLYAEGVSQGNGLAFIDFTLDERNPMSELYGDSHDPSSQAQNKYQLIRVNAKGLNEGCKWVEMFEDVRAVIFSVALSDYDQLGAPASGTSRRLENKMIQSKDLFEATIRHPSFRDTPFVLVLNKFDIFEEEIGRSQFNAFEWISDFSPLRTYDCNQAIDQQAFFYVAMKFKNLYAAHTGDRKLFVWQARARDGPTVDEAFRYLREVLRWEDEKEYGGFCPDESLYKXTPMLSSSRLVEQDWQQHPAADQRQGSTVGCCC

SEQ ID NO: 4929 - protein, 265 aa, Triticum aestivum
  unsure (1)..(265): unsure at all Xaa locations
MSSAEPQKVLGMPPFVADFLMGGVSAAVSKTAAAPIERVKLLIQNQDEMLKTGRLDRKYNGIGDCFKRTMADEGVMSLWRGNTANVIRYFPTQALNFAFRDKFKKMFGYKKDKDGYAMWMAGNLASGGAAGATSLLFVYSLDYARTRLANDAKNAKSGGDRQFNGLVDVYKKTLASDGIAGLYRGFMPSVAGIVVYRGLYFGMYDSIKPVVLTGNLQGNFLASFALGWIVTTGAGIASYPLDTIRRRMMMTSXGEGVKYKNTMDA

SEQ ID NO: 4930 - protein, 304 aa, Triticum aestivum
  unsure (1)..(304): unsure at all Xaa locations
MNVAGPATAFVPSARPAPRAPRPLWRPSARCNPSPRAATEPPAAAPVYAPTPRDRPLRTPHSGYHYDGTARAFFEGWYFKVSIPECRQSFCFMYSVENPFFRDGMTALDRTLYGPQFTGVGAQILGADDKYICQFSEKSNNFWGSRHELILGNTFIPNRVLEGYQVTPTWHQGFIRDDGRSKYVPNVQTARWEYSTRPVYGWGDVTSKQKSTAGWLAAFPFFEPHWQICMGXGLSTGWDRMGWEKRFGFENAPSYSERRLGVGGSPKEXGTGWCWPPKGPGLVLVPCSRPAWVGFGKLGLNTLK

SEQ ID NO: 4931 - protein, 491 aa, Triticum aestivum
  unsure (1)..(491): unsure at all Xaa locations
MANAGDPASLPPSASPFSSTRALESVPFSSGNPRIEETRGVVLLHPDPPTAAAAASSSSSHLPAERKPQVFVPAVPNHMTYADFCRFCGSFVPHMLEMRIVRIDGAEDQYSVLIKFDTLSSTDSFYKHFNGKQFSSLEGDVSRIRFVEDVHYTQLIEHAHSSITSSAEQPTCPVCLERLDQDPGGILTTICNHSFHCSCISKWTGSSCPVCRYCQQQPEKSMCSVCGTSENLWICLICGNVGCGRYKGGHAIEHWKETEHCYSLELETQKVWDYAGDNYVHRLIQSKTDGKLVEYNCYGGHEADGICSICSGDAGMDEALLNSKVEAVMYXNVEEYNDLLTSQLDKQRNYYESLLSEVKEENEKEISAATSKAVSMMKLQKLQAKLDKCLEEKSFLDDINANLVKNQEMWKERVRKVQEREQAALKLKDEKIEKLEAELRDLIAHIECQNAVAAAPGSISSDIQGGTILPGPSAPSSSSSPVRPTKDRKRN

SEQ ID NO: 4932 - protein, 114 aa, Triticum aestivum
MPKDTGDAKLLIQSLNKAYAATPANLKIIDLYVVFAIVTALVQVAYMGVVGSFPFNSFLSGVLSCIGTAVLAVCLRIQVNKDNKEFKDLPPERAFADFVLCNLVLHLVIMNFLG

SEQ ID NO: 4933 - protein, 420 aa, Triticum aestivum
  unsure (1)..(420): unsure at all Xaa locations
MEGPSVEVPPYFLCPISLEIMRDPVTLATGITYDRCSIERWLSDGHATCPITQQKLAEADREATPNHTLRRLTQAWCALHAVERFPTPRPPLDACRVAEIVEEGRGAGRQKELAALREIKAIVAESDRNRRCVEATPGAVEFLVSVVRNHATASKSAEDLSELSLDSPTSTSSPEEDALSVICSLKPSKKSLVRILEENRDFLXPLVCMLRRPSYRSRCYGILLLKAMVSVMEPARLMAVRTEVVQELVRVVSDRVSPRARKAALHVLCRLCPWGRNRVKAVEAGAMTVLVELLLDEGGRHPTELAVVAIDHLCGCAEGRSDLVAHPAGLAVVAKKAMRVSLTTTESAVRALHAVARHSPTPAVLQEMLAVGVVAKLLLVLQVDAGERARAKAKELLKMHARVWKDSPCLQAHLKAHYPC

SEQ ID NO: 4934 - protein, 207 aa, Triticum aestivum
MAFDSEFANQQSSMYSQPTDEPIWSGILKINNEVYISLTAHLSTTACGFVREFSRSLQPVVKVIKLPRLEAWPESWRTSRPTDGDIALYFFPPSASPNEESDGPVEEIIDSGAVLQAVIGVAELLIFPSTMLPAQYHLCQGKRYLWGMFKRREDESDSDHLVEEQDGSACAKVGEIQEHIFMDRQYEVQCVSPDHETSAVKHVVHVE

SEQ ID NO: 4935 - protein, 492 aa, Triticum aestivum
  unsure (1)..(492): unsure at all Xaa locations
NHYRSHMKNIQXARKRRFRLERQLATSEVPREQQINLIKDLERKETEYMRLKRHKICVDDFELLTIIGRGAFGEVRLCREKTSGNIYAMKKLKKSDMXLSGGQVEHVRAERNLMAEVASHCTVKLYYSFQDTEYLYLIMEYLPGGDIMTLLMREDTLTEPVARFYIAETILAIESIHKHNYIHRDIKPDNLLLDKNGHMKLSDFGLCKPIDCSKLSTLSEDEPMGDDNLKESMDVDSSLSETANGRRWRSQHEQLQHWQMNRRKXLAFSTVGTPDYIAPEVLLKKGYGMECDWWSLGAIMYEMLVGYPPFYSDDPITTCRKIVHWRNHVKFPDDSRLSPEARDLICRLLCDVDHRIGGAGADQIKAHPWFRGVAWDKLYEMEAAFKPQVNDELDTQNFMKFDEMDNSPPARTGSGPSRKAKLNSKDLSFVGYTYKNFDAVKGLKHADMQRSSSLTRPSIGAIFGSNGMESSREPNGKDTHMHTFSSGDPMSP

SEQ ID NO: 4936 - protein, 73 aa, Triticum aestivum
  unsure (1)..(73): unsure at all Xaa locations
FPNQVIVQLELWNKKATGKYXKKVYVLPKHLDKKVAALHLGKLGARLTKLTKSQFDPTSIPIQGPYKPAAFRY

SEQ ID NO: 4937 - protein, 705 aa, Triticum aestivum
  unsure (1)..(705): unsure at all Xaa locations
TFRKKRQKSTSPLPPPPPASRPPPFPSPARRQIGPEECLRHPSLAPRRHLGPGIGRRGASVGRAARPTGRGGGPAPRDGHGIRVCGRRSGLGAQIGPPGKRQCSTAHRKQGFRRRPDLFTEYGDANRYKIQXESSARGSYGVVCAHTSDAARILREIKLLNIFRHPADAAPILREIKLLRPLRHPDVVEIKHPMLPPSRKDFKDIYVVFELMESDLHQVIKANDDLTKEHYQFFLYQLLRALKYIHTASVYHRDLKPKNILANSNCKLKICDFGLARVAFNDTPTTVFWTDYVATRWYRAPELCGSFFTKYTPAIDIWSIGCIFAEVLTGKPLFPGKNVVHQLDLMTDLLGTPSMDTISRVRNEKARRYLSSMRKKDPVPFSQKFPNADPLGVKLLEKLLAFDPKDRPTAEEALTDPYFRGLSKPEREPSCQPIRKMEFDFEHSRVSKDDIRELIFQEILEYHPQLLKSYIDGTERTTFLYPSAVDHFKKQFSHLEESDGSGPVVPADRKHASLPRSTIVHSTPIPAKDTRPLFGKPCNKTSSETGRYAGNGHSASQASHAAQAVVSRRAAGSALPYDAASRPTISPGCPPQQQIPQMYGQYQHQAPPGAGAGAGIPQAMGGYACGGYTKGTAPNAAAAPAMRAPPYRHLPAGQKNGPLDRLAVETTDIYTRSLNGIVAAAAASAGTASAHRKVGAVPFGMPTTY

SEQ ID NO: 4938 - protein, 171 aa, Triticum aestivum
MTSYIDFSKPSLWVSAASIVFNPTFWNIAAQQEYHNKVITKLFGGNPRLGCYALAVTIFSLGIFRDYLYNEALAEQPTHPTLLAPAIKYSAIPLFAMGNTLVLTSMWALGVTGTYLGDYFGILMDEPVTTFPFNVSSSPMYHGSAMSFLATAIWYGKPAGIFLTGIVHTAY

SEQ ID NO: 4939 - protein, 78 aa, Triticum aestivum
MSYYGQQQAPVGAPPQQGYPPQGYPPAGYPPPQQGYPPAGYGQQGYPPQQQQQQNSGPSFMQGCLAALCCCCLLDACF

SEQ ID NO: 4940 - protein, 589 aa, Triticum aestivum
  unsure (1)..(589): unsure at all Xaa locations
HPGPPPPPPARHRARDPLRRLRTHKITTLARGRGGGRPLRELANLVLIMGNHAXMAETPPGNANVLTTGLKLVDKYDLYGSVAFPKQHYQAAVPWMDAQAALTKGLYNNPALMDPFGLTXSEAAAHGLPIVATKNGGPVDITNTLNSGLLVDPHDQNAIADALLKLVADKNLWHECRKNGLRNIHLYSWPEHCRTYLARVAGCRIRNPRWLKDTPADAGADDEAEDSLMEFQDLSLRLSIDGERGSTNEPASSDPQDQVQKIMNKLHQSSSAAPDAGTDKNPAVQAAGTVNKYPLLRRRRRLFIVAVDCYGDDGRASKKMLQVIQEVFRAVRSDTQLSKISGFALSTAMPLSETLQLLQMGKVPPTDFDALICGSGSEVYYPGSAQCLDAQGKLRPDQDYLQHINHRWSHDGARQTIGKLMASQDGSGSVVEPDVESCNAHCVSFFVRDPKKVRTIDEMRERLRMRGLRCHLMYCRKSTRMQVVPLMASRSQALRYLFVRWGLPVGNMYIVLGEHGDTDREEMLSGLHKTVIVKGVTEKGSEDLLRSSGSYHKEDVVPSDSPLATTTRGDLKSDEILRALKEVSKASSG

SEQ ID NO: 4941 - protein, 140 aa, Triticum aestivum
IGEGKMFSPGNLRATFDNPDYDKLVNYYVKEKYTLRYTGGMVPDVNQIIVKEKGIFTNVTSPTAKAKLRLLFEVAPLGFLIEKAGGHSSDGKQSVLDKVISQLDERTQVAYGSKNEIIRFEETLYGSSRLAASATVGATA

SEQ ID NO: 4942 - protein, 394 aa, Triticum aestivum
  unsure (1)..(394): unsure at all Xaa locations
METVAAAGYAHGAATRSPACCAAMSFSQSYRPKAARPATSFYGESLRANTARTSFPAGRQSKAASRAALTTRCAIGDSLEEFLTKATPDKNLIRLLICMGEAMRTIAFKVRTASCGGTACVNSFGDEQLAVDMLADKLLFEALEYSHVCKYACSEEVPELQDMGGPVEGGFSVAFDPLDGSSIVDTNFTVGTIFGVWPGDKLTXASPGGDQVAAAMGIYGPRTTFVVALKDCPGTHEFLLLDEGKWQHVKDTTSIGEGKMFSPGNLRATFDNPDYDKLVNYYVKEKYTLRYTGGMVPDVNQIIVKEKGIFTNVTSPTAKAKLRLLFEVAPLGFLIEKAGGHSSDGKQSVLDKVISVLDERTQVAYGSKNEIIRFEETLYGSSRLAASATVGATA

SEQ ID NO: 4943 - protein, 393 aa, Triticum aestivum
METVAAAGYARGAATRSPACCAAMSFSQSYRPKAARPATSFYGESLRANTARTSFPAGRQSKAASRAALTTRCAIGDSLEEFLTKATPDKNLIRLLICMGEAMRTIAFKVRTASCGGTACVNSFGDEQLAVDMLADKLLFEALEYSHVCKYACSEEVPELQDMGGPVEGGFSVAFDPLDGSSIVDTNFTVGTIFGVWPGDKLTGVTGGDQVAAAMGIYGPRTTFVVALKDCPGTHEFLLLDEGKWQHVKDTTTIGEGKMFSPGNLRATFDNPDYDKLVNYYVKEKYTLRYTGGMVPDVNQIIVKEKGIFTNVTSPTAKAKLRLLFEVAPLGFLIEKAGGHSSDGKQSVLDKVISVLDERTQVAYGSKNEIIRFEETLYGSSRLAASATVGATA

SEQ ID NO: 4944 - protein, 271 aa, Triticum aestivum
MLLLNPASEAAAAALDSIRQQLLEEPMAPARPAYCRSASFGSLVADQWSESLPFRPNDADDMVVYGALRDAFSCGWLPDGSFAAVKPEPLPSPDSYDGCCLGSFLASPPGLDAPWAEEAEVAATASRGKHFRGVRQRPWGKFAAEIRDPAKNGARVWLGTFDSAEDAAVAYDRAAYRMRGSRALLNFPLRIGSEIAAAAGQKRPSPQPASPDSPPPSSSAPGSSKRRKRGEAAAESMSMALVPPPPVQAPVQLTLPVQPWLATGAVQQLVS

SEQ ID NO: 4945 - protein, 272 aa, Triticum aestivum
MLLLNPASEAAALDSIRQQLLEEPARPAYCRSASFGSLVADQWSESLPFRPNDADDMVVYGALRDAFSCGWLPDGSFAAVKPEPLPSPDGSYDGSCLGSFLAPPAPGPDAPWAEEEAEVAAAASRGKHFRGVRQRPWGKFAAEIRDPAKNGARVWLGTFDSAEDAAVAYDRAAYRMRGSRALLNFPLRIGSEIAAAAAAAGQKRPSPQPASPDSSSPSCSAPGSSKRRKRGEAAAASMAMALVPPPPAQAPVQLTLPAQPWLAAGAVQQLVS

SEQ ID NO: 4946 - protein, 435 aa, Triticum aestivum
MDEAGRASAPAVVTVTASAAAPSPPPPPPPATATAAAADPPSPDPDALYEEGMWQQMAMSSGATMQSGPYPVRPGEPDCTYYLRTGLCRFGMSCRFNHPQDRNTAIASARMKGEYPERVGQPECQYYLKTGTCKFGPTCKFHHPREKAGIAGMVQLNTLGYPLRPNERECAYYLKTGQCKYGNTCKFNHPEIFNAVASSRGSPIYPPVHNSGSTGPHSYTGTMASWTYPRGSFIPSPRWQSPSNYTPMIVPQGLVQVPSWNSYPGQMVPVSSPESRLQSPGAQQYYGTSRQGEASAGNQGMQSPYRSSSFPAPQYALQRENVFPERPDQPECIYYIKTGDCKFGAVCKFHHPRVRSQPPPDCILSPMGLPLRPGEELCKFYSRYGICKFGVNCKFDHPMAAPMGVYAYGYSASASPNAPMGRRLLESPSGSAYAS

SEQ ID NO: 4947 - protein, 283 aa, Triticum aestivum
MFQAARAQLGGAIIRSAGRAQQPREIRTPKSPRSLSLPRAPMASVDAGEGQAAPAPRATVSHVIFDMDGLLLDTEGFYTEVQERILARYGKVFDWSLKAKMMGKKAMESARIFVDECGLAGLLTPEQFLEEREGMLQELFPSCAVLPGVVRLIHHLHANEIPICVATGSHKRHFALKTQIHQEMFALMHHVVMGDDPEVKAGKPSPDIFLAAMRRFEGNVEPSKCLVFEDAPSGVGAAKNAGMYAVMVPDPRLDVSYQKEADQVLSSLLDFNPTEWGLPPFKE

SEQ ID NO: 4948 - protein, 288 aa, Triticum aestivum
  unsure (1)..(288): unsure at all Xaa locations
MEGALVTSNFSMPDLYPAKANAAHAPRSRRLSYISPAASSAAAPNPSYRRRKGTSPPPPWAAATATVLTSPPKPVEQQETEEHLVDTSTNNATGTRVATARTSRASDAPRSSRPRRRPTASLQAAFCNALEEAINTFVDPPVLRPSVDPRHVLSANFAPVDELPPTPCPVVRGVIPRCLAGGAYIRNGPNPQXLPRGPHHLFDGDGMLHSLLLPTAPDSDPVLCSRYVQTYKYIVERNAGEPVLPNVFSGFHGLAGMARGAVTAARVLTGQMNPMEGVGLANTSLAVF

SEQ ID NO: 4949 - protein, 160 aa, Triticum aestivum
GPHSMPTRPNPVNHRNIRILPPLQHGAIMDFSRLYEGSNVVDEHRDMRLDIDSMTYEELLALEEHIGDVNTGLAKSHIVDKLKTSLYVPGATCVSNQSSEPSTENEACIICQEEYKAEDCVGILDCGHRYHAECLKQWLTVKNLCPICKTTALSAGRRSG

SEQ ID NO: 4950 - protein, 334 aa, Triticum aestivum
  unsure (1)..(334): unsure at all Xaa locations
MEGEEKPVVGGAYWGVGARACDSCATEAARLFCRADAAFLCAGCDARAHGAGSRHARVWLCEVCEHAPAAVTCKADAAVLCASCDADIHAANPLARRHERVPVAPFFGAAADAHKPFVPSGAQAAXEDDGSNDAEAASWLLPEPDHKXDGANGATAGRSSSXDSDLYXLDLDFARXNGTDXQRAISCAXFNGQPRDLTCNGWATKGFLLSDHSQLNXHSGXXPSSEAAVVXPDAAAAPVVSRGREREARLMRYREKRKSRRFEKTIRYASRKAYAETRPRVKXGRFAKRTGTADADGLEEHEEMYSSAAAAVAALMAPGPDHDYGVDGVVPTLV

SEQ ID NO: 4951 - protein, 393 aa, Triticum aestivum
MDAGGAQPPDSEMAEAGAGAAAAAGTAPGGAMDNIQATLTHGGRFIQYNIFGNVFEVTAKYKPPILPIGKGAYGIVCSALNSETGEQVAIKKIANAFDNKIDAKRTLREIKLLRHMDHENIVAIRDIIPPAQRTAFNDVYIAYELMDTDLHQIIRSNQALSEEHCQYFLYQILRGLKYIHSANVLHRDLKPSNLLLNANCDLKICDFGLARTTSETDFMTEYVVTRWYRAPELLLNSSEYTAAIDVWSVGCIFMELMDRKPLFPGRDHVHQLRLLMELIGTPNEADLDFVNENARRYIRQLPRHARQSLSEKFPHVHPSAIDLVEKMLTFDPRQRITVEGALAHPYLASLHDISDEPVCTMPFSFDFEQHALSEEQMKDLIHQEGITFNPDYQ

SEQ ID NO: 4952 - protein, 225 aa, Triticum aestivum
  unsure (1)..(225): unsure at all Xaa locations
MASNQNQASYHAGETKARTEEKTGQVMGATKDKAGQTTDATKQKAGETTEAAKQKAGETAEATKQKAAEAKDKTAQTAQAAKEKTYETAQSAKERAAQGKDQTASTLGEKTEAAKQKAAETTEAARQKAAEATEAAKQKASETAQYTKESAVAGKDKTGSVLQQAGETVVNAVVGAKDAVXNTLGMGSRQTGGEPRGDNNTVANTLGMGGRQHQHRQGQHPREDH

SEQ ID NO: 4953 - protein, 194 aa, Triticum aestivum
TRIAAAAEVPQDDEAIPDGELGEVSVSTYVNSLKNEFATLRSAEIKDMVENNKIKLSTIMQSNRGSSTIWQMSALDGTGLATNLLTPRQDDVSCSTLGLELCLAEKDGGSSQEDSPYGTLTATLGGILTAKNANKPIELPTVSGLPPYTTWVFLDRNQRMTEDQSAFHRQNIYYNADCGKALMFSDSEDGRRGR

SEQ ID NO: 4954 - protein, 254 aa, Triticum aestivum
TRNNVYMAKLAEQAERYDEMVQFTKEVAKMGAELSVEERNLLSVAYKNVIGSRRASWRIVSSIEQKEESKGNSAQVEKIRTYRQKIETELQEVCKDILSVLSEDLIPVAEGGESKVFYYKMKGDYHRYLAEFLTGEARKESATEAHEAYKSATDVAQTELAPTHPIRLGLALNFSVFYYEILNSPDRACHLAGRAGDDAIAELDTLSEESYKDSTLIMQLLRDNLTLWTSDLQDESDKPEPKAEEAEESKWGGG

SEQ ID NO: 4955 - protein, 136 aa, Triticum aestivum
  unsure (1)..(136): unsure at all Xaa locations
TTRTRGRTRGRPLRELANLVLIMGNXRDAIEEIPPGNANVLTTVLKLVDKYDLYGSVAFPKHNKQADVPEIYPLTPEQRWYIKSCSGRVFALHIXEGVAHGLSKVSTKRGGALDIIHTLYRGLLVDSHDQNAIADA

SEQ ID NO: 4956 - protein, 149 aa, Triticum aestivum
MPMGSSAAMPALPPGFRFHPTDEELIVHYLGRQAASMPSPVPIIAEVNIYKCNPWDLPGKALFGENEWYFFSPRDRKYPNGARPNRAAGSGYWKATGTDKAILSTPANESIGVKKALVFYRGKPPKGVKTDWIMHEYRLTAADNRTTKR

SEQ ID NO: 4957 - protein, 98 aa, Triticum aestivum
MSYYNQQPPVGAPPPQGARPVDSRYGDKGGYPPPGYPPAGYPPPAQGYPPAGYPQQGYPPQYAQQPPPHQQQQQSSGPSFMEGCLAALCCCCLLDACF

SEQ ID NO: 4958 - protein, 369 aa, Triticum aestivum
MVSATKLEGGYCFHSKNSPLDQPEGVKIHLYRLGIEQREHDALKSFAYAGQGSPSLLDTLILSQWENFAQKGHMGYDVTACELKVIEGQRDFVIQMNDKWNTFPLKKHDKFGHPFGCLKPNSARSYEELLLCIAEGENNEPEVVPSITPPNNGVLLIANAYPVEYGHIFLVPNATNQLSSFWDKRMFGLITKIASEVNSAAFRVFFDDGTSIVPKHMFFQACYFANPLPVESSSTVALYDGATRSGICVSEIVDYPLKALVFTSTNVNALVDVVSEACLALHENNTVHSLMMSNNGRNVFLFPQVKNLVTGCCLSAWECCGYFVHHTKVDFDRASETGISNRMASFSFQDGDFEDLKKLCCAIADGLVT

SEQ ID NO: 4959 - protein, 817 aa, Triticum aestivum
  unsure (1)..(817): unsure at all Xaa locations
MGETAGERALSRIHSVRERIGDSLSVHTNELVAVFSRLVNQGKGMLQPHQITAEYNAAIPEAEREKLKDTAFEDLLRGAQEAIVIPPWVALAIRPRPGVWEYVRVNVSELGVEELSVAEYLQFKEQLANGSIDNNFVXLELDFEPFNASFPRPSLSKSIGNGVQFLNRHLSSKLFHDKESMYPLLNFLRAHNYKGMTMMLNDRIRSLSKLQGALRKAETHLSGLPADTPYSEFHHRFQELGLEKGWGDCAQRASETIHLLLDLLEAPDPSSLEKFLGTIPMVFNVVILSPHGYFAQANVLGYPDTGGQIVYILDQVRAMENEMLLRIKQQGLDITPKILIVTRLLPDAHGTTCGQRLEKVLGTEHTHILRVPFKTEDGIVRKWISRFEVWPYLEAYTDDVAHEIAGELQATPDLIIGNYSDGNLVACLLAHKLGVTHCTIAHALEKTKYPNSDLYWKKFEDHYHFSCQFTADLIAMNHADFIITSTFQEIAGNKDTVGQYESHMAFTMPGLYRVVHGIDVFDPKFNIVSPGADMSIYFPYTEQQKRLTSLHTEIEELLFSDVENAEHKFVLKDKKKPIIFSMARLDRVKNMTGLVEMYGRNPRLQEAVNLVVVCGDHGKVSKDKEEQAEFKKMFDLIEQYNLIGHIRWISAQMNRVRNGELYRYICDMKGAFVQPAFYEAFGLTVIEAMTCGLPTFATAYGGPAEIIVXGVSGYHIDPYQNDKASALLVDFFGKCKEDPSHWNKISQGGLQRIEEKYTWKLYSERLMTLSGVYGFWKYVSNLDRRETRRYLEMLYALKYRKMAATVPLAVEGETSGK

SEQ ID NO: 4960 - protein, 161 aa, Triticum aestivum
MAAVATTTAVHGSQAAGAQRLLLLLALVIEAVNNGADIFTEDQQEIIKQFGRIKSETVPENKDAGSDDDDDDDEDEDDETGDADDDDADAGEDFSGEEGEDDDEDDDPEANGDDAGAGSDDDDGDDDDDDGEDGEDDDDDDEDEDEEDEEDEDQPPAKKKK

SEQ ID NO: 4961 - protein, 356 aa, Triticum aestivum
  unsure (1)..(356): unsure at all Xaa locations
MAKEAGGEGAMSESVLRKVLVSYCYVAVWIFLSFTVIVYNKYILDPXMYNWPFPISLTMVHMAFCSSLAVALVRVFRVVDLPSSPAMTTQLYTSSVLPIXALYSLSLWFSNSAYIYLSVSFIQMLKALMPVAVYSIGVLFKKETFRSSAMLNMLSISFGVAIAAYGEARFDLRGVALQLAAVAFEATRLVLIQILLTSKGISLNPITSLYYVAPCCLGFLFLPWVFVELPRLRAVGMFEPDFFVFGTNSLCAFALNLAVFLLVGKTSALTMNVAGVVKDWLLIAFSWSVIRDTVTPINLFGYGIAFLGVXGYYNHVKLQALKAKEAQKKVAQAXRKPGSLLQERDSHGERKTETQS

SEQ ID NO: 4962 - protein, 320 aa, Triticum aestivum
MAGAAAQQQQRGGGGGGGAVRVGGGGPAPFLTKTHQMVEERGTDEVISWGEQGRSFVVWKPVELARDLLPLHFKHCNFSSFVRQLNTYGFRKVVPDRWEFANENFRRGEQGLLSGIRRRKATATTTTPQSSKTSGTGVNVAFPPPLPALRPASASTSGTGNDHSSSSASSPTRPDLSSENEQLRKDNHALAAELALARRHCEELLGFLSRFLDVRQLDLRLLMDGDMQGAAGAGGARSADQEHCCEKKVKLFGVILKDASARKRGRCDEAAASERPMNMTRIGEPWVGVPIVLPGALRRRELMGASPWPDGCTQHARAPL

SEQ ID NO: 4963 - protein, 241 aa, Triticum aestivum
MASLFKDPSKLSVYRDRRFPGTQEEFEAALLASLTVYVGNMSFYTTEEQAYELFSRAGEIKKIIMGLDKNTKTPCGFCFVLYYSREDAEDAVKYISGTMLDDRPIRVDFDWGFEEGRQWGRGRSGGQVRDEYRTDYDPGRGGYGKMVQKELEAQRELVDYGVGFQTNAPPQFDRADRKRGYGDRNDRGDYQRRRSAPDMARRATDSDSKRDANQEPEKNPRFREKGDSDDEDDDYDKKRRR

SEQ ID NO: 4964 - protein, 233 aa, Triticum aestivum
  unsure (1)..(233): unsure at all Xaa locations
IVESVGEGVTELVLGDHVLPVFTSECECAHCKSKESNLCDLLRINVDRGVMIGDGESRFTINGKPIFHFVXGTSTFSEYTVIHVGCLAKINPEAPLDKVCVLSCGISTGLGATLNVAKPKKGDDPRRFCSTPCFCRLKRIMCYNQDXLPCASVSHDQAMEGAKMAWXSRIIGVDLNPAKYEQAKKFGCTDFVNPKDHTKPVQEVLVEMTNGGVDRVVECTGHIDAMIGXFECV

SEQ ID NO: 4965 - protein, 266 aa, Triticum aestivum
MSPAEPTRDESVYMAKLAEQAERYEEMVEFMERVAKATGGAGPGEELSVEERNLLSVAYKNVIGARRASWRIISSIEQKEEGRGNDAHAATIRSYRSKIEAELAKICDGILALLDSHLVPSAGAAESKVFYLKMKGDYHRYLAEFKSGGERKEAAESTMNAYKAAQDIALADLAPTHPIRLGLALNFSVFYYEILNSPDRACNLAKQAFDEAISELDSLGEESYKDSTLIMQLLRDNLTLWTSDTNEDDVDEIKEAPAPKESGDGQ

SEQ ID NO: 4966 - protein, 73 aa, Triticum aestivum
DNAAWIGAALVLCGSLTVQLFGSAPEKSQKVESCSGNTFESPLKRQDHLSLSAIPVDSSKNIGSQVERKDKTL

SEQ ID NO: 4967 - protein, 268 aa, Triticum aestivum
  unsure (1)..(268): unsure at all Xaa locations
MGRGPVQLRRIENKINRQVTFSKRRSGLLKKAHEISVLCDAEVALIVFSTKGKLYEYSSQDSSMDVILERYQRYSFEERAVLDPSIGNQANWGDEYGSLKIKLDALQKSQRQLLGEQLDPLTTKELQQLEQQLDSSLKHIRSRKNQLLFESISELQKKEKSLKDQNGVLQKHLVETEKEKNNVLSNIHHQEXQLNGATNINHQEQLNGATTSSPSPTPATAQDSMATPNIGPYQSRESGGGNPEPQPSPAQANNSNLPPWMLSTISNR

SEQ ID NO: 4968 - protein, 220 aa, Triticum aestivum
PAGERSSPDSRAMSKRGRDVWDMELGGLDTARLLMLLAQQHQQHQHQRAVAGAAQAMGGGRVFECKTCNRQFPTFQALGGHRASHKRPRLQQHPQKPHAIDSIDDGAALCLGRRAPQAPPLPAKPRAHECPVCGLEFAVGQALGGHMRRHRVEAEAATNAPSGKAAEPEMVVASCDAGGICLDLNLTPSENCAKCRSAAGLGAAAGQGVHKALAMLDCSL

SEQ ID NO: 4969 - protein, 157 aa, Triticum aestivum
RVAQRFGPPAAAPRRAKPNPPRKGEPRRDGFSAARLFSQGVSYTYDDVIFLPGFIDFPADAVDLSTRLSRRVPLSVPCVASPMDTVSEAAMAAAMASLGGVAVVHSNTEPRAQASIVRAAKSRRLPFVSSLPIFCPAFAPTLNDFAGPDYAPVTGQG

SEQ ID NO: 4970 - protein, 143 aa, Triticum aestivum
  unsure (1)..(143): unsure at all Xaa locations
ILLPSWANGLGSMGSISVSYGEDGPVFCGLSSDGSHLVTCSGADASVVYGAPLRIPFLGLTAGDGFACGLLLDTSQPYCWGSNSYVKIGVPQPMVEGVEYSLLSAGDNHLCALRMPDKGIPHGVNPDTLVIECWXYNMTATHV

SEQ ID NO: 4971 - protein, 243 aa, Triticum aestivum
FSRGRTSRWPVAMECGQCSARLAVTRGASSVQCAHCRRATRVERHGAVVHGAVGFVRSVFTNIGRARPHPGYPPVHGNKRALLVGINYTGTAAELPGPINDVKCMSFLLTLKYGFPGDCILVLTDEERDPYRRPTRANILVAMRWLVHGCSSGDSLVFHFSGHGDQEKDKDGDEQDGQDESICPLDWQLNGAILDDEINEAIVRPLVQGVRLHAIIDACRSGTVLDLPNLCQIKKNGKPLWID

SEQ ID NO: 4972 - protein, 65 aa, Triticum aestivum
  unsure (1)..(65): unsure at all Xaa locations
GSSATVATGVQREVYSXKGVMRRLMRWSRLRWEAAEHAECAVCLDEFAAGDVLAHLPCGHRFHWG

SEQ ID NO: 4973 - protein, 214 aa, Triticum aestivum
MGGYGDLFEKAKPYIAMICLQFGYAGMNVITQVSLNGGMSHYVLVVYRHAFATVSIAPFALILERKVRPKMTWSSFLQIFVLALLGPVIDQNFYYVGLKYTGPTFACAMSNILPAMTFVMAFIFRMEKVDLRNLRCQAKVAGTVVTVAGAMLMTLYKGPLMRMAWTSHGQAHGGEAPAVDPTGREWFLGSLFIIIATLAWASLFILQAHTLKQY

SEQ ID NO: 4974 - protein, 144 aa, Triticum aestivum
  unsure (1)..(144): unsure at all Xaa locations
MAKRLREAAPWEEAPGSPVNGLDDGCLMHIFSFLSPXPRWRFLACHPRLWLRVERPLRNVKEPGVYPNLEAAISAARPGDTILIAAGGTYLACNIQIKKPLCIIGGGELPDDTVLTCSRGSDKYAPFFDFKFPCLYFLLLFGVY

SEQ ID NO: 4975 - protein, 189 aa, Triticum aestivum
GHQAWAYLQDMQSNIDLVLTEVFMHGGLSGIDLLGRIMNHEVCKDIPVIMMSSHDSMGTVLSCLSNGAADFLAKPIRKNELKNLWAHVWRRSHSSSGSGSGSAIQTQKCTKSKSADDSNNNSNNRNDDASMGLNARDGSDNGSGTQSSRTKRAVEIDSPQDMSPDQSVDPPDSTCAHVSHLKSEICSNR

SEQ ID NO: 4976 - protein, 135 aa, Triticum aestivum
MHLLLCCTFLLAFAAPATTAASAPAPAPTPAKQTMTWDVEYIMWAPDCQQRVMIGINGKFPGPNITARAGETLSITVNNKLHTEGLVIHWHGMRQVGTPWADGTASISQCAVSPGDSFTYEFVADKPGTYFYHGH

SEQ ID NO: 4977 - protein, 302 aa, Triticum aestivum
  unsure (1)..(302): unsure at all Xaa locations
MVFVKNQKTRAYSKRFQVKFKRRRQGKTDYRARLRLTNQDKNKYNTPKYRFVVRFTNKDVTAQIVYATIAGDIVMAAAYSHELPRYGLEVGLTNYAAAYCTGLLLARRVLKCRDLDQEYEGNVEATGEDFSVEPADERRPFRALLDVGLIRTTTGNRVFGAXLKGALDGGLDIPHSDKRFAGFKKDEKQLDAEIHRKYIYGGHVADYMKSLADEEPEKYQSHFSEYIKKGIEIDDMEALYKKVHAAIRADPTVAKSTKEPPKTHKRYNPKKLTYEQRKASLVERLNALNSSAGADVDEDDDE

SEQ ID NO: 4978 - protein, 173 aa, Triticum aestivum
MASNQDKASYRAGEAKAHTEEKAGQVTGAAKDEACDAKDRASGAAGQATGKGQGAVEATKQKAGEAGQKTSETAQAGKDRAAEGKDRTGSYLGHATEGTKQKASEATGYTQDRASDAAQYTKDSAVAGKDKTGSVLSQAGEQVKNAVVGAKDAVASTLGMGGRQHLQRNQGRE

SEQ ID NO: 4979 - protein, 170 aa, Triticum aestivum
MDHAAEAQRTDLMTITRHALNEQGRHPESRGDFTILLSHIVLGCKFVASAVNKAGLAKLIGLAGETNVQGEEQKKLDVLSNEVFVKALVSSGRTCVLVSEENEAAIFVDAPLRGKYCVCFDPLDGSSNIDCGVSIGTIFGIYMIKDKDNATLEDVLQPGTDMIAAGYCMY

SEQ ID NO: 4980 - protein, 302 aa, Triticum aestivum
MVYIKNQKTRAYSKRFQVKFKRRRQGKTDYRARLRLTNQDKNKYNTPKYRFVVRFTNKDVTAQIVYATIAGDIVMAAAYSHELPRYGLEVGLTNYAAAYCTGLLLARRVLKNRDLDEEYEGNVEATGEDFSVEPSDERRPFRALLDVGLIRTTTGNRVFGALKGALDGGLDIPHSDKRFAGFKKDEKSLDAEIHRKYIFGGHVADYMRSLADEEPEKFQTHFSEYIKRGISADDMEAVYKKVHAAIRADPTMAKSTKAPPKTHKRYNPKKLTYEQRKASLVERLNALNNSAGAADDDEEDDE

SEQ ID NO: 4981 - protein, 153 aa, Triticum aestivum
MASNQDQASFRAGEAKGHTQEKAGQVMGAAKDKAYEAKDRAAGLAGHASGQGQGATEATKHKAGEATDRATNETAQAAKDKAAGTTQAAKDRTVEGKDQTGSFLGEKTEMAKQKADETAQYTQDRTYDAAQYAKESAVVGMDKTGSVLQQAGE

SEQ ID NO: 4982 - protein, 485 aa, Triticum aestivum; identical to SEQ ID NO: 4877

SEQ ID NO: 4983 - protein, 164 aa, Triticum aestivum
  unsure (1)..(164): unsure at all Xaa locations
MASLLDKANGFVADKIAHMPKPEASLDKVTFKGMTREAITVHSHVNVTNXPYSHRIPICDIAFNLKCGGKEVAXGTIPDPGWIEDSGEVTKLEVPAKVPYDFLISLMKDLGRDWDIDYELLVKLTIDLPIIGNFTIPLDTAGEFKLPTLSDFFGGSAKTEEATA

SEQ ID NO: 4984 - protein, 38 aa, Triticum aestivum
RRQEGNAAGNGFLLLDSEFNVKGRWEKPGHSPLFGYDF

SEQ ID NO: 4985 - protein, 302 aa, Triticum aestivum; identical to SEQ ID NO: 4226

SEQ ID NO: 4986 - protein, 155 aa, Triticum aestivum
MPLSLGADHLAAPGARAPPARVGTGMGMDTSLSLGGAAAYLPLNENDSLDMLLFDVLREASAVAAASPSSSSSPPTKTATAIAAAGADAIESGGACAAGRAAERPHYRGVRRRPWGKYAAEIRDPSRPGTRLWLGTFGTAEEAAVAYDRAAFRLR

SEQ ID NO: 4987 - protein, 191 aa, Triticum aestivum
LCPPPAPPFSPLRSSSRARVFIRVSGRGMADDDSGSPRGGGGVREQDRFLPIANISRIMKKAVPANGKIAKDAKETLQECVSEFISFVTSEASDKCQKEKRKTINGDDLLWAMATLGFEEYVDPLKIYLQKYRDMEGDSKLTSKSGEGSVKKDIIGAHSGATSSNAQAMVQHGGYAQGMGYMQPQYHNGDT

SEQ ID NO: 4988 - protein, 48 aa, Triticum aestivum
  unsure (1)..(48): unsure at all Xaa locations
PNXKKLVIHGVLXEAKTREERKMLATFTSFIVCLMRKYVHVDVQFEYE

SEQ ID NO: 4989 - protein, 142 aa, Triticum aestivum
MPPRRPNTGGGGGTSSAAPPPPPRKVPLRSLLRAASVACGVQFGWALQLSLLTPYVQELGIPHAFASLVWLCGPLSGLLVQPLVGHLSDRIAPANSPLGRRRPFIAAGAASIAFSVLTVGFSGDLGRLFGDNIAARAPGADV

SEQ ID NO: 4990 - protein, 289 aa, Triticum aestivum
  unsure (1)..(289): unsure at all Xaa locations
SDYWTGASVIIIIVTILTMAPEKRSAEFVFTHYDASASGWPAGWSFFVGLLQGAYVLTGYGMVASMCEEVQNPEREVPKAIVLSVAAAGVTGIIYLIPILFVLPDVKMLLSVANSQPIGTLFKVVTGSAAGGFGLLFLILGILMFAGIGALTAASRCTYAFARDGAIPGYKLWSKVNTRFDMPVNALILSTIVDCILGCIYFGSTAAFNSFTGVATICLASSYGVPVGVXLLRGRKIVKHSPFXLCKFGPLXHXICVVWIIFLIVIFCMPVSLPVDAVTMNYASGVFAG

SEQ ID NO: 4991 - protein, 281 aa, Triticum aestivum
GPSWSRPGHRRGFALQAGRSPLAAPPAAPPVAAPPRFQPLRSSRWRVYGGESSGGGGSSSDASGGSFQCNICFELPQEPIVTLCGHLFCWPCLYRWLHMHANTPECPVCKAIVEEDKLVPLYGRGKDRVDPRSKNTPGADIPQRPAGQRPATAQQADPNNNFGNAHANPWFMGMGGAGPGAGVPLANGRWGNYAFSAAFGGLFPMLSFQMHGFPDPAAYAQPAGFHYGFGHGHGFHGGHMGHAHGVPRQGPLGQQQQQADVYLKALLIMVGVLVIASLLAA

SEQ ID NO: 4992 - protein, 269 aa, Triticum aestivum
  unsure (1)..(269): unsure at all Xaa locations
GXTELTTDVSRXIPKMNCASLVTRLVLVDKETWLKESHSMPQLLSKLRSKDQADPPKLFLLENPTNSIKSSSNISREHNLNVIMKPLRASMLEASLRRALGGVDKAHVKNGLVGNSALGSLLHKRQIIVVDDNAVNLKVAAGALKKYGAEVICADSGKKAIALLKPPHSFDACFMDIQMPEMDGFEATKRIRMMERELNERIERGEAPPECANVRRWRTPILAMTADVIQATYEHCLKCEMDGYVSKPFEGEQLYREVTRFFQSHDHVQ

SEQ ID NO: 4993 - protein, 363 aa, Triticum aestivum
MNMNYGSMGPGAMVRCRQCSSSITAMPGARAVQCMQCSCVTRVSGRGRQQHGYGQGYGNGGGMLMPPMRPTPAFGGGRGKKRAVLIGIKYTNRRSCELRGPINDVKCMRYLLTERFGFPNDCVLILTDEERNPCRQPTKDNIRMAMHWLVQGCSYGDSLVFQFSGLGAQVPDDDGDELDGMDEALCPVDSFQQGPILDDEINDLAIVRPLVHGVKLHAIVDACHSATVLDLPYQCTVSKQTGRWRWRDERPMTGACKGTSGGQAVLISGSSNGKSNMSVLPEPYATIGAMTHSFIRAVECEPRTTYGRLLTSMRAIMRDSGGNCNLQGPIGGSIRKVANFSGVEEPQLSSAYKFDVEREPFCM

SEQ ID NO: 4994 - protein, 522 aa, Triticum aestivum
MARGGGNGEVELSVGVGGGGAGAGGADAPAVDISLGRLILAGMVAGGVQYGWALQLSLLTPYVQTLGLSHALTSFMWLCGPIAGLVVQPCVGLYSDKCTSRWGRRRPFILTGYILICIAVVVVGFSADIGAALGDSKEECSLYHGPRWHAAIVYVLGFWLLDFSNNTVQGPARALMADLSAQHGPSAANSIFCSWMALGNILGYSSGSTNNWHKWFPFLRTRACCEACANLKGAFLVAVLFLAFCLVITVIFAKEIPYKAIAPLPTKANGQVEVEPTGPLAVFKGFKNLPPGMPSVLLVTGLTWLSWFPFILYDTDWMGREIYHGDPKGTPDEANAFQAGVRAGAFGLLLNSVVLGFSSFLIEPLCKRLGPRVVWVSSNFLVCLSMAAICIISWWATQDMHGYIQHAITASKEIKIVSLALFAFLGVPLAILYSVPFAVTAQLAANRGGGQGLCTGVLNIAIVIPQVIIAVGAGPWDELFGKGNIPAFGMASAFALIGGIVGIFLLPKISRRQFRAVSGGGH

SEQ ID NO: 4995 - protein, 121 aa, Triticum aestivum
LQRFLRDNICFGETLASSGEGESTRVWRGEKGWKLIQTFHKSFVQVQSILDQNRMLISEINQNHESRAPDSLTRNVGLIRELNNNIRRVVGLYADLSASFAHRGAAMDGGSSEGDSSGTLR

SEQ ID NO: 4996 - protein, 158 aa, Triticum aestivum
MGGETVAGSGDEEDDQHELGEGERHGRREPLGDRRGKRRPRVPGAGQPHPQQVIQTFHKSFVQVQSILDQNRMLISEINQNHESRAPDSLTRNVGLIRELNNNIRRVVGLYADLSASFAHRGAAMDGGSSEGDSSGTLRSSDAAGRAAAAGQKRVRPG

SEQ ID NO: 4997 - protein, 134 aa, Triticum aestivum
MEGESFSGMGNGGGGGGGGGHHQVVDGKLIQTFHKSFVQVQSILDQNRMLISEINQNHESRAPDSLTRNVGLIRELNNNIRRVVGLYADLSASFAHRGAAMDGGSSEGDSSGTLRSSDAAGRAAAAGQKRVRPG

SEQ ID NO: 4998 - protein, 227 aa, Triticum aestivum
  unsure (1)..(227): unsure at all Xaa locations
MMAPRRSAAETADADRARLHQLGYKQELKRGLSAVSNFAFSFSIISVLMGVTATYNTGLRYGGPASMTLGWLVVTVFNGCVALSMAEICSAYPTSGGLYYWSAKLAGKEWAPLASWVTGWFNIVGQWAGTTXSVDFSLAQLIQVIILLSCXGRRAPARANGGGYTASKYVVLAIHGFFLVLHGLINSLPIRGLSWCGKLGAFGYSAGAFTLVILIPAVAKERASAKF

SEQ ID NO: 4999 - protein, 339 aa, Triticum aestivum
MVVKSGGGGGAEEGAAGAAVRRWVEAGGGRLVLDGGLATELEAHGADLNDPLWSAKCILSSPHLIRKVHLDYIEAGANIIITASYQATIQGFESKGFSKEQGENLLTKSVEIAHEAREMFLKQHPDQSTALRPILVAASIGSYGAYLADGSEYSGDYGEAGTLEFLKDFHRRRLQVLAEARPDLIAFETIPNKLEAQAYVELLEECNINIPSWFSFNSKDGVNVVSGDSLIECAKIANECAKVGAVGINCTPPRFIHSLILSIRKVTDKPILIYPNSGERYDAEKKEWVESTGVSDGDFVSYVGEWCKDGAALIGGCCRTTPNTIRAIIRSLNQYYPAA

SEQ ID NO: 5000 - protein, 168 aa, Triticum aestivum
DCHIETSSRAPLNYTQGGPRRHNPQAASRGASSTMDRAALPAAVEPKKKGNVRFAFACAILASMTSILLGYDIGVMSGASLYIQKDLKINDTQLEVLMGILNVYSLIGSFAAGRTSDWIGRRFTIVFAAVIFFAGALIMGFSVNYAMLMFGRFVAGIGVGYALMIAPV

SEQ ID NO: 5001 - protein, 126 aa, Triticum aestivum
SLERALALLMGSPCLEQPILPTEVVLGSSRMHKKVSQRSSNQSCSENELVDGDDQRIEYRAPSWITFPSVTSSQRRKSSASEADLDGRTTTDGRNVGSSIGDGLRSLEEEIGPASPQEDLYLQHNF

SEQ ID NO: 5002 - protein, 228 aa, Triticum aestivum
  unsure (1)..(228): unsure at all Xaa locations
MDNSGVIFYGGAYATVMSAPPKRPAGRTKFRETRHPVYRGVRRRGAAGRWVCEVRQPNNKSRIWLGTFASPEAAARAHDVAALALRGRAACLNFADSAALLAVDPATLRTPQDIRAAAITLARAACPRHPPRPHXLAETACPAAPVAAEASAPAPAMMAMMQEPSAVEYDDYPMQYGGIGDFDQHSYYYDGLSAGGGDWQSSSHMDGADDDSNCGGGYGAGEVPLWSY

SEQ ID NO: 5003 - protein, 219 aa, Triticum aestivum
MDQYSYGGGDGDQAGQGGYATVTSAPPKRPAGRTKFRETRHPVYRGVRRRGAAGRWVCEVREPNKKSRIWLGTFASPEAAARAHDVAALALRGRAACLNFADSATLLAVDPATLRTPDDIRAAAIALAETACPAAPVAAEASAPAPAMMAMMQEPSAVEYDDYPMQYGGIGDFDQHSYYYDGLSAGGGDWQSSSHMDGADDDSNCGGGYGAGEVPLWSY

SEQ ID NO: 5004 - protein, 253 aa, Triticum aestivum
MEATAATRRLMGLCCCLSGVILLSFLLPGALAEERFYEFVVQETVVKRLCQTNRIITVNGQFPGPTIEVHNGDTLAIRAVNMAQYNVTLHWHGLRQLRNGWADGPEFVTQCPIRPGSSYTYRYTIQEQEGTLWWHAHSSWLRATVHGALIILPKRGMPYPFPKPDKEFPVVLAEWWRRDPIAVLRQSMVTGAPPNVSDTILINGQPGDFLPCSSQETSIIPVVAGETNLPRIINAAMNSELFVSLAGHKMTGG

SEQ ID NO: 5005 - protein, 254 aa, Triticum aestivum
  unsure (1)..(254): unsure at all Xaa locations
IDRLKRDKQLLMAEVVKLRQEQQNTKARLKAMEDRLRGTEQKQQQMTSFMARILXNPEFLKQLIAKNGMRKELHDAISKKRRRRIDGGPEAYAVGASSSSLDQELPVVFDSHGSVELLAEGSVPVELLADGIPPDLEGSVDLLGDEIPPGLEGSVALLADGLEGSVELLVDGIPSDLDGSGIDSNGVTEPQDYGLGTCEAQQNRAPGLFHDNFWEELLNKGLSVENDEPVNVDGMDVLSEKMGYLIPNSPTLST

SEQ ID NO: 5006 - protein, 165 aa, Triticum aestivum
  unsure (1)..(165): unsure at all Xaa locations
FQAYYLKVQYPSRKGAXTKKLTVVGNGVSISQLVRYPVSGFAFEGGASLEDLSQVVSDACIFLQENNSPFNVLISESGKRLFLLLQCYAEKQASGKASQEFLDMRINPAVWELSGHLVLKRRKDYDEASAATLCGFLVEASLSEAEFQELKKCVLEFLASASPEK

SEQ ID NO: 5007 - protein, 155 aa, Triticum aestivum
MRLLVAEVAAASPLSSASSECNSNSCRWKPYSNSTDFQANASVLLILIFSALICALSLCAAIRCFLRPTTPETDDNDHKPDPEADGSFTIPTPTLVYSSDLELAGAEAECAICLSEFEQGESIQVLEKCHHGFHVKCIHKWLSSRSSCPTWPDFY

SEQ ID NO: 5008 - protein, 195 aa, Triticum aestivum
MSVPDERADGMLSLHESPTRNVQPAQEHLSLEEVSTESSIRPFFVEFDNNIFSSSRRRCSNTRAERQLLVLETNLFFGAFASYDRHRDMRMDIDNMSYEELLALEERIGSVSTALSEEQFTKCLRRSIYSQVASEVSKSTVDDMKCSICQEEYMEGEEVGRLPCEHWYHVCCIGQWLRQKNWCPVCKASAVPSKG

SEQ ID NO: 5009 - protein, 204 aa, Triticum aestivum
MPRSGALPLLAALVLALAAAAAASASNSKGAPAATDFIRKSCRETQYPSVCMQSLSSYGKPPPRSPQELARAALSVSADRARSASAYVGRICGPGLRSGSGAKAKSSPARDCLENMADSVGHLRDAAKELDGSLGRAGSPAFRWHLSNVQTWCSAALTDENTCLDGLSRGVDAGTRAAIRSKVVEVAQVTSNALALVNKVGSGH

SEQ ID NO: 5010 - protein, 339 aa, Triticum aestivum
  unsure (1)..(339): unsure at all Xaa locations
AASRRRGIRRGDGEAAARGGAVGGGNGGTASERGGRGLRHRGGKEMAKRLREAAPWGEAPGSPVNGLDDGCLMHIFSFLSPIPDRYNTALVCHRWRFLACHPRLWLRVERPLRDVKEPGVYPDLEAAISAARPGDTILIAAGGTYXACNIQIKKPLCIIGGGELPDDTVLTCSRGSDNAPXLYRSTCKIANLTIKAELGSCLLHRSGKLASQEWRQTCWPTCPCPRSGRRACAGGDRGRPPVLVDAVLRGLLPGARLVLVQLHLGRAHLGLAALVRPLPLRAPPRPGCLRPCPTSLASVILALAFTALTPSFTFSFAAFIFAWPLCPFPIKQRYLPLAA

SEQ ID NO: 5011 - protein, 249 aa, Triticum aestivum
MKKCASELEFEAFIRQHIAAAEAEAQRGRPGHGNDDGGFGGDPGARADVFSPGGGLPGLCFGDSQNALELEGSNAGHLWWSEGLRAPPHHAVPAPTQSQTPAVSASPRETISGNQALETESDSDSESLVEIQGGRCKRSGKSSDTRRIRRMVSNRESARRSRRRKHAQLTDLELQVEQLKSESATLFKQLTEANQQFTTAVTDNRILKSDVETLRIKVKMAEDMVARGAVSCGLGQQLGLAPFLNSRKM

SEQ ID NO: 5012 - protein, 282 aa, Triticum aestivum
MKIQCDSCGVAAATVVCCADEAALCARCDVEIHAANKLASKHQRLPLDALGAKLPRCDICQEKAAFIFCVEDRALFCRDCDEPIHVPGTLSGNHQRYLATGIRVGLGPVSACAAGDHGAAHDADHHAPPKVPCEPSPPQQPAPRAHPVPSTGESLPPAWAVVGLLQFWDYRVKRRLAPGRAWRGPGRGLSAAPSTRPTAAAPPPSPAASPPVPLATRPPPGRPAAPPPPPGASATTPPSRSPAPSPSSPSLIFPTRCAGPKAGKGPPVRIPGGLFLIGAELG

SEQ ID NO: 5013 - protein, 284 aa, Triticum aestivum
  unsure (1)..(284): unsure at all Xaa locations
MASAELSREENVYMAKLAEQAERYEEMVEFMEKVAKTVDSEELTVEERNLLSVAYKNVIGARXRASWRIISSIEQKGRRARGNEDRVTLIKDYXRGKIETELTKICDGILKLLESHLVPSSTAPESKVFYLKMKGDYYRYLAEFKTGAERKDAAENTMVAYKAAQDIALAELAPTHPIRLGLALNFSXVFYYEILNSPDRACSLAKQAFDEAISELDTLSEESYKDSTLIMQLLRDNLTLWXTSDISEDPAGRDXREAPKHDSKRGGSRLYVAEASTQCLLLSN

SEQ ID NO: 5014 - protein, 214 aa, Triticum aestivum
RHEVSMSLPQIMKVTELPKLKAWPKSWEKASVPSAESIGLFFFSQNTRSNKEFDDLVKHVIDYDIVLETDVSFAKLLVFPSVVLPAEYRVFQGKHYLWGVFKRSKDMAERDALVEQNCTTCLADEDVPEQNALDIVPCKALDQEMALVVSDIHHDNQPSLTTSQVVESEASSDKGPSHPVINSPERPMYLILDTSCKVLKKWSCERMDTKLSML

SEQ ID NO: 5015 - protein, 80 aa, Triticum aestivum
PAGSGPDRPTMFYAGDGVSDLSAAKETDLLFAKADKDLVTWCENENVPFVTFRDWSSITQTVKDIAAGTVSVKDAARGRI

SEQ ID NO: 5016 - protein, 392 aa, Triticum aestivum
TVAIGDHVLSEGEWLSLNGSTGEVILGKQPLSPPALSGDLGTFMSWVDDVRKLKVLANADTPEDALAARNNGAQGIGLCRTEHMFFASDERIKAVRQMIMAPTVELRQQALDRLLPYQRSDFEGIFRAMDGLSVTIRLLDPPLHEFLPEGNVEEIVRELCAETGANEEEALERVEKLAEVNPMLGFRGCRLGISYPELTEMQARAIFEAAIAMSNQGVEVFPEIMVPLVGTPQELGHQVNVIKQTAEKVFANAGKTIGYKIGTMIEIPRAALVADQIAEQAEFFSFGTNDLTQMTFGYSRDDVGKFIPIYLAQGILQHDPFEVLDQRGVGELVKFATERGRQTRPNLKVGICGEHGGEPSSVAFFAKVGLDYVSCSPFRVPIARLAAAQVLV

SEQ ID NO: 5017 - protein, 277 aa, Triticum aestivum
CCFRSIRSTLPYFRVCGLTPAPPGGGMVLLAAPNRRRPSVSAFLIYLDMGDMSKGSSTYIGKLRSNFLGTKFTVYDAHPPYDGAIVSKSRSARVIGLNQVSPRVPAGNYPVSHISYELNVLGSRGPRRMNCVMSSIPASAVEEGGKAPTQTEFPLGNLDSFPSIPFFRSKSARIDSAPAQAQDEEKLVLKNKSPRWHEQLQCWCLNFRGRVTVASVKNFQLVASDENGAAGQEHDKVILQFGKIGKDLFTMDYRYPISAFQSFAICLSSFDTKIACE

SEQ ID NO: 5018 - protein, 80 aa, Triticum aestivum
MSYPAPQQPGYYGPPPQQGYGQYPPPQQQMYYQQGPPPPQEEPKKDRGCLTACLATLCCCWLCGETCECCLDCLDCCDCC

SEQ ID NO: 5019 - protein, 276 aa, Triticum aestivum
  unsure (1)..(276): unsure at all Xaa locations
SDLRTQEHAVTALLNXSIHEDNKASIMSSGAVPSVVHVLKNGSMEARENAAATLFSLSVVDEYKVMIGGTGAIPALVVLLSEGSHSIPHVVMNTVLILPYYLLDLGRAIRAGLVPLIMGLVEMXLCDEPLLPGEVFEIYSCGLLRNCTIGTAEVVMGMSEQLGSGSPRNRENAAAVMLHLCSGEQQLVHLARAHECGIMVPLRELALNGTERGKRKAVQLLERMSRFMVQQQEEQESHSRLQAAAAQVLPQAPEQVQEREIPDQLESPASQYPTLL

SEQ ID NO: 5020 - protein, 128 aa, Triticum aestivum
MAEETPQDVSMESPPPAPMQTDQEPKYGGYSRFEIELEFVQSLANPAYLNHLASQKLLSQPAFVAYLAYLRYWSKPPYLKYLTYPGPTLRHLELLQQETFRQQIINPDVVRPLTQEGMRASADCDRGE

SEQ ID NO: 5021 - protein, 612 aa, Triticum aestivum
  unsure (1)..(612): unsure at all Xaa locations
MAEAGDPTLEQGLLANPEESNQLTYTGDGSVDFSGNPVVKEKTGRWKACPFILGNECCERLAYYGISTNLVTYLTKKLHDGNSSAARNVTTWQGTCYLTPLIGAILADAYWGRYWTIATFSTIYFIGMSVLTLSASVPMLMPPSCEGAICPEASPLQYTVFFLGLYLIALGTGGIKPCVSSFGADQFDDTDPAERIQKGSFFNWFYFSINIGALISSSFLVWVQDNLGWGLGFGIPTVFMGLAIISFFAGTSLYRFQKPGGSPITRVCQVVAATLRKWNAPVPEDSSLLYELADGVSAIEGSRQLEHTDELRCLDKAATITDLDVKEDSFNNPWRXCTVTQVEELKILVRMFPVWATTIVFSAVYAQMSTMFVEQGMVLDPTIGSFKXIPPASLSTFDVVSVIIWVPIYDSILVPIARRFTGKERGFSELQRMGIGLVISILAMSAAAVLEIKRLAIAREAHLVDQNVPVPLSILWQIPQYFLVGASEVFTFIGALEFFYDQSPDAMRSLCSALQLITTAXLGNYLSALILTMVACFTTRGGRPGWIPDTLNEGRLDYFFWLLAGLSYFNFLVHVVCANRFKSKKAACSFFNGRTSWTASEQQSCTRTLENL

SEQ ID NO: 5022 - protein, 136 aa, Triticum aestivum
MSEAVGTPESSGAKEQERFLPIANIGRIMRRGVPENGKIAKDAKESIQECVSEFISFITSEASDKCMKEKRKTINGDDLIWSMGTLGFEDYVEPLKLYLKLYREMEGDTSKGSISEQAAKKVGALNGQPGSSFNGM

SEQ ID NO: 5023 - protein, 230 aa, Triticum aestivum
IRHEAKLCMIPASCLLEVVFDRVHYSRDTKLSIMVVLVGVAVCTVTDVSVNAKGMLAAVIAVWSTAFQQYYVHYLQRKYSLNSFNLLGHTAPAQAGSLLLVGPFVDYLLTGKRVDHFNFTSLSLLFVVLSCIIAIGVNLSQFICIGRFSAVSFQVLGHMKTVLVLFLGFLFFGKEGLNLHVVLGMILAVLGMMWYGNASAKPGGKERRSVLPVRSDRHNGGSEDKDGGEK

SEQ ID NO: 5024 - protein, 192 aa, Triticum aestivum
  unsure (1)..(192): unsure at all Xaa locations
SGSPGLQEFARDHYLEHPNRKSDQNRRSISAGSRPLLRLLQSTLPLPSPVPITPNAGHDGHHREWRGGANWPGAPREGRRGAAARGADPGGGGGXEREIVLGRNMHASCFAVKEPDADDEFTGEREATMAGVLARYRRSLVERTKHHLGYPYNLDFEYGALSQLQHFSINNLGDPFIESNYGVHSRQFEVVS

SEQ ID NO: 5025 - protein, 503 aa, Triticum aestivum
MQQVSALPPVLLLLLLISLSSSSCCHGANAAAGDHHDFMVVPASSLLHLSQGAVCSGHKDDGLTAMPPHNRAAWVPINRPHGPCSSAGAMDNMVDNMLLWDQLRTSYILKELSDSRAGKAVPTIDANAAPAPPVVKQDSMMMEGNITMGPQPNVTCNARSSSMATSDAARSGKPGVRQTVIIDTSSDITWVQCLPCPVPQCHLQKDPLYDPADSTTYAPIPCGSRACKELGSSYGNGCSGSGQCNYAVNYSDGRATTGTYITDTLTLSDNTTSINGFRFGCSHADRGPFGDRTAGVLALGGGPQSLRAQAAPTYGDAFSYCIPLPSSIGFLSLGGPPVGLLPRFVLTPLIRNPRAPTFYIVRLEAIAVSGKRLAVPPAAFAAGAVMDSNAVITQLPAVAYAALRAAFRSFMGAYPRAAPVLNLDTCYDFTRSPKVTLPKVSLVFAGGATVPLDAASIMLGGCLAFAAIPGNGSLGFIGNIQQQNYEVLYDVGGGSVGFRRGAC

SEQ ID NO: 5026 - protein, 164 aa, Triticum aestivum
YILVWYTFSTCLTLYNKTLLGDKLGKFPAPLLMNTVHFALQAALSKIILLFQAKGIDSAVEMSWKDYFMRVVPTALGTALDINLSNASLVFITVTFATMCKSASPIFLLLFAFAFRLESPSIKLLGIIVVISIGVLLTVARETAFDFWGFIFVTLAAVMSGFSW

SEQ ID NO: 5027 - protein, 332 aa, Triticum aestivum
  unsure (1)..(332): unsure at all Xaa locations
MALSVEKTSSGREYKVKDLSQADFGRLELELAEVEMPGLMACRTEFGPSQPFKGARISGSLHMTIQTAVLIETLTALGAEVRWCSCNIFSTQDHAAAAIARDSAAVFAWKGETLEEYWWCTERCLDWGAGGGPDLTVDDGGDATRRIPAAPQGRGGVRAVRQVPLRTRPRAPRQPRIDHPTIQQRRRAQGQHPPPAEGWTSRSPASATRPLPATRVNASVTKPALANPYRXRHPLPDRLMRATHVMSSATVAVVXGYVGVXSGCGAPRYQGVALLVVTEMAPRRAPRALVEGIQILTLXDVLSEAAFCVPTTGHKGIFFLDLRYLWKNHAKL

SEQ ID NO: 5028 - protein, 485 aa, Triticum aestivum
MALSVEKTSSGREYKVKDLSQADFGRLELELAEVEMPGLMACRTEFGPSQPFKGARISGSLHMTIQTAVLIETLTALGAEVRWCSCNIFSTQDHAAAAIARDSAAVFAWKGETLEEYWWCTERCLDWGAGGGPDLIVDDGGDATLLIHEGVKAEEEFEKSGKVPDPESTDNPEFKIVLTIIRDGLKTDARKYRKMKERLVGVSEETTTGVKRLYQMQESGTLLFPAINVNDSVTKSKFDNLYGCRHSLPDGLMRATDVMIAGKVAVVCGYGDVGKGCAAALKQAGARVIVTEIDPICALQALMEGIQILTLEDVVSEADIFVTTTGNKDIIMVDHMRKMKNNAIVCNIGHFDNEIDMNGLETYPGVKRITIKPQTDRWVFPETKTGIIVLAEGRLMNLGCATGHPSFVMSCSFTNQVIAQLELWNEKATGKYEKKVYVLPKHLDEKVAALHLGKLGARLTKLTKSQSDYISIPVEGPYKPAAYRY

SEQ ID NO: 5029 - protein, 335 aa, Triticum aestivum
  unsure (1)..(335): unsure at all Xaa locations
MANMQESLALVGTMRGHNDVVTAIAAPIDNSPYIVSGSRDKSLLVWDLTNPVPSLGDGTVGTDYAVPFRRLTGHGHFVQDVVISSDGQFALSGSWDGELRLWDLSTGLTTRRFVGHTKDVISVAFSVDNRQIVSASRDNTIKLWNTLGECKYTIGGDMGGGEGHTGWVSCVRFSPNIQQPTIVSGSWDKTVKVWNLTNCKLRSTLAGHGGYVNAVAVSPDGSLCASGGKDGVTLLWDLSEGKRLYQLEAGSIIHALCFSPNRYWLCAATEESVKIWDLESKHVVQDLRPEXPVSTNQMLYCTCLSWSADGSTLYAGYTDGTIRVFKIQAGFAGYA

SEQ ID NO: 5030 - protein, 185 aa, Triticum aestivum
MNGPPENDLCSICHSHFTAPCQANCSHWFCGNCIMLVWRHGSTLQPCKCPLCRRPISLLVPTEDTIRNRSDSAVSEVLANLETYNRYFGGRSTSLFQRMQDLPFLLRRLLREMMDPQRTLPLVIRVRVYIAMILSVVYIVSPIDIIPEGVLGVVGLLDDLLIALICFLHVAALYRSVLYFRHAGS

SEQ ID NO: 5031 - protein, 381 aa, Triticum aestivum
MASSTQGQVITCKAAVAYEANKPLVVEDVQVAPPQAGEVRIKILSTALCHTDYYTWSGKDPEGLFPCILGHEAAGIVESVGEGVTDVQPGDHVIPCYQAECKNCKMCNSGKTNLCGKVRGATGVGVMMSDRKSRFSVNGKPIYHFMGTSTFSQYTVVHDVSVAKINPQAPLDKVCLLGCGVSTGLGAVWNTAKVEAGSVVAVFGLGTVGLAVAEGAKSAGASRIIGIDIDAKKFDVAKNFGVTEFVNPKDHDKPIQQVLVDLTDGGVDYSFECIGNVSIMRAALECCHKGWGTSVVVGVAASGQEIATRPFQLVTGRVWKGTAFGGFKSRSQVPWLVEKYMNKEIKVDEYITHNMNLTDINKAFDLLHEGGCLRCVLAMEH

SEQ ID NO: 5032 - protein, 120 aa, Triticum aestivum
DDVVVQALRHRSVGSASSALAPLSPPRTARSARLELPAGYPASRGKKRAVLVGVSYTGTSYELKGTVKDVELMRNLLCDKFGFPGDSILVLTEESDDPSRVPTRENLLLAMRWLVAGCDA

SEQ ID NO: 5033 - protein, 465 aa, Triticum aestivum
  unsure (1)..(465): unsure at all Xaa locations
PRVRPRVRPRVRPRVRSLPPSHDSLLSSPPPHHHRRESQREGGENQSPCPHPSPDQIPGGPARSLRRGPARPMGGEAPEPRRLSRALSLDGSGVPEEALHLVLGYVDDPRDREAASLACRRWHHIDALTRKHVTVPFCYAVSPARLLARFPRLESLGVKGKPRAAMYGLIPDDWGAYARPWVAELAAPLECLKALHLRRMVVTDDDLAALVRARGHMLQELKLDKCSGFSTDALRLVARSCRSLRTLFLEECTITDNGTVWLHDLAANNPVLVTLNFYLTYLRVEPADLELLAKNCKSLISLKISDCDLSDLIGFFQIATSLQEFAGAEISEQKYGNVKLPSKLCSFGLTFMGTNEMHIIFPFSAVLKKLDLLYSFLTTEDHCQLIAKXPNLLVLAVRNVIGDXRGLGVVXYTCKKLLTLIVERGEDDPGVQEQEGGISQVRLTAIAVSCRELENIAAYVSDITN

SEQ ID NO: 5034 - protein, 186 aa, Triticum aestivum
  unsure (1)..(186): unsure at all Xaa locations
MRRLSDAGEATPLVTPAAAAAAGGTLASPAAAGSNANFDANMVIILAALLCVLIFALGLNSVIRCVLHCGRRLAPSSSLAASATTARTTTSVHVQAGLKRKALRKIPVEVYGGAKSSGGALPATATECAXCLGEFADGEKVRVLPRCHHGFHVRCIDMWLATHTSCPNCRASLAEDGAAAANGGGR

SEQ ID NO: 5035 - protein, 207 aa, Triticum aestivum
ASQEPSRTGTPIIASSPTSTRTPTPNRSVEFGVGTIDSSKMGMSEEELQLNTRKEIMDLGERLGKTTIAGRAREAERAGANDAEDPGEKAVESASARRAGERHEAEKARDPGRFQREEVKIQAWENHQRAKIEAEMKSIEAKQERKRARGDGWLGEKTTEATGRAEAKREAAEARRSQEAERTDEQAAQIRKTGHIPSSISCWCWCL

SEQ ID NO: 5036 - protein, 122 aa, Triticum aestivum
  unsure (1)..(122): unsure at all Xaa locations
QLLKTMDXSKMSSGDASFTVRFKLVAERNDFIHALVAYFNVSFTXCHKLMGFSTGPRSKSTHWKQTVLYLEDVVTICEGETLSGSMTVANNKKNPRDIDITLKYAINGNRCKVSRTQHYKMR

SEQ ID NO: 5037 - protein, 249 aa, Triticum aestivum
  unsure (1)..(249): unsure at all Xaa locations
MEERGKVVCMAKLAEQAGRYDDMVDFMKKLARMDVDMSVEERHLFSVGFKNTIGARRASWRILSSLEQKVAAGEQAGRMISVYRTKVEDELRMVCNEILSIIAIHCLPLANAGENVVFFHKMKGDYYRYLAEFSTGVEKKSAADQSLMAYQHAMVVAXTELSPAHPIRLGLALNFSVFFYDIMNCHQRACQVAKQAFDEATTEINSAGMDGNNDSTLMMQLLNDNLALWKSELTEGETSKDSDIDMEEG

SEQ ID NO: 5038 - protein, 186 aa, Triticum aestivum
MVEEGRSLAETPTWSVATVTTFMVAACFLIERSLSRLAKWLQKTKRKAMLAALEKIREELMLLGVISLLLSQTARWISEICVPSTLFTSKFYMCTEKDFADLDQHGDSSANDTHIARILVGGQSMHVCDEGHEPFVSYEGLEQLHRFLFILGFTHVLYSFVTVVLSMIKIYSWRKWETQASTLSRE

SEQ ID NO: 5039 - protein, 341 aa, Triticum aestivum
MGAGVSSFFFGAAAEAAPGAAGLGDLPELCAAQVLLRLDAPEICRLARLNHAFRGAAGADFVWEAKLPENYRHLIGYVEGGGEEGRRRRRRAGTKEIYARLSRPVSFDDGTKEFWLEKSKGRVCMALSSKALVITGIDDRRYWTHMPTTESRFQSVAYLQQIWWFEVVGELDFCFPVGTYSLYFRVHLGKFSKRFGRRVCSTEHVHGWNKKPVRFQLSTSDGQNALSQCYLDEPGSWVLYHAGDFVSTNPGQALKLKFSMAQIDCTHTKGGLCVDSVLVYPKGFQQEKVVTGKISEMWRSSCSCSGGACTARVVDKRSLQPNPIIKLGSGMQRMKRLCKEL

SEQ ID NO: 5040 - protein, 178 aa, Triticum aestivum
MVGSGMQRGAPLVVGRVIGDVVDPFVRRVALRVGYASRDVANGCELRPSAIADPPRVEVGGPDMRTFYTLVMVDPDAPSPSDPSLREYLHWLVTDIPGTTGVSFGTEVVCYEGPRPVLGIHRLVFLLFQQLGRQTVYAPGWRQNFSTRDFAELYNLGLPVAAVYFNCQRETGTGGRRM

SEQ ID NO: 5041 - protein, 180 aa, Triticum aestivum
MVGSGMHAQRGDPLVVGRVIGDVVDPFVRRVALRVGYASRDVANGCELRPSAIADPPRVEVGGPDMRTFYTLVMVDPDAPSPSDPSLREYLHWLVTDIPATTGVSFGTEVVCYEGPRPVLGIHRLVFLLFQQLGRQTVYAPGWRQNFSTRDFAELYNLGLPVAAVYFNCQRETGTGGRRM

SEQ ID NO: 5042 - protein, 471 aa, Triticum aestivum
  unsure (1)..(471): unsure at all Xaa locations
PPPRRDGGPHPDPAARCPARPPMPQGRKLDPWSPSAPDALPSIACACTSLKTLFLEECRITDNGTEWLHDLAANNPVLVTLNFYLTYLRVEPADLELLAKNCKSLISLKISDCDVSDLIGFFQIATSLQEFAGAEIXEQKYGNVKLPSKLCSFGLTFMGTNEMHIIFPFSAVLKKLDLQYSFLTTEDHCQLIAKCXPNLLVLALRNVIADYTPGGGPXTWSNCKSVTGVRGDAESGMREEEGALGQVGLSAIAVGSSVVGDLAAYVSDITNGALESIGTFCKNLHDFRLVLLDKQETITDLPLDNGARALLRGCTKLRRFALYLRPGGLSDVGLGYIGQHSGTIQYMLLGNVGQTDGGLISFAAGCRNLRKLELRSCCFSERALALAIRQMPSLRYVWVQGYRASQTGRDLMLMARPFWNIEFTPPSTETAGRLMEDGEPCVDRQAQVLAYYSLSGKRSDYPQSVVPLYPA

SEQ ID NO: 5043 - protein, 169 aa, Triticum aestivum
  unsure (1)..(169): unsure at all Xaa locations
MAAAAAGSSAASLPAPIPLNDKAAAAVGGGVGGDRAAGGCGVCAICLDRIPLQETALVKGCDHAYCVTCILRWASYKQTPVCPQCKHPFEFLSVHRSLDSCLHDYMFDESVCLLLRAXTWFKPLVVEAHEEAQEEEDIYRSYQYDXAMRMTLYEEYISRSPSIRIGNRR

SEQ ID NO: 5044 - protein, 179 aa, Triticum aestivum
ILLATFQIDRVGRRPLLLTSTAGMLVCLIGLGTGLTVVGQHPDEKITWAVGLCIASTLAYVSFFSMGLGPITSVYVSEVFPLRVRALGFALGVACNRVTSAAISMTFLSLSKAITIGGSFFLYAGLAALGWLYFYAFVPETRGQPLEDIGKLFGMKDAAVEDDDTATKDKQVKAAVEMN

SEQ ID NO: 5045 - protein, 176 aa, Triticum aestivum
TSPKSMMIAQVIGTAMGCIISPLTFMLFYKAFDIGNPDGTWKAPYALIYRNMAILGVEGFSVLPKYCIAISGGFFAFAAIFSIARDVMPHKYAKYVPLPMAMAVPFLVGRSVPPPGRLGSLIVFAWTKINEKEAGFMVPAVASALICGDGIWTFPASILALAKIKPPICMKFLPAA

SEQ ID NO: 5046 - protein, 219 aa, Triticum aestivum
MADEDEYRCFVGNLSWSTTDESLKDAFSKYGKVTEAKVVMDKFSGRSRGFAFVTFDEKKAMEEAIEDMNGLDLEGRAITVDKAQPQGAGRDRNGDRDFDRDRGSRGGRDYGGGRAARGSGGDCFKCGKPGHFARECPDGDGGRGDRYGGRDDRYGGGRSDRDRSDRGGDRSDRDRSDRGGDRSDRDGDRSERGSDRYSSRSRDGGSGGDRYSRDRSGPY

SEQ ID NO: 5047 - protein, 180 aa, Triticum aestivum
DMVIAEYYYDHFHLDLRAAGTIAACFGMANIVARPMGGYLSDLGARYFGMRARLWNIWILQTAGGAFCIWLGRASALPASVTAMVLFSICAQAACGAVFGVAPFVSRRSLGIISGLTGAGGNVGAGLTQLLFFTSSQYSTGRGLEYMGIMIMACTLPVTLVHFPQWGSILPHPAAITSEF

SEQ ID NO: 5048 - protein, 275 aa, Triticum aestivum
MYEHRRATWLTASAYKGHLLQPPYHITRSRTIPSTVEQKPKASDISPFRASSRNQMASNQNQASYHAGETKARTEEKTGQMMGATKDKAGQTTEATKQKAGETAEATKQKTGQATEATKQKAGETADATKQKAAEAKDKTAQTAQAAKEKTYETAQSAKERAAQGKDQTASTLGEKTEAAKQKAAETTEAARQKAAEATEAAKQKASETAQYTKESAVAGKDKTGSVLQQAGETVVNAVVGAKDAVSNTLGMGGDNKSNTAKDTTHQEDHQGSLD

SEQ ID NO: 5049 - protein, 245 aa, Triticum aestivum
MLAIGLLGGGIPKKELLVNFLLHPIPPIYFFLALARMSESELSVIKPESLKTYIWLQCFDGSIQQVEEEVAMFCPMICREIVKNGTGSSKNHAIALPERVNPSSLSLILDYCRFHQVPGRSNKERKSFDEKFVRIDTEKLCELTSAADSLQLKPLVDLTSRALARIIEGKTPEEIRDIFHLPDDLTEEEKLEPLKNINDDPRIRLLNRLYAKKRKELQERQKLKDIQVQQEQKDERSLDELLCFI

SEQ ID NO: 5050 - protein, 174 aa, Triticum aestivum
MGLRTLFPKQRRQSWSLRESAPAKPPFESLLSSPRPPPSFPPLAMLPSHLNGHSPLARRRPQLPAASPPAAAAVGDPPAAAAGDAALEAHDRVYFQSYSHIGIHESMIKDRVRTDAYREAIMLHQKFIEGKVVMDVGCGTGILSVFCARAGAKRVYAVDASEIATQASEIVKAN

SEQ ID NO: 5051 - protein, 186 aa, Triticum aestivum
MDRLKTSARLMIVSDLDHTMVDHHDSENLSLLRFNALWESNYRHDSLLVFSTGRSPVLYKKLREEKPMLTPDITIMSVGTEITYGNLMVPDAGWVEILNQKWDRSIVIEESKKFPELTLQAETELRPHKVSFYVEKDKAQAVSKALMECFEKHGLDVKIIYSGGMDLDILPQGAGKGQALAYLLKK

SEQ ID NO: 5052 - protein, 91 aa, Triticum aestivum
MSYYNQQPPVGAPPPQGYGDKGGYPPPGYPPAGYPPPAQGYPPAGYPQQGYPPQYAQQPPPHQQQQQSSGPSFMEGCLAALCCCCLLDACF

SEQ ID NO: 5053 - protein, 91 aa, Triticum aestivum; identical to SEQ ID NO: 5052

SEQ ID NO: 5054 - protein, 91 aa, Triticum aestivum; identical to SEQ ID NO: 1881

SEQ ID NO: 5055 - protein, 341 aa, Triticum aestivum
  unsure (1)..(341): unsure at all Xaa locations
MAGGGGAGGLSESVMRKVLLSYCYVAVWIFLSFAVIVYNKYILDPKMYNWPFPISLTMVHMSFCSSLAVGLVRVLCVVDPPSSPXMTPQLYTVSVLPIGALYAMSLWFSNSAYIYLSVSFIQMLKALMPVAVYSIGVLFKKETFRSSAMLNMLSISFGVAIAAYGEARFDLRGVALQLAAVAFEATRLVLIQILLTSKGISLNPITPLPWVFLGRLGFLFLAWVFVELPRLRAVGMFEPDFFVFGTNLLCAFALNLDVFLLVGQXRRLIAFSWSVIRDTVTPINLFGYGIAFLGVGYYNHIKLQALKAKEAHKKSAQPDEEAGSLLQERDSHSDRKSENQA

SEQ ID NO: 5056 - protein, 75 aa, Triticum aestivum
MKFGSIYEEYLRAEQDKYLAKCSHVEYKRLKKVLKRCRLDRSLQADGTNGDQQEDRSDDSSDACDCNSCTCMLSL

SEQ ID NO: 5057 - protein, 86 aa, Triticum aestivum
  unsure (1)..(86): unsure at all Xaa locations
MKFGSIYEEYLRAXQDKYLAKCSHVEYKRLKKVLKRCRLDRSLQADGTNGEQQEDRSDDSSDACDCNSCTLCDQMFFTELTKETQI

SEQ ID NO: 5058 - protein, 102 aa, Triticum aestivum
MKFGSIYEEYLRAEQDKYLAKCSHVEYKRLKKVLKRCRLDRSLQADGTNGDQQEDRSDDSSDACDCNSCTLCDQMFFTELTKEASDIAGYFSSRVQHLLNLH

SEQ ID NO: 5059 - protein, 113 aa, Triticum aestivum
MKFGSIYEEYLRAEQDKYLEKCSHVEYKRLKKVLKRCRLDRSLQADGTNGDQQEDRSDDSSDACDCNSCTLCDQMFFTELTKEASDIAGYFSSRVQHLLNLHVPSGLQRYIWR

SEQ ID NO: 5060 - protein, 92 aa, Triticum aestivum
MHPISAATVRLCLVCLALLLLTRDVRSRNLVGAVVQKERHKQSHGGHGGATPEPPVEEGSDAGAKRGQLQRDLTRWEEIHTDYIYTQDVKHP

SEQ ID NO: 5061 - protein, 169 aa, Triticum aestivum
  unsure (1)..(169): unsure at all Xaa locations
MISSISLLDSSHQLIHKLYRKCWPSNSNAKLNMHSTAKSGGKSMRLKMALLKPHATDFKRNHQAHEEDNVFYKLVYRLPESLSCLSASQKPVRKKKQQKQGTVPSNRFGVILEWEGVCXEDDDPDLEPRGWYVLSLEEAKSFPPDEMLKEIEGMRTDRLXKIVGEDQKK

SEQ ID NO: 5062 - protein, 173 aa, Triticum aestivum
IIDDCSDISARFEKAVTTESNGGDNNGSLSEEQTDRQLKITRASVTAKEIKKVDDNYFGSYSSFGIHREMLGDKVRTDAYRDALLDNPSLMNGATVLDVGCGTGILSLFAAKAGASRVVAVDGSAKMSSVATQVTKNNGLLYDENAQTKQKGSPQVISVVHTKAEELDHKIVV

SEQ ID NO: 5063 - protein, 480 aa, Triticum aestivum
  unsure (1)..(480): unsure at all Xaa locations
MALKASFPGELAALLDSGNTRSRRGAAFRPRQHQRKVDFTFQRRDKRAAYLRTCCSMQQGPPPAWPGRAVVEPERRSWEGPKPISIVGSTGSIGTQTLDIVAENPDKFRVVALAAGSNVTLLADQVRTFKPKLVAVRNESLLNELKEALAGCEEMPEIIPGEQGVIEVARHPDAVTVVTGIVGCAGLKPTVAAIEAGKDIALANKETLIAGGPFVLPLAHKHNVKILPADSEHSAIFQCIQGLSEGSLRRVILTASGGAFRDWPVEKLKDVKVADALKHPNWSMGKKITVDSATLFNKGLEVIEAHYLFGAEYDDIEIVIHPQSIIHSMIETQDSSVLAQLGWPDMRLXPILYTLSWPDRVYCSEVTWPRLDLCKLGSLTFKAPDNVKYPSVDLAYAAGRAGGTMTGVLSAANEKAVELFIDEKISYLDIFKVVEMTCDAHRNELVTRPSLEEIIHYDQWARKFAANLEPSSSGRSPVLA

SEQ ID NO: 5064 - protein, 93 aa, Triticum aestivum
MHPRSASTVRLCLVCLVLLLLTRDAHSRNLVGAVVVQKEKHKQSHGGHGAATLEPWGEEGSNAGAKRRQLQRDPTKWEEIHTDYIYTQDVKHP

SEQ ID NO: 5065 - protein, 129 aa, Triticum aestivum
MASNQNQASYAAGETKARTEEKTGQMMDKAGQATEATKQKAGETAEATKQKAGEAKDKTAQTAQAAKDRAVQSKDQTGSFLGEKTEAAKQKAAETAEAAKQKTSETAQYAQERSSDAAQYTKESAIAGQ

SEQ ID NO: 5066 - protein, 159 aa, Triticum aestivum
EFMSTLVNYKIPLAVASRRPRKAVEAAIEAVGARGFFDAVVAAEDVYRGKPDPELFLYAAQLLGFIPERCVVFGNSNSAVEAAHDARMKCVAVASKHPVYELGAADLVVKRLDELSIVDLKNLADIDSPEFGMEPEPEMEEEEDEAPPSTAVGVDDIFL

SEQ ID NO: 5067 - protein, 125 aa, Triticum aestivum
MSFFRSFFTRATSPGTMSQASTKVQQLIDNNSVVVFSKSYCPYCKQTKKTLDDLNTEYELLELDEVSDGSAPQDALEKISGQRTVPNVYIKQQHIGGNSDLHSLNSGGKLKNLLKEANALKASKL

SEQ ID NO: 5068 - protein, 106 aa, Triticum aestivum
MSQASTKVQQLIDNNSVVVFSKSYCPYCKQTKKTLDDLNTEYELLELDEVSDGSALQDALEKISGQRTVPNVYIKQQHIGGNSDLQSLNSGGKLKNLLKEANALKA

SEQ ID NO: 5069 - protein, 498 aa, Triticum aestivum
  unsure (1)..(498): unsure at all Xaa locations
PRVRKTCYVQFPQRFDGIDLHDRYANRNIVFFDINMKGLDGIQGPMYVGXTGCCFNRQALYGYDPVLTEADLEPNIVVKSCCGGRKKKSKSYMDNKNRMMKRTESSAPIFNMDDIEEGIEGYEDERSMLMSQKRLEKRFGQSPIFTASTFMTQGGIPPSTNPASLLKEAIHVISCGYEDKTEWGKEIGWIYGSVTEDILTGFKMHARGWISIYCMPPRPCFKGSAPINLSDRLNQVLRWALGSVEILFSRHCPIWYNYGGRLKLLERVAYINTIVYPITSLPLIAYCVLPAICLLTNKFIIPEISNYAGMFFILMFASIFATGILELRWSGVGIEDWWRNEQFWVIGGTSAHLFAVFQGLLKVLAGIDTNFTVTSKANDEDGDFAELYVFKWTSLLIPPTTVLVINLVGMVAGISYAINSGYQSWGPLFGKLFFSIWVILHLYPFLKGLMGKQNRTPTIVIVWSILLASIFSLLWVKIDPFISDTQKAVAMGQCGVNC

SEQ ID NO: 5070 - protein, 303 aa, Triticum aestivum
  unsure (1)..(303): unsure at all Xaa locations
MVYIKNQKTRAYSKRFQVKFKRRRQGKTDYRARLRLTNQDKNKYNTPKYRFVVRFTNKDVTAQIVYATIAGDIVMAXAAYSHELPRYGLEVGLTNYAAAYCTGLLLARRVLKNRDLDEEYEGNVEATGEDFSVEPSDERRPFRALLDVGLIRTTTGNRVFGALKGALDGGLDIPHSDKRFAGFKKDEKSLDAEIHRKYIFGGHVADYMRSLADEEPEKFQTHFSEYIKRGISADDMEAVYKKVHAAIRADPTMAKSTKAPPKTHKRYNPKKLTYEQRKASLVERLNALNNSAGAADDDEDDDE

SEQ ID NO: 5071 - protein, 302 aa, Triticum aestivum; identical to SEQ ID NO: 4226

SEQ ID NO: 5072 - protein, 109 aa, Triticum aestivum
MASNQNQASYRAGEAKGHTQEKTGQVMGAAKDMAYEAKDRATDMAEHASGQGQGTTEATKQKAGEATDKASQTAQAAKDKAASTVQAANDRTVESKDQTGTFLGEKSAP

SEQ ID NO: 5073 - protein, 72 aa, Triticum aestivum
GGSAISYGVYFYNATRGSLTTLSSLTFLTPMFASIFGFLYLGETFSPVQLGGALLTLVAIYMVNYKSIVGEK

SEQ ID NO: 5074 - protein, 140 aa, Triticum aestivum
  unsure (1)..(140): unsure at all Xaa locations
MAEEKHHHHLFHHKKDDEPATGVDSXYGEGVYTSETVTTEVVAGGQDEYERYKKEEKQHKHKQHXLGEAGALAAGAFALYEKHEAKKDPENAHRHKXTEEIAATAAVGAGGYAFHEHHXKKKDHKXAEESTGEKKHHLFG

SEQ ID NO: 5075 - protein, 378 aa, Triticum aestivum
MSMLACALQTKGSTCLRHHFVNEAEAANNTRTADIDGGILQGTKPDQHVHKLLLLSAGESGKSTIFKQIKCVVIHCLVPKNCIDEYSTVSYKVAKVQPESSKYVILPDNQEIGEKLSEIGGRLDYPLLNKELVQDVRKLWEDQAIQETYSCGSVLQVPDCAHYFMDNLDRLAEADYVPTKEDVLHARVRTNGVVEIQFSPLGESKRGGEVYRLYDVGGQRNERRKWIHLFEGVDAVIFCAAISEYDQLLFEDETQNRMMETKELFDWVLKQRCFEKTSFMLFLNKFDIFERKIQKVPLTVCEWFKDYEPIAPGKQDVEHAYEFVKKKFEEVYFQSSKPERVDRVFKIYRTTALDQKLVKKTFKLMDESMRRSREGTGT

SEQ ID NO: 5076 - protein, 270 aa, Triticum aestivum
ERVVFVGDSMSRTQWESFICMLMPGVEDPKTVYEVNGNEISKTIRFLGVRFASFDLTVEFFRSVFLVEQRPAPRHAPKRVKSTLRLDKMDNISRKWVNADVLIFNTGHWWTPTKLFNTGCYFQAGRALKLGTTIDAAFRMALQTWASWVEKRVDLNRTHVFFRTYEPSHWSDLNQTICEVTEKPSPEAKGNDKSELGDILGDVVASMNVPITVLNVTLMGAFRTDAHVGAWSYPPTILDCSHWCLPGVPDAWNELVFSYLFTNGWRKMAG

SEQ ID NO: 5077 - protein, 260 aa, Triticum aestivum
FIFFSVKDKVVLVTGGSRGIGEMIATGFVQGGAKVYISSRSSKACDEVAAKLNALGPGKCMALPADLQKLEDVKELVAEISKREDHLDVLVNNAGATWGAPLDEYPDAAFQKVMNLNVNRIFTFTQACLPLLRANATADSPSRVINIGSINGISPPALETYAYSSSKAALHQLTRHLAGQLGSEHILVNAVAPGSFPSKMMSATLKNFGDMIIAGVPVGRVGTPEDIAGTCIYLSSRAGQYTVGAIITVDGGALQKRAKL

SEQ ID NO: 5078 - protein, 409 aa, Triticum aestivum
  unsure (1)..(409): unsure at all Xaa locations
MAAATTTTSRPLRLSRQQAAASSLQCRNQPLSGSRPGVDSEQASPPNVRRMAVVDSGAAPEEEQLRQRSSXDMITLTXEQEGVIENEMTIVLSSISTACKQIASLVQRAPISNLTGVQGATNVQGEDQKKLDVISNEVFSNCLRWSGRTGVIASEEEDVPVAVEESYSGNYIVXFDPLDGSSNIHAVESTGSIFRMYSLSDECHIGDDANCRRXTLDELTQMCIVNVCQPGSNLLAAGYCMYSSSVIFVLTIGTGVYVFTLDPMYGEFVLTQEKVQIPKSGKIYSFNEGNYALWDDKLKKYMDSLKEPGTSGKPYSARYIGSLVGDFHRTMLYGGIYGYPSDQKSKNGKLRLLYECAPMSFIAEQAGGKGSDGHQRVLDIMPTAVHQRVPLYVGSVEEVEKVEKFLSSE

SEQ ID NO: 5079 - protein, 409 aa, Triticum aestivum
MAAATTTTSRPLLLSRQQAAASSLQCRLPRRPGSSLFAGQGQASTPNVRCMAVVDTASAPAPAAARKRSSYDMITLTTWLLKQEQEGVIDNEMTIVLSSISTACKQIASLVQRAPISNLTGVQGATNVQGEDQKKLDVISNEVFSNCLRWSGRTGVIASEEEDVPVAVEESYSGNYIVVFDPLDGSSNIDAAVSTGSIFGIYSPSDECHIGDDATLDEVTQMCIVNVCQPGSNLLAAGYCMYSSSVIFVLTIGTGVYVFTLDPMYGEFVLTQEKVQIPKSGKIYSFNEGNYALWDDKLKKYMDSLKEPGTSGKPYSARYIGSLVGDFHRTMLYGGIYGYPSDQKSKNGKLRLLYECAPMSFIAEQAGGKGSDGHQRVLDIMPTAVHQRVPLYVGSVEEVEKVEKFLSSE

SEQ ID NO: 5080 - protein, 201 aa, Triticum aestivum
MEWAYSGGGHSSSGTKSPAAGGREEGSYMTVSSAPPKRRAGRTKVRETRHPVYKGVRSRNPGRWVCEVREPHGKQRLWLGTFDTAEMAARAHDVAALALRGRAACLNFADSPRTLRVPPQGAGHEEIRRAAVEAAELFRPEPGQRNAATTEAPAASPADAGNAELVANSPYHLMDGLEFEMQGYLDMAHGMLIEPPPMAGP

SEQ ID NO: 5081 - protein, 222 aa, Triticum aestivum
  unsure (1)..(222): unsure at all Xaa locations
LFSLSLVDENKVTIGASGAIPALVLLLGNGSQRGKKDAATALFNLCIYQGNKGKAVRAGLVPILLELLTETESGMVDEALAILAILSSHPEGKAAISAAAAIPILVGVIRNGSSRNKENAAAVLVHLCNGEQQQQHLAEAQEQGIVTLLEELAESGTDXRGKRKAIQLLERMNRFLKQQSQAQGDANGTGACSVPNPVPGSGSSSSRYSARGITASYIISSS

SEQ ID NO: 5082 - protein, 103 aa, Triticum aestivum
MDSGGGATAIRVPYRHIRDAEMELVRLNSTNSTGGDAERPKEEQGSGAEAGEGGRKGAPKWRVVLACMVAAGVQFGWALQLSLLTPYIQTLGIDHAMASFIWL

SEQ ID NO: 5083 - protein, 157 aa, Triticum aestivum; identical to SEQ ID NO: 631

SEQ ID NO: 5084 - protein, 266 aa, Triticum aestivum
  unsure (1)..(266): unsure at all Xaa locations
MDRELEEANCKFAWLKLACAEDELDSCATLLSELKVLLTKFPSMPPSFERTPNAVAELRLARAIYEFAVIFSIKVKDQDAFERNFFQLKVFYMDTRGILPPSPEEYRILGLNLMRLLAENRVSEFHTELELLPPRALDHPCIKYAVELEQSFMEGTYNRLTNGRQAVPHETYLYFMDLLAETVRDEIADCSGQAYDHLPVDDTRKMLMFSSEQKLLEYISEIXHEWEVQNHSVLFHMAKVQPRVGIQAHQMIKRXXCYARELERXV

SEQ ID NO: 5085 - protein, 299 aa, Triticum aestivum
MANTDALSFFKDFMAGGISAAVSKTAVAPIERVKLLLQVQAASTQIAADKQYKGIVDCFVRIPKEQGALSFWRGNLANVIRYFPTQALNFAFKDIYKQIFLGGVDKNTQFWRYFAGNLASGGAAGASSLCIVYPLDFARTRLAADIGKGPADRQFSGLGDCLKKTFKSDGLVGMYRGFGVSVQGIIIYRAAYFGFFDTAKGMLPNPKTTPFLVSWAIAQTVTTVAGIASYPFDTVRRRMMMQAGRKKADIMYTGTLDCWAKIAKNEGTGAFFKGAFSNVLRGTGGALVLVFYDEIKKLL

SEQ ID NO: 5086 - protein, 114 aa, Triticum aestivum
FGRGLCREQALGEVSQELLDTQVNPAVWEISGHIVLKRRSDYEEASETSAWKLLAEVSLSEERFEEVKAYIFSAAGLVLSDEEEEEASEGKGTTTFAPVPVSPMPVAEGCLVHQ

SEQ ID NO: 5087 - protein, 87 aa, Triticum aestivum; identical to SEQ ID NO: 4188

SEQ ID NO: 5088 - protein, 71 aa, Triticum aestivum
DDNEYPFEDGDLDDGLDPAMQEELDREVEDFARRLNSVWPERMHLGQERRIESQLIGGNGSLQRFSVFNHR

SEQ ID NO: 5089 - protein, 236 aa, Triticum aestivum
MSREENVYMAKLAEQAERYEEMVEYMEKVAKTVDVEELTVEERNLLSVAYKNVIGARRASWRIVSSIEQKEESRKNEEHVNLIKEYRGKIEAELSNICDGILKLLDSHLVPSSTAAESKVFYLKMKGDYHRYLAEFKTGAERKESAESTMVAYKAAQDIALAELAPTHPIRLGLALNFSVFYYEILNSPDKACNLAKQAFDEAISELDTLAEESYTEGTPFVQPRGVYWTLPSSAE

SEQ ID NO: 5090 - protein, 258 aa, Triticum aestivum
  unsure (1)..(258): unsure at all Xaa locations
RSRPGRETSSHQTINPLEYNQPWQRPHDTEAVEKQPDSDFKHIDQAPSKVSSDIDADHGFTPEEQRSIIKRIDRRLVITVGAMDCVSLMDRTNMSAANIAGMGAELQLTGFRYNIANLAFFIPYIIXQPPSAILIRRIGPRFHLAIITLLWGAVMIGMGFVEKFPQLAALRAVLGFFEAGFFPSCVYLLSTWYTRYEVGKRYSVFYLLGCVASAFSGILAYGLMQLNGREGLTGWRWIFIIEGALTCALGIAGYWLLX

SEQ ID NO: 5091 - protein, 1003 aa, Triticum aestivum
  unsure (1)..(1003): unsure at all Xaa locations
VGVLHLAGHQVEELWEVNGAIAISVDFIDHVLELSLRWVLPQRTHDCSQLLGGDATISVLVEEAEGLLELGDLVVGELIRHAAGAVVDRWIGREAASERARSGRRRGRGWARRTREQTERGLSGSIGNVAWKERVDGWKMKQDKGAIPMTNGTSIAPSEGRAATDIDASTEYNMEDALLNDETRQPLSRKVPIASSKINPYRMVIVLRLVVLSIFLHYRLTNPVRNAYPLWLLSVICEIWFALSWILDQFPKWFPINRETYLDRLALRYDREGEPSQLAAVDIFVSTVDPLKEPPIVTANTVLSILAVDYPVDKVSCYVSDDGASMLTFDALAETSEFARKWVPFVKKYDIEPRAPEFYFCQKIDYLKDKVQPSFVKDRRAMKREYEEFKIRINALVSKALKVPXEGWIMQDGTPWPGNNTRDHPGMIQVFLGHSGGLDTEGNELPRLVYVSREKRPGFQHHKKAGAMNALVRVSAVLTNGQYMLNLDCDHYINNSKAVREAMCFLMDPNLGPQVCYVQFPQRFDGIDRNDRYANRNTVFFDINLRGLDGIQGPVYVGTGCVFNRTALYGYEPPMKNKESGLFSKLCGGRTSKSKRSTGSKKSDKHADGSVPVFNLEDIEEGVEGAGFDDEKSLLMSQMSLEKRFGQSSVFVASTLMEYGGVPQSATPESLLKEAIHVISCGYEDKSEWGTEIGWIYGSVTEDILTGFKMHARGWRSVYCMPKRPAFKGSAPINLSDRLNQVLRWALGSVEILFSRHCPLWYGYGGRLKFLERFAYINTTIYPLTSLPLLVYCILPAICLLTGKFIMPEISNLASIWFIALFLSIFATGILEMRWSGVGIDEWWRNEQFWVIGGISAHLFAVFQGLLKVLAGIDTNFTVTSKANDEEGDFAELYMFKWTTLLIPPTTILIINMVGVVAGTSYAINSGYQSWGPLFGKLFFAFWVIVHLYPFLKGLMGRQNRTPTIVIVWAVLLASIFSLLWVRVDPFTTRLAGPNIQTCGINC

SEQ ID NO: 5092 - protein, 503 aa, Triticum aestivum
MVATAKIPQRQLFIDGDWRAPALGRRLPVINPTTEASIGEIPAGTSEDVDAAVAAARAALKRNRGRDWSRAPGAVRAKYLRAIAAKMVERKSDLARLEALDCGKPLDEAAWDMDDVAGCFEFFAGHAEALDKRQNAAVALPENFKCHLKKEPIGVVALITPWNYPLLMAVWKVAPALAAGCTAVLKPSELASLTCLELGDVCKEIGLPSGVLNIVTGLGHEAGAPLSSHPDVDKVAFTGSYATGQKIMVAAAPTVKPVTLELGGKSPIVVFDDVDIDKAVEWTLFGCFWTNGQICSATSRLLIHKNIAKEFVDRMVAWSKNIKVSDPLEEGCRLGPVVSEGQYEKIKKFVANAKSEGATILTGGVRPKHLEKGFFIEPTIITDINTSMEIWREEVFGPVLCVKEFSTEEEAIELANDTHYGLAGAVISGDRERCQRLAEEIDAGCIWVNCSQPCFCQAPWGGNKRSGFGRELGKGGIDNYLSIKQVTEYTSDAPWGWYKAPAN

SEQ ID NO: 5093 - protein, 399 aa, Triticum aestivum
  unsure (1)..(399): unsure at all Xaa locations
MGTEPTMLQRWSSSMWGMSGGDRLRLWEDKAWRAHAAMAFTQLAYGGYHVLTKSVLNVGMNQIVFCVYRDLVALALLAPAAYFRERRVRRPVTPQLLGSFALLGFTGIFGNQLLFLLGLGFTNASYAAAFQPAIPVFTFLLAAIVGVEVIHVFTRDGVFKVVGTXVCVFGALLMVFYRGPSLIGLGGANALAGADASWSGSSYPAQWLTPAVLQFSFGTWNLGVLCLLGNCFLMGAYLVIQAPVLVKYPASLSLTAYSYSFATIFMVLTGVFATNGLHEWALTGTEIIAVLYAGVVASCLNYAIMTWANKILGPSLVALYNPLQPACSTILSTIFLGTPIYLGSLIGGVFIIAGLYLVTWARYNEAQRILMSGYLNPLLVEVEDAPAPKRQENSSSIDP

SEQ ID NO: 5094 - protein, 151 aa, Triticum aestivum
  unsure (1)..(151): unsure at all Xaa locations
MSSLMDKAKGFVAEKIAHIPKPEASLDSLSFKGMSRECITVHSNVNVSNPYDHRLPICELTYTLKCAGNVVASGTMPDPGWIAASDTTKLEIPAKIPYDFLISLVKXVGRDWDIDYQLDVGLTIDLPIVGNFTIPLSTSGEMKLPTLKDMF

SEQ ID NO: 5095 - protein, 356 aa, Triticum aestivum
PGRPSRPNLACPRACRPAGLGLVGPGCRGLRDGGLLFSWAMHQVSNHLTTLQVMLPNITEGGSLSNMLENCMYCAMGLGLVGLDFRCLLPPIFENAVLNLFSKNMSTAVENFQVVLDSHRWVPMPSIGFVTNGAVDDTSDDVTPPSVLMEHPPLAVFVNGVSAAMNELKPCAPLSLKHVLAQEVVKGLQAVSDSLVRYNAMRMLRGNESSLFLSLCQAFIEVAYPYCAACFGRCYPNGGVLITECPSLLDAVSQLPIRSGSGISSIDRKSSGGIERRQSGGIERKQTGGIERKQLEGIERRQSGGIERRQSIESAGTAASENGLVTNGPEPEVTSDAGTTAEPAGADMQTDAPANA

SEQ ID NO: 5096 - protein, 405 aa, Triticum aestivum
MGRKLALLVGINYPGTKAELKGCHNDVDRMHKCLVDRFGFDEDNITVLLDRGSSGPQPTGANIRHALAKLVGDARRGDFLFFHYSGHGTRLPAETGQDDDTGYDECIVPSDMNHGTRLPAETGQDDDPGYDECIVPSDMNLITDQDFRDLVQKVPDGCIFTTQSRETEEERSHSGGGFRSFLKETVRDAFESHSRHGADSFYEQPTGDPQTKNRSLPLSTLIEMLKEQTGKDDIEEGSIRLARCKVFGDDASPKIKKFMKVMLDKFHEGGSGEQGGVMGMVGSLAHQFLKAKLEATEEETFKPAIEQDMGSAEEAYAGTKSWAPNNGILISGCQTSQTSADATIPGGTSFGAMSNAIQAILASDDGKITNKDLVMKARAALSKQGYTQQPGLYCSDEHVHVAFIC

SEQ ID NO: 5097 - protein, 237 aa, Triticum aestivum
SSVYAQLFLQLSNHARTTLLSTLGGDLFLASLTAHPSLRAAVVADLLAARARDPACVGFSHCLLNYKGFLAIQAHRVAHVLWAQNRRPLALALQSRVADVFAVDIHPAAVVGKAILLDHATGVVIGETAVVGDNVSILHHVTLGGTGKAVGDRHPKIGDGVLIGAGATILGNVMIGAGAKIGAGSVVLIDVPARSTAVGNPARLIGGRKGESDKDEDMPGESMDHTSFIRQWSDYTI

SEQ ID NO: 5098 - protein, 341 aa, Triticum aestivum
  unsure (1)..(341): unsure at all Xaa locations
MKFGSIYEEYLRAEQDKYLAKCSHVEYKRLKKVLKRCRLDRSLQADGTNGEQQEDRSDDSSDACDCNSCTLCDQMFFTELTKETSDIAGYFSSRVQHLLNLHVPSGLQRYIWRVRQCFIDDQQIMVQEGRLLVNYVTMNAIAIRKXILKKYDKVHGSVSGRDFRSKMQSEHTELLQSPWLIELGAFHLNCDSSDIDEPVGFFKNGFFKNFSCDLTGTQPVMTMAISETIKYDYSLTCPICLDTLFNPYALSCGHLFCKGCACGAASVYIFQGVRSAPPEAKCPVCREVGVFAHAVHMNELDLLIKTRCKDYWRCRLREERTEMVKQSKEYWESQAMLSMGI

SEQ ID NO: 5099 - protein, 133 aa, Triticum aestivum
EYDQMLCEDETKNRMMETKELFDWVLKQRCFEKTSFMLFLNKFDIFERKIQKVPLSACEWFKDYQPIAPGKQEVEHAYEFVKKKFEELYFQSSLPDRVDRVFKIYRTTALDQKLVKKTFKLIDESMRRSREGT

SEQ ID NO: 5100 - protein, 370 aa, Triticum aestivum
  unsure (1)..(370): unsure at all Xaa locations
WGGSTVVGGRYASEGAARGRGLGAGGSGGGEMGEERGEGRPEDEEARCGRLPPGRRAEVGRRAEASGRERWPARKALVSCACGCRRSRDAGVRVVRPPAVSGKITFPSSLKQPGPREFPMQCFIKRNKKNSTFYLYLGLTTATVDKGKFLMAARRFRRGPHTEYIISLDADDLSQGSNAYMGKLRSDFWGTNSKVYDSKPPHDGAKASSSRSSRRFGSRRISPQVSAGNYEXGQLSYKYNLLKSRGPRRMYCALECPSPQETWENSLKTKFRKPMGTTVLRNKAPRWHEHLQCWCLNFHGRVTVASVKNFQLSVAADPNDPTGSRDEETVLLQFGKVDDDIFTMDYRQPLSAFQAFAISLSSFGTKLACE

SEQ ID NO: 5101 - protein, 84 aa, Triticum aestivum
MKVKILQWHAVASWTWDAQDETCGICRMAFDGCCPDCKFPGDDCPIIWGACNHAFHLHCILKWVNSQTSIPLCPMCRREWQFKG

SEQ ID NO: 5102 - protein, 165 aa, Triticum aestivum
  unsure (1)..(165): unsure at all Xaa locations
LVPIIRDNLNLAKADIGNAGVASVSGSIFSRLAMGAICDLXGPRYGCAFLVMLAAPTVFCMSLIDDAAGYITVRFLIGFSLATFVSCQYWMSTMFNSKIIGTVNGLAAGWGNMGGGATQLIMPLVFHAIQKCGATPFVAWRIAYFVPGLMHVVIGLLVLTMGQDL

SEQ ID NO: 5103 - protein, 161 aa, Triticum aestivum
DSDEGWYKIFPFTVTPSCSISCANLKSAFLLDIIILVVTTCITVASVQEPQSLGSDEADHPSTEQEAFLWELFGSFRYFTLPVWMVLIVTALTWIGWFPFILFDTDWMGREIYRGSPDDPSITQSYHDGVRMGSFGLMLNSVLLGFTSIVLEKLCRKWGAG

SEQ ID NO: 5104 - protein, 359 aa, Triticum aestivum
  unsure (1)..(359): unsure at all Xaa locations
MAAEMGVGGEKFQLGTVGALGLSVVSSVSIVICNKALMSSLGFTFATTLTSWHLLVTFCSLHVALWMKFFEHKAFDSRTVMGFGVLNGISIGLLNLSLGFNSVGFYQMTKLAIIPCTVILETTFLQGRNSCRTTQIFPFRASFGCTVVATMTDLQLNAVGYILSLLXIITTCIAQIMTNTIQKKFKVSSTQLLYQSCPYQSLTLFLIGPFLDGFLTNQNVFXAFNYTSNVVFFIVLSCLISVSVNFSTFLVIGKTSPVTYQVLGHLKTCLVLTFGYVLLHDPFSWRNILGILIAVVGMVLYSYFCSTETQPKNTDVSAQQSKEGDSAPLISDSLSKVENGGDDDEPLKVPMWSSKYSRA

SEQ ID NO: 5105 - protein, 165 aa, Triticum aestivum
MSLGSHHHPLLFDHPTPTPPAPPPPLSFHLHPPPPPPPHQHHQQHQQHQLAIDPSPSSSLFPPPPHHHPHHLHHLDLAVDPHRHHHDYQRDQHSDEMQQRPPPAMEEGSQQLHHQDAVDEAEEELGAMKEMMYRIAAMQPVDIDPATIKKPRRRNVRISEDPQSV

SEQ ID NO: 5106 - protein, 422 aa, Triticum aestivum
MSREVQRDPVLPFALAVFQPCYAPVGRERVLLESPSRPSGLFPLLPFLSLVFLCIGAQFSSAFAPRSSFFSIMFFVLPSLHPPSSPSAQALIAAAIDMYKYNTSTHQIGSAASALDQELMKALEPFITIACSSSSHYPYHYYSSPSMTQDSYMATPSSSSYASSFAASPLPTTAPASPSFSQLPPLYSSHSGVNGSMGLAQLGPAQIQQIQAQFFVQQQQQQRGLAGGSFLGPRAQPMKQSGSPPRASAAALALAGVAPAQSKLYRGVRQRHWGKWVAEIRLPKNRTRLWLGTFDTAEDAALAYDKAAFRLRGDLARLNFPSLRRGGAHLAGPLHASVDAKLTAICESLAAPSSKNSEPESPKCSASTEGEDSASAGSPPPPTPPVPEMEKLDFTEAPWDESETFHLRKYPSVEIDWDSILS

SEQ ID NO: 5107 - protein, 230 aa, Triticum aestivum
  unsure (1)..(230): unsure at all Xaa locations
MAAAVVDAAVPVAAKANGAGARCCAAKGPGYATPREAMEKGPREGLLYVTCVYNGTGIDKPDYLATVDVDPNSATYSQVIHRLQATHIGDELHHSGWNACSSCHGDPSTSRRFLILPSLLSGRLYVVDTAKNPRAPALHKVVQAEDIAEKTGXLGFPHTSHFALQTGDIMISCLGDKEGNAAGNGFLLLDSEFNVTGRWEKPGHSPGXGYDSGTXXXSQTMISSSWGXRF

SEQ ID NO: 5108 - protein, 193 aa, Triticum aestivum
FFFDFSLTYVGAGMICSHLVNLSLLFGAVLSWGVMWPLMSKQEGKWYSAKASASSMSGLYGYKAFLCIALLIGDGFYNFLKVILVTLKSIHEKSQRGRLNRVADEDSVAIDDLQRNEVFNRDNIPAWVTYAGYALLSAIAVVAIPLMFREVTRSRPSSALRSPFAPASSAPPLSSASHFYQLELPCMDEHLNL

SEQ ID NO: 5109 - protein, 298 aa, Triticum aestivum
  unsure (1)..(298): unsure at all Xaa locations
MRAMASGGGNWLGFSLSPHMAMEVPSSEPDHAQAQPASASAMSASPTNAATCNLLFSQPAQMAAPPPGYYYVGGAYGDGTSTAGVYYSHHSVMPITSDGSLCIMEGMMPSSSPKLEDFLGGGNGSGHDAVTYYSHHQQQQDQQDQEASRIYQHHQQQLAPYNFQXLDTFGQRTSQYRGVTSRHRWTGRYEAHLWDNSCKKDGQTRKGRQVYLGGYDNEDKAARAYDLAALKYWGPSTNTNFPLENYREEVEEMKSMTRQEFVAHLRRRSSGFSRGASIYRGVTRHHQHGRWQARIGRV

SEQ ID NO: 5110 - protein, 487 aa, Triticum aestivum
  unsure (1)..(487): unsure at all Xaa locations
MALSVEKTSSGREYKVKDLFQADFGRLELELAEVEMPGLMACRTEFGPSQPFKGARISGSLHMTIQTAVLIETLTALGAEVRWCSCNIFSSQDHAAAAIARDSAAVFAWKGETLEEYWWCTERCLDWGVGGGPDLIVDDGGDATLLIHEGVKAEEEFEKSGKVPDPESTDNPEFKIVLTIIRDGLKTDAXSKYRKMKERLVGVSEETTTGVKRLYQMQESGTLLFPAINVNDSVTKSKFDNLYGCRHSLPDGLMRATDVMIAGKVAVVCGYGDVGKGCAAALKQAGARVIVTEIDPICALQALMEGIQILTLEDVVSEADIFVTTTGNKDIIMVDHMRKMKNNAIVCNIGHFDNEIDMNGLETYPGVKRITIKPQTDRWVFPETKTGIIVLAEGRLMNLGCATGHPSFVMSCSFTNQVIAQLELWNEKASGKYEKKVYVLPKHLDEKVAALHLGKLGARLTKLTKSQSDYISIPIEGPYKXLRLYRY

SEQ ID NO: 5111 - protein, 109 aa, Triticum aestivum
MDHAADAQRTDLMTITRHALNEQGRHPESRGDFTILLSHIVLGCKFVASAVNKAGLAKLIGLAGETNVQGEEQKKLDVLSNEVFVKALVSSGRTCVLVSEENEAAIFVD

SEQ ID NO: 5112 - protein, 127 aa, Triticum aestivum
MAKGAGYGLGFVCFALVAAMAGAVQFKVGGDSGWSVAGASKESYNTWAMKNRFQVGDTLVFVYPKDKDSVLVVQPSDYNACNTSSYDKKFADGNTVFTLDHAGAFFFVSGVEANCRANEKLIVMVLP

SEQ ID NO: 5113 - protein, 246 aa, Triticum aestivum
MCGGAIISDFIPERDHRGGSKRSLCTADFWPHAAAAAFDDPTDHHDLYPADLTGAGAFPPQHQAEEEPSRKRERKTMYRGIRRRPWGKWAAEIRDPAKGARVWLGTFATPEGAARAYDRAARRIRGTKAKVNFPGAGGAPAPPRHAVGQLLAPGGGASPSMRQQQRPVVVAFRPQINSLAAVAREEFPDLHRYAHILQSGDVDLRAVAAGGNTPGQSSSSTPAHDSRSPPRPDDRGYGERSAGPGC

SEQ ID NO: 5114 - protein, 103 aa, Triticum aestivum; identical to SEQ ID NO: 683

SEQ ID NO: 5115 - protein, 220 aa, Triticum aestivum
MDPFYTSFSDSFLSIPDHRSPVSDSSECSPKLASSCPKKLAGRKKFRETRHPIYRGVRQRNSGKWVCEVREPNKKSRIWLGTFPTVEMAARAHDVAALALRGRSACLNFADSAWRLRIPESTCPKEIQRAAAEAAMAFQNKTATTETTMVEAVKPAEETVGQTGGETMEENGVFYMAEEAVLGMPRFLENMGEEMLLPPPELGWNHNDLAGDADVSLWSF

SEQ ID NO: 5116 - protein, 362 aa, Triticum aestivum
  unsure (1)..(362): unsure at all Xaa locations
MVGLTSKYYHLLPKRSSQPNKPMPACSSSERANIDALLSKLCSPDPEEQRSAAAELRLLAKRNAHNRLCIAEAGAIPXLLLSLLSSSDLRTQEHAVTALLNLSIHEDNKASIMSSGAVPSVVHVLNNGSMEARENAAATLFSLSVVDEYKVMIGGTGAIPALVVLLSEGSQRGKKDAAAALFNLCIYQGNKGRAIRAGLVPLIMGLVTNPTGALMDEAMAILSILSSHQEGKAAIGAAEPVPALVELLGSGSPRNRENAAAVMLHLCSGEQQLVHLARAHECGIMVPLRELALNGTERGKRKAVQLLERMSRFMVQQQEEQESHSRLQAAAAQVLPQAPEQVQESEIPDQLESPASQYPTLL

SEQ ID NO: 5117 - protein, 379 aa, Triticum aestivum
  unsure (1)..(379): unsure at all Xaa locations
MATAGKVIKCKAAVAGEAGKPLSTEGVEVAPPQAMEVRVTVLDPALCPKAVYFRVAKGQTPVFARLLGHEAXGLVDRGGGGGRGLGAGDDVARGLGEQREERPHCACEDSNLRHLFNTKVERSGMIGDGQCRVAIDGKPLSHHVGXSTFNVSTVIQVRGLPQSYPETPVAQVRLVRLSVPTGRGATLNVAKPKEGMTVTGSSLGAVGLAAMGGARMSGASRIVGVDLNPAKHEQAKKFGCXDFVNPKDHTKPVQEVLVEMTDGGVDRAVECTGNVDAMISAFECVHDGWGVAVLVGVAHKEAVFKTHPMNFLNERTLKGTFFGNYKPRTDLPGVVEMYMRKELELDKFITHSVPFSQINTAFDLMLKGEGLRCVIRMDE

SEQ ID NO: 5118 - protein, 186 aa, Triticum aestivum
MATAGKVIKCKAAVAWEAGKPLSIEEVEVAPPQAMEVRVKILYTALCHTDVYFWEAKGQTPVFPRILGHEAGGIVESVGEGVTELVPGDHVLPVFTGECKDCAHCKSEESNLCDLLRINVDRGVMIGDGQSRFTIGGKPIFHFVGTSTFSEYTVIHVGCLAKINPEAPLDKVCVLSCGISTGLGAT

SEQ ID NO: 5119 - protein, 133 aa, Triticum aestivum
  unsure (1)..(133): unsure at all Xaa locations
MATAGKVIKCKAAVAWEAGKPLSIEEVEVAPPQAMEVRVKILYTALCHTDVYFWEAKGQTPVFPRILGHEAGGIVESVGEGVTELVPGDHVLPVFTGECKDCAHCKSEESNLCDLLRINVDRGVMIGDGEXRF

SEQ ID NO: 5120 - protein, 110 aa, Triticum aestivum
  unsure (1)..(110): unsure at all Xaa locations
LHIAALQPVEVDPEAVRPPKRRNVRTSKXDPQSVAARLRRERISERIRVLQRLVPGGTKMDTASMLDEAIHYVKFLKSQVQSLELAAAATGAAAHRAAAFAYPAMQHAPW

SEQ ID NO: 5121 - protein, 148 aa, Triticum aestivum
  unsure (1)..(148): unsure at all Xaa locations
MPVPLAPYPTPPVPFTPPAPNAGAQSQLXVCSGCRNLLMYPAGATSXVCCAVCSTVTAVPAPGTEMAQLVCGGCHTLLMYIRGATSVQCSCCHTVNLAMEANQVAHVNCGSCRMLLMYQYGARSVKCAVCSFVTSVGASSGAEQKPSN

SEQ ID NO: 5122 - protein, 298 aa, Triticum aestivum
MAGAAAQQQQQKGGGAVRVGGGGPAPFLTKTHQMVEERGTDEVISWGEQGRSFVVWKPVELARDLLPLHFKHCNFSSFVRQLNTYGFRKVVPDRWEFANENFRRGEQGLLSGIRRRKATATTTTPQSSKTSGTGVNVAFPPPLPALRPASASTSGTGNDHSSSSASSPTRPDLSSENEQLRKDNHALAAELALARRHCEELLGFLSRFLDVRQLDLRLLMDGDMQGAAGAGGARSADQEHCCEKKVKLFGVILKDASARKRGRCDEAAASERSMKMTRIGEPWVGVPSSCPARCGGGN

SEQ ID NO: 5123 - protein, 147 aa, Triticum aestivum
  unsure (1)..(147): unsure at all Xaa locations
RRLILTSVAAGGVQNRWALQLSLLTHYVQTLGLSHALTKFMWMCRPIDGLVAQPYVGLYNDKRTCRWRRHTPSIVTGCIHIRIDVVVIGCXADIGADLGDSNEESNLYHEPLWHAINEDDPGYCLLDLSNNTVQGADSALMADDNLT

SEQ ID NO: 5124 - protein, 146 aa, Triticum aestivum
AGAFGSVLSGVGDASSDQWFVDQLNAPPPGSIERGRSEASSIVSEVPDYLFGFDTTSEEPSPGAGAQPKSDAEVAQGDDDDDAPAPVLGAPLVPYVPESAPWPAPPPPYMAQPVYYVPVRPVHYLNAAAHGGYMPGPVYHIVGGGR

SEQ ID NO: 5125 - protein, 422 aa, Triticum aestivum
MDKLKGSARLMIVSDLDHTMVDHHDEENLSLLRFGALWESVYCQDSLLVFSTGRSPTLYKELRKEKPMLTPDITILSVGSEITYGEAMVPDHGWEEYLNNKWDRNIVLEETAKFSELKLQVETEQRPHKVSFLVDKKNAQGVIKSLSEKFEKRGVDAKIIYSGGQDLDILAQGAGKGQALAYLLKKLGSCGKTPNNTLACGDSGNDAELFSIPGVHGVMVSNAQEELLQWHAENAKDNPKIIHATERCAAGIIQAIGHFKLGPNVSPRDVEFPYIKEDPFKPTAAIVKFYVLYEKWRRADVPKADSVIEYFKNTTDANGVIIHPSGVELSIHSSIDELASCYGDKQGKKYRSWVDRLVILQTAPDSWLVRFDLWEAEGNAWACCFTTLALNVKPETPGGFVVTHIHKTWRKEYPGVEQSSKL

SEQ ID NO: 5126 - protein, 241 aa, Triticum aestivum
  unsure (1)..(241): unsure at all Xaa locations
TDVGVICLPPSLEWKPVMGMLAFDLISAVMTALVKKALEQGLNRLVLVTLRXVANIFLAPIAFFKERSTRPKLTLEVLAYLFFSAVFGATLSQYTFFYGLQYTTSTFAITFINLSPVLTFLIAVVMRMEPLKLKSMVGAAKITGTLTSLAGLLLLSLYKGVPLTHQAATAPSPAAHHAAPSDSSGNRSWMLGTMALLFNCLCFSFWLLLQTKLTKIPDHLLQYCHHVFQYMSSTFHRTNVN

SEQ ID NO: 5127 - protein, 442 aa, Triticum aestivum
  unsure (1)..(442): unsure at all Xaa locations
HAQGKSAILVRTETSPEDVGGMHAAAGILTARGGMTSHAAVVARGWGKCCVSGCSSMRVNEIEKVVAIEDKMLYEGDWISLNGSTGEVILGKQPLSPPALSADLETFMSWVDEVRQLKVMANADTPGDALAARKNGAEGIGLCRTEHMFFASDERIKAVRQMIMAPTVELRQKALDRLLPYQRSDFEGIFRAMDGLPVTIRLLDPPLHEFLPEGHVEDIVRELCAETGAAEDDVLARMEKLSEVNPMLGFRGCRLGISYPELTEMQARAIFEAAISMTNQGIQVFPEIMVPLVGTPQELGHQVALIRQIANNVFTNMGKTIDYKVGTMIEIPRAALVADEIAEQAEFFSFGTNDLTQMTFGYXGILQHDPFEVLDQRGVGELVKIATERGRKARPNLKVGIXGEHGGEPSSVAFFAKAGLDYVSCSPFRVPIARLAAAQVLV

SEQ ID NO: 5128 - protein, 306 aa, Triticum aestivum
  unsure (1)..(306): unsure at all Xaa locations
EYSHCVRGRVGNKLVLNDPSLPKSVLMKKKNKPKLSMKESMKVLISSKYVRDLATLVMAYGISINLVEVTWKSKLKAQIPSPNEYSSFMAFFSTTTGSATFTIMLLGWMIFXRFCWVQTSLITPTVLLLPGVXFFSLFXFEQPLTSLLATWGMTPLLAAVYVGALQNIFSKSAKYSLFDPCKEMAYIPLDGDMKLKGKAAIDVVCNPLGKSGGALIQQFLILIFGSLANSTPYLGGILLVIVLAWLGAARSLDKQFSSLAKEDLRKEMSKEKVETAAPKEPESATDVLVEQSNGTENSPSDSSPAQ

SEQ ID NO: 5129 - protein, 235 aa, Triticum aestivum
  unsure (1)..(235): unsure at all Xaa locations
AHTSCLSPSLSLSCQAHTPPALTLPSLLSPHSILLHHTKHTFSLSSPMAVAIAEAPFHVLAVDDSVLDRKLIERLLKTSSFQVTTVDSGTKALEFLGLHDEDASISSVHADQLDVEVNVNLIITDYCMPGMTGYDXLKKIKESSSFRDIXRCLEEGANEFFLKPVRLSDMSKLEPYIMKSRCNQHCHQDKPLLSNSARNQGKHMTPGRRPAKQQRRPTSQNNRQQAAIPSPFSGQ

SEQ ID NO: 5130 - protein, 108 aa, Triticum aestivum
MTSSSSHHHDASSATSTPRAGAGSTTSSNGNGNGGGGSHHHPPPPRAQPHGAACVRLMCSFGGRILPRPGDHQLRYVGGETRIVSVPRTTSHAVLFAALAKLAPALFV

SEQ ID NO: 5131 - protein, 241 aa, Triticum aestivum
MERNNRVHISSNYGRSHEDCLDNSMKHMQLKPNTVETTYTGQHAASAPLYQMNKTGATGAPDPGTEGSHPDQTSDQAGGANGSMDCIHPTLPVDPKIGSSSTAQPFPHNYAGFAPTMQCHCNQDANRSSLNMSSTFSNMLVSTLLSNPTVHAAARLAASYWPAADSNIPVGPNQEVFAENAQGRHIGSPPSMASVVAATVAAASAWWATQGLLPLFAPPIPRCGSKRPGKDAQDFDPKEGG

SEQ ID NO: 5132 - protein, 97 aa, Triticum aestivum
MAAAVADAAVPAAARANGAGAGCCAAKGPGYATPREAMEKGPREGLLYVTCVYNGTGIDKPDYLATVDVDPNSATYSQVIHRLPATHIGDELHHSGW

SEQ ID NO: 5133 - protein, 165 aa, Triticum aestivum
MASEHAAAGEGKHEKQSLMDKAKEFVADKIAHIPKPEATLDAVTFKGLSRECITLHSSVNVSNPYDHRLPICEVTYTLRCAGREVASGTMPDPGWIAASGTTSLEIPAKVPYDFIVSIVRDVGRDWDLDYELQVGLTVDLPIVGNFTIPLSTSGEFKLPTLKDLF

SEQ ID NO: 5134 - protein, 309 aa, Triticum aestivum
  unsure (1)..(309): unsure at all Xaa locations
MAAAGDAGEKKMVTLKSSDGEEFEVEEAVAMESQTIRHMIEDDCADNGIPLPNVTSKILSKVIEYCNKHVQAKPADAADAGAAAPDACASAGSNMCSALPFVVGPGMRRDGTTRFRDSQGEPLHDFLAVSSFSQYTVVDVNQVVKVDPAVPPKLACLLGCGAGTGVGAAWRLAKVQPGSSVVIFGLGAVGLSVAQGAKMCGAAKIIGVDLNPDKEELGKKFGVTDFVNPSKLGESPLSQVIIEMTGGGADYCFECIGAASVMTEAFRSAKQGNGKTVILXVXEKDGKPISLASXEVLFGKCVMGSLFGG

SEQ ID NO: 5135 - protein, 229 aa, Triticum aestivum
MGRGKIEIKRIENATNRQVTYSKRRSGIMKKARELTVLCDAQVAIIMFSSTGKYHEFCSTGTDIKGIFDRYQQAIGTSLWIEQYENMQRTLSHLKDINRNLRTEIRQRMGEDLDALEFEELRDLEQNVDAALKEVRQRKYHVITTQTETYKKKVKHSQEAYKNLQQELGMREDPAYGFVDNPVAGGWDGVAAVAMGGGLAADMYAFRVVPSQPNLHGMAYGGSHDLRLG

SEQ ID NO: 5136 - protein, 229 aa, Triticum aestivum
MGRGKIEIKRIENATNRQVTYSKRRSGIMKKARELTVLCDAQVAIIMFSSTGKYHEFCSTGTDIKGIFDRYQQAIGTSLWIEQYENMQRTLSHLKDINRNLRTEIRQRMGEDLDALEFEELRDLEQNVDAALKEVRQRKYHVITTQTETYKKKVKHSQEAYKNLQQELGMREDPAYGFVDNPVAGGWDGVAAVAMGGGSAADMYAFRVVPSQPNLHGMAYGGSHDLRLG

SEQ ID NO: 5137 - protein, 160 aa, Triticum aestivum
MALKASFPGELAALLDSGNTRSRRGAAFRPRQHQRKVDFTFQRRDKRAAYLRTCCSMQQGPPPAWPGRAVVEPERRSWEGPKPISIVGSTGSIGTQTLDIVAENPDKFRVVALAAGSNVTLLADQVRTFKPKLVAVRNESLLNELKESVAGCEEMPEIIP

SEQ ID NO: 5138 - protein, 107 aa, Triticum aestivum
MALKASFPGELSSLLDSGTTRSRRGAAAAFRHRQRQRKVDFTFQRRDKRAAYLRTCCSMQQGPPPAWPGRAVLEPERRSWEGPKPISIVGSTGSIGTQTLDIVAEKP

SEQ ID NO: 5139 - protein, 204 aa, Triticum aestivum
RDGEGAGRRGGHEAEGRRGRAGDVRDGPGRQGPGRRGPQPAAKPGQVTGAAKDEACDAKDRASGAAGQATGKGQGAVEATKQKAGEAGQKTSETAQAGKDRAAEGKDRTGSYLGHATEGTKQKASEATGYTQDRASDAAQYTKDSAVAGKDKTGSVLSQAGEQVKNAVVGAKDAVASTLGMGGDNTSSATKDASTTETITKSRH

SEQ ID NO: 5140 - protein, 159 aa, Triticum aestivum
  unsure (1)..(159): unsure at all Xaa locations
RRTPIDLMPFLGPEETSQSEPLESTFIFEDREFSELENLAMNIQGIRKGMEHDRGGRNQGCGEAEMTDDFWEELLSEGMRDEAEILELERRRSRYVDAXAQKLGHLSKSDPKFTRIHNHLIYIPLSLIAILYIVVQIYSHRLDCIAVPTPDYVVYIVVV

SEQ ID NO: 5141 - protein, 345 aa, Triticum aestivum
DAWVRFHWCPFGRLAQLPSFFEEGESPPPVTFHDFMGQHVFPENLSVSAAPGTHPCPYVAYLHPLPSLASSSSSHVPERTMDGSAYHDHWNHLAGPSDGRPLQTVQPTDFHHNHWAHGGKEEKAAIGNWLYANGSRPSTHLPHSYVQSNSNNGVTEQPGVPFGSMRAARVDGDSQRRGSVVSPSYFSNGSGSRSRAPNVPPLVPQFMRAHGNINEQYTQSSSSSLFAGAHRSGGMRPAPPPPQPENPTFCLFPPGSSGHSSMDTDEAGGSRFYAWERDRFAPYPLMPVDCETSWWSSQQSHGASESTPAPAPRRLFGQWIGLGRSSPENRSPEGSSYRQMHSPRM

SEQ ID NO: 5142 - protein, 434 aa, Triticum aestivum
MGAGAEPREEEPLEVEEGAGGKEEKAAVSCSICLDAVVAASAERSTARLQCGHEFHLDCIGSAFNAKGVMQCPNCRKIEKGNWLYANGSRPSHDINMDEWAHEEDLYDVSYSEMPFRFHWCPFGRLAQLPSFFEEGESPPPVTFHDFMGQHVFPENLSVSAAPGAHPCPYVAYLHPLPSLASSSSSHVPERTMDGSAYHDHWNHLAGPSDGRPLQTVQPTDFHHNHWAHLPHSYVQSNGNNGVTEQPGVPFGSMRAARVDGDSQRRGSVVSPSYFSNGSGSRSRAPNVPPLVPQFMRAHGNINEQYTQSSSSSLFAGAHRSGGMRPAPPPPQPENPTFCLFPPGSSGHSSMDTDEAGGSRFYAWERDRFAPYPLMPVDCETSWWSSQQSHGASESTPAPAPRRLFGQWIGLGRSSPENRSPEGSSYRQMHSPRM

SEQ ID NO: 5143 - protein, 126 aa, Triticum aestivum
  unsure (1)..(126): unsure at all Xaa locations
MSARDRETIEALARVAAALDGAVLGLGTAALAAASLAKYLAASGALRLIAEAPAVAIPDLRYSLLAGLGDGESRLAAVRGXVRSPPGGTFLIPPGSREHCVVXRHTQTCLFGEWRGIFGWTDLHAL

SEQ ID NO: 5144 - protein, 283 aa, Triticum aestivum
  unsure (1)..(283): unsure at all Xaa locations
RARALALSSNTSLRSQSPAPPLRSXEGRREEMAATEGVLLGMGNPLLDISAVVDDAFLTKYDIKLNNAILAEEKHLPMYDELASKSNVEYIAGGATQNSIRVAQWMLQTPGATSYMGCIGKDKFGEEMKKNAQAAGXTAHYYEDETAPTGTCAVCVVGGERSLIANLSAANCYKSEHLKRPXENWALVEKAKYIYIAGFFLTVSPDSIQLVAEHAAANNKVFLMNXSAPFICESSVIPKRRPPVSDYILRNETEESLANQRMETENMRRCLKILNFLGGNKDA

SEQ ID NO: 5145 - protein, 162 aa, Triticum aestivum
MQPKARIPADPPAPELDRIDCLPDSLVLLILNKLEDVHSLGRCAAVSKRFNDLVPLVHDVYVKIDRVVAVDGDPDDALNLSSPKPRNILSHFLKLMLFTIAKPFHGARGPGGAGGRPLFPRLAHHSPAQVLRSFTHVRNLHIELPSGDVGTEDGVLLKWRAE

SEQ ID NO: 5146 - protein, 95 aa, Triticum aestivum
GLLAYCRKQHGENFPDKMVPCASGFQSRIGFGMIGLGDSICLFGGVIGPGPRNQCIKPLSDVDILNVASERPTWRQGSPMTRCRGSIAGCALLKI

SEQ ID NO: 5147 - protein, 236 aa, Triticum aestivum
  unsure (1)..(236): unsure at all Xaa locations
PAVPGDESVMSLXRGNTANVILYFPTHALNFTFRDKSYKKSGHQKDKDDYTMWMPVNLAYAGAAGATSLLFHYSLDYSRTHLDNHDKNFNPGADRQVNCLDHVYKKNLASDDIDISLPRTACPSXDDIVNHRDRYFIMYDSISPDVLSDNLQGNFLASIDPGRIVPTGDTIHTYPLDTIRXTHXMMTSGEDVKYNNTMDAARQIVSKEGVXTLFKGADATIXRADDGAAVLSIYHQ

SEQ ID NO: 5148 - protein, 92 aa, Triticum aestivum
MVECTMVSTLLDGLPNEVALQCLARVPFVSHPILQLVCRSWRASVRNGELLNVRNQIGATEELLCVLAFEPENIWQLYDPRRDKWITLPVMP

SEQ ID NO: 5149 - protein, 143 aa, Triticum aestivum
  unsure (1)..(143): unsure at all Xaa locations
KDRNKPIIFSMARLDRVKNLTGLVELYGKNPRLQELVNLVVVCGDHGNPSKDKEEQAEFKKMFDLIEQYNLNGHVRWISAQMNRVRNAELYRYICDTKGAFVQPAFYEAFGLTVIEAMTCGLPTFATAXXGGPGAIIATGDDD

SEQ ID NO: 5150 - protein, 151 aa, Triticum aestivum
QGQMLTLVEYLLLLYRALLPTPVWYRFFLNKEYGSLFSSLTTGLYLTFKLTSVVEKVQSFLSAVKALSRKDVHYGSYATAEQAIAAGDMCAICQEKMHVPVLLRCKHIFCEDCVSEWFERERTCPLCRALVKPADIRSFGDGSTSLFFQLF

SEQ ID NO: 5151 - protein, 216 aa, Triticum aestivum
  unsure (1)..(216): unsure at all Xaa locations
MAGGFVKTQKTNAYFKRFQVKFKRRRAGKTDYRARIRLINQDKNKYNTPKYRFVVRFTNKDITAQIVSASIAGDMVLAAAYSHELPRYGLEVGLTNYAAAYCTGLLLARRVLKIRDLDQEYEGNVEATGEDFSVEPAEGRRPFRALLDVGLIRTTTGNRVFGALKGALDGXLDIPHSDKRFAGFKKDDKQLDADIHRKYIYGLHVAEYMKNLADEE

SEQ ID NO: 5152 - protein, 129 aa, Triticum aestivum
MGTAFSSSSSTPESRAMALAKAKEIVASAPVVVFSKSYCPFCVQVKKLFTQLGASFKAIELDTESDGPEIQSALAEWTGQRTVPNVFINGKHIGGCDDTVALNKGGKLIALLTEAGAISGSSSKTTVTP

SEQ ID NO: 5153 - protein, 113 aa, Triticum aestivum; identical to SEQ ID NO: 1711

SEQ ID NO: 5154 - protein, 94 aa, Triticum aestivum
MAAQEQEQQAKTSTTSSLPSSSDRSSSSGPNNLKEGGAESDEEIRRVPEMGGGSASSGAGDGKQLQLAAAGGGQAPAGKKRGRAAGDKEQNRLK

SEQ ID NO: 5155 - protein, 207 aa, Triticum aestivum
DGGAGGLQPLVLDVSRCTKIGARALETFGPHSRCLGALRRVMHPIDVAGRNACGQHDEARAIARTMPALRHLEVGYMLVTTEAILEVLSRCRGLEFVDLRGCWAVDEALLRERHPRLSVLGPGVDDCFENSYWEECSDDDDDDSDDDDDVYSWELMDDDEYYGVVGSDDDDEAVWGDGPGLVENLEVRFYGGGFSESYAGFDWPASP

SEQ ID NO: 5156 - protein, 76 aa, Triticum aestivum
MSAPYDPNQGYYPPQQGGYPPQGGYPPPQPMQYQQAPPPQEEKSHGCFYTCIATLCCCWVCGETCECCLECLDCCC

SEQ ID NO: 5157 - protein, 172 aa, Triticum aestivum
MPRMASLALARWVLLAAMAARLAGADDPYRYFTWIVTYGPINPLGAIQQGILINGQFPGPRIDCVTNDNLIVNVVNNLDEPFLITWNGIKQRKNSWQDGVAGTNCPIPPGANYTYKFQAKDQIGTFTYFPSVALHRAAGGFGALNVYQRPAIPVPYPPPAGDFTLLVGDWYL

SEQ ID NO: 5158 - protein, 165 aa, Triticum aestivum
TELRLHPYRTYGLDDEQPEPFPSLNAFEHPLGNFSLMPEDIDQRPGSSSLDGRRLACKRKNIEGVHGQFSGGASTSFSHRNDNAFHSVPSSSFNPAPGPNVSSHNFLLAPSSIEEQLPNYGATTIMSSVSYNHPSGGNNSSGNSQRSFRARTTTAQQSAFDELEA

SEQ ID NO: 5159 - protein, 142 aa, Triticum aestivum
  unsure (1)..(142): unsure at all Xaa locations
MALSSTFSLPRGFLGVLPQEHHFAPAVELQAKPLKTPRRRSSGISASLSEREAEYHSQRPPTPLLDTVNYPIHMKNLSLKELQQLSDELRSDVIFHVSKTGGHLGSSLGVVELTVALHYVFNTPQDKLLWDVGHQXYPHKIL

SEQ ID NO: 5160 - protein, 137 aa, Triticum aestivum
MGESEYRCWEELLPDALGLVFRNLPLQEVLTVVPRVCKSWGRVVAGPYCWQEIDIEEWSQQRHSRPDHLVRMLDLLLRRSSGACRRICVSGLPCDPLFSFIGDHARALRTLEIPRSEISDAVAASPASPATRSSPSS

SEQ ID NO: 5161 - protein, 274 aa, Triticum aestivum
MGRGKVQLKRIENKINRQVTFSKRRNGLLKKAHEISVLCDAEVAVIVFSPKGKLYEYATDSSMDKILERYERYSYAEKALISAESESEGNWCHEYRKLKAKIETIQKCHKHLMGEDLDSLNLKELQQLEQQLESSLKHIRSRKSHLMMESISELQKKERSLQEENKALQKELVERQKAAASRQQQQQQQQMQWEHQAQTQTHAHTQNQPQAQTSSSSSSFMMRDQQAHAPQQNICSYPPVTMGGEAAAAAAAPGQQAQLRIGGLPPWMLSHLNA

SEQ ID NO: 5162 - protein, 243 aa, Triticum aestivum
MSTAEATREENVYMAKLAEQAERYEEMVEFMEKVAKTADVGELTVEERNLLSVAYKNVIGARRASWRIISSIEQKEESRGNEAYVASIKEYRTRIETELSKICDGILKLLDSHLVPSATAAESKVFYLKMKGDYHRYLAEFKAGADALADLPTTHPIRLGLALNFSVFYYEILNSPDRACNLAKQAFDEAIAELDSLGEESYKDSTLIMQLLRDNLTLWTSDNAEEGGDEIKEAASKPEGEGH

SEQ ID NO: 5163 - protein, 262 aa, Triticum aestivum
  unsure (1)..(262): unsure at all Xaa locations
MSTAEATREENVYMAKLAEQAERYEEMVEFMEKVAKTADVGELTVEERNLLSVAYKNVIGARRASWXRIISSIEQKEESRGNEAYVASIKEYRTRIETELSKICDGILKLLDSHLVPSATAAESKVFYLEMKGDYHRYLQQFKAVTERYXVSLKFFMNYEQQSLLTMXPVETTHAIESXFEPLLDIEEKGSQSTSVNNVYLLVXAFDEAIAELDSLGEESYKDSTLIMQLLRDNLTLWTSDNAEEGGDEIKEAASKPEGEGH

SEQ ID NO: 5164 - protein, 200 aa, Triticum aestivum
  unsure (1)..(200): unsure at all Xaa locations
MVRGKTQMKRIENATSRQVTFSKRRNGLLKKAFELSVLCDAEVALVVFSPRGRLYEFASATSLQKSIDRYKAYTKDTVNNKTVQPDIQQVKADALSLAKKLEALEDTKRKILGENLGGCSTEELHFLEGKIEKSLRVIRGKKTQLLEQQIANLKEKERTLLKDNEXLRGKRNLEAPLFLPAPNCVAPLQPRGEPAPEHQP

SEQ ID NO: 5165 - protein, 168 aa, Triticum aestivum
  unsure (1)..(168): unsure at all Xaa locations
GGYXPDMEAMXQVKEMXYXAAAMRPVNLVXEPPAQGSSKXRXKNVXXSSDPQTVAARXRREXVSDRLRVLXKLVPGGSKMDXXSMLDEAASYLKFLKSQVQALETLGTTSSSTXASAAAAASTGRLQLHSQQHYYSNNPGFXGFARNNNNIXSXFRNPNGNXAKKKKK

SEQ ID NO: 5166 - protein, 187 aa, Triticum aestivum
  unsure (1)..(187): unsure at all Xaa locations
ALNFAFKDYFKRMFNFKKDKDGYWKWFGGNLASGGAAGASSLFFVYSLDYARTRLANDAKASXGGGERQFNGLVDVYRKTLKSDGIAGLYRGFNISCVGIIVYRGLYFGLYDSLKPVLLTGTLQVCSSTLPYTLLSSNFSCLRDNHXHPCSPFTCLQDNFFASFALGWLITNGAGLASYPIDTVRRR

SEQ ID NO: 5167 - protein, 274 aa, Triticum aestivum
  unsure (1)..(274): unsure at all Xaa locations
METKAKDAWGLALVLFLGQLVAFSMAAASFASSFLANLGVNTPLTQSFFAYLLLTLIYVPILLHRRQKPRIPWYWYLALAFVDVQGNYLVVKAYQYSSITSVTLLDCWTVVWVIILTWYALGTRYSFWQFVGAGTCVAGLGLVLLSDAKSTDEQDGGQMPLLGDALVIAGTVCFAFSNVGEEYCVKKNDRVELIAMLGLFGLFVSAIQIFIFERKSLEAVAWSPTMISLFAXFAVALLVFYTITPFVPQMSGSTLFNLSLXTSDMWAVAIRLLF

SEQ ID NO: 5168 - protein, 325 aa, Triticum aestivum
  unsure (1)..(325): unsure at all Xaa locations
MSFVHSPLLAGAWMSILVTSVGICNQDETLIDKHGLRFAHTWTVMHFATVTLLTLVMKWLGYVQPFHLPLSELVKFVFFANLSIVGMNVSLMWNSVGFYQIAKLSIIPLLCIMEVLFENFRYSRDTKLSIXVVLVGVGXVCTVSDVSVNAQGLVAAVIAVCGTALQQHYVNYLQRKYSLNSLKLLGHTAPAQAASLLILGPFVDFWLTRNRIDTFHYTSTVTFFIVLSCVISVGTNLSQFICIGRFTAVTFQVIGHMKTILVLTLGFLLFGKEGLNFHVAFGMILAIVGMIWYSSASSKPGGKERQGLASEKAQKSPQSELDDKV

SEQ ID NO: 5169 - protein, 818 aa, Triticum aestivum
  unsure (1)..(818): unsure at all Xaa locations
MGETAGERALSRIHSVRERIGDSLSAHTNEXLVAVFSRLVNQGKGMLQPHQITAEYNAAIPEAEREKLKDTAFEDLLRGAQEAIVIPPWVALAIRPRPGVWEYVRVNVSELGVEELSIAEYLQFKEQLANGSIDNNFVLELDFEPFNASFPRPSLSKSIGNGVQFLNRHLSSKLFHDKESMYPLLNFLRAHNYKGMTMMLNXDRIRSLSTLQGALRKAETHLSGLPADTPYSEFHHRFQELGLEKGWGDCAQRASETIHLLLDLLEAPDPSSLEKFLGTIPMVFNVVILSPHGYFAQANVLGYPDTGGQIVYILDQVRAMENEMLLRIKQQGLDITPKILIVTRLLPDAHGTTCGQRLEKVLGTEHTHILRVPFKTEDGIVRKWISRFEVWPYLEAYTDDVAHEIAGELQATPDLIIGNYSDGNLVACLLAHKLGVTHCTIAHALEKTKYPNSDLYWKKFEDHYHFSCQFTADLIAMNHADFIITSTFQEIAGNKDTVGQYESHMAFTMPGLYRVVHGIDVFDPKFNIVSPGADMSIYFPYTEQQKRLTSLHTEIEELLFSDVENAEHKFVLKDKKKPIIFSMARLDRVKNMTGLVEMYGRNPRLQELVNLVVVCGDHGKVSKDKEEQAEFKKMFDLIEQYNLIGHIRWISAQMNRVRNGELYRYICDMKGAFVQPAFYEAFGLTVIEAMTCGLPTFATAYGGPAEIIVNGVSGYHIDPYQNDKASALLVDFFGKCKEDPSHCNKISQGGLQRIEEKYTWKLYSERLMTLSGVYGFWKYVSNLDRRETRRYLEMLYALKYRKMAETVPLAVEGETSGK

SEQ ID NO: 5170 - protein, 229 aa, Triticum aestivum
  unsure (1)..(229): unsure at all Xaa locations
APLLEGMSTVEAKNAVSAANLAELALANPKRAKRIWANRQSAELSNERKLLYIGELEXKVQTLQTEATTLSAQLSLLQRDTSGLTSENSELKIRLQNMEQQVHLQDALNDTLKTEVQRLKVATGQMGNGGGMLMNYGGMSQAPHQFGGSQQMFHSNQSMQSLLATHQMQQLQLHQQPQQQQQPMRPQHHQQQQQPLHPLQAQQFQQAARDLKMKGPMWGDGKSPGGGGI

SEQ ID NO: 5171 - protein, 69 aa, Triticum aestivum
MEVEASAHGDTAASKFTLPVDSEHKAKSFRLFSFGNPHMRTFHLSWISFFTCFVSTFAAAPLVPIIRDN

SEQ ID NO: 5172 - protein, 155 aa, Triticum aestivum
MDGANLVRTRTIRSENGLKPAEHSSDNLQDMSSPCESPHAGKVKFMCSFGGKILPRPSDGVLRYVGGETRLISIPRNFSWKELVHKTLSLYNQPHTIKYQLPDEDLDALISLSCEEDLQNMMEEYYSLEKANGSPRLRIFLVSPNDCEETSLSAR

SEQ ID NO: 5173 - protein, 273 aa, Triticum aestivum
MATERESKTFLARLCEQAERYDEMVTYMKEVAKLGGELTVDERNLLSVAYKNVVGTRRASWRIISSIEQKEESKGSDKHVSTIKDYRNKIETELEKVCQDVLDVLDDFLIPNAATGESKVFYHKMKGDYHRYLAEFASGEKRKGAATAAHDAYKSATDVAQTELTPTHPIRLGLALNFSVFYYEILNSPDRACHLAKQAFDDAIAELDSLSEESYRDSTLIMQLLRDNLTLWTSSDSAEGEAAGAADAPKKEEGEAAKPAEEAAEEPAPAPAS

SEQ ID NO: 5174 - protein, 116 aa, Triticum aestivum
  unsure (1)..(116): unsure at all Xaa locations
DGVRLKKYRGMGSLEAMNRKDAKGAAMDRYFHNEMDKLKVAQGVSGAIVDKGSVRSFLXPYLACGIRHGCQDIGSRSLSALRSMMYSGELKLERRSNSAQAEGNVHSLFSYEKRLF

SEQ ID NO: 5175 - protein, 163 aa, Triticum aestivum
MARPQQRYRGVRQRHWGSWVSEIRHPLLKTRIWLGTFETAEDAARAYDEAARIMCGPRVRTNFPDDAAPSSSFLSPALVAKLHRFNVACGSQAGQQQDKDASTSSVGVDPRSPPAPFAGYTGNASAAAASAAAGWSGGFLEEQYVEQMIEELLDSNFSMEISY

SEQ ID NO: 5176 - protein, 166 aa, Triticum aestivum
MAAVATTTALHGSQAAGALAVAAQRLLVLLALAMEAVNNGADIFTEDQQEIIKQFGRIKSETVPENKDAGSDDDDDDDEDEDDETGDADDDDADAGEDFSGEEGEDDDEDEDPEANGDDAGAGSDDDDGDDDDDDGEDGEDDDDDDEDDDEEDEEDEDQPPAKKKK

SEQ ID NO: 5177 - protein, 115 aa, Triticum aestivum
  unsure (1)..(115): unsure at all Xaa locations
MPKADGDATLLIQSLNKAYAATPTNLKIIDLYVVFAVVTALVQVGYMGIVGSLPFNSFLSGVLSCIGTAVLAACLRIQVNKDNKEFKDLPPERAFAXDFVLCNLVLHLVIINFLG

SEQ ID NO: 5178 - protein, 283 aa, Triticum aestivum
MALPAPRWLRREVLVGLALGQFVSLLITSTGFSSSELARRGVNAPTSQSLLNYILLALVYGGIMIYKRQHLTVKWYYYLILSIVDVEANYIVVKAYQYTSLTSVMLLDCWAIPCVLFLTWIFLKTKYGLRKLFGVGICVAGVVLVVFSDVHASERKSKGPSPLKGDMLVIAGASLYAVSNVTEEYIVEKSSRIEVMAMLGVFGAIISGIQICPLGRAQPRSALSSAGPLLPCLGCAPAWFLCHSAVPIILKICGATMLNLSLLTSDMWAVLIRIFAYHEKVDW

SEQ ID NO: 5179 - protein, 213 aa, Triticum aestivum
MAGGSPMQSVLVARGVKGRKLHAFKRNGKDAGVTGVMRSIAGTEEQGAFFVFDLATVVDLYSRWCRALDGVRPYYAVKCNPEPAMLGAMAALGAGFDCASRAEIEAVLALGVVEPGSIVYANPCKPEAHLRYAAEVGVNLATYDTEDEVAKVKRCHPSCDLLLRIKGPDNPDAKIDLGTKYGARADEVVPLLRAAQRGGLRVAGVAFHVGACT

SEQ ID NO: 5180 - protein, 316 aa, Triticum aestivum
PYLAMVLLQVGFAGMYIVAVASLKRGMSHFVLVVYRNIVATVVMAPFALYFERGLRPKMTITIFIKIMGLALLEPVLDQNLYYMGANLTSAGFATALVNILPAVTFVLALILRMEKVRLRSLHSQAKIAGTVLTVAGAVLMVLYHGPVVQFPWAKGQHHAGSAAAAADGAAWLNGTIMAIAACVAWACFFILQSSTLRGYPAELSRAVPLRGMGSLMSGAIALVAERANTQAWVIGFDTRLFTAVYAGIVCSGVAYYVQGIVSRQRGPVFVTAFNPLCMIVTAVMGSIILKEEINLGSVIGAAIIVGGLYFLIWGK

SEQ ID NO: 5181 - protein, 289 aa, Triticum aestivum
RAAARAGTPMKAIVSLSSLLLETALTAEQRLMIETILKSSDFLVTLTNDVLDISKLGNGSLELDIAPFNLHAAFTDVVNLIKPVAACKRLSVMVSLAPELPSCAIGDRKRLMQIMLNVAGNSIKFTKEGHISIAASIARPDSLRDPYASNLHPVPSDGSFYLVVQVKDTGCGIGPEDMAHTFRKFAHGENATTKLHNGNGLGLALSRRFVGLMQGDIWLESEGVGKGCTATFFVKLGTPKKPNVNANPRRMMAPLQPSKGAGGHGADALSISIMDSDARGPRARYQSSG

SEQ ID NO: 5182 - protein, 150 aa, Triticum aestivum
QTNSEDEAAQKDENKANGSDSCIYSINARLKKFSDWLLDIIAMGDLDAFFPAATREYAPFVEEMWKDPAIQATYKRKDELHFLPDVAEYFLSRAIEVSSNEYEPSEKDVIFAEGVTQGNGLSFIEFTLDDRSPMSEPYIDNPEAHSQPLT

SEQ ID NO: 5183 - protein, 339 aa, Triticum aestivum
  unsure (1)..(339): unsure at all Xaa locations
MAFFSHHHLQQPHPAAPPPQQQQQQPAPLSFRNALPVPVDGQIPAPLAFFNAPPAFPDQAGQPQIVDAAGLTAAAGMGWRQPREQELLGENSQMSSIDFLQTGSAVSTGLALSLEDRRHGGGGAGAGNSSGDSPLLLLPMLDDDISREVQRLDADMDRFIRAQSERMRQSILEKVQAKQFEALASVEDKILRKIRDKESEVQNINKRNLELEDQIKQMAGEVGAWQQRAKYNESMISALKYNLEQVCAHQARSLKQARRACYCCPAGIFACAGAVNLQLMPKENASPPSLTACRVXKSSKVCMLLLPCRHLCLCKECESKLSFCPLCQSSKILGMEIYM

SEQ ID NO: 5184 - protein, 109 aa, Triticum aestivum
MAAGGVWVFRKDGVMELERQESSPATSQRGKALVYVPANETMRSLEALERRLGSLGWERYYENRDLVQLHRRDGGVDLIALPRDFARLRSTHMYDVVVKNRHQFKVVDI

SEQ ID NO: 5185 - protein, 304 aa, Triticum aestivum
MASTMPFSAGLVSLGSPPPQRHSCRFQRYHRPGTLISSAIRHGQVKAMAGVSMDGLAQPQAPVAVVTGASRGIGRAIAVALGKAGCKVVVNYAKSGMEAEEVCREIMESGGTAISFSADVSIEAEVETMMRAVIDTWGTLDVMVNNAGITRDALLMRMKKAQWQEVVDVNLTGVYLCAQAAAAVMMKRKKGRIINIASVAGMIGNIGQANYCAAKAGVIGLTKAMAREYGGRNINVNAVSPGWVASDMTAKLGDDIERKALETIPLGRFGKPEEIAGLVEFLAVHPAASYMTGQVLPVDGGLSI

SEQ ID NO: 5186 - protein, 142 aa, Triticum aestivum
MPVDLSKWSGPLSLQEVDEQPQHPLHVTYAGAAVDELGKVLTPTQVKNRPTSISWDGLDSGKLYTLVLTDPDAPSRKDPKYREWHHFLVVNMKGNDISSGTVLSDYVGSGPPKGTGLHRYVWLVYEQDRPLKCDEPILSNRS

SEQ ID NO: 5187 - protein, 153 aa, Triticum aestivum
MFWLAYALVFLGCLGLPPADAAVVEHTFSVGNLTIDRLGQRQVITAVNGQFPGPMLEARDGDAVVVHVVNYSPYNITIHWHGVLQRLSGWADGPSMVSQCPIRPGGATYTYRFNVTGQEGTLWWHAHVSFLRATVYGALLIRPGPDRPHYPFP

SEQ ID NO: 5188 - protein, 396 aa, Triticum aestivum
  unsure (1)..(396): unsure at all Xaa locations
METVAAAGYARGAATRSPACCAAMSFSQSYRPKAARPATSFYGESLRANTARTSFPAGRQSKAASRAALTTRCAIGDSLEEFLTKATPDKNLIRLLICMGEAMRTIAFKVRTASCGGTACVNSFGDEQLAVDMLAVKLLLDSVEYSHVXSSACSEEGPELQDMAAPVEGAFMXDTHLPGGTILGVCPGDKLTGVTGADQAAAAMGIYGPRTPCGFCLGHLRPTPEFLVVALKDCPDTQEFILIDEGKWQHVKDTRTIGERKEYSHGDKRATFDNHDYDNPVNYYVNEKYTLRYTGGMVPDVNQIIVKEKGIFTNVTSPTAKAKLRLLFEVAPLGFLIEKAGGHSSDGKQSVLDKVISVLDERTQVAYGSKNEIIRFEETLYGSSRLAASATVGATA

SEQ ID NO: 5189 - protein, 923 aa, Triticum aestivum
  unsure (1)..(923): unsure at all Xaa locations
MPPARWWTGGSGGRRRARSGRRRGRGWARRTREQTERGRERSVAWPGRNGAGDGWKMKQDKGAIPMTNGTSIAPSEGRAATDIDASTEYNMEDALLNDETRQPLSRKVPIASSKINPYRMVIVLRLVVLSIFLHYRLTNPVRNAYPLWLLSVICEIWFALSWILDQFPKWFPINRETYLDRLALRYDREGEPSQLAAVDIFVSTVDPLKEPPIVTANTVLSILAVDYPVDKVSCYVSDDGASMLTFDALAETSEFARKWVPFVKKYDIEPRAPEFYFCQKIDYLKDKVQPSFVKDRRAMKREYEEFKIRINALVSKALKVPEEGWIMQDGTPWPGNNTRDHPGMIQVFLGHSGGLDTEGNELPRLVSVSREKRPGFQHHKKAGAMNALVRVSAVLTNGQYMLNLDCDHYINNSKAVREAMCFLMDPNLGPQVCYVQFPQRFDGIDRNDRYANRNTVFFDINLRGLDGIQGPVYVGTGCVFNRTAIYGYEPPIKAKKPGFLASLCGGKKKASKSKKRSSDKKKSNKHVDSSVPVFNLEDIEEGXEGAGFDDEKSVLMSQMSLEKRFGQSAAFVASTLMECGGVPQSSTPESLLKEAIHVISCGYEDKSEWGTEIGWIYGSVTEDILTGFKMHARGWRSVYCMPKRPAFKGSAPINLSDRLNQVLRWALGSVEILFSRHCPLWYGYGGRLKFLERFAYINTTIYPLTSLPLLVYCILPAICLLTGKFIMPEISNLASIWFIALFLSIFATGILEMRWSGVGIDEWWRNEQFWVIGGISAHLFAVFQGLLKVLAGIDTNFTVTSKANDEEGDFAELYMFKWTTLLIPPTTILIINMVGVVAGTSYAINSGYQSWGPLFGKLFFAFWVIVHLYPFLKGLMGRQNRTPTIVIVWAVLLASIFSLLWVRVDPFTTRLAGPNIQTCGINC

SEQ ID NO: 5190 - protein, 149 aa, Triticum aestivum
  unsure (1)..(149): unsure at all Xaa locations
MAQPAKLSREENVYMAKLAEQAERYEEMVEFMEKVAKTGDSEELTVEERNLLSVAYKNVIGARRASWRIISSIEQKEESRGNEDRVTLIKDYRGKIEVELTKDLXXILNFLIPPCPSSTXPXSKVXYXXXKGEYYXYLAELXXGTERRI

SEQ ID NO: 5191 - protein, 262 aa, Triticum aestivum
MAQPAELSREENVYMAKLAEQAERYEEMVEFMEKVAKTIDSEELTVEERNLLSVAYKNVIGARRASWRIISSIEQKEESRGNEDRVTLIKDYRGKIEVELTKICDGILKLLDSHLVPSSTAPESKVFYLKMKGDYYRYLAEFKSGTERKDAAENTMVAYKAAQEIALKELPPTHPIRLGLALNFSVFYYEILNSPDRACDLAKQAFDEAISELDSLSEESYKDSTLIMQLLRDNLTLWTSDISEDAAEEMKDAPKGESGDGQ

SEQ ID NO: 5192 - protein, 324 aa, Triticum aestivum
SGALPSLYSAIQQCTSLNSLSGFWDSPRWITPIIHYTRASLTCLNLSYAPMFRTVDLIGTIHQCQNLRHLWVLDHIGDAGLKVVASSCLELQELRIFPANANVLASTGVTEEGLVAVSSGCRKLNSVLYSCSRMTNSALITVAKNCSRITSFRLHICLHGSVDAVTGQPLDEGFGAIVRSCKGLRRLSMSGLLTDSVFLYIGMYAERLETLSVAFAGDSDDGMIYVLNGCKNLRKLEIRNCPFGNTALLAGTHRYEAMRSLWMSSCDITLGGCRSLAAAMPGLNVEVISQADGGANDAKKVEKLYVYRTLAGPRDDAPGFVSAL

SEQ ID NO: 5193 - protein, 351 aa, Triticum aestivum
  unsure (1)..(351): unsure at all Xaa locations
MEEGQESRYWCHSCAEVIVPVEPEKKCPDCDGGFVEEMGSEGFEPSTNVRSERNLSLWAPLLLGMMGGSSRRSRPQRDMMDSSSDEDSRQARIRSALRDTDDEDEDDDDDDSDRELEDMIRRRRRRGSSNVRLLQNLREXLKEPCESVSAGGTVSTDGDTVESSGSEIDSSNTNTGVPLGGCFLGPGLDMLLQRLADSDLNRSGTPPAKKESVAALPTVNIQEVLGCTVCLEEFEMGTEAKEMPCQHKFHSNCILPWLELHSSCPICRFQLPTEESKNPCESGSGGGTVSADGDHAESSNSDIEGANHDGGSLLDESSINDRDVTSALNAIFGDGSSSSSSDENGPCASES

SEQ ID NO: 5194 - protein, 134 aa, Triticum aestivum
MAGQSSYSRLAGDEAAVISAAGGDDDYDAKKLRLLGYEPQLKRNLSLFSNFSVTFSIISVLTGTTTLYGTGLEFGGPVAMVYGWPIADTFTIIVGLAMAEICSAYPTSGGLYFWSARLCSERCWGPFASWLTGW

SEQ ID NO: 5195 - protein, 746 aa, Triticum aestivum
MAGHGQDRKTIDLEDGWAFMQRGITKLINILEGKPEPQFSSEDYMMLYTTIYNMCTQKPPHDYSQQLYDKYREAFEEYIRATVLPSLKEKHDEFMLRELVQRWSNHKVMVRWLSRFFHYLDRYFITRRSLTALRDVGLICFRDLIFQEIKGKVKDAVIALIDQEREGEQIDRALLKNVLDIFVEIGLGNMDCYENDFEDFLLKDTTDYYSVKAQSWIVEDSCPDYMIKAEECLKREKERVGHYLHINSEPKLLEKVQNELLASYATQLLEKEHSGCFALLRDDKVEDLSRMYRLFSKITRGLEPISNMFKTHVTNEGTALVKQAEDSANNKKPEKKEMVGMQEQVFVWKIIELHDKYVAYVTDCFQGHTLFHKALKEAFEVFCNKGVSGSSSAELLATFCDNILKKGCSEKLSDEAIEDALEKVVRLLAYISDKDLFAEFYRKKLARRLLFDKSANDEHERSILTKLKQQCGGQFTSKMEGMVTDLTVARDHQTKFEEFVADHPESNPGVDLAVTVLTTGFWPTYKTFDINLPSEMVKCVEVFKEFYATRTKHRKLTWIYSLGTCNISAKFDAKTIELIVTTYQAALLLLFNGSTKLSYSEIVTQLNLSDDDVVRLLHSLSCAKYKILSKEPAGRTISPNDSFEFNSKFTDRMRRIKIPLPPVDEKKKVVEDVDKDRRYAIDASIVRIMKSRKVMAHTQLVAECVEQLSRMFKPDFKAIKKRIEDLITRDYLERDKDNANTYRYLA

SEQ ID NO: 5196 - protein, 249 aa, Triticum aestivum
  unsure (1)..(249): unsure at all Xaa locations
MDPLRLLLPRAQAQPLLPLPAGVPAPSVRPRLVPRRRARRHRNGAARMLPASAVASESPWTEQDPASGEKEERFDWLDQWYPFAPVEDLDPGAPHGKMVLGIRVVAWYDRGAGEWRVFEDACPHRLAPLSEGRIDDKGRLQCVYHGWCFDGRGACQFIPRAPAPRPPLRXAASAPRAXYPSVVRDHIPVVYPRXQQEHRDLWQRSARHHSRDRDPSFARIRGRDLPTVQCVGENLLTCPYLNTRGYGKH

SEQ ID NO: 5197 - protein, 80 aa, Triticum aestivum
  unsure (1)..(80): unsure at all Xaa locations
MGVAPGSKAERKAALDAGAWMFNVVTSVGIIMANKALMATHGFSFATTXTGLHFLTTTVMTSVMKWLGYIQPSYLPLQEL

SEQ ID NO: 5198 - protein, 244 aa, Triticum aestivum
MGRGKVQLKRIENKINRQVTFSKRRSGLLKKAHEISVLCDAEVGLIIFSTKGKLYEFSTESCMDKILERYERYSYAEKVLVSSESEIQGNWCHEYRKLKAKVETIQKCQKHLMGEDLESLNLKELQQLEQQLESSLKHIRSRKNQLMHESISELQKKERSLQEENKVLQKELVEKQKAQAAQQDQTQPQTSSSSSSFMMRDAPPAAATSIHPAAAGERAGDAAVQPQAPPRTGLPLWMVSHING

SEQ ID NO: 5199 - protein, 110 aa, Triticum aestivum
MAAGGVWVFRKDGVMELKSAGLEPSAAAPSKKALVYVPANETVRSLEALERRLGSLGWERYYENRDIVQLHRRDGGVDLIALPRDFARFRSTHMYDVVVKNRHHFKVVDI

SEQ ID NO: 5200 - protein, 762 aa, Triticum aestivum
  unsure (1)..(762): unsure at all Xaa locations
MPPLYVFSLGLLLLLHIPHWCPSSAAASDTLTAGQSLAVGSKLVSRNGKFALGFFQPAAGITSKSQNTTSSSWYLGIWFNKIPVFTAVWVANRDQPITGPNLNLTQLKISSYGNLVIVNNDSVVWSTHTVNNRTQTSSINTTTGAAVLLNSGNLALTVTESPSSSDLPLWQSFDYPTDIFLPGSKFGRNKVTGLIHQSISKKSLIDPGLGSYSIELEETKGIVLKRRNPLVVYWHWASSKTSSLSLIPILNSILDLDPRTKGLINTTYVDNNQEEYYTYTSPNESSPTFVSLDISGLIKLNVWSQANQSWQIIYTQPADPCTPAATCGPFTVCNGIAQPFCDCMMNFSQKSPLDWEFNDRTGGCIRSTPLHCNTSSNNKNITSSTDMFHSIAQVTLPYNPQSIDFANTQSECEEACLSSCSCTAYSYNSSRCSVWHGELLSVNLNDGIDNTSEDVLYLRLAVKDLLPSLKKKKKKPKVGVTIASIIGFGLIMVMLLLLIWRYKFKCCGLPIYDNPGSAGGIVAFRYTDLVRATKSFSEKLGGGGFGSVYKGVLSDSTTTIAVXRLDGARQGEKQFRAEVSSIGLIQHINLVKLIGFCCEGDHRLLVYEHMLNGSLDGHLFKKSNANVVVLNWNIRCQISLGVARGLCYLHQSCRECIIHCDVKPGNILVDASFAPKVADFGLAAFVGRDFSRVMTTFRGTAGYLAPEWLSGVAITPKIDVLCEEGWGGGGWVCVGVGCGVLGVAVGVEGCYVQVGVGDGEGG

SEQ ID NO: 5201 - protein, 206 aa, Triticum aestivum
  unsure (1)..(206): unsure at all Xaa locations
SKSPPKTRGESAPREIHRSPSPPPSHPLSPMDSAPPAAGGGPGAGYPESTDSSPRSRGGDSWDEPFPSSAAAAAAGGGGRLRLMCSFGGRIVPRPTDKSLCXYLGGETRIVAVDRNASLADVHARLSRSLLPPQSRTPNHQLPSPRPRPADEDLDNLVDEYDRVAATSSSGGASSRTSRIRLFLFPAKPESSSSLGSLLDDSSKSE

SEQ ID NO: 5202 - protein, 345 aa, Triticum aestivum
MGKKKKRVEKVFCYYCDREFDDEKILVQHQKAKHFKCHVCHKKLSTAGGMAIHVLQVHKESVTKVPNAKPERDSTEIEIFGMQGIPSDVLAAHYGEEEDPSSKVAKVEVPTIRPPIMPNYPLGMPFPPRPYGAARPMYNPAMMVRPPIWPLQQPQPWFAQQPPVSVPPMMAGQAPQQPLFPIQNMPNPMMTSAPANLLQTSYAMPTTGVPSPVAPQASQLLFPVNTSGNGAANSSFSSSISPATIAANSPASVGTAGYGYVANNHGTGGPAIGQPPAPATNSKTSATQPATSEVYLVWDDEAMSMEERRLALPMYQVHDETSQMSSVDAAFDRRISDITFSRQLT

SEQ ID NO: 5203 - protein, 413 aa, Triticum aestivum
  unsure (1)..(413): unsure at all Xaa locations
MQRYSRAADVLGFVYLHPLSKCVASPAAAVSKVAGQPLEMEEVEVAPPRAHEVRIRILCTSLCHTDVTFWRLKDFPGQHPIILGHEAAGVVESVGEHVHEVAVGDTVVPVFSAQCGDCPDCLSDRSNICSGLPARPGMPRDGTTRFSFAATGEPIHNFIGVSSFTEYTVVDVARVVRIGPGVPPEKACLLSCGVSTGVGAAWKVAAVEPGSSVAVFGLGVVGLAVAQGCRMRGAKQIIGVDLNPEKWDIGKRLGITDFVNPNDIGEKAVSEVIKEMTGGGTDYCFECIGSTSVMAEAFQSSRKGWGKTVVLGVSSGGAPMSXIPPHDILMGRSVVGSLFGGLKPKADIPILAQKYLDKELELDEFVTHEMGFHDINAAFELLTQGKCLRCIIWMDGAKANGVEALDNGRACKA

SEQ ID NO: 5204 - protein, 232 aa, Triticum aestivum
MSAGWRTLLLRIGDRCPEYGGTADHKEHIEICYNVLSREYEHSKDDIFEFLLQCAEQLPHKIPFFGVLIGLINLENEDFAKGVVDATQANLQDALHTENRDRIRILLRFLCGLMCSKVISPNSIIETYETLLSSAATILDEDAGNASWQPRADFYVYCILASLPWGGSELFEQVPDELERVLVGIQSYISIRRHFDDIAFSVFETDEGHSSNKKDFMEDLWEHMQLLSRNGW

SEQ ID NO: 5205 - protein, 254 aa, Triticum aestivum
GDNSLVDMACATLDEEDKQKSVIGSSSEAALNLLPPANNQTAVSVDSTTAKYTPDKHMFSKDSIYEDFSMDDIDLSYENYEELFGNSHIQTEELFDDAGIDSYFEVKEATAVNSDEQPKPKQPAASNALSADSGMSNPAVKEDDSSLCIPVRQAISYSGFTGESIPEEYQDCGVSPMLLMGEPPWLPPGPDGSFAGIRDSAITRYKEKKKRRKFDHKIRYESRKARADVRKRVKGRFVKAGEAYDYDPLDTRSY

SEQ ID NO: 5206 - protein, 204 aa, Triticum aestivum
MAGQGSYSRLAADEAAAVISGGGGDDYDSKKLRLLGYEPQLKRNLSLLSNFSVTFSIVSVLTGITTLYGTGLQFGGPVTMVYGWPIAGAFTTVVGLAMAEICSAYPTSGGLYFWSARLCSERRWGPFASWLTGWFNLVGQGAVTTRVDLSLAQLIQVIILLSTGGNNGGGYKFTCLLFVTCFILDTNYCRHVVSNLSSLHFFFI

SEQ ID NO: 5207 - protein, 173 aa, Triticum aestivum
MAAVLVAAMVVVLSVSVAESATVEYQFDVATMNVTRLCGSKSIVVVNGQFPGPTVSAREGDLVVVRVVNKAQYNMSIHWHGVRQLRSGWADGPAYITQCPIQPGQSYVYKFTITGQRGTLWWHAHISWLRATVYGPIVILPKLGVPYPFAAPYKEVPIMFGEWWKADTEAVIS

SEQ ID NO: 5208 - protein, 526 aa, Triticum aestivum
MPPPPPPTTALPRPSLLLAVSSAALKISAAAATSPARGVRWKGVGVDGRRGRSRAVGRCWAAAVEEEAGAQEDGVLLPQEGEGSEAAGRYDWREEWYPLYLSKEVPDDAALPLTVFDRQLVLYRDADGVLRCHEDRCPHRLAKLSEGQLVDGKLECLYHGWQFDGEGKCVKIPQLPEGAKIPRNACARNYEVRDSQGVVWVWMSPATPPDAKKLPWFEPYARAGFTDLSTVHELPYDHSILLENLMDPAHVPISHDRTDWTAKREDAQPLAFEVAERTARGFAGHWWRERAPHLRNLLRFEAPCVLTNTLEFVDKDGREQCFSAQFLCRPAGQGKSMLLVRFGSTARSPLLRVLPKWYFHQNACKVFEQDMGFLSSQNEVLLREKVPTKELYLNLRSSETWVAEYLRHITMSPHGMPYYFGHSTISPPPVPAVVEQAPAGAAAGISASFPAKGGLGTQHAPNPTNRYFRHVVHCKGCRDSVNRYTALKKALVVLAAVAAAAGGLAATRQWKAVLRCGGVLLPAAPH

SEQ ID NO: 5209 - protein, 506 aa, Triticum aestivum
  unsure (1)..(506): unsure at all Xaa locations
MARTGPAQARSGPARAGRRSEGLPGAPRSAPAPSPSTPSVKLALSRLDALAKSPAPKRDREDGDGPPSPPPPPSDDVAEGLAALCAAMDPAGFLAFVVERXKEVDALRAELPAALQRCVDPARFAMDAVSEVFPVDRRAVRSPTDLAWACVLILEAVVPALADPDPEIGAARPMVPQAARDRARGMAAEWKEVAERKGGVEGAKPPDAHAFLQHVATFAVAEKEDKELYKRIVLSFSWRRQMPRLALTLGLEDDMEEIIEELITKGQQLDAVNFAYEAGLLEKFSPVPLLKSYLEDSKKIYCTSDNVSTSSGQSGVNANKKEQSALRAVIKCVEDHKLEAEFPLEDLRKRLEDLEMAKTEKKKAASSCSSGGPASKRIKGSTGGAMSPSKSGRLSDNTGAPSSPATATSSSTATAFIGSPASHVSYGTGSPYSYDRSAGHALYCGQSPLPMREPYAYPPAVPVPNVGLGMPYQAPPMTYPIYAGYNSGLGAYGNAMAPAFHQAYYR

SEQ ID NO: 5210 - protein, 463 aa, Triticum aestivum
  unsure (1)..(463): unsure at all Xaa locations
MAAIMASITSELLFFLPFILLALLTFYTSAVAKCHGLHRWSGRTKKRRPNLPPGAVGWPFIGETFGYLRAHPATSMGQFMDQHIARYGKIYRSSLFGDRTVVSADAGLNRYILQNEGRLFECSYPRSIGGILGKWSMLVLVGDPHREMRFISLNFLSSVRLRAVLLPEVERHTLLVLRDWLPSSSSAVFSAQHEAKKFTFNLMAKNIMSMDPGEEETERLRLEYITFMKGVVSAPLNFPGTAYWKALKSRATILGVIERKMEERLEKMNKEASSMEEDDLLGWAMKQSNLSKEQILDLLLSLLFAGHETSSMALALAIFFLEGCPKAVEELREEHLEIARRQKLRGECKLSWEDYKEMVFTQCVINEDLAGXATWXRFLHRXKVIPDVHYNGYXIXSGWKILPXLTXVHLHSSLXXDPNNXXPWXXXGNPFGGXXKKLTXIPXXXGTKXXXGPELAXLQGGPV

SEQ ID NO: 5211 - protein, 247 aa, Triticum aestivum
MESFSSFFDSQPGSRSWSYDSLKNLHQISPSVQNHLKRVYLTLCCALVASAFGAYLHVLWNIGGILTTIACCGSMIWLLSCPPYQQQKRLSLLFLSAVLEGASVGPLIKVAVDFDPSILITAFVGTAIAFICFSGAAMLARRREYLYLGGLLSSGLSMLMWLQFASSIFGGSASIFKFELYFGLLIFVGYMVVDTQEIIEKAHLGDMDYVKHALTLFTDFVAVFVRVLIIMLKNSADKEEKKKKRRN

SEQ ID NO: 5212 - protein, 170 aa, Triticum aestivum
MPPPCPTLCRLPATNLGLPWCPRSIPLPRLALAARRARAVAARASSSSSSPDSSFGSRMEDSVKKTLADNAVVIYSKSWCSYSMEVKGLFKRIGVDPHVIELDQLGAQGPQLQKVLERLTGQSTVPNVFIGGKHIGGCTDTVKLYRKGELATMLTELDIKVNHHDKIEHD

SEQ ID NO: 5213 - protein, 146 aa, Triticum aestivum
KMEAKALVELLEEENIQVPSWICFSSVDGKHLCSGESFGDCLEILNASEKVAIVGVNCTPPQFVEGIIRDFKKQTKKAIAVYPNSGEVWDGRAKRWLPVECFGRKSFDVMARRWQEAGASLVGGCCRTTPSTIRAVSNALKSRNGQ

SEQ ID NO: 5214 - protein, 262 aa, Triticum aestivum
MRIQCDACEGAAATVVCCADEAALCARCDVQIHAANKLASKHQRLPLEDAAAAAGLPRCDVCQDKPAFVFCVDDRALFCRDCDDSIHVQGTLSANHQRYIATGSGVGLGPVSACAAGDHGAGHDADHHAPPKVACEPYPPAQPAARAQQVPSPPQFLPQDWAVDELLQFSDYESNDKLHKDSPLAFKELEWFTADMELFHDHAPKGGRATMEVPEFFASQAADDAAYYRPSRVAATAGLRQSKKARVEIPDDEDFFIVPDLG

SEQ ID NO: 5215 - protein, 193 aa, Triticum aestivum
  unsure (1)..(193): unsure at all Xaa locations
AEAASRGSXSSNVLSQLAAEGQSRIVGWNLARGSGEREVVHVQEENLSADGTLVLSSSGDSAQSIVLQLVKLPLVDKIPPYTTWIFLDKNQRMADDQSIAGRRRIYYDSAGNEALICSESDEEIPQPEEEKHVFTEGEDQLIWKATQERGLSQEDLNVICQFIDASPSEIEGRSEFLFEKHEKHSEFSDKIES

SEQ ID NO: 5216 - protein, 259 aa, Triticum aestivum
  unsure (1)..(259): unsure at all Xaa locations
MKIQCDSCGVAAATVVCCADEAALCARCDVEIHSANKLASKHQRLPLDALGAKLPRCDICQEKAAFIFCVEDRALFCRDCDEPIHVPGTLSGNHQRYLATGIRVGLGPVSACAAGDHGAAHDADHHAPPKVSCEPHSPPPARSRSPXPPQFLPQDWAVDEXLLQFSDYESSDKLHKDSPLXLKELEWXFTADMELFHDHAPKGGRATMEVPEFFASQAADDAAYYRPSRVAATAGVRQSKKARVEIPDDEDFFIVPDLG

SEQ ID NO: 5217 - protein, 387 aa, Triticum aestivum
  unsure (1)..(387): unsure at all Xaa locations
MWGERAHHRHGHHHDHVPSGGSRDRQPKFIADNYSSVDEVIAALREAGLESSNLILGIDFTKSNEWSGRHSFGRKSLHAISGTPNPYEQAISIIGRTLSPFDDDNLIPCFGFGDVSTHDHSVFSFYKDYRPCCGFEEVLDRYKQMIPYLDLSGPTSFAPLIYAAISVVENSNYQHHVLVIIADGQVATSKSYSIVSGRLSPQEQATIQAIVDASFYPLSIVMVGVGDGPWDAMQHFDDCIPDRAFDNFQFVNFTGLMSASKDMSKKEAAFALAALMEIPTQYKATQGHLQSTCSSSFLEALHXILPPPSKVLEYDNIVAASHTPAATSQSTDVGYTVSDEKVCPICLTNPKDMAFQCGHLTCKECGPTLSTCPLCRAPITVRVRLFS

SEQ ID NO: 5218 - protein, 111 aa, Triticum aestivum
MADGGVWVFRKDGVMELESAAGSTSSRSGPGNKALVYVPANETMRSLQALEQRLGAHGWERYYENRDVVQLHRRDGSLDLISLPRDFAQLRSTHMYVVVVKNRGHFKVLDL

SEQ ID NO: 5219 - protein, 286 aa, Triticum aestivum
MLLSWCSRSLTTTRQARIRSALRDTDDEDEEDDDDDSDRELEDMIRRRRRRGSSLVRLLQTLQRERARERDRGGERTESLILINSNNEAIILQGTFGPSDNQENSSNTSTGVSLGDYFLGPGLDMLLQRLADSDLNRSGTPPAKKESVAALPTVNIQEVLGCTVCLEEFEMGTEAKEMPCQHKFHSNCILPWLELHSSCPICRFQLPTEESKNPCESGSGGGTVSADGDHAESSNSDIEGANHDGGSLLDESSINDRDVTSALNAIFGDGSSSSSSDENGPRSSES

SEQ ID NO: 5220 - protein, 183 aa, Triticum aestivum
  unsure (1)..(183): unsure at all Xaa locations
MSDADDYRCFVGSLSWNTTDVDLKDAFGKFGRVTETKVVLDKFSGRSRGFGFVTFDDKKAMEEAVEAMNGIDLDGRNITVERAQPQGSGRDRDGDRDYRGGGDRYGGGRDFGGGRGGGRGGGGDCYKCGKPGHFARECPSGDGGDRYGSRDDRYSSRDDRYSSRDDWYSSRDDRXWWQGWCKG

SEQ ID NO: 5221 - protein, 414 aa, Triticum aestivum
MSLKSIVRELKEMRDGIGSMSRRGGVSDGRAGHGRGGVAAFLAKPEPQQQGQWANLPPELLIDVIQRVEASEVAWPARRHVVACAAVCRSWREVTKDVVKTLEECSRITFPISLKQPGPRDCPVQCFVRRDRATSTYLLYLGLSPSLHGENDKLLLAARKIRRAARTSFVISLISDDFSHSSSTYVGKLKPNFLGTKFTIFDSQPPCDAAVLPNNKPSKRHSKQVSPRLPLGNYNVATVSYELTVLRNRGPRRMQCTMHSIPAVCIQEGGKAPTPTGMVHSLDEQVSTLSTSSKGKEPNIEFLSTSLSADLSGPISTSEAPLLLKNKAPRWHEQLQCWCLNFRGRVTVASVKNFQLVASVDPSLGVPAAEQEKVILQFGKIGKDIFTMDYRYPLSAFQAFAICLTSFDTKPACE

SEQ ID NO: 5222 - protein, 468 aa, Triticum aestivum
  unsure (1)..(468): unsure at all Xaa locations
MALKPPSLPDQLSSRLEPPTTRSRSRRGAAAAFHQRRVHFAFQRRAKRPAYRLACCSRQQXAPPPAWPGRAVIAPERRSGAGPTPTSIVVSTGSAETQTLEIVAENTDKFRVVALAAGSNVTLLVDQVKRFKAIPVALRNDQLLSELKAGEAGFGEMPQLTGAEPVVRGVARYPEVVPAVAGIEAGKGIRPADTAIETGNDLALANKAPKIAGGTVVAPPAHKHKFKILPADSEHSAIFQCIQGLSEGITXVRVSLTASGGAFRDWPVEKLKDVKVADALKHPNWSMGKKITVDSATLFNKGLEVIEAHYLFGAEYDDIEIVIHPQSIIHSMIETQDSSVLAQLGWPDMRLPEPTYLGLAIWRLVLLGFKAPDSVKYASVDLAYAAGRAGGTMTGVLSAANEKAVELFIDEKISYLDIFKVVEMTCDAHRNELVTRPSLEEIIHYDQWARKFAANLEPSSSGRSPVLA

SEQ ID NO: 5223 - protein, 138 aa, Triticum aestivum
  unsure (1)..(138): unsure at all Xaa locations
RDWYTLSTCLTLYXNKEMLGKRMWKFPAPXLMNTVHFTIAGLLRTRVIVVVPXNGAWRPSXSTMSWKDYFQRVVPTALATALDINLTNISLVVITVTFATMCKSGAPIYILLFAXLFRLEKPSFNILGIMLIVSVGVL

SEQ ID NO: 5224 - protein, 206 aa, Triticum aestivum
  unsure (1)..(206): unsure at all Xaa locations
SLVFHFSGHGVQKXTAGDEVDGYNEALCPLDFEEKGKILDDEINETIVRPLGPGVKLHAIIDTCHSGTILDLRYLCRLPRTGYWQWENHIRPGKPKGTNGGLAISISGCNDDQKSTESSVQGFSDTAAIGAMTDSFIRAVESEPGTTYGRLLSAMRATIRDSQGTGRRLPGRIGSFVRKMITSSAVQEPQLCSSEMFDIYRKPFLL

SEQ ID NO: 5225 - protein, 507 aa, Triticum aestivum
MEVEASAHGDAAASKFTLPVDSEHKAKSFRLFSFANPHMRTFHLSWISFFTCFVSTFAAAPLVPIIRDNLNLAKADIGNAGVASVSGSIFSRLAMGAVCDLLGPRYGCAFLVMLSAPTVFCMAAIDDASGYIAVRFLIGFSLAAFVSCQYWMSTMFNSKIIGTVNGLAAGWGNMGGGATQLIMPLVFHAIQKCGATPFVAWRIAYFVPGMMHIVMGLLVLTMGQDLPDGNLASLQKKGDMAKDKFSKVLWGAVTNYRTWIFVLLYGYCMGVELTTDNVIAEYYYDHFHLDLRAAGTIAACFGMANIVARPMGGYLSDLGARYFGMRARLWNIWILQTAGGAFCIWLGRASALPASVTAMVLFSICAQAACGAVFGVAPFVSRRSLGIISGLTGAGGNVGAGLTQLLFFTSSQYSTGRGLEYMGIMIMACTLPVTLVHFPQWGSMFFPASADATEEEYYASEWSEEEKGKGLHIAGQKFAENSRSERGRRNVILATSATPPNNTPQHV

SEQ ID NO: 5226 - protein, 179 aa, Triticum aestivum
  unsure (1)..(179): unsure at all Xaa locations
MAPSLETPESIDDVFANPIKQKPQLVAPEPQNCVGPDSQQAGKADSCAGCPNQAICASAPKGPDPDIPVISARLENVKHKILVLSGKGGVGKSTFTSLLAHAFATNPDSNVGIMDTDICGPSIPKMMGVEGETVHVSGTGWSPIWVMDNLAVMSIQFLLPNRGXDPVIWRGPKKNGLIK

SEQ ID NO: 5227 - protein, 253 aa, Triticum aestivum
MAADLGFEATELRLGLPGGGGEGEARSSSGKRGFAETIDLKLKLEPAGEEAPAEEDRADVAVVAAAAAENQEETATDAGAGKMKRSPSQSSVVTSAALPDPAEKPRAPKAQVVGWPPVRSFRKNILAEKSSPAAAAAFVKVSMDGAPYLRKVDLNMYKTYQDLSKALEKMFSSFTIGNCGTPGMNGMNESKLMDLLNGSEYVPTYEDKDGDWMLVGDVPWEMFVESCKRLRIMKGSEAIGLAPRAMEKCKNRS

SEQ ID NO: 5228 - protein, 233 aa, Triticum aestivum
  unsure (1)..(233): unsure at all Xaa locations
MASAVESPPAHSPPTNPPQRPRGILKNSYRKSPPASPEQEQAASEKELTIANTHINAGHRRSSSGARPTGSRRQSGVNSSSDGLEQSQRLKWDEANLYLTEQERSSTMKITEPKTPYAKHYDPAEDPSDDEDPLADAGARLKDSRPRREDDIPGLSLGEPEEEIPEAGAPSPRSEKSVHVDDESSIGHDAEEDLAGMSPEEREKHRKFEQLRKRHYENEEMWAXLLGHPDDLP

SEQ ID NO: 5229 - protein, 273 aa, Triticum aestivum
  unsure (1)..(273): unsure at all Xaa locations
MLLLNPASEAAAAAALDSIRQQLLEEPARPAYCRSASFGSLVADQWSESLPFRPNDADDMVVYGALRDAFSCGWLPDGSFAAVKPEPLPSPGSYDGSCLGSFLASPPELDAPWTEEEAEVAATASRGKHFRGVRQRPWGKFAAEIRDPAKNGARVWLGTFDSAXDAAVAYDRAAYRMRGSRALLNFPLRIGSEIAAAAAAAGQKRPSPQPASPDSPPPSSARXGSSKRRKRGEAAAASMAMALVPPPPAQAPVQLTLPAQPWLAAGAVQQLVS

SEQ ID NO: 5230 - protein, 228 aa, Triticum aestivum
HNLIDKYQLKGQIRWIKAQTDRVRNGELYRYIADTKGAFVQPALYEAFGLTVIEAMNCGLPTFATNQGGPAEIIVDGVSGFHINPMNGREAGTKIADFFQKCKEDPSYWNKVSTAGLQRIYECYTWKIYATKVLNMGSMYGFWRTLNKEERAAKQRYLQMFYNLQYRNLVKTVPRIGEQPPRTTASTSTAGAAVVRDEIVVRPKERKPRNRIQRMMTSLLGPKRRANK

SEQ ID NO: 5231 - protein, 833 aa, Triticum aestivum
MGEAAGDRVLSRLHSVRERIGDSLSAHPNELVAVFTRLVNLGNGMLQSHQIIAEYNTAIPEAEREKLKDGAFEDVLRAAQEAIVISPWVALAIRPRPGVWEYVRVNVSELAVEELSVPEYLQFKEQLVEGSNKDFVLELDFEPFNASFPRPSLSKSIGNGVQFLNRHLSSKLFHDKESMYPLLNFLRAHNYKGMTMMLNDRIRSLSALQGALRKAEEHLSGLPADTPYSDFHHRFQELGLEKGWGDCAKRAQETLHLLLDLLEAPDPSTLEKFLGTIPMVFNVVILSPHGYFAQANVLGYPDTGGQVVYILDQVRAMENEMLLRIKQQGLDITPRILIVTRLLPDATGTTCGQRLEKVLGTEHTHILRVPFRTESGIVRKWISRFEVCPYLETFTEDVAHEISGELQANPDLIIGNYSDGNLVACLLAHKMGVTHCTIAHALEKTKYPNSDLYWKKFEDHYHFSCQFTTDLIAMNHADFIITSTFQEIAGNKDTVGQYESHMAFTMPGMYRVVHGIDVFDPKFNIVSPGADMSIYFPYSESQRRLTSLHPEIEELLYSNVDNNEHKYVLKDRNKPIIFSMARLDRVKNLTGLVELYGKNPRLQELVNLVVVCGDHGNPSKDKEEQAEFKKMFDLIEQYNLNGHVRWISAQMNRVRNAELYRYICDTKGAFVQPAFYEAFGLTVIEAMTCGLPTFATAYGGPAEIIVNGVSGYHIDPYQGDKASALLVEFFEKCQVDPSHWTKISQGGLQRIEEKYTWKLYSERLMTLTGVYGFWKYVSNLERRETRRYLEMLYALKYRTMASTVPLAVEGDSREQVIWPPPDQKKSGLDSCKD

SEQ ID NO: 5232 - protein, 241 aa, Triticum aestivum
  unsure (1)..(241): unsure at all Xaa locations
PDHDDPAHTGHINMFWSPFLVRAREPDHDDPAHTGHYSLYLDEPDDKWVSQVPRFDYVLVPAARWFCPPSLFYAKRRLIGCSFCSRQYGVPDLTLYYSQRKAWRVSLRAINALEARVKGRVMVRMLSPMSHFEXGTWVQGGNGGGTQPVRGNQSVIEGRDLQFYTAPMEEYRAAEKAARAKGRRRVLMDGTAAMLMRPDGHPSRYGHWPNEKVQLYNDCIHWCLPGRIDSWNDLLFQMMLV

SEQ ID NO: 5233 - protein, 223 aa, Triticum aestivum
  unsure (1)..(223): unsure at all Xaa locations
MVVASLCEDRAEKMASAGLLEAVAPKKKKSNIKYASTCAVVASMASIVLGYGTHVDIITSTPDSVSRLAIXSVYFVAAIDTGVMSGASLYIQKDLEITNVQVEILMGILSIYSIIGTLAAGRTSDWIGRRFTAIFAAFFFFAGALLMGFASGYTMLMLGRFVAGIGVGYAIVIAPVYTAEIAPASARXGFLVSFTGVFINIGILXLGYISNYPLARAWRFNLG

SEQ ID NO: 5234 - protein, 266 aa, Triticum aestivum
RPYNDTSTSPLSSYGRGDGSYLQAEPLSPAKALRAAMLKRRFAGTIVKAQQKALLDHGQQIDPAKLQLEKERLEKRQQEEKERIEAQVKAAEAAAQFKLDEELRKKREREREAARLALHMMKKTVDIDNSDFLKDLENISKKWELNPPAKLIVDFVDGMELPPGLGSPLERLGLFMKRDIEEEVEDEMEDRYQHPPWMSTAYHHPPWMSTAYHPPPWMSTACYHPLWIWISTGRKERSAAVGSILFSCDFVSHTYCVHQHDRTSWL

SEQ ID NO: 5235 - protein, 239 aa, Triticum aestivum
  unsure (1)..(239): unsure at all Xaa locations
SARVDLGRRHGVAKVVGTVVSIGGATVITLYKGLPLFSHNLHVQAVLSWTSGSPIFNWTLGCVFILGHCLSWSGWMVLQVPVLKRYPARLSVISLTCVFGLLQFLVIAAFTEEDMSRWKVQSVGELFTILYAGLVASGVAFAXLQIWCIDRGGPLFTAVFQPVQTVAVAVMAAIILGDQLYTGGIIGAVLIVIGLYFVLWGKSEEKKTRSQDPEMARHLLGEDGGAADKDQQVSTAVLA

SEQ ID NO: 5236 - protein, 138 aa, Triticum aestivum
QYDDGDEDDLYEEYISRSPSIRIGNRRWGDNGYVRGGRREARPVDSQEERGVPSRTPKKKEGSASGSGSGSVSKDVAGRRARRAQKREAADKAAAEKHLKLLQRLGRGKTPEAPPEAPPESLEVGPPAPLEVGPPVIG

SEQ ID NO: 5237 - protein, 136 aa, Triticum aestivum
AKIKPAVNQIGTHPYFQRDPLVKFCQKHGICVTAHTPLGGSTANTELFGSVSCLDDPVIKSLAEKYGKSPAQLVLRWGLQRNTVVIPKTSKEERLEENFAVFDFDISVEDMEKIKALDRNYRTNQPAKFWGSNLYA

SEQ ID NO: 5238 - protein, 205 aa, Triticum aestivum
EERPNQFQNKAGNTTKLNPTKATWAGNKEKPGYLRDSFNSSGSKSVSASSSKAPVRKNCDEKLRRPLSAQFNNAESSNRRTVVNRLQSSKKAIAGEEDGHPCAQQIESEDSSSTSTTGDQPTGLDPEVLDSSVSSGSSSHVVDSVARNTALRTKPRRQKDKEEIGPGKTQTACTSGHHPDGPRKKGIGAKAAKAPPPRPQRGGTK

SEQ ID NO: 5239 - protein, 238 aa, Triticum aestivum
  unsure (1)..(238): unsure at all Xaa locations
GVSXXYYEDEXAHKXXCXXCVVGGERXLIEXLXEGNCXKXENXKKKEKWEXVEKEKXSKVXGFFFRVXLEXIEFVXENVAESKKVFLMNXSATFICEFFGDXKEKVFXYGDYIFGNEIEERXFFKVGGWEIENVEXMVLXFXXIVXXYGKKKRIVVIIXGVDXVVVXEDGKVKXFLVILLTKEKFVXXNGVGDGFVGXXXFKLVKGKXXEXXVKAGCRXXXVXIQKXXXIYLEKPDLN

SEQ ID NO: 5240 - protein, 229 aa, Triticum aestivum
  unsure (1)..(229): unsure at all Xaa locations
MDQPKPTPSAAASPAGADAAPNPYAFTCELPQSIYALAFSPSAPVLAAGSFLEDLHNRVSLLCFDSVHPTVASFRAVPXLSFDHPYPPTKLQFNPRAASTPLLASSSDALRLWHAPLDDLSASAPAPELRSVLDNRKASASDFCAPLTSFDWNEIEPRRIGTACIDTTCTVWDIERGVVETQLIAHDKAVHDIAWGEAGVFASVSADGSVRVFDLRDKEHSTIVYESPR

SEQ ID NO: 5241 - protein, 132 aa, Triticum aestivum
  unsure (1)..(132): unsure at all Xaa locations
CLGHEFVLVCHVFYMDGLLLDTEGFYTEVQEKIXARYGKVFDWSLKANMMGEKATESTHIFINECSLASLLTPEQFLEEREGMMQELFPSXVVLPDDCLHSCFDVSRLKLEEARHARRSFRMKKFEEGNSSL

SEQ ID NO: 5242 - protein, 180 aa, Triticum aestivum
RQRDQRRGGAGRELGAAMAGLLDKAKGFVADKIAHMPKPEASLDKVTFKGMTREAITVHSHVNVTNPYSHRIPICDIAFTLKCGGKEVASGTIPDPGWIEDSGEVTKLEVPAKVPYDFLISLMKDLGRDWDIDYELLVKLTIDLPIIGNFTIPLDTAGEFKLPTLSDFFGGSAKTEEATA

SEQ ID NO: 5243 - protein, 163 aa, Triticum aestivum
MASLMDKAKGFVADKIAHMPKPEASLDKVTFKGMTREAITVHSHVNVTNPYSHRIPICDIAFNLKCGGKEVASGTIPDPGWIEDSGEVTKLEVPAKVPYDFLISLMKDLGRDWDIDYELLVKLTIDLPIIGNFTIPLETAGEFKLPTLSDFFGGAAKTEEATA

SEQ ID NO: 5244 - protein, 159 aa, Triticum aestivum
DASSNDVPPRPRANRSESLRQQLQMPDPRGIASMVRRLIENQDIVRGQAAPPAGGVEVTVLPTARSRARVRRQQRHSLVSPSPIMLRASNAAPESGNQVRLPSSNSVNAAPTVTQQSSSMEQASTSSTLAVIVGQAAQSRRSRPSESTTTRRTRRRQQQ

SEQ ID NO: 5245 - protein, 126 aa, Triticum aestivum
MAADDGFSAARLFSQGVSYTYDDVIFLPGFIDFPADAVDLSTRLSRRVPLSIPCVASPMDTVSEAAMAAAMASLGGVAVVHSNTEPRAQASIVRAAKSRRLPFVSSVPIFSPASAPTLNDFAGHEY

SEQ ID NO: 5246 - protein, 279 aa, Triticum aestivum
LKWRWKPRRCDMPRFSARSVLEWLRGKRVVFVGDSMSRTQWESFICMLMTGVDDPKKVYEVNGSQISKTIRFLGVRFESFDLSVEFFRSVFLVQQTPAPPLHVTKRVRAILKLDKMDDLSRKWANADVLIFNSGHWWTPSKLFDMGCYFEAGGLLKLGTSVNSAFKMALETWASWVKEKVDLKRTRVFFRTYEPSHWSGLNQKVCEVTERPTTEAIGADRSEFRDILADVVANMSVPVTILNVTLMGAFRSDAHIGIWSHPSTILDCSHWCLPGVPNAW

SEQ ID NO: 5247 - protein, 131 aa, Triticum aestivum
MAGASSWSSSCSCTSSLGSLDDDDVFCVVKPGSPGAAAEGSVKFLCSYGGMILPRHPDGALRYVGGNNRVLSVDRSLQFHELQRKLTDMCGWEALSLRCQLPTEDLDALVSVTTNDDLGHLLEEYDAASRR

SEQ ID NO: 5248 - protein, 231 aa, Triticum aestivum
MAGASSWSSSCSCTSSLGSLDDDDVFCVVKPGSPGAAAEGSVKFLCSYGGMILPRHPDGALRYVGGNNRVLSVDRSLQFHELQRKLTDMCGWEALSLRCQLPTEDLDALVSVTTNDDLGHLLEEYDAASRDRLQPLKIRAFLFPRAKTPPLSPSTPSSRPTAGVRPPPPPAPHGSPPFGSWAFGPPAPTPAPAPPQRQSVAITAGLAAACWCISLAVVRSSMGRCAAVTDL

SEQ ID NO: 5249 - protein, 173 aa, Triticum aestivum
MRPGVRSTVERLDRPSAYYQNRNKRRRDRDDESNQPQEPQVDPLANATTLYVGNLSFYTTEEQVYELFAKCGEIKRLVMGLDRFNKTPCGFCFVEYFTHQDALDCLKYIGGTKLDERIIRTDLDPGFEEGRQYGRGKSGGQVRDEYREDFDEGRGGVGRAIQAEERDEYAEGK

SEQ ID NO: 5250 - protein, 231 aa, Triticum aestivum
  unsure (1)..(231): unsure at all Xaa locations
MHPLRRKVSRTLRLISSLFFVYSLDYARTRLANDXKASKGGGERXFNGLVDVYRKTLKSDGIAGLYRGFNISCVGIIVYRGLYFGLYDSLKPVLLTGTLQVCSSTLPYTLLSSNFSCLRDNHXHPCSPFTCLQDNFFASFALGWLITNGAGLASYPIDTVRRRMMMTSGEAVKYKSSLDAFQQILKKEGAKSLFKGAGANILRAIAGAGVLSGYDQLQILFFGKKYGSGGA

SEQ ID NO: 5251 - protein, 380 aa, Triticum aestivum
MADRANHPSVMQKFGGQFHLASSFSEGVRARNICPSVPSYERRFTTSCYMTQNLGISVPMMSSSPLFANAPPEKKGVKNFAIDFLMGGVSAAVSKTAAAPIERVKLLIQNQDEMIKAGRLSEPYKGIGDCFGRTIKDEGFGSLWRGNTANVIRYFPTQALNFAFKDYFKRMFNFKKDKDGYWKWFGGNLASGGAAGASSLFFVYSLDYARTRLANDAKASKGGGERQFNGLVDVYRKTLKSDGIAGLYRGFNISCVGIIVYRGLYFGLYDSLKPVLLTGTLQDNFFASFALGWLITNGAGLASYPIDTVRRRMMMTSGEAVKYKSSLDAFQQILKKEGAKSLFKGAGANILRAIAGAGVLSGYDQLQILFFGKKYGSGGA

SEQ ID NO: 5252 - protein, 380 aa, Triticum aestivum
MADRANHPSVMQKFGGQFHLASSFSEGVRARNICPSVPSYERRFTTSSYMTQNLGISVPMMSSSPLFANAPPEKKGVKNFAIDFLMGGVSAAVSKTAAAPIERVKLLIQNQDEMIKAGRLSEPYKGIGDCFGRTIKDEGFGSLWRGNTANVIRYFPTQALNFAFKDYFKRMFNFKKDKDGYWKWFGGNLASGGAAGASSLFFVYSLDYARTRLANDAKASKGGGDRQFNGLVDVYRKTLKSDGIAGLYRGFNISCVGIIVYRGLYFGLYDSLKPVLLTGTLQDNFFASFALGWLITNGAGLASYPIDTVRRRMMMTSGEAVKYKSSLDAFQQILAKEGAKSLFKGAGANILRAIAGAGVLSGYDQLQILFFGKKYGSGGA

SEQ ID NO: 5253 - protein, 380 aa, Triticum aestivum; identical to SEQ ID NO: 4690

SEQ ID NO: 5254 - protein, 156 aa, Triticum aestivum
GESIHGLVDVYRKTLKSDGIAGLYRGFNISCVGIIVYRGLYFGLYDSLKPVLLTGTLQDNFFASFALGWLITNGAGLASYPIDTVRRRMMMTSGEAVKYKSSLDAFQQILKKEGAKSLFKGAGANILRAIAGAGVLSGYDQLQILFFGKKYGSGGA

SEQ ID NO: 5255 - protein, 118 aa, Triticum aestivum
  unsure (1)..(118): unsure at all Xaa locations
MSFVFRGSRADIEAGGFPGFATERRAMRIHAGGRPVNSNSLAFLVTVLVLFMVLSSHQMSPNFLLWMVLGVFLLATSLRMYATCQQLQAQSQAHAADGNGFLGRTELRVHVPPTIXPC

SEQ ID NO: 5256 - protein, 120 aa, Triticum aestivum
VHCVESGKDAISLLQPPHCFHACFMDVQMPEMDGFEATRQIREMEKKANEEKREQSSSGEGSTFVEWHLPVLAMTADVIQATYEECMKSGMDGYVSKPFDEQQLYQAVSRLVVGTADSAS

SEQ ID NO: 5257 - protein, 259 aa, Triticum aestivum
RHEGIQIRLDSGHKTCPKTQQLLSHTSLTPNFVLKSLIAQWCEANGIELPKNKANSRDKKAAKSSDYDHAGLVSLMNRLRSGSQDEQRAAAGEIRLLAKRNVNNRICIAEAGAIPLLVNLLSSSDPRTQEHAVTALLNLSIHENNKANIVSSHAIPKIVEVLKTGSMEARENAAATLFSLSVVDENKVTIGGAGAIPPLINLLCDGSPRGKKDAATAIFNLCIYQGNKIRAVKAGIVIHLMNFLVDPTGGMIDEALTLL

SEQ ID NO: 5258 - protein, 147 aa, Triticum aestivum
  unsure (1)..(147): unsure at all Xaa locations
RPGPIEIDVAWLRXNATSVQNIKPQVDRFLMPSGRHIILLAEGRLVNLGCATGHSSFVMSCSFTNQVLAQIMLYKAADKTFAEKYVEFAKTDKLDVGVYVLPKILDEEVARLHLAHCQAELSTLSNVQAEYLGLTVEGPFKADIYRY

SEQ ID NO: 5259 - protein, 357 aa, Triticum aestivum
  unsure (1)..(357): unsure at all Xaa locations
MAKEAGGEGAMSESVLRKVLVSYCYVAVWIFLSFTVIVYNKYILDPKMYNWPFPISLTMVHMAFCSSLAVALVRVFRVVDLPSSPAMTTQLYTSSVLPIGALYSLSLWFSNSAYIYLSVSFIQMLKALMPVAVYSIGVLFKKETFRSSAMLNMLSISFGVAIAAYGEARFDLRGVALQLAAVAFEATRLVLIQILLTSKGISLNPITSLYYVAPCCLGFLFLPWVFVELPRLRAVGMFEPDFFVFGTNSLCAFALNLAVFLLVGKTSALTMNVAGVVKDWLLIAFSWSVIRDTVTPINLFGYGIXFLGVGYYNHVKLQALKAKEAXXKVAQADEEAGSLLQERDSHGGERKTETQSS

SEQ ID NO: 5260 - protein, 182 aa, Triticum aestivum
RHEARAARVDGDSQRRASVVSPSYFSNGSGSRSRPPSVPPLMPQFMRAHGSISEQYQQNSSSSLFAGAHRSGGMRPAPTPLPENPTFSLFPPGSSGHSSMETDDVGGSRFYAWERDRFAPYPLMPVDCETSWWTSQQQSHSTSEPTSAPRRLFGQWLGVGRSSPEHRSPEGSSYRQMHSPRM

SEQ ID NO: 5261 - protein, 360 aa, Triticum aestivum
  unsure (1)..(360): unsure at all Xaa locations
MSSDGGGSQMGVAGALGLSVTSSVAIVICNKYLMSTLEFYFATTLTSWHLLVXTFCTLHIAQRLRFFEPKPIDAQTVISFGFLNGISIGLLNLCLGFNSVGFYQMTKLAIIPFTMLLETIFLSKKFSQSIKASLMVLLLGVGIASVTDLQLNLLGSIIAVLTIAATCVCQILTNQIQRRLKVSSTQLLYQSSLYQSAVLLITGPFVDKLLTKKDVFAFEYTFEVVVFILMSCGIAVSVNFSTFLVIGTTSPVTYQVLGHLKTCLILSFGYVLLKDPFTLRNLAGILIAIFGMGLYSFFSVSESRKKTEGATLPVNTQMSEKDSAPLLGTKTSPWQESNGVENFDDVPRTAKTAFSRQLNP

SEQ ID NO: 5262 - protein, 300 aa, Triticum aestivum
  unsure (1)..(300): unsure at all Xaa locations
MALKVASFSLLELSSGTTRSRRGAAFRPRQHQRKVDLTFQRRDKRAAYLRTCCSMQQGPPPAWPGRAVAEPERRSWEGPKPISIVGSTGSIGTQTLDIVAENPDKFRVVALAAGSNVTLLADQVKTFKPKLVALRNESLINELKEALAGCEEMPEIIPGEQGVIEVARHPDAVTVVTGIVGCAGLKPTVAAIEAGKDIALANKETLIAGGPXVLPLAHKPNVKILXADSKHSAXFKCIQGLLKGXXXXXXSXGLGGALGNKLKKKVIFEDPTGTGEKIQEICLSGSFPCLLIQLWDPAST

SEQ ID NO: 5263 - protein, 500 aa, Triticum aestivum
PNGLNPLSPIPTHTLAMAAANLLSRSLVPSLTPNPGSQPSRSRAASVSLRRRHGPAAPLRASLSTASPSTRVAMGEAPKHCFQRGADGHLYCEGVGVEDTMAAADRTPFYLYSKPQVVLNFTAYDKALQGLRSIVGYAVKANNNLSVLQLLRGLGCGAVLVSGNELRLALRAGFDPTRCIFNGNGKTLEDLILAAESGVFVNIDSEFDLENIVAAARVAGRQVPVLLRINPDVDPQVHPYVATGNKTSKFGIRNEKLQWFLDSIKSYSNDIKLVGVHCHLGSTITKVDIFRDAANLMVNFVDEIRAQGFELEYLNIGGGLGIDYHHTGAVLPTPMDLINTVRELVLSRDLTLIIEPGRSLIANTCCFVNKVTGVKSNGTKNFIVVDGSMAELIRPSLYGAYQHIELVSPSPGAEVATFDIVGPVCESADFLGKDRELPTPDKGAGLVVHDAGAYCMSMASTYNLKMRPAEYWVEDDGSIVKIRHGETFDDYMKFFDGLPA

SEQ ID NO: 5264 - protein, 103 aa, Triticum aestivum
TLSPFAGLAFHPLDGILQALPHSLCLFFMPIHFTTHLVLIFIEGIWTANIHDCIHGKLWPVMGAGYHTIHHTTYRHNYGHYTIWMDWLFGTLHNPEEDEGKAM

SEQ ID NO: 5265 - protein, 80 aa, Triticum aestivum
  unsure (1)..(80): unsure at all Xaa locations
VGCREKEYDYLSIKDGKQMFKLSSDKELHQYFPEEPPEWDVKDGGVLFQKGKESQPCKEIRGGRVINQTFGXGRELERIV

SEQ ID NO: 5266 - protein, 286 aa, Triticum aestivum
PDVRGLIHAALRLGYRHLDCAADYQNEAEVGDALAEAFQTGLVKREDLFITTKLWNSDHGHVLEACKDSLKKLQLDYLDLYLIHFPVATRHTGVGTTSSALGDDGVLDIDTTISLETTWHAMEELVSMGLVRSIGISNYDIFLTRDCLAYAKIKPAVNQIEVHPYFQRDSLVKFCQKHGICVTAHTPLGGSTANTEWFGSVSCLDDPVIKSLAEKYGKTPAQLVLRWGLQRNTVVIPKTSKLERLQENFEVFDFDISGEDMEKMKAVDRKYRTNQPAKFWGIDLFA

SEQ ID NO: 5267 - protein, 289 aa, Triticum aestivum
MDLLDAGHRHSSELPAAGADMEGASVLPLSGAAYQPYVSELLSFSIERLHKEPELLRVDGERVRRQMQEVAVENYAAFIAASEALSFVRAQLEGFDKHLEALVEEIPNLTSGCTEFVESAHQILEERKLNQTLLANHSTLLDLLEIPQLMDTCIRNGNYDEALDLEASVSKISKLHPDLPVIQGLAAEVKKTIQSLISQLLQKLRSNIQLPECLRIVAHLRRIGVFSESELRLQFLRCREAWLSGILDDLDQRNVYDYLKGMVSCHRTHLFDVVNQYRAIFNNDKSGSE

SEQ ID NO: 5268 - protein, 271 aa, Triticum aestivum
MYKQGAAGGAGPDRKRISDALDKHLEKAAASPSTSRGSAGARGNHNRVVVPSSIPKGRCSEGESESDSEASDVSGSDGEDTSWISWYCNLRGNEFFCEVDDDYIQDDFNLCGLSSQVPYYDYALDLILDIESSHGDIFTEEQNELVESAAEMLYGLIHARYILTSKGLAAMLEKYKNYDFGRCPRVYCCGQPCLPVGQSDIHRSSTVKIYCPKCEDIYYPRSKYQGNIDGAYFGTTFPHLFLMTYDHLKPQKPSQRYVPRVFGFKLHNHKP

SEQ ID NO: 5269 - protein, 418 aa, Triticum aestivum
  unsure (1)..(418): unsure at all Xaa locations
RPRDATLQAPPQPYLPPGQRRPGGEERGEKGFPAQRXVLAMELKLNTSXEEADDSGGGXTFACDVVRLAVLLFASVCSFETLEEKMRAMANLRYRVLPPQLLLKWPKEASFCQLMMHPVPDTRPKMSEVLQSEFLNQSRNSLEEREAALRLREEIEEQELLLDFLLQLQKRKQDIADNLQDTVAFLSSDINEVLHRQSALGQCGNSRTELGKEVSSGTVEDQSDCGSRKRFRPELHAVDMEEHSRSLEECSRTVPSSVVIQESVLSKSSRLMKNFKKLETAYFLARSKLARQVGNPLRSCDQVVKRTTGSAVGTEGSSIDDFALEGHSGRRQGGWMNSFLEGLCXFDRDNEFFATAGVNKKIKVFEYNMIVNEHRDIHYPVVEMSNKSKLSCISWNSYMKSHIASSDFDGLVQVWDVT

SEQ ID NO: 5270 - protein, 384 aa, Triticum aestivum
  unsure (1)..(384): unsure at all Xaa locations
SKLLLLLLCTYHTLVAHAGDDLRSYKPVGSPESATVNCSQPKAATPSSGGVTVPLHHRHGPCSRLPSTKAPTWEEILRHDQLRAAYVTRKFSGVKGGAGDVEQSDVTLPTRLGTSMSTLEYVINVGIGSPAVTQTMSIDTGSDVSWVQCKPCSKCHSXANPLFDPTSSSTYSPFSCTSAARAQVSQDGQGNGCSGSQCQYIVTYGDQSSTAGTYSSDTLVLGSTAVKNFQFGCSQSNSGLLLTQQTAGLMGLGGGAESLVSQTAGTLGRAFSYCLPPNPGSRGFLTLGAPTSTSGFVTTPMYRNRRAPTFYAVRLQAIRVGGKELNIPPXVFSAVSIVESGTYQRVPPTPIRAGSPFRRLTGPNPAPQVLQYRHQINASPPPPL

SEQ ID NO: 5271 - protein, 114 aa, Triticum aestivum
  unsure (1)..(114): unsure at all Xaa locations
MSSPREENVYLAKLAEQAERYEEMVEFMEKVAKTVDSEELTVEERNLLSVAYKNVIGARRASWRIISSIEQKEESRXNEDHVAIIKDYRGKIETELSKICDGILNLLDSHLVPA

SEQ ID NO: 5272 - protein, 119 aa, Triticum aestivum
  unsure (1)..(119): unsure at all Xaa locations
MAPPPEEERGGGGCRARWLRREVLLALALGQLVSLLITSTGFSSSELARRGINAPTSQSLLNYILLALVYGGILLYRRQPLTTKWYYYLILGIIDVEANYIVVKSYQYTSXLTSVMXLD

SEQ ID NO: 5273 - protein, 496 aa, Triticum aestivum
  unsure (1)..(496): unsure at all Xaa locations
PAPELRAAGAFSYNRLEGPIPSSFSSLSLSEINLSSNRLNGTIPELGSLATFPKSQYENNSGLCGXPLPACEPHTGQGSSNGGQSNRRKASLAGSVAMGLLFSLFCIFGLVIIAIESKKRRQKRRPAGTSRDIYIDSRSHSGTMYSNWRLSGTNALSINLAAFEKPLQKLTLGDLVEATNGFHNESLIGSGGFGDVYKATLKDGRVGAIKKLIHVSGQGDREFTAEMETIGKIKHRNLVPLLGYCKIGEERLLMYDFMKFGSLEDVLHDRKKIGIKLNWAARRKIAIGAARGLAFLHHNCIPHIIHRDMKSSNVLVDENLEARVSDFGMARMMSVVDTHLSVSTLAGTPGYVPPEYDRGFRCTTKGDVYSYGVVLLELLTGKPPTDSTDFGEDHNLVGWVKMHTKLKIADVFDPELLKDDPTLELELLEHLKIACACLDDRPSRRPTMLKVMTMFKEIQAGSTVDSKTSSVATGLSDDPGFAVMDMTLKEAKEEKD

SEQ ID NO: 5274 - protein, 316 aa, Triticum aestivum
  unsure (1)..(316): unsure at all Xaa locations
MEPAEKKPPAVSDLGAWGMNVVSSVGLIMANKQLMSSAGYAFSFATTLTGFHFTVTALVGWISKATGYSASKHVPLWELVWFSLVANASITGMNLSLMLNSVGFYQISKLSMIPVVCLMEWVLNSKXCACLAVFCTSRQRITIGSFQKKYNIGSFELVSKTAPIQAVSLIILGPFVDYYLNGRWLLNYSFSTGATFFILLSCSLAVFCNMSQYLCIGRFSATSFQVLGHMKTVCVLILGWVLFDSALTIKNILGMLLAIMGMVVYSWAMAVXRRRPPRPIPRNKSDMLDGEDVPLKSRTSGIPLSSDDLEEGPMKS

SEQ ID NO: 5275 - protein, 199 aa, Triticum aestivum
MAANFWTSSHCKQLLDPEDVDLVPAADRERGITPEEFRLIKIHMSFHIWRLAQQVKVRQRVIATAVTYFRRVYTRKSMSDYDPRLVAPTCLYLASKVEESTVQARLLVFYIKKMCGSDDKYRFEIKDILEMEMKLLEALDYYLVVFHPYRPLLQLLQDAGITDLTQFAWGLVNDTYKMDLILIYPPYMIALACIYIASV

SEQ ID NO: 5276 - protein, 116 aa, Triticum aestivum
MAPTGLLLLLGCLASALLAGATKVHHHEFVVQETPVKRLCEEHNIITVNGQFPGPTLEVREGDTLVVNVVNQAQYNVTIHWHGIRQFRTGWADGPEFVTQCPIKPGGSYKYRFTIE

SEQ ID NO: 5277 - protein, 201 aa, Triticum aestivum
GGIGGDGVGGMFTFAIEGMLRGAGPYGLVVTDALEPDCPIIYVNRGFEEATGYRAEEVLGRNCRFLQCRGPFAQRRHPLVDDAVVSGIQRCVDNGTQFRGDLLNFRKDGFPLMNRLHLTPIYGDDDIITHYMGIQFFTNANVDLGPVPGSVTREPVRSTRFAPDNFFRPITTGLEQDNFCREYSSLFQLTDEVLCQSILSR

SEQ ID NO: 5278 - protein, 98 aa, Triticum aestivum
MQVPGDVGGGGGEAGDMRGRHRIQAELKKLEQEARFLEEELEELNKMDKVSTALQEFVVTIESKADPLLPVTTGAAYQSWDRWFEGPQDLRRCKCWFL

SEQ ID NO: 5279 - protein, 153 aa, Triticum aestivum
GLSLHGAPSSWRAAACCIARRRPRPGTSSWKGGPHVLGRRDCEEKVLIGINGQFPGPTIRAKAGHTIVVELKNGLHTEGVVIHWHGVRQIGTPWADGTAAISQCAINPEETFTYRFVVDKPGTYFYHGHYGMQRAAGLYGSLIVDVADGEEEP

SEQ ID NO: 5280 - protein, 120 aa, Triticum aestivum
MADVDEYRCFIGNLSWSTTDESLKDAFSKFGNLTEAKVVLDKFSGRSRGFGFVTFDEKQAMEDAIEGMNGLDLDGRNITVDKAQPQGPGRDRNGDRDYDRDRGSRYDRGRDYGSGRAPAR

SEQ ID NO: 5281 - protein, 83 aa, Triticum aestivum
MSYYGQQQAPVGAPPQQGYPPQGYPPAVFPPPQQGYPPAGYGQQGYPPQQGYPPQQQQQNSGPSFMQGCLAALCCCCLLDACF

SEQ ID NO: 5282 - protein, 83 aa, Triticum aestivum
MSYYGQQQAPVGAPPQQGYPPQGYPPAVYPPPQQGYPPAGYGQQGYPPQQGYPPQQQQQNSGPSFMQGCLAALCCCCLLDACF

SEQ ID NO: 5283 - protein, 86 aa, Triticum aestivum
MSYYGQQQAPVGAPPQQGYPPQGYPPAGYPPPQQGYPPAGYGQQQQGYPPQQGYPPQQQQQQNSGPSFMQGCLAALCCCCLLDACF

SEQ ID NO: 5284 - protein, 64 aa, Triticum aestivum
  unsure (1)..(64): unsure at all Xaa locations
MMSKLGVLALFFHLRELEMDEYWVYIGYIVICGTKGNLHGILVGXVYRIEVFPDGILYAFGEPH

SEQ ID NO: 5285 - protein, 190 aa, Triticum aestivum
  unsure (1)..(190): unsure at all Xaa locations
MASSDTPALKNNPKFIFFTDFDGTVTTADSNDYMTDNLGFGVERRRQLNKDVLFGKMHFRDSFVEMLDSIKTPFDECVDILLKNIKLDPGFKEFYDWAQQNNVPIVILSGGMEPVIRALLDTLLGPGWDIQIVSNYVTAREGKTLKDEGGWRIEFHDDSIHXHDKSIEIRKYSSLPDRPTMFYAGRGSFR

SEQ ID NO: 5286 - protein, 210 aa, Triticum aestivum
LAATFGRGTSPPAIESRADCREPSAMSKRGRGVWDMELGSLDTTRLLMLLAQQHQHQHHHRGVAEAAQAMTGGRVFQCKTCNRQFPTFHALGGHRASHKRPRLHHPPPQHALVGVDDDAALCLGRRAPQAPPQPARPRVHECPICGLEFAVGQALGGHMRRHRVEAEAEAGANAPSSKAAPATEMVVASCDDAGICLDLNLTPSENCAKC

SEQ ID NO: 5287 - protein, 134 aa, Triticum aestivum
  unsure (1)..(134): unsure at all Xaa locations
QPAPIVYGSSPRGGPHAAPAGRAPPSPAPRGRLGWNKQDPRYMATIIMDSPKVVVLDIRAPTXIWDLSSMGTGNNSGGNGNGNGNAAAAAAAEGGLDPILAYTAGAEVEQLQWSATQPDWVAIVFANKLQILRV

SEQ ID NO: 5288 - protein, 375 aa, Triticum aestivum
  unsure (1)..(375): unsure at all Xaa locations
MWGERAHHKHGHHHDNVGSRDRQPKFIADNYSSVDEVVAALREAGLESSNLILGIDFTKSNEWSGRHSFGRKSLHAISGTPNPYEQAISIIGRTLSPFDDDNLIPCFGFGDASTHDHSVFSFYQENRPCRGFEEVLDRYRQIVPHLNLSGPTSFAPLIYAAMSVVESSNCQYHVLVIIADGQVTTSNSRARLSPQEQATIQAIVAXDASFYPLXAARRSMWGCGDGPKDDAAXLEVKSKKFGKARRYLNVHKALLYVKMAICVCSLMDNFHHLLYSLLLSSWHAQNANPPRILPPPSKVLERDNIVAASHTPAATSQSTDVGYTVSDEKVCPICLTNPKAFSFYVCRKTCKECGPTLSTCPLCRAPITVRVRLFS

SEQ ID NO: 5289 - protein, 191 aa, Triticum aestivum
  unsure (1)..(191): unsure at all Xaa locations
MAAAECGSREERWSLAGATALVTGGSKGIGGAIVEELAGFGARVHTCSRNAAELEECCLRWEEKGMRVTVSVCHVSVPADREKLMDTVRQTFDGKLSILVNNAGQHLVKPTVECTMEEYKNVMATNLESSFHLCQLARPLXARAVGGNIINISSIASSIGFAGSTIYTITKDQIAEAEAEEVHDGGRRQRR

SEQ ID NO: 5290 - protein, 39 aa, Triticum aestivum
AGLSVNTDFFVDIGTEPEGPSLAHEMRYPGGDCTSDIWI

SEQ ID NO: 5291 - protein, 146 aa, Triticum aestivum
  unsure (1)..(146): unsure at all Xaa locations
YXNVWHRVSRHXXPLNMVWLSVXVAFAMALTSLGSQVAFQAMASIATIGLYXSYALPIFFRVTTARKSFIPGPFHLGQYGIAVGWTXVLWVAFVXVLFSLPVAYPVAKDDFNYTPVAVGGVLLLSIGAWVLHARFWFQGPIINVDT

SEQ ID NO: 5292 - protein, 215 aa, Triticum aestivum
ASRAFERPLLRALASHQDKASYQAGETKARTEEKTGQAMGATKDTAQHAKETTKQKASDSDTGSYLGQKTEEAKHKAGQTTESTKQKAGQTTEAAKQKAAETTEATKQKAGETTEATKQKTAETTEATKQKAAEAMEATKQKAAEAGQYAKETVVSGKDKSAGVIQQATEQVKSAAAGAKDAVMNTLGMGGDNNSKQSDTNTDSSKDSSTITRDH

SEQ ID NO: 5293 - protein, 203 aa, Triticum aestivum
  unsure (1)..(203): unsure at all Xaa locations
MAETKAPKDPYGFLKDFMAGGISAAVSKTAVAPIERVKLILQVQAASTQIAADKQYKGIVDCLVRIPKEQGFASFWRGNFANVIRYFPTQALNFAFKDVYKQLFMDGVDKKTQFWRYFAGNLASGGAAGATSLCFVYPLDYARTRLXADVGKGPAERQFKGLGDCIAKTVKSDGPIGLYRGFIVSVQSIIIYRAAYFGFFDTA

SEQ ID NO: 5294 - protein, 274 aa, Triticum aestivum
MSPAADSASGSKRQAELLKQEGNTCFKKDRISAAIDAYTGAIALCQNVAVYWTNRALCYKKRNEWAKVEEDCRMAIHYDSHSVKAHYMLGLALLNRQELAGGIKALEKSLELGRGAHPASYMVEEIWQELSKAKYIEWEGLSKMRSSQLHKLNATCKEALKSYNSLDNPTGDMSEEHLNELDEVFRKAAKADTPTEVPDHLCCKITLDIFRDPVITPSGITYERAVILDHLNRVGKFDPVTREPLEPFQLISNLAVKEAVDVFLKEHGWAYKIR

SEQ ID NO: 5295 - protein, 155 aa, Triticum aestivum
MLNSQTLVKFVALDDELVTIHKASWNRMYFAGIYDPVDQSWRGKENEIALCWSGPTVVVDGTLYMLDQSLGTKLMMWINETKEWVMVGRLSDKLTRPPCELVAIGRKIYVIGKGLSTVTIDMDMAARVDGFLVSSSTGPLMEHDFSPEKCSVITI

SEQ ID NO: 5296 - protein, 363 aa, Triticum aestivum
MNHHLESGDYQKLFCRKMESAELHTPLLHGLPDEIALLCLARVPRQYHNALRCVSRGWKTLLCSEEWHSYRKRNNLDESWIYVICRGTGFKCYVLVPDPTTRCLKVIQVMEPPCSGREGVSIETLDRRLFLMGGCSWLKDATDEVYCYDAASNHWSKAAPMPTARCFFVTAALNNKIYVTGGLGLTDKSPNSWDIYDKATDSWFSHKNPMLTPDIVKFVALDDELVTIHKASWNRMYFAGIYDPVDQSWRGKENEIALCWSGPTVVVDGTLYMLDQSLGTKLMMWINETKEWVMVGRLSDKLTRPPCELVAIGRKIYVIGKGLSTVTIDMDMAARVDGFLVSSSTGPLMEHDFSPEKCSVITI

SEQ ID NO: 5297 - protein, 123 aa, Triticum aestivum
FSASLFCTLNDKIYVTGGLGLTDKSPNSWDIYDKATDSWFSHKNPMLTPDIVKFVALDDELVTIHKASWNRMYFAGIYDPVDQSWRGKENEIALCWSGPTVVVDGTLYMLDQSLGTKLMMWLN

SEQ ID NO: 5298 - protein, 92 aa, Triticum aestivum
MNHHLESSDYQKLFCRKMDSAELQTPLLHGLPDEIALLCLARVPRQYHNALRCVSRGWKALLSSEEWHSYRKRNNLAESWIYVICRGTGFKC

SEQ ID NO: 5299 - protein, 170 aa, Triticum aestivum
MAAADVEYRCFVGGLAWATNNETLEQAFANFGQVIDSKVITDRETGRSRGFGFVTFSSEQSMLDAIENMNGKELDGRNITVNQAQSRGGGGGGGGYGGGGGGYGGRREGGGYGGGGGGYGGRREGGGGYGGGGYGGGGGGYGGRREGGGGYGGGGGYGGNRGDSGGNWRN

SEQ ID NO: 5300 - protein, 268 aa, Triticum aestivum
  unsure (1)..(268): unsure at all Xaa locations
MSSVKEYSLFCLENPLLDIQAQGDQALLDKYGLKPNDAILAEEKHIPLYEDLLNNYDAKLIAGGAAQNSARGAQYILPPNRVVYVGGAGDDKYSAILHDAVKAAGLRVEYRVDPKEKTGRCGAIITGHNRSLCTDLGAANHYDLDHLKKPEIWKLVENAEVYYVGGFHFTVCPPAIMELAKQAAKDNKPFVLSLSAPFIPQFFXKEVVDASAPFWDYIIGNETEAAAYAESHDLPSKEPKGCRKHLANLPKENXQRKRVAIITQGTDP

SEQ ID NO: 5301 - protein, 220 aa, Triticum aestivum
MMKLRWWRVDASEVAAVTAMGVWEAVLAGGGRRFIKRKDSDAGETGRALEELRSSLYNEMHSSEGAKRQQQRFCGPSVALTFNFAVAVGIIVANRPPTRPVGFKYPIALSLIHYAGALVLMAILKALSLLPVAPPSKSTPFSSLFALGAVMSLSTGLANVSLKHNSVRFYQMAKIAVTPTIVAAEFMLFHKKVSCQKVITLATESIGVAVATATDLEFNF

SEQ ID NO: 5302 - protein, 372 aa, Triticum aestivum
  unsure (1)..(372): unsure at all Xaa locations
TRPSTEGHRLSKELVSMVRGRKTTRDIILWVEEQIVPANGTKFAVDVVSQTLLDIGSKSFTHLITVLERYGQIISKLCPDEEMQLLLMDEVSAYWKNSTQMTAIAIDRMMGYRLISNLAIVKWVFSPANVDQFHVSDRPWEILRNTVSKTYNRISDLRKEIQTLRKSIQVAKEASAKAIKELEEAKSILEIVEGQPVSSERPGRLRRLQGFADKAKEEEVTIEESLEAKQALLARGLEEGKELLRLLFKSFVDVLTERLPPVSADGDVPNLRAGDPNVTFPASDPEAATMEIDDENGADNNSQVNGENMKAGYTIGELEQWCLCTLGYLKSFSRQYATEIWSHIGMLDEEVFVGSIHPLIRKAAXSPVCADR

SEQ ID NO: 5303 - protein, 261 aa, Triticum aestivum
  unsure (1)..(261): unsure at all Xaa locations
PRPPTRPGGRGGDGQFALSGSWDGELRLWDLSTGVTTRRFVGHEKDVLSVAFSIDNRQIVWGCRDRTIKLWNTLGECKYTIGGGRGGGEGHTGWVSCVRFSPNILPPTIVSGSWDRSVKVWNLTNCKLRSTLAGHGGYVSAVAVSPDGSLCASGGKDGVTLLWDLSEGKRLYPLDAGSIIHALCFSPNRYWLCAATQDSIKIWDLESKHIVQDLRPEXPVSTKQMLYCTCLSWSADGSTLYAGYTDGTIRIYQISGFSYSS

SEQ ID NO: 5304 - protein, 145 aa, Triticum aestivum
RPPEVSRRGRRPETAPGSASASASVAPPVGARCAVCRGVDISVPHQANCSHWFCGHCIVGVWLQGSVLRPSNCPVCRRPITLLVPSEAASLLRDEPEIAPVMNRIEQYNGRFAGVPHSMIQWLLDQPFYMRRMLAEFRDTPQEPP

SEQ ID NO: 5305 - protein, 121 aa, Triticum aestivum
MEEHREERCWEDLLPDALGLIFRNLSLQEMLTVVPRVCKSWSRVVSGPYCWQEIDIQEWSQQQNKPDQLTRMVHTLVTRSGDSFRRISVSGLPNDSLFTFIANHARSLKTLELPRSEISDC

SEQ ID NO: 5306 - protein, 407 aa, Triticum aestivum
MSYFPGQGYNGGGGGGNGYGYGPPSGPPPPQQQYGGYSGDNSGSRRYPPPNYPPPPHLDAYGFPLPQGLNHHAQHARSGPPPPSVPQQFGHGAPEGYTFQYSRCTGRRKALLIGINYFNQEGELRGCINDVHNVSAFLVERYGYKREDMILLTDDQQDPVMIPTRENIIRAMGWLVSNAQPDDALFLHYSGHGGQVEDLDGDEDDGYDECIYPVDHSQAGPIIDDEIHFRVVKPLAQGVRLTAIFDSCHSATVMDLPYVYSTKGVLKEPNLAKEAALGLFDAFQAYSSGDVSGAAKSMFSMAKNAFNGGDEAYEKTKDTRTSPADVVMWSGSKDDQTSADATINAQATGAMSWAFISAIKANPKQSYVELLNSVRDILETKYTQKPQLSSSHPIDTDPLVCYVTRWS

SEQ ID NO: 5307 - protein, 262 aa, Triticum aestivum
  unsure (1)..(262): unsure at all Xaa locations
MATAAAAGTREEMVYMAKLAEQAERYEEMVEFMEKVVAAAGTGELTVEERNLLSVAYKNVIGARRASWRIVSSIEQKEEGRGAAGHAAAARGYRALVEAELSNICAGILRLLDERLVPAPXLKGRNYYPXLTLKLDYHRYLAEFKSAAERKDAADSTLGAYQAAQDIAMKELPPTHPIRLGLALNFSVFYYEILNSPDRACSLAKQAFDEAIAELDSLGEDSYKDSTLIMQLLRDNLTLWTSDMQDDAGDEMRDSSKPEDEQ

SEQ ID NO: 5308 - protein, 130 aa, Triticum aestivum
YDYSLDMWSLGCMFAGMIFRKEPFFYGHDNHDQLVKIAKVLGTDSLNAYLKKYHLELDPQLEHLVGRHSRKPWSKFINADNQHLVSPEAIDFLDKLLRYDHQDRLTAREAMAHPYFLQVRAAENSRARPQ

SEQ ID NO: 5309 - protein, 427 aa, Triticum aestivum
  unsure (1)..(427): unsure at all Xaa locations
MTTVASLSLVPHLLIKPSLRCLSRKGVGRYGGIKVYAVLRDDSADYLKDNHHWEALFHVDGPGPRVPIEKGQYLEAKQALDVVRFDIQYCDWRARQDLLTIMVLHNKVVEVLNPLARDFKSVGNLRKDLDGLQEELAKAHYQLYLSESTVSSALAQMETVVNERLLSDGSAFANTADCASLDPSTSLDTTPRPSSTVRLGPKNPERRSLIMAGPLTPHRAILYRGWFPAACSTGLQDGSRVPIDSGGEQSVRFRXKTXRPGCVQNTCAHRACPLDLGSVNEGRITCPYHGWEYSTDGKCEKMPSTKMLNVRIRALPCFEQEGMVWIWPGDDTPTPTIPSLLPPSGFTIHAEIVMELPVEHGLLLDNLLDLAHAPFTHTSTFAKGWSVPSFVKFLTPTSGLQGYWXPYPIDNGVTDPPXHWFLSNHLG

SEQ ID NO: 5310 - protein, 179 aa, Triticum aestivum
MEGQRSQRWGYLKDKAIATSLAEEETENSMDGEEDDTGDEDKRKRVIERARGPNTERVPLRLCLVDRCTANLTEAKQYYRRHKVCEVHAKASSATVAGVKQRFCQQCSRFHELAEFDETKRSCRRRLAGHNERRRKISGDSYGEGSGRRGVSLTQTQERNRIDMKLPMTNSPFKRPQIR

SEQ ID NO: 5311 - protein, 265 aa, Triticum aestivum
  unsure (1)..(265): unsure at all Xaa locations
MAERNLSQIISQLKHSPSMSYTDANALLSKAKLALLKLNALTPSPSTPTQLLPLARETYEQGALFAIRARNPEAFTRYVQQLQPFYELPASVLPPNLLERNKVTGLSLLLLLTQGRYGEFHTELESLENREGGGGDVESDRYLGYPIRLERWLMEGSYDRVWKAMKSSEVPCDEYSVFSEILKNQIRSEIASSSERAYPSLPISSTKSLLFLDSEGDVISFAHHRGWIVRDGHIYFPDAAEGENGDQNKEMSQMVIXDALGYARE

SEQ ID NO: 5312 - protein, 77 aa, Triticum aestivum
MQEQGESSRPSSSDRSSSSGNHMGHKEGMESDDEIGTVPELGLGPSGASTSGRREADGPERAQSFTAQGSARRRGRT

SEQ ID NO: 5313 - protein, 563 aa, Triticum aestivum
  unsure (1)..(563): unsure at all Xaa locations
MLPPGAELELHERTPSSSSRHARLTGALLSMQASSRSSSMERTSQWLSSQDVQTDLVVRVAGAAFPLHKAVMVPKCGYIRKAVAVATRPDPAATVEIELDGLPGGADAFEKAARYCYGANFEISARNAAALLCAAAFLDMQPADGGLARRVEEFLAQAGLRTLPNAIAVLRSCEGPLLTAAEELGVARRAADAVALRICNEVLFPTRSPPEWWASELAALSPVSFHRVFTALRCRRAGPEVLVAAATAYAELLLADGKASDHRALLESVVAVLPSADDAPLPXSXFLCRLLHDAVTTEASAKTCRDLELRLAAVLDQATAGDLLAFAFDGAGERVINTESLRRVIAAFVERESGAGRNRRASLSGAAALGAGALQKVAKMVDEVAAEIATDESLPISKFVGVAGAVPKDARXPPHDCLYRAVDIYLKAHPKLDEIEREKVCSVMDTLKLSYTARIHASQNKRLPLQAVLSALYYDQLKLRSAGVGHDDEDSDARSEAGSARMQAKADAALARENEALRSELARMRAHMSSGVQQSKGSGSRTAARRRRWRGRKRASSGRCRAR

SEQ ID NO: 5314 - protein, 166 aa, Triticum aestivum
  unsure (1)..(166): unsure at all Xaa locations
SSCHDPCVICLEMECXVAAEGCDHEFCTKCALYLCSTTSSSTCTRGVPGSISCPLCRHXIVSFVKLTGTTFLKELPWTTSSLALCAAGASTGSLRRQSDIRRLRSTSVHLGCSSFRSTGSGRLSSIKLNCGRLDETLPCLVSCIRPDVRRSSSYRERVGSRYTEFS

SEQ ID NO: 5315 - protein, 281 aa, Triticum aestivum
MAALRDRGDAAIKLFGRTIPLLDAAAEVVTKLGNDANSNDVMPCVSNKLLNVEATPFCSKNREQNDQAISKHGVEVRTGFKSEEIKTGSDGSGQDKVLKKPDIIVPCPRCNSMETKFCYFNNYNVSQPRHFCRNCQRYWTAGGNIRNVPVGSGRRRNKHASHFRHAMMSCDANIAAPGDVSNEIHHLALPLLPQVLPGPIKENETVKEFGSQVPVCKPMSSIHNIEEQKDTHLVALASGDNSEEQSCPSPATVSGCSENQTPDSAVKKEPSNVLGYYNGIT

SEQ ID NO: 5316 - protein, 308 aa, Triticum aestivum
KNFPTLGLEAYKNRFYFDFSPTYIGVGMICPHIVNVSVMLGGIISWGIMWPLMGKKKGSWYPASLPESSLHGLQAYRVFISIALILGDGLYNFVKVLIRTIAGFISMVHKNSKAMLPVSDNGSPTAEAMSFDDERRTELFLKDQIPMATAYGGYAVVASISIGTLPQIFPQLKWYYILVAYVVAPVLAFCNAYGSGLTDWSLASTYGKLAIFVFGAWAGLANGGVLVGLAACGVMMSIVSTASDLMQDFKTGYLTLASPKSMFISQVIGTSMGCVISPCVFWLFYKAFSDIGISGSEYPAPYAIVYRN

SEQ ID NO: 5317 - protein, 220 aa, Triticum aestivum
  unsure (1)..(220): unsure at all Xaa locations
MASSTQGQVITCKAAVAYEANKPLVVEDVQVAPPQAGEVRIKILSTALCHTDYYTWSGKDPEGLFPCILGHEAAGIVESVGEGVTDVQPGDHVIPCYQAECKDCKMCNSGKTNLCGKVRGATGVGVMMSDRKSRFSVNGKPIYHFMGTSTFSQYTVVHDVSVAKINPQAPLDKVCLLGCGVSTGLGAVWNTAXVEAGSIVAVFGLGTVGLAVAEGAKSAG

SEQ ID NO: 5318 - protein, 457 aa, Triticum aestivum
  unsure (1)..(457): unsure at all Xaa locations
LLHPSQSVPPLHKALALLLKPRDLPDLFMQTPFLPHPLVLLQVLPLTLLCRPTHLINLWTFTMHTKTVAIVMTVDKVSTAVVSCATALMLVHIIPDLLSVKTRELFLKKKADELDREMGLIRTQEETGRHVRMLTHERKSTLDRHTILMCRLVELGRTLGLEECALWMPSLXGSSLHPVHTLRHPIPGGKSVQINLPVVNQVFSSNRAIIVPHTSPLARIRPVQGRYVPPEVAAVRVPLLHLSNFQINDWPELSXAKSYAIMVLMLPSDSARKWHVHELELVEVVADQVAVALSHAAILEESMRARDLLMDQNVALDLARREAEMAIRARNDFLAVMNHEMRTPMNAIIALSSLLLETELTPEQRLMVETVLKSSNLLATLINDVLDLSKLEDGSFELDISTFNLHAVFKEVMSFVKPIAAIKKLSVSAMLSPDLPLSVIGDEKRLMQTILNVCGNA

SEQ ID NO: 5319 - protein, 468 aa, Triticum aestivum
MAIAVSPTHTKQKQQQQDHRRIPSQSNHTRRQARMAIAVSGQWTRLRTLGCGASGAVVTLAADAASGELFAVKSVRAADAAQLSREQGILSGLSSPHVVGCIGGGGDRDGSYHLFLEFAPGGSLADEAARNGGRLEERAIRAYAADVLRGLAYIHGKSLVHGDVKSRNVVIGADGRAMIADFGCARALGSAGPIGGTPAFMAPEVARGEEQGPAADVWALGCTVVEMATGRAPWGEMDNVLAAVHRIGYTDAVPEVPTWLSAEAKSFLAMCFARNARDRCTAAQLLEHPFVALQAGEAKARWVSPKSTLDAAFWESETDEEEEEEEEVSESPSERIKSLSCSVLPDWDSDEGWIDVLGEQCEACDSPAATKGPADVSSRAPSKVLGSPAVPAEDVAVVGTLSSDEHEVDAEDEPFGDDTILAADPSVDRQNQVCSSSDRDVLSSSHVPCNNRVLAIEKFRFPQKKKKK

SEQ ID NO: 5320 - protein, 194 aa, Triticum aestivum
  unsure (1)..(194): unsure at all Xaa locations
METPAGGSADRRVTGSGASAGAAASSLSRYGLNFSASSLLQAPLAALLEYSGVVPSGPVPQTVQQAVPSSSSSSEADGLLSAAAAGDGEVSIRIQGDPGDPDTASATATGASPQDSIEVAASSNFDQASVARRGGGADAEASGGGSGGATXNGAGDRPYQRYDVHHVARWIEQILPFSLLLLVVFIRQHXVIAV

SEQ ID NO: 5321 - protein, 169 aa, Triticum aestivum
GKLIFPAKTLHRESPLVGSPSLPAPPNQNSDLRPRTRRPRCPATSSKQIAFSLVLLLAAAESAAATRSPSAFVQNAIYSNRITIFSKSYCPYCMRAKRIFKDLNEDPYVVELDLREDGRDIQGVLLDLVGRNTVPQVFVYGHHVGGSDDTKTALSDGQLQKLLGKSQSQ

SEQ ID NO: 5322 - protein, 369 aa, Triticum aestivum
  unsure (1)..(369): unsure at all Xaa locations
KEAFERVVEKRMLSSDKVQEAIGQIVYKVESTISKRPLMHTDTMDSYDHPSILAELNSKLTETMPFIQHEGCQKELNVALSKYLKLLXKSVIKEKASEYQNVDYYACTVNNIITNHFYRQGRFDLGDXCLKLPFQEMYGILEAMKARNLEPALNWAAKNHDQLLQNSSMLELKLHSLQFVEILTKGSRDVALQYARTHLVPFASLHKAEIQKLMACLIWADRLEQSPYAEFVSSTHWEKLAEELIHQFCSLLGQSSDSPLSVAISAGFQGLPTLLKLTTVMAAKKQEWQTMKQLPVPIDIGPEFQYHSVFVCPVLREQSSDENPPMLMPCGHAVSKQSIMKLSKSSSRPFKCPYCPSEAVASQCKQLHF

SEQ ID NO: 5323 - protein, 255 aa, Triticum aestivum
RLCTCLPLPSIKSPFSIPISISKSVTMSTTNSGQESEKVNTNIVTLTRFLTEEQAKHPEATGDFTLLCHALQFSFKSIAYYIRRATLVNLTGLAGSSNITGDDQKKLDVISNDLFIEAMRSSGKCALLVSEEEDEIIYFKDASDARYAVACDPIDGSSNLDAGVSVGTIFAIHKLPEGSKGCKEDILKPGTELLAAGFTMYGASAQLVITMRGGTVNGFTLDNGVGEFILSHPNMRLPKSRDIYSCNEGNSLYWG

SEQ ID NO: 5324 - protein, 496 aa, Triticum aestivum
  unsure (1)..(496): unsure at all Xaa locations
MVLSHAASAGSSDDSVHSTFASRYVRASLPRFRMPENSIPKEAAYQIINDELMLDGNPRLNLASFVTTWMEPECNKLMMDSINKNYVDMDEYPVTTELQNRCVNMIAHLFNAPLGETETAVGVGTVGSSEAIMLAGLAFKRRWQNKMKAAGKPCDKPNIVTGANVQVCXWEKFARYFEVELKEVKLSEGYYVMDPEKAVEMVDENTICVAAILGSTLNGEFEDVKMLNDLLVKKNEETGWDTPIHVDAASGGFIAPFLYPELEWDFRLPLVKSINVSGHKYGLVYAGIGWCIWRSKEDLPDELIFHINYLGADQPTFTLNFSKGSSQVIAQYYQLIRLGFEGYRNIMDNCQENAMVLKEGLERTGRFNIVSKDQGVPLVAFSLKDSSRHDEFEISEFLRRFGWIVPAYTMPPDAQHVTVLRVVIREDFSRTFAERLVIDIEKVLHELDALPSRSSGPALQHPNGDTVSEKDLARQREVVSVWKRAVAARKKTQGVC

SEQ ID NO: 5325 - protein, 117 aa, Triticum aestivum
MSYYGQQQPPVGAPPPQGYPGKEEYPPAGYPPAGYPPPGQGQGYPPQGYPPQQGGYPPQQGYPPQQGGYPPQQGYPQQGYPPQYAQQPPRQQQSSGPSFMEGCLAALCCCCLLDACF

SEQ ID NO: 5326 - protein, 177 aa, Triticum aestivum
  unsure (1)..(177): unsure at all Xaa locations
MGRQPCCDKVGLKKGPWTAEEDQKLVGFLLTHGHYCWRVVPKLAGLLRCGKSCRLRWTNYLRPDLKRGLLSDEEQQLVIDLHAQLGNKWSKIAAQLXPGRTDNEIKNHWDTHIKKKLRKXMGIEPVTHRPLGQKAPPPPQQPPPPPPTTTAWQQLDGAERSQQAEDEDVKAVPLIQP

SEQ ID NO: 5327 - protein, 184 aa, Triticum aestivum
NDDCTRHVVRALLRKCGYEVISAENGLHAWQYLEDVQNRIDLVLTEVAMPCLSGIGLLSKITSHSICKGIPVIMMSKNDSMSTVFRCLSKGAVDFLVKPIRKNELKTLWQHIWRRCHSSSGSESGIHTQKCSKPKAGDEYENNSHDDDDDCGSHDDDDDDDDDADDDFSVGPNARDGSDNGSGT

SEQ ID NO: 5328 - protein, 121 aa, Triticum aestivum
AGRSRGYKGFQKEVQKCLRNAHYLKDRLKDAGISAMLNELSSTVVFERPKDEEFVRRWQLACEGSISHVVVMPSVTVDKLDTFLNELVEKRVTWYQEGKCQSPCIAADVGQENCLCTLHKT

SEQ ID NO: 5329 - protein, 69 aa, Triticum aestivum
PRVRPRVRGRVGNIELLVTTRISVLAKRDTFLNELVEKRVTWYQEGKCQSPCIAADVGQENCLCTLHKS

SEQ ID NO: 5330 - protein, 352 aa, Triticum aestivum
  unsure (1)..(352): unsure at all Xaa locations
ARASFGTPCAGHARQVVGGVFGWAARLRVPGKVGSWGLVSVRGSASYIYKLFYRREVFPDGILYASRDXHYSVFKAARMYRMDCVKVDTLVSGEIDCADFGRKLHENKDKPAIINVNIGTTVKGAVDDLDLVIETLEKSGFKDRFYIHCDGALFGLMMPFVKQAPRVSFKKPIGSVSVSGHKFVGCPMPCGVQITRLNHINALSSNVEYLASRDATIMGSRNGHAPIFLWYTLNRKGYRGFQKEVQKCLRNAHYLKDRLKDAGISAMLNELSSTVVFERPKDEEFVRRWQLACEGSISHVVVMPSVNVDKLDTFLNELVEKRVTWYQEGKCQSPCIAADVGQENCLCTLHKT

SEQ ID NO: 5331 - protein, 317 aa, Triticum aestivum
  unsure (1)..(317): unsure at all Xaa locations
MKRQIKRPTRSQESPEPGEKLAFAEKENLLAAYMEHDEPELAEADEEEEEEERAMSCGLGGKKRRLALEQVRALERSFETDNKLDPERKARIARDLGLHPRQVAVWFQNRRARWKTKQLERDFNALRARHDALRADCDALRRDKDALAAEIHELREKLSTKPETSVKAEAAGNADAAEERLQQATMIGAAVCKDGSSDSDSSAVFNDEXASPYSGAVFEQQGFMGFGASFLDSASAAAATTGCSSLPMLEPKWPGAYPYDASRSGGYGFTEEWLAGSDAIVNDGSSAFFSEEHVSNLNFGWCSSGAEGFDLQSYCKK

SEQ ID NO: 5332 - protein, 262 aa, Triticum aestivum
  unsure (1)..(262): unsure at all Xaa locations
MSTAEATREENVYMAKLAEQAERYEEMVEFMEKVAKTADVGELTVEERNLLSVAYKNVIGARRASWRIISSIEQKEESRGNEAYVASIKEYRTRIETELSKICDGILKLLDSHLVPSATAAESKVFYLKMKGDYHRYLAEFKAGAERKEAAENTLVAYKSAQDIALADLPTTHPIRLGLALNFSVFYYEILNSPDRACNLAKQAFDEAIAELDSXLGEESYKDSTLIMQLLRDNLTLWTSDNAEEGGDEIKEAASKPEGEGH

SEQ ID NO: 5333 - protein, 261 aa, Triticum aestivum
MSTAEATREENVYMAKLAEQAERYEEMVEFMEKVAKTADVGELTVEERNLLSVAYKNVIGARRASWRIISSIEQKEESRGNEAYVASIKEYRTRIETELSKICDGILKLLDSHLVPSATAAESKVFYLKMKGDYHRYLAEFKAGAERKEAAENTLVAYKSAQDIALADLPTTHPIRLGLALNFSVFYYEILNSPDRACNLAKQAFDEAIAELDSLGEESYKDSTLIMQLLRDNLTLWTSDNAKEGGDEIKEPPSKPEGEGP

SEQ ID NO: 5334 - protein, 66 aa, Triticum aestivum
  unsure (1)..(66): unsure at all Xaa locations
ASRVGGFPPCQSRQCFACHRIMLDEGFFRWXRYKDWFWGRDKVRSLVFKNYGGLFGAQCEMLPSVD

SEQ ID NO: 5335 - protein, 474 aa, Triticum aestivum
MAAAAVAADSKIDGLRDAVAKLGEISENEKAGFISLVSRYLSGEAEQIEWSKIQTPTDEVVVPYDTLAPPPEDLDAMKALLDKLVVLKLNGGLGTTMGCTGPKSVIEVRNGFTFLDLIVIQIESLNKKYGCSVPLLLMNSFNTHDDTQKIVEKYSNSNIEIHTFNQSQYPRIVTEDFLPLPSQRADREGWPGYPPGHGDVFPSLNNSGKLDTLLSQGKEYVFVANSDNLGAIVDIKILNHLITNQNEYCMEVTPKTLADVKGGTLISYEGRVQLLEIAQVPDEHVNEFKSIEKFKIFNTNNLWVNLKAIKRLVDAEALKMEIIPNPKEVDGVKVLQLETAAGAAIRFFEKAIGINVPRSRFLPVKATSDLLLVQSDLYTLVDGYVIRNPARVKPSNPSIELGPEFKKVANFLARFKTIPSIVELDSLKVSGDVSFGSGVVLEGNVTIAAKAGVKLEIPDGAVLENKDINGPEDL

SEQ ID NO: 5336 - protein, 114 aa, Triticum aestivum
MASNQEQASYRAGEAKGHTQEKAGQVMGAAKDMAYEAKDRAAGMAGHTSRQGQGTTEATKHKAGEATDKASQTAQAAKDKAASTAQAAKDRTVESKDQTGSFLGEKTEMAKQKA

SEQ ID NO: 5337 - protein, 212 aa, Triticum aestivum
MDAFEKMLLRAPRLKRCDRPRCWCLQEKAGQAMGAAKDKAYEAKDRAAGLAGHASGQGQGATEASKHKAGEATDRASQTAQAAKDRAAGTAQAAKDKTNETARTVESKDQTGSFLGEKTEMAKQKAAETAEAARQKAAETAQYTQDRTYDAAQYAKESAVAGKDKTGSVLQQAGETVVGAKDAVANTLGMCGDGTGNNAATKDTTERITRDH

SEQ ID NO: 5338 - protein, 431 aa, Triticum aestivum
  unsure (1)..(431): unsure at all Xaa locations
MKLTIKRVPTVVSNYQEDAGERPRGGCGRNCLGHCCLPVSELPVYAFKANPTKLPLQEDAVPTDFFINLLLGQWEDRMTQGLFRYDVTACETKVIPGNLGFVAQLNEGRHLKKRPTEFRVDRVLQPFDSAKFNFTKVGQEEVLFQFENSGSDDSYFLRSAAVTVADRAPNVVAINVSPIEYGHVLLIPRVLDHLPQRIDQESFLLALHMAXAEAASPYFRLGYNSLGAFATINHLHFQAYYLTVPFPVEKAATQRIPLAEGGIKSGVKVSKLMNYPVRGLVFEEGNTLNDLANVVSSACIWLQDNNVPCNVLISDSGRKIFLFPQCYAEKQALGEVSQELLDTQVNPAVWEISGHIVLKRRDDYEEASEXRAWRLLAEVSLSEARFEEVXAYIFDAACLVQSQVEEETDDAIYAPVLVGPSAVGEGCLVIP

SEQ ID NO: 5339 - protein, 211 aa, Triticum aestivum
MSSHRSCGLVVVLACAALMAAVAGTAQYNVGGDNGWGVPGAGAESYNTWAEKTTFQVGDQLVFVYPKDKDSVLLVAPADYNACNTNTYDKQFSDGNTVFDLDRAGAFFFISGVDANCRANEKLIVMVAAAAKGAPTPSQGSPAATATTPPSAPSGGAPPNSPATPNAPAGEASNSTPAKGAPPGAASGAGLTVAGLAGSFVALFGYAMLAF

SEQ ID NO: 5340 - protein, 307 aa, Triticum aestivum
  unsure (1)..(307): unsure at all Xaa locations
MGRGDGHDDALRRWLREAGGWLVVDGALGTELEAHGADLQDELWSARCLVSAPHLIRKVHLDYLDAGANIITTASYQATLXGFQSRGVSREQGEALLRRSVQIAQEARAIFVXRAGRKAPTPRAMSTTAWRSRAHRARARGKLEAQAYAGRLAENDIRSTPGDSLTSKDHANGARGDPVTEGAAVADSCRRVATVGINCTAPRLIHGLILSISKVTTKPIVVYPNTGETYVAETKEWVDSAAAGSGAPGTDFVSCVGQWRQAGASLVGGCCRTGPATVRAIARALREADAAAAAEDTDDDYPAVAVL

SEQ ID NO: 5341 - protein, 100 aa, Triticum aestivum
MGRGDGHDDALRRWLREAGGWLVVDGALGTELEAHGADLQDELWSARCLVSAPHLIRKVHLDYLDAGANIITTASYQVHTCPRFLRSPSKANALSLVHTR

SEQ ID NO: 5342 - protein, 366 aa, Triticum aestivum
  unsure (1)..(366): unsure at all Xaa locations
MGRGDGHDDALRRWLREAGGWLVVDGALGTELEAHGADLQDELWSARCLVSAPHLIRKVHLDYLDAGANIITTASYQATLQGFQSRGVSREQGEALLRRSVQIAQEARAIFVXKAGRKAPTPRAMSTTAWRSRAHRARARGGPSVGELRGRTSRDGFXSTPGELWXRSVTQRKAAQKTFRRLQVLADAGXPDLIAFETIPQQLEAQAYAELLEGDDIRIPAWFSFTSKDGANAASGDPITECAAVADSCRRVAAVGINCTAPRLIHGLVLSISKVTSKPIVVYPNTGETYVAETKEWVDSAAAGGGVAGTDFVSCVGKWRQAGASLVGGCCRTGPATVRAIARALREEDAAADADTDDDYPAVAVL

SEQ ID NO: 5343 - protein, 399 aa, Triticum aestivum
  unsure (1)..(399): unsure at all Xaa locations
MEVEIPTEHRAPKVEASAWRWRDLPGAAAKPLRDPLLAVNFLLLAVGAACGPLLLRLYFLRGGSRKWLSSLLQTAGWPLLLVPLCFSFSSRRRRSRRSRQGEDATASGGVFLMTPRLLAASAVVGLMTGADNFLYAYGQAYLPVSTSSILISTQLAFTAAFALLLVRQRFTGSTVNAIVLLSVGAAMLGMGSGGDRPAGVSGAQYAAGFGMALGAAALYGLVLPVMELSQAWHAARAGAAALTYTLVVEIQVIIGVTATAFCAVGMLANNDFQVTPTRKLKQRXNEAIPGEARQSELGQAGYYLLLVGTAAVYQCFCLGIIGAIYYGSALLAGVIITVLLPVTEVLAVVFFHEPFSGTKGVALGLSLWGLASYFYGEVRNKAPEAEHRTSLCVDRDCEN

SEQ ID NO: 5344 - protein, 388 aa, Triticum aestivum
  unsure (1)..(388): unsure at all Xaa locations
MGVGKKVLNDVKPYMMMILLQIGYAGMYIVSVASLKRGMSHYVLVTYRNLVATLVMLPFALFFEKGIRPKMTLRIFIKILGLALLEPVLVRSLYLLGVXRRKEVACVARRSSFSVVISLFDFVRPQEFMSSWCSSCYHMLLXSLDLLMTRMHVFMYHAPLAQCPWAININXTFYSTPPPPPSASATWLKGTIAIITSCVAWAGFFVLQSNTLNSYPAALTLTTLICAMGTGINGSMALVAERHDMSAWVIGLDTRLFTVVYSGVVCSGVAFFVQGIVTETRGPVFVTAFQPLCMIITAVLGSVILKEETTLGSVIGAAIIVLGLYSLIWGKSNDIIDKPVHSVAEKLALPLTSVNGNGTNGTNGGRHVNGGQVAHDVETPAVKGAICH

SEQ ID NO: 5345 - protein, 263 aa, Triticum aestivum
SCLYTSQRRVGEKKQQKQGTVPSNRFGVILEWEGVVVEDDDPDLEPRVWYVLSLEEAKGGGHDEMLKEIEGMRTDQAISEVLCWSTDAKEIERLAARKEVIYQKLRGTFYQLRPGVLDFLNALVDSDIPIAVTASRPKMNLEEGIKAVGLQGYFDVVVAAEDFRRGKPEGEMFEVAAEQLGLEPDVCLVMGSSNLTTESAHTAGMRCVAVASRHPAYELHAANHVVRWLDQLSVVDLQRLANGEVLGRRGRRSDMDMEIVIEE

SEQ ID NO: 5346 - protein, 429 aa, Triticum aestivum
  unsure (1)..(429): unsure at all Xaa locations
MAGNEWINGYLEAILDSGASGGGGGGGGGSGAGAGGGGGGGGGGDPKSSSSPRGPHTIFNPTTYFVEEVVKGVDESDLHRTWIKVVATRNARERSSRLENMCWRIWHLARKKKQLEIEGIQRMSARQNEQEKVRREATEDLSEDLDEGEKGDIVGRPAPSGAPGKKFQXRNFSDLSVWSDENKEKKLYIVLISVHGLVRGENMELGSDSDTGGQVKYVVELARALAMMPGVYRVDLFTRQVSSPDVDWSYGEPTEMLTSGSHDAEGSGESGGAYIVRIPCGQSNKYIKKESLWPYLQEFVDGALAHILNMSKVLGEQVGHGKPVLPYVIHGHYADAGDVAALLSGALNVPMVLTGHSLGRNKLEQIMMQGRMSKEEIDATYKIMRRIEGEELALDAAELVITSTRQEIDEQWGLYDGFDVKLEKVLRAR

SEQ ID NO: 5347 - protein, 495 aa, Triticum aestivum
VVNLVQQDFQLKRPITNAVLKNQQVLLDFMHMVCIDSSMTTNKPIAWIDVHGNRFFPELCAGLVTSKPSQHGKSDPSGKSKAGECAGTLILTAEAESSSSDSVDAVLPHAKKVNNILEEGQEVHNYAAVENKAGPAICLNEPASGNIHAATYKQKIGQPVDSAVRKLLLEGAGQPFSEENIIGIYRTPLVDQQGRARFNLFQKELEATKMHRGNANVRYAWLPCSKDAMEEMMMRGVLEVTKPMLGPMYGIGTHLAPANCAKTCASYSDIDENGIMRMMLCRVIMGNVEVVLPGSKQFQPTNERFDSGVDDLQKPKHYVIWDANVHRHIYAEYAVVIKAPSMTNEYLAREDTASNISEIRNSGSAESVIKDDSSETMASPADKQQAPRFGRAPTRRPPTSPWMPLPMLFAAISTKVPRSDMDVIHGHYEEFKRRKISRPEFVRRLRQIFGDKLLVSTVMRLQPKVVAPMAGAEVLPRGTPGTGGSSTSRSSSLSI

SEQ ID NO: 5348 - protein, 252 aa, Triticum aestivum
  unsure (1)..(252): unsure at all Xaa locations
MSASYWQSTQCRFWTFTKEQLATMRQKLEEDNAELVRMFPLPQQRHLNIYFNQQLIRLAKRLTIRQQSMATAQVYMKRFYSKVEIRRTNPYLVIATAIYLACKIEESPQHIRLIVTEARQMWGDLVAIDTSKLGECEFFMISEMRSQLIVYQPYRTVVALRSELGLQEDEVQLARSVINDHFMTDLPLLYPPHVIAMVAMLXLALVLRPNNSGPGQNPSGAAAAAGLAAAQXALMRAQGQQTFRGRATDAAT

SEQ ID NO: 5349 - protein, 213 aa, Triticum aestivum
MSAPAHKFKVADLSLAAFGRKEIELAENEMPGLMQTRAKYAADQPLAGARIAGCLHMTIQTAVLIETLTALGAEVTWTSCNIFSTQDHAAAAIAAAGVPVFAWKGETDEEYNWCLEQQLTAFKDNKKLNLILDDGGDLTTLVHQKYPEMLKDCFGVSEETTTGVHHLYRMLRDNKLLVPAINVNDSVTKSKFDNLYGCRESLVDGIKRATDVM

SEQ ID NO: 5350 - protein, 325 aa, Triticum aestivum
  unsure (1)..(325): unsure at all Xaa locations
MAMERELMETFEAAKKAADAAAEEADGSSPEAERCLDALRRLREFRVNTDVLVSTQVGKRLRYLTKHPNSDIQAVAADLFGYWKKVVIEETGKKNGTPANGKSNNSAAKAEKPQPMKVERKSANVKVEKNSTSTTVKTEKNATAKLKKDTIQMQRASVPSGPPKLTSLVRCNDAAREKSRELLVDAFLKVSKEASGDGAEXIGGPLHRVTPCDPQGVAVTVECPLFPRLXRRPPRPAEVRPGSLVDMPADEMASDARKLENQQIKEKALFDCERASAPKASTDQFKCGRCGQRPTTYYQLQTRSADEPMTTFVTCVNCNNHWKFC

SEQ ID NO: 5351 - protein, 253 aa, Triticum aestivum
MPVISPLPFSLLPAPAAPAASRARWNSFPHHRLLRGMCSNGFDSTNCLRMEEVEPNLSPFLHKLFKEWDDCKARGLFHHNITTCETKVLPGEHNFVATLIEGRDQKKRPTEFGMNQVLQPFHSDKFNFTKVKPEEVIFRFQETENDSAQYFDGAPPTVSASPSSILINVSPIGYCHVLLIPQIQECLPQRVDRESFLLAMYVAREAKNPFFRVGYNSLGAFATINHLHFQAYYLKVQYPVEKAPTEKLTVVGN

SEQ ID NO: 5352 - protein, 139 aa, Triticum aestivum
  unsure (1)..(139): unsure at all Xaa locations
MTGTIANGVAAPTAPGLREKAAAAPLPEELAPEVVEGEREIVLGRNMHASCFAVKEPDADDEFTGEREAXMAGVLARYRRSLVERTKHHLGYPYNLDFEYGALSQLQHFSINNLGDPFIESNYGVHSRQFEVGGLGCSP

SEQ ID NO: 5353 - protein, 102 aa, Triticum aestivum
  unsure (1)..(102): unsure at all Xaa locations
XFFXXXQYSXGRGXEYMXIMIMACTLPVTXVHFPQWGSMFFPASADATEEEYYGSEWSEEEKRNGLHIAGQKFAENSRSERGRRNVILATSATPPNNTPQHV

SEQ ID NO: 5354 - protein, 288 aa, Triticum aestivum
  unsure (1)..(288): unsure at all Xaa locations
MAKSFTLLALLSALVVLSLLVSPIACSRKLPRPATKAHKNHTAATPSSSAAYGSGGWLAGGATYYGAPNGDGSDGGACGYQSAVGNRPFSSMIAAGNPSLYRDGKGCGACYEVKCTGNQACSGQPATXVVITDECPARAACLGEAAHFDMSGTSMGAMAKPGMADKLRAGGIIKIQYKRVPCKYPGMNIAFKVDQGSNPYYLEVLIEFEDDDGDLNAVDLMEANCGTWTPMAQNWGALYRLNSNTGKPLRGPFSLRLTSDSGRKLVVNNVIPASWKAGATYRSLVNYP

SEQ ID NO: 5355 - protein, 84 aa, Triticum aestivum
MKVKILQWHAVASWTWDAQDETCGICRMAFDGCCPDCKFPGDECPIIWGACNHAFHLHCILKWVNSQTSTALCPMCRREWQFKG

SEQ ID NO: 5356 - protein, 512 aa, Triticum aestivum
  unsure (1)..(512): unsure at all Xaa locations
MAADSKLQSPLLPPPAGSEGGGDDEGHGAASKRLESILSDESVPWARRMCAATAVEMRMLXGLAAPAVLVYMINYLMSMSTQIFSGHLGTLELAAASLGNTGIQVFAYGLMLGMGSAVETLCGQAYGANKFDMLGIYMQRSTVLLMATGIPLAVLYAFSRPILILLGESPEIASAAAIFVYGLIPQIFAYAANFPIQKFMQAQSIMAPSAYISTATLAVHLVLSYLVVYKFGLGLLGASLMLSISWWIIVIGQFVYIVTSSRCRLTWTGFSLQAFSGLPEFFKLSLASAIMLCLETWYFQILVLIAGLLKDPEMALASLSVCMTISGWVFMISVGFNAAASVRVSNELGAGNPKSAAFSVVVVTVLSFILAAIISIVILFFRDYISYIYTGGDDVAAAVSKLTPLLALTLILNGIQPVLSGVAVGCGWQAFVAYVNVGCYYVVGIPLGCLLGFYFDLGAAGIWSGMIGGTFMQTVILVWVTVRTDWNKEVAEARKRLNKWEGNKMPLLAGQE

SEQ ID NO: 5357 - protein, 281 aa, Triticum aestivum
  unsure (1)..(281): unsure at all Xaa locations
MATTVDWRSYRPDLPAAMYHMVDSRDQVMHAFAPATAQGAAPTISFAFPCPGAEQSAGLLRGASYLTPAQILQLQSQLHHVRRAPGAAMAAVGQPMKRHGVAALPARPATKLYRGVRQRHWGKWVAEIRLPRNRTRLWLGTFDTADEAALGYDAAAFXLRGESARLNFPELRRGGEHHGPPLDAAIDAKLRSICHGEDMPQSQSDETPAPTTTLTPISFPDVKSEPVCSVSESSSSADGEVSSCSDVVPEMQLLDFSEAPWDEFLLRKYPSLEIDWDAILS

SEQ ID NO: 5358 - protein, 243 aa, Triticum aestivum
  unsure (1)..(243): unsure at all Xaa locations
MLPSARPLLAAAAVLCFWLLVAVAEAKVHHYTWDISYQLKSPDCFEKLAVTVNGEAPGPTIRAXRGDTIVVAVHNKLETENTAIHWHGIRQIDTPWADGVAGVTQCPILPGETFTXYHAHYGMQRVAGLNGMIVVTVPDGFVEPFSYDEEHTVLLGDWWHKSVYEQATGLSSNPFVFVTEPQSLLINGRGMFNCSLAPSGTCNASRPDCALPTLFTAVPGKTYLLRIGSLTSLSSLYSRRATR

SEQ ID NO: 5359 - protein, 157 aa, Triticum aestivum
EGRLAWLFHLLGHTAPAQAASLLIFGPFVDLWLTDKRVDTFDYTMVVTFFIVLSCIIAVGTNLSQFICIGRFTAVSFQVLGHMKTILVLTLGFFFFGKEGLNFHVALGMTIAVIGMIWYGNASSKPGGKERQVYIPISEKTQKHGILSSQSELDLKV

SEQ ID NO: 5360 - protein, 264 aa, Triticum aestivum
  unsure (1)..(264): unsure at all Xaa locations
FGARWLRASSKQLLDPEEVDVVPAQDRERGVTPVEFRLVKIHMSFRCIXIISDIWRLAQQVKVRQRVIATAITYFRCVYTRKSMTEYDPRLVAPACLYLASKVEESTVQARLLVFYIKKMCGSDDKYRFEIKDILEMEMKLLEALDYYLVVYHPYRPLLQLLQDAGITDLTQFAXWGLVNDTYKMDLILIYPPYMIALACIYIASVLKDKDTTSWFEELRVDMNIVKNISMEILDFYDTYKIDPQRGLQEDKIIPVMNKLPSKA

SEQ ID NO: 5361 - protein, 154 aa, Triticum aestivum
  unsure (1)..(154): unsure at all Xaa locations
LLLTSKTNLQRSINDQDARPLRRRRRHHLFHHKEGEDFQPAADGGVDTYGYSTETVVTATGNDGEYERITKEEKHHKHKEHLGEMGAAAAGAFALYEKHEAKKDPEHAHKHKIEEEGAAAAAVGAGGFVFHEHHEKKQDHXEAKEASGEKKHHH

SEQ ID NO: 5362 - protein, 107 aa, Triticum aestivum; identical to SEQ ID NO: 2889

SEQ ID NO: 5363 - protein, 261 aa, Triticum aestivum
MSTAEATREENVYMAKLAEQAERYEEMVEFMEKVAKTADVGELTVEERNLLSVAYKNVIGARRASWRIISSIEQKEESRGNEAYVASIKEYRTRIETELSKICDGILKLLDSHLVPSATAAESKVFYLKMKGDYHRYLAEFKAGAERKEAAENTLVAYKSAQDIALADLPTTHPIRLGLALNFSVFYYEILNSPDRACNLAKQAFDEAIAELDSLGEESYKDSTLIMQLLRDNLTLWTSDNAEEGGDEIKEAASKPEGEGH

SEQ ID NO: 5364 - protein, 70 aa, Triticum aestivum
  unsure (1)..(70): unsure at all Xaa locations
SVYMAKLAEQAXRYEEMVEFMERVANATVGARPGGSYXLQERIRLFLADKNFIRARGSSWKIIFSILHMV

SEQ ID NO: 5365 - protein, 221 aa, Triticum aestivum
  unsure (1)..(221): unsure at all Xaa locations
RPVRVDIFSLGLVFFYVLTNGSHPFDCGDRYMREVNIRKGQYNLDLLDSLGDFSREASDLISSMLEADPKCRPTAKEVMAHPFFWSARKRLSFLCDVSDHFEKEPRDPPSSALAELESHASDVTGDFLKALPRDFVDSLGKQRKYNGARLLDLLRALRNKKNHYEDMPEALKRNVGXLPDGYLAFWTVRFPSLLLICWNVVWAIRWDKTDRFREYYEPAAL

SEQ ID NO: 5366 - protein, 172 aa, Triticum aestivum
GYVERLGHGGFESSWRKDAMDWICKVHSYYNFGPLTLCLSVNYMDRFLSSFDLPHDKSWMQQLMSVACLSLAVKMEETVAPLPVDLQVCDEYYAFEPRNIKRMELIVMETLKWRMHSVTPFSFLCYFLDKFNEGKPPSYMLVSRCAELIVATVKDYRFLSFRPSEIAAAVVL

SEQ ID NO: 5367 - protein, 150 aa, Triticum aestivum
  unsure (1)..(150): unsure at all Xaa locations
MESEGSTSPNGGAACAVCGGAAALYCPADAAALCVPCDAAVHSANPLASRHERVPLAAAVAATSGVYDLFAADEEGGSSWPTPGQGSPNSGSSGFSNNGSGIEMSLFDLLSDVDLVATGAGGXMLSDNGXVAPLWXQPGLAADXSAAWAS

SEQ ID NO: 5368 - protein, 262 aa, Triticum aestivum
  unsure (1)..(262): unsure at all Xaa locations
SVVAVITIPRMFPELKWYYAVVAYLLAPALGFSNAYGSGLTDINMAFNYGKVALLILAAAAGKEHGVVAGMVGCGMVKCMTSISADLMQDFKTGHLTLTSPRSMLIAQIIGTAIGCVISPLTFYVFYNAFDIGNQDSPWKAPYALIYRNIAILGVEGFSALPMHCLQLCCGFFAFALVANLMRDFLPQKYGKWVPLPMAMGFPFLVGASFAIDMCAGSLIVYIWAQXDRSKAAHMVQQLPPVKCGDGLGSPTSCLRWQVPTM

SEQ ID NO: 5369 - protein, 188 aa, Triticum aestivum
  unsure (1)..(188): unsure at all Xaa locations
LLRLGWRIMLGIGAVPSVLLAFMXVLGMPESPRWLVMKGXLADAKVVLXKTSDTPEEAAERLADIXTAAGIPLDLDGDVVTVPKNKGSSEEKRVWKDLILSPTKAMRHILIAGIGIHFFQQSSGIDAVVLYSPRVFKSAGFTGDNRLLGTTVAVGATKTVFILVATFLLDRIGRRPLLLSSTGGMIVS

SEQ ID NO: 5370 - protein, 203 aa, Triticum aestivum
  unsure (1)..(203): unsure at all Xaa locations
MSAETERSSTESSAASGLDFEDTALTLTLRLPGDPDRKRGASSSSSCSLADRSSLLAEAPPAPKARVVGWPPVRSFRKNALENVAAGSAKFVKVAVDGAPYLRKVNLRDYAGYDQLLRALQGKFCSHFTIRKFANDQMKLVDXDEMKLVDAVNGTEYVPTYEDKDGDWMLVGDVPWKMFEEACQRVRLMKNSEAVNIAPRAAR

SEQ ID NO: 5371 - protein, 204 aa, Triticum aestivum
  unsure (1)..(204): unsure at all Xaa locations
MSAETERSSTESSAASGLDFEDTALTLTLRLPGDPDRKRGASSSSSCSLADRSSLLAEAPPAPKARAVGWPXPVRSFRKNALENVAAGSTRAACAPAKFVKVAVDGAPYXLRKVNLRDYPGYDQLLRALPGKPCSHFTIRKFANDEMKLVDAVNGTEYVPPFEDKDGDWMLVGDVPWKMFEEACQRVRLMKNSEAVNVAPRAAR

SEQ ID NO: 5372 - protein, 301 aa, Triticum aestivum
MVFVKNQKTRAYSKRFQVKFKRRRQGKTDYRARLRLTNQDKNKYNTPKYRFVVRFTNKDVTAQIVYATIAGDIVMAAAYSHELPRYGLEVGLTNYAAAYCTGLLLARRVLKCRDLDQEYEGNVEATGEDFSVEPADERRPFRALLDVGLIRTTTGNRVFGALKGALDGGLDIPHSDKRFAGFKKDEKQLDAEIHRKYIYGGHVADYMKSLADEEPEKYQSHFSEYIKKGIEADNMESLYKKVHAAIRADPTMAKSTKEPPKTHKRYNPKKLTYEQRKANLVERLNALNSSAGADDDEDDDE

SEQ ID NO: 5373 - protein, 301 aa, Triticum aestivum
MVFVKNQKTRAYSKRFQVKFKRRRQGKTDYRARLRLTNQDKNKYNTPKYRFVVRFTNKDVTAQIVYATIAGDIVMAAAYSHELPRYGLEVGLTNYAAAYCTGLLLARRVLKCRDLDQEYEGNVEATGEDFSVEPADERRPFRALLDVGLIRTTTGNRVFGALKGALDGGLDIPHSDKRFAGFKKDEKQLDAEIHRKYIYGGHVADYMKSLADEEPEKYQSHFSEYIKKGIEADNMEALYKKVHAAIRADPTMAKSTKEPPKTHKRYNPKKLTYEQRKASLVERLNALNSSAGADVDEDDDE

SEQ ID NO: 5374 - protein, 277 aa, Triticum aestivum
  unsure (1)..(277): unsure at all Xaa locations
MTAPAELSREENVYMAKLAEQAERYEEMVEFMEKVAKTVDSEELTVEERNLLSVAYKNVIGARRASWRIISSIEQKEESRGNEDRVTLIKEYRGKIETELSKICDGILKLLETHLVPSSTAPESKVFYLKMKGDYYRYLAEFKSGPERKDAAENTMVAYKAAQDIALAELAPTHPIRLGLALNFSVFYYEILNSPDPARGSALRAAAGVXRACNLAKQAFDEAISELDTLSEESYKDSTLIMQLLRDNLTLWTSDITEDTAEEEIREAPKNDSSEGQ

SEQ ID NO: 5375 - protein, 243 aa, Triticum aestivum
RPRGRTSRWPVAMECGQCSARLAVTRGASSVQCAHCRRATRVERHGAVVHGAVGFVRSVFTNIGRARPHPGYPPVHGNKRALLVGINYTGTAAELPGPINDVKCMSFLLTLKYGFPGDCILVLTDEERYPYRRPTRANILLAMRWLVHGCSSGDSLVFHFSGHGDQEKDKDGDEQDGQDESICPLDWQLNGAILDRQPGRPVLRPLRPPARPRPLAPPRRRGPPLRLPNLCQIKKNGKPLWID

SEQ ID NO: 5376 - protein, 116 aa, Triticum aestivum
CTGQEFAEPTGTAATIRQRGYRRMQDRLGGVSEESTTGVKRIYQMQESGTRLFVAINVNESVTKSKFDKLYRCRHSLTDGLMKATDVMISGNVAVVCGYGDVGTGCAAALKQAGVS

SEQ ID NO: 5377 - protein, 135 aa, Triticum aestivum
  unsure (1)..(135): unsure at all Xaa locations
MALKVSFPGELAGAAILESPRSGAFRHLRQAVDFTFRKRDKRAAFLRMTCCSMQQGPLPAWPGRAVAEPERRSWDSPKPISIIGSTGSVGTQTLAIVAENPDKFRVVALAAGSNVTLLADQVQXFKPNLVAIGNE

SEQ ID NO: 5378 - protein, 206 aa, Triticum aestivum
TATILGAGFGRGGTSLPFWENVYGFDMSCIGKEVTGSSARFPVVDVLDSKDVVTDTAVLHYFDLATMKESEMDFTASLELRLPESGAAAVAGVTWCHGIVLWFDTGFTDRFCKDKPVVLSTSPFSTPTHWSQTIFTFEEPIAITNEKSVVGSSASVGSAECPAATIRSRISIVRASEHRSIDISIETTGISSDGQKHSWPAQIFNL

SEQ ID NO: 5379 - protein, 153 aa, Triticum aestivum
MAGVVEELVKKAGGCAVIDGGFATQLEALGADINDSLWSAACLITKPHLIKEVHMQYLEAGADVIISSSYQATIPGFLARGLLLEEAEGLLRTSVQLAREARDEFWKSTLRSSKPVYNRALVAASIGSYGAYLADGSEYSGSYGDDVTSEKLK

SEQ ID NO: 5380 - protein, 185 aa, Triticum aestivum
MAITLNNGFKMPIIGLGVWRMEDLVSSGLVRSIGISNYDIFLTRDCLAYSKIKPAVNQIETHPYFQRDSLVKFCQKHGICVTAHTPLGGAAANAEWFGTVSCLDDQVLKGLAEKYKKTAAQISLRWGIQRNTVVIPKSSKLERLKENFQVFDFELSKEDMELIGSIDRKYRTNQPAVFWGIDLYA

SEQ ID NO: 5381 - protein, 145 aa, Triticum aestivum
  unsure (1)..(145): unsure at all Xaa locations
MEAVNNGADIFTEDQQEIIKQFGRIKSETVPENKDAGSDDDDDDDEDEDDETGDADDDDADAGEDFSGEEGEDDDEDDDPEANGDDAGAGSDDDDGDDDDDDGEDGEDDDDDDEDEDEEDEEDEDQPPAXEEEMICLPAVSVSVR

SEQ ID NO: 5382 - protein, 178 aa, Triticum aestivum
  unsure (1)..(178): unsure at all Xaa locations
MAALATATAVHGSQAAGALAVAAQRLLVLLALAMEAVNNGADIFTEDQQEIIKQFGRIKSETVPENKDAGSDDDDDDDEDEDDETGDADDDDADAGEDFSGEEGEDDDEDDDPEANGDDAGAGSDDDDGDDDDDDGEDGEDDDDDDEDEDEEDEEDEDQPPAXEEEMICLPAVSVSVR

SEQ ID NO: 5383 - protein, 110 aa, Triticum aestivum
  unsure (1)..(110): unsure at all Xaa locations
MAHEDADYPAKLAEPAARNDQMAENMNIATAEDRDLTGXERNTLSGGNKNAIGASRASCFTVPPTHQNEASKANSTPVTLIKEHRPRIEAELAKICEEILEALDPHPIPS

SEQ ID NO: 5384 - protein, 312 aa, Triticum aestivum
  unsure (1)..(312): unsure at all Xaa locations
NGSSKGDVPEDANAHLVAIAERMATVKHKILVLSGKGGVGKSTFSAQLSFALAEMDHQVGLLDIDICGPSIPKMLGLEGQDIHQSNLGWSPIYVESNLGVMSIGFMLPNPDDAVIWRGPRKNRLIKQFLKDVDWGEIDYLVVDAPXGTSDEHXSIVQYXQATEVDGAIIVTTPQQVSLIDVRKEINFCKKVGVPVLGVVENMSGLRQAFTDLKFVKPGPAGETDATEWAMNYIKEKAPELLSVVACSEVFDSSKGGAEKMCHEMGVPFLGKVPMDPQLCKAAEEGRSCFADQRCSASAPALKSIIDKLIKTK

SEQ ID NO: 5385 - protein, 336 aa, Triticum aestivum
  unsure (1)..(336): unsure at all Xaa locations
NTRYWFSLEQSEEAGKADSCAGCPNQQICATAPKGPDPDLVAIAERMATVKHKILVLSGKGGVGKSTFSAQLSFALAEMDHQVGLLDIDICGPSIPKMLGLEGQDIHQSNLGWSPIYVESNLGVMSIGFMLPNPDDAVIWRGPRKNGLIKQFLKDVDWGEIDYLVVDAPPGTSDEHISIVQYLQXTEVDGAIIVTTPQQVSLIDVRKEINFCKKVGVPVLGVVENMSGLRQAFTDLKFVKPGPAGETDATEWAMNYIKEKAPELLSVVACSEVFDSSKGGAEKMCHEMGVPFLGKVPMDPQLCKAAEEGRSCFADQRCSASAPALKSIIDKLIKTK

SEQ ID NO: 5386 - protein, 173 aa, Triticum aestivum
  unsure (1)..(173): unsure at all Xaa locations
MENGGSKGDVPEDANAHCPGTQSEEAGKADSCAGCPNQQICATAPKGPDPDLVAIAERMATVKHKILVLSGKGGVGKSTFSAQLSFALAEMDHQVGLLDIDICGPSIPKMLGLEGQDIHQSNLGWSPIYVESNLXVMSIGFMLANPDDAVIWRXGPSKNGLIKQLFRGVDWGE

SEQ ID NO: 5387 - protein, 442 aa, Triticum aestivum
  unsure (1)..(442): unsure at all Xaa locations
MAPAQCARVQRVFHFGKGKSEGNKAMKDLLGGKGANLAEMASIGLSVPPGFTVSTEACEQYQAAGRALPPGLWEETLEGLRWVEEYMGARLGDPARPLLLSVRSGAAVSMPGMMDTVLNLGLNDEGAAGLAAKSGDRFAYDSYRRFLDMFGNVVMDIPHALFEEKLEAMKATKGVDNDTDLTANDLRELVGQYKNVYVEAKGEQFPSXPKRQLQLAVLAVFDSWDSPRANKYRSINQITGLRGTAVNVQCMVFGNMGNTSGTGVLFTRNPSTGEKKLYGEFLVNAQGEDVVAGIRTPEDLDAMRDHMPEAYAELVENCDILESHYKEMMDIEFTVQENRLWMLQCRSGKRTGTGAVKIAVDMVNEALVDRNTAIKMVEPGHLDQLLHPQFANPEAASYKGKVITTGLPASPGAAVGQIVFTAEDAEAWHAQGKSAILVRTET

SEQ ID NO: 5388 - protein, 284 aa, Triticum aestivum
  unsure (1)..(284): unsure at all Xaa locations
MTMHIYLPQTCQVQSVAPWDKKKLVKNGSLNVFRLDEYNATIEFYWAPFLVESNSDDPDIHSITDRMITPTSIAKHAANWIGVDYLIFNTYIWWMNTPKMKIVPDGSFTRKPVKYDELDRVVAYRQILETWSGWVEENVDPKRTMVXFMSVSPVHMQSEGWGSPDNIKCFSETQPVLNYTKTLDVGTDWDLFTESHEVTKAMKKVPVHFINITALSEIRKDAHTSVHTLRQGKLLTKEQQANPRKFADCIHWCLPGLPDTWNEFIYGHIVSSPLQRQIENQSAR

SEQ ID NO: 5389 - protein, 162 aa, Triticum aestivum
  unsure (1)..(162): unsure at all Xaa locations
LYGCXHSLPDGLMXATXVIIXGKVXVVCXYCDVXKGCXAALKQAGXRXNXTHNXPICXPQALMEGXQILTLEDVVSXADIFVXTTGNKDIIMVXHMMKMKNNAILXNICXXDNXIXMNGLXEXXWCQRXNIKRQTERXVFPETXKTXINXLCEGRLMXLDVH

SEQ ID NO: 5390 - protein, 362 aa, Triticum aestivum
MVKAKLLAVLALVAVAAPFLRAAGQEEGEGGARPSELLPFAVGAAPAGCDVGQGEWVYDEAAAPAYDEEACPYIPAELTCQAHGRPDKSYQHWRWQPRGCSLPSFNGTVMLETLRGKRMLFVGDSLNRAQYVSLLCLLHRAMPEGSTSFETVDALSIFRAKAYDATIEFYWAPLLAESNADDGVEHQLNDRVIRGAPMDRHSGMGAEEAYRLVLRTRGRWLDGNVDPKRSRVFFVTASPTHATGQLWGDEAEGSNCHGQTKPIADASYWGSTSRAMLRVTGEVLAASARVPVGVVNVTQMSEYRRDAHTQVYREQWAPPTKEQLADPKSYADCTHWCLPGVPDAWNELLYWKLFFPANDQAL

SEQ ID NO: 5391 - protein, 299 aa, Triticum aestivum
  unsure (1)..(299): unsure at all Xaa locations
MAKLLAVLALVAAAAPFLGVAGQEGEGGSELLPFXXDPAPEGCDVGQGEWVYDEAAAPAYEEAXCPXIPAELTCQAHGRPDKXMRNRQTFPLRMVVXSFNATVMLEMLRGKRMLFVGDSLNRAQYVSLLCLLHRAMPEGSSSFETVDALSIFRAKAYDATIEFYWAPLLAESNADDGVEHQLNDRVIRGAPMDRHSRFWKGADVLVFNSYLWWMTGDKIQILRGADNDMSKDIVEMGAEEAYRLVLHQVVRWLDGNVDPKKSRVFFVTASPTHASGQLWGDEAEGSNCHAQTKPIADAY

SEQ ID NO: 5392 - protein, 415 aa, Zea mays
  unsure (1)..(415): unsure at all Xaa locations
ASIWGWGPVVSAWEDEIGAISSRGVLRLRPGSHAGAGRAPAAEPDEVPREGCWAQLPLELLRMVLVRVEDQEPRWPGRSAVVACACVCRCWRAAVKEIVRVPEASGKLTFPISLKQPGPRDAPFKCFIRRNRAAQSYSMCLGVTDGXADDGKFLLAARKCRRPXCTEYLISLDAKNTSAGSYIGKLRSNFLGTKFTVYDAHPPCARAAVSKGVAVSKGYMIGSAQVSPGVPAGNYPVSHISYXATLSSRVPRKMKCVMDTIPVSAIKGGGTAPTQTEXIHEQMSSSSFASVPFFTRKPGHRPDSCPXSGVPPGTQNETKTVLKNKSPRWHQPLQCWCLNFHGRVTVASVKNFQLVAASGESGQDDDVILQFGKVGKDLLTMDFRYPISAFXAFAICLSSFDTKITREFVSQRHTL

SEQ ID NO: 5393 - protein, 112 aa, Zea mays
MSGVWVFEDGIVRRADSDPPSGAGAGGSRPNKVLVHVPSGEVVTSYDVLERRLRELGWERYLYDPCLLQFHQRSTVHLITVPRDFSRLKLVHMYDVVVKTRNVFEVRDAAPA

SEQ ID NO: 5394 - protein, 326 aa, Zea mays
MDTAAELELGLELEQKPAAGYWSVVGARPCDACAAEPARLHCRADGAFLCPGCDARAHGAGSRHARVWLCEVCEHAPAAVTCRADAAALCAACDADIHSANPLARRHERLPVAPLFGALADAPQPFPSPAPAQGEAVAEDYGSSEAEAASWLLPEPDNSHEDSAADTFFADSDAYLGADLDFARCMDGVKAIGVPVAPPELDIGAGSFCYPEHSMNHILSSSSEVAVVPDAQAAGLPVVVVVSRGEEREARLMRYREKRKNRRFDKTIRYASRKAYAETRPRIKGRFAKRRSAEGEDEALEHEEGACFSPTGSAPAASDGVVPSFC

SEQ ID NO: 5395 - protein, 357 aa, Zea mays
MGRDGGGGVAGGMSESVLRKVLLSYLYVAVWIFLSFSVIVYNKYILDPKMYNWPFPISLTMVHMGFCSSLAVALVRVLRVVDLPTSPSMTPQLYTSSVVPIGALYAMSLWFSNSAYIYLSVSFIQMLKALMPVAVYSIGVLFNKETFRSSSMLNMLSISFGVAIAAYGEARFDVRGVALQLAAVAFEATRLVLIQILLTSKGISLNPITSLYYVAPCCLCFLVVPWVFVELPRLRAVGTFQPDFFVFGTNSLCAFALNLAVFLLVGKTSALTMNVAGVVKDWLLIAFSWSVIRDTVTPINLFGYGIAFLGVAYYNHVKLQALKAKEAQKKAAQADEEVGSLLQERDGHGDHKSDNQA

SEQ ID NO: 5396 - protein, 103 aa, Zea mays
LFYYCALLQMSGATLFNLSLLTSDMWAVAIRVLFYQQEINRLYYLAFTVVAIGLIIYSLNDRSSDDETAGSTEAPAQYQQLPIEDNSTRIGSSSGKCLIGSRS

SEQ ID NO: 5397 - protein, 206 aa, Zea mays
PTRPSTRPPTRPIPFVKKAPQVTFKKPIGSVSVSGHKFVGCPMPCGVQITRLEHINALSSNVEYLASRDATIMGSRNGHAPIFLWYTLNRKGYRGFQKEVQKCLRNAHYLKDRLKEAGIGAMLNELSSTVVFERPKDEVFVRRWQLACEGNICHVVVMPSVNIDKLDYFLNELVEKRATWYQDGISQPPCIARVVGFENCLCGRHK

SEQ ID NO: 5398 - protein, 261 aa, Zea mays
MPGMDPGGGGSSRYFHQLLRPQQQQSSPLSPNSHVKMEHHRMSPDKSPLGEAEAGGSGAGADQPSSSAMVPVEGGGSGSGTGGTPTRRPRGRPPGSKNKPKPPIIVTRDSPNALHSHVLEVAAGADVVDCVAEYARRRGRGVCVLSGGGAVVNVALRQPGASPPGSMVATLRGRLEILSLTGTVLPPPAPPGASGLTVFLSGGQGQVVGGSVVGPLVAAGPVVLMAASFANAVYERLPLEGEEEEDETAAGAAGAEPQDQG

SEQ ID NO: 5399 - protein, 488 aa, Zea mays
LAVFVSDQVPQALIGDPGRIRQIITNLVGNSIKFTEKGHIYLTVHVVEEIMNCLEVETGTQSANTLSGYPVANRKRSWENFRVFSRELNSSEMPFAPIASDSISLIISVEDTGVGIPFDAQSRVFTPFMQVGPSIARIHGGTGIGLSISKCLVGLMRGEIGFASKPQVGSTFTFTAVLTRAHSSRNENKSSEFKGINALVVDHRPVRAKVTRYHLQRLGVQTELTTDLDQYISKINCGSQIAKLVLIDKETWLKESHSMPLLVTKLRNKDQPDSTKLFLLENPKSTAKSNSHIFREFNLNVIMKPLRASMLQVSLHRALGGIDKLHCRNGVLGNSTLGSLLHKKRILVVDDNIVNLKVAAGALKKYGAEVTCADSGKKAITQLKPPHSFDACFMDIQMPEMDGFEATKRIRVMERDLNEQIERGEAPPECAGLRQWRTPILAMTADVIQATHEQCLKSEMDGYVSKPFEGEQLYREVARFFQNQDQVQ

SEQ ID NO: 5400 - protein, 101 aa, Zea mays
  unsure (1)..(101): unsure at all Xaa locations
VADQHKCRYWFLKRKCLEAVTWFPPMISLFTGFAVAIFDSYTVAPFVLKMNDATMFNPSLLTXDMWAVAIRVLVSQQDNSTWNDHTLGVAARIMQRLLVLG

SEQ ID NO: 5401 - protein, 102 aa, Zea mays
  unsure (1)..(102): unsure at all Xaa locations
GLTINPDGFKADPKTDHKMKERLVGVSXEETTTGDKRLYQMHETRALXLYPAINGNDMXTKSKPDSLHGXRHSLPDALMRATDVRIATKDAEACGYWDDGKG

SEQ ID NO: 5402 - protein, 187 aa, Zea mays
  unsure (1)..(187): unsure at all Xaa locations
PRVRSVTLRRRFVRVEGRREEMAATEGVLLGMGNPLLDISGVVDDALLTKYDIQLNNGILVEELRRNIDPTMXRKINAWILAGGATQKCIRVAQWMLXTSGATSYIGCIGKDKVGXECKKNPQGVRYTRCVPTRIRICAHGTCTICLVGGERKXIVNNTPGNCYKFDHLKRPNIWALVEKAKIIYIG

SEQ ID NO: 5403 - protein, 623 aa, Zea mays
MPATSTKPEYNVDSIDDELANGPLAKRSCRDPLCCLLFVLFMGGMVGIAIWGYTQGNPNLIGRGYDTDGRMCGVDDAVKDYPYLYFPTPVSGQLNKALCLSSCPTSDSLPATLGCKTTTEYPDCVADGNNQTLVADYASNSYVGNIYIYSTKEYVSRFCIPSEAGELLKTATATMMNSSGADILEQWIGDIRETWPVIAVSIAVAFVIGFTYMVLLRYCSGVLTWFAILAFIAGTAILGWRFYESAKKLETQNTEAGNTDDDSTTSKTVLMEKVIAYICWGVAGFTFLAVLCLYSRIKLAIAIMKAAADYVKDTPSVFLVPPVTVVILLIFYAFWAGAAVFLVSSGEATHTAGSVFGSFTFDKTLKRLLIYHLFGLLWFNAFVIAATQFVLASSTALWYFSQGTGQAAPKTIRTSVKRFFRYHFGSIAFGSLILALIQLVRIILAYMEAQANRMKGKDNKIVKFTLKCLQCYVGCFERFIKFLNKNAYIQIALSGKSFCGAAKDAFVLIASNPLRMGVVSSIGSIFVFFGKIFIAAITALIAFIVLTNWDRYSQNIYSPFIPTLVIFIFAYVVGAIFMTVYGLAADAILACFILDEQINKKKNAPPRHCPSSLRDFLDNHKRN

SEQ ID NO: 5404 - protein, 104 aa, Zea mays
MRRRGSNSSPLAAAALPLLLLLVAGCFHCAATAARHLPSPGAPVQALDHQGTQHDDTTSLASTTTTTMGAEACDDGNGKDECVLRRLLVDAHLDYIYTQHKGKP

SEQ ID NO: 5405 - protein, 323 aa, Zea mays; identical to SEQ ID NO: 845

SEQ ID NO: 5406 - protein, 486 aa, Zea mays
  unsure (1)..(486): unsure at all Xaa locations
MALSVEKTASGREYKVKDLSQADFGRLELELAEVEMPGLMACRAEFGPSQPFKGARISGSLHMTIQTAVLIETLTALGAEVRWCSCNIFSTQDHAAAAIARDSAAVFAWKGETLEEYWWCTERCLDWGAGGXGPDLIVDDGGDATLLIHEGVKAEEEFERSGKVPDPASTDNAEFKIVLTIIRDGLKADPKKYRKMKERLVGVSEETTTGVKRLYQMQETGALLFPAINVNDSVTKSKFDNLYGCRHSLPDGLMRATDVMIAGKVAVVCGYGDVGKGCAAALKQAGARVIVTEIDPICALQALMEGLQVLPLEDVVSEADIFVTTTGNKDIIMVDHMRKMKNNAIVCNIGHFDNEIDMLGLETYPGVKRITIKPQTDRWVFPETNTGIIVLAEGRLMNLGCATGHPSFVMSCSFTNQVIAQLELWKEKSSGKYEKKVYVLPKHLDEKVAALHLGKLGAKLTKLTKSQADYISVPIEGPYKPAHYRY

SEQ ID NO: 5407 - protein, 124 aa, Zea mays
  unsure (1)..(124): unsure at all Xaa locations
SRPAGKRVFLFPQCYAEKXALGEVSQELLDTQVNPAVWEISGHMVLKRRMDYEEASETSAWKLLAEVSLSEERFEEVKAYIFSAAGLVQYDEEEEEASDGEGPTAYVPVKVTPLPVAEGCLVLP

SEQ ID NO: 5408 - protein, 146 aa, Zea mays
  unsure (1)..(146): unsure at all Xaa locations
HLLSQSRRCVGSNTESEQQHKKEISSYSHMLTVVLFFYAPRSLFLPALRTFDXAQPVHRMEVWAFSNHXYQANXHLPYLTCNDLCRIFDSCHXYHCPPMYTSITTLITSYYISNICKTTHHKILFSKSETSYANDHDAVTSSKNLF

SEQ ID NO: 5409 - protein, 485 aa, Zea mays
MALSVEKTSSGREYKVKDLSQADFGRLELDLAEVEMPGLMACRTEFGPSQPFAGARISGSLHMTIQTAVLIETLTALGAEVRWCSCNIFSTQDHAAAAIARDSAAVFAWKGETLEEYWWCTERCLDWGEAGGPDLIVDDGGDATLLIHEGVKAEEEYEKTGKIPDPESTDNAEFKIVLTIIRDGLKADPKKYRKMKERLVGVSEETTTGVKRLYQMQETGALLFPAINVNDSVTKSKFDNLYGCRHSLPDGLMRATDVMIAGKVAVVCGYGDVGKGCAAALKQAGARVIVTEIDPICALQALMEGLQVLPLEDVVSEADIFVTTTGNKDIIMVDHMRKMKNNAIVCNIGHFDNEIDMLGLETYPGVKRITIKPQTDRWVFPETNTGIIVLAEGRLMNLGCATGHPSFVMSCSFTNQVIAQLELWKEKSSGKYEKKVYVLPKHLDEKVAALHLGKLGAKLTKLTKSQADYISVPIEGPYKPAHYRY

SEQ ID NO: 5410 - protein, 107 aa, Zea mays
  unsure (1)..(107): unsure at all Xaa locations
TKTVYEEELTVEERNLLSGAYKNVIGARRASWRIGNSIEQKEESLKNXYPVDLIKEYSGXIEAXLSNICDELLKLLDSHLEPYCNAAESNVFYLKMKGDYHTSLTEF

SEQ ID NO: 5411 - protein, 460 aa, Zea mays
SHQTTFSPQGLLGITCQVRWIGHRLVNTSSPTNKFDPAAHLSRASSIVITMVGSSPLQAVLVAPGVKDRKVLAFKRDALKDKDAVSGLIHSILASSPAQRSAFYVFDLAKVVDLFRAWRRALPDARPCYAVKCNPDPALLGALAALGAGFDCASRAEIEAVLALGVRPGDIVYANPCKPEAHLEYAAEVGVNLTTYDSEEEVAKVRRCHPGCELLLRLKGPDGGDVRVDLGTKYGAHPDEVVPLLRAAQRAGVGVAGVSFHVGSGASNLHVYRGAIQAARAAFDAAAALGMPPMRVLDIGGGFVSGPTFDDAAAVINDALAHHFGDLPCVEVIAEPGRYFAETAFTLAARVIGKRTRGEVREYWIDDGLYGSLNCIIMDHYVPTPRPLASPRPGDKTYTSTVFGPTCDSLDTVLTGYLLPEMSVGDWLVFDDMGAYTTGAGSNFNGYATSDIKIYVAYSS

SEQ ID NO: 5412 - protein, 111 aa, Zea mays
  unsure (1)..(111): unsure at all Xaa locations
FGADVAADTIRQTSGLAGFPKRDESAHDAFGVGHSYTSISGGAXAWPVARHLLFFKSEVISVIXTGAMMDGQAYEAMNNSGYLDANMIGGLNDXKQVSFPTATLDGPSKPR

SEQ ID NO: 5413 - protein, 190 aa, Zea mays
  unsure (1)..(190): unsure at all Xaa locations
RRPARSYYLLINVNQASTKSKFDNXLYGGRHSLPHGLMRATDIMIAGNGAXDRGYCDVRKGXAPTLKQAGARNIGTYIDPICSLQALMKGLQDLTFEDVIXEADILTTTTGNNDITMGDHMRKMNNNAXIVCNIDHYDTEIDMLRLQTYPGDKRITIKPHTDQMVFPETNTGIIVHAEGLLMNLRCATGH

SEQ ID NO: 5414 - protein, 131 aa, Zea mays
MSEEKHHHFFNHHKKDEEQPAGEYGYSETEVVTATGEAEYERYKKEEKEHKHKQHLGEAGAIAAGAFALYEKHEAKKDPEHAHRHKITEEVAAAAAVGAGGYVFHEHHEKKKDHKDAEEASGEKKHHHLFG

SEQ ID NO: 5415 - protein, 110 aa, Zea mays
SSDGYWFVAYVPSPVRHSGSPVPVLNESGAKSTSRQAPAEQVQPVAAAPQAGEDDDDDDDDDDDDDVDLDLGDDDDDDDDDDDGTAADDDDDDDDDEDYFERFFDDILGA

SEQ ID NO: 5416 - protein, 383 aa, Zea mays
MIGFPPWNCLPTGIAKIAAAAAVVVAALASSGLALPRPRAAPPPAGSGPLMSKAKVYTDVNVLRPKEYWDYEALTVQWGEQDDYEVVRKVGRGKYSEVFEGINVNNNEKCIIKILKPVKKKKIKREIKILQNLCGGPNIVKLLDIVRDQHSKTPSLIFEFVNNTDFKVLYPTLTDYDIRYYIYELLKALDYCHSQGIMHRDVKPHNVMIDHELRKLRLIDWGLAEFYHPGKEYNVRVASRYFKGPELLVDLQDYDYSLDMWSLGCMFAGMIFRKEPFFYGHDNHDQLVKIAKVLGTDGLNAYLNKYHIELDPQLEALVGRHSRKPWSKFMNADNQHLVSPEAIDFLDKLLRYDHQDRLTAREAMAHPYFLQVRAVENSRTRPQ

SEQ ID NO: 5417 - protein, 219 aa, Zea mays
  unsure (1)..(219): unsure at all Xaa locations
MAAAARPASAHLLLLAPLPSPPRLSHLIHTRRLYALAPARRPAAARARRESSPPSAPSPPAPGDSLDCVGTGSDVECFVDAGAEDAAPLLPALSAGASKDDGKSEGDAAVSASPTGRELLEWASLVSPFFFWGTAMVAMKGVIPRTGPFFVAAIRLLPAGALLVAFAXAARGRKQPSGWEAWLAIAAFGLIDAACFQVHNHGHVDFLLAFAGLSRGGTA

SEQ ID NO: 5418 - protein, 262 aa, Zea mays
MVFTIDLSGKTIVVSGGNRGIGLAMSEACANAGANVAILFHSHPKAHEAAENVAKQFNVKCKAYQCDVGDAKLVKDTVAQIEGDLGTPIHGLCANAGVSVVKPALELTTEDFHKVFNANVLGAFNTCQALAQHWVEKGYKTGSIVITSSMSSSLYNQKGLNDPLTQIFYNASKGAVTNMVKGLATEWVKHGIRVNALEPGFCETEQTSGMDPKIREWQAASVPMGRFSQPHEQADPAILLLSDKASYITGTQLRPDGGFSAY

SEQ ID NO: 5419 - protein, 154 aa, Zea mays
MARPQQRYRGVRQRHWGSWVSEIRHPLLKARIWLGTFETAEDAARAYDEAARIMCGPRARTNFPADANGPPPSFLSAALVDKLHRFNLASVQAAQRQREAAAAAAAAAATSAPATPPTPPATQWGGGGRSLEEQHVEQMIEELLDSDFSMEICC

SEQ ID NO: 5420 - protein, 95 aa, Zea mays
  unsure (1)..(95): unsure at all Xaa locations
CVSSSQRNWFLLKEDNIGSCELLSKTAPIQAISLIILGPFVECXLNGRSLLNYPFSGGATFFILLSCSLAVFCNMSQYLCIGRFSATSFQVLGHM

SEQ ID NO: 5421 - protein, 148 aa, Zea mays
  unsure (1)..(148): unsure at all Xaa locations
GINPKKGGRGEHARQNTEGNDXAEGQGQKSRTTEARPERRTNYARSXADMSMAGYXLDXGDRHPSNLNVDRYSGKILHIDFGDCLEASMNREKFPEKEPIRXTRMLEKAMEVSGIEGTFRTTCENEMQGLRTNRDSGMAMKEASEHDP

SEQ ID NO: 5422 - protein, 127 aa, Zea mays
  unsure (1)..(127): unsure at all Xaa locations
MRGRVGPREVLTGDKQKELRPLDELDDXNHGDQDXDACTTQTRSGSSHGMSSLKERQCKHPLGVTXPGEVSRAKKNGLDYLFHLYEQCRIFLLQVQYLAKLNGHKSPTKVTNQVFLFAKTCCASYIN

SEQ ID NO: 5423 - protein, 276 aa, Zea mays
  unsure (1)..(276): unsure at all Xaa locations
LSVSGGARSVRRRRRRRAAGLSVSAVATETPRTEEQQPSPSGEERFDWLDQWYPLAPVCDLDPRAPHGKTVLGLSVVAWYDRGAGEWRVFDDACPHRLAPLSEGRIDDRGRLQCXXHGWCFDGAGACKFIPQAPALGPPVHTSSRACVASYPCVVQNNILWFYPRADPEHSDVLQRKRPPLIPEIDDPDFVTVYGIRDLPYGYDILVENLMDPAHVPYAHKGIMRGIRKKEDPGRVDYYKEGGGPVKMKIEQANHRKGLCHRKSGANSSSWCPCTF

SEQ ID NO: 5424 - protein, 105 aa, Zea mays
  unsure (1)..(105): unsure at all Xaa locations
GIHKVVQKGSRDAXYLKDRLKVAGIGAMLYELTPTSWCXRSTDEASARPWAVAREWNICHPWGTTTVNIVKLDYVLNEVAEKRATRDQDGISPSRCIDRVAGFEN

SEQ ID NO: 5425 - protein, 423 aa, Zea mays
  unsure (1)..(423): unsure at all Xaa locations
MATNGYSNGGSTKGKPIKCKAAVAWGPGEPLVMQEVEVAPPARMEVRVKVLYTSICHTDLSFWRGENERQRRFPRILGHEAAGVVESVGEGVEDLAPGDHVVPIFNGECGTCAYCHSSATNLCGTYRVDAFKSTMVSDDGTRFSVVNTSGDTVPVYHFLNTSTFAEYTVLDAACAVKINPAAPLQKMCLLSCGASSGVGAVWNTANVSAGSTVAIFGLGAVGLAVAEGARLRGAARIIGVDINPEKFTKGREMGVTDFVDSRASDKPVHEVIREMTHGGVDYSFECTGINGVLREAFVSTHDVLRSICLLASXLASPLNFSNVLRCATHMQGWGLTVVLGIHATPKMLPLHPMELFDGRRITACVFGDVKGKSQLPAIVDKCVNGDLDINLDGFITHRMPFSDINKAIQLLEEGKSLRCVLNL

SEQ ID NO: 5426 - protein, 549 aa, Zea mays
  unsure (1)..(549): unsure at all Xaa locations
MGRRMEAPSSPASLVVVLLLGSLLLQARADDPYRFYTWNVTFGDIYPLGVKQEGILINGQFPGPQIDAVTNDNIIVNVFNNLPVPFLLSWQGIQQRRSSWQDGVYGTNCPXIPPGGNFTYNMQFKDQIGSYYYFPSLLFHKAAGGYGAIRVLSRPRIPVPFDPPAGDFTILAGDWFKLNHTDLKGILDSGNDLPFPDGLLINGQGWNGNRFTVDQGKTYRFRVSNVGIATSVNIRIQGHSMLLVEVEGSHTMQSTYTSIDVHLGQSYSFLVTADQPPADYSIVVSTRFTTPVLTTAAILHYSSSNGAASVPPPPAPTVEIDFSLNQARSIRWNLTASGPRPNPQGSYHYGLVNTTRTIRLANSRATINGKLRYAVNGISFVPADTPLKVADFYSIPGVFTLGSMPDNPTGGGAYLQTSVMAANMRDYVEVVFENAENLVQSWHIDGYAFWVVGMDGGQWTPASRQGYNLRDAIARYTLQVYPQSWTAIYMPLDNVGMWNVRSESWARQYLGQQFYLRVYSPANSWRDENPIPKNALLCGRASGRRTRPL

SEQ ID NO: 5427 - protein, 311 aa, Zea mays
MAASVALSSGHRMPAVGLGVWRMEKADIRGLIHTALRVGYRHLDCAADYQNEAEVGDALAEAFQTGLVKREDLFITTKLWNSDHGHVLEACKDSLKKLQLDYLDLYLIHFPVATRHTGVGTTSSALGDDGVLDIDTTISLETTWHAMEELVSMGLVRSIGISNYDIFLTRDCLAYAKIKPAVNQIETHPYFQRESLVKFCHKHGICVTAHTPLGGSTANTEWFGSVSCLDDPVIKSLAEKYGKTPAQLVLRWGLQRNTVVIPKTSKLERLQENFEVFDFDISGEDMEKMKAVDRKYRTNQPAKFWGIDLFA

SEQ ID NO: 5428 - protein, 723 aa, Zea mays
  unsure (1)..(723): unsure at all Xaa locations
MEMNSSGEETVVKVRKPYTITKQRERWTEAEHKRFLEALKLYGRAWQRIEGAXEHVGTKTAVQIRSHAQKFFTKLEKEAMNNGTSPGQAHDIDIPPPRPKRKPNSPYPRKSCLSSETQTKELPNDKSTKPNMPLSNGHVKMVGDASLQNFQRKELSEKGSRSEVLNLFRDAPSASFSSVNKSSSNHGAPRRTEASKTESRDMSIMENNSFNPNTQEDVKVISDQEMERLNGIQIRSKCEHSHEGYLDISTQQMKLMPKSVETTYVDEQTARASHTLAESNGTASVPVTVPEGTHPDQTSDQVGINGSMNPCIHPMVSADPKFGSSATPQTFPHNYAAFAPMMQCNCNQDTYRSFTNMSSTFSSMLVSTLLSNPAIHAAARLAASYWPAAEGNTPIDPNQENPADGVQGRNIGSPPSMASIVAATVAAASAWWATQGLLPFFAPPVAFPFVPAPSAAFPTVDVPRPSEKDRDCPVENAQNECQEARKQVQFEGLRVAASSESDGSGKGEVSLHTELKLSPAQNADATPTTGAGTNDAFRNKKKQDRSSCGSNTPSSSDVDAGNVPEEDNANEKAKQASCSNSSAGDTNHRRFRSNGSTSDSWKEVSEEGRLAFDALFSREKLPQSFSPPQAVDSKEVAKEEEDEVTTVAVDLNKNATSIDHDDLDTMDEPRASFPNELSHLKLKSRRTGFKPYKRCSVEAKENRVPTSDMVGTKRIRLDSEAST

SEQ ID NO: 5429 - protein, 511 aa, Zea mays
MAAPGGLDQDCAQDAAIKLFGRSIPVLHSSVFAATAAAESEVSTKLANDVRSKDGMPCLPNMSLIVKTNPFPSKSNMKNGLQAISSQHGKMEADSNSEEAKNSLQAIISQPGKRYDSKSEEAKTESGGSGQEKVLKKPDKILPCPRCNSMETKFCYFNNYNVNQPRHFCRNCKRYWTAGGTMRNVPVGSGRRRNKDPSHHHHFTKVCDYTIATNGDVSDATQRQSVAAKLCLLQGSGKQNETACKSVSPVSNIKEQNNADLISLVSGDNKEEKSCASSAVVSGSSENWMPENTVKKEEDNTSAYGDGVKLPDHKMQSHHAGPVSVFSRNPAAVMVTNQCSEDGIHTPGNGTVSPLSLPPPPMVPTPGICAPAVPFPFPLVPAFVSCIPGWPSGLWGAPWPGSSAPTLLSLPPNGLAGSNSGVLGKHTRVANLQEEQKAEKKFWVPKALRIDNPEEAAKSSIWASLGIKPDDRIIFKSFQSKDLKNSATKMPESLQANPAAFSRSQTFQERA

SEQ ID NO: 5430 - protein, 238 aa, Zea mays
MLSVTGEDPGGQAHPAPRHHHHASGRKKSRDSLEAPSNSSDGGKTTDHADEATCRRVKVARARVCTRIDPSDATTLAVKDGYQWRKYGQKVTRDNPSPRAYFRCAYGPSCPVKKKVQRSAEDSSVLVATYEGEHNHPCPTRAGDLPSSATASGSVPRSISNSINSSGPAITLDLTMNGAGGVRVLEGAEAPDLRKLCQEIASPDFRTALVEQMARSLTKDCKFTDALAAAILQQLPGY

SEQ ID NO: 5431 - protein, 618 aa, Zea mays; identical to SEQ ID NO: 1023

SEQ ID NO: 5432 - protein, 276 aa, Zea mays
MLLNPASETSVLDTIRQHLLEEPAAAEARPADESFGSLVADQWSGSLPFRTDDADDMVVFGVLQDAFAYGWLPDGSFVHVKPEPVRSPDSSSYHPCSYDGSPCFGLLDPEPPLTPGTTTPGRGQEEAAAAMARGKHYRGVRQRPWGKFAAEIRDPARNGARVWLGTYDTAEDAALAYDRAAYRMRGSRALLNFPLRIGSGDKRPSPAPPEPATSSDSSSSASGSHKRRKRGEAAAANMAMALVPPPSQLNRPPQPWFPAAPVEQAAMAPRVEQIVV

SEQ ID NO: 5433 - protein, 379 aa, Zea mays
MATAGKVIKCRAAVTWEAGKPLSIEEVEVAPPQAMEVRIKILYTALCHTDVYFWEAKGQTPVFPRILGHEAGGIVESVGEGVTDVAPGDHVLPVFTGECKECAHCKSEESNMCDLLRINVDRGVMIGDGKSRFTISGQPIFHFVGTSTFSEYTVIHVGCLAKINPEAPLDKVCILSCGISTGLGATLNVAKPAKGSTVAIFGLGAVGLAAMEGARLAGASRIIGVDINPAKYEQAKKFGCTEFVNPKDHDKPVQEVLIELTNGGVDRSVECTGNVNAMISAFECVHDGWGVAVLVGVPHKDDQFKTHPMNFLSEKTLKGTFFGNYKPRTDLPNVVEMYMKKELELEKFITHSVPFSEINTAFDLMLKGESLRCIMRMED

SEQ ID NO: 5434 - protein, 99 aa, Zea mays
PGAVFRGEGFNGPEAVPRLEQWLIKNPSSHPQYGVWELNQKDFWGMFDGSPYEPPPPKYGGGGPFMRVYPKSQKGPHPEKEVQEAEAPLLEPAPPGEGA

SEQ ID NO: 5435 - protein, 405 aa, Zea mays
MHDLVVSSNFLEQEGVSSSACSALFYFTPSALELEPSPSPQTQASDLSHLRRRFVRVEGRREEMAATEGVLLGMGNPLLDISAVVDDAFLTKYDIKLNNAILAEEKHLPMYDELASKSNVEYIAGGATQNSIRVAQWMLQTPGATSYMGCIGKDKFGEEMKKNAQAAGVTAHYYEDETAPTGTCAVCVVGGERSLIANLSAANCYKSEHLKRPENWALVEKAKYIYIAGFFLTVSPDSIQLVAEHAAANNKVFLMNLSAPFICEFFRDAQEKVLPYADYIFGNETEAKIFAKVRGWETENIEEIALKISQLPLASGKQKRIAVITQGADPVVVAEDGKVKTFPVILLPKEKLVDTNGAGDAFVGGFLSQLVLGKGIEDCVRAGCYAANVIIQRPGCTYPEKPDFN

SEQ ID NO: 5436 - protein, 236 aa, Zea mays
  unsure (1)..(236): unsure at all Xaa locations
ITVYVYLVNQVHMDYLEAGANIIITASYQATIQGFESKGFSKEQSENLLTKSVEIALEAREMFLKEHXEKFTPIQHPVLVAASLGSYGAYLADGSEYSGDYGEAGTKEFLKDFHRRRLQAYVELLEECNINIPAWFSFNSKDGVHIVSGDSLIECTTIADKCAKVGAVGINCTPPRFIHGLILSIRKVTDKPILIYPNSGERYDGEKKEWVESTGVSDGDFVSYVNEWCKDGAVLI

SEQ ID NO: 5437 - protein, 450 aa, Zea mays
MVAECQGGGGAAAGGGDFLIKLFGMTIPVPECGDAKDLQQSKSNRWTEQDQDSHGLETAPAPAHTDTSDPSPQPEVVDAEDPTETQQRPCNGDGDGDAAGQREKLKKPDKVLPCPRCNSMDTKFCYFNNYNVNQPRHFCKNCQRYWTAGGAMRNVPVGAGRRKNTNAAASHFFQRVRATNATVLSFGGHGGAPPAARLDLDLAEQLSHQLAPVRSAGDAGRPCSEGSSSRDGNGSRSSVDEAAANADDGSVQQHPGPASMNSSGATVWPPYSCAPAPAAYFPQGIAIPIYPAAPAYWGCMVPGAWSLPWPVQHPSSSSSPTTTSAPSVVSSSGAADDSSSHALGKRPRDREGDDGRNGGNAKVWAPKSIRIDDVDEVARSSIWSLVGIKGDQTKQQDAADDHAGGHSKQLGTVFEPKRGEATKKAMMTSSPLLHANPVALTRSVAFQEGS

SEQ ID NO: 5438 - protein, 387 aa, Zea mays
MADQANQPTVLHKLGGQFHLSSTFSEGVRARNICPSVSSYERRFATRNYMTQGLWGPSMSVSGGINVPVMQTPLCANAPAEKGGKNFMIDFMMGGVSAAVSKTAAAPIERVKLLIQNQDEMIKSGRLSEPYKGIADCFKRTIKDEGFSSLWRGNTANVIRYFPTQALNFAFKDYFKRLFNFKKDRDGYWKWFAGNLASGGAAGASSLFFVYSLDYARTRLANDAKAAKGGGERQFNGLVDVYRKTLKSDGIAGLYRGFNISCVGIIVYRGLYFGLYDSIKPVVLTGNLQDNFFASFALGWLITNGAGLASYPIDTVRRRMMMTSGEAVKYKSSLDAFQQILKKEGPKSLFKGAGANILRAIAGAGVLSGYDQLQILFFGKKYGSGGA

SEQ ID NO: 5439 - protein, 267 aa, Zea mays
QVKYVVKLARALPATAGVHRVDLLTRQISCPDVDWTYGEPVEMITHQADDGDGSGGGAYIVRLPCGPRDKYLPKESLWPHIPEFVDRALAHVTNVARALGDQQQQQPDAGAGAGAAAPVWPYVVHGHYADAAEAAAHLASALNVPMVMTGHSLGRNKLEQLLKLGRMPRAEIQGTYRIARRIEAEETGLDAADMVVTSTKQEIEEQWGLYDGFDLMVERKLRVRRRRGLSCLGRYMPRMVVIPPGMDFSYVDTQDLAEGDADLQACK

SEQ ID NO: 5440 - protein, 122 aa, Zea mays
MCLSEEKTYTGREHKGKDLSHADFVRLEIELTAVEMPSLMACRAAFVPDRPFAGARIWERVHMTIQTVGLIETLTALGAEVRWRYCNMLLTQDHAGVDIARDSDCVFVWKGETLEEYWWCTE

SEQ ID NO: 5441 - protein, 694 aa, Zea mays
  unsure (1)..(694): unsure at all Xaa locations
MEMNSSGEETVVKVRKPYTITKQRERWTEAEHKRFLEALKLYGRAWQRIEEHVGTKTAVQIRSHAQKFFTKLEKEAMNNGTSPGQAHDIDIPPPRPKRKPNSPYPRKSCLSSETQTKELPNDKSTKPNMPLSNGHVKMVGDASLQNFQRKELSEKGSRSEVLNLFRDAPSASFSSVNKSSSNHGAPRRTEASKTESRDMSIMENNSFNPNTQEDVKVISDQEMERLNGIQIRSKCEHSHEGYLDISTQQMKLMPKSVETTYVDEQTARASHTLAESNGTASVPVTVPEGTHPDQTSDQVGINGSMNPCIHPXFLQTQKFGSSATPQTFPHNYAAFAPMMXATATKIRTAARLAASYWPAAEGNTPIDPNQENPADGVQGRNIGSPPSMASIVAATVAAASVWWATQGLLPFFAPPVAFPFVPAPSAAFPTVDVPRPSEKDRDCPVENAQNECQEARKQVQFEGLRVAASSESDGSGKGEVSLHTELKLSPAQNADATPTTGAGTNDAFRNKKKQDRSSCGSNTPSSSDVDAGNVPEEDNANEKAKQASCSNSSAGDTNHRRFRSNGSTSDSWKEVSEEGRLAFDALFSREKLPQSFSPPQAVDSKEVAKEEEDEVTTVAVDLNKNATSIDHDDLDTMDEPRASFPNELSHLKLKSRRTGFKPYKRCSVEAKENRVPTSDMVGTKRIRLDSEAST

SEQ ID NO: 5442 - protein, 644 aa, Zea mays
MNSAAPAPIKRAGRPASALLSLLLALHVSISKAGLARVGQLDRPSLATSRSAGMHASLGMSSSSSSSSRGWSSYSPLLFATLLTLLLCSQLAIAKEQYHEFVVKEATVTRLCGTQQQRIMTVNGQFPGPTVEVAEGDALIVRVRNRGSYNVTVHWHGVRQMRTAWADGPEFVTQCPIRPGTSYTYRFTVAGQEGTLWWHAHSSWLRATVHGALIIRPRAGVPYPFNAGDTPAREITIILGEWWNMNPIDVVRTATRTGAAPNISDALTVNGQPGDLYKCSSNGTTTFSVTSGETNLLRFINAALNTELFVSLAGHTMTVVGADASYTKPYATPVILVAPGQTTDVLVTFDQPPSRYYLAARAYASAQGVPFDNTTTTAIFDYGTGASNSSSPAMPTLPAYNDTATATAFTTSLRGLRAADLPARVDESLFFTVGVGLFNCSSGQTCGGPNNTRFAASINNVSFVLPSTTSILQAHYAYAAGGATPAGVFTADFPANPPVRFDYTAPNVSRALWQPVPGTRVYSLKYGAAVQLVLQGTNVFAAENHPIHLHGYDFYILAEGFGNFDAAADTASFNMDDPPMRNTVGVPVNGWAVIRFVADNPGVWLMHCHLDVHITWGLAMAFLVEDGVGELQSLEAPPSDLPIC

SEQ ID NO: 5443 - protein, 408 aa, Zea mays
MGQKRALLVGINYLGTDGELKGCLNDVARMRRCLVGRFGFDEADIRVLADADPSTPPPTGANIRLELERLVAGARPGDALFFHYSGHGLQLPAETGEDDDTGYDECIVPCDLNLIKDQDFTDLVAKVPDGCRFTMVSDSCHSGGLIDKTKEQIGNSTKQNRTQQRREREMKPPPPAPGSALRVSLARIVRGVLESLGCIHCSRCRVQQQGNSNSSSISNRSLPLSTFIQMLRDKTGRHDVGVGSIRTTLFHHFGDEASPKVKRFMKAMLLGKLRHDGKEAEEQSRVPREAEVEETLAQDAHSVEEVYAGPAAAAAAARVPPRNGVLISGCQTDETSADATTADGMSYGALSNVIQTILAGDGKKRGVALAVTNRELVVRARELLSRQGYTQQPGLYCSDEHATLPFIC

SEQ ID NO: 5444 - protein, 164 aa, Zea mays
  unsure (1)..(164): unsure at all Xaa locations
NLTQKFSLEIQVDFEKYEGMIKVMEKVVIQLILWSSLEEHYLLPVACKNVIGIRCASWRIVSSIEYREXGCVNMDRATLIEGYHNKIEVELNKICVGILKLFASHLPPSLIVPKSKVFYLKMKGDYYRILLWRSWPPYPIRLWLMLNLSTLLILLVVSPNRFGF

SEQ ID NO: 5445 - protein, 138 aa, Zea mays
MERGRSSTSSSCRSLLLLLLLLVCFSHGAAVAAAAARLLTPLQAAAAVPPLALRQAESNGATAAAADDGLVMTEEGDADATSNGNDDDEISSVSETTGAEEEACGTEGDDDDEEECLQRRLLGDAHLDYIYTQHKGKP

SEQ ID NO: 5446 - protein, 384 aa, Zea mays
MGIWDSILPGGGRRFIKRKDSDAGEAGRALEELRGSLYNDFHTSEGARRQQQKLCGPIVALTFNFVVAVGIIMANKMVMGAVGFNFPVALSLIHYLFAFALMSVLKALYLLPIASPSKSTPFSSLFALGAVMSFSTGLANISLKHNSVGFYQMAKIAVTPTIVVAEFILFKKKVSLRKVSTLVVVSFGVAVATVTDLEFNFFGACVALAWIIPSAVNKILWSNLQQSGNWTALALMWKTTPITIFFFIVLMPLLDPPGLLSFSWDFKNSSTIIISALFGFLLQWSGALALGATSALAHVVLGQFKTIVIMLSGYLVFKSDPGFTSLCGAVIALAGMSVYTYLGMKESAANARRNSLNSRQNSHLKKAKAIVDGENPETKPMDSV

SEQ ID NO: 5447 - protein, 268 aa, Zea mays
MSPSEPTREESVYMAKLAEQAERYEEMVEFMERVARYAGGAGGGDELSVEERNLLSVAYKNVIGARRASWRIISSIEQKEEGRGNEAHAASIRAYRSKIEAELARICDGILALLDSHLVPSAGGAESKVFYLKMKGDYHRYLAEFKSGAERKDAAESTMNAYKAAQDIALADLAPTHPIRLGLALNFSVFYYEILNSPDRACNLAKQAFDEAISELDSLGEESYKDSTLIMQLLRDNLTLWTSDTNEDAGDEIKEAAAAPKESAPEGQ

SEQ ID NO: 5448 - protein, 338 aa, Zea mays
MAGNDNWINSYLDAILDAGKAAIGGDRPSLLLRERGHFSPARYFVEEVITGYDETDLYKTWLRANAMRSPQERNTRLENMTWRIWNLARKKKEFEKEEACRMSKRQPETEKTRADATADMSEDLFEGEKGEDAGDPSVAYGDSTTGSSPKTSSIDKLYIVLISLHGLVRGENMELGRDSDTGGQIKYVVELAKALSSSPGVYRVDLLTRQILAPNFDRSYGEPKELLVSTSGKNYKQEKGENSGAYIIRIPFGPKDKYLAKEHLWPFIQEFVDGALSHIVRMSKAIGEETGRGHPVWPAVIHGHYASAGIAAALLSGALNLPMAFTGHFLGKDKFDSN

SEQ ID NO: 5449 - protein, 68 aa, Zea mays
GFFFFGKKGFNFPVALGMFLAVIGIIWFGNPSSKPGGKKPPVFSPPSEKTQKHGGVFSQSEVDQKVLN

SEQ ID NO: 5450 - protein, 525 aa, Zea mays
MSSSSTSSCHGSGNPSPPAAAGAVSVAAAAAGPAAWPRRQCRDVFWLVVFLLHLLVFGAALALFGLNRFHQADRFNIGRYANLTAEPWGTPAGPPDPAPAPPPPSVYRSEDPSVPPSELTETYWKYYGAAGAVGAALACAWLAAAAWRKDGGKVVMRTAVHCLTAYLAVVSVLCFWGKHFFWGVALAVGAGLHFLYVMSVLDRFPFTMLVLQKAVRMVRELPDVMRIAYAFVLVMLCWMALWSFGISGIVAFGIPNGGQWWLLLIFSVSLFWTGAVLSNTVHVIVSGMVFLVLIHGGPAAATMPPKPLLKSLQYAVTTSFGSICYGSLFTAAIRTLRWEIRGIRSKIGSNECLLCCIDFLFHIVETLVRFFNKYAYVQIAVNGQSFNRSARDAWELFQSTGIESLVAYDCSGAILLMSTILGGLITGTCMGVWTYFKQSDKAVMVGSTSMLMGMILVGLTVVVVESAVTSIYICYAEDPLLIQRWDPEFFEQMSEALHQRLQYRSARARQILNGRLDHLPHTSSI

SEQ ID NO: 5451 - protein, 165 aa, Zea mays
  unsure (1)..(165): unsure at all Xaa locations
GRSNVYMAQLAEHAXRCEEMGVVYXEKVANTVYGEELTVEERNLLWAAYKNVIGARRASWSIASSIEQKEESRLNEXMLTLCKEYRANIVAELINICDGILMLGDSHLLPSSTAGESNVFYLKMKGDYHRYLAEFKTGPDRNECAGSTMMDYMAAPDIALAELAP

SEQ ID NO: 5452 - protein, 357 aa, Zea mays; identical to SEQ ID NO: 5395

SEQ ID NO: 5453 - protein, 61 aa, Zea mays
VLGHINTVLVLTLGFLFFGKESAQVSMSSLGMFLAVIGMIWYRNAWSKFVGKDRQVYTTPS

SEQ ID NO: 5454 - protein, 107 aa, Zea mays
  unsure (1)..(107): unsure at all Xaa locations
PPPSSAPSKPFAGDGISQSLHMTIQTAVLIETLTALGAQDHWCSCNIFYTQDHADAAIGRDXPPCSAGKGETLYEYWGSTEXRCLNWGEAGGPHLLVVDGGDSTLLI

SEQ ID NO: 5455 - protein, 132 aa, Zea mays
  unsure (1)..(132): unsure at all Xaa locations
MARTSCQAAHIVAGTRHEMPALMACPAEFWPCKPFAGARISGSLHMTIYTAVLMETLTALGAXVRCCSCNIFCTQEHAGGAIARNSTAAFSXKGETLEEYXRCTERXLEWGEAGGLQSLHPLRPAKPLCSSY

SEQ ID NO: 5456 - protein, 117 aa, Zea mays
FGSSDDIRKKHYRGVRQRPWGKWAAEIRDPKKAARVWLGTFDTAEAAAMAYDAAALRFKGNKAKLNFPERVVMPIQPQTNNNNSTSSSAPTTHALLLFHHHNKYIIIVLFQQKGFQI

SEQ ID NO: 5457 - protein, 96 aa, Zea mays
  unsure (1)..(96): unsure at all Xaa locations
MALSVVKTSYGLEYKVKDLSQADFGRLETELTPVRMPGLIACRTKLSPCKPFIRARISGSMHMTIQTAVLMETITALGSEVRXCCCNIFCTHDHAD

SEQ ID NO: 5458 - protein, 200 aa, Zea mays
MAEDLVLDTAIRDWVLIPLSVVMVLIGVLRYFVSKLMRSPATSPSPDPKLVKEGQVVIRARNLRTNAQFIPAKAFKARKVYYTNEENGLLHVPKEDAQKAQAAMFSDPNMAMDMMKKNLSMIVPQTLTFAWVNFFFSGFVAAKIPFPLTQRFRGMLQNGIDLSTVDVSYVSSRSWYFLNLFGLRGLFSLILGEETPPVVP

SEQ ID NO: 5459 - protein, 125 aa, Zea mays
  unsure (1)..(125): unsure at all Xaa locations
MAEEKHHHHHLLHHKKDEEQLAAGXYGESRLYTEAMXREVVSTGXNEYDEYKKEEKEHKHKHHLREAVAIDAGAFLLYEKHEDKNDPXHAHRHNIEDEVEDDDDVDFCGFDFHEHHKKNNDHNEA

SEQ ID NO: 5460 - protein, 124 aa, Zea mays
  unsure (1)..(124): unsure at all Xaa locations
ARRWPQESSPAEEYVYMDNLGEQAERHEEMVLLMDKVATTVDSEELTEEERNLLSGAYRNVIGASRASWPIISFIEQKEEGRCNEDRVTLFEDVRGKIESXLTQICDGILKLLETHLEPSSTAP

SEQ ID NO: 5461 - protein, 671 aa, Zea mays
IEGTPSKLNARTNYDSDNIMVLVRNDYSLSASDLGKHLFNWTRTSFSVKYNHPDIPCIRSEGLPLALPDSRSANVIVLKEGTPFISIHGSDALEPVHPPSELPNTAGKSNILLDDSQNQTHDVARSHAISADPEATLNPTRNTSGWLFPLFPIFLVTGYLLSLISASKSCRQFVIQLIEPFTRDKKSVDIRGRSEGSPKKRKTRKKDGLVNSSETLTASDKECSDTGGSTEAPMKNSALTDALGGRHIGKLYVSNKEIGRGSNGTIVFEGSYDGRQVAVKRLLRSHNDIAEKETRNLIISDHDPNIVRLYGCDHDSDFVYISLERCHCSLADLIQKQSYLSSGESISNNEVSMSINSKISNVKGIDVELWTQDGLPSAQLLKLMRDVVAGLVHLHNLGIIHRDLKPQNVLISAEGPIRAKLSDMGISKHLQDDMTSVSHHGTGIGSSGWQAPEQLRHGRQTRAMDLFSLGCLIFYCITKGKHPFGEYYERDVNIANNRFDLFMVDYIPEAVHLISHLLQPNPEARPTAVYVMHHPLFWSPELRLSFLRDTSDRIEKTSETDLINALESIGPVAFGGKWGEKLDAALVTDMGRYRKYNFESTRDLLRYIRNKSGHYRELSNDLKGILGSLPEGFDHYFASRFPKLLIEVYKVLWVHCKDEEAFSKHFNGSSL

SEQ ID NO: 5462 - protein, 173 aa, Zea mays
  unsure (1)..(173): unsure at all Xaa locations
TNYARSLAGISMVGNMLGXXDGYANHLMFDRYIGKFLHIVLDDCFEAXMNGEKIPEKVPFRLTRMLAKTIEDSVIEGTFRTTCETAMQVLLTDIHTVMDMMEAFVHDPVLNRRMINFNEDPHESNYGNVHAHTDANTEETMADAELMQPQIRARERALVQDVNQVGDANDDVN

SEQ ID NO: 5463 - protein, 115 aa, Zea mays
  unsure (1)..(115): unsure at all Xaa locations
TGTTKPRSSPAPGGSQPSEQDDQGGDRHRATTAAQAERHEEQAEATERAAKTADAEEPPDEERNLRPEANKTEKGERRTTRRTXPNTEQKEERRKNEEHGNRTKDKRGKNQAEPS

SEQ ID NO: 5464 - protein, 812 aa, Zea mays
  unsure (1)..(812): unsure at all Xaa locations
MAAKLTRLHSLRERLGATFSSHPNELIALFSRYVHQGKGMLQRHQLLAEFDALFDSDKEKYAXPFEDILRXAAQEAIVLPPWVALAIRPRPGVWDYIRVNVSELAVEELSVSEYLAFKEQLVDGQSNSNFVLELDFEPFNASFPRPXPMSKSIGNGVQFLNRHLSSKLFQDKESLYPLLNFLKAHNYKGTTMMLNDRIQSLRGLQSSLRKAEEYLLSVPQDTPYSEFNHRFQEXLGLEKGWGDXLAKRVLDTLHLLLDLLXEAPDPANLEKFLGTIPMMFNVVILSPHGYFAQSNVLGYPDTGGQVVYILDQVRALENEMLLRIKQQGLDITPKILIVTRLLXPDAAGTTCGQRLEKVIGTEHTDIIRVPFRNENGILRKWISRFDVWPYLETYTEDVSSEIMKEMQAKPDLIIGNYSDGNLVATLLAHKLGVTQCTIAHALEKTKYPNSDIYLDKFDSQYHFSCQFTADLIAMNHTDFIITSTFQEIAGSKDTVGQYESHIAFTLPGLYRVVHGIDVFDPKFNIVSPGADMSVYYPYTGNXDKRLTAFHPEIEELIYSDVENSEHKFVLKDKKKPIIFSMARLDRVKNMTGLVEMYGKNARLRELANLVIVAGDHGKESKDREEQAEFKKMYSLIDEYKLKGHIRWISAQMNRVRNGELYRYICDTKGAFVQPXAFYEAFGLTVIESMTCGLPTIATCHGGPAEIIXVDGVSGLHIDPYHSDKAADILVNFFDKCKADPSYWDKISQGGLQRIYEKYTWKLYSERLMTLTGVYGFWKYVSXLERRETRRYIEMFYALKYRSLASQVPLSFD

SEQ ID NO: 5465 - protein, 802 aa, Zea mays
MAAKLTRLHSLRERLGATFSSHPNELIALFSRYVHQGKGMLQRHQLLAEFDALFDSDKEKYAPFEDILRAAQEAIVLPPWVALAIRPRPGVWDYIRVNVSELAVEELSVSEYLAFKEQLVDGQSNSNFVLELDFEPFNASFPRPSMSKSIGNGVQFLNRHLSSKLFQDKESLYPLLNFLKAHNYKGTTMMLNDRIQSLRGLQSSLRKAEEYLLSVPQDTPYSEFNHRFQELGLEKGWGDTAKRVLDTLHLLLDLLEAPDPANLEKFLGTIPMMFNVVILSPHGYFAQSNVLGYPDTGGQVVYILDQVRALENEMLLRIKQQGLDITPKILIVTRLLPDAAGTTCGQRLEKVIGTEHTDIIRVPFRNENGILRKWISRFDVWPYLETYTEDVSSEIMKEMQAKPDLIIGNYSDGNLVATLLAHKLGVTQCTIAHALEKTKYPNSDIYLDKFDSQYHFSCQFTADLIAMNHTDFIITSTFQEIAGSKDTVGQYESHIAFTLPGLYRVVHGIDVFDPKFNIVSPGADMSVYYPYTETDKRLTAFHPEIEELINSDVENSEHKFVLKDKKKPIIFSMARLDRVKNMTGLVEMYGKNARLRELANLVIVAGDHGKESKDREEQAEFKKMYSLIDEYKLKGHIRWISAQMNRVRNGELYRYICDTKGAFVQPAFYEAFGLTVIESMTCGLPTIATCHGGPAEIIVDGVSGLHIDPYHSDKAADILVNFFDKCKADPSYWDKISQGGLQRIYEKYTWKLYSERLMTLTGVYGFWKYVSNLERRETRRYIEMFYALKYRSLASQVPLSFD

SEQ ID NO: 5466 - protein, 330 aa, Zea mays
MDPPKPPSSVASSSGPETPNPHAFTCELPHSIYALAFSPVAPVLASGSFLEDLHNRVSLLSFDPVRPSAASFRALPALSFDHPYPPTKLQFNPRAAAPSLLASSADTLRIWHTPLDDLSDTAPAPELRSVLDNRKASSEFCAPLTSFDWNEVEPRRIGTASIDTTCTVWDIDRGVVETQLIAHDKAVHDIAWGEAGVFASVSADGSVRVFDLRDKEHSTIVYESPRPDTPLLRLAWNRSDLRYMAALLMDSSAVVVLDIRAPGVPVAELHRHRACANAVAWAPQATRHLCSAGDDGQALIWELPETAAAVPAEGIDPVLVYDAGAEINQL

SEQ ID NO: 5467 - protein, 57 aa, Zea mays
  unsure (1)..(57): unsure at all Xaa locations
ENVSMAKLAEQAERYEEMVEFMEKVXSTVDSEELTVVERTLLSVAYKIVLGARRASW

SEQ ID NO: 5468 - protein, 693 aa, Zea mays
  unsure (1)..(693): unsure at all Xaa locations
IFCFPQNLIKIPTQKPREETSVARAANHPPSSPVRFLMEPLPSAAAAGVGGPGPGYPESTESSPRSRGGDSWDEPFPSSAAAAAAAAGGGGRLRLMCSFGGRIVPRPTDKSLCYLGGETRIVAVDRHASLADVHARLSRSLLGGRPFTLKYQLPNEDLDSLISVSTDEDLDNLVDEYDRIAATSSGGGSSRTSRIRLFLFPAKPESSSSLGSLLDDSSKSENWFVDALNSAISGSLDGIPRGISTDSASVNCLLGLEDDSSVHXRSGVTNSAPTEEQRASQPKLPAGAAAAAXRHPHDVQSVPDSPMLDKNSSFGSTSSAPSLSNLPPIRVRPEDRPSDARIMQLPPCEDNFAQMGMIRAAAAHVXQTQQQVPIPAMTGMSPSEASSRLFSDDDKSDHGGGGGRKQQPPKQDVPPVVDPTNRAVYYNDRSPPAELKRDMPVGTEAASYRLPVSAPDAAAAAAATAATQAPPGYVLAQMHAPPPPQQPPPQQQPQQPAPQQIVAAGNQHFIHNPATGTFIPIQSYYHHPVHQQAPQTMQRQQQAPTFDPNTGMYYVPMQQNAHQAYGVPPGAQVTLPPPTLVDTTPKPTVPIPQMAVRPELQQPGVYRTTAAATPAPAPNAAPGYAGMAYHHVIQSHHHHHPAPQPVANMAGNYGYEFADPTRPQVYYSQAAAPPTLPQYPPIVSPDAGQAEKH

SEQ ID NO: 5469 - protein, 163 aa, Zea mays
MAAAAAAAKDAAVTLSSGHRMPAVGLGVWRMDKPDVRGLIHAALRLGYRHLDCAADYQNEAEVGDALAEAFQTGLVKREDLFITTKLWNSDHGHVLEACKDSLKKLQLDYLDLYLIHFPVATRHTGVGTTSSALGDDGVLDIDTTISLETTWHAMERTLVPWG

SEQ ID NO: 5470 - protein, 386 aa, Zea mays; identical to SEQ ID NO: 1188

SEQ ID NO: 5471 - protein, 459 aa, Zea mays
RRTLLSRVCLSLSYFDCKSARHPSTTMSGKPAFKVADISLADWGRKEIMLAENEMPGLMSLRRKYKESLPLKGARIAGCLHMTVQTAVLIETLVALGAEVQWSSCNIFSTQDHAAAAIAKTGVPVYAWKGETDDEYIWCIEQTLVFKDGQPLNMILDDGGDLTNLVHEKYPQYLANIKGISEETTTGVHNLYKMMTAGKLKVPCINVNDSVTKSKFDNLYGCRESLIDGIKRATDVMLAGKVCVVAGYGDVGKGCAQSLRAFGGRVIITEIDPINALQASMEGYEVVTMDEASKEGQIFVTTTGCKDIITGKHFLSMRNDSIICNIGHFDCEIEVTWLEKNAVEKINIKPQVDRYKLANGHHIILLAEGRLVNLGCAMGHPSFVMSNSFTNQTLAQIELWTKPGQYSVGVHMLPKKLDEQVAALHLDHLGVKLTKLTADQAAYLGIPAEGPYKPDHYRY

SEQ ID NO: 5472 - protein, 488 aa, Zea mays
MASASMLARSLLRTPDPTQTSHPNRRSAAVVSFPRRHRRLSVRASVSTASPSPPPQPAAAAAGVPKHCFRRGADGYLYCEGVRVEDAMTAAERSPFYLYSKPQILRNFAAYRDALQGLRSIIGYAVKANNNLPVLRVLRELGCGAVLVSGNELRLALQAGFDPARCIFNGNGKTLEDLKLAAESGVFVNVDSEFDLENIVRAARATGKKVPVLLRINPDVDPQVHPYVATGNKTSKFGIRNEKLQWFLDSIKSYPNEIKLVGVHCHLGSTITKVDIFRDAAVLMVNYVDEIRAQGFKLEYLNIGGGLGIDYHHTNAVLPTPMDLINTVRELVLSQDLTLIIEPGRSLIANTCCFVNRVTGVKSNGTKNFIVVDGSMAELIRPSLYGAYQHIELVSPPTPGAEVATFDIVGPVCESADFLGKDRELPTPDEGAGLVVHDAGAYCMSMASTYNLKLRPPEYWVEADGSIVKIRHGEKLDDYMKFFDGLPA

SEQ ID NO: 5473 - protein, 174 aa, Zea mays
MARPQQRYRGVRQRHWGSWVSEIRHPLLKTRIWLGTFETAEDAARAYDEAARIMCGSRVRTNFPEDAGGGGGGDGQQQQQAAPSLLSPALVAKLHRSNLASAQAAQGKADASAAAAAALPRVAAAVPAGMGVSASPSASASAAGDWSGGLLEEQYVDQMIEELLDSNFSMEISY

SEQ ID NO: 5474 - protein, 809 aa, Zea mays
MSAPKLDRNPSIRDRVEDTLHAHRNELVALLSKYVNKGKGILQPHHILDALDEVQGSGGRALAEGPFLDVLRSAQEAIVLPPFVAIAVRPRPGVWEYVRVNVHELSVEQLTVSEYLRFKEELVDGQHNDPYVLELDFEPFNVSVPRPNRSSSIGNGVQFLNRHLSSIMFRNRDCLEPLLDFLRGHRHKGHVMMLNDRIQSLGRLQSVLTKAEEHLSKLPADTPYSQFAYKFQEWGLEKGWGDTAGHVLEMIHLLLDIIQAPDPSTLEKFLGRIPMIFNVVVVSPHGYFGQANVLGLPDTGGQIVYILDQVRALENEMVLRLKKQGLDVSPKILIVTRLIPDAKGTSCNQRLERISGTQHTYILRVPFRNENGILKKWISRFDVWPYLETFAEDAAGEIAAELQGTPDFIIGNYSDGNLVASLLSYKMGITQCNIAHALEKTKYPDSDIFWKNFDEKYHFSCQFTADIIAMNNADFIITSTYQEIAGSKNTVGQYESHTAFTLPGLYRVVHGIDVFDPKFNIVSPGADMSIYFPHTEKAKRLTSLHGSIENLIYDPEQNDEHIGHLDDRSKPILFSMARLDRVKNITGLVEAFAKCAKLRELVNLVVVAGYNDVNKSKDREEIAEIEKMHELIKTHNLFGQFRWISAQTNRARNGELYRYIADTHGAFVQPAFYEAFGLTVVEAMTCGLPTFATLHGGPAEIIEHGVSGFHIDPYHPEQAANLMADFFDRCKQDPDHWVNISGAGLQRIYEKYTWKIYSERLMTLAGVYGFWKYVSKLERLETRRYLEMFYILKFRELAKTVPLAIDQPQ

SEQ ID NO: 5475 - protein, 158 aa, Zea mays
  unsure (1)..(158): unsure at all Xaa locations
TGGTRGIGRAVVEELAALGAAVHTCSRKAEELGERIKEWEARGFSVTGSVCDLSERDQRERLLREVADRFGGKLNILXSIIFISSVAGAIGIFSGTIYAMTKGAINQLTKNLACEWAKDNIRANSVASWYITTSLTEGILANKNFEEQVVSRTPLGTC

SEQ ID NO: 5476 - protein, 130 aa, Zea mays
  unsure (1)..(130): unsure at all Xaa locations
PERGGEXRGXPTRARKAGQGAGGADRARAQAAAAQASARRRGHSHADKEHKRRXXXXRNRGTAQQGRERKKAGGXEXEXKEREXAQQTKXREERKKTLRNESQRXRQXLKXXAGNRRGXGSXASGEAPGQ

SEQ ID NO: 5477 - protein, 138 aa, Zea mays
MAEEKHHHHHLFHHKKDEEQLAAGGYGESAEYTEATVTEVVSTGENEYDEYKKEEKEHKHKQHLGEAGAIAAGAFALYEKHEAKKDPEHAHRHKIEEEVAAAAAVGSGGFAFHEHHEKKKDHKEAEEAGGEKKHHFFG

SEQ ID NO: 5478 - protein, 575 aa, Zea mays
HASATVRFHESIAQLEQALCDFPYDKLDISDEAREQVELVHAQLKRAKERVDMPDDEFYNELCSLYNKSHDPSAELDILGRLSEKLHLTTIADLTQESLALHEMVASGGGNDPGEHIEKMSMLLKKIKDFVQTQNPETGPLVTAKPMGSNGKPRPVNVPDEFRCPISLELMKDPVIVATGQTYERALIEKWLASGHHTCPSTQQRMPNTTLTPNYVLRSLITQWCEANGIDPPKRPTQQPDRPTSSCSSSERASIDALLSKLCSADPEEQRSAAAELRLLAKRNANNRICIAEAGAIPLLLSLLSSSDLQTQEHAVTALLNLSIHEDNKASIILSGAVPGIVHVLKNGSMEARENAAATLFSLSVVDEYKVTIGGTGAIPALVVLLSEGRQRGKKDAAAALFNLCIYQGNKGRAIRAGLVPLVMGLVTNPTGALLDEAMAILSILSSHPEGKAAIGAAEPVPVLVEMIAGGSPRNRENAAAVMLHLSASVRQSAHLARAQECGIMAPLRELALNGTGRGKRKAVQLLERMSRFLVQQQEDAVDPRVQELEEIERQLAAFGPGVTEADVLQQLGAL

SEQ ID NO: 5479 - protein, 352 aa, Zea mays
  unsure (1)..(352): unsure at all Xaa locations
MACGSSARRLIGSVGSKCPFQPDQRRSSFGFPDPTPPVSLGECNPASVELKAAQVEMSTLKKSDKKAALDFAAWSFNVTTSVGLIMVNKALMATYGFSFATTLTGLHFVTTTLMTXYFXWLGLSQPSHLPLADLVKFVIFSNLSIXVGMNVSLMWNSVGFYQIAKLCMIPXSXLLGRLVFDHVHYSRDTKLSIMVXLKGSAVCRVTDVSVNARVXLCLVIAVWSTALPTYYXHFSPTQYSLNSFNLLGHTAPAQAGSLLLVGPFADYLLTGKRVDHFSFSSLALFFLALSCFIAIGVNLSQTRRQRAAQRPTAEVCKSQGKFGRKGRCREIVLLSLIANLNGEFSVPRLNFW

SEQ ID NO: 5480 - protein, 90 aa, Zea mays
  unsure (1)..(90): unsure at all Xaa locations
TLTLFQSQRYEEMVDFMDIVAGAVDSEELTVKDRILLYDAYKNVIVTIRASXRIISFIDHMEEDHANVDHVTLINNYLPTIESDLNTYLL

SEQ ID NO: 5481 - protein, 395 aa, Zea mays
MGDDVRGLRAAAVTTAAGVVPAKTPERARLHVAMLALQFGYAGFHVVSRLALNMGVSKLVFPVYRNLIALCLLAPFAYFLEKKDRPAMTPAFLLQFFLLALCGITANQGFYLLGLDNTSPTFASAIQNSVPAITFAMAAALGIERVRLRRRDGLAKAAGTVLCVAGATVITLFKGPAVFGPAPSVAAAVPVPMPAPGGGNNNNNNKSWALGCVYLMGHCLSWSGWLVLQAPVLKRYPARLSVTSYTCFFGLLQFLAVAAVFERDAAAWALGSGSELLTILYAGLVASGVAFAVQTWCIDRGGPVFVAVYQPVQTLLVAVMASLLLGEQFYLGGIMGAVFIIAGLYLVLWGKSQERALAAKQTAAAAAGSVCDDDAAASCLKQPLLPPPPATSEAV

SEQ ID NO: 5482 - protein, 83 aa, Zea mays
MLPCTRSLPIGRVFWHPADDTTPSRKLSILYKLFPISFVMNQAGGQSFTGKQRPLDVVPAKIDDRSPIFLGSYNDVEEIIALY

SEQ ID NO: 5483 - protein, 70 aa, Zea mays
  unsure (1)..(70): unsure at all Xaa locations
VDRRVREMIEYMDKVTKTVATEEHTVEDPIDESVAXTIVIGTLRASWRITSSIEPTDEGQGDDDRITDIM

SEQ ID NO: 5484 - protein, 87 aa, Zea mays
LAEQAERVEEMVEFMEKVFKTVDLEELTVEERNLLVVAYNNFIGARRSLWRIIFFIEHKEDGQGLDVLVSLIKDYFGKIDTELIIDL

SEQ ID NO: 5485 - protein, 121 aa, Zea mays
MTEQAISFAKDFLAGGIAAAISKTAVAPIERVKLLLQVQHASKQIAADKQYKGIVDCIVRIPKEQGVLSFWRGNLANVIRYFPTQALNFAFKDKYKQIFLGGVDKRTQFWRYFAGNLASGG

SEQ ID NO: 5486 - protein, 248 aa, Zea mays
MEEREKLVCLAKLAEQAERYDDMVEFMKNLARMDVDMSAEERHLFSVGFKNTIGAKRASWRIICSHEQKVAADRQTGVMIDAYKKKVEEELRKVCNEVLSVIAIHCLPLASTGENIVFFYKMKGDYYRYLAEFSTGTEKKAASDQSLMAYQHAMVVASSELSPAHQIRLGLALNLSVFFYEIMNSHERACQVAKQAFDEALTEINSGEGVYKDSTLMMQLLKDNLALWTSELTGGEASKGNDDVDMEG

SEQ ID NO: 5487 - protein, 80 aa, Zea mays
  unsure (1)..(80): unsure at all Xaa locations
LLSRVREKVAKTVYVEERTCXERNLLSVAYKNVIGARRASWRIXVSSIVQKEVSCXNVEHVYLIKEYLGMIVVCTCLYMI

SEQ ID NO: 5488 - protein, 61 aa, Zea mays
  unsure (1)..(61): unsure at all Xaa locations
ADLYREEKWYMPMLAEQAXMYHEMAAFMEKASKTVDMAELTEDDRNLQSDAYKNVIGAPSA

SEQ ID NO: 5489 - protein, 379 aa, Zea mays
MATAGKVIKCKAAVAWEAGKPLSIEEVEVAPPQAMEVRVKILFTSLCHTDVYFWEAKGQTPVFPRIFGHEAGGIIESVGEGVTDVAPGDHVLPVFTGECKECAHCKSAESNMCDLLRINTDRGVMIADGKSRFSINGKPIYHFVGTSTFSEYTVMHVGCVAKINPQAPLDKVCVLSCGISTGLGASINVAKPPKGSTVAVFGLGAVGLAAAEGARIAGASRIIGVDLNPSRFEEARKFGCTEFVNPKDHNKPVQEVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFAEINKAFDLMAKGEGIRCIIRMEN

SEQ ID NO: 5490 - protein, 816 aa, Zea mays
MGEGAGDRVLSRLHSVRERIGDSLSAHPNELVAVFTRLKNLGKGMLQPHQIIAEYNNAIPEAEREKLKDGAFEDVLRAAQEAIVIPPWVALAIRPRPGVWEYVRVNVSELAVEELRVPEYLQFKEQLVEEGPNNNFVLELDFEPFNASFPRPSLSKSIGNGVQFLNRHLSSKLFHDKESMYPLLNFLRAHNYKGMTMMLNDRIRSLSALQGALRKAEEHLSTLQADTPYSEFHHRFQELGLEKGWGDCAKRAQETIHLLLDLLEAPDPSTLEKFLGTIPMVFNVVILSPHGYFAQANVLGYPDTGGQVVYILDQVRAMENEMLLRIKQCGLDITPKILIVTRLLPDATGTTCGQRLEKVLGTEHCHILRVPFRTENGIVRKWISRFEVWPYLETYTDDVAHEIAGELQANPDLIIGNYSDGNLVACLLAHKMGVTHCTIAHALEKTKYPNSDLYWKKFEDHYHFSCQFTTDLIAMNHADFIITSTFQEIAGNKDTVGQYESHMAFTMPGLYRVVHGIDVFDPKFNIVSPGADLSIYFPYTESHKRLTSLHPEIEELLYSQTENTEHKFVLNDRNKPIIFSMARLDRVKNLTGLVELYGRNKRLQELVNLVVVCGDHGNPSKDKEEQAEFKKMFDLIEQYNLNGHIRWISAQMNRVRNGELYRYICDTKGAFVQPAFYEAFGLTVVEAMTCGLPTFATAYGGPAEIIVHGVSGYHIDPYQGDKASALLVDFFDKCQADPSHWSKISQGGLQRIEEKYTWKLYSERLMTLTGVYGFWKYVSNLERRETRRYLEMLYALKYRTMASTVPLAVEGEPSSK

SEQ ID NO: 5491 - protein, 259 aa, Zea mays
MRIQCDACEAAAATVVCCADEAALCARCDVEIHAANKLASKHQRLPLGDAAALPASLPRCDIRYWPAFIFCVEDRALLCRDCDEPIHVPGTLSGNHQRYLATGIRVGFSSVCGASAEGLPPAPPKGSSKPTAVVSAPAAGTTTKTRTVKDALPQEVPSSPFLPPSGWAVEDLLELSDYESSDKKDSSLGLKELEWFEDIDLFHAHSPAKTAMAEFFASPQPVSNAGFYKANGARLFKKSRMEVPDDDDDEDYFIVPDLG

SEQ ID NO: 5492 - protein, 153 aa, Zea mays; identical to SEQ ID NO: 899

SEQ ID NO: 5493 - protein, 109 aa, Zea mays
  unsure (1)..(109): unsure at all Xaa locations
LDSRHDKLVECMRKGERTVDVEDLTPPAHPLLSPGYKTETGAQHRLXAIENYMVHIHDCRHNQDHVNLIDDHHAXIKDILFNTRDNVLELIDSHLLPYYTTALSMELYL

SEQ ID NO: 5494 - protein, 132 aa, Zea mays
  unsure (1)..(132): unsure at all Xaa locations
HSLNVYMAKLPERAYRHEEMVYFMENVTKTDDSHELTVEEHYLLSAAYKNVIAVRSALXHMISFIEQHDQGQGAEDTRHTLKGQYXGSTETELTKICDGEMKLVXCELVPSYIVPEIKALYLKMKGDYYRYT

SEQ ID NO: 5495 - protein, 104 aa, Zea mays
  unsure (1)..(104): unsure at all Xaa locations
KLNCKTASTELYREENVYMAXKLAEQAKRYEEMDEFMXKVTNTVYWXELTVEERNLLYXAYKNVIGARRASWRIIYSIEQKEEGRSNEDRVTLIKDYRGKTETE

SEQ ID NO: 5496 - protein, 68 aa, Zea mays
  unsure (1)..(68): unsure at all Xaa locations
PVLSLEENVYLAKLAAQAKRFEEKLEFMVNATKPVDSKDLTVQERNLLYDAYTNVIGARPAXWRIISS

SEQ ID NO: 5497 - protein, 119 aa, Zea mays
HPCASPGPDEGQEENSIFNNVNGDVNDYIDQAARHAERYEDMDKDIETVDMTEHTEELTDLVRDLYTNAYKTVIAAWRTVCCIEHYVEHKEDYQHIDLLVDYIKEFHAKINAVLNSIWD

SEQ ID NO: 5498 - protein, 151 aa, Zea mays
ADAHRTDLMTITRFVLNEQSKYPESRGDFTILLSHIVLGCKFVCSAVNKAGLAKLIGLAGETNIQGEEQKKLDVLSNDVFVNALVSSGRTSVLVSEEDEEATFVEPSKRGKYCVVFDPLDGSSNIDCGVSIGTIFGIYTLDHTDEPTTADV

SEQ ID NO: 5499 - protein, 52 aa, Zea mays
  unsure (1)..(52): unsure at all Xaa locations
EELIGEDQNLLFVEYKNVIGAGRAXWPIISSINQKEEGRGNEDRLPLIKDNR

SEQ ID NO: 5500 - protein, 572 aa, Zea mays
SGQDWPEALQQSHVPRHRCKSPDPSTLEKFLGTIPMVFNVVILSPHGYFAQANVLGYPDTGGQVVYILDQVRAMENEMLLKIKQCGLDITPKILIVTRLLPDATGTTCGQRLEKVLGTEHCHILRVPFRTENGIVRKWISRFEVWPYLETYTDDVAHEIAGELQANPDLIIGNYSDGNLVACLLAHKMGVTHCTIAHALEKTKYPNSDLYWKKFEDHYHFSCQFTTDLIAMNHADFIITSTFQEIAGNKDTVGQYESHMAFTMPGLYRVVHGIDVFDPKFNIVSPGADLSIYFPYTESHKRLTSLHPEIEELLYSQTENTEHKFVLNDRNKPIIFSMARLDRVKNLTGLVELYGRNKRLQELVNLVVVCGDHGNPSKDKEEQAEFKKMFDLIEQYNLNGHIRWISAQMNRVRNGELYRYICDTKGAFVQPAFYEAFGLTVVEAMTCGLPTFATAYGGPAEIIVHGVSGYHIDPYQGDKASALLVDFFDKCQAEPSHWSKISQGGLQRIEEKYTWKLYSERLMTLTGVYGFWKYVSNLERRETRRYLEMLYALKYRTMASTVPLAVEGEPSSK

SEQ ID NO: 5501 - protein, 99 aa, Zea mays
  unsure (1)..(99): unsure at all Xaa locations
PTSLSFHFSISQIQFARASSCGGRALSVEKTWYGREYKVKDLSQADFARLEIELAEVLMPGLMGCRAWFGPSQXPFAGARIQGSLHMTIQTGGLIETLT

SEQ ID NO: 5502 - protein, 92 aa, Zea mays
SFVNLGCATGHPSFVMSCSFTNQVIAQLELWKEKSSGKYEKKVYVLPKHLDEKVAALHLGKLGAKLTKLTKSQADYISVPIEGPYKPAHYRY

SEQ ID NO: 5503 - protein, 240 aa, Zea mays
  unsure (1)..(240): unsure at all Xaa locations
MMTGQDPGGQAHPGQRGEPAAHRDHRLHVRQPGRRAAESRRQEEEQGQPGAVEFGRRQRCRRERRPQRRGHVQADQAHGSTDTPPRSPSXDGYQWRKYGQXKVTRDNPSPRAYFRCAYAPSCPVKKKVQRSAEDSAMLVATYEGEHNHPSPTRAGELPSSTSINSSGPAITLDLTRNGAGAVRGLEAAAAEVPGLKRLCQEIASPDFRTALVEQMARSLTKDPKFTDALAAAILQQLPEY

SEQ ID NO: 5504 - protein, 370 aa, Zea mays
  unsure (1)..(370): unsure at all Xaa locations
MAPLPPGPEMEVMSGWLWKTALMEVPRKHHSPPKWSVILWMLVTANLWIMCSSSTQKKVLMPGFSASEMDYIDNDGKFLLSNGYVFGFGFATISVSDSTYYVLAVVHLPTTSIVWSANANSPVSHSDNFVFDKDGNAYLQSGGSTVWTANISGKGXHLYAAARLGQSXVVFGKDGSSPLWQSFSHPTDTLLSGQSFIEGMSLLSHSNAQNMTYTLEIKSGDMLLYAGFQLPQPYWSALQDNRVIIDKNGNNNIYSANLSSGSWSFYDQSGLLQSQLVIAQQQGDANTTLAAVLGNDGLINFYMLQSVNGKSALPVTVPQDSCDMPAHCKPYFICNSGTGCQCPSALSSYANCDPGVISPCNSKNKFQLVQ

SEQ ID NO: 5505 - protein, 125 aa, Zea mays
ACRICIFRPPAVRLLLLGEGRLKRRPLLPTAARIIVVLTTTHGGRAHNLWCAVTRKKDLEDYLVKFRWILTIFGVLTISTLIYFNIVLGDMWSVMNSEKKRSNQHDKNVHKVGNRLKQMNPKNDG

SEQ ID NO: 5506 - protein, 401 aa, Zea mays
SGGGTTASSRATLSGNRFKDRTSIEDFEIIKPISRGAFGRVFLAKKRVTGDLFAIKVLRKADMIRKNAVESILAERDILISARNPFVVRFFYSFTCRENLYLVMEYLNGGDLYSLLRNLGCLDEDMARTYIAELVLALEYLHSMNVIHRDLKPDNLLISRDGHIKLTDFGLSKVGLINSTDDLSGPDVSCALVGEHQPADAEQREQKRRQRQKQAAVGTPDYLAPEILLGMAHGPTADWWSVGVILFELLVGIPPFNAEHPQIIFDNIMNREIPWPHVPEELSSEAYDLIDRLLMENPVQRLGATGAGEVKAHPFFKDINWDMLARQKVAFIPSTDDEYDTSYFACRHAWSGAGEHGGAAGSDYDDRSEASSMSCGSSPRSDYEEDGDECGSMEEFGAPLS

SEQ ID NO: 5507 - protein, 71 aa, Zea mays
  unsure (1)..(71): unsure at all Xaa locations
RLIITRPCVIVLTWILLKTKYGLRKFIGIXVCMAGLILVVFSDVCSSYRASMNKLHFLYIWNCTITVLMSY

SEQ ID NO: 5508 - protein, 316 aa, Zea mays
MSGKQQDKSFMGMPGFVVDFLMGGVSAAVSKTAAAPIERVKLLIQNQDEMLKSGRLDRKYGGIVECFSRTAKNEGVLSLWRGNTANVIRYFPTQALNFAFRDTYKSMFAYKKERDGYAKWMAGNLASGGAAGATSLLFVYSLDYARTRLANDAKSAKKGGERQFNGLVDVYKKTLASDGIAGLYRGFMPSVAGIVVYRGLYFGMYDSIKPVLLTGNLEGNFLASFALGWAVTTGAGIASYPLDTIRRRMMMTSGEAVKYKGTMDAARQIVAAEGVKSLFKGAGANILRGVAGAGVLSIYDQAQLILFGKKFKGGSG

SEQ ID NO: 5509 - protein, 105 aa, Zea mays
  unsure (1)..(105): unsure at all Xaa locations
GQVAVGAQSALGAKKRGRTAGDKEQNRLKRLLRNRVSDQQAQXRENAFITELDVKVNGLELRNAXLEQIVCTLQNENNTLRQILKNTTAHASMTYRGLRGCHGKV

SEQ ID NO: 5510 - protein, 401 aa, Zea mays
MADAGEGRRVCGMPEKAQLHVAMLALQFGYAGFHVVSRLALNMGISKLVFPVYRNIIALCLLVPFAYFLEKKDRPQLTLNFVIQFFLLALCGITANQGFYLLGLDNTSPTFASAIQNSVPAITFAMAAALRIEKVRLDRRDGVAKVAGTLACVAGASVITLYKGPTIFGPSGGGGGGDKLQLQQVAVAVAAGEKNWTLGCVYLIGHCLSWSGWLVLQAPVLKKYPARLSVTSYTCFFGVIQFLVIAAFMERDADAWKFHSGSELFTILYAGFIASGVAFAVQIWCIDRGGPVFVAVYQPVQTLVVAIMASLTLGEKFYLGGIIGAVLIIAGLYLVLWGKSEERARIARDAAAALVVSGAGDREGLLAAGGGGGGGIRSKAAASAAVTQPLLLPSSTSTDNV

SEQ ID NO: 5511 - protein, 249 aa, Zea mays; identical to SEQ ID NO: 953

SEQ ID NO: 5512 - protein, 431 aa, Zea mays
MATGETAVDRRKDPLGPRDMHLSGEEHVPKARKPYTITKQREKWTEDEHRRFLEALQLHGRAWRHIQEHIGTKTAVQIRSHAQKFFTKVVRESSSGCNASAGAAPAIQVPPPRPKRKPAHPYPRKVDGAAKNPAPELKLLEKLPPRDRDEGSPTSVLASARTASRAEVLGSAFANSSSASRSLDLSASGLDERGDGGGSLVSSVAGEHGCASPRTRAPYTKVLVEANEVSHLGPEAPVLKLFGKKVVVKDLKTDYSPAAASVAKASRDHNPTGAAGASSWSPWAGQRAGAAAHVLRSPARRPSGAARRSVVRLQRERAVRGVLPAGGGFSSGAPASFRASGSQTRAEGKVPDRFEHGLQRRVGGAELGHRAVPPRPRARKHRRRLRGATGCHPAAGQVREFGFLQRERVRAVQAVRGRERGAALGGARRGG

SEQ ID NO: 5513 - protein, 114 aa, Zea mays
IRYLYRNSPQMDLELSYRFMDWFSHHLSNFGFTWKWAEWVDDAQLPNAHPSKWFLKGALDKEVRLSFAQRIQKTLPEPYLPLVGPEKEKDVPDFKFQNPETPFSKEGQEIASLL

SEQ ID NO: 5514 - protein, 134 aa, Zea mays
VVHLPVEKVDAIISEWMGYFPLFESMLDSVLYAKNKYLAKGGSVYPDICTISLVAVSDVNKHADRIAFWDDVYGLKMSCMKNAVIPEAVVEVLDPKTLISEPCGIKHIDCHTTSISDLEFSSDFTLKITRTSMC

SEQ ID NO: 5515 - protein, 165 aa, Zea mays
  unsure (1)..(165): unsure at all Xaa locations
LHAIVDTCHSGAILDLPXLCRLSRYVRTTGYWQWENQQTARLAASGETKCTSGGLAISISGCGDSQTSQDTTALSGSASTGAMTYSFIKAVESEPGTTYGRLLTAMRATIRDNGGEFGIPGPIGTFFRRVITLMPSSSSYWILVWQEPQLCASETFDIYRKPFLL

SEQ ID NO: 5516 - protein, 284 aa, Zea mays
GYLEADASGLCFSLKGCRKECAFYLVSLPVSYRYEYLMAETIFSQLLLLPNPPFKPIYYTLVIIDLCKALPGAFPSVVVGAVHALFDRISNMDMECRTRLILWFSHHLSNFQFIWPWQEWSYVKDLPKWAPQRVFVQEVLEREVRLSYFEKIKQSIEDAAELEELLPPKAGPNFKFHSDESNESTDGLKLSKELIGLIRGKKSTYDIILWVEEQIIPKNGTEFALDVVSQTLLDMGSKSFTHLVTILERYNKIISKLCPNEEMQLLLMNGVSAYWKDKYQMTAI

SEQ ID NO: 5517 - protein, 573 aa, Zea mays
MASSISAPAPPAAPATAPASGRPKKPSQFNPSTGKTRTPVPARPMRAAAPKWNPLQRLAAAALDALEEGLVAGVLERAHPLPRTADPAVQIAGNYAPVGERPPTGELPVSGRVPACLDGVYVRNGANPLHAPRAGHHLFDGDGMLHAVRLRGGRAESYACRFTETARLRQERAIGRAVFPKAIGELHGHSGVARLLLFGARSLCGVLDASQGIGVANAGLVYHNNRLLAMSEDDLPYHVRVTADGDLETAGRYDFGGQLDTAMIAHPKLDPATGELFALSYNVVSKPFLKYFYFTADGRKSPDVEIPVDAPTMMHDFAVTENHAIIPDQQIVFKLQEMVLGGSPVVYDRNKTARFGVLPKRATDASRLRWVDVPDCFCFHLWNAWEDEATGEVVVIGSCMTPADAVFNESAAGEESFRSVLSEIRLDPRTGTSSRRAVLSDADQVNLEAGMVNRQLLGRRTRYAYLAIAEPWPKVSGFAKVDLEAGTVDKFIYGDGRYGGEPCFVPRPDAPAGAAEDDGYVLCYVHDEARGASEMLVVNARDMRAEAAVKLPGRVPYGLHGTFIAGKELQRQA

SEQ ID NO: 5518 - protein, 487 aa, Zea mays
RPPAQGRRLPVVNPTTEAHIGEIPAGTAEDVDAAVAAARAALKRNRGRDWARAPGAVRAKYLRAIAAKVIERKQELAKLEALDCGKPYDEAAWDMDDVAGCFEYFADQAEALDKRQNSPVSLPMETFKCHLRREPIGVVGLITPWNYPLLMATWKVAPALAAGCAAVLKPSELASVTCLELADICKEVGLPPGVLNIVTGLGPDAGAPLSAHPDVDKVAFTGSFETGKKIMAAAAPMVKPVTLELGGKSPIVVFDDVDIDKAVEWTLFGCFWTNGQICSATSRLLVHTKIAKKFNERMVAWAKNIKVSDPLEEGCRLGPVVSEGQYEKIKKFILNAKSEGATILTGGVRPAHLEKGFFIEPTIITDITTSMEIWREEVFGPVLCVKEFSTEDEAIELANDTQYGLAGAVISGDRERCQRLSEEIDAGIIWVNCSQPCFCQAPWGGNKRSGFGRELGEGGIDNYLSVKQVTEYISDEPWGWYRSPSKL

SEQ ID NO: 5519 - protein, 220 aa, Zea mays
MAAAAAGTREEMVYMAKLAEQAERYEEMVEFMEKVAAAAELTVEERNLLSVAYKNVIGARRASWRIVSSIEHKEETRGAAAVDARVFYLKMKGDYHRYLAEFKTGAERKDAADSTLAAYQAAQDIAVKELPPTHPIRLGLALNFSVFYYEILSSPDRACSLAKQAFDEAISELDSLGEESYKDSTLIMQLLRDNLTLWTSDMQEDGGDEMRDANKPDEEQ

SEQ ID NO: 5520 - protein, 206 aa, Zea mays
KNVIGARRASWRIVSSIEQKEESRKNEEHVNLIKEYRGKIEAELSNICDGILKLLDSHLVPSSTAAESKVFYLKMKGDYHRYLAEFKTGAERKESAESTMVAYKAAQDIALAELAPTHPIRLGLALNFSVFYYEILNSPDKACNLAKQAFDEAISELDSLGEESYKDSTLIMQLLRDNLTLWTSDLTEDGADEGKDAQKGDAGEGQ

SEQ ID NO: 5521 - protein, 68 aa, Zea mays
  unsure (1)..(68): unsure at all Xaa locations
MAREENVYMAKLAEQAERYEEMVEYIENVAKTVYVEELTCEERNXLLSGAYKYFIGASFVLCCIVISI

SEQ ID NO: 5522 - protein, 168 aa, Zea mays
  unsure (1)..(168): unsure at all Xaa locations
RAIQLSLAAPFQQAELEGGWWGWLSLSLVHGGREKHHHHHLFHHKRDEEQLAAGGYGESAEYTEATVTGGGGTXXEXYHEYKKEEKEHKHKQHLGEGGAIAXGAFALYEKHEAKKDPEHAHRHKSEEEVSAAGGVWSGGFAFHEPHEKKKDHKEAXEAGGEKKHHXFG

SEQ ID NO: 5523 - protein, 592 aa, Zea mays
  unsure (1)..(592): unsure at all Xaa locations
MPLRQRPTMGGGGGGVAKMPAGQLWLLLLGVLLLAFGVPAQASRNTHYDFVITETKVTRLCHEKTILAVXTGRSPGPTIYARKDDVVIVNVYNQGYKNITLHWHGVDQPRNPWSDGPEYITQCPIQPGANFTYKIIFTEEEGTLWWLPRAVGARAAGRGAIVIHPKRGTVYPYPKPHKEMPIILGEWWNADVEQILLESQRTGGDVNISDANTINGQPGDFAPCSKEDTFKMSVEHGKTYLLRVINAGLTNRPGFAVAGHRPTVVGTDGRYLRPFTVDYILISPGQTMNMLLEANCATDGSANSRYYMAARPFFTNTAVNVDDKNTTAILEYTDAPXPRAGPPDSPDLPAMDDIAAATAYTAQLRSLVTKEHPIDVPMEVDEHMLVTISVNTIPCEPNKTCAGPXDNRLAASLNNVSFMNPTIDILDAYYDSISGVYEPDFPNKPPFFFNFTAPNPPQDLWFTKRGTKVKVVEYGTVLEVVFQDTAILGAESHPMHLHGFSFYVVGRGFGNFDKDKDPATYNLVDPPYQNTVSVPTGGWAAMRFRAANPGVWFMHCHFDRHTVWGMDTVFIVKNGKGPDAQMMPRPPNMPKC

SEQ ID NO: 5524 - protein, 183 aa, Zea mays
MAPTFMELALEQAKFALDNLEVPVGCVIVEDGKVISSGSNKTNATRNATRHAEMEAIDVLLREWQSMGLDQPQVAEKFAGCDLYVTCEPCIMCATALSIIGIREVYFGCANDKFGGCGSIMSLHNGGASSSDELSGSQASTPKGFKCTGGIMAEEAVALFRCFYEQGNPNAPRPHRPVRMPQQ

SEQ ID NO: 5525 - protein, 245 aa, Zea mays
AVPEGRRPQVVTFGVPEEDSGGRYESSEMDGGHDAASAEQHVAVTRPAERKGRTCCRRCGKSKWESKESCIVCDARYCGHCLLRAMGSMPEGRKCVTCIGQPIDEAKRSRLGKGSRILSRLLGPLEVRQILKVEKECQANQLRPEQLLVNGFPLDDEEMTDLLSCQRPPGNLKPGRYWYDKESGLWGKVILVGLRKPVSCNLSFSSDQKKKMSPGNQAAGNNWGTIIIPLNRTARVGRVFCPKTQ

SEQ ID NO: 5526 - protein, 225 aa, Zea mays
  unsure (1)..(225): unsure at all Xaa locations
PLLSPGVYRVXMTRQIIAPNFDRGYGEPDEMLALTSFKNFKCERGENSGAHIIRIPFGPKEKHLAKENIWPFIQEFVDGALGHIVRMSKTLGEETGSVCPVWPAVIHGHYASAGVAAALLSGALNVPMVFTGHFLGKDKLEGLLKQGRQTREQINVTYKIMRRIEAEELSLDASEIVIASTRQEIEEQWNLYDGFEVMLARKLRALVKRGANCYGRYMPRMVVSK

SEQ ID NO: 5527 - protein, 98 aa, Zea mays
TAQNKVQQLIDDNGVVVFSKSYCPYCNNTKRLLDGYGAKYATYELNQESDGDDLQQALLKITGQRTVPNVFINKQHIGGNSDFEAVIKNGKDGKKIEE

SEQ ID NO: 5528 - protein, 79 aa, Zea mays
  unsure (1)..(79): unsure at all Xaa locations
MVLSIENTWAGREYKVKDLSQADLRRLEIELAEVEMPSLMACRTXFSPTKPFASARISGSIHMTIQTGVLIETLSRLGA

SEQ ID NO: 5529 - protein, 592 aa, Zea mays
MDAGAGATAIRVPYRHLRDAEMELVSLNGGAPGGDTGPPPPPPKDQPRSRADRTKLVLACMVAAGVQFGWALQLSLLTPYIQTLGIDHAMASFIWLCGPITGFVVQPCVGVWSDKCRSKYGRRRPFILAGCIMICAAVTLIGFSADLGYILGDTTEHCRTYKGSRFRAAIVFILGFWMLDLANNTVQGPARALLADLSGPDQCNSANAIFCSWMAVGNILGFSAGASGEWHKWFPFLTTRACCEACGNLKAAFLVAVVFLLLCMSVTLYFAEESPLDPKDTQGLSDSAPLLNGSRDAAHASNEPNNERFPNGHVGLNNVSANNNTEEFTNVNSNTENGGVFNDGPGAVLVNILTRMRHLPPGMHSVLLVMALTWLSWFPFFLFDTDWMGREVYHGDPNGDLSERKAYDNGVREGAFGLLLNSVVLGVGSFLVDPLCRMIGARLVWAISNFTVFICMMATTILSWISSDLYSSKLHHIIGANKTVKITALVVFSLLGLPLSITYSVPFSVTAELTAGTGGGQGLATGVLNLAIVVPQIVVSLGAGPWDALYGGGNTPAFVLASVFSLAAGVLAVLKLPKLSNSYQSAGFHGFG

SEQ ID NO: 5530 - protein, 308 aa, Zea mays
CSSFCPNSQSSNQAIAVLAPPTSLLASAPLSGGSRMFEMFLENGGKLPGPPEPSAHPHSTPPRPRHHHSMSMDGSTSLFGSGLAGMPGRSGTDAKKAMGDAKLAELALVDPKRAKRILANRQSAARSKERKMRYIAELERKVQTLQLEATTLSAQLAMLQRDTTGMTSENSDLKIRVQTMEQQVQLQDALNDRLRDEIQQLKVATGQVNASIGKTGNSGMSSFGGNPQSYQRSHIQSLLAAQHLQRLRIHSQHQQQQTHFQQQQQPQPQLLLQEAHPFPVDLKMRGFSLSSHAQNAGASDSHAAKSEP

SEQ ID NO: 5531 - protein, 338 aa, Zea mays
MGRSPCCEKIGLKKGPWTPEEDQKLLAYIQEHGHGSWRALPVKAGLQRCGKSCRLRWTNYLRPDIKRGKFSLQEEQTIIQLHALLGNRWSAIATHLPNRTDNEIKNHWNTHLKKRLAKIGIDPVTHKSTCGTLTGTTNDRSAKAAASLSHMAQWENARLEAEARLARESKTRTATPTPSALHAQPMDLPASAASPWLDVLHAWQGAKIDLESPTSTLTFTGSNGGMLPTPRTNGPEVSESNSVMSHYQMSDELEGEETYWQIFSKHQVPEVDSKESEDDFIGCEEPWFSGMAGVGAGFTGMLLDVSYEHELSECWGESSSGQTVEPSKPASDKEDKDY

SEQ ID NO: 5532 - protein, 84 aa, Zea mays
  unsure (1)..(84): unsure at all Xaa locations
GVLPVLMVFQTENNHPSPTPPARIKEFFHKTKQTGALIXTMTALGAEVQXKTCNILSTQDHAAGVIDRYSEKENSWKGETLDEY

SEQ ID NO: 5533 - protein, 486 aa, Zea mays
  unsure (1)..(486): unsure at all Xaa locations
MAAANLLSRSLLPTPNTIRTSHPTPRSPAVVSFPRRRARLSVCASVSMASPSPPPQPAAAGVPKHCFRRGADGYLYCEGVRVEDAMAAAERSPFYLYSKLQILRNFAAYRDALQGLRSIVGYAVKANNNLPVLRVLRELGCGAVLVSGNELRLALQAGFDPARCIFNGNGKTLEDLKLAAESGVFVNVDSEFDLENIVRAARATGKKVPVLLRINPDVDPQVHPYVATGNKTSKFGIRNEKLQWFLNSIKSYSNEIKLVGVHCHLGSTITKVDIFRDAAVLMVNYVDEIRAQGFKLEYLNIGGGLGIDYHHTDAVLPTPMDLINTVRELVLSQDLTLIIEPGRSLIANTCCFVNRVTGVKSNGTKNFIVVDGSMAELIRPSLYGAYQHIELVSPPTPXAEVATFDIVGPVCESADFLGKDRELPTPDEGAGLVVHDAGAYCMSMASTYNLKLRPPEYWVEEDGSIVKIRHEEKLDDYMKFFDGLPA

SEQ ID NO: 5534 - protein, 95 aa, Zea mays
  unsure (1)..(95): unsure at all Xaa locations
GGGFSIPGGAPXVRDIVEYIQNVAITEXIQNGTGVEPNVVGVAYRNVIGARRASWRIGSSIEQKGEARKNEXDGNLIKGYRAEIEAXLSNICDGI

SEQ ID NO: 5535 - protein, 85 aa, Zea mays
MSPSEPTREESVYMAKLAEQAERYEEMVEFMERVARSVGGAGGGEELSVEERKLVFVAYKNVMGARKGLWRIISCIEQKEEGRGN

SEQ ID NO: 5536 - protein, 466 aa, Zea mays
MALLRLLAFSLLFAVATPVRDIADDACSSQVKDFQHLNNSSGLHLTLHHPQSPCSPAPLPADLPFSAVLAHDGARVASLAARLAKTPSSRPTLLDESRAGSSSSSSPDDESSLASVPLGPGTSVGVGNYVTRMGLGTPAKSYVMVVDTGSSLTWLQCSPCVVSCHRQSGPVFNPKASSSYTSVSCSAQQCSDLTTATLNPASCSTSNVCIYQASYGDSSFSVGYLSKDTVSFGSTSVPNFYYGCGQDNEGLFGQSAGLIGLARNKLSLLYQLAPSMGYSFSYCLPTSSSSSGYLSIGSYNPGQYSYTPMASSSLDDSLYFIKMTGIKVAGKPLSVSSSAYSSLPTIIDSGTVITRLPTGVYSALSKAVAGAMKGTPRASAFSILDTCFQGQAARLRVPEVTMAFAGGAALKLAARNLLVDVDSATTCLAFAPARSAAIIGNTQQQTFSVVYDVKNSKIGFAAAGCS

SEQ ID NO: 5537 - protein, 300 aa, Zea mays
MSAGWRTLLLRIGDRCAEYGGSADHKEHIETCYGVLSREYEHSRDAIFEFLLQCTEQLPHKIPFFGVLIGLINLENEDFSKAIVDTTQANLEDALHNENRDRIRILLRFLSGLMCSKVVVPSSIIETFETLLSSAVTILDDETGNPSWQPRADFYVYCILASLPWAGPELFEQVPDEFERVLFGIQSYISIRRHFDDIAFSVFETDEGHSPNKKDFMEDLWERIQALSRNGWKVKSVPKPHLPFEAQLVAGKSHRLSPISCPPPTPSQSSSGNVKRSGRNMKPDMKYPQRLRRLHISPNE

SEQ ID NO: 5538 - protein, 566 aa, Zea mays
LLVPTLNLLTVPNLTEGLSKHLTNCVHSKLSFSRFLQFRDPRAQRRHPLVDPMVVSEIRRCLNEGIEFQGELLNFRKDGAPLYNRLSLIPMHGDDGYVTHVIGIQLFSEANIDLSSVSYPVYKQQTNNRPIIQDLNSASHEHAPKVQSADHCGILQLSDEVLAHNILSRLSPRDVASIGSVCTRMHELTKNDHLRKMVCQNAWGRDATVKLEMSTKMVGWGRLARELTTLEAASWRKFTVGGRVEPSRCNFSACAVGNRLVLFGGEGVNMQPMDDTFVLNMEAARPEWRRVKVSASPPGRWGHTLSWLNGSWLVVFGGCGQQGLLNDVFVLDLDAQQPTWREVASEGPPLPRSWHSSCTLDGSKLVVSGGCTESGVLLSDTFLLDLTKEKPAWREIPTSWSPPSRLGHTMSVYGTTKLLMFGGLAKSGSLRLRSSDAYTMDVGEDSPQWRQLATTGFPNVGPPPRLDHVAVSLPCGRIIIFGGSIAGLHSPAQLFLVDPAEEKPTWRILNVPGKPPKFAWGHSTCVVGGTRVLVLGGHTGEEWILNELHELCLASRPDDDDDTATD

SEQ ID NO: 5539 - protein, 76 aa, Zea mays
TRPGIYGYPRDKKSKNGKLRLLYECAPMSFIVEQAGGKGSDGHQRILDITPTEIHQRVPLYIGSVEEVDKVEKFLA

SEQ ID NO: 5540 - protein, 359 aa, Zea mays
MMGSDVENEEQKGGTKSKYEAEVLPPVPKIEIQWEPHHQTLPVGRGIQIMGERVIVEGSVQHNPLNEGSILWITESRMPLGIVDELFGPVKNPYYLVRYNSEEEVPAGISAGTDVCFVAEFADHILNMKELYAKGYDESDSVDKDAEDLPDFSDDEKEAEYKRSLRQAKRQTDRQHEPMKTSCYMKGSQPRGGGIRKPMPPRNLDTSTRGHQPQPHFRRSDMVPAGTENTARSLGPQNAPMIAPTMLQPGPMNPAVPPPVPLANQMGGCFMNLAQQQLLSQQPNMVWPGGFPQPPLPNMGVDGAALAANIMQNLLTGASQFQQQFQNLNFSGAGANQFPQQFQNQNFSGGAGANQFPQQ

SEQ ID NO: 5541 - protein, 470 aa, Zea mays
AHSTLILATGRSIQQKKKKKKPTAQQISTRNTLLVPLSPDTDIPWPLPLPTHLRSAIPSSRRLRIHLPGATSGQPLAVQPSSPSGELRGVAKMISRQLVLTYLYLLIYICLSSGVILFNKWVLSPKYFKFPFPITLTMIHMAFSGIVTFFLVRVFKVVAPVKMTFHIYATCVIPISAFFASSLWFGNTAYLYISVAFIQMLKALMPVATFIMAVFCGTDKLRWDLFLNMVLVSVGVVVSSYGEIHFNVIGTLYQVTGIFAEALRLVLTQVLLQKKGLTLNPITSLYYIAPCSFIFLFIPWYLLEKPEMDVTQIQFNYSIFFLNALSAFALNISIFLVIGRTGAVTIRVAGVLKDWILIALSTIIFPESVITSLNIIGYAVALSGVVLYNYLKMKDVRANQLPADNNSDRATKDKKSSSMFRPDNSMDNSDGTVAGGLASEAAAVDEEAPLIPSARLSYVTRTQTGSSSNR

SEQ ID NO: 5542 - protein, 357 aa, Zea mays
MGRDGGGGVAGGMSDSVLRKVLLSYFYVAVWIFLSFSVIVYNKYILDPKMYNWPFPISLTMVHMGFCSSLAVALVRVLRVVDLPTSPSMTPQFYTSSVVPIGALYAMSLWFSNSAYIYLSVSFIQMLKALMPVAVYSIGVLFKKETFRSSSMLNMLSISFGVAIAAYGEARFDVRGVALQLAAVAFEATRLVLIQILLTSKGISLNPITSLYYVAPCCFCFLLVPWAFVELPRLRAVGTFQPDFFVFGTNSLCAFALNLAVFLLVGKTSALTMNVAGVVKDWLLIAFSWSVIRDTVTPINLFGYGIAFLGVGYYNHVKLQALKAKEAQKKATQADEEAGSLLQERDGHSDRKSDNQA

SEQ ID NO: 5543 - protein, 546 aa, Zea mays
  unsure (1)..(546): unsure at all Xaa locations
MGLGAAVALALGDPPADYASIAAVGLFVALMCVCIVVGHLLEENRWMNESITALFIGLGTGAVILFASSGKHSRVLVFSEDLFFIYLLPPIIFNAGFQVKKKQFFRNFITITLFGAVGTLISFTVISLXALGLISRLNIGALELGDYLALGAIFSATDSVCTLQVLSQDETPFLYSLVFGEGVVNDATSVVLFNAIQNFDPGNISSAKLLNFIGSFLYLFGSSTILGVASGLLSAYTIKKLYFGRHSTDREVSIMMLMAYLSYMLAELLDLSGILTVFFCGIVMSHYTWHNVTESSRVTTKHAFATLSFISETFLFLYVGMDALDIEKWKIVGQTYSPVKSIALSSTILALVLVSRAAFVFPLSFVSNLTKKTPNGKISFRQQVIVWWAGLMRGAVSIALAYNKFTRSGHTQQPSNAIMITSTISVVLFSTIVFGLLTKPLIRLLIPSRHLSREPSALSEPSSPKSFFEQLAANSPGHPDLENGISLRRPASLRFLLVSPARSVHHYWRKFDDSFMRPVFGGRGFVPFVPGSPTESSLPLLPGNEN

SEQ ID NO: 5544 - protein, 480 aa, Zea mays
ACLQYVYVSLTDESPLPVAARSSTQAYKPGPDTRKPTLGLSHALTSFMWLCGPIAGLVVQPLVGLYSDRCTSRWGRRRPFILTGCMLICVAVIVVGFSSDIGAALGDTKEHCSLYHGPRWHAAIVYVLGFWLLDFSNNTVQGPARAMMADLCDHHGPSAANSIFCSWMALGNILGYSSGSTNNWHKWFPFFKRAPAVFLVLCLTVTLIFAKEVPYRANENLPTTKAGGEVETEPTGPLAVLKGFKDLPPGMPSVLLVTAITWLSWFPFILYDTDWMGREIYHGDPKGSNAQISAFNEGVRVGAFGLLLNSVILGFSSFLIEPMCRKVGPRVVWVTSNFMVCVAMAATALISFWSLRDYHGYVQDAITANASIKAVCLVLFAFLGVPLAILYSVPFAVTAQLAATRGGGQGLCTGVLNISIVIPQVIIALGAGPWDALFGKGNIPAFGVASGFALIGGVVGVFLLPKISKRQFRAVSAGGH

SEQ ID NO: 5545 - protein, 109 aa, Zea mays
MRRRGSNSSPLAAAAQLLLLLLLLVAGCIHSAAAAAPAGADGAGGLVLQEGGTGNGDELSSSTLLETTTTTMGAEACEEGNDKDECLLTRRLLVDAHLDYIYTQHKGKP

SEQ ID NO: 5546 - protein, 133 aa, Zea mays
MRRRGSNSSPLAAAAQLLLLLLLLVAGCIHSAAAAARHLPSPGAPVQALDHQAETGGKAASAGADGAGGLVLQEGGTGNGDELSSSTLLETTTTTMGAEACEEGNDKDECLLTRRLLVDAHLDYIYTQHKGKP

SEQ ID NO: 5547 - protein, 200 aa, Zea mays
SSRVDLQQQQAPGPRIVPHPHAAPPPAKKSRRGPRSRSSQYRGVTFYRRTGRWESHIWDCGKQVYLANRFTGEFFVMAYDRAAIKFRGVDADINFNLSDYEDDMKQMGSLSKEEFVHVLRRQSTGFSRGSSRYRGVTLHKCGRWEARMGQFLAKKYIYLGLFDSEVEAARAYDKAAIKCNGREAVTNFEPSTYHGELPTE

SEQ ID NO: 5548 - protein, 325 aa, Zea mays
MEASDSGSSVLNASEAASAGGAPAPAEEGSSSTPAALEFSILIRSDSDAAGADEDEDATPSPPPRHRHQHQQQLVTRELFPAGAGPPAPAPRHWAELGFFRADLQQQQAPGPRIVPHPHAAPPPAKKSRRGPRSRSSQYRGVTFYRRTGRWESHIWDCGKQVYLGGFDTAHAAARAYDRAAIKFRGVDADINFNLSDYDDDMKQMKSLSKEEFVHALRRQSTGFSRGSSKYRGVTLHKCGRWEARMGQFLGKKYIYLGLFDSEVEAARAYDKAAIKCNGREAVTNFEPSTYHGELPTEGTYFFLHIYNLQVLLAIKLLGFYCFFC

SEQ ID NO: 5549 - protein, 313 aa, Zea mays
MQLDLNVAEAPPPVEMEASDSGSSVLNASEAASAGGAPAPAEEGSSSTPAALEFSILIRSDSDAAGADEDEDATPSPPPRHRHQHQQQLVTRELFPAGAGPPAPAPRHWAELGFFRADLQQQQAPGPRIVPHPHAAPPPAKKSRRGPRSRSSQYRGVTFYRRTGRWESHIWDCGKQVYLANRFSGEFFVMAYDRAAIKFRGVDADINFNLSDYDDDMKQMKSLSKEEFVHALRRQSTGFSRGSSKYRGVTLHKCGRWEARMGQFLGKKYIYLGLFDSEVEAARAYDKAAIKCNGREAVTNFEPSTYHGELPTE

SEQ ID NO: 5550 - protein, 175 aa, Zea mays
MEALFGCNKHGGDKAADLASFIIVQAALEVPRLLGLLAMILHNEIFTSGGDQNLINRILSKNKNATDFENKDDGESDDDNDEEGDDEDAENQEDDGGDEGSDDNGNEEEDDDDDDNDPAANGEGGSDDDDDGGEDEEEDDDDDDDGDGDNEEDEEEEEEEDDDDDVPQPPTKKRK

SEQ ID NO: 5551 - protein, 81 aa, Zea mays
PEHDARRSAEISDTASIENCIVRWHQQSLSRDENVYMAELAEQAGMYEQMDEFMDNVQRTVESEEVTVDERNLLSDGYKNV

SEQ ID NO: 5552 - protein, 211 aa, Zea mays
  unsure (1)..(211): unsure at all Xaa locations
MAEDLVLDTAIRDWVLIPLSVVMVLIGVLRYFVSKLMRSPATSPSPDPKLVKEGQVVIRARNLRTNAQFIPANVFKARKVYYTNEENGLLHVPKEDAQKAQAAMFSDPNMAMDMMKKNLSMIVPQTLTFAWVNFFFSGFVAAKIPFPLTQRFRGMLPNGIDLSTVDVSYVSSRSCXDDAQKMMQMGGGFGFNPTMSLGAEKDSLDIMQHDW

SEQ ID NO: 5553 - protein, 267 aa, Zea mays
  unsure (1)..(267): unsure at all Xaa locations
MPLSSFSFLRHHLPLPLQLPPTSNRQPPHPRLFHLLLPPFTPRRTFVCQPLTAATDDMAAAAAAASPPTLLEHMGQAGTAADLTVLVAHIQSACKRIAALVASPGNAELSRAKARGGAMAAGRDAPKPLDELSNDIILSALQSSGKVAALASEENDLPIWISDGGPYVVVTDPLDGSRNIEVSIPTGTIFGIYNRLVEVDHLPLEERAQLNSLQSGTRLVAAGYVLYSSATILCISXGAGTHAFTLDWSTGEFILTHPSIQIPPRGN

SEQ ID NO: 5554 - protein, 485 aa, Zea mays
PLERKLCILKGVFPRQPKKKVEGNHKTYYHTKDIAFLAHDPLIEKFREIKVHRRKVKKAVAKKNRDLADRLLNRPPTYKLDRLVLERYPTFVDALRDLDDCLTMVHLFAALPAVDGERVEVKRIHNCRRLSHECLTFISVKGIYYQAEVQGQKITWLTPHALQQVLTDDVDFNVMLSFLEFYETLLGFVNFKIYHSINVNYPPILDPRLEALAVELYALCRYISAGSRRMIGNSQTDEVMEDKDEKSKAEEVIEEEKVVKNKASSKADESEFRLAQLQHQLPTNEPGALMNLVEESTADDADDDDTKDCKGLFKNLKFYLSREVPRESLLFIIPAFGGTVSWEGEGAPFKEIDEDITHQRLKDVFHSIGASSEKFTLSAENLPNTLEYIEGEVEALDEVIGSHADFCALVASRGTATAFLKAGCTHGKIVNRPNYSLSSSDLIDIPSLARSIGNRFMTQIWVNGGRKMTGDEARSHLKPDDEAEV

SEQ ID NO: 5555 - protein, 599 aa, Zea mays
CRPLQQETTLVWSFGRGAKKNRPGKKSRGRSTKTIISLSAGVSFLQIKKRQVEQRSQLASELRRDGSAERLQPASCRGRPRGVGGGDPRHRRRGDEGDDVKLRLLGYKQQLKRDLSVVANFSVSFSIVSVVTGVTTLFGTGLQFGGPATMVYGWPIAGAFTAAVGLAMAEICSAYPTSGGLYFWSARLCTHRRWGPFAAWLTGWFNVVGQWAVTTSVDYSLAQLIQVIILLATGGKNGGGYLASKYMVIGFHAAILLSHAVINSLPITFLSFFGQFAAAWNMLGVFVLMVAVPTVATERASAEFVFTHFNTDNGAGIRSNLYIFVLGLLMSQYTLTGYDASAHMTEETKNADKNGPIGIISAIGISILVGWGYILGVTFAVKDIPYLLSPDNDAGGYAIAEVFYLAFKSRYGSGAGGIVCLGVVAVAVYFCGMSSVTSNSRMAYAFSRDGAMPFSSVWHKVNKQEVPINAVWLSALVALCMALPSLGSLVAFQAMVSIATIGLYISYALPILFRVTLARKYFVPGPFNLGRYGVLVGWVAVLWVATITVLFSLPVTYPVTKDTLNYTPVAVGGLLFLVLASWLLSARHWFKGPVTNLDG

SEQ ID NO: 5556 - protein, 221 aa, Zea mays
PTGSVFNCGLFARNRTVFCWGDETVSGVVGLAPRDLHFQSIGAGGYHVCGVLENAQVFCWGRSLEMQQVVPSSAIGDGDVNIVPMDAMSTVVGGRFHACGIRSLDHQVACWGFTLHNSTSPPKGLKMYALVAGDYFTCGVPAETSLMPRCWGNSGPLALPMAVPPGICVPTACSHGYYEYVNHGEVGSIKVCKPANSRLCLPCSTGCPEGLYESSPCNATG

SEQ ID NO: 5557 - protein, 217 aa, Zea mays
MGVQLTTNNIIAEFYYDQFELDIRVAGIIAACFGMANLVSRPLGGVLSDLGARYWGMRARLWNIWILQTAGGAFCFWLGRASELPASVTAMNMGIMAMACTLSGRWRRAAADAGFEVRVAEPDHHSDMDTFVVLVNSAGWACTAPAHRHGVSAHGSVLIQMVSFDGLGWLTGVTFKDLMAHSACSASACPSTTAIRGGDMGGAGDMGSADDMDGGVT

SEQ ID NO: 5558 - protein, 167 aa, Zea mays
GYPCCRRDSFSRVLWHAVANYRTWVFVFVYGYSMGVQLTTNNIIAEFYYDQFELDIRVAGIIAACFGMANLVSRPLGGVLSDLGARYWGMRARLWNIWILQTAGGAFCFWLGRASELPASVTAMVLFSAATHEGHLEHGHHGHGMHVEREMAPRRGRRRLRGTGGGA

SEQ ID NO: 5559 - protein, 142 aa, Zea mays
DPPRIGTPSIDTTCTIWYVERESVDTQLMAHDKEVSDIAWGGAGVLPSVSADGSVRVFDFRDKEHSTIIYESGSAPTPLVRLGWIKQDPRYMATIIMDSPKVVVLDIRYPTLPVVELHRPHAPVNAIAWAPHLSATMPGYES

SEQ ID NO: 5560 - protein, 160 aa, Zea mays
DPPRIGTPSIDTTCTIWYVERESVDTQLMAHDKEVSDIAWGGAGVLPSVSADGSVRVFDFRDKEHSTIIYESGSGGSSGGGSNSGPGDGGTASPTPLVRLGWIKQDPRYMATIIMDSPKVVVLDIRYPTLPVVELHRPHAPVNAIAWAPHLSATMPGYES

SEQ ID NO: 5561 - protein, 256 aa, Zea mays
MATSTMRVAAGVLLVVSALATLARAEDPYLFFEWKVTYGTRSLLGVPQKVILINGEFPGPRINCSSNNNIVVNVFNQLDHPLLFTWNGMQHRKNSWMDGMPGTQCPIAPNTNFTYKWQPKDQIGSFFYFPSIGMQRAAGGYGAISVVSRLLIPVPFDQPPPESDHAVLIGDWYTKDHEVLARQLDAGKSVGRPAGVLINGKGGKDLEAAAPMLTFEAGKTYRLRVCNTGIKASLNFSIQGHDMKLVELEGSHTLQV

SEQ ID NO: 5562 - protein, 268 aa, Zea mays
MSPSEPTREESVYMAKLAEQAERYEEMVEFMERVARYAGGAGGGEELSVEERNLLSVAYKNVIGARRASWRIISSIEQKEEGRGNEAHAASIRAYRSKIEAELARICDGILALLDSHLVPSAGGAESKVFYLKMKGDYHRYLAEFKSGAERKDAAESTMNAYKAAQDIALADLAPTHPIRLGLALNFSVFYYEILNSPDRACNLAKQAFDEAISELDSLGEESYKDSTLIMQLLRDNLTLWTSDTNEDGGDEIKEAAAAPKESAPEGQ

SEQ ID NO: 5563 - protein, 277 aa, Zea mays
  unsure (1)..(277): unsure at all Xaa locations
LAPLALVLLAFQRARGYERAVLVGITYAGMRQGCGDLRGPVNDVKCMRNLLCQRFGFPGECIIMLTDDQRDPFRLPTKENIRMAMHWLVQGCSYGDSLVFHFSGIGAQVADDDGDEADGYDEAICPLDAFQSGPILDDEINEVIVRPLVHGARLHAVVDACYSATVLDLPYQCRMSRNGFWQWEDESPPSGAWKGTSGGHAVLISGYSEXQRQLRHGQGHDTYIHTADRALLPCTVVGAMTHSFVRTLECQPRGVTYGHLLSSMRAIMKNRGGGCDL

SEQ ID NO: 5564 - protein, 361 aa, Zea mays
  unsure (1)..(361): unsure at all Xaa locations
ALAPGLTSRQPVNFGGNGNATIRCKYCRASLSVIPGERAIQCAQCNCVTRIRRADPHPRWARPAHVPPAFQRARGKKRAVLVGITYAGMRQGCGDLRGPVNDVKCMRNLLCQRFGFPGECIIMLTDDQRDPFRLPTKENIRMAMHWLVQGCSYGDSLVFHFSGIGAQVADDDGDEADGYDEAICPLDAFQSGPILDDEINEVIVRPLVHGARLHXVVDACYSATVLDLPYLCRMSRNGFWQWEDECPPSGAWKGTSGGHAVLISGYSEGKGNFAMMPDAHASVVGAMTHSFVRTLECQPRGVTYGHLLSSMRAIMKNRGGGCDLQGAIGAPIRTVANFSGVQEPNLSSSETFDIYRKQFVL

SEQ ID NO: 5565 - protein, 131 aa, Zea mays
MKIQCDACEGAAATVVCCADEAALCARCDVEIHAANKLASKHQRLPLEALSAKLPRCDVCQMRYTHDVRRKQANLASRSQEKAAFIFCVEDRALFCQDCDEPIHVPGTLSGNHQRYLATGIRVGLASASAC

SEQ ID NO: 5566 - protein, 721 aa, Zea mays
  unsure (1)..(721): unsure at all Xaa locations
MEMNSSGEETVVKVRKPYTITKQRERWTEAEHKRFLEALKLYGRAWQRIEXEHVGTKTAVQIRSHAQKFFTKLEKEAMNNGTSPGQAHDIDIPPPRPKRKPNSPYPRKSCLSSETQTKELPNDKSTKPNMPLSNGHVKMVGDASLQNFQRKELSEKGSRSEVLNLFRDAPSASFSSVNKSSSNHGAPRRTEASKTESRDMSIMENNSFNPNTQEDVKVISDQEMERLNGIQIRSKCEHSHEGYLDISTQQMKLMPKSVETTYVDEQTARASHTLAESNGTASIPVTVPEGTHPDQTSDQVGINGSMNPCIHPMVSADPKFGSSATPQTFPHNYAAFAPMMQCNCNQDTYRSFTNMSSTFSSMLVSTLLSNPAIHAAARLAASYWPAAEGNTPIDPNQENPADGVQGRNIGSPPSMASIVAATVAAASAWWATQGLLPFFAPPVAFPFVPAPSAAFPTVDVPRPSEKDRDCPVENAQNECQEARKQVQFEGLRVAASSESDGSGKGEVSLHTELKLSPAQNADATPTTGAGTNDAFRNKKKQDRSSCGSNTPSSSDVDAGNVPEEDNANEKAKQASCSNSSAGDTNHRRFRSNGSTSDSWKEVSEEGRLAFDALFSREKLPQSFSPPQAVDSKEVAKEEEDEVTTVAVDLNKNATSIDHDDLDTMDEPRASFPNELSHLKLKSRRTGFKPYKRCSVEAKENRVPTSDMVGTKRIRLDSEAST

SEQ ID NO: 5567 - protein, 192 aa, Zea mays
  unsure (1)..(192): unsure at all Xaa locations
MAAQEQEQEKQQAKTSTTSSLPSSSERSSSSARNNLTEGGAESDEEIRRVPEMGGASASASSGAGADERPKGEDGKQXAGGGGGAAXAGGKKRGRTAGDKEQNRLKRLLRNRVSAQQARERKKAYLTELEAKAKGLELRNAELEQRVSTLQNENNTLRQILKNTTAHASKRSGGGAGGKGGDGGKKHHLAKS

SEQ ID NO: 5568 - protein, 423 aa, Zea mays
HASGRWHVRLPLGNSGLRVLCSPFPSDFPTAVTIFTANSPAGAAPSVRPFFRYRTRQSPQRSLSLAPPTQRSASAREEEMASSGYEGILLGMGNPLLDISAVVDEGFLAKYDVKPGNVILAEDKHLPMYDELASKSNVEYIAGGATQNSIRVAQWMLQIPGASSYIGCIGKDKFGEEMKKNAQAAGINAHYHEDDNAPTGTCAVCVVGGERSLIANLSAANCYKSEHLKKPENWALVEKAKYIYIAGFFLTVSPDSIQLVAEHAAATNKVFMMNLSAPFICEVFRDAQEKALPYVDYIFGNETEARTFAKVRGWETENVEEIALKISQLPKASGTHKRITVITQGCDPVVVADDGKVKTFPVILLPKEKLVDTNGAGDAFVGGFLSQLVQEKSIDECVRAACYAANVVIQRSGCTYPEKPDFN

SEQ ID NO: 5569 - protein, 301 aa, Zea mays
VMRFLTNPHKPMILALSRPDPKKNITTLVKAFGECRPLRELANLTLIMGNRDDIDDMSAGNASVLTTVLKLIDKYDLYGSVAFPKHHNQADVPEIYRLAAKMKGVFINPALVEPFGLTLIEALNNGLLVDPHDQNAIADALLKLVADKNLWQECRRNGLRNIHLYSWPEHCRTYLTRVAGCRLRNPRWLKDTPADAGADEEEFLEDSMDAQDLSLRLSIDGEKSSLNTNDPLWFDPQDQVQKIMNNIKQSSALPPSMSSVAAEGTGSTMNKYPLLRRRRRLFVIAVDCYQDDGRASKKMLQ

SEQ ID NO: 5570 - protein, 328 aa, Zea mays
VMRFLTNPHKPMILALSRPDPKKNITTLVKAFGECRPLRELANLTLIMGNRDDIDDMSAGNASVLTTVLKLIDKYDLYGSVAFPKHHNQADVPEIYRLAAKMKGVFINPALVEPFGLTLIEAAAHGLPIVATKNGGPVDITNALNNGLLVDPHDQNAIADALLKLVADKNLWQECRRNGLRNIHLYSWPEHCRTYLTRVAGCRLRNPRWLKDTPADAGADEEEFLEDSMDAQDLSLRLSIDGEKSSLNTNDPLWFDPQDQVQKIMNNIKQSSALPPSMSSVAAEGTGSTMNKYPLLRRRRRLFVIAVDCYQDDGRASKKMLQVNSRGS

SEQ ID NO: 5571 - protein, 161 aa, Zea mays
MDPNDAFSAAHPFRWDLGPPAHAAPAPAPPPPPLAPLLLPPHAPRELEDLVAGYGVRPSTVARISELGFTASTLLGMTERELDDMMAALAGLFRWDVLLGERFGLRAALRAERGRVMSLGARCFHAGSTLDAASQEGTAYRSMYSCHTHTDILVYMLSFLL

SEQ ID NO: 5572 - protein, 191 aa, Zea mays
  unsure (1)..(191): unsure at all Xaa locations
VRTSDDSDNIIVLVRTDYSLSASDLGNHLFNWTXTSFTANYYVKYKHPDMLDQSSCLQGDIPCIRTEGLPLALPDLNSANVIVLKDATPFVSMHGSDALXPCQTPRKLPNTGGKSNILLDDSQNQTHDVARSHAISADPEATLNPTRNTCGWLYPLFTIFLITGYLVSLISASKSCRQFMIQLIEPFTHNK

SEQ ID NO: 5573 - protein, 249 aa, Zea mays
MQQSGGSGSGTTDPKGQENNVQDSTGSPPQQEVADTEDSSADKQQGEAGNPKEKLKKPDKILPCPRCNSMDTKFCYYNNYNINQPRHFCKNCQRYWTAGGAMRNVPVGAGRRKSKSASATSHFLQRVRAGLPVDPLVCAAAKTNGTVLSFGSAMSSLDLTEQMKQLKEKLVPIAGDERSVGSRTQGPSAKAEDPDRKENVTADKSARVVQHPCMTNGVAMWPFSCAPPVPASACYGPGSIAMPFYPATG

SEQ ID NO: 5574 - protein, 123 aa, Zea mays
  unsure (1)..(123): unsure at all Xaa locations
RARWGHSGLTGAXGKGAXLTQLLFFTTSSYSTRKGIENMGIMAMACTLPLVLVHFPQWGSMLLPPSADADEERYYASEWSEDEKSVGRHSASLKFAENSRSERGKRNAVAVLATAAATPEHVV

SEQ ID NO: 5575 - protein, 311 aa, Zea mays
MSSAEPQKVLGMPPFVADFLMGGVSAAVSKTAAAPIERVKLLIQNQDEMLKTGRLDRKYNGIGDCFKRTMADEGVMSLWRGNTANVIRYFPTQALNFAFRDKFKKMFGYKKDKDGYAMWMAGNLASGGAAGATSLLFVYSLDYARTRLANDAKNAKSGGDRQFNGLVDVYKKTLASDGIAGLYRGFMPSVAGIVVYRGLYFGMYDSIKPVVLTGNLQGNFLASFALGWIVTTGAGIASYPLDTIRRRMMMTSGEAVKYKNTMDAARQIVAKEGVKSLFKGAGANILRGVAGAGVLSIYDQLQVLLFGKAFK

SEQ ID NO: 5576 - protein, 437 aa, Zea mays
LQGLPYNPQDGLAATDEDCKQACLSRCYCVAYAYAYRSGCKLWYYNLYNLSFASRGPPPYSKVYVRWGSKLRPKSGLRTGLIVSMVVGSVALAAVILALLWRSRTWRGVFTCSRREFEAGGSLAFYSYAQMKKATRNFSDKLGEGGFGSVFRGTMAGPTAVAVKRLKRSGQADKQFRAEVQTLGVIKHANLVRLLGFCVRGDTRLLVYEYMPNGSLDAHLFSERSARLSWSLRYQIALGIAKGIAYLHEECEDRIIHCDIKPENILLDSELRAKIADFGMAKLLGREFDSALTTVRGTMGYLAPEWISGRPVTRKADVYSFGIVLLEIVSGRRSTARLRSGSGSHRYFPLHAAARVSEGDVLCLLDGRLGGDADVEELDVACRVACWCVQDDEGDRPSMGQVVRMLEGVVSVAVPPIPSSFQNLVEGEGSVIYSDEE

SEQ ID NO: 5577 - protein, 207 aa, Zea mays
STVDLQTLIMGNRDVIDEMSSTNAAVLTSALKLIDKYDLYGQVAYPKHHKQSEVPDIYRLAARTKGVFINCALVEPFGLTLIEAAAYGLPMVATRNGGPVYIHRVLDNGILVDPHNQNNYLARVVTLKPRHPRWQKNDVAAEISEADSPEDSLRDIHDISLNLKLSLDSEKSGSKEGNSNALRRHFEDAAQKLSGVNDIKKDVPGEN

SEQ ID NO: 5578 - protein, 1059 aa, Zea mays; identical to SEQ ID NO: 831

SEQ ID NO: 5579 - protein, 566 aa, Zea mays
LGMLQMLMDTDLDTTQQDYVRTAQASGKTLVSLINEVLDQAKIESGKLELEVVPFDLRTVCDDILSLFCGKAQEKGLELAVFVSDQVPQTLIGDPGRIRQIITNLVGNSIKFTEKGHIYLTVHVVEEIMHCLEVETGTQYTNTLSGYPVANRKRSWENFRLFSRELNSSEMPFAPIASDSISLMISVEDTGAGIPFDAQSRVFTPFMQVGPSIARIHGGTGIGLSISKCLVGLMKGEIGFASKPQVGSTFTFTAVLTRVHSSRNENKSSEFKEINALVVDHRPVRAKVTKYHLQRLGVQTELTTDLDQYISKNNCGSQIAKLVLIDKETWLKESHSMPLLVTKLRNKDQPDSTKLFLLENPKSSVKSNSHIFREYNLNVIMKPLRASMLQVSLQRALGGIDKLHCRNGVVGNSTLGSLLHKKRIIVVDDNIVNLKVAAGALKKYGAEVTCADSGKEAITLLKPPHNFDACFMDIQMPEMDGFEATKRIRVMERDLNEQIECGEAPPECVGVRQWRTPILAMTADVIQATHEQCLKSEMDGYVSKPFEGEQLYREVARFFLNQDQVQ

SEQ ID NO: 5580 - protein, 316 aa, Zea mays
EGEKPDSIISTNLNFNGKLQPDASNGTAQIAKVQCPRDTHFWVYHDGGYEEEGQNNIKGKIWESPLTRFACALVSLPVPPTNFDATKDEAPYSSKTVPDYLDHKRIQKLLILGSPGAGTSTIFKQAKLLYGNRFTDEELENIKLMIQSNMFKYLGILLEGRERFEEEALAVPNHPSSVGDDPQQDESKSSSSNSCIYSINAKLKKFSDWLLDIIATGDLDTFFPAATREYAPVVDELWKDPAIQATYKRKDELHFLPDAAEYFLSRAVEVSSNEYEPSEKDVIYAEGVTQGNGLAFIDFTLDDRSPMSESFGDNHD

SEQ ID NO: 5581 - protein, 226 aa, Zea mays
  unsure (1)..(226): unsure at all Xaa locations
MAAQPALKASFRGELNAVSFLDSSRGPFGQHKVDFTFQRKGKRAISLRRTCCSMQQAPPPAWPGRAVAEPGRRSLDGPKPISIVGSTGSIGTQTLDIVAENPDKFRVVALSAGSNVTLLADQVKTFKPKLVAVRNETLVDELKEALADCEEKPEIIPGEQGVIEVARHPDAITVVTGNSKGVQGLKPTIAAIEAGKDIALANKRTLLQXGPFVLPLHTTQVKIFLL

SEQ ID NO: 5582 - protein, 99 aa, Zea mays
  unsure (1)..(99): unsure at all Xaa locations
DSHQGKFVIFSNLSIVGMNVSLMWNSAGFYQIAKLCMIPASCLLEVVFDHVHYSRDTKLSIMVVLIGVAVCTVTDVSVNARGLIAAVIXAWSTALQQYY

SEQ ID NO: 5583 - protein, 501 aa, Zea mays
MASSSPDLADDGFAAPRLFSQGVSYTYDDVIFLPGYIGFPADAVDLSTRLSRRVPLSIPCVASPMDTVSEAAMAAAMASLGAAAVVHCNTEPHSQAAIVRAAKSRRLPFVSSVPFFSPSSSPTLNDFAGSEYALVTERGDSLSRLVGIAVAADAASREVPISVSEYMRPTPRSASSAFDFEEAATFLADEGLDYAPLVSDDGEVVDLITAKDVERIRSYPKLGKPSLGANGKFVVAASIGTREDDKGRLEQLVKAGANAIVIDSSQGNSIYQLDMIKFAKKMYPEVDLIGGNVVTIAQAQNLIQAGVDGLRVGMGSGSICTTQEVCAVGRGQATAVYKVSSYAKDHNVPVIADGGISNSGHIVKALSLGASTVMMGSFLAGSHEAPGTYEYKDGRRVKKYRGMGSLEAMTKGSDARYLGDTLKLKVAQGVVGAVADKGSVLRFIPYTMQAVKQGLQDLGADSLQSAHDLLRSETLRLEVRTGAAQAEGGIHGLVSYEKKAF

SEQ ID NO: 5584 - protein, 239 aa, Zea mays
MGRGKIVIRRIDNSTSRQVTFSKRRNGIFKKARELAILCDAEVGLVIFSSTGRLYEYASTSIKSVIDRYGRAKEEEHVADPNTELKFWQREAASLRQQLHNLQENHRQLMGQNLSGLGVKGLQNLENQLEMSICCIRTKKDQLLVDEIHELNRKGSLIQQDNMGLHRKVNLIRQENAELYKKLYEKEAEGEVNRDSTTPYNFVVAEGANVPIHLELNIPLQENGVEQPVAPKLGLQLNQ

SEQ ID NO: 5585 - protein, 257 aa, Zea mays
  unsure (1)..(257): unsure at all Xaa locations
ILFLDENDEELFSMFLDVDKLNSSCGASSEAEAESSSAAGGGGEGAELADAPRPRHQHSQSMDGSMSIKAEQLVGAPGMEGMSSAEAKKAVSAAKLAELALVDPKRAKRIWANRQSAARSKERKMRYIGELELKVQTLQTEATTLSAQLALLQRDTTGLTTENSELKIRLQTMEQQVHLQDALNDTLKTEVQRLKVATGQVGNGWXXGMMLNFXAMPRLVGGNQQMFHSSQAMQSXLAAHQLQQLQLHSQXQQQQLH

SEQ ID NO: 5586 - protein, 635 aa, Zea mays
  unsure (1)..(635): unsure at all Xaa locations
MDGCDCIEPLWPTDDLLVKYQYISDFFIALAYFSIPLELIYFVKKSSFFPYRWVLIQFGAFIVLCGATHLINLWTFTTHTKTVAMVMTIAKISTAVVSCATALMLVHIIPDLLSVKTRELFLKNKAEELDREMGLIRTQEETGRHVRMLTHEIRSTLDRHTILKTTLVELGRTLGLEECALWMPSRSGSSLQLSHTLRHQITXVGSSVPMNLPVVNQVFSSNRAIIIPHTSSLARVRPLAGRYVPPEVAAVRVPLLHLSNFQINDWPELSAKSFAIMVLMLPSDSARKWHVHELELVEVVADQVAVALSHAAILEESMRARDLLMEQNVALDLARREAEMAIRARNDFLAVMNHEMRTPMNAIIALSSLLLETELTPEQRLMVETVLKSSNLLATLINDVLDLSKLEDGSLELEIKAFNLHAVFKEVMGFIKPIASIKRLSVSVMLAPDLPLCAIGDEKRLMQTILNISGNAVKFTKEGHITLVASIVKADSLREFRTPEFHPTASDEHFYLKVQVKDTGCGVSPQDLPHVFTKFAHPQSGGNRGFNGSGLGLAICKRFVSLMGGHIWIDSEGTGRGCTATFVIKLGVCDNTNTYQQQLVPLVWPSSADSNLSAPKVLPDGRGSVSLKSRYQRSV

SEQ ID NO: 5587 - protein, 216 aa, Zea mays
STKLANDVRSKDGMPCLPNMSLIVKTNPFPSKSNMKNGLQAISSQHGKMEYDSKSEEAKTESGGSGQEKVLKKPDKILPCPRCNSMETKFCYFNNYNVNQPRHFCRNCKRYWTAGGTMRNVPVGSGRRRNKDPSHHHHFTKVCDYTIATNGDVSDATQRQSVAAKLCLLQGSGKQNETACKSVSPVSNIKEQNNADLISLVSGDNKEEKSCASSAG

SEQ ID NO: 5588 - protein, 155 aa, Zea mays
MILSLAVSSANLLLLFFQYTKARTAWIVRLKILDFASIIESVGEGVTDVAPGDHVLPVFTGECKECAHCKSAESNMCDLLRINTDRGVMIADGKSRFSINGKPIYHFVGTSTFSEYTVMHVGCVAKINPQAPLDKVCVLSCGISTGLGAVWNTAK

SEQ ID NO: 5589 - protein, 171 aa, Zea mays
MDTAAPLQLKACAGDAAEKLLLAVAAEGPICGVPDFKMRGKKSDELEPVDAGDEDDDGGDDGDEDGDFGEEGEEDVSEGEGYDNPKGNETKKQRGDPEENGEEDEEEPEDQEGGGDDDDDDDDDDENGDDEDDDNGDDDEEGVDEEDDDQDEDEEEDDDEDSLQPPKKRKK

SEQ ID NO: 5590 - protein, 81 aa, Zea mays
LQRFRGVRQRHWGSWVSEIRHPLLKTRIWLGTYETAEDAARAYDEAARLMSGPSARTNFPLSLSGGGSTPTPTARISTSRR

SEQ ID NO: 5591 - protein, 181 aa, Zea mays
MPKLQRFRGVRQRHWGSWVSEIRHPLLKTRIWLGTYETAEDAARAYDEAARLISGPAARTNFPLTDGGGGGGTLSPTLRAKLEKCCCTAPAQEPKHGGDGADAPRTGAGRGDDGSSRRDRRRDGDEEDEEAGVKVEPDADADGEEYIEEMIRELTYYGPVEIQHHPSAAGGGGACSSSAIG

SEQ ID NO: 5592 - protein, 103 aa, Zea mays
SDETTTGVKRLHQTQETGALLFPAINVNDSVTKSKFDNPHGCRHSLPDGPTRATDVTIAGQVAVVCGHGDVGKGRAAALKQAGARVTVTDTDPICGLQALTEG

SEQ ID NO: 5593 - protein, 155 aa, Zea mays
MEKTELIQKAKLAEQAERYDDMATCMKAVTEQGAELSNEERNLLSVAYKNVVGGRRSAWRVISSIEQKTDTSDKKLQLIKDYREKVESELRSICTTVLELVDKCLIANATNPESKVFYLKMKGDYLRYLAEGACGDDRKRTMENWRGAYQEAFGV

SEQ ID NO: 5594 - protein, 255 aa, Zea mays
MGRGRVELKRIENKINRQVTFSKRRNGLLKKAYELSVLCDAEVALIIFSSRGKLYEFGSAGITKTLERYQHCCYNAQDSNGALSETQSWYQEMSKLRAKFEALQRTQRHLLGEELGPLSVKELQQLEKQLECALSQARQRKTQLMMEQVEELRRKERHLGEMNRQLKHKLEAEGCSNYRTLQHAAWPAPGSTMVEHDGATYHVHPTTAQSVAMDCEPTLQIGYPPHHQFLPSEAANNIPRSPPGGENNFMLGWVL

SEQ ID NO: 5595 - protein, 468 aa, Zea mays
  unsure (1)..(468): unsure at all Xaa locations
MAGNEWINGYLEAILDSHTSSRGAGGGGGGGDPRSPTKAASPRGAHMNFNPSHYFVEEVVKGVDESDLHRTWIKVVATRNARERSTRLENMCWRIWHLARKKKQLELEGIQRISARRKEQEQVRREATEDLAEDLSEGEKGDTIGELAPVETTKKKFQRNFSXLTVWSDDNKEKKLYIVLISVHGLVRGENMELGRDSDTGGQVKYVVELARAMSMMPGVYRVDLFTRQVSSPDVDWSYGEPTEMLCAGSNDGEGMGESGGAYIVRIPCGPRDKYLKKEALWPYLQEFVDGALAHILNMSKALGEQVGNGRPVLPYVIHGHYADAGDVAALLSGALNVPMVLTGHSLGRNKLEQLLKQGRMSKEEIDSTYKIMRRIEGEELALDASELVITSTRQEIDEQWGLYDGFDVKLEKVLRARARRGVSCHGRYMPRMVVIPPGMDFSNVVVHEDIDGDGDVNDIIFDRTRGS

SEQ ID NO: 5596 - protein, 246 aa, Zea mays
HARLAPRIDRARSLQRWTRCLPPPLLAGPPLLPAPAAARAAGWAIGALLTCIFAVVGSLVGIFIGAFMGMSTESGMFRGAGVGAVSGAVFSIEAVESCIEIWRSSHSGKYSILFVLDIISSLFSGRIVWEKVSPALQRAVQSQMSLMSTPFIDNSDLFETGSTGGMSRDLIDRIPKTRFSAASNCDQETDSSCCPVCLQDFGARQFVRALPQCQHIFHVRCIDSWLLRHASCPLCRAGVHIDHIHM

SEQ ID NO: 5597 - protein, 144 aa, Zea mays
  unsure (1)..(144): unsure at all Xaa locations
TLFRRTRVSRLTRNAVKTPPPNGISTTLTGRKWVHGLTSPTIHRGAKKWFSQWITYGKLVTSRGRGEKHSLLSVVYKNVFGTPRCWWRLIYSIVQEEEGLRIDDRQRLSXDYPGGDEDDLTMICDWVLALVDSHLVTSFTGPEC

SEQ ID NO: 5598 - protein, 610 aa, Zea mays
MERRRADKEEAEEPLRPEEEEDEEDEEEGWDDWCSDGEDVGGGLLCLFCSSSFDSESSLFEHCAAEHCFDFHMIVKELGLDFYSCIKLINFVRSKVAEKKCWSCGQAFSSNTELCSHLHTVENCLIEGKVPWEDDVYLKPFMEDDSLLHSLSIDDDDEDGDCGVSMEKGQYSAGNEVLAEPWGNKLSSISERNDSDISAQFQQECTIGSTQREVRESLHVAIDGHLKVARASVNSKAIKTVDDNYFGSYSSFGIHREMLGDKVRTDAYRDAILGNPSLISGATVLDVGCGTGILSLFAARAGASRVVAVDGSAKMASVATQVAKNNGLLYDENVEAEQKQGSAQVISVVHTKAEELNQKIQVPQNGFDLLVSEWMGYCLLYESMLSSVIYARDHFLKPGGAILPDTAMILGAGFGKGGTSLPFWENVYGFDMSCIGKEVTSTSARFPVVDVLSSQDIVTETAVLHSFDLASMKESEMDFTASFELMLSESSATVSGVTWCYGIVLWFDTGFTDRFCKEKPVVLSTSPFSTPTHWSQTIFTFEEPIAMAKEESTLGSSALAGTDECPATALRSRISIVRASEHRSIDISVETTAISSDGRKRSWPVQIFNL

SEQ ID NO: 5599 - protein, 186 aa, Zea mays
RGGREGSCPPAWARACDGCRAAPSVVYCHADTAYLCASCNSRVHAANRVASRHERVRVCEACECAPAVLACRADAAALCAACDAQVHSANPLAGRHQRVPVLPLPAAAVPAASVLAEAAATAAAVAGDKDEEVDSWLLLSNNNNISSNTSTFYADVDEYFDLVGYSSYCDNHINSNTHSVFHRYFA

SEQ ID NO: 5600 - protein, 374 aa, Zea mays
MLGAARRQLGSGPMLGQVLRRLRPAVAAEVARGYSAAAKEMTVRDALNSALDEEMSADPSVFLMGEEVGEYQGAYKISKGLLDRYGPDRVLDTPITEAGFTGIGVGAAYHGLRPIIEFMTFNFSMQAIDHIINSAAKSNYMSAGQISVPIVFRGPNGAAAGVGAQHSQCYAAWFAHVPGLKVLTPYSSEDARGLLKAAIRDPDPVIFLENELLYGESFPVSAEVLDSSFCLPIGKAKIEREGKDVTITAFSKMVGYALQAAEILSKEGISAEVINLRSIRPLDRAAINASVRKTNRLVTVEEGFPQHGIGAEICMSVVEESFAYLDAPVERIAGADVPMPYAANLERMAVPQVDDIVRAAKRACYRAVPMAAAA

SEQ ID NO: 5601 - protein, 208 aa, Zea mays
MGSGNKRATGNANYRLARSVVQFLDPGRQAEKHQLVKMSAGFQLGVIGSLALSVASSVSIVLCNKALISTLGFPFATTLTSWHLMVTFCTLHVAQRLRFFEPKAIDGQTVILFGLLNGTSIGLLNLSLGFNSIGFYQMTKLAIIPFTVLLETIFLKKRFSESIKLSLLVLLLGVGIASVTDLKLNLLGSILSGLAIATTCVGQIVSYI

SEQ ID NO: 5602 - protein, 75 aa, Zea mays
TGGEVFHNGILYASRESHYSVFKAARMYIMGCVKVDILMSGEIDCAMSREIDCDNFQRKLLQNRDKPAIINVNIG

SEQ ID NO: 5603 - protein, 187 aa, Zea mays
  unsure (1)..(187): unsure at all Xaa locations
IRGRVDRRTSAVKVDEYARGMISASGSSLVEXLGLYYIGPVDGHCVEDLVTIFEKVKSMPAPGPVLIHIVTEKGKGYPPAEAAADRMHVVVKFEPATVRQLKSKSPTLFVHRSIFAXSLIREAESDEKVVAIHAAMGGGTGLNYFQKRFPERCFDVGIAEQHAVTFAAGLAAEGLKPFCAIYSSFLQ

SEQ ID NO: 5604 - protein, 547 aa, Zea mays
LGMLQMLMDTDLDTTQQDYVRTAQASGKTLVSLINEVLDQAKIESGKLELEVVPFDLRTVCDDILSLFCGKAQEKGLELAVFVSDQVPQTLIGDPGRIRQIITNLVGNSIKFTEKGHIYLTVHVVEEIMHCLEVETGTQYTNTLSGYPVANRKRSWENFRLFSRELNSSEMPFAPIASDSISLMISVEDTGAGIPFDAQSRVFTPFMQVGPSIARIHGGTGIGLSISKCLVGLMRGEIGFASKPQVGSTFTFTAVLTRVHSSRNENKSSEFKEINALVVDHRPVRAKVTKYHLQRLGVQTELTTDLDQYISKNNCGSQIAKLVLIDKETWLKESHSMPLLVTKLRNKDQPDSTKLFLLENPKSSVKSNSHIFREYNLNVIMKPLRASMLQVSLQRALGGIDKLHCRNGVVGNSTLGSLLHKKRIIVVDDNIVNLKVAAGALKKYGAEVTCADSGKKAITQLKPPHSFDACFMDIQMPEMDGFEATKRIRVMERDLNEQIERGEAPPECAGLRQWRTPILAMTADVIQATHEQCLKSEMDGYVSKMSN

SEQ ID NO: 5605 - protein, 175 aa, Zea mays
  unsure (1)..(175): unsure at all Xaa locations
MEINLVNLCIRWPWLIFIRLVIHVLLFSQDSSVPSSIGMPTRXRIPILYTLSWPDRIYCSEVTWPRLDLCKLGSLTFKAPDNVKYPSMDLAYAAGRAGGTMTGVLSAANEKAVELFIDEKISYLDIFKVVELTCDAHRNELVASPSLEEIIHYDLWARRHAASLQPASGLSPVPA

SEQ ID NO: 5606 - protein, 189 aa, Zea mays
VFYYKCTDFILVIPYYDAQWEQLAVFVSDQVPQTLIGDPGRIRQIITNLVGNSIKFTEKGHIYLTVHVVEEIMHCLEVETGTQYTNTLSGYPVANRKRSWENFRLFSRELNSSEMPFAPIASDSISLMISVEDTGAGIPFDAQSRVFTPFMQVGPSIARIHGGTGIGLSISKCLVGLMKGEIGFSSKPQ

SEQ ID NO: 5607 - protein, 496 aa, Zea mays
  unsure (1)..(496): unsure at all Xaa locations
SLCVPSTNQSIYVDIGVMSGAAMYIKKDLKITDVQLEILIGILSLYSLIGSFAGARTSDRIGRRLTLVFAAVIFFAGALLMGFAVNYSMLMVGRFVAGVGVGYGGMIAPVYTAEISPAASRGFLTSFPEVFINVGILLGYLSNFAFARLPLRFGWRVMLGIGAAPAGLLALMVLWMPESPRWLVMKGRLADARAVLEKTSASPEEAAERLADIKVAAGIPKGLDGDVVAVPKERSGGEMQVWRELILSPTPAIRRILLSAVGLHFFQQASGSDSVVLYSPSVFKSAGITDDNKLLDLGVTCAVGVAKTLFIPVATFLLDRAGRRPLLLTSTGGMIVSLVGLGTGLTVVGHHPDAKIPXRPVALCIASTLAYVAFFSIGLGPVTXVYNSEIFPLQVRALGFAVGVACNRXVTSAVISMTFLSLSKGITIGGSFFLYSGIAAVGWVFFFTCLPETRGRTLEEMGKLFGMPEPDTDMAEAYNAAAKEKAVEMPAVLGND

SEQ ID NO: 5608 - protein, 342 aa, Zea mays
MWFGGGPIDAAGALRGFVREAGGCAVVDGGLGTELEAHGADLHDALWSAKCLASAPHLIRKVHLDYLEAGADVIISASYQATIEGFQSRGFSRDESEELLRRSVHVAQEARRVFAAEGDRSSRRGRPPALVAASVGSYGAYRADGSEYSGDYGKSMTKEDLKNFHRRRLQVLAGAGPDLIAFETIPNKLEAQVYAELLEENGIRIPAWFSFTSKDGVNAASGDPINECAAVADSCPRVAAVGVNCTAPRFIHGLILSIKKVTSKPIVVYPNSGESYVAETNEWVDSDGATGTDDFVSRVGEWRRAGAALIGGCCRTSPATVRAIARAVREAEYDDIPAVAVL

SEQ ID NO: 5609 - protein, 323 aa, Zea mays
QRGHSTCPVTARPLRAEDLIPNHATRRMIQDWCVANRALGVERVPTPRVPLSAADAAELLAAVSAAARRGDAMVCRQLAAKARALGKESDRNRRCLAAGGAARALSSAFLRLVDQPASFGGALGEILATLVVFFPLDEECRSHIASPASLDAIVSILSHDGEATSKSSAAVVLREIASSSDSDPECLDALSETSGVHDALIKLLQKPVSAQATKAALVTAYYLVRGSDLAARRLVDLGMVELLVEMLVDADKGTTEKALAVLDSLLLTEEGRGKACAHALAVPVLVKKMQHVSEMATEFAVSALWRLCKSFSGEGPCKAEALQ

SEQ ID NO: 5610 - protein, 253 aa, Zea mays
MDVKCRRLEGKVAIVTASTMGIGLAIAERLGLEGAAVVISSRKQKNVNEAVEGLRAKGITAVGAVCHVSDAQQRKSLIETAVKNFGHIDILVSNAAANPSVDSILEMKESVLDKLWDINVKASILLIQDAAPHLRKGSSVIIISSIAGYNPEQGLTMYGVTKTALFGLTKALAGEMGPDTRVNCVAPGFVPTRFASFLTENETIRKELNERTKLKRLGTVEDMAAAAAFLASDDASYITAETIVVAGGVQSRL

SEQ ID NO: 5611 - protein, 253 aa, Zea mays
MDVKCRRLEGKVAIVTASTMGIGLAIAERLGLEGAAVVISSRKQKNVNEAVEGLRAKGITAVGAVCHVSDAQQRKSLIETAVKSFGHIDILVSNAAANPSVDSILEMKESVLDKLWDINVKASILLIQDAAPHLRKGSSVIIISSIAGYNPEQGLTMYGVTKTALFGLTKALAGEMGPDTRVNCIAPGFVPTRFASFLTENETIRKELNERTKLKRLGTVEDMAAAAAFLASDDASYITAETIVVAGGVQSRL

SEQ ID NO: 5612 - protein, 167 aa, Zea mays
ITQSSNERRDNSGSLHGLLLGKNILVVDDNKVNLRVAAGTLKKFGAKVECVESGKDALASLQVPHKFHLCLMDIQMPEMDGFEATKQIRAMEAKANEQAVACDDSETDGATRAARWHLPVLAMTADVIQATHEECTKYGMDGYVTKPFEEKQLFQALQKFLDPGMSS

SEQ ID NO: 5613 - protein, 195 aa, Zea mays
MASHQDKASYQAGETKARTEEKTGQAVGATKDTAQHAKDRAADAAGHAAGKGQDAKEATKQKASDTGGYLGKKTDEAKHKAGETTEATKQKASETTEATKQKAGETTEAARQKAADAMEAAKQKAAEAGQYAKDTAVSGKDKSSGVIQQATEQVKSAAAGAKDAVMSTLGMGGDDKQGDANTNTNKDSSTITRDH

SEQ ID NO: 5614 - protein, 221 aa, Zea mays
MASHQDKASYQAGETKARTEEKTGQAVGATKDTAQHAKDRAADAAGHAAGKGQDAKEATKQKASDTGSYLGKKTDEAKHKAGETTEATKHKAGETTEAAKQKAGETTEAAKQKAGETTETTKQKAGETTEAARQKAADAMEAAKQKAAEAGQYAKDTAVSGKDKSGGVIQQATEQVKSAAAGRKDAVMSTLGMGGDNKQGDANTNTNTNTTKDSSTITRDH

SEQ ID NO: 5615 - protein, 390 aa, Zea mays
MARIQPRTDQRPAVDVDHVGHGNFTGHLKSTLSSGDMDLPGGARAPKARKPYTISKQREKWTEDEHRLFLEALRQHGRAWRRIQEHVGSKTAVQIRSHAQKFFSKVIRESSGGDSNGNGNGVAAPPQIQIPPPRPKRRPTHPYPRKLGNSVGKDASAAIKQLRKPQLQAQSLSEQENCSPKSVLTTAQMCSEALPAEGSGSPASSVHMEDKCLTPNTSVGESSVQVALSTDSNDAACEIPEAEGPVLRLFGKRVVVSNLDQQPSSNTGSLQHAADMELDDASAETPTSGTGKLSSHAAEEAETWCPWLVALDAQTVTSNKQRSRPWTESIETSSSVPGTAQNSDPAESTKVNRGEDKVAVPVPGSRKCAGAIPACRRGFVPYKKCTARSK

SEQ ID NO: 5616 - protein, 610 aa, Zea mays
MQQRRKSVFASAPFAMKQAALGAGVAARKNGAPLSLAAVVFALFVFATFLYNEDIKSITDFQFSSGAIRAKSPDLHLLQEAEAAAHAAVNTLAKRGEEVIVRVLEVEAPPVVNASSVLAAAAKANAKAKANAVDVGQEKERDVTLPTVTGGRGGADEARRRADEEVAEKAASAKAAAATAALRGVVSVPQTCDLYRGSWVYDEVSAPVYKEGECEFLTEQVTCMRNGRRDDSYQKWRWQPAGCDLPRFDARLLLERLRNKRLMFVGDSLNRNQWESMVCLVQSVIPDRGQKTLTKFVNGGSSNVFYAHEYNATVEFYWAPFLVESNSDNPKVHSVPDRIIQWHAIAKHARNWIGVDYLVFNTYIWWLNTLDIKVLKQGSSFDDQGGSTEYVEVDRPVAYKEVLTTWAKWVDRNIDPNRTTVFFMGMSPNHITSMASAKKTAGRRGKKKKRVPEFRVPVSDPGFSGTDRVLVIPYPTRIRGSISGPEAWGNKGGIKCAMETLPIASNRSAALDVGTDWRLYAGAREVLPTLRRVPVHFVDITALSELRKDAHTSVHTLRQGKLLTPEQQADPKTYADCIHWCLPGLPDTWNQFLYARIASSPWPNDAQAQQ

SEQ ID NO: 5617 - protein, 369 aa, Zea mays
LQLHWEQLADDIESGSLTPRVADPSVRDAVARVLRGDPELARFVRAECSRGDWAGIVTRVWPNTRYLDVIVTGAMQQYIPTLEYYSGGLPMACTMYASSECYFGLNLRPMCRPSEVCYTIMPNMGYFEFLPVDEASGVAPGDAAQLVDLARVEAGREYELVITTYAGLYRYRVGDILRVAGFHNAAPQFRFVRRKNVLLSIESDKTDEAELQRAVDRASALLRARCGGGAAVVEYTSHACTRSIPGHYVIYWELLATTKASKQGAAQAVAGDVLERCCLEMEEALNSVYRQSRVADGSIGPLEIRVVRSGTFEELMDYAISRGASINQYKVPRCVSFPPIVELLDSRVVSRHFSPAPPHWAPAARPSSD

SEQ ID NO: 5618 - protein, 211 aa, Zea mays
MAADERDRERWILPGATALVTGGSKGIGHAIVEELAALGARVHTCSRNAAELEECRRRWAEKGGGRLLQQVTVSVCDVAVRADREALMATVRDVFGVKLDILVNNAAQVVFKPAVECTGEEYARIMATNLESCFHLSQLAHPLLRNASLAGGGSVVHISSTAGLLGFPGAVLYSTAKGISIDVHKTRGPLARGPGLSPVRIACRIRQTFEP

SEQ ID NO: 5619 - protein, 303 aa, Zea mays
  unsure (1)..(303): unsure at all Xaa locations
MAASVALSSGHRMPAVGLGVWRMEKADIRGLIHTALRVGYRHLDCAADYQNEAEVGDALAEAFQTGLVKREXNSDHGHVLEACKDSLKKLQLDYLDLYLIHFPVATRHTGVGTTSSALGDDGVLDIDTTISLETTWHAMEELVSXXLVRSIGISNYDIFLTRDCLAYAKIKPAVNQIEVHPYFQRDSLVKFSXKHGICVTAHTPLGGSTANTEWFGSVSCLDDPVIKSLAEKYGKTPAQLVLRWGLQRNTVVIPKTSKLERLQENFEVFDFDISGEDMEKMKAVDRKYRTNQPAKFWGIDLFA

SEQ ID NO: 5620 - protein, 198 aa, Zea mays
MAECKDDDSGRRSPSSSMDSSTHPPALSTASSGSRRPAERRDQLSADLQLGLSLSPASSALLVAETNNSIVPSTPRNQALPDWPPIKPFLRSALTASARRRRTLFVKVYMEGVPIGRKLDMLLLDGYSSLLAKLCHMFKASITYADAVEYHQRVPHEKAAHVLTYEDHDGDWMMVGDVPWELFLGSVKKLRIAKTDRC

SEQ ID NO: 5621 - protein, 335 aa, Zea mays
MAPGSKAERKAALDAGAWMFNVVTSVGIIMVNKALMATHGFSFATTLTGLHFAMTTLMTLVMKWLGYIQPSYLPLPELVKFAFFANLSIVGMNVSLMWNSVGFYQIAKLCIIPVLCILEIMFDKVRYSRDTKLSIVLVLVGVAVCTVTDVSVNSQGLLAAVIAVWSTALQQHYVHHLQWKYSLGSFNLLGHTAPAQAASLLVLGPFVDFWLTNKRVDAFNYTSIVTFFIVLSCIIAVGTNLSQFICIGRFTAVSFQVLGHMKTVLVLTLGFFFFGKEGLNFHVALGMFLAVIGMIWYGNASSKPGGKERQVYSTPSEKTQKHGVLSSQSELDQKV

SEQ ID NO: 5622 - protein, 126 aa, Zea mays
MEAEKKPPAVSDVGAWAMNVVSSVSLIMANKQLMSSSGYAFAFATTLTGFHFTVTALVGWISNATGYSVSKHVPLWELVWFSLVANTSITGMNLSLMLNSVGFYQVRRPFSAWVACVRAWLKLGTC

SEQ ID NO: 5623 - protein, 367 aa, Zea mays
GHIRSHRRGRRCRDLYCHGCRGHWEAVHLRLAVSDVGAWAMNVVSSVSLIMANKQLMSSSGYAFAFATTLTGFHFTVTALVGWISNATGYSVSKHVPLWELVWFSLVANTSITGMNLSLMLNSVGFYQISKLSMIPVVCLMEWVLNSKHYTTKVISAVVVVAAGVGICTVTDVEVNAKGFICACVAVFCTSLQQITIGSFQKKYNIGSFELLSKTAPIQAISLIILGPFVDYYLNGRSLLNYPFSGGATFFILLSCSLAVFCNMSQYLCIGRFSATSFQVLGHMKTVCVLILGWILFDSALTVKNILGMLLAVMGMVVYSWAMEAEKKAAAPVPRIKSEMLDGEDVPLKARVSGVPAVDLEDGEMKS

SEQ ID NO: 5624 - protein, 766 aa, Zea mays
  unsure (1)..(766): unsure at all Xaa locations
RQILTQSGVGDTTSRASKSEARKSYSQEQHNLKWKRSQEIKPVNLLPPLDTDVKKVADSPTKERISSWKPFPSPVTKVPKESTPTKLESPNKKTDAHSTVSSHVELSSPVESLPQQQLPVKHQHKTSWGHWSDQPNISEEGSIMCRICEEYVPTQYVEDHSRVCAIADRCDKKGVSVDERLIRVAEMLEKMVESYSPKDLPNAAVSPDVAKVSSSSINEESDGPSPKLSDWSRRGSADMLDYLQETDNTISLDDIKNLPSMTCKTRFGPKSDHGMATSSAGSMTPRSPLTPRSNHIDMLLAGKNAINESGDLPQIVELADIARCIANTPLDEESALSQMVTCIEDLQEIVNRRKHEALTVQTFGTRIEKLHREKYLQLCDSVDMDKVDSASTIMDEEDDVVRSLRASPVHPVKDRTSIDDFEIMKPISRGAFGRVFLAKKRTTGDLFATSRPAGKVLRKADMIRKNAVESILAERDILITVRNPFVVRFFYSFTSRENLYLVMEYLNGGDLYSLLRNLGCLDEDVARVYLAEVVLALEYLHSMHIVHRDLKPDNLLIAHDGHIKLTDFGLSKVGLINSTDLSGPAVSGASLYGDDEPQMNELEQMDHRARRQNRSAVGTPDYLAPEILLGTGHGCSADWWSVGVILFELIVGIPPFNAEHPEAIFENIMNRKIPWPHVPEEMSFDAQDLIDRLLTEDPHQRLGANGASEXDDMGEDSTGLNEFESSANVNYSFSNFSFKNLSQLASINYDLLTKGLKDDPPPRTEM

SEQ ID NO: 5625 - protein, 160 aa, Zea mays
MPPLPTGRVFQCKTCSRQFPTFQALGGHRASHKRPRVLQHQQQPVVADHAGLCLGRQQPPQPPPTPKPRVHACPVCGLEFAIGQALGGHMRRHRAEADADASSKLRPPLDKAACDVAGGICLDLNLTPLENCAKCRGVLVLGAAGQGGVHKTLAMLDCSL

SEQ ID NO: 5626 - protein, 302 aa, Zea mays
  unsure (1)..(302): unsure at all Xaa locations
MGGFVKTHKTNAYFKRFQVKFKRRRAGKTDYRARIRLINQDKNKYNTPKYRFVVRFTNKDITAQIISASIAGDMVLASAYSHELPRYGLEVGLTNYAAAYCTGLLLARRVLKIXGLDKEYEGNVEATGEDFSVEPADERRPFRALLDVGLIRTTTGNRVFGALKGALDGGLDIPHSEKRFAGFKKDDKQLDADTHRRYIYGGHVADYMKNLAEEEPEKYQSHFSAYIKKGVEAEEIEALYKKVHAAIRADPSVVKSTKQPPKEHKRYNPKKLTYEQRKASLIERLNQLNSSGGADDDDEDDE

SEQ ID NO: 5627 - protein, 62 aa, Zea mays
GYLLVANRDRWPGLIFIRLVIHVLLFSQDSSALAQLGWPDMRIPILYTLSWPDRIYRPSSIC

SEQ ID NO: 5628 - protein, 206 aa, Zea mays
TSGVAYGVRVTHAEREQFERQQGWSIKKMYSSKTKKQSQGPGNAEDAEVREPAEEYAPVIFAQDAYKHVISFDLLSGADDRDNVLRARESGKGVLTAPFKLLNNRLGVISTYAVYKYELPPNARPQERIQAAIGYLGGIFDIEALVDKLLHQLAGKQSIMVNVYDTTNDRRISMYGSNDTGSGMCQVSTLNFGDPSRKHEMHCRFI

SEQ ID NO: 5629 - protein, 112 aa, Zea mays
GEWSKDGGGGEPTKYRGVRRRPWGKYAAEIRDSSRHGVRIWLGTFDTAEEAARAYDRSAYSMRGANAVLNFPEDAPAYAAAASRGSAGGSSSRPAGSGRDVIEFEYLDDEVL

SEQ ID NO: 5630 - protein, 105 aa, Zea mays
TNAGLVGSDGPTNSGPFDITFMSCLPNMIVMSPSNEDELIDMVATAAMIEDRPICFRYPRGAIVGTSGSVTYGNPFEIGKGEILVEGKEIAFLGYGEVVQRCLIA

SEQ ID NO: 5631 - protein, 275 aa, Zea mays
MRKSRVNPSRQERSGGMATPRRLIRERAEAAVATLVAVRPHEIPPLMSAATTFFFILSAYFVVLPLRDEGAISMGLDTLPGLFAGSLLLTVVAAPIASLAFSLPSIPKSKALMMIHRFFSISLLAFFVLWYTSTPGQSGPTSQSSEGGSDKPAGWRNQSWFYIVVRISLFLWVALLNLITISSTWARVIDVMDSESGSRLFGFIGAGATLGQLFGSLFAASMAWLGPFLLLFSSLLMELAALSSKGICIDGNHASAELRQTGAGQAPNTWLMMKF

SEQ ID NO: 5632 - protein, 462 aa, Zea mays
  unsure (1)..(462): unsure at all Xaa locations
MNTVASLPLAPRLLIKPSLACFSRKDVARYGGIKVYAVLREDGAEFARNNNLGALFQVDDPGPRAPVKKFLDVNEALEVVRFDIQYCDWRARQDLLTIMLLHSKVVEVLNPLAREFKSIGTLRKELAELQQELEKAHNQVHLSEARVSSALDKLAHMETLVSASSTAEPPTSSSLAATATATATASSTARVRAKNKQPRRRLDVSGPVKPYNPSLKNFWYPVXPSLLPPSVFTVHAEIVMELPVEHGLLLDNLLDLAHAPFTHTSTFAKGWSVPRYVCIVCIPSIPLLQFVRKLSXLCSFSLVKFLTPASGLQGYWDPYPIDMEFRPPCMVLSTIGISKPGKLQGKSTRQCSTHLHQLHVCLPSSRNKTRLLYRMSLDFAPWLKHVPLMHLLWSHFAEKVLNEDLRLVLGQQEGMIDGANVWNWPXVSYDKLGIRYRLWRDAVERGADDRLPFSSTQAESLS

SEQ ID NO: 5633 - protein, 125 aa, Zea mays
MDRLDGSARLLLVSDLDQTMIDHDDRENLSLLRFEALWEAEFAQDSLLVFSTGRTPVSYKGLRRDKPLVTPDVTIMSVGTVIAYGEEMVRDVGWEERLDSDWDRAVVVEETARLPQLTRMQPERN

SEQ ID NO: 5634 - protein, 271 aa, Zea mays
MGRGKVQLKRIENKINRQVTFSKRRNGLLKKAHEISVLCDAEVAVIVFSPKGKLYEYASDSRMDKILERYERYSYAEKALISAESESEGNWCHEYRKLKAKIETIQRCHKHLMGEDLESLNPKELQQLEQQLESSLKHIRSRKSHLMAESISELQKKERSLQEENKALQKELSERQKAVASRQQQQQQVQWDQQTQVQVQTSSSSSSFMMRQDQQGLPPPQNICFPPLSIGERGEEVAAAAQQQLPPPPGQAQPQLRIAGLPPWMLSHLNA

SEQ ID NO: 5635 - protein, 187 aa, Zea mays
KVVPGGVGNYRAWVLALTYGYCYGVELIMENVAANFFRKRFHLPMEVAGAAAACFGAMNAVARPAGGLASDAVAILFGMRGRLWQQVPACHAPSSRHRRRVRTARDARSPNPAPTDTASILHIAETTVVSPLPRSRVTRALPSKIAAKVRPLPLIPSRSRPKCGVSGHSSYPVVALPLPLPALSVNW

SEQ ID NO: 5636 - protein, 418 aa, Zea mays
MMVSKEPAAAATSSGPWKIDFSGEKPPTPLLDTVNYPLHMKNLSILELEQLAAELRAEVVHTVSKTGGHLSSSLGVVELSVALHHVFDTPEDKIIWDVGHQAYPHKILTGRRSRMHTIRQTSGLAGFPKRDESAHDAFGVGHSSTSISAALGMAVARDLLGRKNHVISVIGDGAMTAGQAYEAMNNSGYLDANMIVVLNDNKQPVGALSRALTKLQSSTKFRRLREAAKSVTKQIGGPTHEVAAKVDEYARGMISASGSSLFEELGLYYIGPVDGHCVEDLVTIFEKVKSMPAPGPVLIHIVTEKGKGYPPAEAAADRMHGVVKFEPATGRQLKSKSPTLSYTQYFAESLIREAESDEKVVAIHAAMGGGTGLNYFQKRFPERCFDVGIAEQHAVTFAAGLAAEGLKPFCAIYSSFLQ

SEQ ID NO: 5637 - protein, 550 aa, Zea mays
  unsure (1)..(550): unsure at all Xaa locations
MSPIMALQASSSSPSAFRAVPATANASCRRQFQVRAQVAGGSSSSSIGADGGKMMVSKEPAAAATSSGPWKIDFSGEKPPTPLLDTVNYPLHMKNLSILELEQLAAELRAEVVHTVSKTGGHLSSSLGVVELSVALHHVFDTPEDKIIWDVGHQAYPHKILTGRRSRMHTIRQTSGLAGFPKRDESAHDAFGVGHSSTSISAALGMAVARDLLGRKNHVISVIGDGAMTAGQAYEAMNNSGYLDANMIVVLNDNKQVSLPTAXTLDGPSKPVGALSRALTKLQSSTKFRRLREAAKSVTKQIGGPTHEVAAKVDEYARGMISASGSSLFEELGLYYIGPVDGHCVEDLVTIFEKVKSMPAPGPVLIHIVTEKGKGYPPAEAAADRMHGVVKFEPATGRQLKSKSPTLSYTQYFAESLIREAESDEKVVAIHAAMGGGTGLNYFQKRFPERCFDVGIAEQHAVTFAAGLAAEGLKPFCAIYSSFLQRGYDQVVHDVDLQRLPVRFALYQSWLVGTDGPTHCGAFDVAYMACLPNMVVMAPADEAELMHMVA

SEQ ID NO: 5638 - protein, 248 aa, Zea mays
  unsure (1)..(248): unsure at all Xaa locations
MGQQEGHSNPHPDEAALPTTTAAPSPSPSSSRLYTAWLVASWYASNIGVLLLNKYLLSVYGFRFPLLLTACHMSACAVLSTLAQHASPRPRSSSSPRSHRQLARVALLGAVFCASVVAGNVSLRHLPVSFNQAVGATTPFFTALLAYAVAARREACRTYAALRPGGXRMDSMDLLRYMAPVAVLLLVPATLAMERDAFGVVAGLAREGPSFLXVLLWNCWLGYFGNLTNFLGTKDTSPLTLQVLGDAK

SEQ ID NO: 5639 - protein, 215 aa, Zea mays
MAAHQDSAASGSGPPRRPRVLLAASGSVAAIKFEVLCRSVAEWADVHAVATASALEFIDVASFPGGVPLYTDDQEWSSWKRVGDKVLHIELRRWADVLVIAPLSANTLAKVRRTHASWSSRSPSPVAADNSACCQVAGGLCDNLLTCVVRAWDYSKPVYVAPAMNTFMWGNPFTARHLAVLRDLGMSVVPPVNGAMAEPSEICKTLMLFFGPQHL

SEQ ID NO: 5640 - protein, 143 aa, Zea mays
MKRFAVQESEMARMLRQAPERVFVCKTCNRVFPSFQALGGHRASHKKPRLDGDGGGDPSLAKPKLHGCSVCGLEFAIGQALGGHMRRHRAMTGGAPVAVPPATTRIQPGGGLWLDLNYPPCDDGRDAVEAECGRNAAAATGIT

SEQ ID NO: 5641 - protein, 142 aa, Zea mays
MKRFAVQESEMARMLRQAPERVFVCKTCNRVFPSFQALGGHRASHKKPRLDGDGAGDPSLAKPKLHGCSVCGLEFAIGQALGGHMRRHRAMTGGRHHPPRPRRRQAARRRAVARPQLPAVRRRPRRGGGGVWPQCRRRHGDH

SEQ ID NO: 5642 - protein, 213 aa, Zea mays
MRSVLFFVCICFLFVSTARAEGPYQFFDWEITYGSISPIGSLQQGILINGQFPGPKIECQTNENLIINVRNKLPDPFLLSWNGLQQRKNSWQDGVSGTNCPIPPGHNFTYHMQAKDQIGSFFYFPSLALHKAAGGYGAIRIDSRPMVPVPFPPPAGEYAVLIGDWYTTNHKSLQRMLDSGKESPRPDGVLINGKGGADVVDFAVEQGKTYRLR

SEQ ID NO: 5643 - protein, 113 aa, Zea mays
MDDGGEPTKYRGVRRRPSGKFAAEIRDSSRQSVRMWLGTFDTAEEAARAYDRAAYAMRGQIAVLNFPAEARNYVRGGSSSSRQQQQGGGGGGGSGGGAGQQVIELECLDDQVL

SEQ ID NO: 5644 - protein, 117 aa, Zea mays
PRVRGRVGSAESTMVAYKAAQDIALAELAPTHPIRLGLALNFSVFYYEILNSPDKACNLAKQAFDEAISELDTLGEESYKDSTLIMQLLRDNLTLWTSDITEEGIEEGKEASKGDAE

SEQ ID NO: 5645 - protein, 333 aa, Zea mays
MEDAKMGNGATIRAVLAILQWWGFNVTVIIINKWIFQKLEFKFPLTVSCVHFICSSIGAYIAIKVLRTKPLIEVASEDRWRRIFPMSLVFCVNIVLGNVSLRYIPVSFMQTIKSFTPATTVVLQWLVWRKYFEWRIWASLVPIVGGILVTSVTELSFNTAGFCAALVGCLATSTKTILAESLLHGYKFDSINTVYYMAPLATLILSVPAVALEGGAVLGWLRTHESVGPALAVVVTSGVLAFCLNFSIFYVIHSTTAVTFNVAGNLKVAVAVLASWMVFRNPISAMNALGCGVTLVGCTFYGYVRHRLSQNQAPRARLEMLPLTAVDKQGDKI

SEQ ID NO: 5646 - protein, 155 aa, Zea mays
PASGNTLEDLANVVSNACIWLQDNNVPYNVLISDCGKRVFLFPQCYAEKQALGEVSQELLDTQVNPAVWEISGHIVLKRRSDYEEASETSAWKLLAEVSLSEERFEEVKAYIFSAAGLVLSDEEEEEASEGKGTTTFAPVPVSPMPVAEGCLVHQ

SEQ ID NO: 5647 - protein, 316 aa, Zea mays
MDYLPKKLNRRGVNVKIVYSRGNALHVLPRGAGKGQALVYLLKKLDSSGKPPKNTLVCGDSGNDAELFGVPSVHGVMVCNAQEELVQWYQENARDNPRIIQATERCAAGIMQAIGHLGLGPNVSARDLVGFPAYYPNNNKKGAAATAKPADVVVRFYVLYEKWRRGELPSSNSSSSSAMRYLKSITHPNGTIIHPCGSERSLHASIDALLSSCYGDKKNFRVWVDRLVTSPIGTSSWLARFDSWEMEGGVRYCCRTTILLNIKPESPEGLELTHIHKTWVQGHSAGPGTNVVAVDASAVEAEADPLPPMSLLRLAT

SEQ ID NO: 5648 - protein, 75 aa, Zea mays
MASAKRSREENVYMAKLAQQAERYKEMVEFMDKVAKTVDSDELTVEERSLLSVTYKNVIGARRASWRIISSIEQK

SEQ ID NO: 5649 - protein, 51 aa, Zea mays
  unsure (1)..(51): unsure at all Xaa locations
MASAELSRYVNVYLSXLAEQAERYDVMVDFMEMVAKTVDSEELTVEERYLL

SEQ ID NO: 5650 - protein, 293 aa, Zea mays
MVSYGGRIQPRPHDNQLAYVNGETKILSLERPVLFADFAARLTTLVGNARDVCVKYQLPGEDLDALISVTNDEDLEHLVVEYDRAHNNGPAAGSGSGRGGATPRLRVFLFPVQPPPPPPPAGLLEPKADQRLYIVEALNTVSLPSSKLDPPPVPSHQSSPPQQQKRESVFAQQSSSPPPPPPQAKHEAVFVQQAPPQPLTAFQMPPPPQPSHVVLTAAGPDYLFGLDNGFVPPPAVKVKDPAGDPPTVRENVPVEIPAKNDDRHPNPAGDHVAVSPVVSPAEYQRQIQELEKL

SEQ ID NO: 5651 - protein, 204 aa, Zea mays
  unsure (1)..(204): unsure at all Xaa locations
MSLSLERSSSVVRDVATPAPPATSGASAPYPRAGAGASLSLPGAAAAHGHSQYLPLNEDDSLXDMVLFDVLREASGPGSASAAAPDTYQPPSSLPTLKALASGAARRGSRTAYAPEAATAGRHYRGVRRXPWGKYAAEIRDPARHGARLWLGTFATAEEAAAAYDRAAVRMRGAKALLNFPPGVAGCGSAATATAKQAGLTEAK

SEQ ID NO: 5652 - protein, 217 aa, Zea mays
MKPFLLSSSLPAAAAHAVAVVVVSISIAVLSATSMLAVAAVEHTFVVSQVKMTRMCKQIPVTVVNGQLPGPTIEVTEGHSVTVHVVNMSPYNLTIHWHGVYQLLNCWNDGVPMVTQRPIPPNANFTYRFDVAGQEGTLWWHAHDAFLRATVYGALIIRPRNGAASYPFPKPHKEIPILIGEWWEKDLAAVDRNFTRGHYDEFSSGSTINGKLGDLFK

SEQ ID NO: 5653 - protein, 198 aa, Zea mays
MAECKDDDSGRRSPSSSMDSSTHPPALSTASSASRHPAERRDQLSADLQLGLSLSPASSALLVAETNNSIVPSTPRNQALPDWPPIKPFLRSALTASARRRRTLFVKVYMEGVPIGRKLDMLLLDGYSSLLAKLCHMFKASITYADAVEYHQRVPHEKAAHVLTYEDHDGDWMMVGDVPWELFLGSVKKLRIARTDRC

SEQ ID NO: 5654 - protein, 245 aa, Zea mays
GYMTQSLWGPSMSFSGGINVPVMQTPLCANAPAEKGGKNFMIDFMMGGVSAAVSKTAAAPIERVKLLIQNQDEMIKSGRLSEPYKGIVDCFKRTIKDEGFSSLWRGNTANVIRVYSLDYARTRLANDAKAAKGGGERQFNGLVDVYRKTLKSDGIAGLYRGFNISCVGIIVYRGLYFGLYDSIKPVVLTGNLQDNFFASFALGWLITNGAGLASYPIDTVRRRMMMTSGEAVKYKSSLDAFQQIL

SEQ ID NO: 5655 - protein, 217 aa, Zea mays
  unsure (1)..(217): unsure at all Xaa locations
MATPYRLPWRCYALVTALVLFFSVDATEGAIREYQFDVQMTNVTRLCSSKSIVTVNGQFPGPTVFAREGDFIVIRVVNHVPYNMSIHWHGIRQLRSGWADGPAYITQCPIQSGQSYVYKFTITGQRGTLWWHAHISWLRATVYGPIVILPKPGVPYPFPAPYDEVPVLFGEGXTADTEAVISQALQTGGGPNVSDAFTLHGLXGPLXNCSAKERSAE

SEQ ID NO: 5656 - protein, 478 aa, Zea mays
MAKPPPPTSTSDPALPTTATTTSSAPKSSSRPSPRPRGLLDPLAASARSLLASARRSPVTTLAAAFFLLALVMYGEDARTIAELSIDDYLYPDADLYNVSGLPPLALPPLTCDLSSGRWVFDNVSVPAYREKDCTFLTKQVSCLANGRPDDMWQYWRWQPNECSLPTFDARRFMEAMRGKRLMFVGDSLNRNQWESLVCLVQPILSKGRKKIVKRGSFNTFYAKEYRATLEFYWAPFLVESNSDNPNFHSIKERIISPERIEAHAKHWKDADYLIFNTYIWWMNNADIKVRRPNSRYWSDNDEVPRIEAYGRVFKTWSDWLNDNIDPARTSVFFMTISPPHLSPQNWGNPDGIKCVRETLPYQNYSQHLDLYHDMRLYDLVVNVASSMEKVPVTVINITRMSDYRKDAHTSLYTIRQGKLLTPKQKADPEKFADCIHWCLPGVPDVWNQILYTRILSKSSWHSNFSPPPSQSLPLPPQ

SEQ ID NO: 5657 - protein, 582 aa, Zea mays
  unsure (1)..(582): unsure at all Xaa locations
MGEVEDMYTQDGTVDMKGNPAVKKGTGNWRACPYILANECCERLAYYGMSTNLVNYMKTRLGQVNSVASNNVTNWQGTCYITPLIGAFFADAYMGRFWTIAIFMIIYIFGLALLTMASSVKGLVPTSCGDKDVCHPTDAQAAVVFVALYLIALGTGGIKPCVSSFGADQFDENDEREKKSKSSFFNWFYFSINIGALVASTVLVYVQTHVGWGWGFGIPAVVMAIAVGSFFVGTPLYRHQKPGGSPLTRIAQVLVACARKWNVAVPADKSRLHETVDGESGIEGSRKLEHSEQLACLDRAAVVTAEDGAEASPWRLCSVTQVEELKSVIRLLPIWASGIVFAAVYSQMSTMFVLQGNTLDQSMGPRFKIPSATLSMVDTISVIVWVPVYDRAIVPLVRSYTGRPRGFTQLQRMGIGLVVSIFSMVAAGVLDIVRLRAIARHGLYGEDDIVPISIFWQIPQYFIIGCAEVFTFVGQLEFFYDQAPDAMRSMCSALSLTTVALGNYLSTVLVTIVTHITTRHGRIGWIPENLNRGHLXDYFFXLLAVLSXLLNFLAYLVIASWYKYKKTADDYPGAKGEHGTEH

SEQ ID NO: 5658 - protein, 581 aa, Zea mays
  unsure (1)..(581): unsure at all Xaa locations
MGEVEDMYTQDGTVDMKGNPAVKKGTGNWRACPYILANECCERLAYYGMSTNLVNYMKTRLGQVNSVASNNVTNWQGTCYITPLIGAFFADAYMGRFWTIAIFMIIYIFGLALLTMASSVKGLVPTSCGDKDVCHPTDAQAAVVFVALYLIALGTGGIKPCVSSFGADQFDENDEREKKSKSSFFNWFYFSINIGALVASTVLVYVQTHVGWGWGFGIPAVVMAIAVGSFFVGTPLYRHQKPGGSPLTRIAQVLVACARKWNVAVPADKSRLHETVDGESGIEGSRKLEHSEQLACLDRAAVVTAEDGAEASPWRLCSVTQVEELKSVIRLLPIWASGIVFAAVYSQMSTMFVLQGNTLDQSMGPRFKIPSATLSMVDTISVIVWVPVYDRAIVPLVRSYTGRPRGFTQLQRMGIGLVVSIFSMVAAXGVLDIVRLRAIARHGLYGENDIVPISIFWQIPQYFIIGCAEVFTFVGQLEFFYDQAPDAMRSMCSALSLTTVALGNYLSTVLVTIVTHITTRHGRIGWIPENLNRGHLDYFFWLLAVLSLLNFLAYLVIASWYKYKKTADDYPGAKGEHGTEH

SEQ ID NO: 5659 - protein, 189 aa, Zea mays
PLLSGVAYAQRVVHADREGFERHQGWIIKTMKHEPSPAQDEYAPVVYSQETVSYIEGLDMMSGEEDRENILRSRASGKAVLTRPFRLMSNHLGVVLTFPVYHADLPSDAKEEDRVAATAGYLGGAFDVESLVENLLRQLAGNQELVVNVYDVTNISNPLVMYGSEVPLGNPSSSHICMLDFGDPFRKHH

SEQ ID NO: 5660 - protein, 180 aa, Zea mays
  unsure (1)..(180): unsure at all Xaa locations
LQLAVFVCDNVPKDVLGDPWRFRQILTNLVGNAVKFTERGHVFVRVCLADNSNMEAVDSTTNGAFNTLSGFEAADRRNSWQYFKMLLSDGTNSDQSDSDHVTLAISIEDTGVGIPIXAQDRVFTPFMQADSSTSRNYGGTGIGLSISXCLAELMGGQISFVSRPFVGSTFTFXTTLKRSY

SEQ ID NO: 5661 - protein, 164 aa, Zea mays
HACRYRQKLPMQWSAITNPLGTFVIWMLLGYSIAAAYSRYDKVTEDCRKMEELKTQAEAADVAKSQFLATVSHEIRTPMNGVLGMLDMLLGTDLTMTQKDYAQTAQMCGRALITLINDVLDRAKIEAGKLELEAVPFDLRSLMDDVISLFSSKSREKCIEVCYC

SEQ ID NO: 5662 - protein, 339 aa, Zea mays
  unsure (1)..(339): unsure at all Xaa locations
PTRPRTRGRDDSYQKWRWQPAGCDLPRFDARLLLERLRNKRLMFVGDSLNRNQWESMVCLVQSVIPDRGQKTLTKFVNGGSSNVFYAHEYNATVEFYWAPFLVESNSDNPKVHSVPDRVIQWHAIAKHARNWIGVDYLVFNTYIWWLNTLDMKVLKQGSSFDDQGGSTEYVEVDRPVAYKEVLTTWAKWVDRNIDPNRTTVFFMGMSPNHITPEAWGNKGGIKCAMETLPIASNRSAALDVGTDWRLYAGAREVLPTLRRVPVHFVDITALSELRKDAHTXSVHTLRQGKLLTPEQQADPKTYADCIHWCLPGLPDTWNQFLYARIASSPWPNDAQAQQ

SEQ ID NO: 5663 - protein, 160 aa, Zea mays
TLDIVAENPDKFRVVALSAGSNVTLLADQVKTFKPKLVAVRNETLVDELKEALADCEEKPEIIPGEQGVIEVARHPDAITVVTGIVGCAGLKPTVAAIEAGKDIALANKETLIAGGPFVLPLAHKHKVKILPADSEHSAIFQCIQGLSEGALRRIILTAS

SEQ ID NO: 5664 - protein, 166 aa, Zea mays
  unsure (1)..(166): unsure at all Xaa locations
MAAAVTAAVFVLFAAMSTTRAPAALVEQTFVVSQMSMTHLCRETMVTVVNGQLPGPVIEATEGDSVAVHVVNQSPHNLTIHWHGVKQQRNCWADGVPMVTQCPILPGHNFTYRFDVAGQEGTLWWHAHVFSLRGTVHGAFIXPPRRRADDDSYYPFPKPHAEVPIV

SEQ ID NO: 5665 - protein, 519 aa, Zea mays
  unsure (1)..(519): unsure at all Xaa locations
PLTMASDELAKAVEPRKKGNVKYASICAILASMASVILGYDIGVMSGAAMYIKKDLNITDVQLEILIGILSLYSLFGSFAGARTSDRIGRRLTVVFAAVIFFVGSLLMGFAVNYGMXLMAGRFVAGVGVGYGGMIAPVYTXAEISPAASRGFLTTFPXEVFINIGILLGYLSNFAFARLPSHLGWRVMLAIGAVPSGLLALLVFCMPESPRWLVLKGRLADARAVLEKTSATPEEAAERLADIKAAAGIPKGLDGDVVTVPNKEQGGGELQVWKQLILSPTPAVRRILLSAVGLHFFQQASGSDSVVQYSARLFKSAGITDDNKLLGVTCAVGVTKTFFILVATFLLDRAGRRPLLLISTGGMIVSLICLGSGLTVAGHHPDTKVAWAVALCIASTLSYIAFFSIGLGPITGVYTSEIFPLQVRALGFAVGVASNRVTSAVISMTFLSLSKAITIGGSFFLYSGIAAVAWVFFFTCLPETRGRTLEEMGKLFGMPDTGMAEEAEDAAAKEKVVELPSSK

SEQ ID NO: 5666 - protein, 269 aa, Zea mays
  unsure (1)..(269): unsure at all Xaa locations
LAEGDAYLQMLMSPGKAKKPLPPIWSEVLRFFVNPHKPMILALSRPDPKKNVTTLLKAYGESRHLRELANLTLILGNRHDIEEMSGGAATVLTAVLKLIDRYDLYGCVAYPKHHKQTDVPHIYRLAAKTKGVFINPALVEPFGLTLIEAAAYGLPVVATKNGGPVDIIKALHNGLLVDPHDEAAITEALLSLLADKARWAECRRNGXRNIHRFSWPHHCRLYLSHVAANCDHPAPHQLLRVPASPRAAPAEHGTDDSLSESLRGLSISI

SEQ ID NO: 5667 - protein, 427 aa, Zea mays
MDDAGRAPPPAPAAVTVSATAAPAPTPPSATVAADKSSLDPDALYEEGMWQQMAMNSGATMQPGSYPERPGEPDCTYYLRTGLCRFGMSCRFNHPPDRNLAIASARMKGEYPERVGQPECQYYLKTGTCKFGPTCKFHHPREKAGIAGRVQLNTLGYPLLPNEKECAYYLKTGQCKYANTCKFHHPELFNVVPSSRGSPIYTSVHSSASAGPQSYTGTMSSWTFPRASFIPSPRWQSPSNYAPMVVPHGLVQVPSWNSYPGQLQSPGAQQTYGSSQQGEASAGNQGMLSPYRSSSFPVPQYALQRDNVFPERPDEPECQYYMKTGDCKFGAVCKFHHPRVRSQPPPDCVLSPMGLPIRPGEELCKFYSRYGICKFGANCKFDHPTMAAPMGVYAYGFSGSASVAPASTNAPMTRHLLGSPSGSGYMS

SEQ ID NO: 5668 - protein, 112 aa, Zea mays
RSMPPIWAEVMRFLTNPHKPMILALSRPDPKKNITTLVKAFGECPPLRELANLTLIMGNRDDIDDMSAGNASVLTTVLKLIDKYDLYGSVAFPKHHNQADVPEIYRLAAKMK

SEQ ID NO: 5669 - protein, 429 aa, Zea mays
LGTSRPAAIQTAVLIETLTALGAEVRWCSCNIFSTQDHAAAAIARDSAAVFAWKGETLEEYWWCTERCLDWGEAGGPDLIVDDGGDATLLIHEGVKAEEDYEKTGKIPDPESTDNAEFKIVLTIIRDGLKADPKKYRKMKERLVGVSEETTTGVKRLYQMQETGALLFPAINVNDSVTKSKFDNLYGCRHSLPDGLMRATDVMIAGKVAVVCGYGDVGKGCAAALKQAGARVIVTEIDPICALQALMEGLQVLPLEDVVSEADIFVTTTGNKDIIMVDHMRKMKNNAIVCNIGHFDNEIDMLGLETYPGVKRITIKPQTDRWVFPETNTGIIVLAEGRLMNLGCATGHPSFVMSCSFTNQVIAQLELWKEKSSGKYEKKVYVLPKHLDEKVAALHLGKLGAKLTKLTKSQADYISVPIEGPYKPAHYRY

SEQ ID NO: 5670 - protein, 578 aa, Zea mays
  unsure (1)..(578): unsure at all Xaa locations
MGAAPPSSWLIAFILFFSTLVALPQSSHAGGTTRHYTFNVTMKKVTRLCTTRAIPTVNGQFPGPKIVTREGDRVVVKVLNNVKDNVTIHWHGVRQLRTGWSDXGPAYVXQCPIQTGQSFVYNFTITGQRGTLFWHAHVSWMRATLYGAIVILPKRGVPYPLPVKPYKDVPVIFGEWFNADPETIVAQALQTGAGPNVSDAFTINGLPGPLYNCSSKDTFKLKVLPGKWYLLRLINAALNDELFFSIANHTLTVVDVDAAYVKPFHTDIVLITPGQTTNVLLRAKPDAGCPAATHLMLARPYGTGQPGTFDNTTVAAVLEYAPPGHIRSLPLFRPSLPALNDTAFAANYSARLRSLATPDYPANVPRAVDRSFFFAVGLGTNPCPVNQTCQGPNGTMFTASMNNVSFNMPTTALLQAHYGSVAGVYTPDFPVAPLDPFNYTGTPPNNTNVSHGTKVVVLDYNTSVEVVLQATSILGAESHPLHLHGFDFFVVGQGFGNYDSSKDPPKFNLVDPVQRNTVGVPAGGWVAIRFFADNPGVWFMHCHLEVHTSWGLKMAWVVNDGPLPEQKLMPPPADLPKC

SEQ ID NO: 5671 - protein, 675 aa, Zea mays
  unsure (1)..(675): unsure at all Xaa locations
KIPVFTPVWIANRDYPFTDPNNKPLPKRTLQISRDGNLVVVQEDNNAPQRTETLVVWSTGIITNNASSKTTTSINTNTTNTVAELTHNGNLVVRDASATDASKVRWQSFDYPTDVYLPGSKLGRNKVTGLNRVFVSRKNRANPARGSYCVGVDARFSQGIILSQCSSSVVYWASGTFSLSDVDPSDSGFISYNQIDNAQEQYYIYTIPNDTLSVYTAVETSGQIKGRVWVESSHAWRDFYTQPMNPCSVHAACGPFTVCTGGDNANMSCDCMEGFSIRSPSEWDLDDRAGGCTRNNQLDCATDRFLPVPGVQLAYDPVPMKATDADGCGQACATDCSCTAYSYASTTGGGGGGCSIWRGELLNTATASTTGDTLYLRLSAKDLQTLRENQRSGRPSNKATVVTAASIAAGGFVIIALIVLLVCSWRRTSNTQDCDGTIIRSFTYSHLRHATRNFSDRLGGGGFGSVYKGXILGRDDDGSAVTTIAVKRLLDGARQGEKQFRAEVSSIGLIQHINLVKLVGFCCESDKRLLVYEHMVNGSLDVHLFNSNGGGGGGKDGVVVLDWSTRYQIAVGVARGLAYLHEGCRERIIHCDIKPENILLDASLVPKIADFGMAAIVPRDFSRVLTTFRGTIGYLAPEWIGGEAITEKVDAYSFGMVLLEIVSGRRNSPKVYTTN

SEQ ID NO: 5672 - protein, 280 aa, Zea mays
MEVNSSGEETVVKVRKPYTITKQRERWTEAEHKRFLEALKLYGRAWQRIEEHVGTKTAVQIRSHAQKFFTKLEKEAMNNGTSPGQAHDIDIPPPRPKRKPNSPYPRKSCLSSETQTKELPNDKSTKPNMPLSNGHVKMVGDASLQNFQRKELSEKGSRSEVLNLFRDAPSASFSSVNKSSSNHGAPRRTEASKTESRDMSIMENNSFNPNTQEDVKVISDQEMERLNGIQIRSKCEHSHEGYLDISTQQMKLMPKSVETTYVDEQTARASHTLAESNGDS

SEQ ID NO: 5673 - protein, 144 aa, Zea mays
  unsure (1)..(144): unsure at all Xaa locations
EGLKPFCAIFXSFLQRGYDQXVHDVYLQKLPVRFDMDRAGLVGADRPTHCGAFDVADMAXLTNMAVMAXGGRPIFFFMXATAAAIDERPTCLRYPRGNELGVPLTPNYKGTSLEDRKSRILLEGNRVGIILLAKATLRRIVDSQ

SEQ ID NO: 5674 - protein, 391 aa, Zea mays
MGKSCVPPVAMVLVQLGFAGMNVVSKLALDAGMSPYVLIAYRNLIAAAVISPVAYLLERRSGATITKKVLLQIFVSSIFGATLNQVLYFVGLKSTSPTVACALTNTLPALTFVMAAALKMESVRPGTPAGQAKLVGTAVCVGGSMVIPFYKGPVLGLWASPLHWRFVADHAPSPAAAAAHSGAAVLGDVLIIASCVAWAVWFILHTKMSEGFSAPYTSTAIMCLMAGVQCAGVSAAMDRSLDVWKLGCDIRLYSVLYIGIVGSGIGFTLMSWCIQVRGPLYVSMFSPLLLVVVAIIGWAILGEKIRVGTAVGSVLIVAGLYMVLWGKGREMDRPDLNNDDDIADEETAVGLVGFSGKGGGAVAIASSRVEAISLPVSFSTTSPKRLQHIHG

SEQ ID NO: 5675 - protein, 287 aa, Zea mays
LQWAGTASIDFSLAQLIQVIVLLSTGGNNGGGYLASKHVVFAFHAGILLSHAVINSLSITWLSLLGQFAALWSMLGVLVLMIAVPVVATERASAKYVFTHFNTDNSAGIHSNLYIFVLGLLMSQYTLSGYDASAHMTEETKNAGRNGPVGIITAIGVSLVVGWGYILGITFAVKDIPALLSTGNDAGGYAIAQVFYLAFKGRMTYAFSRDGAMPFSSVWHKVNEQEVPVNAVWLSAFVSLCMALPSLGSLVEYQAMASVATTGVYIAYALPILLRVTLAHGRFVFEP

SEQ ID NO: 5676 - protein, 371 aa, Zea mays
  unsure (1)..(371): unsure at all Xaa locations
AGTASIDFSLAQLIQVIVLLSTGGNNGGGYLASKHVVFAFHAGILLSHAAINSLSITWLSLLGQFAALWSMLGVLVLMIAVPVVATERASAKYVFTHFNTDNSAGIHSNLYIFVLGLLMSQYTLSGYDASAHMTEETKNAGRNGPVGIITAIGVSLVVGWGYILGITFAVKDIPALLSTGNDAGGYAIAQVFYLAFKGRYGNGAGGIVCLPVGXVAVAVYFCGMSSMTSNSRMTYAFSRDGAMPFSSVWHKVNEQEVPVNAVWLSAFVSLCMALPSLGSLVEYQAMASVATTGVYIAYALPILLRVTLAHGRFVFEPXSLGRYGVLVGWTDVLWVATITVLFSLPVSYPVTKDTINYTPGARDAGLFVLIL

SEQ ID NO: 5677 - protein, 381 aa, Zea mays
  unsure (1)..(381): unsure at all Xaa locations
MGAGDDDTKPAAMEVTSTSSPPSLPSPAAPPPSLLRSVLLSYAYVGIWMSLSFSVIVYNKYILDPKLYNWPFPISLTMIHMAFCALLATTLVRVLRVVDVPSSSAPHQQQQAMTPRLYASSVLPIGALYALSLWFSNSAYIYLSVSFIQMLKALMPVAVKLLXVALRTDAFRVLSMLNMLSISFGVAIAAYGEARFDVRGVALQLAAVAFEATRLVLIQILLTSKGISLNPITSLYYVAPCCFCFLLVPWAFVELPRLRAVGTFQPDFFVFGTNSLCAFALNLAVFLLVGKTSALTMNVAGVVKDWLLIAFSWSVIRDTVTPINLFGYGIAFLGVGYYNHVKLQALKAKEAQKKATQADEEAGSLLQERDGHSDRKSDNQA

SEQ ID NO: 5678 - protein, 178 aa, Zea mays
  unsure (1)..(178): unsure at all Xaa locations
IPGLDPRVRPCNGGINXPMMSSSPIFANAPAEKGGKNFMIDFLMGGVSAAVSKTAAAPIERVKLLIQNQDEMIKAGRLSEPYKGIGDCFGRTIKDEGFASLWRGNTANVIRYFPTQALNFAFKDYFKRLFNFKKDKDGYWKWFGGNLASGGAAXASSLFFXVYSLDYARTRLANDAKA

SEQ ID NO: 5679 - protein, 156 aa, Zea mays
EKAITEKLKTLGNSVSIFHLVDYPVNGFVFEGGASLEDLSDVVSKVCIFLQENNRSFNVLISESGKRIFLLPQCYAEKQLLGKASQEFLDMRINPAIWELSGHLVLKRRKDYEEASEANICRFLVEAALSETEFQELNRCVLDFLAFFLGDQYQRA

SEQ ID NO: 5680 - protein, 65 aa, Zea mays
EIVMGKNVHTSCFAVKEPDADDEDTGEREATMAIILALYRRSLVERTKHHLGGRCSPKVYCHAST

SEQ ID NO: 5681 - protein, 274 aa, Zea mays; identical to SEQ ID NO: 1176

SEQ ID NO: 5682 - protein, 260 aa, Zea mays
MSEGSEVKTGNFMLDFALGGVSAAVSKTAVAPIDRVKLLLQTQDANAKLTKKYTGIVDCLTRVPKEEGVSAFWRGNLANVIRYFPTQALNFAFKDTYKKIFCPYNPKTEFWKFFFGNLASGGAAGATSLMVVYPLDFARTRLAADVGKTGAERQFTGLVDCLTKVYKSDGYKGLYQGFGVSVLGIIAYRACYFGGYDTLKRVLFSEGKTSILFKFLVAQVVTAASGLVSYPLDTVRRRLMMQSGGKTGMYNGTLDCFAKI

SEQ ID NO: 5683 - protein, 302 aa, Zea mays
MMLLMDSGSRGDCSPVCLDLSVGLSPPSPGSGPETTADAERLDRPATGCWGPRTSSLADGQDEAKTLEARLTQVSEENRRLTEIIAYMYASQVAARRSPDGRKRSRDSLEPSNSGDANAAVESAALSDEGTCRRIKLTRVCTKIDPSDTTLTVKDGYQWRKYGQKVTRDNPSPRAYFRCAYAPSCPVKKKVQRSAEDSAMLVATYEGEHNHPSPTRAGELPSSTSINSSGPAITLDLTRNGAGAVRGLDAAAEVPGLKRLCQEIASPDFRTALVEQMARSLTKDPKFTDALAAAILQQLPEY

SEQ ID NO: 5684 - protein, 150 aa, Zea mays
MLMSPGKAKKPLPPIWSEVLRFFVNPHKPMILALSRPDPKKNVTTLLKAYGESRHLRELANLTLILGNRHDIEEMSGGAATVLTAVLKLIDRYDLYGCVAYPKHHKQTDVPHIYRLAAKTKEHLLQDKQKQLQQTATRTQISKLAKTQAQ

SEQ ID NO: 5685 - protein, 221 aa, Zea mays
HACRCSCSPGKAKKPLPPIWSEVLRFFVNPHKPMILALSRPDPKKNVTTLLKAYGESRHLRELANLTLILGNRHDIEEMSGGAATVLTAVLKLIDRYDLYGCVAYPKHHKQTDVPHIYRLAAKTKFTDSNSTAGTPAYSVRAKTTINLKLGEHSSIPPYTSTFAKKIEHLLTTSTFKTKKQLQQTTTRTQISKLAKTQAQDCERTTPQNQMTPISDADSCF

SEQ ID NO: 5686 - protein, 238 aa, Zea mays
  unsure (1)..(238): unsure at all Xaa locations
GKFGAEMKKNAQAVGVTAHYYEDETAPTGTCAVCVVGGERSLIANLSAANCYKSEHLKRPENWALVSPDSIQLVAEHAAANNKVFLMNLSAPFICEFFRDAQEKVLPYADYIFGNETEAKIFAKVRGWETENIEEIALKISQLPLASGKQKRIAVITQGADPVVVAEDGKVKTFPVILLPKEKLVDTNGAGDAFVGGFLSQLVLGKGMEDCVRAXGCYAANVIIQRPGCTYPEKPDFN

SEQ ID NO: 5687 - protein, 384 aa, Zea mays
  unsure (1)..(384): unsure at all Xaa locations
MGNPLLDXSAVVDDXFLTKYDIKLNNAILAEEKHLPMYDELASKSNVEYIAGGATQNSIRVAQWMLQTPGATXSYMGCIGKDKFGEEMKKNAQAAGVTAHYYEDETAPTGTCAVCVVGGERSLIANLSAANCYKSEHLKRPENWAXLVEKAKYIXLAGIFPLQCRLIAIQLVAEHAAANNKVFXMNLSAPFHLGVLSVMPQEERSLPYADYIFRQRNWRQRSLPKSEGWETEXLRQIAFEXILNFPLASGKQKRIAVITQGADPXVVVAEDGKVKTFPVILLPKXEKLVDTNGAGDAFVGXGFLSQLVLGKGIEDCVRAGCYAANVIIQAARGCTYPXEKPDFNLVQKLTHVMRGTVIGTLNLLTQWRGFGCLHHPCILPRLLF

SEQ ID NO: 5688 - protein, 152 aa, Zea mays
GRVGSAPFICEFFRDAQEKVLPYADYIFGNETEAKIFAKVRGWETENIEEIALKISQLPLASGKQKRIAVITQGADPVVVAEDGKVKTFPVILLPKEKLVDTNGAGDAFVGGFLSQLAQGKSIEDSVRAGCYAANVIIQRPGCTYPEKPDFN

SEQ ID NO: 5689 - protein, 342 aa, Zea mays
MAATEGVLLGMGNPLLDISAVVDDAFLTKYDIKLNNAILAEEKHLPMYDELASKSNVEYIAGGATQNSIRVAQWMLQTPGATSYMGCIGKDKFGEEMKKNAQAAGVTAHYYEDETAPTGTCAVCVVGGERSLIANLSAANCYKSEHLKRPENWALVEKAKYIYIAGFFLTVSPDSIQLVAEHAAANNKVFLMNLSAPFICEFFRDAQEKVLPYADYIFGNETEAKIFAKVRGWETENIEEIALKISQLPLASGKQKRIAVITQGADPVVVAEDGKVKTFPVILLPKEKLVDTNGAGDAFVGGFLSQLVLGKGIEDCVRAGCYAANVIIQRPGCTYPEKPDFN

SEQ ID NO: 5690 - protein, 342 aa, Zea mays; identical to SEQ ID NO: 665

SEQ ID NO: 5691 - protein, 482 aa, Zea mays
MATGGKSAAPQPPPAASSSSERALESVHFSSGNPRIEETRGVVVLHPDPPAAASWSHVPLGSKPRVCVLAVPNHMTYADFCRFCGAFVPHTLEMRIVRTDGAEDQYSVLINFDTQSSTDSFYKHFNGKQFSSLEGGVCHVRFVEEVHYTELIEHAHTSVTNLAEQPTCPVCLERLDQDPGGILTTICNHSFHCSCISKWTDSSCPVCRYCQQQPEKSMCSICGTSENLWICLICGHVGCGRYKGGHAIEHWKETQHCYSLELETQKVWDYAGDNYVHRLIQSKTDGKLVEYNFHGDHTAESTCSLCSGDAAMDEALLNSKFEAIVEEYNDLVTFQLEKQRNYYESLLLEVKEETEKEISAATEKAMSTKLQKLEVKFDKCMEEKKFLDEVNGNLVKNQEMWIETIRKAQAREQAALRLKDEKIEKLQEELRGLIAHFDCQSDTAQASNAISSDIPGGMILPVASESSSSGGVVGGTGNGEQN

SEQ ID NO: 5692 - protein, 71 aa, Zea mays
  unsure (1)..(71): unsure at all Xaa locations
RRPPLDPQFPAPERNPAPEKFVLYRYYRYGREENVYMXKLAEQAERYEEMVEYMEKVAKTVDVEELTGEER

SEQ ID NO: 5693 - protein, 245 aa, Zea mays; identical to SEQ ID NO: 1126

SEQ ID NO: 5694 - protein, 438 aa, Zea mays
MALSVEKTSSGREYKVKDLSQADFGRLEIELAEVEMPGLMACRAEFGPSKPFAGARISGSLHMTIQTAVLIETLTALGAEVRWCSCNIFSTQDHAAAAIARDSAAVFAWKGETLEEYWWCTERCLDWGEAGGPDLIVDDGGDATLLIHEGVKAEEEYEKTGKIPDPESTDNAEFKIVLTIIRDGLKADPKKYRKMKERLVGVSEETTTGVKRLYQMQETGALLFPAINVNDSVTKSKFDNLYGCRHSLPDGLMRATDVMIAGKVAVVCGYGDVGKGCAAALKQAGARVIVTEIDPICALQALMEGLQVLPLEDVVSEADIFVTTTGNKDIIMVDHMRKMKNNAIVCNIGHFDNEIDMLGLETYPGVKRITIKPQTDRWAVVCYEVRYTGLSVIFCMHMHYHIRSRVAGFLLLKNNGVVGWGEAMCVARYSFVLLTLLI

SEQ ID NO: 5695 - protein, 156 aa, Zea mays
AEALCCLAHALGEDFTIFIPSIRKILVKHHLRYRKWDEIENRLLRRELLITENLSVQKYTQCPPDVISDPLDDCDGTPSEIADETQRQARSHQVNDVRLRSAGEASQRSTREDWAEWMRHFSIALLKESPSPALRTCARLAQLQPSVGRELFAAGM

SEQ ID NO: 5696 - protein, 552 aa, Zea mays
MADGNAGGAARVLFSILGLALALPLPLLVAGDDPYRFFTWTVTYGDIYPLGVKQQGILINNQFPGPQIEAVTNDNLIINVFNKLNEPFLLSWSGLQQRRNSFEDGVAGTTCPIPPGSNFTYIMQAKDQIGTYYYFPSLAFHKAAGGFGGIRVLSRPQIPVPFPPPAADYTVLIGDWYKANHTDLRYVLDSGVALGFPDGLLINGRGLNGYTFNVQPGRTYRFRITNVGLATSLNIRFQGHTMKLVEVEGSHTMQTTYSSLDVHLGQSYSVLLTADQPGYDYAVVVSTRFTSRIISTTAVLRYANSAGRAPGPLPGGPTIQIDWSLNQARSVRWNLTASGPRPNPQGSYHYGLVPVTRTIRLANSAATIGGKRRYAVNGASYVGPDTPLKVADYYKIGGVFSVGTIADSPPAYGGAAYLRTSVMGASYRDYVEVVFENGEDEVQSWHIDGYAFWVVGMDGGKWSSASRQGYNLRDGVSRYTVQVYPRSWTAIYMPLDNVGMWNVRSENWARQYLGQQFYLRVWTPSTSLRDEYPIPKNALLCGRAAGRRTRPL

SEQ ID NO: 5697 - protein, 570 aa, Zea mays
  unsure (1)..(570): unsure at all Xaa locations
MASPSSSSWLLLLLSCLALALLAADAEVHHHEFVVQETPVKRLCKTHNVITVNGQYPGPTLEVREGDTLVINVVNRAQYNVTIHWHGIRQMRTGWADGPEFVTQCPIRPGGSYKYRFTIEGQEGTLWWHAHSSWLRATVYGALIIRPRENKTYPFAKPSREVPVILGEWWDANPIDVIREAQRTGGAPNVSDAFTINGQPGDLYKCSQKETTAIPVKPGETALLRFINAALNHELFVTIAQHRMTVVATDASYTKPFTTSVLMVAPGQTTDVLVTMDQAPARYYVAARAYVSGQNVAFDNTTTTAVLEYDCGCASDFGPKIQPAFPSLPAFNDTAAAAAFAAGIKSPGRVRVHESVDEHLFFTVGLGLFNCEPGQLCAGPNNSTRFTASMNNVSFVFPRTDSLLHAHYFKTPGVFTTDFPAHPPVQFDYTAQNVSQALWQPVPATKLYPLRFGSVVQLVLQDTSIVTPENHPXHIHGYDFFILAEGFGNFEPEKDVDKFNYVDPPQRNTVAVPVNGWAVIQFVADNPGVWLMHCHLDVHITWGLAMAFLVEDGYGELQSLEPPPVDLPMC

SEQ ID NO: 5698 - protein, 411 aa, Zea mays
MRLPRSDSFCLPRAFLPDLRLLPTRQSRSTASAPPHRSSARKRGARGQAMGKEGASGGGGGGDGGMSASVIRKVLVSYMYVAVWIFLSFSVIVYNKYILDPKMYNWPFPISLTMVHMAFCSSLAVALVRVLRVVDLPSSPAMTSQLYLSSVVPIGALYSLSLWFSNSAYIYLSVSFIQMLKALMPVAVYSIGVLFKKETFRSSAMLNMLSISFGVAIAAYGEARFDARGVALQLAAVAFEATRLVLIQILLTSKGISLNPITSLYYVAPCCLAFLVVPWVFVELPRLRAVAGGFQPDLFVFGTNSLCAFALNLAVFLLVGKTSALTMNVAGVVKDWLLIAFSWSVIRDTVTPVNLFGYGIAFLGVGYYNHVKLQALKAKEAQKKAAQADEEAGSLLQERDSHGDRKTDNQA

SEQ ID NO: 5699 - protein, 254 aa, Zea mays
  unsure (1)..(254): unsure at all Xaa locations
YACRFRSGIPGSTHASAGAEPAERGAGEGDGRREPAPFRAVRRDTMEPAVSLAVCALLFLLWVRVKGLEFVLIHQRWVFVCLFLLPLSLIFDIYYYVRAWVVFKLSSAPRLHEQRVRDIQKQVREWKEQGSKTFMCTGRPGWLTVSLRVGKYKKTHKNIMINLMDILEVDTKKQIVRVEPLVSMGQVTALLNSIGWTLPVLPELDDLTVGGXLIMGTGIESSSHKYGXLFQHICTAYELILADGSFVRCTPSET

SEQ ID NO: 5700 - protein, 374 aa, Zea mays
MLGAARRQLGSGPMLGQVLRRLRPAAAAEVARGYSAAAKEMTVRDALNSALDEEMSADPSVFLMGEEVGEYQGAYKISKGLLDKYGPDRVLDTPITEAGFTGIGVGAAYQGLRPVIEFMTFNFSMQAIDHIINSAAKSNYMSAGQISVPIVFRGPNGAAAGVGAQHSQCYAVWFAHVPGLKVLTPYSSEDARGLLKAAIRDPDPVIFLENELLYGESFPVSAEVLDSSFCLPIGKAKIERGGKDVTITAFSKMVGYALQAAEILSKEGISAEVINLRSIRPLDRAAINASVRKTNRLVTVEEGFPQHGIGAEICMSVVEESFEYLDAPVERIAGADVPMPYAANLERMAVPQVDDIVRAAKRACYRAVPMAAAA

SEQ ID NO: 5701 - protein, 457 aa, Zea mays
MDMNNGWLGFSLSPSAASRGGYGYGDGGGGASASACGDGEGSCPSPAAAASPLPLVAMPLDDSLHYSSAPDWRHGAAEAKGPKLEDFMSITCSNKSSGRSLYDSCGHHDDEQASKYHEVHGIHPLSCGSYYHGCISSGGGGGGGIGLGINMNAPPCTGGFPDHQHHQFVPSSHHGQYFLGAPAASAGPPAGAAMPMYNAGGGSVVGGSMSISGIKSWLREAMYVPPERPAAAALSLAVTDDVPPAEPPQLLPAPLPVHRKPAQTFGQRTSQFRGVTRHRWTGRYEAHLWDNTCRKEGQTRKGRQVYLGGYDREEKAARAYDLAALKYWGPSTHINFPLSHYEKELEEMKHMSRQEFIAHLRRNSSGFSRGASMYRGVTRHHQHGRWQARIGRVAGNKDLYLGTFSTQEEAAEAYDIAAIKFRGLNAVTNFDISKYDVKRICASTHLIGGGDACRRSP

SEQ ID NO: 5702 - protein, 149 aa, Zea mays
LTEDGKVISSGSNKTNATRNATRHAEMEAIDVLLREWQSMGLDQPQVAEKFAGCDLYVTCEPCIMCATALSIIGIREVYFGCANDKFGGCGSIMSLQNELSGSQASTPKGFKCTGGIMAEEAVALFRCFYEQGNPNAPRPHRPVRMPQQ

SEQ ID NO: 5703 - protein, 112 aa, Zea mays
MPSASLKDIVHTLLKGYQTETPILQKIIDVFLIYILITGIVQFIYVVLVGTFPFNSFLSGFISTVGCFVLTVSLRMQVDPKNEIKGVSVERAFADYVLCNLILFLVVLNFMG

SEQ ID NO: 5704 - protein, 240 aa, Zea mays
MGRGKIVIRRIDNSTSRQVTFSKRRNGIFKKAKELAILCDAEVGLVIFSSTGRLYEYSSTSMKSVIDRYGKAKEEQQVVANPNSELKFWQREAASLRQQLHNLQENYRQLTGDDLSGLNVKELQSLENQLETSLRGVRAKKDHLLIDEIHDLNRKASLFHQENTDLYNKINLIRQENDELHKKIYETEGPSGVNRESPTPFNFAVVETRDVPVQLELSTLPQQNNIEPSTAPKLGLQLIP

SEQ ID NO: 5705 - protein, 182 aa, Zea mays
VLSVSIVLIYTYIFFLQVTMATVTRLCVTKSVPTVNGRFPGPRLVVREGDRLVVQVHNNINSNVTFHWHGVRQLRSGWADGPSYITQCPIRPGQSYAYDFRIVGQRGTLWWHAHFSWLRATLYGPLVILPPRGVPYPFPKPHRQVTLMLGKPNDLQIKRRPASQLDRNSELISLNTYPLHLQ

SEQ ID NO: 5706 - protein, 370 aa, Zea mays; identical to SEQ ID NO: 717

SEQ ID NO: 5707 - protein, 297 aa, Zea mays
  unsure (1)..(297): unsure at all Xaa locations
RSPSPTGYHQHAPPPPLISSPRCFPARPRIGAAAPRSSPPKSTPPSSGSTQSRRGSTCCRHRLRAVVRIERHPPQAFRAGAVREVRRLRRGHKLGGVELRGERAGGGCLALVVWWEGEENLDSEKYEELIEFMEKVAKTVDSEEHYVLSIAYKIVXGTQCASWCIISSIEXGEEGRVNVDCVTLIEDYHNKIEVELSKICDGILKLLDSHRFXSLTAAESKVFYLKMKGDYYGYLAEFETGSRRKDAAXNTMVAHKPAQDIALEELAPTHPIRLWLVLNFSTRLTMRPCLQSRQIGP

SEQ ID NO: 5708 - protein, 509 aa, Zea mays
  unsure (1)..(509): unsure at all Xaa locations
MASDAAHGSSLDGVTPSSKFDLPVDSEHKAKTIRLLSFANPHMRTFHLSWMSFFTCVVSTFAAAPLIPIIRENLGLTKADIGNAGVASVSGAIFSRLAMGAVCDLLGPRYGCAFVVMLXAAPAVSCMAVIASAGXYVAWRFLIGFSLATFVSLQYWTSTMFNSKIIGTVNGLAAGWGNMGXRRHAAHXMPLVYDVIRKCGATPFTAWRLAYFVPGLMHVVMGVLVLTLGQDLPDGNLRSLQKKGNVNKDSFSKVMWYAVINYRTWIFVLLYGYCMGVELTTDNVIAEYMYDRFDLDLRVAGTIAACFGMANIVARPMGGIMSDMGARYWGMRARLWNIWILQTAGGAFCLWLGRASTLPVSVVAMVLFSFCAQAACGAIFGVIPFVSRRSLGIISGMTGAGGNFGAGLTQLLFFTSSTYSTGRGLEYMGIMIMACTLPVVFVHFPQWGSMFFPPSATADEEGYYASEWNDDEKSKGLHSASLKFAENSRSERGKRNVIQADAAATPEHV

SEQ ID NO: 5709 - protein, 335 aa, Zea mays
MAPGSKAERKAALDAGAWMFNVVTSVGIIMVNKALMATHGFSFATTLTGLHFAMTTLMTLVMKWLGYIQPSYLPLPELVKFAFFANLSIVGMNVSLMWNSVGFYQIAKLCIIPVLCILEIIFDKVRYSRDTKLSIVLVFIGVAVCTVTDVSVNSQGLLAAVIAVWSTALQQHYVHHLQWKYSLGSFNLLGHTAPAQAASLLIVGPFVDFWLTNKRVDAFNYTSIVTFFIVLSCIIAVGTNLSQFICIGRFTAVSFQVLGHMKTVLVLTLGFLFFGKEGLNFHVALGMLLAVIGMIWYGNASSKSGGKERQVYPTPSEKTQKHGALSSQSELDQKV

SEQ ID NO: 5710 - protein, 574 aa, Zea mays
  unsure (1)..(574): unsure at all Xaa locations
MALLPGAARRLLCSLFLCLWLSTLARAATRRYEWEVSYQFKSPDCVRKLSATINGQTPGPTIRATQGDTVEVKVRNSLLTENLAIHWHGIRQIGTPWADGTEGVTQCPILPGDTLTYAFVVDRPGTYMYHAHYGMQRSAGLYGVVVVVVAAAPGAKADDAEPFAYDDEHHVLLNDWWHNSTYEXAVGLASVPMVWVGEPHSLLINGRGRFNCSAAAVPGTCNATSPECDTPVFAVVPGQTYRFRIASVASLSALNFEIEGHEMTVVEADGHYVKPFVVKNINIYSGETYSVLIKADQDPNRNYWLASNVVSRQPATPTGTAILSYSGDRAPPSTTPPTGPAWNDTMYRFQQSVATVAHPAYVEPPPPRADRTILLLNTQNKIDAHTKWALNGVSFTLPHTPYLVAMKRGLLDTFDQRPPPETYAYQGYDVYAPPQNPNATTSDGLYRLRFGSVVDVVLQNANMLAPNKSETHPWHLHGHDFWVLGYGIGRFDPAVHPASYNLKDPVLKNTVAVHPYGWTALRFKADNPGVWAFHCHIEAHFFMGMGIVFEEGIQRVASLPPEIMGCGETNGGHR

SEQ ID NO: 5711 - protein, 237 aa, Zea mays
ACLQPQPRPPPQPSKVRLMVSYGGRIQPRPHDNQLAYVNGETKILSLERPVLFADFAARLTTLVGNARDVCVKYQLPGEDLDALISVTNDEDLEHLVVEYDRAHNNGPAAARLRVFLFPVQPPPPPPPAGLLEPKADQRLYIVEALNTVSLPSSKLDPPPVPSHQSSPPQQQKRESVFAQQSSSPPPPPPQAKHEAVFVQQAPPQPLTAFQMPPPPQPSHVVSPAEYQRQIQELEKL

SEQ ID NO: 5712 - protein, 129 aa, Zea mays
  unsure (1)..(129): unsure at all Xaa locations
GLMRAPDVMIAGKVAVVXGSGDVGKGCAAAXLKQAGARVIVTEIDPICALQALMKGLQVLPLEDVVSEADIFVTTTGNKDIIMVDHMRKMKNNAIVCNIGHFDNEIDMLGLETYPGVARYSFVLLTLLI

SEQ ID NO: 5713 - protein, 328 aa, Zea mays
MMVSKIPDPESTDNAEFKIVLTIIRDGLKADPKKYRKMKERLVGVSEETTTGVKRLYQMQETGALLFPAINVNDSVTKSKFDNLYGCRHSLPDGLMRATDVMIAGKVAVVCGYGDVGKGCAAALKQAGARVIVTEIDPICALQALMEGLQVLPLEDVVSEADIFVTTTGNKDIIMVDHMRKMKNNAIVCNIGHFDNEIDMLGLETYPGVKRITIKPQTDRWVFPETNTGIIVLAEGRLMNLGCATGHPSFVMSCSFTNQVIAQLELWKEKSSGKYEKKVYVLPKHLDEKVAALHLGKLGAKLTKLTKSQADYISVPIEGPYKPAHYRY

SEQ ID NO: 5714 - protein, 257 aa, Zea mays
  unsure (1)..(257): unsure at all Xaa locations
MDADGWAPRLESPPPVAGVAGASRGIGRAIAVALGGAGCKVVVNYAKSGXKAEEECREIEADGGTAVSFAADVSCEADVESMMRAAIDAWGTLDVLVNNAGITRDALLMRMKRTQWQEVVDVNLTGVYLCSQAAATLMMKRKKGRIINIASVSGIIGNVGQANYCAAKAGVIGLTKAMAREYGGRNINVNAVAPGWVASDMTAGLGDGVERKALETIPLGRFGRPEEVAGLVGFLAVHPAASYVTGQVLTIDGGLSI

SEQ ID NO: 5715 - protein, 397 aa, Zea mays
MDDAGRPPPHAPVAVTASASASATAAPAPPQPSATAAVDRSSPDPDALYEEGMWQQMAMDSGATMQPGSYPERPGEPDCTYYLRTGLCRFGMSCRFNHPPDRNLAIASARMKGEYPERAGQPECQYYLKTGTCKFGPTCKFHHPREKAGIAGRVQLNTSGYPLRPNEKECAYYLKTGHCKYANTCKFHHPELFNVVPSSRGSPIYTSVHSSASAGPQSYTGTMPSWAFPRASFIPSPRWQSPSNYAPMIVPQGLVQVPSWNSYPGQLQSPGAQQTYGSSQQGEASAGNQGMLSPYRSSSFPVPQYALQRENVFPERPDEPECQYYMKTGDCKFGAVCKFHHPRVRSLPPPDCVLSPMGLPLRPGEELCKFYSRYGICKFGANCKFDHPTVVAPMVYA

SEQ ID NO: 5716 - protein, 319 aa, Zea mays
MSCRFNHPPDRNLAIASARMKGEYPERAGQPECQYYLKTGTCKFGPTCKFHHPREKAGIAGRVQLNTSGYPLRPNEKECAYYLKTGHCKYANTCKFHHPELFNVVPSSRGSPIYTSVHSSASAGPQSYTGTMPSWAFPRASFIPSPRWQSPSNYAPMIVPQGLVQMQSWNSYTGQLQSPGAQQTYGSSQQGEASTGNQGMLSPYRPSSFPVPQYALQRENVFPERPDEPECQYYMKTGDCKFGAVCKFHHPRGEELCKFYSRYGICKFGANCKFDHPTVVAPMVYAYGFSASASPASASTNVPMARRLLGSPPGSGYTS

SEQ ID NO: 5717 - protein, 322 aa, Zea mays
RMKGEYPERVGQPECQYYLKTGTCKFGPTCKFHHPREKAGIAGRVQLNTLGYPLRPNEKECAYYLKTGHCKYANTCKFHHPELFNAVPSSRGSPIYTSVHSSASAGPQSYTGTMPSWTFPRASFIPSPRWQSPSNYAPMIVPQGLVQVPSWNSYPGQLQSPGAQQTYGSSQQGEASAGNQGMLSPYRSSSFPVPQYALQRDNVFPERPDEPECQYYMKTGDCKFGAVCKFHHPRVRSQPPPDCVLSPMGLPIRPGEELCKFYSRYGICKFGANCKFDHPTMAAPMGVYAYGFSGSASVAPASTNAPMTRRLLGSPSGSGYMS

SEQ ID NO: 5718 - protein, 382 aa, Zea mays
  unsure (1)..(382): unsure at all Xaa locations
TNKGSSRAQSRREVTGRRRGGDVGRRRASRTGVAGALGLSVTSSVAIVXICNKYLISTLGFFFATTLTSWHLMVTFFTLYVAQRLRFFEPKPIDARTVISFGLLNGISIGLLNLCLGFXNSVGFYQMTKLXAIIPFTIVLETLFLSKKFSQSIKASLMVLLLGVGIASVTDLQLNLLGSIIAVLTIAATXASGQILTNQIQRRLKVSSTQLLYQSSPYQSAVLLVTGPFVDKLLTKRDVFAFSYTTQVVVFILLSCSIAVCVNFSTFLVIGTTSPVTYQVLGHLKTCLVLSFGYIILKDPFSARNVVGILIAIFGMGLYSYYSVVESRKKTEDASSLPVAAQMSEKDSAPLLGAKSSPRTENKAEETFDYMPRTAKSAFTGR

SEQ ID NO: 5719 - protein, 195 aa, Zea mays
MASAELSREENVYMAKLAEQAERYEEMVEFMEKVAKTVDSEKLLESHLVPSSTAPESKVFYLKMKGDYYRYLAEFKTGAERKDAAENTMVAYKAAQDIALAELAPTHPIRLGLALNFSVFYYEILNSPDRACSLAKQAFDEAISELDTLSEESYKDSTLIMQLLRDNLTLWTSDISEDPAEEIREAPKHDSSEGQ

SEQ ID NO: 5720 - protein, 261 aa, Zea mays
  unsure (1)..(261): unsure at all Xaa locations
MKIQCDACEGAAATVVCCADEAALCARCDVEIHAANKLASKHQRLPLEALSAKLPRCDVCQEKAAFIFCVEDRALFCQDCDEPIHVPGTLSGNHQRYLATGIRVGLASASACSDACDAHDSDHHAPPKATIEPPHAAVSAAVQQVPSPPQFLPQGWAVDELLQFSDYESSDKARRXQAPPTLGFKELEWFADIDLFHEQAPKASRTLAEVPELFGYQAANDAAYYRPAKAAGGGGAGVRQSKKARIEVTDDEDYLIVPDLG

SEQ ID NO: 5721 - protein, 253 aa, Zea mays
SRFADKVVVITGAGSGIGAAAAQRFASEGAQVVLVGRTRDKLEQVLSTLSGENHLVAPCDVGDADQVKQLAEQVQRQYGRVDVLVNNAGSIVQGKIHEVSIADWKSLMSTDLDGVFYCTHFFMPALLNSKGNVVNTSSVSGLGGDWGMSVYNAAKGAVTNFTRALAMDYGTDGVRVNAVCPGFTFTDLTEEMKNDEALLARFYDRIPLGRAGEPENIGSAIAFIASDDARYITGVNLPVDGGLTASNGQPKQA

SEQ ID NO: 5722 - protein, 104 aa, Zea mays
MANVKEVQRIINGNNVVVFSKTWCPYCKAAKAALNESKANYEVVELDNRNDGDDLQDALLEISGQRSVPNIFFAQQHVGGNSDLQELVKNGTLKSRLEEAGAFA

SEQ ID NO: 5723 - protein, 245 aa, Zea mays
  unsure (1)..(245): unsure at all Xaa locations
MASAELSREENVYMAKLAEQAERYEEMVEFMEKVAKTVDSEELTVEERNLLSVAYKNVIGARRASWRIISSIEQKEXGRGNEDRVTLIKDYRGKIETELTKICDGILKLLETHLVPSSTAPESKVFYLKMKGDYYRYLAEFKTGAERKDAAENTMVGYKAAQDIALGELAPTHPIRXGLGLNFSVCYYEILNSPDRACGLAKQAFDEAISELGTLSEECYKDSTLIMRLLRDNLTLWASDICEDP

SEQ ID NO: 5724 - protein, 599 aa, Zea mays; identical to SEQ ID NO: 999

SEQ ID NO: 5725 - protein, 270 aa, Zea mays
AANTLVSLAQLGGTGFYACKVGKDEAGAFYLQDLNDCGLDTNPHHETAGEGITGKCLVFVTPDADRTMNAFLGISGSLSVTEMDWSALKQSQYLYLEGYLVTSPSAKAACIEAKAIAEQSGVKTCLSLSDPNMAKFFQDGLKEMLGSGVDLLFANEAEALEMAGTSDLNQAIAYCKSIAKNFALTRGGAGSLIFDGENLLTIGTPKVQPIDTVGAGDMYAGGFLYGLTHGMDYEKAGQLASETAAKVVTCYGPRLDTEILQEILQSVQAV

SEQ ID NO: 5726 - protein, 88 aa, Zea mays
  unsure (1)..(88): unsure at all Xaa locations
MANSRQAQRTRKGRVMEKVAKTGDSDELTGEERNLLTVVFKNXIGARHASWRIIYSIEHKEEGRGNDDRDTLIKDYRGKIETEHTKDC

SEQ ID NO: 5727 - protein, 107 aa, Zea mays
  unsure (1)..(107): unsure at all Xaa locations
MAPRSKAERKAVLGAGAWMFNVVTSVGIIMVNKALMATHGFSFATTLTVLHFCNXTLMTLVMETCHMMNVLSPLLYKKKKMSGVCQANSLLGKIPKTKGDSRKEKRE

SEQ ID NO: 5728 - protein, 791 aa, Zea mays
MESPGLFAVVALFVVVVAAAAADDAQLLEQFKEAVPSQAADLRGWSASDGACRFPGAGCRGGRLTSLSLAAVPLNADFRAVAATLLQLSSLETLSLRGANVSGTLAAVPRCGAKLQSLDLSANAGLRGSVSDVEALVAACAGLSALNLSGGSIGGPRSAGVVASGFARLDALDLSGNKISGDGDLRWMVGAGVGAVRQLDLSGNKISSLPEFTNCSGLEYLDLSGNLIAGEVAGRTLADCRGLRTLNLSGNHLVGPFPPDVAALTSLAGLNLSNNNFSSDLPADAFTELQQLKVVALSFNHFNGSIPDSLAALPELDVLDLSSNTFSGTIPSSICQGPNSSLRMLYLQNNYLSGAIPESISNCTRLESLDLSLNNINGTLPASLGKLGELRDLILWQNFLEGEIPASLENLDKLEHLILDYNGLTGSIPPELSKCKELNWISLASNQLSGPIPAWLGQLSNLAILKLSNNSFSGPIPAELGNCQSLVWLDLNSNQLNGSIPAELAKQSGKMNIGLVIGRPYVYLRNDELSSECHGKGSLLEFTSIRPEELSRMPSKELCNFTRVYMGSTEYTFNKNGSMIFLDLSFNQLDSEIPKELGNMYYLMILNLGHNLLSGVIPPELAGAKKLAVLDLSHNQLEGPIPNSFSTLSLSEINLSNNQLNGSIPELGSLFTFPKISYENNSGLCGFPLLPCGHNAGSSSSDGHRSHRNQASLAGSVAMGLLFSLFCIVGIVIIVVECKKRKQINEEASTSRDIYIDSRSHSGTMNSNWRLSGTNALSVNLAAFEKRLQAC

SEQ ID NO: 5729 - protein, 672 aa, Zea mays
KPLSGPIPAWLGQLSNLAILKLSNNSFSGPIPAELGNCQSLVWLDLNSNQLKGSIPAELAKQSGKMNVGLVLGRPYVYLRNDELSSECHGKGSLLEFTSIRPEELSRMPSKKLCNFTRVYMGSTEYTFNKNGSMIFLDLSFNQLDSEIPKELGNMYYLMIMNLGHNLLSGVIPPELAGAKKLAVLDLSHNQLQGPIPNSFSTLSLSEINLSNNQLNGSIPELGSLFTFPRISYENNSGLCGFPLLPCGHNAGSSSSGDHRSHRTQASLAGSVAMGLLFSLFCIVGIVIIAIECKKRKQINEEASTSRDIYIDSRSHSGTMNSNWRLSGTNALSVNLAAFEKRLQKLTFNDLIVATNGFHNDSQIGSGGFGDVYKAQLKDGKVVAIKKLIHVSGQGDREFTAEMETIGRIKHRNLVPLLGYCKCGEERLLVYDYMRFGSLEDVLHDRKKIGIKLNWAARKKIAIGAARGLAYLHHNCIPHIIHRDMKSSNVLIDEQLEARVSDFGMARMMSVVDTHLSVSTLAGTPGYVPPEYYQSFRCTTKGDVYSYGVVLLELLTGKPPTDSTDFGEDNNLVGWVKQHSKSKLADLFDPVLLVEDPALELELLEHLKIACACLDDRPSKRPTMLKVMAMFKEMQASSAVDSKTSACTVAVDDACFGDVEMTTLKEDKEEKD

SEQ ID NO: 5730 - protein, 242 aa, Zea mays
  unsure (1)..(242): unsure at all Xaa locations
MDHAAEAQRTDLMTITRHVLNEQSRHPESRGDFTILLSHIVLGCKFVAAAVNKAGLAKLIGLAGETNVQGEEQKKLDVLSNEVFVKALVSSGRTCVLVSEENEAAIFVDAPLRGKYCVCFDPLDGSSNIDCGVSIGTIFGIYMIKDKDNATLEDVLQPGTHMIAAGYCMYGSSCTLVLSTGNGVNGFTLDPSLGEFILTHPNIKIXNKGKIYSVNERNARNWDAPTAKYVERCKFPQDGSSP

SEQ ID NO: 5731 - protein, 614 aa, Zea mays
MAVMAEVVSTTGAALRSPATQQPAAAGAAKGTDAEKLQFIEDMTSNVDAVQERVLGEILARNADTEYLSSRCGLAGATDRATFRAKVPMATYEDLQPYIRRIADGDRSPILSGHPVSEFLTSSGTSGGERKLMPTIEDELNRRQLLYSLQMPVMNLYVPGMDKGKALHFLFVKSETKTPGGLAARPVLTSYYKSNHFRNRPFDAYNNYTSPTAAILCADAFQSMYAQMVCGLCQRQDVLRVGAVFASGLLRAIRFLQLNWEQLAEDIEAGSLTPRVTDPSVREAVAGILRPDPAVAELVRSECSGGDWAGIVTRIWPNTKYLDVIVTGAMAQYIPTLKHYSGGLPMACTMYASSECYFGLNLRPMCDPSEVSYTLMPNMCYFEFLPMGGAVDASQLVDLGRVERGREYELVITTYAGLNRYRVGDVLQVTGFHNSAPQFRFVRRKNVLLSIESDKTDEAELQRAVERASALLRPHGAAVVEYTSQAYTKSIPGHYVVYWELLQAKGGAAVDGETLEGCCLEMEEALNAVYRQSRVADGSIGPLEIRVVRPGTFEELMDYAISRGASINQYKVPRCVTFPPIIELLDSRVVSSHLSPALPHWTAGQRSGSGSGSD

SEQ ID NO: 5732 - protein, 477 aa, Zea mays
  unsure (1)..(477): unsure at all Xaa locations
MATTRPRGGGGAASGALVMAIVVLLLLPPYGAGAEECEDGGISSRARAGDRVEALPGQPAVAFAQYSGYVAVDRDRGRALFYWLTEAVGDDAAAKPLVLWLNGGXSDPSTCSQSLAPFFSCNNQQSRSSSVVNDDAMCALFFLPLLWGVWSISIFFIKKETKTDERTAQDALQFLVSWMSRFPQYRHRDFYIAGESYAGHYVPQLARKIVEYNEASPHPFINLKGILVGNAVTDNYYDNIGTVTYWWTHAMISDRTYKAILRWCNFSSSSISRPCNRAMSYAMNHEFGDIDQYSIYTPSCAAAAARANATVLRFKNTLVRRRRSSGYDPCTETYAERYYNRMDVQRAMHANTTGIPYRWTACSDVLIKTWQDSEFSMLPTYKKLMKAGLRIWVFSGDTDSVVPVTATRFAISHLGLKIKTRWYPWYSAGQVGGWSEVYEGLTFASVRGAGHEVPLFQPRRAFRMFRSFLAGEPLPKS

SEQ ID NO: 5733 - protein, 388 aa, Zea mays
MYSSDGLALAGPGCSSVAYGASEEIGPFRIKPNGTGLFLNKYSWNREANLLFLESPAGVGFSYANTTSDLKTSGDERTAQDALQFLVSWMSRFPQYRHRDFYIAGESYAGHYVPQLARKIVEYNEASPHPFINLKGILVGNAVTDNYYDNIGTVTYWWTHAMISDRTYKAILRWCNFSSSSISRPCNRAMSYAMNHEFGDIDQYSIYTPSCAAAAARANATVLRFKNTLVRRRRSSGYDPCTETYAERYYNRMDVQRAMHANTTGIPYRWTACSDVLIKTWQDSEFSMLPTYKKLMKAGLRIWVFSGDTDSVVPVTATRFAISHLGLKIKTRWYPWYSAGQVGGWSEVYEGLTFASVRGAGHEVPLFQPRRAFRMFRSFLAGEPLPKS

SEQ ID NO: 5734 - protein, 243 aa, Zea mays
  unsure (1)..(243): unsure at all Xaa locations
NSARGQTPVFPRILGHEAGGIVESVGEGVTECKECAHCKSEESNMCDLLRINVDRGVMIGDGKSRFTISGQPIFHFVGTSTFSEYTVIHVGCLAKINPEAPLDKVCILSCGISTGLGATLNVAKPAKGSTVAIFGLGAVGLAAMEGARLAGASRIIGVDINPAKYEQAKKFGCTEFVNPKDHDKPVQEVLIELTNGGVDRSVECTGNINAMISAFECVHDGWXCXACWLGVPHRDDQFKTHPM

SEQ ID NO: 5735 - protein, 141 aa, Zea mays
  unsure (1)..(141): unsure at all Xaa locations
MFVAVDCSYKWGFAVRPLSGGAPFFILLSCSLAVFCNMSQYLCIGRFSATSFQVLGHMKPVCVLILGWILFDSALTXKNILGMLLAVMGMVVYSWAVEAEKKAAAPVPRIKSEMLDGEDVPLKARVSGVPAVDLEDGEMKS

SEQ ID NO: 5736 - protein, 356 aa, Zea mays
MAPSSYEVAASILLCAEDSSSILDLEAEAEEEALLARSGEPGGGAEFPVPSEECVAGFLESEAAHMPREDYAERLRSGGMDLRVRTDAIDWIWKVHTCYGFGPLTACLAVNYLDRFLSLYQLPEGKAWMTQLLSVACLSLAAKMEETYVPSSLDLQQAGDARYVFEAKTIQRMELLVLSTLKWRMQAVTPLSYVDYFLHRLRGGAAPSRRAVLRSAELILCIARGTHCLDFRPSEIALAVAATVAGEERAVDIDRAFTHRVHKERVSRCLEAIQQATATMALPQPLKSEGPSSSGRRASSSSATVPRSPTGVLDAGCLSYRRAAAAAASHASSSWRDEDDDDCPPAVCSKRRKISR

SEQ ID NO: 5737 - protein, 298 aa, Zea mays
  unsure (1)..(298): unsure at all Xaa locations
MAAAATTSSSSHLLLLSRQQAASLRCRLSFLGQPRRPGRVTAQAPAAKDVRCMAAVDTAASAAAAETSPKSSSSYEIVTLTTWLLQQERTGAIDNEMTIVLASISTACKQIAALVQRAPISNLTGVQGAVNVQGEDQKKLDVVSNEVFSNCLKSSGRTGVIASEEEDVPVAVEQSYSGNYIVVFDPLDGSSNIDAAVSTGSIFGIYNPNDECLADVDDNDTLDSVEQRCIVNVCQPGSNLLAAGYCMYSSSVIFVLTVGTXVYVFTLDPMYGEFVLTQEKVQIPKAGKIYAFHEGNYA

SEQ ID NO: 5738 - protein, 175 aa, Zea mays
MNLAVAAALPSVTPRTGVVLPRSSRRHCPRGVVPLAASSSVSSFTSPSAAAAPIYAPTPQDRSLRTPHSGYHFDGTVRPFFEGWYFKVSIPECRQSFCFMYSFENPLFRDGMSDLDKLLYGPRFTGVGAQILGADDKYICQFSEKSNNFWGSQTTCQMSKQLAGSTALVQFMGGV

SEQ ID NO: 5739 - protein, 209 aa, Zea mays
MMGSDVENEEQKGGTKSKYEAEVLPPVPKIEIQLEPHHQTLPVGTISAIMGERVIVEGSVQHNPLNEGSILWITESRMPLGIVDELFGPVKNPYYLVRYNSEEEVPAGISAGTDVCFVAEFADHILNMKELYAKGYDESDSVDKDAEDLPDFSDDEKEAEYKRSLRQAKRQTDRQHEPMKTSCYMKGSQAISSGIRKPMPPRNLDTSTR

SEQ ID NO: 5740 - protein, 581 aa, Zea mays
LANNSLGGVIPKELGKCSSLMWLDLNSNRLTGEIPRRLGRQLGSTPLSGILSGNTLAFVRNVGNSCKSVGGLLEFAGIRPERLLQVPTLKSCDFTRLYSGAAVSGWTRYQTLEYLDLSYNALSGGIPEEFGDMVVLQVLDLARNNLTGEIPASLGRLHNLGVFDVSHNALSGGIPDSFSNLSFLVQIDVSDNNLSGEIPQRGQLSTLPASQYTGNPGLCGMPLLPCGPTPRATASVLAPPDGSRFDRRSLWVVILAVLVTGVVACGMAVACFVVARARRKEAREARMLSSLQDGTRTATTWKLGKAEKEALSINVATFQRQLRRLTFTQLIEATNGFSAGSLVGSGGFGEVFKATLKDGSCVAIKKLIHLSYQGDREFTAEMETLGKIKHRNLVPLLGYCKIGEERLLVYEYMSNGSLEDGLHGRALRLPWERRKRVARGAARGLCFLHHNCIPHIIHRDMKSSNVLLDGDMEARVADFGMARLISALDTHLSVSTLAGTPGYVPPEYYQSFRCTAKGDVYSLGVVFLELLTGRRPTDKEDFGDTNLVGWVKMKVREGTGKEVVDPELVIAAVDGEEKEMA

SEQ ID NO: 5741 - protein, 134 aa, Zea mays
MRGKKSDELEPVDAGDEDDDGGDDGDEDGDFGEEGEEDVSEGEGYDNPKGNETKKQRGDPEENGEEDEEEPEDQEGGGDDDDDDDDDDENGDDEDDDNGDDDEEGVDEEDDDQDEDEEDDDDEDSLQPPKKRKK

SEQ ID NO: 5742 - protein, 98 aa, Zea mays
  unsure (1)..(98): unsure at all Xaa locations
SIWTSTMFNIKIIGTVKRAGVGXGSNMDGGTKQLIRPLVNEAILRCGATPFTAWRIAYFVPGIMHISVGIPEPTAGQGLPEKKIRSLRKQQQHQQQGG

SEQ ID NO: 5743 - protein, 104 aa, Zea mays
  unsure (1)..(104): unsure at all Xaa locations
MSDKLPYKVADIGLAAWGRKALDIAENEMPGLMRMREMYSASKPLKGARIAGCLHMTVETAVLIETLVALGAEVRWSSCXXFSTQDRXAAGXAXAGLALFAWAG

SEQ ID NO: 5744 - protein, 611 aa, Zea mays
  unsure (1)..(611): unsure at all Xaa locations
MDEHKLGYKGSDVLQELEILTINAKTAQEVILSKILEKNRATEYLNKFMNGSIDISAFKCQVPVVTYDVVQPYIARIAAGERSSILCGEQIVELLRSSGTSRGEPRLMPSISEDIYRRTYLYSLIMPIMSKYIRGLGEGKAMYLLFVKAETLTNAGIPVRSVLTSYYKSPQFLQRKHDLYNSYTSPDEVILCPDSQHSMYCQLLCGLVERENDVRLGAVFASAFLRYIITTTNTAQTLTLIFRDLVENTHAALLLPPTDRGDGVIPPRCGQVAVSMNGVAQPSGRAVPAGVRERVECLASNGVLGRLSTNDRYLXSFLTGPVQQYVPMLEFYSDGRIPLVCTMYASSESYFGVNLRPLCSPKDVSYTILPNMAYFEFVPLDDGLSLAEDGEAVEKQKLVGLADVKLGCYYELVVTTFAGLYRYRVGDVLQVTGFYNRAPQFKFICRRNVILSVDADKTNEEDLHGSVSRAKKILEDRGHILLEYTSFTDTSTVPGHYVLFWEVKATPTSGSGGARLDAQVLESCCVAVEESLDCVYRRCRAHDRSVGPLEIRLVEAGAFDALMDLLVSQGGSINQYKTPRCIEPGGAALELLDSKATASFFSPRDPEATGV

SEQ ID NO: 5745 - protein, 556 aa, Zea mays
MDSVRSWFQKFQPRDKSKRPVVAARHGKDPGKPPMDDAPSSATKQRVAAAKQYIENHYKTQMKSLQDRKERRWMLERKLQDAEVPVEEQNNILKHLEKKETEYMRLQRHKMGVEDFELLTIIGRGAFGEVRLCREKASKNVYAMKKLKKSEMLRRGQVEHVKAERNLLAEVDSAYIVKLYYSFQDEEFLYLIMEYLPGGDMMTLLMRKDILTEDEARFYIAETVLAIESIHKHNYVHRDIKPDNLLLDHSGHLKLSDFGLCKPLDSSNFPNLNEPDYMSGKVTTPLPDTTRLSNPSAPRRTQQEQLSHWQKNRRMLAYSTVGTPDYIAPEVLLKKGYGTECDWWSLGAIMYEMLVGYPPFYSEDPMSTCRKIVNWRSHLKFPEEAKLPPEAKALISKLLCNVEHRLGTKGAHEIKAHPWFGGVQWEKLYQMKAAFIPEVNGELDTQNFEKFEETGTQIQSSSKSGPWRKMLPSKDANFVGYTYKNFEIVNDDEVAGIAELKKKSSKSKRPTIKTLFESMDEEEPVQGSFLGMLPPKEGQPSSHSSVPQERHQPRRK

SEQ ID NO: 5746 - protein, 193 aa, Zea mays
FGSSLKLCSNWLHTCTNLKNPNCLAFNLSAPFIMEFFSTQLEEVYPYVDIVFCNDSEARMYAMMKEWSMDLTVEQIAGRLANNDRRNLDRPRIVIVTQDLNPVLMTRSKTPELKGPENWSSIEFPVQKLEKEEIVDTNGAGDSFAGGFLAQLALNEFNLDLDSLRRCCAAGNYCAREIIKQNGCTIPDKKANY

SEQ ID NO: 5747 - protein, 105 aa, Zea mays
  unsure (1)..(105): unsure at all Xaa locations
NVYTIIIATQVGTFKNMVNLLVRISRTVDWGELTTEELNLLTVQYQIVTADHLTSRSMFYSVQHQGEGSGIEVRDTMTLVFRDKTDTELTIMCPXVNKLIESYVV

SEQ ID NO: 5748 - protein, 138 aa, Zea mays
MQHVQVSQVVMTHLCEETPVTVVNGQLPGPAIEVTEGDSVAVHVINESPIYMSMYWHGVKQRMNCWADGVPMVTQCPIRPNHSFTYRFSVAGQQGTLWWHAHVSCLRGSVHGALIIRPRHGASSYPFPKPHKEVPLVI

SEQ ID NO: 5749 - protein, 101 aa, Zea mays
MDLRPLTLLVVMGSLPTTLVGRLEMGPTCDLFDPRDASGFTNLLAALTVVIIAVTASSPVGFIVLRFVAGLSLANFVANQHWMSGIFAPSVIGLANAVTTG

SEQ ID NO: 5750 - protein, 409 aa, Zea mays
MNGVGDAHAAVAAAAMVQQTLGMSLPMAAFVPEHCSANKLARPPGLPPLPQAFVAQQRGDVCMEAADPAAGPRKAHRRSRSDVPFGYFPPAGHHQLPPPKVEAGWGGHLPAGGGDDDLFNAYLNLEGLDGLNSSDDRLDDGDSRGSSMRTNGADSSENESEECAADSRAGIRLCAAAADRREGLKRAAAAPVPRHARSLSMDSLIGKLNFSAGATGAASGVIPGPNRFSLEFGSAEFSPVEMKKIMADEKLAEMALADPKRVKRVLANRQSAARSKERKMRYIGELEHKVQILQTEATTLSAQLTLLQRDSAGIATQNNELKFRLQAMEQQAQLRDALNEALTAEVQRLKLATAELGDSCSSSNLAQQIQISVQDQMFQLHQQQATPIPFYQLQQAQQNGAGKKHEPTE

SEQ ID NO: 5751 - protein, 113 aa, Zea mays
MADPLVRARPKRKKVLADYLVRLRWIPALFVALPISALIYLSVFLVNTWSAMKSEKRRQKEHQENVERVVKRLKERDPKRDVSASLGWVSTRESVSTSSSTEEAAVRTSRRKM

SEQ ID NO: 5752 - protein, 333 aa, Zea mays
KLRKFLHLSTDRVLDLILSTSTTLTSWHLLVTFCSLHVALWMKFFEHKPFDSRTVMGFGVLNGISIGLLNLSLGFNSVGFYQMTKLAIIPCTVILETLFFRKKFSRSIQMSLSVLLLGVGVATVTDLQLNAVGSILSLLAIITTCIAQIMTNTIQKKFKVSSTQLLYQSCPYQSLTLFLIGPFLDGFLTNQNVFAFNYTSQVVFFIVLSCLISVSVNFSTFLVIGKTSPVTYQVLGHLKTCLVLAFGYVLLHDPFSWRNILGILIAVVGMVLYSYFCTVETQQKNVEVSPQQVKESEAGPLIADSMSKVENGGGGVDDEPLKVPMWSSKYSRE

SEQ ID NO: 5753 - protein, 213 aa, Zea mays
ESTCSNVVNEYVGAMRQLACEILDLLGEGLGLKDPRSFSRLIADTDSDSLLRINHYPPPNSFRIVAGNGANQSAGARIGFGEHSDPQILSLLRSNDVDGLQVLLNSDGREVWVQVPADPSAFFVNVGDLLQAFTNGKVISVRHRVIASSSRARLSTIYFAAPPLHARILALPETVTADSPRQYRPFTWAEYKKTMYSLRLSHSRLNLFHIGHD

SEQ ID NO: 5754 - protein, 366 aa, Zea mays
MVVPSTTPVVRQETPPPSHDGIGIPTVDLSAPGGRGALSRQVARACAQHGFFRAVNHGVAPGPAARLDAAARTFFALAPHNKQRAGPPSPLGYGCRSIGFNGDAGELEYLLLHANPAAVAHRARSIDTDDPSRFSNVVNEYVGAMRQLACEILDLLGEGLGLKDPRSFSRLIADTDSDSLLRINHYPPPCAIHKLDHDSQCRMKNSFRIVAGNGANQSAGARIGFGEHSDPQILSLLRSNDVDGLQVLLNSDGREVWVQVPADPSAFFVNVGDLLQAFTNGKVISVRHRVIASSSRARLSTIYFAAPPLHARILALPETVTANSPRQYRPFTWAEYKKTMYSLRLSHSRLNLFHIGHDDHGKGEQE

SEQ ID NO: 5755 - protein, 282 aa, Zea mays
DLIAMNHTDFIITSTFQEIAGSKDTVGQYESHIAFTLPGLYRVVHGIDVFDPKFNIVSPGADMSVYYPYTETDKRLTAFHPEIEELIYSDVENSEHKFVLKDKKKPIIFSMARLDRVKNMTGLVEMYGKNARLRELANLVIVAGDHGKESKDREEQAEFKKMYSLIDEYKLKGHIRWISAQMNRVRNGELYRYICDTKGAFVQPAFYEAFGLTVIESMTCGLPTIATCHGGPAEIIVDGVSGLHIDPYHSDKAADILVNFFDKCKADPSYWDKISQGGLQVA

SEQ ID NO: 5756 - protein, 759 aa, Zea mays
DLQLQPGSSSYYLGIWFDKVPVLTPVWAANRDNPVSANSTSRELVISDDGNMVFQAQGATVWSTRANTTTNDTVAVLLGNGNLVLRSASNSSLTFWESFDYPTDTQLPGVKVGWNKVTGLNRRLVSRKNAVDLSSGIYSSTLGRDGVARMLWNSSSVYWSSTWNGRFFSAVPEMSAGSPLANFTFVNNDQEVYFTYNIFDESTIVRTTLHVSGQNQVRVWTGQDWMTGNNQPAHQCDVYAVCGPFAVCEPNGDTLCSCMKGFSVRSPSDWEIEDRTGGCVRDTPLLSCGAGDGNSGTRMAADKFYSMPGIRLPQNGKAMPADASSAKQCAQVCLSSCSCTAYSYGKDGCSIWHGELLNVATEGDSDDTIYLRLAAKEFRSGKGSSRSGVVIGAAVGASVAAAAALVFVLLVLIWRRNGRRWSRPVVHNDKGSVVGIVAFKYADLQDATKKFSEKLGEGGFGSVFKGCLGDSTTTVVAVKRLDGARQGEKQFRAEVNSIGIVQHINLVRLIGFCCEGDRRLLVYEHMPNGSLDSHLFRSHGGRRPLDWNVRYKIAVGVARGLAYLHHGCRDCIIHCDIKPQNILLDASYLPKIADFGMAKFLGRDFSRVVTTMRGTVGYLAPEWISGTPITSKIDVYSYGMVLLEIVSGKRNSITQQSSSHTIEGQQGDYLPVQVAGKLLRGDVLSVVDADLRGDVNVEEVERVCRIACWCIQDREFDRPTMVEVVQFLEGICEPEIPPMPRLLHAIAGGGSNQMAGVGV

SEQ ID NO: 5757 - protein, 82 aa, Zea mays
MARRATVMVLAAALAVLLLASSSSKTAPVASAARDDPSAAAAAAEGKGKEKECEGANDEDECMMRRTLAAHTDYIYTQQHHG

SEQ ID NO: 5758 - protein, 636 aa, Zea mays; identical to SEQ ID NO: 630

SEQ ID NO: 5759 - protein, 110 aa, Zea mays
  unsure (1)..(110): unsure at all Xaa locations
AGGQAAVVEHTFVVKQVYIRHLCNDTLATVVNGQFPGPPVEATEGDTVIVHLVNESPFEITIHWHGVKQRLTCWADGAGMVTQCPIQPNSTFTYRFKVDGHEGTLXWHSH

SEQ ID NO: 5760 - protein, 190 aa, Zea mays
  unsure (1)..(190): unsure at all Xaa locations
MAANGKSSLANGASTGGKPIKCKAAVAWGPGEPLVMEEVEVXXPGRLEVRVKLLFTSICHTDLSFLKGENELHRKFPRILGHEAAGVVESVGDGVEDLAAGDHVIPIFNGECGACAYCESDRTNLCGTYRVDASKSTMVSDGGTRFSVADRVSGRTVPVYHFLNTSTFAEYTVLDAACAVKVNPEAPLQK

SEQ ID NO: 5761 - protein, 107 aa, Zea mays
AQIVRIECGPEEYIAKEMLWDYLDNFADHALDYLKEQPELPDVIHSHYADAGYVGTRLSHQLGIPLVHTGHSLGRSKRTRLLLSGIKADEIESRYNMARRINAEEET

SEQ ID NO: 5762 - protein, 134 aa, Zea mays
GDWSKDGGGGEPTKYRGVRRRPWGKYAAEIRDSSRHGVRIWLGTFDTAEEAARAYDRSAYSMRGANAVLNFPEDAHAYAAACRGSGSSSSSSRHRQQQQQGSGRDVIELEYLDDEVLQEMLRNHEPSSSARKKM

SEQ ID NO: 5763 - protein, 314 aa, Zea mays
  unsure (1)..(314): unsure at all Xaa locations
NSEVKRAWARVVLGWVTSWEVLVLHSTTAYARSPTTPFLRGPSPGAAPRQEESLFSLTICRGEENVYXAKLAEQAERYEEMXVSIMEKVAKTVDVEELTVEERNLLSVAYKNVIGARRASWRIVSSIEQKEESRKNEEHVNLIKEYRGKIEAELSNSGSRENNICDGILKLLDSHLVPSSTAAESKVFYLKMKGDYHRYLAEFKTGAERKESAESTMVAYKAAQDIALAELAPYPIPIRXLGLAPNFSVFYYEILNSPDKACNPGKXQAFDEAISELDSLXGRESYKDSTLIMQLXLRDNLTLWDIPTLTEGWC

SEQ ID NO: 5764 - protein, 256 aa, Zea mays
MAREENVYMAKLAEQAERYEEMVEYMEKVAKTVDVEELTVEERNLLSVAYKNVIGARRASWRIVSSIEQKEESRKNEEHVNLIKEYRAKIEAELSNICDGILKLLDSHLVPSSTAAESKVFYLKMKGDYHRYLAEFKTGPERKESAESTMMAYKAAQDIALAELAPTHPIRLGLALNFSVFYYEILNSPDKACNLAKQAFDEAISQLDTLGEESYKDSTLIMQLLRDNLTLWTSDLTEDGADEGKEAPKGEAGDGQ

SEQ ID NO: 5765 - protein, 243 aa, Zea mays; identical to SEQ ID NO: 857

SEQ ID NO: 5766 - protein, 264 aa, Zea mays
KLNLHCSEETKNAEWSGPMGIVVSVALSSVFGWIYLVALTSAVTADDVPSLLDPTNDAGGNAIAQALYATFRRRFGSGAGGVLCLAAMAVAIFLCGVASVTSNSRMGYAFSRDGAMPLSQVWYRVNKQEVPFNVVWLSVSVAFVMALTSLGSQVAFQAMVSITTLGMYIAYALPIFFRVSAARNSFVPGPFHLGRRCSLVVGWVAVLWVALVTVLFCLPVAYPVAGVNFNYTPVAVGGVLVLSLGAWVLHARFWFRGPVTTIDA

SEQ ID NO: 5767 - protein, 707 aa, Zea mays
  unsure (1)..(707): unsure at all Xaa locations
TCRNLVTLDLSSNNLSGHIPSAISXLTFLNNLNLSSNQLSSAIPAEICVGFGSAAHPDSEFIQHHGLLDLSYNRLTGNIPTAIKNCVMVTVLNLQGNMLSGTIPPELAELPNVTAIYLSYNTLVGPMLPWSAXLVQLQGLFLSNNHLSGSIPAEIGQILPKIEKLDLSSNALTGTLPESLLCINYLTYLDISNNSLSGQIPFSCSKEKESSSSLILFNGSSNHFSGNLDESISNFTQLSFLDIHNNSLTGSLPFSLSDLSYLNYLDLSSNDFNGPAPCGICNIVGLTFADFSGNHIGMSGLVDCAAEGFCTGKGFDRKALNSSDRVRRAAIICVSILTVVIVLVFLVVYLKRRLLRSRPLALVPVSKAKATIEPTSSDELLGKKFREPLSINLATFEHALLRVTADDIQKATENFSKVHIIGDGGFGTVYRAALPEGRRVAIKRLHGGHQFQGDREFLAEMETIGKVKHPNLVPLLGYCVCGDERFLIYEYMENGSLEMWLKNRADAIETLGWPDRLKICIGSARGLSFLHHGFVPHIIHRDMKSSNILLDENFEPRVSDFGLARIISACETHVSTDIAGTYGYIPSEYALTMKSFTKGDVYSFCAVMLELLTGRPPTGQEEGEGGGNLVGWVRWMMAHGKEGELFDPCLPVSSVWRVQMAHVLAIARDCTVDEPWKRPTMLEVVKGLKMAETIECGPLVVTVTKDM

SEQ ID NO: 5768 - protein, 104 aa, Zea mays
MHGRTAMAVACLLCMTALLLVQDVQSRRLLWTEQEKKQTHGGLVGNHGAADRRSTSLQEPCSGATGGGGTGSADKQGELPCDDDTSKWTELHTDYIYTQDFKHP

SEQ ID NO: 5769 - protein, 251 aa, Zea mays
MGRGPVQLRRIENKINRQVTFSKRRNGLLKKAHEISVLCDAEVALIVFSTKGKLYEYSSHSSMEGILERYQRYSFEERAVLNPSIEDQANWGDEYVRLKSKLDALQKSQRQLLGEQLSSLTIKELQQLEQQLDSSLKHIRSRKNQLMFDSISALQKKEKALTDQNGVLQKFMEAEKEKNKALMNAQLREQQNGASTSSPSLSPPIVPDSMPTLNIGPCQPRGGAESESEPSPAPAQANRGNLPPWMLRTVK

SEQ ID NO: 5770 - protein, 409 aa, Zea mays; identical to SEQ ID NO: 921

SEQ ID NO: 5771 - protein, 260 aa, Zea mays
MDRKRIKDALEKHLERSSPSTSRGVVSKERERLAAGKLPSSLGKAEVSDGEEFETDSEDSDVSGSEGEDTSWISWFCTLRGNEFFCEIDDDYIQDDFNLCGLSNQVPYYDYALDLILDIESSNDDGFTEEQNELIESSAEMLYGLIHARYILTSKGLAAMLEKFKNYYDFGRCPRVYCCGQPCLPAGQSDVPRSSTVKIYCPKCEELNYPRSKYQGNIDGSYFGTTFPHLFLMTYPHLKPQKPSQQYTPRVFGFKLHKPS

SEQ ID NO: 5772 - protein, 332 aa, Zea mays
MSKARVYTDVNVLRPKEYWDYEALTVQWGEQDNYEVVRKVGRGKYSEVFEGINVNNNEKCIIKILKPVKKKKIKREIKILQNLYGGPNIVKLLDIVRDQHSKTPSLIFEYVNNTDFKVLYPTLTDYDIRYYIYELLKALDYCHSQGIMHRDVKPHNVMIDHELRKLRLIDWGLAEFYHPGKEYNVRVASRYFKGPELLVDLQDYDYSLDMWSLGCMFAGMIFRKEPFFYGHDNHDQLVKIAKVLGTDGLNVYLNKYRIELDPQLEALVGRHSRKPWTKFINADNQHLVSHEAIDFLDKLLRYDHQDRLTAREAMTHPYFQQVRAAENSTTRA

SEQ ID NO: 5773 - protein, 217 aa, Zea mays
MPFLPCCCSNVVNEYVGAMRQLACEILDLLGEGLGLEDPRSFSKLITDTDSDSLLRINHYPTACNAHNLDHDSQCKMKSSRVGFGEHSDPQILSLLRANDVDGLQVLLNADGKEVWVQVPADQSAFFVNVGDLLQALTNGKLVSVRHRVIASSSRARLSTIYFAAPPLHARILALAETITANAPSQYRPFTWAEYKKTMYSLRLSHSRLNLFHIDHD

SEQ ID NO: 5774 - protein, 225 aa, Zea mays
MRQLACEILDLLGEGLGLEDPRSFSKLITDTDSDSLLRINHYPTACNAHNLDHDSQCKMKSSVRTKTTSNGVKPSAGGRVGFGEHSDPQILSLLRANDVDGLQVLLNADGKEVWVQVPADQSAFFVNVGDLLQALTNGKLVSVRHRVIASSSRARLSTIYFAAPPLHARILALAETITANAPSQYRPFTWAEYKKTMYSLRLSHSRLNLFHIDHDGHSNVGEGEE

SEQ ID NO: 5775 - protein, 44 aa, Zea mays
RKYGAVGTFMSVYYKSKKGRKTEKEVQEAEQAHLETAYAEADQP

SEQ ID NO: 5776 - protein, 518 aa, Zea mays
MGTVGGGELPVADPAAADADRARLQQLGYKQELKRGLSVVSNFAFSFAIISVLTGVTTTYNTGLRYGGPASMTLGWLVVATFNGCVALSMAEICSAYPTSGGLYYWSAKLAGNEWAPLASWVTGWFNIVGQWACTTSVDFSLAQLIQVIILLSTGGANGGGYLASKYVVLAIYTAILVVHGLINSLHIQWPSWFGQLGALWNVAGVFVLVILVPSVAKERASAEFVFTHLNTDNGMGIHSKAYILAVGLLMSQYSSIGYDTSAHMTEETKKADWSGPMGIVYSVALSSVFGWVYLLALTSVVTDIPYLLDTGNDAGGYAIAQALYDTFRRRYGTGAGGIACLVIIAVAVFLCGTACVTSNSRMGYAFSWDGAMPFSHLWYRVNKQEVPFNVVWLSVSVAFVMALTSLGSQVAFQAMVSIATLGLYIAYALPIFFRVTTARKSFVPGPFHLGRCGIAVGSVAVLWVALVTVLFCLPVAYPVAKDTFNYTPVAVGGVLVLSLVAWVLHARFWFRGPITNV

SEQ ID NO: 5777 - protein, 507 aa, Zea mays
  unsure (1)..(507): unsure at all Xaa locations
MSARRSSAGSDDRDQARLQQLGYKQELKRGLSVVSNFAFSFSMISVLAGVTTTYNTGLRYGGPASMTLGWLVVALFNGCVALSMAEICSAYPTTGGLYYWSAKLAGKDWGPLACWVTGWFNIVGQWACTTSVDFSLAQFVQVIVLLATGGANGGGYLASKYVVLAIYCAILVLHGLINSLPIXWLAFFGQLGAFWNLGGVCLERASMEFMFTHCYTDDAVGIHSKVYVLAIGLLTSQYSLLGYDTSAHMSEETKNAEWSGPMGIVVSVALSSVFGWIYLVALTSAVTADDVPSLLDPTNDAGGNAIAQALYATFRRRFGSGAGXVLCLAAMAVAIFLCGVASVTSNSRMGYAFSRDGAMPLSQVWYRVNKQEVPFNVVWLSVSVAFVMALTSLGSQVAFQAMVSITTLGMYIAYALPIFFRVTAARNSFVPGPFHLGRRCSLVVGWVAVLWVALVTVLFCLPVAYPVAGVNFNYTPVAVGGVLVLSLGAWVLHARFWFRGPVTTIDA

SEQ ID NO: 5778 - protein, 208 aa, Zea mays
MKRFAVQESEMARMLVLMSRSHGQDQALPLSACLAGGQRGEDRQAPERVFVCKTCNRVFPSFQALGGHRASHKKPRLDGDGAGDPSLAKPKLHGCSVCGLEFAIGQALGGHMRRHRAMTGGVPAVPPATTRIVVDEKPDGDVVGIIRHDHGGVKQPGGGLWLDLNYPPCDDGRDAVEAECGRNAAAATGITFHQFLDTATMAVDCLGY

SEQ ID NO: 5779 - protein, 381 aa, Zea mays
  unsure (1)..(381): unsure at all Xaa locations
MATAGKVIKCKAAVAWEAGKPLSIEEVEVAPPQAMEVRVKILYTALCHTDVYFWEAKGQTPVFPRILGHEAGGIVESVGEGGVTELAPGDHVLPVFTGECKECAHCKSEESNMCDLLRINVDRGVMIGDGKSRFTISGQPIFHFVGTSTFSEYTVIHVGCLAKINPEAPLDKVCILSCGISTGLGATLNVAKPAKGSTVAIFGLGAVGLAAMEGARLAGASRIIGVDINPAKYEQAKKFGCTEFVNPKDHDKPVQEVLIELTNGGVDRSVECTGNINAMISAFECVHDGWGVAVXLLGVPHKDDQFKTHPMNFPSEKPLKGTFFGNYKPRTDLPNVVEMYMKKELELEKFITHSVPFSEINTAFDLMLKGESLRCIMRMED

SEQ ID NO: 5780 - protein, 411 aa, Zea mays
  unsure (1)..(411): unsure at all Xaa locations
LVSCHLIRTLIDQITVHAPGPQWACTTSVDFSLAQLIQVIILLSTGGANGGGYLASKYVVLAIYTAILVVHGLINSLHIQWLSWFGQLGALWNVAGVFVLVILVPSVAKERASAEFVFTHLNTDNGMGIHSKAYILAVGLLMSQYSSIGYDTSAHMTEETKKADWSGPMGIVYSVALSSVFGWVYLLALTSVVTDIPYLLDTSNGAXGGYAIAQALYDTFRRRYGTGAXGGIACLVIIAVAVFLCGTACVTSNSRMGYAFSRDGAMPFSHLWYRVNKQEVPFNVVWLSVSVAFVMALTSLGSQVAFQAMVSIATLGLYIAYALPIFFRVTTARKSFVPGPFHLGRCGIAVGSVAVLWVALVTVLFCLPVAYPVAKDTFNYTPVAVGGVLVLSLVAWVLHARFWFRGPITNV

SEQ ID NO: 5781 - protein, 520 aa, Zea mays
  unsure (1)..(520): unsure at all Xaa locations
MAPVSLPPGFRFHPTDEELIICYLKRKINGRQIELEIIPEVDLYKCEPWDLPEKSFLPSKDLEWYFFSPRDRKYPNGSRTNRATKSGYWKATGKDRKVSSHRRAVGMKKTLVYYRGRAPHGSRTDWVMHEYRLDERECETDTGLQDAYALCRVFKKTAPGPKIIEHYGAVHHPIEQTQWMGSSVERSPTLDLSSDVRGDDFDSSSFSFPTEAPMDSSMHVEDFPHDVSLDTKASVLRSSNPNNEVDILQEFLSVASASQELINGTSSSYAAEMWAGAGTSSTSGTHYVNELSSLFEFGVKAKEEADNFYHMDCIGTSAGFSPKPVRVDEPVRLVEIADMEEFKEEKRRVENLRGVRLHNNDDLGEIPTDCCITQYPISDTADISDTAPIFSQSQPDDFAIGFSDDADPNASFDLCERVDVKHGLFVSTVGVPKTFFHHVEPSKKQXKALIRDKFLVKKLPSSCQRSLLGSKETAAVSELLQMVVSSLLLTPTEVTGPTTMTTEQEELARKAMKPPGPGRC

SEQ ID NO: 5782 - protein, 690 aa, Zea mays
MAPVSLPPGFRFHPTDEELIICYLKRKINGRQIELEIIPEVDLYKCEPWDLPEKSFLPSKDLEWYFFSPRDRKYPNGSRTNRATKSGYWKATGKDRKVNSHRRAVGMKKTLVYYRGRAPHGSRTDWVMHEYRLDERECETDTGLQDAYALCRVFKKTAPGPKIIEHYGAVHHPIEQTQWMGSSVERSPTLDLSSDVRGDDFDSSSFSFPTEAPMDSSMHGGLFGMQMSAPHEDAKWMQFLSEDAFNATNPFFTNPASSSFSCLPSKVDVALECARLQHRLSLPPLEVEDFPHDVSLDTKASVLRSSNPNNEVDILQEFLSVASASQELINGTSSSYAAEMWAGAGTSSTSDTHYVNELSSLFEFGVKAKEEADNFYHMDCIGTSSGFSPKPVRVDEPVRLVEIADMEEFKEEKRRVENLRGVRLHNNDDLGEIPTDCCITQYPISDTADISGEAGHLTNPTSAGGLDTAPIFSQSQPDDFAIGFSDDADPNASFDLCERVDVKHGLFVSTVGAPKTFFHHVEPSKKVSFHLNNNPVASDDDVSKATTGKSRSPIISVMTTKDSGSSFSVFSKLKALIRDKFLVKKLPSSCQRSLLGSKETAAVSELLQMVVSSLLLTPTEVTGPTTMTTEQEKLARKAMKPGPRRCDGSHAWLLPLPKRSKGISSMFFSGKWAFLTSALAIRAPGPGCNH

SEQ ID NO: 5783 - protein, 345 aa, Zea mays
MTSCGCLMLEKVEGDASAKTRVKAAPGAGAGAWCGSCAGDWRGRSEAIFPIYVMGSSRESTVAAARGIVDSPEDPIWVAVKAEAKSEAEKEPILSSFLYASVLSHDCLERALSFVLANRLEDPTLLATQLIDIFNDVMLNNKDICRSIRLDAQAFKDRDPACAQYSWALLYLKGYQSLQSYRIANILWNQGRKVLALALQSRISEVFAVDIHPAAKIGEGILLDHGTGLVIGETAVVGNWVSKEPIPLMQGVTLGGTGKEHGDRHPKIGQGALIGASATILGNINVGEGAMIAAGSLVLKDVPPHSMAVGNPAKVVGYTEKEDPSLTMKHDARRDYFEHAAIRLR

SEQ ID NO: 5784 - protein, 536 aa, Zea mays
MASPAIPFAPLTSHRAAPFVLGCPPPWPPPPPPAARPRPPPPRPDAAAAARLLEEEAGAGSSRARSPGGPELESMVLDLNAESPTPGSASAASSSSVVVGGGFFRFDLLGGTPDEEGCSPSPPIVTRQLFPLPYPDAAGSTAASTASNGSPPPEVAVAWARRPADLGAPALAQGKVVSAPSSPAVVSPAAGKKSRRGPRSRSSQYRGVTFYRRTGRWESHIWDCGKQVYLGGFDTAHAAARAYDRAAIKFRGLDADINFQLKDYEDDLKQMRNWTKEEFVHILRRQSTGFARGSSKYRGVTLHKCGRWEARMGQLLGKKYIYLGLFDSEIEAARAYDRAAIRFNGPDAVTNFDSVSYDGDVPLPPAVEKDVVDGDILDLNLRISQPNVHDLRSDGTLTGFGLSCNSPEASSSIVSQPMGPQWPVHPHSRSMRPQHPHLYASPCPGFFVNLREAPMQEEENRSEPACPQPFPSWSWAWQTQGSRAPVLPATTAASSGFSTAAATGVDAATAGHSVPPPSGSLRQFSGYHQLRFPPTA

SEQ ID NO: 5785 - protein, 293 aa, Zea mays
DLQLISDQLLGGEACLPVVPNAAAYTASSVHYHHPTQAAFLQQPAQQVAYVDLTNEYAADATACDCEAAFRAAEPVMIRFGGDPSPVSDSDPSRRPLLLTVSLPPPASHAWGPAAAVPLPLEAAAAALDANDFRKYRGVRQRPWGKFAAEIRDPKRRGSRVWLGTYDTAVDAARAYDRAAFRMRGAKAILNFPNEVGSRGADFLAPPPPPVAAAATSSSSQNKRKLRDAEATAGGAAEPAAASKSVKAAEASGSPAPPSLSPATTTTTTTTTAASTVTTCCSPSSGSAAGRLL

SEQ ID NO: 5786 - protein, 286 aa, Zea mays
DQLLGGEACLPVVPNSAAYTASSVHYHHHHPTQAAFLPQPAQQVAYVDLTNEYAADATACDCEAAFRAAEPVMIRFGGDPSPVSDSDPSRRPLLLTVSLPPPASHAWGPAAAVPLPLEAAAAALDANDFRKYRGVRQRPWGKFAAEIRDPKRRGSRVWLGTYDTAVDAARAYDRAAFRMRGAKAILNFPNEVGSRGADFLAPPPAPPPVAAAATSSSSQNKRKLRDAEATAGGAAEPAAANKSVKVEASGSPAPSLSPATTTTTTTTTTTASTVTTCCSPSSGSAA

SEQ ID NO: 5787 - protein, 335 aa, Zea mays
MADRRSNGGSPPSWSFASQSSHYHLAAMRGSYAPQSLWRPSPMPVRGAALSSTPHVVASAPAEKNFAADFLLGGVSSAVSKTVAAPIERVKMLLQNQDELIRTGRLSEPYRGIGDCFGRTVRDEGFLSLWRGNNTNVIRYFPTQALNFAFKDYFKGLFNFNKDRDGYWRWFAGNIASGSAAGATSLLFVYSLDYARTRLTSDYRAAAKGGERQFTGLVDVYRKTLRSDGVVGLYRGFNVSVAGIVVYRGLYFGMYDSLKPVLLTEKLQDNFFASLALGWMITNGASLASYPLDTIRRRMMMTSGEAVKYKSSMDAFAQIVRNEGPKSLFKGAGAN

SEQ ID NO: 5788 - protein, 336 aa, Zea mays
MAALPRSPNSARLPLSLRDLRWIGESMDPRIAGLPNPPRIPPAEASFYGDESRAPSSNHRPFITVTPAKGSGSARSLEAGRPTAGSHGIRIPSFLLSVQVQQPARASLQETESIRVPKLAALPAKQEDSCGMELELGLAPPSARRPTPMTIDQQQQQQQRHLAEDELSSTSSDHHPCAARSGKRGFAEAFQEAAATTTTLPLFDDGSSCGGRSGGGKRPLVGWPPLSSARSRACGGGAAKYVKVKKEGDAIGRKVDLSLHASYDELLATLARMFPTNNGSQDDKEISSKSTAAATTTTSHRDVVVTYEDGEGDWMLLGDVPWDDFARSVKRLKLLG

SEQ ID NO: 5789 - protein, 333 aa, Zea mays
MSKARVYTDVNVLRPKEYWDYEALTVQWGEQDNYEVVRKVGRGKYSEVFEGINVNNNEKCIIKILKPVKKKKIKREIKILQNLYGGPNIVKLLDIVRDQHSKTPSLIFEYYVNNTDFKVLYPTLTDYDIRYYIYELLKALDYCHSQGIMHRDVKPHNVMIDHELRKLRLIDWGLAEFYHPGKEYNVRVASRYFKGPELLVDLQDYDYSLDMWSLGCMFAGMIFRKEPFFYGHDNHDQLVKIAKVLGTDGLNVYLNKYRIELDPQLEALVGRHSRKPWTKFINADNQHLVSHEAIDFLDKLLRYDHQDRLTAREAMTHPYFQQVRAAENSRTRA

SEQ ID NO: 5790 - protein, 202 aa, Zea mays
  unsure (1)..(202): unsure at all Xaa locations
ADYVSSDQDLLRCRVRTSGIFETKFQVDKVNXFHMCDVGGQRDERRKWIQCFNDVTAIIFVVASSSYNMVIREDNQTNRLQEALNLFKSIWINRWLRTISVILFLNKQDLLAEKVLAGKSKIVDYFPEFARYTTPEDATPEPGEDPRVARAKYFIRDEFLRISTASGDGRHYCYPHFTCAVDTENIRRVFNDCRDIIQRMHL

SEQ ID NO: 5791 - protein, 387 aa, Zea mays
  unsure (1)..(387): unsure at all Xaa locations
HFPIYRRKLCILKGVFPRQPKKKVEGNHKTYYHTKDIAFLAHDPLIEKFREIKVHRRKVKKAVAKKNRDLADRLLNRPPTYKLDRLVLERYPTFVDALRDLDDCLTMVHLFAALPAVDGERVEVKRIHNCRRFIXSYMSHPKLSHECLTFISVKGIYYQAEVQGQKITWLTPHALQQVLTDDVDFNVMLSFLEFYETLLGFVNFKIYHSINVNYPPILDPRLEALAVELYALCRYMSAGSRRMIGNSQTDEVMEDKDEKSKAEEVIEEEKVVKNKASSKADESEFRLAQLQHQLPTNEPGALMNLVEESTADDADDDDTKDCKGLFKNLKFYLSREVPRESLLFIIPAFGGTVSWEGEGAPFKEIDEDITHQVDSICNNLLHQSLTI

SEQ ID NO: 5792 - protein, 74 aa, Zea mays
  unsure (1)..(74): unsure at all Xaa locations
MALPQLFCKEDVYMRTSLLRXLQRYHEMVHVLEKVAKTVDSVELSDEERNLLHGAYQNVSGARLASLRMIFSIQ

SEQ ID NO: 5793 - protein, 255 aa, Zea mays
MATAGKVIKCRAAVAWEAGKPLSIEEVEVAPPQAMEVRVKILYTALCHTDVYFWEAKGQTPVFPRILGHEAGGIVESVGEGVTELAPGDHVLPVFTGECKECAHCKSEESNMCDLLRINVDRGVMIGDGKSRFTISGQPIFHFVGTSTFSEYTVIHVGCLAKINPEAPLDKVCILSCGISTGLGATLNVAKPAKGSTVAIFGLGAVGLAAMEGARLAGASRIIGVDINPAKYEQGITKLINAILGLIFLHQSSSD

SEQ ID NO: 5794 - protein, 118 aa, Zea mays
DLHKTSAGLGSVIIDSQPLTVAILASLLFGESIGAIGVGGLVLGVVGLLLLEVPALSVEGNDTTIWGSGESLMFLSAQSMAVGTIMVRWVSKYSDPIMATGWRLYCFNLAFLCSILAN

SEQ ID NO: 5795 - protein, 222 aa, Zea mays
CSGGSCVPSPRASDESFSCLPLPPPPPQKDDVTDAAALSQQLPIGPAIDDSCLQQAFFATPQSRNEAPAPPLQPPAKLRIGGATRSKRKKKSKKEVKRVPVVGASPDPWAWRKYGQKPIKGSPYPRGYYRCSTDKDCRARKQVERCRTDPSTVIVSYTGEHSHPVPLHRNALAGTTRNKPQPASSICNSPGRAASPIGDDDLGAAPAAINVVTDEKCPFSQA

SEQ ID NO: 5796 - protein, 231 aa, Zea mays
MAASRRSSVELPVADPAADPDQVRLHQLGYKQELKRGLSVLSNFALSFSIISVLMGVTITYNTGLRYGGPVSMTLGWFLVSALNACVALSMAEICSAYPTSGGLYYWSAKLAGKDWAPLASWLTGWFNIVGQWAGTTSVDFSLAQLVQVIVLLATGGLNGGGYMASKYVVLAIYGAILVIHGLMNSLPIQYLAWFGHLGAFWNTAGTFALVIIIPAVATERASTEFIFTHL

SEQ ID NO: 5797 - protein, 81 aa, Zea mays
ASNALRRAYKARGENVGAWRQACYAPLVEIAARHGFDIDAVFAAHPRLTIWYVPTRLRQLCHQARGSHAHAAAGLPPPPIF

SEQ ID NO: 5798 - protein, 187 aa, Zea mays
LTTANNRSLPSPIPFLSEQSSAGRHIGKLYVSNKEIGRGSNGTVVFEGSYDGRQVAVKRLLRSHNDIAEKETQNLIISDHDPNIVRLYGCDYDSDFVYISLERCHCSLADLIQKHSYLSSGESVSNNEASFSIKSKISNVKGMDVELWTHDGLPSAQLLKLMRYMNDLICFLLLVVVVHRQLTVSHC

SEQ ID NO: 5799 - protein, 568 aa, Zea mays
  unsure (1)..(568): unsure at all Xaa locations
MGCPPRLLCCLFLSLSLAAVVARAATRHQEWEISYQFKSPDCVRKLAVTINGETPGPTIRATQGDTVVVRVKNSLLTENVAIHWHGIRQRGTPWADGTEGVTQCPILPGDTFTYAFVVDRPGTYMYHAHYGMQRSAGLNGLIVVAAAPGGPDAEPFRYDGEHDVLLNDWWHKSTYEQAAGLASAPLVWVGEPQSLLINGRGRFVNCSAAGACDAAHPECATPVFAVVPGRTYRFRIASVTSLSALNFEIEGHEMTVVEADGHYVKPFVVKNLNIYSGETYSVLIKADQDPNRNYWLASNVVSREPGTPAGTAVLSYYGGRSSPRRSPPTAPPAGPAWNDTAYRFRQSVATVAHPAHVEPPPPRADRTILLLNTQNKIDAHIKWALNGVSFTLPHTPYLVAMKRGLLDTFDQSPPPETYAHRGYDVYAVPPNPNATTSDGLNRLRFGSVVDVVLQNANXLAPNKSETHPWHLHGHDFWVLGYGIGRFDPAVHPASYNLRDPILKNTVAVHPYGWTALRFRADNPGVWAFHCHIESHFFMGMGIAFEEGVDRVAPLPPQIMGCGKTRGGH

SEQ ID NO: 5800 - protein, 377 aa, Zea mays
GRVGFGMTCKFNHPADRKLAVAAARMKGEYPQRIGQPECQYYLKTGTCKFGATCKFHHPREKAAMATRVQLNELGYPLRPNEKECAYYLRTGQCKFGSTCKFHHSQPSTMMVAVRGSVYSPGQSATSPGQHAYQGAVTSWPLSRSASFIASPRWPGHSSYAQVIVPPGLVQVPGWSPYTAQIGSSSSEDQQRTPGAAQYYTGSRQSGTSIGDQGMFSSYQAGSVPVGLYAVQRENLFPERPDQPECQFYMKTGDCKFGAVCKFHHPRERIIPTPNCALSPLGLPLRPGEPICSFYNRYGMCKFGPNCKFDHPMGNAMYGQAPSPASEAPAPRRMLAHVPPSHPEASPDGGSGRSRRIAHSDSQQIPSGERSAEREAS

SEQ ID NO: 5801 - protein, 132 aa, Zea mays
  unsure (1)..(132): unsure at all Xaa locations
MSEEKHHHLFHHHKKDEEQXPAGEYSETVATEAVTTGDGENEYEGYKKEHKHKQHLGEAGAIGAGAFGLYEKHEAKKDPEHAHRHKIEEELAATAAVGAGGYAFHEHHEKKKDHKXAEEAPGGEKKHHHLFG

SEQ ID NO: 5802 - protein, 521 aa, Zea mays
MARGDGELELSVGVRGTGGAAAAAAADHVAPISLGRLILAGMVAGGVQYGWALQLSLLTPYVQTLGLSHALTSFMWLCGPIAGLVVQPLVGLYSDRCTARWGRRRPFILIGCMLICLAVIVVGFSSDIGAALGDTKEHCSLYHGPRWHAAIVYVLGFWLLDFSNNTVQGPARAMMADLCGHHGPSAANSIFCSWMALGNILGYSSGSTNNWHKWFPFLLTNACCEACANLKGAFLVAVVFLVMCLTVTLFFANEVPYRGNQNLPTKANGEVETEPSGPLAVLKGFKNLPTGMPSVLLVTGLTWLSWFPFILYDTDWMGREIYHGDPKGSNAQISAFDEGVRVGSFGLLLNSIVLGFSSFLIEPMCRKVGPRVVWVTSNFMVCVAMAATALISFWSLKDYHGYVQDAITASTSIKAVCLVLFAFLGVPLAILYSVPFAVTAQLAATKGGGQGLCTGVLNISIVIPQVIIALGAGPWDALFGKGNIPAFGVASGFALIGGVVGVFLLPKISKRQFRAVSAGGH

SEQ ID NO: 5803 - protein, 256 aa, Zea mays
MSREENVYMAKLAEQAERYEEMVEYMEKVAKTVDVEELTVEERNLLSVAYKNVIGARRASWRIVSSIEQKEESRKNEEHVNLIKEYRGKIEAELSNICDGILKLLDSHLVPSSTAAESKVFYLKMKGDYHRYLAEFKTGAERKESAESTMVAYKAAQDIALAELAPTHPIRLGLALNFSVFYYEILNSPDKACNLAKQAFDEAISELDSLGEESYKDSTLIMQLLRDNLTLWTSDLTEDGADEGKDAQKGDAGEGQ

SEQ ID NO: 5804 - protein, 191 aa, Zea mays
AGRKKEESRKNEEHVNLIKEYRAKIEAELSNICDGILKLLDSHLVPSFTAAESKVFYLKMKGDYHRYLAEFKTGPERKESAESTMMAYKAAQDIALAELAPTHPIRLGLALNFSVFYYEILNSPDKACNLAKQAFDEAISQLDTLGEESYKDSTLIMQLLRDNLTLWTSDLTEDGADEGKEAPKGEAGDGQ

SEQ ID NO: 5805 - protein, 362 aa, Zea mays
  unsure (1)..(362): unsure at all Xaa locations
VESPRVRAIASARMKGEYPERVGQPECQYYLKTGTCKFGPTCKFHHPREKAGIAGRVQLNTLGYPLLPVCFFLPVTCPLLHMSVCFAEKESTLLLXNEKECAYYLKTGQCKYANTCKFHHPELFNVVPSSRGSPIYTSVHSSASAGPQSYTGTMSSWTFPRASFIPSPRWQSPSNYAPMVVPHGLVQVPSWNSYPGQLQSPGAQQTYGSSQQGEASAGNQGMLSPYRSSSFPVPQYALQRDNVFPERPDEPECQYYMKTGDCKFGAVCKFHHPRVRSQPPPDCVLSPMGLPIRPGEELCKFYSRYGICKFGANCKFDHPTMAAPMGVYAYGFSGSASVAPASTNAPMTRHLLGSPSGSGYMS

SEQ ID NO: 5806 - protein, 127 aa, Zea mays
MDMDMDMASCRRRWPLLLALAQLLVVCGGLGATVEHTFDVRNDLSISQLCQPARAITAVNGRLPGPTIHVREGDTVVVHVINNSPYNITIHWHGLFQRGTQWADGPEMVTQCPIRPSSRYTYRYNAT

SEQ ID NO: 5807 - protein, 135 aa, Zea mays
VSNYKFHPSLDRNSDSSALTYHAMSLVLQFFLALSCFIAIGVNLSQFICIGRFSAVSFQVLGHMKTVLVLSLGFLFFGKEGLNLQVVLGMVLAVLGMIWYGNASAKPGGKERRSVLPLRSASLKGSSEEKGGAEK

SEQ ID NO: 5808 - protein, 257 aa, Zea mays
QVKYVVKLARALPATAGVHRVDLLTRQISCPDVDWTYGEPVEMITHQADDGDGSGGGAYIVRLPCGPRDKYLPKESLWPHIPEFVDRALAHVTNVARALGDQAGAAAPVWPYVVHGHYADAAEAAAHLASALNVPMVMTGHSLGRNKLEQLLKLGRMPRAEIQGTYRIARRIEAEETGLDAADMVVTSTKQEIEEQWGLYDGFDLMVERKLRVRRRRGLSCLGRYMPRMVVIPPGMDFSYVDTQDLAEGDADLQACK

SEQ ID NO: 5809 - protein, 196 aa, Zea mays
MAAQEHEHEHEHEKQQAKTSTTSSLPSSSERSSSSAPNNLREGAAGAGVESDEEIRRVPELGGASASASASSGAGKEDGARAVAAGAQGHPPAAGKKRGRAPGDKEQNRLKRLLRNRVSAQQARERKKAYLTELEVRAKDLELRNAELEQRVSTLQNENNTLRQILKNTTAHASKRSGGGGGKGGDGGKKHHFSKS

SEQ ID NO: 5810 - protein, 247 aa, Zea mays
MGRGKVQLKRIENKINRQVTFSKRRSGLLKKAHEISVLCDAEVALIIFSTKGKLYEYSTDSCMDKILERYERYSYAEKVLISAEYETQGNWCHEYRKLKAKVETIQKCQKHLMGEDLETLNLKELQQLEQQLESSLKHIRTRKSQLMVESISALQRKEKSLQEENKVLQKEKALAEKQKDQRQQVQRDQTQQQTSSSSTSFMLREAAPTTNVSIFPVAAGGRVVEGAAAQPQARVGLPPWMLSHLSC

SEQ ID NO: 5811 - protein, 247 aa, Zea mays
  unsure (1)..(247): unsure at all Xaa locations
MGRGKVQLKRIENKINRQVTFSKRRSGLLKKAHEISVLCDAEVALIIFSTKGKLYEYSTDSXSMDKILERYERYSYAEKVLISAEYETQGNWCHEYRKLKAXKVDTIQECQKHLMGEDLRTLNLKELQQLEQQLESSLKHIRTRKSQLMVESISALQRKEKSLQEENKVLQKELAEKQKDQRQQVQRDQTQQQTSSSSTSFMLREAAPTTNVSIFPVAAGGRVVEGAAAQPQARVGLPPWMLSHLSC

SEQ ID NO: 5812 - protein, 382 aa, Zea mays
MENQGPKPIRCKAAVCRAAGEPLAIEEVVVDTPKAHEVRIRIICTSLCHSDVTFWRMKDLPDNIPRIFGHEAFGVVESVGEQVDEFAAGDAVVPTFLGQCSECVDCRSARSNMCSKYRFAVRPGMPRDGTTRFTDGQGRPLHHFFGVSSFAEYTVVDVNQVVKLNPAVPPALACLLSCGASTGVGAAWKQAKVEPGSSVAIFGLGAVGLAVAEGARICGASKIIGVDINPDKCELGKKFGVTHFINPKELGEEKPVHQAIAEMTDGGADYCFECIGLAALMNDAFRSSRDGWGKTIILGVEMHGAPLCISPHEILHGKSVIGSMFGGVKPKQDIPILADKYMNKELELDKFITHEVGLKDINQAFDLLLQGKSLRCTIWMDK

SEQ ID NO: 5813 - protein, 375 aa, Zea mays
MGAEAAHGHPQQQPPSSLRPGREAAAPPAVVGLQLSALIDHVARVDWSLLDRVPGDRGGSQQVSIDELNHILDEVNAHILPSRNDLTPVTTIAGGSVANTIRGLSAGFGISTGIIGACGDDNQGLLFVNNMSFSGVDLTRLRAKKGHTAQCVCLVDASGNRTMRPCLSSAVKIQANEFRKEDFKGSKWLIVRYAQQNMEQIVEAIRIAKQEGLSVSLDLASFEMVRDSRSKLVNLLETGNIDLCFANEDEAREVIGGSLESDPEEALAFLGKYCKWAVVTLASKGCMAKHGKQVVRVPAIGESNAVDTTGAGDLFASGFLYGLVKGLPLEECCKVGACSGGSVTRALGGEVRPENWQWMYKQMHARGLLLPELKN

SEQ ID NO: 5814 - protein, 182 aa, Zea mays
MSPSEPTREESVYMAKLAEQAERYEEMVEFMERVARSAGGAESKVFYLKMKGDYHRYLAEFKSGAERKDAAESTMNAYKAAQDIALADLAPTHPIRLGLALNFSVFYYEILNSPDRACNLAKQAFDEAISELDSLGEESYKDSTLIMQLLRDNLTLWTSDTNEDGGDEIKDAAAPKESAEGQ

SEQ ID NO: 5815 - protein, 126 aa, Zea mays
MVGTYYRYADFIFGNETETENVEEIALKISQLPLASGKQKRTAVITQGADPVVVAEDGKVKTFPVILLPKEKLVDTNGAGDAFVGGFLSRLVQGKSIEDCVTAGCYAANVIIQRPGCTYPEKPDFN

SEQ ID NO: 5816 - protein, 357 aa, Zea mays
MVPGYDCAASVLLCAEDNAAILGLDDDGEESSSATPPRDTVAAAAAAATGVAVDGILTEFPLLSDDCVATLVEKEVEHMPAEGYLQKLQRRHGDLDLAAVRKDAIDWIWKVIEHYNFAPLTAVLSVNYLDRFLSTYEFPEGRAWMTQLLAVACLSLASKIEETFVPLPLDLQVAEAKFVFEGRTIKRMELLVLSTLKWRMHAVTACSFVEYFLHKLSDHGAPSLLARSRSSDLVLSTAKGAEFVVFRPSEIAASVALAAIGECRSSVIERAASSCKYLDKERVLRCHEMIQEKITAGSIVLKSAGSSISSVPQSPIGVLDAAACLSQQSDDATVGSPAVCYHSSSTSKRRRITRRLL

SEQ ID NO: 5817 - protein, 656 aa, Zea mays
  unsure (1)..(656): unsure at all Xaa locations
MLPWGAVGSGGWEFRNAYRRQLLALSRRIRLLGPFAEELREARRGSAEQEEQERALAPLADALEEALDLLQLGRDGSRIFLVLDRDEVMKKFHESIAQLEQALCDFPYDKLDISDEAREQVELVHAQLKRAKERVDMPDDEFYNELCSLYNKSHDPSAELDILGRLSEKLHLTTIADLTQESLALHEMVASGGGNDPGEHIEKMSMLLKKIKDFVQTQNPETGPLVTAKPMDSNGKPRPVNVPDEFRCPISLELMKDPVIVATGQTYERALIEKWLASGHHTCPSTQQRMPNTTLTPNYVLRSLITQWCEANGIDPPKRPTQQPDRPTSSCSSSERASIDALLSKLCSADPEEQRSAAAELRLLAKRNANNRIXRVAEAGAIPLLLSLLSSSNLQTQEHAVTALLNLSIHEDNKTSIISSGAVPGIVHVLKNGSMEARENAAATLFSLSVVDEYKVTIGGTGAIPALVVLLSEGSQRGKKDAAAALFNLCIYQGNKGRAIRAGLGHFIMGLVTNPTGALLDEAMAILSILSSHPEGKAAIGAAEPVPVLVEMIGSGSPRNRENAAAVMLHLSVQSVHLARAQECGIMVPLRDLALNGTERGRRKAVQLLERMSRFLVRQQEGISSHEQMLDELERQLDAFGPGVTEADILEQSGLL

SEQ ID NO: 5818 - protein, 49 aa, Zea mays
  unsure (1)..(49): unsure at all Xaa locations
VLDWFARLXELENDEYWXYITNCGTKGNLHGILFFERTWPSWFRFAKEL

SEQ ID NO: 5819 - protein, 278 aa, Zea mays
MDTAAELELGLELEQKPAAGYWSVVGARPCDACAAEPARLHCRADGAFLCPGCDARAHGAGSRHARVWLCEVCEHAPAVVTCRADAAALCAACDADIHSANPLARRHERLPVAPLFGALADAPQPFPSPAPAQGEAVAEDYGSSEAEAASWLLPEPDNSHEDSAADTFFADSDAYLGADLDFARCMDGVKAIGVPVAPPELDIGAGSFCYPEHSMNHILSSSSEVAVVPDAQVGRRRPVLVLRRGKEREARLMRYREKRKSRRFDKTIRYASRKAYAE

SEQ ID NO: 5820 - protein, 253 aa, Zea mays
MDVKCRRLEGKVAVVTASTQGIGLAIAERLGLEGAAAVVSSRKQKNVDEAVEGLKAKGITVVGAVCHVSDAQQRKNIIETAVKNFGHIDILVSNAAANPTVNVILEMKEVVLDKLWDINVKASILLIQDAAPHLRAGSSVILISSIAGYNPEQGLTMYGVTKTALFGLTKALAGEMGPDIRVNCIAPGFVPTRFASFFIDNETIRKKLNERTMLKRLGSVEDMAAAAAFLASDDASFITAETIVVAGGVPSRL

SEQ ID NO: 5821 - protein, 604 aa, Zea mays
MQGLAPPTSVSIHRHLPARSRARASNSVRFSPRAVSSVPPAECLQAPFHKPVADLPAPSRKPAAIAVPGHAAAPRKAEGGKKQLNLFQRAAAAALDAFEEGFVANVLERPHGLPSTADPAVQIAGNFAPVGERPPVHELPVSGRIPPFIDGVYARNGANPCFDPVAGHHLFDGDGMVHALRIRNGAAESYACRFTETARLRQERAIGRPVFPKAIGELHGHSGIARLALFYARAACGLVDPSAGTGVANAGLVYFNGRLLAMSEDDLPYHVRVADDGDLETVGRYDFDGQLGCAMIAHPKLDPATGELHALSYDVIKRPYLKYFYFRPDGTKSDDVEIPLEQPTMIHDFAITENFVVVPDHQVVFKLQEMLRGGSPVVLDKEKTSRFGVLPKHAADASEMAWVDVPDCFCFHLWNAWEDEATGEVVVIGSCMTPADSIFNESDERLESVLTEIRLDARTGRSTRRAVLPPSQQENLEVGMVNRNLLGRESRYAYLAVAEPWPKESGFAKEDLSTGELTKFEYGEGRFGGEPCFVPMDPAAAHPRGEDDGYVLTFVHDERAGTSELLVVNAADIRLEATVQLPSRVPFGFHGTFITGQELEAQAA

SEQ ID NO: 5822 - protein, 631 aa, Zea mays
MGRGADEVVKVVDSEDGEGEEEEAEAAAAEGSSKETPMLPRMPVRVLLAEGDDSTRHVISALLRKCGYRVAAASDGVKAWDILKEKSFNIDLVLTEVELPLMSGFLLLSTIMEHDASKNIPVIMMSSHDSVSMVFKCMLKGASDFLVKPLRKNELRNLWQHVWRKQLANGGPDVQHIQEENLAERMEQKTGVTKDDNLNSDGPCKNRECSEQESDAQSSCTRSELEAESKQTNNILEYMQSTERHLSIRSHKDLELNGETKTRTKGNNLIPTREDDLLPKKRTCLNDNNSERTSRDMELVHIMDNQQKHDTQRDVDTMRTTSRRNDEKNSIPAHQLELSLRRTDYGKLENHEKNDRRTLNHSTSSAFYLYNCRTASSLGNAGDGQLCSTSETLVDVENRNGDLAALSEDTTETNRPPIRVVPFPVPVQCFTFDGQPFWNGTPVASPFYPQSAPPIWNSKTPTWQESTPQATSLPQKSQQKEPVEMDAKPVENAEEQFVVGPPSASGKQLHVEIPKDDLRHISPVTGESGISTVLDSTRNTLSSSGCDSTSNQITAPTEPSSNVYRGVPETARAEGLRHLSQREAALNKFRLKRKDRCFEKKVRYQSRKLLAEQRPRVKGQFVRQDHSIQGS

SEQ ID NO: 5823 - protein, 179 aa, Zea mays
AVTGALFGLATEIGLVRGAGVGAISGAVVSMKVVDSSVAIWRSDESGIWSVLYVLDVLWSLVTGRLVREKVDPAVQSAVDSQMNAADSQDTAPTLADMFETAAAGMPAAAIAALPVTAVTESTVTDASGEPIGCPICLQDFEAGETARRLPECGHTFHLPCIDVWLLRHASCPLCRRAV

SEQ ID NO: 5824 - protein, 328 aa, Zea mays
MAATPDERKQERPMRPATSPASVVADFAMGGAAAVVAKTGAAPVERVKLLLQNQAEMLRRGTLTRPYRGIADAFTRILREEGPAALWRGNQANVIRYFPTQAFNFAFRGYFKSFFGYDREKDGKWKWLAGNVASGSAAGATTSLLLYHLDYARTRLATDAIESRGTKRQFRGLLDVYKKTLTTDGMSGLYRGFSVSITGISLYRGLYFGIYDSMKPLVLVGPLEGNFFASFVLGWTITTFSGACAYPFDTVRRRMMLTSGEPFKYKNGFHAVKLIVSTEGFFTLFRGVGANILSGLAGAGVLSGYDQLQRLASRHDQNFEHNMKGALK

SEQ ID NO: 5825 - protein, 376 aa, Zea mays
CSSASAAASSASSAVVDIRHVARHFSSNMIRSLVFGKRHFGGGAGPGAEEVAHVDALFALLNYVYIFSVSDYVPAAWRWMVAGLDLGGDREAGRSVMRTLSRLHDPIIRERIHEWDGLRERGEKREVRDFLDALVSLVDSQGRPFLSFDEIKAQTAVQMMFATIDNPSNTVEWALAEMMNRPEVMHKAMEELDTVVGKDRLVQEPDIPRLNYLKACVREAFRMHPYHAFNPPHVATEDAIVSGYLIPKGSHVLLSRVGLGRNPDVWDAPLQFRPERHLMMNENDDVDDRYHHVVLTEPDLRFISFSAGRRGCPGVSLGSSVTMMLFARLLQGFTWTKPPGVRAIRLQESSTSLALAEPLLLQAQPRLPVHLYAASG

SEQ ID NO: 5826 - protein, 312 aa, Zea mays
VALSSLQKLDFKFPLTVSCVHFICSSIGAYIAIHVLKAKPLIQVEPEDRWKRIFPMSFVFCINIVLGNVSLRYIPVSFMQTIKSFTPATTVILQWLVWSKHFEWRIWASLVPIVGGILLTSVTELSFNIFGFCAAMVGCLATSTKTILAESLLHGYKFDSINTVYYMAPFATMILALPAMVLEGGGVMNWFYTHDSIVPALTIILGSGVLAFCLNFSIFYVIHSTTAVTFNVAGNLKVAVAVLVSWSIFRNPISAMNAIGCGITLVGCTFYGYVRHLISQRQAAAPGSLGTAQARNQTEMLPLVVDEKQEKV

SEQ ID NO: 5827 - protein, 87 aa, Zea mays
  unsure (1)..(87): unsure at all Xaa locations
KNCLKEAGIGTMLNELSSPVVFKGQRIKNFFXRWQLAFXRNIAPVVVMPSVNIAKVDYFLNELVXKRAPWFQDGINQPPCISKKVGV

SEQ ID NO: 5828 - protein, 1075 aa, Zea mays
MAANKGMVAGSHNRNEFVMIRHDGDVPGSAKPTKSANGQVCQICGDSVGVSATGDVFVACNECAFPVCRPCYEYERKEGNQCCPQCKTRYKRQKGSPRVHGDEDEEDVDDLDNEFNYKQGSGKGPEWQLQGDDADLSSSARHEPHHRIPRLTSGQQISGEIPDASPDRHSIRSPTSSYVDPSVPVPVRIVDPSKDLNSYGLNSVDWKERVESWRVKQDKNMMQVTNKYPEARGGDMEGTGSNGEDMQMVDDARLPLSRIVPISSNQLNLYRVVIILRLIILCFFFQYRVSHPVRDAYGLWLVSVICEVWFALSWLLDQFPKWYPINRETYLDRLALRYDREGEPSQLAPIDVFVSTVDPLKEPPLITANTVLSILSVDYPVDKVSCYVSDDGSAMLTFESLSETAEFARKWVPFCKKHNIEPRAPEFYFAQKIDYLKDKIQPSFVKERRAMKREYEEFKVRINALVAKAQKVPEEGWTMADGTAWPGNNPRDHPGMIQVFLGHSGGLDTDGNELPRLVYVSREKRPGFQHHKKAGAMNALIRVSAVLTNGAYLLNVDCDHYFNSSKALREAMCFMMDPALGRKTCYVQFPQRFDGIDLHDRYANRNIVFFDINMKGLDGIQGPVYVGTGCCFNRQALYGYDPVLTEADLEPNIVIKSCCGRRKKKNKSYMDSQSRIMKRTESSAPIFNMEDIEEGIEGYEDERSVLMSQRKLEKRFGQSPIFIASTFMTQGGIPPSTNPASLLKEAIHVISCGYEDKTEWGKEIGWIYGSVTEDILTGFKMHARGWQSIYCMPPRPCFKGSAPINLSDRLNQVLRWALGSVEILLSRHCPIWYGYNGRLKLLERLAYINTIVYPITSIPLIAYCVLPAICLLTNKFIIPEISNYAGMFFILLFASIFATGILELRWSGVGIEDWWRNEQFWVIGGTSAHLFAVFQGLLKVLAGIDTNFTVTSKASDEDGDFAELYVFKWTSLLIPPTTVLVINLVGMVAGISYAINSGYQSWGPLFGKLFFSIWVILHLYPFLKGLMGRQNRTPTIVIVWSILLASIFSLLWVKIDPFISPTQKAAALGQCGVNC

SEQ ID NO: 5829 - protein, 649 aa, Zea mays
  unsure (1)..(649): unsure at all Xaa locations
TLAGSLIPVPHPSPFAKITAAGDSKNLHAHARPRSPASRPRAVADSLSDPDPMGGEVPEPRRLSRSLSFGCGGVPEEALHLVLGYVDDPRDREAASLVCRRWHRIDALSRKHVTVGFCYAVEPARLLARFRRLESLALKGRPRAAMYGLIPEDFGAYAAPWVAELAAPLDCLKALHLRRMTVTDEDIAVLVRARGHMLQVLKLDKCSGFSTDALRLVARSCRSLRTLFLEECIIADEGSEWLHELAVNNSVLVTLNFYMTELKVEPADLELLARNCKSLISLKMSDCDLSDLIGFLQTSKALQEFAGGAFFEVGEYTKYEKVKLPPRLCFLGGLTFMGKNEMPVIFPYSASLKKLDLQYTFLTTEDHCQLIAKCPNLLVLEVRNVIGDRGLEVVADTCKKLRRLRIERGDDDPGQEEQGGVSQIGLTAVAVGCRELEYIAAYVSDITNGALESIGTFCKNMYDFRLVLLDKQNKITDLPLXDNGVRALLRSCTKLRRFALYLRPGGLSDAGLGYVGQYSGNIQYMLLGNVGESDNGLIRFAMGCANLRKLELRGCCFSERALAVAVLQMPSLRYVWVQGYRASQTGRDLMLMARPYWNIEFVPPRPESACRVMADGQPCVDTHAQVLAYYSLAGRRPDCPRWLVTLHPA

SEQ ID NO: 5830 - protein, 256 aa, Zea mays
MSREENVYMAKLAEQAERYEEMVEYMEKVAKTVDVEELTVEERNLLSVAYKNVIGARRASWRIVSSIEQKEESRKNEEHVNLIKEYRGKIEAELSNICDGILKLLDSHLVPSSTAAESKVFYLKMKGDYHRYLAEFKTGAERKESAESTMVAYKAAQDIALAELAPTHPIRLGLALNFSVFYYEILNSPDKACNLAKQAFDEAISELDSLGEESYKDSTLIMQLLRDNLTLWTSDLTEDGADEGKDAPKGDAGEGQ

SEQ ID NO: 5831 - protein, 194 aa, Zea mays
MALSVEKTSSGREYKVRWCSCNIFSTQDHAAAAIARDSAAVFAWKGETLEEYWWCTERCLDWGEAGGPDLIVDDGGDATLLIHEGVKAEEDYEKTGKIPDPESTDNAEFKIVLTIIRDGLKADPKKYRKMKERLVGVSEETTTGVKRLYQMQETGALLFPAINVNDSVTQSKVDTLYGCRHSLPDGLMRATDVM

SEQ ID NO: 5832 - protein, 393 aa, Zea mays
MAPSCYDAAASMLLCAEEHSSILWYDEEEEELEAVGRRRGRSPGYGDDFGADLFPPQSEECVAGLVERERDHMPGPCYGDRLRGGGGCLCVRREAVDWIWKAYTHHRFRPLTAYLAVNYLDRFLSLSEVPDGKDWMTQLLAVACVSLAAKMEETAVPQCLDLQEVGDARYVFEAKTVQRMELLVLTTLNWRMHAVTPFSYVDYFLNKLSNGGSTAPRSCWLLQSAELILRAARGTGCVGFRPSEIAAAVAAAVAGDVDDADGVENACCAHVDKERVLRCQEAIGSMASSAAIDGDATVPPKSARRRSSPVPVPVPVPQSPVGVLDAAACLSYRSEEAATATATATSAASHGPPGSSSSSSTSPVTSKRRKLASRCDGSCSDRSKRAPAQWTKE

SEQ ID NO: 5833 - protein, 252 aa, Zea mays
  unsure (1)..(252): unsure at all Xaa locations
VRLQVPVRNSRVDPRVRFDTRAPMAAQGMVETRVFLQYLPAIRALWEDSGIQNAYDRRREFQLGESVKYFLDNLDKLGVPDYIPSQQDILLARRPTKGIHEYDFEIKNVPFKMVDVGGQRSERKRWFECFDSVTSILFLVSSSEFDQVLMEDRQTNRLTESLNIFETIVNNRVFSNVSIILFLNKTDLLEEKVQVVSIKDYFLEFEGDPHCLRDVQKFLVECFRXKRRDQQQRPXLYHHFTTAINTEKHXLV

SEQ ID NO: 5834 - protein, 90 aa, Zea mays
  unsure (1)..(90): unsure at all Xaa locations
RNLLSVAYKNVIGARRXSWRIVTSIEQKEESKGNESQVTLIKEYRQKIETELAKICEDILEVLDKHLIPSAQTGESKVFYHKMKGDYHRY

SEQ ID NO: 5835 - protein, 213 aa, Zea mays
QLRRRDESPKLPLPSPRASGSLTRSGSGSLEGGAVALFDMEFSNGEFTESEKKKIMANERLAEIALTDPKRVKRILANRQSAARSKERKMRYIQELEHKVQVLQTEATTLSAQLTMLQRDSAGLATQNNELKIRLQAMEQQAQLRDALNEALTGEVQRLKLATGEMTDGPMPKGLQQQMNSQMLQLQQLQIQQQAPPQQTQQQGQRQQPQKSA

SEQ ID NO: 5836 - protein, 216 aa, Zea mays
  unsure (1)..(216): unsure at all Xaa locations
MPRSWMILLLVLCSAAVLAQAATVEHTFNINXTEGLQVATISWPRICQPGNVSITAVDGVPGPVIEANEGDTVLVHVINHSPLNVTVHWHGVFQLGTPWADGPSMVTQCPICPGHRYTYRFRITGQEGTLWWHAHSSLLRATVYGALIIRPSSGSAYPFPAPDEEKTVLLGEWWNAETVPLTNPVADAYTINGRPGDSYSCETTAKRKCWTAGLIV

SEQ ID NO: 5837 - protein, 357 aa, Zea mays
MGRDGGGGVAGGMSDSVLRKVLLSYFYVAVWIFLSFSVIVYNKYILDPKMYNWPFPISLTMVHMGFCSSLAVALVRVLRVVELPTSPSMTPQFYTSSVVPIGALYAMSLWFSNSAYIYLSVSFIQMLKALMPVAVYSIGVLFKKETFRSSSMLNMLSISFGVAIAAYGEARFDVRGVALQLAAVAFEATRLVLIQILLTSKGISLDLPTSLYYVAPCCLCFLVVPWVFVELPRLRAVGTFQPDFFVFGTNSLCAFALNLAVFLLVGKTSALTMNVAGVVKDWLLIAFSWSVIRDTVTPINLFGYGIAFLGVAYYNHVKLQALKAKEAQKKAAQADEEVGSLLQERDGHGDHKSDNQA

SEQ ID NO: 5838 - protein, 75 aa, Zea mays
  unsure (1)..(75): unsure at all Xaa locations
KLNGERALAELSREENVYMAKLAXQAERYEEMAEFMEKVAKTVDSEELTVEERNLLSAAYKNVIGARRALWRIIF

SEQ ID NO: 5839 - protein, 431 aa, Zea mays
MVGSVGNGLADLGARAVSMNGAGKALRPAGAAAAAAAAETLPMELDPSEALVAAAVEAKGEEAANGRREFVMGRNVHTSCFAVKEPDADDEETGEREATMASVLALYRRSLVERTKHHLGYPYNLDFDYGALTQLQHFSINNLGDPFIESNYGVHSRQFEVGVLDWFARLWELEKDEYWGYITNCGTEGNLHGILVGREVFPDGILYASRESHYSVFKAARMYRMDCVKVDTLMSGEIDCADFQRKLLQNRDKPAIINVNIGTTVKGAVDDLDLVIKTLEENGFKDRFYIHCDGALFGLMIPFVKKAPQVTFKKPIGSVSVSGHKFVGCPMPCGVQITRLEHINALSSNVEYLASRDATIMGSRNGHAPIFLWYTLNRKGYRGFQKEVQKCLRNAHYLKDCLDAPPPAKLRKGLRLRFLAATDMVGSMGNG

SEQ ID NO: 5840 - protein, 165 aa, Zea mays
DPVIASSGPRLPGTSHSIPFSEPTEAAAYITVLYLKMKGDYHRYLAENKTGAERKDVEDSTLAANHSAHDIVVKELPPTHPIRLALALNFCEFYYEILSPRVRGRVGAKQAFDEAISELDTLGEESYKDSTLIMQLLRDNLTLWTSDMQEDGSDEMRDASKPDDE

SEQ ID NO: 5841 - protein, 849 aa, Zea mays
MARIMTTRRSDSIADMMPEALRQSRYYMKSCFQRYVSRGSRLMKQQHLLEELHAGSSDSFLGHVISCTHEAVVLPPYVALAVRRNPGVWEYITVHSGDLTVQQITPSDYLRRKESLYDDHWAQDDNSLEVNLSLCLSTPRLTLPSSIGNGMHLLSRFLSSSLGGVNKIKPLLDYLLALRYQNTKLLISDTLLDTVGKLQAALLLAQAFVSEQHPDTPFQQMAHRFHEWGLEKGWGDTAGACGQTLGFLSEMLQAPDPVSVDRFFSRVPSVFDVVIFSVHGYFGQHKVLGMPDTGGQVVYILDQVRALEEELLQRIKGQGLTFKPNILVVTRLIPEAKGTTCNVELEPIDKTRHSSILRVPFKTQDGQDLPHWVSRFDIYPYLERYAQDSCTKILHILGRKPDLVIGNYTDGNLVAYLVSRKLGVTQGTIAHALEKTKYEDSDVKWREMDHRYHFSCQFTADMIAMNTSDFIIASTYQEIAGSKDKPGQYESHYAFTMPGLCRFATGISVFDPKFNIAAPGADQSVYFPFTLKHKRLMGLHPQIEELVYGKEENDEHIGYLQDRSKPVIFSMARLDKVKNITGLVEWYGQNKRLRDLANLVVVGGLLDPKHSKDREEIEEINEMHSLINKYQLKGQIRWIKAQTDRVRNGELYRCVADTRGAFVQPALYEAFGLTVIEAMNCGLPTFATNQGGPAEIIVNEVSGFHINPLDGKEASNKIANFFQKCNEDPMYWNRMSTAGLQRIYECYTWQIYATKVLNMGSMYGFWRTLDKQEKQDKQHYLHMFYNLHYRKLANTVPKVGEQPEQATAAALPDRSATRPKERGTQIRIQRTVSNLLGPVLPASHLSDAA

SEQ ID NO: 5842 - protein, 226 aa, Zea mays
MEANRGMVAGSRGGVVTIRHDGDGAAAKQLKNVNEQICQICGDTLGLSATGDIFVACNECAFPVCRPCYEYERKEGNQCCPQCKTRYKRHKGSPRVRGDEEEDGVDDLDNEFNYTQGNVQGPQWQLQGQGEDVDISSSSRHEPHHRIPRLTTGQQMSGDIPDASPDRNSIRSPTPSYVDPSIPVPVRIVDPSKDLNSYGVGSVDWKERVESWKVRQDKNMIQVRQQ

SEQ ID NO: 5843 - protein, 268 aa, Zea mays; identical to SEQ ID NO: 5562

SEQ ID NO: 5844 - protein, 267 aa, Zea mays; identical to SEQ ID NO: 1198

SEQ ID NO: 5845 - protein, 542 aa, Zea mays
VEFGQLIHDFDIYGDEDNPSPASEDPSIWFEIMRFFTNPRKPMILAIARPYAEKNIATLVKAFGECHPLRELANLTLIMGNREAISKMNKISAAVLTSVLTLIDEYDLYGQVAYPKHHKHSEVPDIYRLAARTKGAFINVAYFEQFGVTLIEAAMHGLPVIATKNGAPVEIHQVLENGLLVDPHDQHAIADALYKMLSEKQFWSRCRENGLKNIHQFSWPEHCKNYLSRILTLGPKHPAFACKEDHKVPVKCRKHIFVIAVDSVNKEDLIQIIRNSVEATRSGTMSDLTGFVLSTSLTIAELQSVIVRTGMLPTDFDAFICNSGSDIYYPSQSSDVPSNSRVTFASDHNYRSHIEYRWGGEGLRKYLVKWASSVVERRGRTEKQVIFEDSEHSSTYCLAFKVINPSHLPPLKELQKLMRIQSLRCHALYNHGATRLSVIPIHASRSQALRYLSICWGIELPDAVVIVGETGDSDYEELFGGLHKTVILKGGFNTPANRIHTVRRYPLQDVVALDSSNIIAIEGFSTGDIRSAMQQKLGIPTR

SEQ ID NO: 5846 - protein, 350 aa, Zea mays
MEVEESFDAGVEDEQAAAEVIGSEKTSADYYFDSYSHFGIHESEMLKDVVRTKTYQNVITQSSFLIKNKVVLDVGAGTGILSLFCAKAGAKHVYAIECSQMADMAQEIVKSNGYSDVITVIKGKVEEIELPVPKVDVIISEWMGYFLLFENMLNTVLYARDKWLADGGVVLPDRTSLRLTAIEDAEYKEDKIEFWNNVYGFDMSCIKKQAMMEPLVDTVDANQIVTNCQLLKTMDISKMTPGDASFTVPFKLVAERNDYIHALVAYFDVSFTKCHKLMGFSTGPRSKATHWKQTVLYLEDVITICQGESLSGSMTVTPNKSNPRDIDIKLKYSINGHRCQVSRTQFYKMR

SEQ ID NO: 5847 - protein, 406 aa, Zea mays
NLQVDHHDEENLSLLRFGALWESVYCEDSLLVFSTGRSPTLYKELRKEKPMLTPDITIMSVGTEITYGEAMVPDDGWEEYLNNKWDRNIVVAETVSFSELKLQPETEQRPHKVSFFVDKKNAQEVIKSVAERLDKCGLDAKIIYSGGQDLDILPQGAGKGQALAYLLKKLSSCGKPPNNTLVCGDSGNDAELFSIPGVHGVMVSNAQEELLQWYTENAKDNPKIIHSNERCAAGIIQAIGHFKLGPNISPRDLQFPYAKEASFKPTDAVVKFYVLYEKWRRAEVPKSDSVIKYFKNITHANGVTIHPAGLELSLHASIDALGSCYGDKQGRKYRAWVDRLFITQTGSDSWVGRFDLWESEGDVRACSLSSLALILKAESPEGFVLTHIQKTWLNGYSSGVEQAFKL

SEQ ID NO: 5848 - protein, 486 aa, Zea mays
  unsure (1)..(486): unsure at all Xaa locations
MALSVEKTASGREYKVKDLSQADFGRLELELAEVEMPGLMACRAEFGPSQPFAGARISGSLHMTIQTAVLIETLTALGAEVRWCSCNIFSTQDHAAAAIARDSAAVFAWKGETLEEYWWCTERCLDWGAGGXGPDLIVDDGGDATLLIHEGVKAEEDYEKTGKIPDPESTDNAEFKIVLTIIRDGLKADPKKYRKMKERLVGVSEETTTGVKRLYQMQETGALLFPAINVNDSVTKSKFDNLYGCRHSLPDGLMRATDVMIAGKVAVVCGYGDVGKGCAAALKQAGARVIVTEIDPICALQALMEGLQVLPLEDVVSEADIFVTTTGNKDIIMVDHMRKMKNNAIVCNIGHFDNEIDMLGLETYPGVKRITIKPQTDRWVFPETNTGIIVLAEGRLMNLGCATGHPSFVMSCSFTNQVIAQLELWKEKSSGKYEKKVYVLPKHLDEKVAALHLGKLGAKLTKLTKSQADYISVPIEGPYKPAHYRY

SEQ ID NO: 5849 - protein, 146 aa, Zea mays
  unsure (1)..(146): unsure at all Xaa locations
MEMKLTIRRVPTVVSNYQEDADKPRAGCGRNCLGDCCLPASKLPLYAFKLTPAKGSQEDAASTKLLLLVDILLSEWEDRMTRGLFRYDVTACETKVIPGNLGFVAQLNEGRHLKKRPTEFRVDRVLQPXFDPAKFNFTKVGQEEVL

SEQ ID NO: 5850 - protein, 423 aa, Zea mays
  unsure (1)..(423): unsure at all Xaa locations
HCFRRGADGYLYCEGVRVEDAMAAAERSPFYLYSKLQILRNFAAYRDALQGLRSIVGYAVKANNNLPVLRVLRELGCGAVLVSGNELRLALQAGFDPARCIFNGNGKTLEDLKLAAESGVFVNVDSEFDLENIVRAARATGKKVPVLLRINPDVDPQVHPYVATGNKTSKFGIRNEKLQWXXNSIKSYSNEIKLVGVHCHLGSTITKVDIFRDAAVLMVNYVDEIRAQGFKLEYLNIGGGLGIDYHHTDAVLPTPMDLINTVRELVLSQDLTLIIEPGRSLIANTCCFVNRVTGVKSNGTKNFIVVDGSMAELIRPSLYGAYQHIELVSPPTPGAEVATFDIVGPVCESADFLGKDRELPTPDEGAGLVVHDAGAYCMSMASTYNLKLRPPEYWVQTTIHIWCPLGSGASLTKISCCNISKDH

SEQ ID NO: 5851 - protein, 273 aa, Zea mays
  unsure (1)..(273): unsure at all Xaa locations
MDAAAAAAARGDTKKKKMLATLVGCNYAGTPYELQGCINDVHAMRAVLLARFGFAPADVTVLTDDQHGRGGGGGVLPTGAAVRRALDDMVARAAPGDVLFFHFSGHGTLVPPVGGGRRRERPRHARPAGRTGSGHGDRDDEAIVPCDFNLITDVDFRELVDRLPRGATFTMVSDSCHSGGLIDQEKEQIGPTTAAADSYLHGGARAARFLPYAAVLGHLSGAXGGGAXASHHVXDHLVALFGADASAKFRFHRHHGRSGAAARTDDDDAGILV

SEQ ID NO: 5852 - protein, 142 aa, Zea mays
MAAVDARVFYLKMKGDYHRYLAEFKTGAERKDAADSTLAAYQAAQDIAVKELPPTHPIRLGLALNFSVFYYEILSSPDRACSLAKQAFDEAISELDSLGEESYKDSTLIMQLLRDNLTLWTSDMQEDGGDEMRDANKPDEEQ

SEQ ID NO: 5853 - protein, 212 aa, Zea mays
  unsure (1)..(212): unsure at all Xaa locations
PSRPAGSCGISIGLGATLNVAKPAKGSTVAIFGLGXAVGTCLLCEGARLAGASRIIGVDINPAKYEQAKKFGCTEFVNPKDHDKPVQEVLIELTNGGVDRSVECTGNVNAMISAFECVHDGWGVAVLVGVPHKDDQFKTHPMNFLSEKTLKGTFFGNYKPRTDLPNVVEMYMKKELELEKFITHSVPFSEINTAFDLMLKGESLRCIMRMED

SEQ ID NO: 5854 - protein, 349 aa, Zea mays
MDGTSFDLTEHEGSNLSPFLLKLFNEWDDRKTRGLFHHDISSCETKVLPGVHNFVATLIEGRDQKKRPTEFTMNQVLQPFVSEKFNFTKVSPLEVIFRFNDTEKDPAQYFDGVPDTVSASSSAILINVSPIGYCHVLLTPKIQDCLPQRIDQESFLIAMYVAREARTPFFRVGYNSLGGFATINHLHFQAYYLKVQYPVEKAITEKLKTLGNSVSIFHLVDYPVNGFVFEGGASLEDLSDVVSKVCIFLQENNRPFNVLISESGKRIFLLPQCYAEKQLLGKASQEFLDMRINPAIWELSGHLVLKRRKDYEEASEANIRRFLVEAALSETEFQELNRCVLDFLTSSLG

SEQ ID NO: 5855 - protein, 231 aa, Zea mays
MGRGKVQLKRIENKINRQVTFSKRRSGLLKKAHEISVLCDAEVALIIFSTKGKLYEYSTDSCMDKILERYERYSYAEKVLISAEYETQGNWCHEYRKLKAKVETIQKCQKHLMGEDLETLNLKELQQLEQQLESSLKHIRTRKSQLMVESISALQRKLAEKQKDQRQQVQRDQTQQQTSSSSMSFMLREAAPTTNVSIFPVAAGGRVVEGAAAQPQARVGLPPWMLSHLSC

SEQ ID NO: 5856 - protein, 96 aa, Zea mays
DIALAELAPTHPIRLGLALNFSVFYYEILNSPDKACNLAKQAFDEAISQLDTLGEESYKDSTLIMQLLRDNLTLWTSDLTEDGADEGKEAPKGEGW

SEQ ID NO: 5857 - protein, 494 aa, Zea mays
  unsure (1)..(494): unsure at all Xaa locations
MVLSHGVGGSDESVHSTFASRYVRTSLPRYRMPEQSIPKEAAYQIINDELMLDGNPRLNLASFVTTWMEPECDKLIQASVNKNYVDMDEYPVTTELQNRCVNMIAHLFNAPLGDAETAVGVGTVGSSEAIMLAGLAFKRRWQNKMKAAGKPCDKPNIVTGANVQVCWEKFARYFEVELKEVKLSDGYYVMDPQKAVDMVDENTICVAAILXGSTLNGEFEDVKLLNDLLTKKNAETGWDTPIHVDAASGGFIAPFLYPELEWDFRLPLVKSINVSGHKYGLVYAGIGWCIWRTKADLPEELIFHINYLGADQPTFTLNFSKGSSQVIAQYYQLIRLGFEGYKNIMENCQENATVLKQGLEKTGKFNIVSKDNGVPLVAFSLKDNSRHNEFEISDFLRRFGWIVPAYTMPPDAQHVTVLRVVIREDFSRTLAERLVLDIEKVLHELDALPARVPSGDLAALAAAESSEREMEKKRQVISLWKRAVLAKKKTNGVC

SEQ ID NO: 5858 - protein, 168 aa, Zea mays
CFRFPRGNGVGAALPPGNKGVALEVGRGRVLVGGGTRVALLGYGAMVQACLKAAEALKEHDVYVTVADARFCKPLDTALIRELAAEHEVLITAEEGSIGGFGSHVAHYLSLTGLLDGPLKLRSMFLPDRYIDHGAPQDQIEEAGLTPRHIAATVLSLLGRPLEAMQLK

SEQ ID NO: 5859 - protein, 220 aa, Zea mays
  unsure (1)..(220): unsure at all Xaa locations
MADELRSTSVGQKFHGQSVLLSRISSYSAMNNPLFNNAYSAYNVPQRSYHGMNATAGLSSVMAPSPVFASAPKEKGFSGFMIDFMMGGVSAAVSKTAAAPIERVKLLIQNQDEMLRTGRLSEPYKGIGDCFGRTIRDEGFVSLWRGNTANVIRYFPTQALNFAFKDHFKRMFNFKKDKDGYWKWFAGNLASGGAAXACSLFFGYSLDYARTRLANDAKLQ

SEQ ID NO: 5860 - protein, 816 aa, Zea mays; identical to SEQ ID NO: 5490

SEQ ID NO: 5861 - protein, 408 aa, Zea mays
  unsure (1)..(408): unsure at all Xaa locations
MDDAGRAPPPAPAAVTVSATAAPAPTPPSATVAADKSSLDPDALYEEGMWQQMAMNSGATMQPGSYPERPGEPDCTYYLRTGLCRFGMSCRFNHPPDRNLAIASARMKGEYPERVGQPECQXKAGIAGRVQLNTLGYPLRPNEKXECAYYLKTGQCKYANTCKFHHPELFNVVPSSRGSPIYTSVHSSASAGPQSYTGTMSSWTFPRASFIPSPRWQSPSNYAPMIVPHGLVQVPSWNSYPGQLQSPGAQQTYGSSQQGEASAGNQGMLSPYRSSSFPVPQYVLQRDNVFPERPDEPECQYYMKTGDCKFGAVCKFHHPRVRSQPPPDCVLSPMGLPIRPGEELCKFYSRYGICKFGANCKFDHPTMAAPMGVYAYGFSGSASVAPASTNAPMTRHLLGSPSGSGYMS

SEQ ID NO: 5862 - protein, 335 aa, Zea mays
EREMSALKKSDKKAALDFAAWSFNVTTSVGLIMVNKALMATYGFSFATTLTGLHFVTTTLMTIVFRWLGLSQPSHLPLADLVKFVIFSNLSIVGMNVSLMWNSVGFYQIAKLCMIPASCLLEVVFDHVHYSRDTKLSIMVVLIGVAVCTVTDVSVNARGLIAAVIAVWSTALQQYYVHFLQRKYSLNSFNLLGHTAPAQAGSLLLVGPFADYLLTGKRVDHFSFSSLALFFLALSCFIAIGVNLSQFICIGRFSAVSFQVLGHMKTVLVLSLGFLFFGKEGLNLQVVLGMVLAVLGMIWYGNASAKPGGKERRSILPVRSASLKGSSEEKGGAEK

SEQ ID NO: 5863 - protein, 390 aa, Zea mays
MSVLTCVIESMGSSCSRSHSFDEAEAAENAKSADIDRRILQETKAEQHIHKLLLLGAGESGKSTIFKQIKLLFQTGFDEAELRSYTSVIHANVYQTIKILYEGAKELAQVEPDSSKYVLSPDNQEIGEKLSEIGARLEYPSLNKERVQDVRKLWQDPAIQETYSRGSILQVPDCAQYFMENLDKLSEEDYVPTKEDVLHARVRTNGVVETQFSPLGESKRGGEVYRLYDVGGQRNERRKWIHLFEGVNAVIFCAAISEYDQMLFEDETKNRMMETKELFDWVLKQRCFEKTSFMLFLNKFDIFERKIQKVPLSVCEWFKDYQPTAPGKQEVEHAYEFVKKKFEELYFQSSKPDRVDRVFKIYRTTALDQKLVKKTFKLIDESMRRSREGT

SEQ ID NO: 5864 - protein, 140 aa, Zea mays
MAEEKHHHHHLFHHKKDEEQEEQLAGGGYGESAEYTEATVTEVVSTGENEYDEYKEEKQHKHKQHLGEAGAIAAGAFALYEKHEAKKDPEHAHRHKIEEEVAAAAAVGSGGFAFHEHHEKKKDHKEAEEAGGEKKHHFFG

SEQ ID NO: 5865 - protein, 140 aa, Zea mays
  unsure (1)..(140): unsure at all Xaa locations
MADEKHHHHHLFHHKKDEEQXSSSPAVVTGEGALYTEATVTEVVSTGENXYDEYNEEKHHKHKQHLGXAGAIVTGAFTLYEKHEAKKDPEHAHRHKIDEEVAAAAAVCSGGFAFHEHHEXKKDHKDAXEAGGEKKHHFFG

SEQ ID NO: 5866 - protein, 180 aa, Zea mays
MRGAEEERSGAATDAGGEEEKRERSVGLMAGLMDKAKGFVVEKVTQIPKPEAALDHVSFRSISREGVELHSHVDISNPYSHRIPICEITYTFKSAGKVIASGTMPDPGWIAASGSTKLDLPVKVPYDFIVSLMKDLGGDWDIDYMMEVGLTVDLPAIGAFTIPLTTEGEIKLPTFRDLLF

SEQ ID NO: 5867 - protein, 375 aa, Zea mays
MGAEAAHGHPQQQPPSSLRPGREAAAPPAVVGLQLSALIDHVARVDWSLLDRVPGDRGGSQQVSIDELNHILDEVNAHILPSRNDLTPVTTIAGGSVANTIRGLSAGFGISTGIIGACGDDNQGLLFVNNMSFSGVDLTRLRAKKGHTAQCVCLVDASGNRTMRPCLSSAVKIQANEFRKEDFKGSKWLIVRYAQQNMEQIVEAIRIAKQEGLSVSLDLASFEMVRDSRSKLVNLLETGNIDLCFANEDEAREVIGGSLESDPEEALAFLGKYCKWAVVTLASKGCVAKHGKQVVRVPAIGESNAVDTTGAGDLFASGFLYGLVKGLPLEECCKVGACSGGSVTRALGGEVRPENWQWMYKQMHARGLLLPELKN

SEQ ID NO: 5868 - protein, 255 aa, Zea mays; identical to SEQ ID NO: 5594

SEQ ID NO: 5869 - protein, 366 aa, Zea mays
MGKEKNGDSLPPFPFTIVETLAPPRRRHAGSVGAMSKARVYADVNVLRPKEYWDYEALTVQWGEQDDYEVVRKVGRGKYSEVFEGINVNNNEKCIIKILKPVKKKKIKREIKILQNLCGGPNIVKLLDIVRDQHSKTPSLIFEYVNNTDFKVLYPTLTDYDIRYYIYELLKALDYCHSQGIMHRDVKPHNVMIDHELRKLRLIDWGLAEFYHPGKEYNVRVASRYFKGPELLVDLQDYDYSLDMWSLGCMFAGMIFRKEPFFYGHDNHDQLVKIAKVLGTDGLNAYLNKYRIELDPQLEALVGRHSRKPWLKFMNADNQHLVSPEAIDFLDKLLRYDHQERLTALEAMTHPYFQQVRAAENSRTRA

SEQ ID NO: 5870 - protein, 387 aa, Zea mays
MADQANQPTVLHKLGGQFHLSSSFSEGVRARNICPSVSSYERSFATRNYMTQSLFSPSMSVTGGINVPVMRTPLFANAPAEKGGKNFMIDFMMGGVSAAVSKTAAAPIERVKLLIQNQDEMIKSGRLSEPYKGIGDCFKRTIKDEGFSSLWRGNTANVIRYFPTQALNFAFKDYFKRLFNFKKDKDGYWKWFAGNLASGGAAGASSLFFVYSLDYARTRLANDAKAAKGGGDRQFNGLVDVYRKTLKSDGIAGLYRGFNISCVGIIVYRGLYFGLYDSIKPVVLTGNLQDNFFASFALGWLITNGAGLASYPIDTVRRRMMMTSGEAVKYKSSLDAFQQILKKEGPKSLFKGAGANILRAIAGAGVLSGYDQLQILFFGKKYGSGGA

SEQ ID NO: 5871 - protein, 125 aa, Zea mays
MRRRSCSMPLPLAAAALLLLLVCFFHYSAAARLLPPSPVPAQLVHRETGVTAAAAAAYGGLALQEGGVGNGDELSISGDEMMAAEVEEGAVACEADDDEDDGCMQRRLLQNAHLDYIYTQHKGKP

SEQ ID NO: 5872 - protein, 134 aa, Zea mays
  unsure (1)..(134): unsure at all Xaa locations
PSSAHTRRIRSQDPLRHRNRVTARAAGDPDPPTRPSPARSHVAVGADAGERNLLSVAYKNVIGARRASWRIISSIEQKEEGRGNEAHAASIRAYRSKIEAELARICDGILALLDSHLVPSAXGAEXKXFYLTMK

SEQ ID NO: 5873 - protein, 274 aa, Zea mays
  unsure (1)..(274): unsure at all Xaa locations
MSPSEPTREESVYMAKLAEQAERYEEMVEFMERVARSAGGAGGGEELSVEERNLLSXVAYKNVIGARRASXWRIISSIEQKEEXRGNEAHAASIRAYRSKIETELAXICDGILALLDSHLVPSAGXAESKVFYLKMKGDXYHRYLAEFKSGAERKDAAESTMNAYKAAQDIGXADLAPTHPIRXLGLALNFSVFYYEILNSPDRACNLAKQXPFDEAISELDSPGERESXYRDSTLIMQLXLRDNLTLWTSDTNEDGGDEIKDAAAPKESAEGQ

SEQ ID NO: 5874 - protein, 117 aa, Zea mays
  unsure (1)..(117): unsure at all Xaa locations
SCRAEVLPGKRLRGARNWGCLHMTIQTADLIETLTALVAEGRLGSCNSFCTHDHADAIIERDSERXFRWKGETLEEHRGSTERCLYWSKVGGINLMINDQKDPTVMIHHGGKVDEDF

SEQ ID NO: 5875 - protein, 261 aa, Zea mays
  unsure (1)..(261): unsure at all Xaa locations
MASSSPDLADDGFAAPRLFSQGVSYTYDDVIFLPGYIGFPADAVDLSTRLSRRVPLSIPCVASPMDTVSEAAMAAAMASLGAAAVVHCNTEPHSQAAIVRAAKSRRLPFVSSVPFFSPSSSPTLNDFAGSEYALVTERGDSLSRLVGIAVAADAASREVPISVSEYMRPTPRSASSAFDFEEAATFLADEGLDYAPLVSDDGEVVDLITAKDVERIRSYPKLGKPSLGAXGKFVVAASIGTREXDDRXRLEQLVKAGAMLS

SEQ ID NO: 5876 - protein, 193 aa, Zea mays
  unsure (1)..(193): unsure at all Xaa locations
MASSSTYLADDGFAAPRLFSQGVSYTYDDVIFLPAYIGFPADAVDLSTRLSRRIPLSIPCVASPMDTVSEAAMAAAMASLGAAAVVHCNTDPHAQAAIVRAAKSRRLPFVSSVPFFSPSSAPTLNDFAGSEYALVTERGDSLSRLVXGVAVAADAASREVPVSVSEYMRPTPRSASAXFDFEEXTFLADEGLD

SEQ ID NO: 5877 - protein, 389 aa, Zea mays
  unsure (1)..(389): unsure at all Xaa locations
MADQANQPTVLHKLGGQFHLRSIISEGVRARNICPSVSSYERRFATRNYMTQSLLGPSMSVSGGINVPVMRTPLCANAPAEKGGKNFMIDFMMGGVSAAVSKTAAAPIERVKLLIQNQDEMIKSGRLSEPYKGIVDCFKRTIKDEGFSSLWRGNTANVIRYFPTQALNFAFKDYFKRLFNFKKDRDGYWKWFAGNLASGGAAGASSLFFVYSLDYARTRLANDAKAAXKGGGERQFNGLVDVYRKTLKSDGIXAGLYRGFNISCVGIIVYRGLYFGLYDSIKPVVLTGNLQDNFFASFALGWLITNGAGLASYPIDTVRRRMMMTSGEAVKYKSSLDAFQQILKKEGPKSLFKGAGANILRAIAGAGVLSGYDQLQILFFGKKYGSGGA

SEQ ID NO: 5878 - protein, 195 aa, Zea mays
MASHQDKASYQAGETKARTEEKTGQAVGATKDTAQHAKDRAADAAGHAAGKGQDAKEATKQKASDTGSYLGKKTDEAKHKAGETTEATKQKAGETTEATKQKAGETTEAARQKAADAMEAAKQKAAEAGQYAKDTAVSGKDKSGGVIQQATEQVKSAAAGAKDAVMSTLGMGGDDKQGDANTNTNKDSSTITRDH

SEQ ID NO: 5879 - protein, 271 aa, Zea mays
  unsure (1)..(271): unsure at all Xaa locations
MDPWISSQPSLSLDLRVGLPPLSLHHQAPVAVALPRPKLLVEENFLLPPPKKEPEVAALETELQRMGEENRRLAEALAEVASKYEALRGQYTEMVAAAATACGNHPSSTSEGGSVSPSRKRKSESTDTAPAPRSSYXHQHYPAVAPDQTECTSGEPCKRIREAECKPRVSKLHVHADPADLSLVVKDGYQWRKYGQKVTKDNPCPRAYFRCSFAPACPVKKKVQRSAHDASVLVATYEGDHTHAPPPSGSGKNAAKPPSPARRQEAAVAVT

SEQ ID NO: 5880 - protein, 237 aa, Zea mays
  unsure (1)..(237): unsure at all Xaa locations
TIFTPVLARGGGTGTVVSASLIHKLYGNKLRPFLEHAEHLTEDVVSVFPAADALEQYIMGGRGSVTGDDGLDSLCRHKLVPYQIESKSGTLVLRWVNGQLERIETWVKRAADQEVWDPISPQQRHGNSIPHVRPRVRETADQFFAFKVPMRDGELNSLCRGLDKAFQXLSQLVTAPLVDKEDLAPPIPVLTRYKKELGIKAFVKKEVQEVRTVDERKASEITQLTMAKLCVRLNSLY

SEQ ID NO: 5881 - protein, 363 aa, Zea mays
MELHKYWGVGGRRCGSCEGAPAAVHCRTCVGGSFLCTTCDARPAHARLGHERVWMCEVCELAPAAVTCKADAAVLCAACDSDIHDANPLARRHARVPVAPIGSEAAAAAVEAMLFGTGEAAASEADEQHAAAEQQQHAHALALNVEAGDLEPGRLFSELDPYLSVEIPRFQHADSVVPNGAGAAVELDFTCGIGVKHSSYSSYTATSLAHSGSSSEVGVVPEAFGGSGSGGGSFELDFTRPKPQAYMPYTGTPQSHSVPSVDVEVVPERGDLAAVRPVPLMGESREARLMRYREKRKNRRFEKTIRYASRKAYAETRPRIKGRFAKRADHDGDADADDAEAEAEAAVPMSYVLDFGYGVVPSF

SEQ ID NO: 5882 - protein, 389 aa, Zea mays
  unsure (1)..(389): unsure at all Xaa locations
MADQANQPTVLHKLGGQFHLRSIISEGVRARNICPSVSSYERRFATRNYMTQSLWGPSMSVSGGINVPVMQTPLCANAPAEKGGKNFMIDFMMGGVSAAVSKTAAAPIERVKLLIQNQDEMIKSGRLSEPYKGIVDCFKRTIKDEGFSSLWRGNTANVIRYFPTQALNFAFKDYFKRLFNFKKDRDGYWKWFAGNLASGGAAGASSLFFVYSLDYARTRLANDAKAAKGGGERQFNGLVDVYRKTLKSDGIAGLYRGFNISCVGIIVYRGLYFGLYDSIKPVVLTXGNLQDNFFASFALGWLITNGAGLASYPIDTVRRRMMMTSGEAVKYKSSLDAFQQILKKEGPKSLFKGXAGANILRAIAGAGVLSGYDQLQILFFGKKYGSGGA

SEQ ID NO: 5883 - protein, 310 aa, Zea mays
  unsure (1)..(310): unsure at all Xaa locations
MVSTILNSALSVDSGSGILLTIIRDGLKADPKKYRKMKERLVGVSEETTTGVKRLYQMQETGALLFPAINVNDSVTKSKFDNLYGCRHSLPDGLMRATDVMIAGKVAVVCGYGDVGKGCAAALKQAGARVIVTEIDPICALQALMEGLQVLPLEDVVSEADIFVTTTGNKDIIMVDHMRKMKNNAIVCNIGHFDNEIDMLGLETYPGVKRITIKPQTDRWVFPETNTXHPSFVMSCSFTNQVIAQLELWKEKSSGKYEKKVYVLPKHLDEKVAALHLGKLGAKLTKLTKSQADYISVPIEGPYKPAHYRY

SEQ ID NO: 5884 - protein, 214 aa, Zea mays
MSSVPDCSDAIVPNSKRRRHRSPPAASSSSSHSSARAQKEELEDEEEDMAKCLILLAQGPAAIEAARVMPAPRSRPKSTGSRRFLAAAEARGGVCVSYECKTCNRCFPSFQALGGHRTSHNKHPRRPAEEVLAAMAITTTLSLAATRPAHECSSCGSVFTSGQALGGHMRRHRPLTTTSSSPATGTEDQQDSSSKLLQESRINLELDLNLLPST

SEQ ID NO: 5885 - protein, 151 aa, Zea mays
AVDYLDLVIKTLEENGFKGRFYIHCDFALFGLMIPFVKKAPQVTFKKPIGSVSVSGHKFVGCPMPCGVQITRLEYINALSSNVEYLASRDATIMGSRNGHAPIFLWYTLNRKGYRGFQKEVQKCLKNTHYLKDRLKEAGIGAMLNELSSTG

SEQ ID NO: 5886 - protein, 154 aa, Zea mays
HVDYDVQAERRPSCRFPAPRTRSPATFEQILEMDEDEDEREFSKSIVYDFFGQADQTFKKMDKELEKKEGKYLKELSELGHFLKGSSATLGLTKVKDSCEKIQHYGQLKDDAGTKDITEEQAQENLGKIIKQAKKEFADVKDILKEFYKDDNEA

SEQ ID NO: 5887 - protein, 168 aa, Zea mays
  unsure (1)..(168): unsure at all Xaa locations
MAISSALPCSSLLMAAALLLASVVVQGQGITRHYDFNVTMANVTRLCATKSIVTGNGQFPGPKIVAREGDRLIIRVTNQAQHNISLHWHGIRQLRTGWADGPAYITQCPIQTGQSYVYNYTVAGQRGHAXWWHAHISWLRATVYGXLVVLPRPGVPYPFPAXYXGVPV

SEQ ID NO: 5888 - protein, 83 aa, Zea mays
  unsure (1)..(83): unsure at all Xaa locations
MSESFVVGYRTRAGTTCASWCIIXCFPQRADSRGTDDRPTFIKDYRGKIETELTKICDGILXCLRPHLVPSSTATDXRAFYLK

SEQ ID NO: 5889 - protein, 331 aa, Zea mays
MDPWVSSQPSLSLDLHVGLPPMGHPHSHHQAAPMVALAKPKILVEENFMQLKKDPEVAVLESELQRVSEENRRLGEMLREVASKYETLQGQFTDMVTAGAHAGGNNHYNNQPSSASEGGSVSPSRKRKSEESNGTPPPSHQQQQQHYAGGLAYAAAPDQAECTSGEPCKRIREAERKPKVSRRFVHADPSDLSLVVKDGYQWRKYGQKVTKDNPCPRAYFRCSLAPSCPVKKKVQRSADDSAVLVATYEGEHNHARPPQHDGAAKRSSAPPAGEAARPPAPLPLQKQEAGPSSEVARKNLAEHMAVTLTRDPGFKAALVSALSGRILDQGL

SEQ ID NO: 5890 - protein, 148 aa, Zea mays
  unsure (1)..(148): unsure at all Xaa locations
IGLLALAVQTVNCVAEIYNEDQQEIYKLLYGRIKSENVPEIKAGSDDDDDDEDDEGDDEDEEEDDDDDDDDDDERXGDDDDEDDDDEEGGDEDDDPEANGEGGSDDDDDDNDGDDDGNDDDDDEDDDEDEDEEDDDDEEEQPPSKKKK

SEQ ID NO: 5891 - protein, 573 aa, Zea mays
  unsure (1)..(573): unsure at all Xaa locations
MADVHEPLVRRKRKKVLXDYLVKFRWILVIFVVLPISTLIYFNIFLGDMWSAMKSEKKRQKQHDENVQKVVKRLKQRNPKKDGLVCTARKPWXIAVGMRNVXDYKRARXHFEVDLSSFRNILEIDKERMGCQGSSPLSTWGQITRATCPMNFGPLARVVAXELDDLHWLVGLINGYGIEGSSHLYGLFSXDTVVAXEVVLADGXRVVRATKDNEYSDLFYGIPWSQGTLGFLVSAEIKLIPIKEYMKLTYTPVKGGLKEIAQAYADSFAPRDGDPAKVPDFVEGMVYTESEGVMMTGXHASKEEAKKKGNKINCVGWWFKPWFYQHAQTALKRGEFVEYIPTREYYHRHTRCLYWEGKLILPFGDQFWFRFLLGWLMPPKVSLLKATQGEAIRNYYHDNHVIQDMLVPLYKVGDALEFVHREMEVYPLWLCPHRLYKLPVKTMVYPEPGFEHQHRQGDTSYAQMFTDVGVYYAXPGAVLRGEEFNGAEAVHRLEQWLIENHSYQPQYAVSELNEKDFWRMFDASHYEHXRQKYGAVGTFMSVYYKSKKGRKTEKEVQEAEAAILEPAYADEEA

SEQ ID NO: 5892 - protein, 485 aa, Zea mays; identical to SEQ ID NO: 629

SEQ ID NO: 5893 - protein, 256 aa, Zea mays; identical to SEQ ID NO: 5830

SEQ ID NO: 5894 - protein, 661 aa, Zea mays
MVEMAVVELRTLPLGFRFHPTDEELVTHYLKGKITGRINSESEVIPEIDVCKCEPWDLPDKSLIRSDDPEWFFFAPKDRKYPNGSRSNRATEAGYWKATGKDRIIKSKGDKRKQHTIGMKKTLVFHRGRAPKGERTGWIMHEYRTTEPEFESGEQGGYVLYRLFRKQEEKTERSSPEEVDRSGYSPTPSRSSPDNLEANEEANTPLNKESPESALHESPIELPKSVETNGGSMTRWLADRNDNLMVTAPDVSHIPFHGHAAGVAKQVDPSVGASGHLVNPHNGNDDYNKFVSDFTPILPLENAFFTDIQQGAFGFDGIMNPLDPLDAFLNQTLVDPDEHSSTTSKVQYDSDIPTEFENHWNMKVEPQDDQCWWANIGFEPDEPNPLLPCDTTDQDILSVDSGADSFNELFNSMEETGITVRPQQLDSTVQPNHVFASQGNATRRLRLQVECREIITKDESEDEVSCVLTPDCLNDSVEESTAEKDVASDGDEAESTGIVIRSHHPAPRSSSESSFTQQGTAMQRLRLQSGLNKGQRPSTDDSSSCIIDEPGSQHKAEKAEIEEDASTNLAGSADDLPGNIHDDEQKNIPEHGAEMTSPEAKSVLRLRKTSEEGNKDVKQESCLEPHVRAPMQKGGFQSYIIWLVLPVALLLLLCVGTYGWV

SEQ ID NO: 5895 - protein, 218 aa, Zea mays
  unsure (1)..(218): unsure at all Xaa locations
MAMAISSALPCSLLVAALMLLASVVQVQGITRHYDFNVTMANVTRLCASKSIITXVNGQFPGPKIVAREGDRLVIRVTNHAQHNISLHWHGIRQLRTGWADGPXAYITQCPIQTGQSYVYNYTVVGQRGTLWWHAHISWLRATVYGPLVILPKLGVPYPFPAPYKEVPVIFGEWWLADTEVVIKQALQLGAGPNVSDAHTINGLPGPLYNCSAKGTFL

SEQ ID NO: 5896 - protein, 486 aa, Zea mays
MATMARSGAVKLCCCTSALLLLCCFLLPGAQAEERFYEFVVQGTPVKRLCKTQEIITVNGQFPGPTIEVYSGDTLAVRAVNLARYNVTLHWHGLRQLRIRLEDGPEMVTQCPIRPGSRYTYRYNATGQEGTLWWHAHSSMLRATVHGAIVIKPRNGAQGYPFPKPDQERIVLLGEWWNGNVFDLERNAFLTGNLVPQADAYTINGKPGDLHRCSGGSNRRPRTFKLKVRSGSTYLLRIINAAVNTPMFFKVAGHSFTVVEADAGYTEPYETDVVVVAPGQTVDALMATAAAPPSRRRYYMMASPYNSARPSLPFRNSTATAVVEYVDVGQQNKQGPRRRPVLAPMPPPNDTATAHRFFTSLAALVRPGARAPAVPLAVDTRMLVTIGLGLAACRPEQTRCSGGSRQQVFAGSMNNASFVLPAAMSLLEAHFRNATAGVYTRDFPDAPPLEFDYTRPPRGMSLATAKSTRVRTLPYNATVEVVLQAS

SEQ ID NO: 5897 - protein, 485 aa, Zea mays; identical to SEQ ID NO: 629

SEQ ID NO: 5898 - protein, 123 aa, Zea mays
  unsure (1)..(123): unsure at all Xaa locations
MGLSVEKTSSGREYKVKDLSQADFGRLEIELAEVEMPGLMACRAEFGPSKPFAGARIXGSLHMTIQTGVLIETLTALGAEVRXMXCNIFYTQDHAAADMARDSAAAFGWKAETLEXDWWCNER

SEQ ID NO: 5899 - protein, 97 aa, Zea mays
  unsure (1)..(97): unsure at all Xaa locations
AWPARCTPGASGSPSSTPPARGRGTASRLPRTTSRLEIELAXEVEMPGLMAXRAEFSPSKLFAGSRISGSLHMTIQTAVLIETLTELGAEVRWCYCN

SEQ ID NO: 5900 - protein, 120 aa, Zea mays
MALSVEKTSSGREYKVKDLSQADFGRLEIELAEVEMPGLMACRAEFGPSKPFAGARISGSLHMTIQTVVLIETLTALGAEVRWCSCNIFSTQDHAVGVIARDLVGRFAWKGETLEEYWWC

SEQ ID NO: 5901 - protein, 181 aa, Zea mays
  unsure (1)..(181): unsure at all Xaa locations
MADDKHDSEHALSDSDTTTDEQQVLAQTSEAEEKRLLRKLDLRLLPAVSILYLLSFLDRSNVANARIEGLTKDLKMTGNQYLTGLTLYFVGYVLFEIPCNIVLKRTTPRFWLPTLTVAWGXVATLIGIVQNLTGFLIVRFFLGVTESGLFPGVVYYLSMWYKRNERQYRISLFLAVRRLLE

SEQ ID NO: 5902 - protein, 100 aa, Zea mays
MMRRCSIAALAIFLLLLVCSSSSSNCAAAARLLPGAGHLRPLRHAAVGASGDELSAGSEVTTQDTMEACEEGNGKDECVQRRLLLDAHLDYIYTQHKGKP

SEQ ID NO: 5903 - protein, 100 aa, Zea mays
MMRRCSIAALAIFLLLLVCSSSSSNCAAAARLLPGAGHLRPLRHAAVGASGDELSAGSEVTTQDTMEACEEGNGKDECVQRQLLLDAHLDYIYTQHKGKP

SEQ ID NO: 5904 - protein, 306 aa, Zea mays
  unsure (1)..(306): unsure at all Xaa locations
MRIQCDACEAAAATVVCCADEAALCARCDVEIHAANKLASKHQRLPLALGDATAASASSLPRCDVCQEKPAFIFCVEDRALLCRDCDEPIHGPGTLSGNHQRYLATGIRVGFSSVCGASAEGLPPAPPKGSSKPAAVVSAPAAGATTKTRTVKDALPQEVPSSPFLPPSGWAVEDLLELSDYESSDKARTXPSKTSFFLSAVMMMRSTTSFSGSYSYLSFPFPSVLCFLFQKDSSFGLKELEWFEDIDLFHAHSPAKTAMXEFFASPQPVSNAGFSKANGGRLFKKSRMGVPVDDDEDYFIVPDLG

SEQ ID NO: 5905 - protein, 418 aa, Zea mays
MKIQCDACEGAAATVVCCADEAALCARCDVEIHAANKLASKHQRLPLEALSASLPRCDVCQEKAAFIFCVEDRALFCRDCDEPIHVPGTLSGNHQRYLATDSVRVPMLIFLGGCWPACLHWKPRPTLGRSRPKGPCHWLSPPGRRAAAGRLEAPFPTGGMRIQCDACEAAAATVVCCADEAALCARCDVEIHAANKLASKHQRLPLGDAAALPASLPRCDVCQERPAFIFCVEDRALLCRDCDEPIHVPGTLSGNHQRYLATGIRVGFSSVCGASAEGLPPAPPKGSSKPAAVVSAPAAGTTTKTRTVKDALPQEVPSSPFLPPSGWAVEDLLELSDYESSDKKDSSLGLKELEWFEDIDLFHAHSPAKTAMAEFFASPQPVSNAGFYKANGARLFKKSRMEVPDDDDEDYFIVPDLG

SEQ ID NO: 5906 - protein, 230 aa, Zea mays
MDLSPSSSAPSAPPVPCEWSGAGLGSAACGLACRVLCAVATCVFAAVGSLVGAVTGSMVGLATESGMLRGAGIGAISGAVFSIEVAESSRDLWHSGDSGVWTLLYMVDIISSLLSGRLVREKVGPAVQSAVQSQISAISSPFEETSDLFETGSVRGLPEAAVRRLPETVVAEDGAVDAAGQALCCSVCLQDFRVGDRARRLPGCRHLFHVPCIDCWLLRHGSCPLCRRDI

SEQ ID NO: 5907 - protein, 426 aa, Zea mays
  unsure (1)..(426): unsure at all Xaa locations
MASNSTYLAADGFAAPRLFSQGVSYTYDDVIFLPAYIGFPADAVDLSTRLSRRIPLSIPCVASPMDTVSESAMAAAMASLGAAAVVHCNTDPHAQAAIVRAAKSRRLPFVSSVPFFSPYSAPTLNDFAGSEYALVTERGDSLSRLVGVAVAADAVSREVPVSISEYMRPTPRSASAAFDFEEAATFLADEGLDYAPLVSDDGEXVDLITAKDVERIRSYPKLGKPSLGANGKFVVAASIGTREDDKGRLEQLVKAGANAIVIDSSQGNSIYQLDMIKFAKKMYPEVDLIGGNVVTIAQAQNLIQAGVDGLRVGMGSGSICTTQEVCAVGRGQATAVYKVSSYAKDHNVPVIADVAYRCVNKNPRKRPWISEVTQAISRLRQHQLIKHDAITLPRSETRTVLRRIDYQHVELSDLTSIKELTPIRAS

SEQ ID NO: 5908 - protein, 323 aa, Zea mays
MTAKGGASPAPGGAGAAANGRFFTVGLVTAWYSSNIGVLLLNKYLLSNYGFKYPIFLTMCHMSACALFSYAAIAWLRIVPMQLVRSRVQLAKISALSLVFCGSVVSGNVSLRYLPVSFNQAVGATTPFFTAVFAYIMTVKRESWITYLTLVPVVTGVVIASGGEPSFHLFGFIMCIGATAARALKTVSDVVILSSDGEKLNSMNLLLYMAPIAVIFLLPATIFMEDNVVGVTIELAKKDFTIVWLLLFNSCLSYFVNLTNFLVTKHTSALTLQVLGNAKGAVAVVVSIMIFRNPVSITGMLGYTLTVFGVILYSESKKRSNKP

SEQ ID NO: 5909 - protein, 184 aa, Zea mays
  unsure (1)..(184): unsure at all Xaa locations
LMEGLQVLTLEDVVSEADIFVTTTGXKDIIMVDHMRKMKNNAIVCNIGHFDNEIDMLGLENYPGVKRITIKPQTDRWVFPETNTGIIVLAEGRLMNLGCATGHPSFVMSCSFTNKVIAQLELWKEKSTGKYEKKVYVLPKHLDEKVAALHLGKLGAKLTQLSKSQADYISVPVEGPYKPAHYRY

SEQ ID NO: 5910 - protein, 256 aa, Zea mays
MSREENVYMAKLAEQAERYEEMVEYMEKVAKTVDVEELTVEERNLLSVAYKNVIGARRASWRIVSSIEQKEESRKNEEHVNLIKEYRGKIEAELSNICDGILKLLDSHLVPSSTAAESKVFYLKMKGDYHRYLAEFKTGPERKESAESTMMAYKAAQDIALAELAPTHPIRLGLALNFSVFYYEILNSPDKACNLAKQAFDEAISQLDTLGEESYKDSTLIMQLLRDNLTLWTSDLTEDGADEGKEAPKGEAGDGQ

SEQ ID NO: 5911 - protein, 220 aa, Zea mays
MATSEPVQESLVVHYSQPSRPRVLLAASGSVAAIKFESLCRSFSEWADVRAVATTSSLHFVDRSSLPSGIVLYTDDDEWSTWKKIGDEVLHIELRKWADVMVIAPLSANTLAKIAGGLCDNLLTCIVRAWDYSKPLFVAPAMNTLMWNNPFTERHLHTINQLGIALIPPVTKRLACGDYGNGAMAETSQIHTSVRLACKTQPHDASSSLAGPVSNNRPSS

SEQ ID NO: 5912 - protein, 69 aa, Zea mays
  unsure (1)..(69): unsure at all Xaa locations
MGGVREPGVRRKRKKVVVDYLVKFRWVXGILVGLAIXAVVCLRMFLGGMWGAMKAEKKRRKQGGENGQK

SEQ ID NO: 5913 - protein, 339 aa, Zea mays
MVGTAAGSAEEAVRRWVDAAGGRLVLDGGLATELEANGADLNDPLWSAKCLLSSPHLIRKVHMDYLEAGANIIITASYQATIQGFESKGFSKEQSENLLTKSVEIALEAREMFLKEHLEKSTPIQHPVLVAASLGSYGAYLADGSEYSGDYGEAGTKEFLKDFHRRRLQVLAEAGPNLIAFETIPNKLEAEAYVELLEECNINIPAWFSFNSKDGVHIVSGDSLIECATIADKCAKVGAVGINCTPPRFIHGLILSIRKVTDKPILIYPNSGERYDGEKKEWVESTGVSDGDFVSYVNEWCKDGAVLIGGCCRTTPNTIRAIHRTLNKSPNKQQLPAVE

SEQ ID NO: 5914 - protein, 138 aa, Zea mays
  unsure (1)..(138): unsure at all Xaa locations
PHTDHYCCSCEDTEGPFPCMLAHXAGCIGKSASERLTDVQPGDHGIPCYPAECKECKCCKTXKTNLCGKARSDTGVGVMMNDMKSRVSENGKPIYHFMRTSTFRQYTVVHDVSDAKINPQAPLDKVCLLGCGVPTGLG

SEQ ID NO: 5915 - protein, 394 aa, Zea mays
  unsure (1)..(394): unsure at all Xaa locations
MADHANQPTVLHKLSGQLHLRSIISEGVRXARNICPSVSSYERRFATRNYMTQSLWGPSMSVSGGINVPVMHTQLCANAPAEKGCTIFMIDFMMGGVSPAVSKTAAAPIERVKLLIQNQHEMIKSGRLSGPYKGIVDCFKRTIKDEGFSSLWRGNTANVIRYFPTQALNFAFKDYFKRLFNFKKDRDGYWKWFAGNLASGGAAGASSLFFVYSLDYARTRMANDAKAAKGGGERQFNGLVDVYRKTLKSDGIAGLYRGFNISCVGIIVYRGLYFGLYDSIKPVVLTGNLQDNFFASFALGWLITNGAGLASYPIDTVRRRMMMTSGEAVKYKSSLDAFQQILKKXEGPKSLFKGAGANILRAIAGAGVLSGYDQLQILFFGKKYGFRRCLNGEI

SEQ ID NO: 5916 - protein, 97 aa, Zea mays
MARRATVMVLAAALAVLLLASSSSKTAPVASAARDDPSAAAAAVVSSSRDQKDGSAAAAEGKGKEKECEGANDEDECMMRRTLAAHTDYIYTQQHHG

SEQ ID NO: 5917 - protein, 168 aa, Zea mays
  unsure (1)..(168): unsure at all Xaa locations
MASDAAHGSSLDGVTPSSKFDLPVDSEHKAKTIRLLSFANPHMRTFHLSWMSFFTCVVSTFAAAPLIPIIRENLGLTKADIGNAGVASVSGAIFSRLAMGAVCDLLGPRYGCAFVVMLGXPAVSCMAVIASAGXYVAWRFLIGFSLATFVSLQYWTSTMFNIKIIGTS

SEQ ID NO: 5918 - protein, 405 aa, Zea mays
  unsure (1)..(405): unsure at all Xaa locations
LARRGGGGPYIFNTCAWRGPEEAQAEAAPALEGAWVWATAGRRRSRATHTHGGRYVQYNVYGNLLEVSAKYVPPIRPVGRGACGIICAAVNAQTREEVAIKKIGNAFDNQIDAKRTLREIKLLRHMNHENVISIKDIIRPPRRENFNDVYIVYELMDTDLHHLLRSNQQLTDDHCQYFVYQLLRGLKYVHSANVLHRDLRPSNMLLNAKCDLKIGDFGLARTTTETDFMMEYVVTRWYRAPELLLNCSEYTQAIDMWSVGCIFGEMVTREPLFPGKDYVHQLRLITELVGSPDDTSLGFLRSDHARRYVRSLPQHPKQQFRVRFPTMSXGAMDLLERMLVFDPSKRITVDEALCHPYLASLHEVNDEPICPAPFSFDFEQPSLTEEAIKELIWKESLKFNPDPIH

SEQ ID NO: 5919 - protein, 61 aa, Zea mays
STSTCGGEDNVYMAKLAEQAERYEEMVEYMEKVAKTVDVEELTVEERNLLYVVYKNVMGGA

SEQ ID NO: 5920 - protein, 137 aa, Zea mays
MAEGEFKPAAMQVEAPAEAAAAPSKPRFRMPVDSDNKATEFWLFSFARPHMSAFHMSWFSFFCCFLSTFAAPPLLPLIRDTLGLTATDIGNAGIASVSGAVFARVAMGTACDLVGPRLASAAIILLTTPPVYYSGVI

SEQ ID NO: 5921 - protein, 323 aa, Zea mays
QLTPSDFCTCRVVESVGEGVEGLAPGDHVVPIFTGECEKCVYCKSDKTNLCGTYRVDPLKSSMVYDDGTRFSVVDQASGQRRPVYHFLNTSTFTEYTVLDAACAVKINPEAPLQRMCLLSCGISTGVGAAWNTANVSARSTVAVFGLGAVGLAVAEGARLRGATRIIGVDVNPSKFTKGKEMGITDFIDPNDICDKPVHEVIREMTDGGVDYSFECTGINDVLREAFLSTHDGWGLTVVLGIHSTPKMVPLHPMELYGRRITGCVFGDFKGKSQLPDLVDKCVNGEVNINFDGFITHKMPFSDINKAFRLLEEGKSLRCLLSL

SEQ ID NO: 5922 - protein, 114 aa, Zea mays
MPRATSDAKLLIQSLGKAYAATPTNLKIIDLYVGFAVATALIQVAYMGLGGSVPFNSFLSGVLSCIGTAVLAVCLRIQVNKDNKEFKDLPPERAFADFVLCNLVLHLVIMNFLG

SEQ ID NO: 5923 - protein, 552 aa, Zea mays
  unsure (1)..(552): unsure at all Xaa locations
MAAPPPAPFLLLLLAVAAASFAGADDPYRYFTWTVTYGPISPLGTTQQGILINGQFPGPRIDCVTNDNLVVNVVNSLDEPFLLTWNGVKQRKNSWQDGVAGTNCGIPPGANYTYRFQAKDQIGTFFYFPSLALHRAAGGFGALNVYQRPAIPVPYPPPAGDFTLLVGDWYAAASPHADLRRALDDGGGGALPPPAALLINGAAASGAAPFVGAQGGTYLFRVSNIGLRASVNVRVQGHALRLVEVEGTHPVQSAYDSLDVHAGQSLAFLVTLDQAPLDYAVVASTRFAAAELTAVATLHYAGATARAPGPLPPAPPPGYGWSLGQARSFRWNLTASAARPNPQGSFHYGAIPTSRTLVLASSASLDGAGRRRCAVNAVSFVVPDTPLKLADRYDIAGVIDWDGXPARLDGAAGAAAVLRAGTPVLRLGLHEFVEVVFQNTEEELQSWHLDGYDFWVVGYGDGQWNETQRQTYNLVDAQARHTVQVYPNGWSAILVSLDNQXGMWNLRSAMWDRQYLGQQLYLRVWTPEQSLSNEYAIPANAILCGKAAALPH

SEQ ID NO: 5924 - protein, 178 aa, Zea mays
LQVQMTNVTRLCVTKSIPTVNGEFPGPKLVVREGDRLVVKVHNHINYNVSFHWHGVRQLRNGWADGPSYITQCPIQGGQSYVYDFTVTGQRGTLWWHAHFSWLRVHLYGPLVILPKRGEGYPFPRPYKEVPILFGEWFNADTEAVINQALQTGAGPNVSDAYTFNGLPGPTYNCSSKG

SEQ ID NO: 5925 - protein, 608 aa, Zea mays
MATMARSGAVRLCCCTSALLMLCCFLLPGALAEERFYEFVVQGTPVKRLCKTQEIITVNGQFPGPTIEVYSGDTLAVRAVNLARYNVTLHWHGLRQLRNGWADGPEFVTQCPIRPGGSYTYRFTVQGQEGTLWWHAHSSWLRATVHGALIIHPRRGVPYPFPKPHTEAPVILAEWWRRDPIAVLRQSMITGAPPNVSDALLINGQPGDLLPCSSQETSIIPVVAGETSLLRINNAAMNTELFVSLAGHRMTVVAADAMYTKPFETDVVLLGPGQTTDVLVTAHAAPGRYYLAARAYASAQGVPFDNTTATAIFQYKNAPGCPTTSGAGAGAGAGGGSTFSGPVGRSSRSSGYLGRAGPQPMLPFLPAFNDTNTATAFSNRLRSPVPVKVPGPVTQEVFTTVGFGLFNCRPGPFCQGPNNTRFGASMNNVSFQLPDTVSLLQAHYHHIPGVFTDDFPALPPVFFDFTSQNVPRALWQPVKGTRLYRVRYGAVVQIVFQDTGIFAAEEHPMHIHGYHFYVLATGFGNYDPRRDAARFNLVDPPSRNTIGVPVGGWAVVRFVADNPGVWLVHCHIDAHLTGGLAMALLVEDGESELEATMAPPLDLPICVL

SEQ ID NO: 5926 - protein, 358 aa, Zea mays
EGEKPDSIISTNLNFNGKLQPDASNGTAQVFINGREITKIELRILKIAKVQCPRDTHFWVYHDGGYEEEGQNNIKGKIWESPLTRFACALVSLPVPPTNFDATKDEAPYSSKTVPDYLDHKRIQKLLILGSPGAGTSTIFKQAKLLYGNRFTDEELENIKLMIQSNMFKYLGILLEGRERFEEEALAVPNHPSSVGDDPQQDESKSSSSNSCIYSINAKLKKFSDWLLDIIATGDLDTFFPAATREYAPVVDELWKDPAIQATYKRKDELHFLPDAAEYFLSRAVEVSSNEYEPSEKDVIYAEGVTQGNGLAFIDFTLDDRSPMSESFGDNHDAYPQQPVNKYSLSSPLCSTVEFFLS

SEQ ID NO: 5927 - protein, 222 aa, Zea mays
  unsure (1)..(222): unsure at all Xaa locations
MSAGFQLGVIGSLALSVASSVAIVICNKALISTLGFPFATTLTSWHLMVTFCTLHVAHRLHFFEPKAIDGQTVILFGLLNGTSIGLLNLSLGFNSIGFYQMTKLAIIPFTVLLETIFLKQRFSESIKLSLLVLLLGVGIASITDLKLNMLGSILSGLXIATTCVXQILTNTIQKRLKVSLTQPLYPAAPYQAGILFATGPFVDQLLTDRSVFAHKYSAPVLV

SEQ ID NO: 5928 - protein, 356 aa, Zea mays
  unsure (1)..(356): unsure at all Xaa locations
MTAGFQLGVIGSLTLSVASSVAIVICNKALISTLGFPFATTLTSWHLMVTFCTLHVAQRLRFFEPKAIDGQTVVLFGLLNGTSIGLLNLSLGFNSIGFYQMTKLAIIPFTXLLETIFLKKRFSETIKFSLLVLLARQLASALSYRPQVKLPLGVPFFSGLAIAXTCVGQILTNTIQREAXKVSSTQLLYQSXPYQAAILFATXGPFVDHLLTGRSVFAHRYTFPVVGFIVLSCLIAVSVNFSTFLVIGTTSPVTYQVLGHLKTCLVLSFGYTLLHDPFTVRNILGILVAIFGMALYSIFSVREGKKKSAGDALPVSQMPDKETERAACDQGQQRHQKGQRGCSRLLRRSRLPLLIA

SEQ ID NO: 5929 - protein, 153 aa, Zea mays
  unsure (1)..(153): unsure at all Xaa locations
QPTREDSGNMGKLANQARAXDEVGGSSSCERVARSAMGNGRGEELSXEERNLLTISYNNVIRGRLASWRILSSIXQKDEGRGNEAHAASIRTYRSEIKIEVDHICDGILGLLDSHVIASDDADKTKVFYLKMKGDYRRYLGEIKSGEEMKDAA

SEQ ID NO: 5930 - protein, 236 aa, Zea mays
IGTLEAGRDLFFHFCFSRLSDLEHPSAVPIFAAPAIMFDNIDFTQPSLWVSAISIAFNPTFWNIAAQSEYHNKVITKLFSGNARYGCYALAVAIFSLGIFRDYLYNEALADQPTSPLLQSPLVKYSAIPLFLTGNTLVLTSMWALGVTGTYLGDYFGILMDAPVTSFPFNVSDAPMYHGSTLSFLATALWYGKPAGLFLTGCVAVAYAVARQFEDPFTGMIYAKRDEERAKGKKGL

SEQ ID NO: 5931 - protein, 275 aa, Zea mays
MLLNPASEASVLVTIRQHLLEEPAAAEARPADESFGSLVADQWSGSLPFRTDDADDMVVFGALQDAFAYGWLPDGSFVHVKPEPVRSPDSSSYPCSYDGSSCFGLLDPEPLTPGTTTPGRGQEEAAAAMARCLHYRWGRQRPWGKFAAEIRDPARNGARVWLGTYDTAEDAALAYDRAAYRMRGSRALLNFPLRIGSGDKRPSPAPPEPATSSDSSSSWASGSHKRRKRGEAAAANMAMALVPPPSQLNRPAQPWFPAAPVEQAAMAPRVEQLVV

SEQ ID NO: 5932 - protein, 105 aa, Zea mays
MARPQQRYRGVRQRHWGSWVSDIRHPLLKTRIWLGTFETAEDAARAYDEAARIMCGPRVRTNFPEDAAADGQGQPAATALLSPALVAKLHRFQPCVRAGGARQGR

SEQ ID NO: 5933 - protein, 145 aa, Zea mays
  unsure (1)..(145): unsure at all Xaa locations
ALAVQVSLILIPGQIYAVNNARYSDWPEVLTXFIDTLRQRXGQHPKKYSARYVCSLVADFHRTLIYGGVAMNPRDHLRLVYEANPLSFLAEQAGGRGSDGKNRILTIQPVKLHQRLPLFLGSMDDMLELESYGDVQQKVNPGYEV

SEQ ID NO: 5934 - protein, 203 aa, Zea mays
MADVHEPLVRRKRKKVLVDYLVKFRWILVIFVVLPISTLIYFNIFLGDMWSALKSEKKRQKQHDENVQKVVKRLKQRNPKKDGLVCTARKPWIAVGMRNVDYKRARHFEVDLSSFRNILEIDKERMVAKVEPLVNMGQITRATCPMNLALAVVAELDDLTVGGLINGYGIEGSSHLYGLFSDTVVAMEVVLADGRVVRATKDN

SEQ ID NO: 5935 - protein, 234 aa, Zea mays
  unsure (1)..(234): unsure at all Xaa locations
MLFKSLAVWLSLGSLALSSPLRAEPLDASDDFPSFEEIVKRQDGACTNTPRTRSCWSNGYSIATDFDAKSPPDGTTVTYNFEISNVTKPNPDGSGGNRPMMLINGQYPGPVVRAKWGDTIIVNVKNNLAHNGTGIHWHGIRMLNSXRXDGVPGXTECPIAPGXTRQYKFRATQFGTTWYHSHWSAQYGDGXVVGTHDHWMVQPLPLTIVDPRYSALDWIGTTPPAFTLNEVAQH

SEQ ID NO: 5936 - protein, 183 aa, Zea mays
  unsure (1)..(183): unsure at all Xaa locations
MAREENVYMAKLADYRRKXYEEMVDHMHNVPNTVDVEQLTVEERDLWSGAYXNVIGGRRASWXRIVLLLSETELTEXRNEPQSIDEPLSTEYRAQIEAELINIRDGLLXVLDSLLVASSTGAVPKVFYLKMNVDYHRDLAESTTVPDRKESADITMMVYYAAHDIASTEMRPTHPISLAIAPN

SEQ ID NO: 5937 - protein, 401 aa, Zea mays
MSFRSLIQDMKDEFGSISRHSLRSRSHRSAGNAARAAAAGPSEAMDQSCWSQLPPELLREVLVRIEASESWWPARKNVVSGAGVCRTWRGIMKEAVRVPEVSGKLTFPISLKQPGPRDGTLKCFIRRNRTTQTYYLYIGLTEALADDGKFLLAARKCRKPTCTDYLISLDKVDMSKGSSTYIGKLRSNFLGTKFTVYDAHPPYDGAAVSKSRSARVVGLKQVSPRVPAGNYPVSHISYELNVLGSRGPRRMNCVMDSIPASAVKEGGKTPTQTEFPLSSLDSFPSFPFFRSKSARIDSSTSQSSSQREDRLVLKNKSPRWHEQLQCWCLNFRGRVTVASVKNFQLVASEDNGPENQESDKVILQFGKIGKDLFTMDYGYPISAFQAFAICLSSFDTKIACE

SEQ ID NO: 5938 - protein, 319 aa, Zea mays
  unsure (1)..(319): unsure at all Xaa locations
MWGGGGFFLFNLXXPXEYWDYEALTAQWGEQDNYEVVRKGGRGKYSEVFEGVTVNNNEECIIKILKPVKKKKIKREIKILQNLYGGPNIVKLLDIVRDQHSKTPSLIFEYVNNTDFKVLYPTLTDYDIRYYIYEVLKALDYCHSQGIMHRXDVKPHNVMIDHELRKLRXLIDWGLAEFYHPGKEYNVRVASRYFKGPELLVDLQDYDYSLDMWSLGCMFAGMIFRKEPFFYGHDNHDQLVKIAKVLGTDGLNVYLNKYRIELDPQLEALVGRHSRKPWLKFMNADNQHLVSPEAIDFLDKLLRYDHQERLTALEAMTHP

SEQ ID NO: 5939 - protein, 401 aa, Zea mays
MSFRSLIQDMKDEFGSISRHSLRSRSHRSAGNAARAAAAGPSEAMDQSCWSQLPPELLREVLVRIEASESWWPARKDVVSGAGVCRTWRGIMKEAVRVPEVSGKLTFPISLKQPGPRDGTLKCFIRRNRTTQTYYLYIGLTEALADDGKFLLAARKCRKPTCTDYLISLDKVDMSKGSSTYIGKLRSNFLGTKFTVYDAHPPYDGAAVSKSRSARVVGLKQVSPRVPAGNYPVSHISYELNVLGSRGPRRMNCVMDSIPASAVKEGGKTPTQTEFPLSSLDSFPSFPFFRSKSARIDSSTSQSSSQREDRLVLKNKSPRWHEQLQCWCLNFRGRVTVASVKNFQLVASEDNGPESQESDKVILQFGKIGKDLFTMDYGYPISAFQAFAICLSSFDTKIACE

SEQ ID NO: 5940 - protein, 975 aa, Zea mays
  unsure (1)..(975): unsure at all Xaa locations
MGGKYRAARTKRWWRGLAAAGWVLTAVVCSAVMHWTLRRDSMDRAEERLVSMCEEGARKLQEQGKVTVNHVQTIAILISTLKFEKSPPAIDQDTFAKYTARTSFERPLLNGVAFAQRLYHHERXEVLQSRQQIGIRNDKFGRLMFKVEYTPVIFSQDTFTFPAWIDLMCREQYRKNLFRASTSGKAILTNPFRLLGSNHLGVVLTFAVYRPDLPADASVDQRVEGTIGYLGGAFDVESLVENLLSKLAGNQDIVVNVYDVTNASDAMVLYGPSSLDEQVPFLHVSMLDFGDPFRKHEMRCRYRQKLPMPWSAITNPLGTFVIWMLLGYSIAAAYSRYDKVTEDCRKMEELKTQAEAADVAKSQFLATVSHEIRTPMNGVLGMLDMLLGTDLTMTQKDYAQTAQMCGRALITLINDVLDRAKIEAGKLELEAVPFDLRSLMDDVVSLFSSKSREKCIELAVFVCDNVPKVVIGDPWRFRQILTNLVGNAVKFTERGHVFVRVCLAENSNMEANQVLHGAMNGKGGRVESTANGAFNTLSGFEAADRRNSWQYFKLLLSDKESLLDDLEGENSNQSDSDRVTLAISIEDTGVGIPLQAQDRVFTPFMQADSSTSRNYGGTGIGLSISKCLAELMGGQISFTSHPSVGSTFTFSATLKHSYKDISGDSSRSLTEALPTAFKGMKAILVDGRPVRSAVTRYHLKRLGILLQVVNNMNAVVKAFPGQNGAAGSREKASILFIESDFWRPETDVQLLNHLREQKNGQLSDGHKVVLLVTSEADKDKYGSIFDIVMCKPIRASTIASSIQQLLKVEIAERKDNQNRPSFLRSLLVGKNILVVDDNKVNLRVAAAALKKYGANVSCVESGKDAISLLQPPHRFDACFMDVQMPEMDGFEATGQIRQMELKANEERKNKLASIEGATTAEYHLPVLAMTADVIQATYEECIKSGMDGYVSKPFDEEQLYQAVSRLVVGTTDSAV

SEQ ID NO: 5941 - protein, 120 aa, Zea mays
MMMLIDCSGCRTPLQLPHGAPCIRCAICGAVTHIAPAPPAEPNRGAVQPAPGWAPPPPPVHGRKRAVVCGISYRYSRHELKGCINDAKCMRHLLMTRFNFPDDSIIMLNGPETGPIEYPM

SEQ ID NO: 5942 - protein, 152 aa, Zea mays
MARPQQRYRGVRQRHWGSWVSEIRHPLLKARIWLGTFETAEDAARAYDEAARIMCGPRARTNFPADANGPPPSFLSAALVDKLHRFNLASVQAAQRQREAAAAAAAAAAAATSAPATPPAAQWGGGRSLEEQHVEQMIEELLDSDFSMEICC

SEQ ID NO: 5943 - protein, 137 aa, Zea mays
  unsure (1)..(137): unsure at all Xaa locations
DFVDVEELXVEERNLLSVAYKNVIGARRASWRIVSSIEQKEESRKNEEHVNLIKEYRGKIEAELSNICDGILKLLDSHLVPSSTAAESKVFYLKMKGDYHRYLAEFKTGAERKESAESTMVAYKXAAQDIALAELAP

SEQ ID NO: 5944 - protein, 264 aa, Zea mays
  unsure (1)..(264): unsure at all Xaa locations
TAQVCGKALISLINEVLDRAKIEAGKLDLESVPFDLRSILDDVISLFSSKSREKGIELAVYVSERVPELLLGDPGRFRQIITNLVGNSIKFTERGHIFVQVHLADHSNLATESKVEPVANGMNGHTNXKTAVATSVSLNTLSGFEAADSRNSWENFKLLLSYEKSEMPYESVSDKVTLVVSVEDTGIGIPLDAQAKVFTPFMQADSSTSRTYGGTGIGLSISKCLVELMGGQINFVSRPHVGSTFTFTAVLKRCDRSAIGDKKP

SEQ ID NO: 5945 - protein, 116 aa, Zea mays
  unsure (1)..(116): unsure at all Xaa locations
SHLPNPIREFSLLCRLALSVEKTSSGREYKVKDLSQADFGRLKIELAEDEMPGLMACRAEFXPWGGVDGFFFSGSFHMTIQTVVLIETLTALGANVRWRSCNIFSIHHHPFPATSR

SEQ ID NO: 5946 - protein, 386 aa, Zea mays
LGACLGKRGPGCSSVAYGASEEIGPFRIKPNGTGLFLNKYSWNREANLLFLESPAGVGFSYANTTSDLKTSGDERTAQDALQFLVSWMSRFPQYRHRDFYIAGESYAGHYVPQLARKIVEYNEASPHPFINLKGILVGNAVTDNYYDNIGTVTYWWTHAMISDRTYKAILRWCNFSSSSISRPCNRAMSYAMNHEFGDIDQYSIYTPSCAAAAARANATVLRFKNTLVRRRRSSGYDPCTETYAERYYNRMDVQRAMHANTTGIPYRWTACSDVLIKTWQDSEFSMLPTYKKLMKAGLRIWVFSGDTDSVVPVTATRFAISHLGLKIKTRWYPWYSAGQVGGWSEVYEGLTFASVRGAGHEVPLFQPRRAFRMFRSFLAGEPLPKS

SEQ ID NO: 5947 - protein, 214 aa, Zea mays
  unsure (1)..(214): unsure at all Xaa locations
GLELELGPLDSHQVDPRAEDIQIGVIRALALSVASYAAVVLRNKALITXLGFPFATTVTIWNLMVTFCTLHVAQILLFFEPDEIDAQTTILFGLLNGTSMVIVNLSLGSYSIEIYQMTKMEIIPFTELLETIFLKKRFSESIKLSLLVLLRXERIASATDLKINLVGCIISGLVIDTTCVGHIRTITIHKRLXGSSTQLLYQSAAYHQVILFAS

SEQ ID NO: 5948 - protein, 112 aa, Zea mays
MSGVWVFEDGIVRRADSEPPSGAGAGGSRPNKVLVHVPSGEVVTSYEVLERRLRELGWERYLYDPCLLQFHQRSTVHLITVPRDFARLKLVHMYDVVVKTRNVFEVRDAAAA

SEQ ID NO: 5949 - protein, 580 aa, Zea mays
MGEVEDMYTQDGTVDMKGNPAVKKGTGNWRACPYILANECCERLAYYGMSTNLVNYMKTRLGQVNSVASNNVTNWQGTCYITPLIGAFFADAYMGRFWTIAIFMIIYIFGLALLTMASSVKGLVPTSCGDKDVCHPTDAQAAVVFVALYLIALGTGGIKPCVSSFGADQFDENDEREKKSKSSFFNWFYFSINIGALVASTVLVYVQTHVGWGWGFGIPAVVMAIAVGSFFVGTPLYRHQKPGGSPLTRIAQVLVACARKWNVAVPADKSRLHETVDGESGIEGSRKLEHSEQLACLDRAAVVTAEDGAEASPWRLCSVTQVEELKSVIRLLPIWASGIVFAAVYSQMSTMFVLQGNTLDQSMGPRFKIPSATLSMVDTISVIVWVPVYDRAIVPLVRSYTGRPRGFTQLQRMGIGLVVSIFSMVAAGVLDIVRLRAIARHGLYGEDDIVPISIFWQIPQYFIIGCAEVFTFVGQLEFFYDQAPDAMRSMCSALSLTTVALGNYLSTVLVTIVTHITTRHGRIGWIPENLNRGHLDYFFWLLAVLSLLNFLAYLVIASWYKYKKTADDYPGAKGEHGTEH

SEQ ID NO: 5950 - protein, 443 aa, Zea mays
MAAPSGGGGGGAGEGSSSAAAAMTIGAHGVDQVTEAMWQMNLGDAMELGPYPERVGDPDCSYYMRTGMCRFGMTCKFNHPADRKLAVAAARMKGEYPQRIGQPECQYYLKTGTCKFGATCKFHHPREKAAMATRVQLNELGYPLRLNEKECAYYLRTGQCKFGSTCKFHHPQPSTMMVAVRGSVYSPGQSATSPGHHAYQGAVTSWPLSRSASFIASPRWPGHSSYAQVIVPPGLVQVPGWSPYAAQIGSSSSDDQQRTPGAAQYYTGSRQSGTPGIGDRGMFSSYQAGSVPVGLYAVQTENVFPERPDQPECQFYMKTGDCKFGSVCKFHHPRERIIPTPNCALSPLGLPLRPGEPICSFYNRYGMCKFGPNCKFHHPMGNPMYGHASSPTSEAQTSRRMLAHVPSHPEVSPDSGSGRSRRIVHSDSQQIPSVERITEREAS

SEQ ID NO: 5951 - protein, 104 aa, Zea mays
  unsure (1)..(104): unsure at all Xaa locations
ATLTELVSSAENEYYQYKKQXKEHKHNQHLGESGAIAAGAFALYXKHEANKDPQHAHHRKIEEEVPSSSSVGSVGFAFYERHQKKKDHKQSKQAVGEKKHHFFG

SEQ ID NO: 5952 - protein, 232 aa, Zea mays
MSYFPGQGYNGGGGGGNGYGYGPPSGPPPPQQQYGGYSGDNSGSRRYPPPNYPPPPHLDAYGFPLPQGLNHHAQHARSGPPPPSVPQQFGHGAPEGYTFQYSRCTGRRKALLIGINYFNQEGELRGCINDVHNVSAFLVERYGYKREDMILLTDDQQDPVIIPTRENIIRAMGWLVSNAQPDDALFLHYSGHGGQVEDLDGDEDDGYDECIYPVDHSQAGPIIDDEIHFRVV

SEQ ID NO: 5953 - protein, 223 aa, Zea mays
MDTDTDTTTSTGSRLHPAAGHVRSLAARGAESLVTCVFATVGTVLGAITGGLIGLATETGVLRGTGVGGITGALVSMEVVESLWRSDEPAIWSVVYVLDVIWSLLTGRLVREKVDPAVLSAVESQMSAADTPALHGDHADIFDTGGTNGMARVAMDALPVVRFTERSNVDANGDLIACSVCLQEFQAGDSARSLPVCRHTFHLPCIDGWLLRHASCPLCRRAV

SEQ ID NO: 5954 - protein, 460 aa, Zea mays
SFPIPEPGPPPRVRPPPSPPTPAPPSFHTHLDPPNPNPSGRTAAMAESGESSPNSAAATDDTQHEMPEAGAAAAAVHAQPRPPPPPSRARLMVSYGGRIQPRPFDPLLACVCGVTLILSLERPLCFPGFAARLAALVGFAAAVRVKYQLPGEDLDALVSVTNDEDLEHLVHEYDRLHVHRHATASSAGSSRGGSAPRLRVFLFPVQSPPPPPQPAGILEPKSEQRQWFVDALNTVLLPSSKQDPPPVPPQQQKQEQESVFAQQSPPPQAKHEAVFVQQSPPQPQTVVQMQMPPPQHVVLAAASPDYLFGLDNGFVHPPAVKVKDPAGDPPAVRESVPVELPAKNEDRHPIPNPAGDNVAVSPAEYQRQIPGLEKLQVADNAAHQPPPPAPAPAPAPSLAPTPVPAALPRNGSDDSLTRGYPLATPTPNSSAEYYLPKFPEKPPVPPPPQSSAPPPPTYLQ

SEQ ID NO: 5955 - protein, 289 aa, Zea mays
  unsure (1)..(289): unsure at all Xaa locations
TPQFYTSSVVPMGAGGGGGLWVSNSAYIYLCVXFIQMLKGLMPVAVYSIGVLFKSETFRGSSMAGGXGAISFGVAIAAYGEGRFDVRGVXLQLAAVAFEGTRVVLIQSLLTCKGISLNPMRGLYYVAPCCFCFLLVPWAFVELPRLRAVGTFQPDFFVFGTNSLCAFALNLAVFLLVGKTSALTMNVAGVVKDWLLIAFSWSVIRDTVTPINLFGYGIAFLGVGYYNHVKLQALKAKEAQKKATQADEEAGSLLQERDGHSDRKSDPASSSACVAFFWASLALSACSLT

SEQ ID NO: 5956 - protein, 101 aa, Zea mays
LSVHERNLSFVAYNNVIGTRRASWRIGSSIEQKEESRKNEEHVNLIKEYRAKIEALLCYILYVILNLLYSHLVPSSTAAESMVFYLMTMVYYQRYLAEFKT

SEQ ID NO: 5957 - protein, 581 aa, Zea mays
  unsure (1)..(581): unsure at all Xaa locations
MGEVEDMYTQDGTVDMKGNPAVKKGTGNWRACPYILANECCERLAYYGMSTNLVNYMKTRLGQVNSVASNNVTNWQGTCYITPLIGAFFADAYMGRFWTIAIFMIIYIFGLALLTMASSVKGLVPTSCGDKDVCHPTDAQTGXVVFVALYLIALGTGGIKPCVSSFGADQFDENDEREKKSKSSFFNWFYFSINIGALVASTVLVYVQTHVGWGWGFGIPAVVMAIAVGSFFVGTPLYRHQKPGGSPLTRIAQVLVACARKWNVAVPADKSRLHETVDGESGIEGSRKLEHSEQLACLDRAAVVTAEDGAEASPWRLCSVTQVEELKSVIRLLPIWASGIVFAAVYSQMSTMFVLQGNTLDQSMGPRFKIPSATLSMVDTISVIVWVPVYDRAIVPLVRSYTGRPRGFTQLQRMGIGLVVSIFSMVAAGVLDIVRLRAIARHGLYGENDIVPISIFWQIPQYFIIGCAEVFTFVGQLEFFYDQAPDAMRSMCSALSLTTVALGNYLSTVLVTIVTHITTRHGRIGWIPENLNRGHLDYFFWLLAVLSLLNFLAYLVIASWYKYKKTADDYPGAKGEHGTEH

SEQ ID NO: 5958 - protein, 580 aa, Zea mays; identical to SEQ ID NO: 1212

SEQ ID NO: 5959 - protein, 267 aa, Zea mays
ISSATCRTRLLLNPRKLNTFGYILAEEQTDPYKIPTKHNIRMAMYWLVQGCQPGDSLVFHYSGHGSQQRNYSGDEVDGFDETLCPLDFETQGMILDDEINTALVRPLPHGVKLHALIDACHSGTALDLPYLCRMNRSGQYVWEDHRPRSGVWKGTSGGEAISFSGCDDDQTSADTSALSKITSTGAMTFCFIQAIERGQGTTYGSILNSMRSTIRNTGDSAGVGGGAVTSLITMLLTGGSLSAGGLRQEPQLTACEPFDVYAKPFSL

SEQ ID NO: 5960 - protein, 425 aa, Zea mays; identical to SEQ ID NO: 977

SEQ ID NO: 5961 - protein, 187 aa, Zea mays
MATERESKTFLARLCEQAERYDEMVTYMKEVAKVAGELTGDERNLLSVAYKNVVGTRRASWRIISSIEQKEESKGTEKHVGTIRDYRQKIETELEQVCQDVLNVLDDSLIPKAESGESKVFYHKMKGDYHRYLAEFASGEKRKVAATAAHEAYKTATDVAQTELTPTHPIRLGLALNFLVFYYEILN

SEQ ID NO: 5962 - protein, 186 aa, Zea mays
NKKQNRSSSSTGTLPLWPLPCLPFPSPSSSPHPPTHPLQSFPQPTAAVDARVFYLKMKGDYHRYLAEFKTGAERKDAADSTLAAYQAAQDIAVKELPPTHPIRLGLALNFSVFYYEILSSPDRACSLAKQAFDEAISELDSLGEESYKDSTLIMQLLRDNLTLWTSDMQEDGGDEMRDANKPDEEQ

SEQ ID NO: 5963 - protein, 131 aa, Zea mays; identical to SEQ ID NO: 1069

SEQ ID NO: 5964 - protein, 322 aa, Zea mays
  unsure (1)..(322): unsure at all Xaa locations
MAKGDVVQAEKSFMGMPGFVVDFLMGGVSAAVSKTAAAPIERVKLLIQNQDEMLKTGRLDRKYDGIAECFRRTSQQEGVLSLWRGNTANVIRYFPTQALNFAFRDTYKSMFAFKKERDGYAKWMAGNLASGGAAGATSLLFVYSLDYARTRLANDAKNAKKGGDRQFNGLVDVYKKTLASDGIAGLYRGFMPSVXGIVVYRGLYFGMYDSIKPVLLTGNLLRXNFLASFALGXWAVTTGAGIASXYPLDTIRRRMMMTSGEAVKYKGTMDAARQIVAAEGVTSLFKGAGANILRGVAGAGVLSIYDQAQLLLFGKKFKGGSG

SEQ ID NO: 5965 - protein, 240 aa, Zea mays
MSQDKSAFGMPGFVVDFLMGGVSAAVSKTAAAPIERVKLLIQNQDEMLKSGRLDRKYDGITECFKRTAQNEGVLSLWRGNTANVIRYFPTQALNFAFRDTYKSMFAYKKERDGYAKWMAGNLASGGAAGATSLLFVYSLDYARTRLANDAKSAKKGGERQFNGLVDVYKKTLASDGIAGLYRGFLPSVAGIVVYRGLYFGMYDSIKPVLLTGSLEGNFLALFALGLCRVPVIYDPQLILF

SEQ ID NO: 5966 - protein, 128 aa, Zea mays
  unsure (1)..(128): unsure at all Xaa locations
MALSEEKTSSAREYKVXGSLSADFGRLDIDVAEVEMPGLMECRAEFGPSKPFTGARISCSLHMTIQTDGLIDTLTALGADVRWMXCKIFSTQDHAAXVISRESVAVLACKGETLHQYCACAPHHCLDW

SEQ ID NO: 5967 - protein, 347 aa, Zea mays
MDPWISSQPSLSLDLRVGLPPLSLHHQAPVAVALPRPKLLVEENFLLPPPKKEPEVAALETELQRMGEENRRLAEALAEVASKYEALRGQYTEMVAAAATACGNHPSSTSEGGSVSPSRKRKSESTDTAPPAQQLLHQHYPAVAPDQTECTSGEPCKRIREAECKPRVSKLHVHADPADLSLVVKDGYQWRKYGQKVTKDNPCPRAYFRCSFAPACPVKKKVQRSADDPTILVATYEGDHNHGQPPPQAQAPHDGSSPGASKKPPSPPRPVAAAPAPLHHQQVQQHQQQQAVGAVKCEPPVAAAASELIRRNLAEQMAMTLTRDPSFKAAFVTALSGRLFEMSPTKD

SEQ ID NO: 5968 - protein, 511 aa, Zea mays
  unsure (1)..(511): unsure at all Xaa locations
MMASQAMVPLRQLFVDGEWRPLALGRRLPVVNPTTEAHIGEIPAGTTEDVDPAVXASSRAALKRNXRGRDWARAPGAVRARDLRAIVAKGIERKQELAKLEALDCGKXYDEAAWDMDDVAGCFEYFADQAEALDKRQNSPVSLPMETFKCHLRREPIGVVGLITPWNYPLLMATWKXVAPALAAGCTAVLKPSELASVTCLELADICKEVGLPSGVLNIVTGLGPDAGAPLSAHPDVDKVAFTGSIETGKKIMASAAPMVKPVTLELGGKSPIVVFDDVDIDKAVEWTLFGCFWTNGQICSATSRLLIHTKIAKKFNERMVAWAKNIKVSDPLEEGCRLGPVVSEGQYEKIKKFISNAKSQGATILTGGVRPAHLEKGFFIEPTIITDITTSMEIWREEVFGPVLCVKEFSTEDEAIELANDTQYGLAGAXVISGDRERCQRLSEEIDAGCIWVNCSQPCFCQAPWGGNKRSGFGRELGEGGIDNYLSVKQVTEYISDEXPWGWYQSPSKL

SEQ ID NO: 5969 - protein, 404 aa, Zea mays
ASFCLPAFLPDLRLLPTRQSRSTASAPPHRSSARKRGARGQAMGKEGASGGGGGGDGGMSASVIRKVLVSYMYVAVWIFLSFSVIVYNKYILDPKMYNWPFPISLTMVHMAFCSSLAVALVRVLRVVDLPSSPAMTSQLYLSSVVPIGALYSLSLWFSNSAYIYLSVSFIQMLKALMPVAVYSIGVLFKKETFRSSAMLNMLSISFGVAIAAYGEARFDARGVALQLAAVAFEATRLVLIQILLTSKGISLNPITSLYYVAPCCLAFLVVPWVFVELPRLRAVAGGFQPDLFVFGTNSLCAFALNLAVFLLVGKTSALTMNVAGVVKDWLLIAFSWSVIRDTVTPVNLFGYGIAFLGVGYYNHVKLQALKAKEAQKKAAQADEEAGSLLQERDSHGDRKTDNQA

SEQ ID NO: 5970 - protein, 183 aa, Zea mays
  unsure (1)..(183): unsure at all Xaa locations
MGLSVDNTSSGRQHXVKELSHEDFVRLEIELXQAEMPGLMACRAEFGPSNPFAGARMSVALHMTIQTAVLIKTLTAVGAEVRWCSCKIFSTQDHGVAVIARDSGAEFAWKAETLDEDCGGNHRCLDXGKEGGPYLIIDDGGKSTLLIHKDDKAKDDYENTGQRPHPENIDNAEFKTAVTIIRD

SEQ ID NO: 5971 - protein, 350 aa, Zea mays
MSIELLASAFNLCAVLCPANCLRSLSRSLSRFSRLPSSLCLLQEPMAATTIDWHARNNAALPAAMYGVAVPDSKELVRALIAPPMQQAPTISFAYPCSGVEQQSAAGSFLGAGGGGLTPAQILQVQSRLQFLRRPAGAAVATQPMKRQGVPLPQAPAVSKLYRGVRQRHWGKWVAEIRLPRNRTRLWLGTFDTAEEAALAYDSAAFRLRGDSARLNFPELRRGGQHLGPPLHAAVDAKLHAICNGTDVVVPPPQSRSNDATVVATATATATTAPSPFSSASPHVKSEPGSSGSDSSFSADGDVSSTGSSDVVLDMQLLDFSEASWDDSESFRLRKYPSLEIDWDSILLIS

SEQ ID NO: 5972 - protein, 212 aa, Zea mays
MKRFAVQESEMARMLVLMSRSHGQDQALPLSACLAGGQQGEDRQAPERVFVCKTCNRVFPSFQALGGHRASHKKPRLDGDGGGDPSLAKPKLHGCSVCGLEFAIGQALGGHMRRHRAMTGGVPAVPPATTRIVVDEKPDGDVVGIIRHDHVHDHGGVKQPRGGLWLDLNYPPCDDGRDAVEAECGRNAAAATGITFHQFLDTATMAVDCLGY

SEQ ID NO: 5973 - protein, 127 aa, Zea mays
TRYPGIAPNLEEIRQLLHKGEQTVNTIISFGQFLDILPIRASKGYAVRWLSQQWNIPLEHVFTAGGSGADEDMMRGNTLSVVVANRHHEELSNLGEIEPIYFSEKRYAAGILDGLAHYRFFELLDPV

SEQ ID NO: 5974 - protein, 346 aa, Zea mays
  unsure (1)..(346): unsure at all Xaa locations
RREEMAASEGVLLGMGNPLLDISAVVDDAFLAKYDIKLNNAILAEEKHSPMYDELASNSNVEYIAGGATQNSIRVAQWMLQTPGATSYMGCIGKDKFGEEMKKNAQAAGVTAHYYEDETAPTGTCAVCVVGGERSLIANLSAANCYKSEHLKRPENWALVEKAKYIYIAGFFLTVSPDSIQLVAEHAAANNKVFLMNLSAPFICEFFYDAQEKVLPYADFIFGNETEAKIFAKVRGWETENVEEIALKISQLPLASGKQKRIAVITQGADPVVVAEDGKVKTFPVILLPKEKLVDTNGAGDAFVGGFLSRLVQGKSIEDCVTAGCYAANVIIQAXGCTYPEKPDFN

SEQ ID NO: 5975 - protein, 70 aa, Zea mays
ARVITSTHQEIAEQYAQYDYYQPDQMLVIPPGTDLEKFYPPKGNEWETPIVQELQRFLRHPRKPIILALS

SEQ ID NO: 5976 - protein, 409 aa, Zea mays
  unsure (1)..(409): unsure at all Xaa locations
MDRLGGSARLLLVSDLDQTMIDHDDRENLSLLRFEALWEAEFAQDSLLVFSTGRTPVSYKGLRRDRPLVTPDVTIMSVGTVIAYGEEMVRDVGWEERLDSDWDRAIVVEETARLPQLARMQPERNQGPHKVSFFVDKQGAQEVMDYLPKKLERRGVHVKIVYSSGNALDVLPRGAGKGQALVYLLKKLDSNGKPPKNTLVCGDSGNDAELFGVPSVHGVMVCNAQEELVQWYQENARDNPRIIQATERCAAGIMQAIXADVVVRFYVLYEKWRRGELPSSNYFSSSSAMRYLKSITHPNGTIIHPCGSERSLHASRSLHASVDALLSSCYGDKKNFRVWVDRLVTSPIGTSSWLARLDSLEMEGGVRYCCRTTILLNIKPESPEGLELTHIHKTWVQGHSAGPGSALVF

SEQ ID NO: 5977 - protein, 358 aa, Zea mays
  unsure (1)..(358): unsure at all Xaa locations
MSDGAGSRTGVAGALGLSVTSSVAIVICNKYLISTLGFFFXTTTLTSWHLMVTFFTLYVXAQRLRFFEPKPIDARTVISFGLLNGISIGLLNLCLGFNSVGFYQMTKLAIIPFTIVLETLFLSKKFSQSIKASLMVLLLGVGIASVTDLQLNLLGSIIAVLTIAATCVGQILTNQIQRRLKVSSTQLLYQSSPYQSAVLLVTGPFVDKLLTKRDVFAFSYTTQVVVFILLSCSIAVCVNFSTFLVIGTTSPVTYQVLGHLKTCLVLSFGYIILKDPFSARNVVGILIAIFGMGLYSYYSVVESRKKTEDASSLPVAAQMSEKDSAPLLGAKSSPRTENKAEETFDYMPRTAKSAFTGR

SEQ ID NO: 5978 - protein, 98 aa, Zea mays
MKNSALTDALGGRQIGKVYVSNKEIGRGSNGTIVFEGSYDGRQVAVKRLLRSHNDIAEKETRNLIISDHDPNIVRLYGCDHDSDFVYISLERCHCRHA

SEQ ID NO: 5979 - protein, 184 aa, Zea mays
MISLLGHIITVFYLVYSSLLQYVHHLQWKYSLGSFNLLGHTAPAQAASLLVLGPFVDFWLTNKRVDAFNYTSIVTFFIVLSCIIAVGTNLSQFICIGRFTAVSFQVLGHMKTVLVLTLGFFFFGKEGLNFHVALGMFLAVIGMIWYGNASSKPGGKERQVYSTPSEKTQKHGVLSSQSELDQKV

SEQ ID NO: 5980 - protein, 197 aa, Zea mays
MVASGGHEDVSFRDNVLQGKDLKTLHQSLEGTDGVDLGHKDIIMVDHMRKMKNNAIVCNIGHFDNEIDMLGLETYPGVKRITIKPQTDRWVFPETNTGIIVLAEGRLMNLGCATGHPSFVMSCSFTNQVIAQLELWKEKSSGKYEKKVYVLPKHLDEKVAALHLGKLGAKLTKLTKSQADYISVPIEGPYKPAHYRY

SEQ ID NO: 5981 - protein, 266 aa, Zea mays; identical to SEQ ID NO: 962

SEQ ID NO: 5982 - protein, 245 aa, Zea mays
MGRGKVQLKRIENKINRQVTFSKRRSGLLKKAHEISVLCDAEVALIIFSTKGKLYEYSTDSCMDKILDRYERYSYAEKVLISAESETQGNWCHEYRKLKAKVETIQKCQKHLMGEDLETLNLKELQQLEQQLESSLKHIRTRKNQLMLESISELQRKEKSLQEENKVLQKELAEKQKAQRKQVQWGQTQQQTSSSSSCFVIREAAPTTNISIFPVAAGGRLVEGAAAQPQARVGLPPWMLSHLSS

SEQ ID NO: 5983 - protein, 256 aa, Zea mays; identical to SEQ ID NO: 5764

SEQ ID NO: 5984 - protein, 198 aa, Zea mays
MAECKDDDSGRRSPSSSMDSSTHPPALSTASSASRRPPERRDQLSPDLQLGLSLSPASSALLVAETNNSIVPSTPRNQALPDWPPIKPFLRSALTASARRRRTLFVKVYMEGVPIGRKLDMLLLDGYSSLLAKLRHMFKTSITYADAVEYHQRVPHEKAAHVLTYEDHDGDWMMVGDVPWELFLGSVKKLRIARTDRC

SEQ ID NO: 5985 - protein, 590 aa, Zea mays
MPLRQRPTMGGGGGGVAKMPAGQLWLLLLGVLLLAFGVPAQASRNTHYDFVITETKVTRLCHEKTILAVNGQFPGPTIYARKDDVVIVNVYNQGYKNITLHWHGVDQPRNPWSDGPEYITQCPIQPGANFTYKIIFTEEEGTLWWHAHSEFDLEAGRGAIVIHPKRGTVYPYPKPHKEMPIILGEWWNADVEQILLESQRTGGDVNISDANTINGQPGDFAPCSKEDTFKMSVEHGKTYLLRVINAGLTNEMFFAVAGHRLTVVGTDGRYLRPFTVDYILISPGQTMNMLLEANCATDGSANSRYYMAARPFFTNTAVNVDDKNTTAILEYTDAPPSAGPPDSPDLPAMDDIAAATAYTAQLRSLVTKEHPIDVPMEVDEHMLVTISVNTIPCEPNKTCAGPGNNRLAASLNNVSFMNPTIDILDAYYDSISGVYEPDFPNKPPFFFNFTAPNPPQDLWFTKRGTKVKVVEYGTVLEVVFQDTAILGAESHPMHLHGFSFYVVGRGFGNFDKDKDPATYNLVDPPYQNTVSVPTGGWAAMRFRAANPGVWFMHCHFDRHTVWGMDTVFIVKNGKTPNAQMMPRPPNMPKC

SEQ ID NO: 5986 - protein, 366 aa, Zea mays
PLERKLCILKGVFPRQPKKKVEGNHKTYYHTKDIAFLAHDPLIEKFREIKVHRRKVKKAVAKKNRDLADRLLNRPPTYKLDRLVLERYPTFVDALRDLDDCLTMVHLFAALPAVDGERVEVKRIHNCRRLSHECLTFISVKGIYYQAEVQGQKITWLTPHALQQVLTDDVDFNVMLSFLEFYETLLGFVNFKIYHSINVNYPPILDPRLEALAVELYALCRYMSAGSRRMIGNSQTDEVMEDKDEKSKAEEVIEEEKVVKNKASSKADESEFRLAQLQHQLPTNEPGALMNLVEESTADDADDDDTKDCKGLFKNLKFYLSREVPRESLLFIIPAFGGTVSWEGEGAPFKEIDEDITHQLKTCPTH

SEQ ID NO: 5987 - protein, 356 aa, Zea mays
MWDSYSQYHFSCQFTADLIAMNHTDFIITSTFQEIAGSKDTVGQYESHIAFTLPGLYRVVHGIDVFDPKFNIVSPGADMSVYYPYTETDKRLTAFHPEIEELIYSDVENSEHKFVLKDKKKPIIFSMARLDRVKNMTGLVEMYGKNARLRELANLVIVAGDHGKESKDREEQAEFKKMYSLIDEYKLKGHIRWISAQMNRVRNGELYRYICDTKGAFVQPAFYEAFGLTVIESMTCGLPTIATCHGGPAEIIVDGVSGLHIDPYHSDKAADILVNFFDKCKADPSYWDKISQGGLQRIYEKYTWKLYSERLMTLTGVYGFWKYVSNLERRETRRYIEMFYALKYRSLASQVPLSFD

SEQ ID NO: 5988 - protein, 229 aa, Zea mays
VDPASEEEGKSPPPAFVLRRVEGMKNEQAISEVLCWSRDPSELRRLALRKDEIHSSLRGGSYHQMRNGSREFMSTLANYKIPIAVVTTRPRKVIEEAIEAVGVRSFFDAVVTAEDVYRGKPDPEMFLYAAQLLSFIPERCIVFGNSNSAVEAAHDARMKCVAVASKHKIYELSAADLVVKQLDELSVIDLKNLADIESPEFGMEPEPEMEEEEEVPPPSTSVGIDDLFW

SEQ ID NO: 5989 - protein, 249 aa, Zea mays
MVVVAAANRQSSTSEGGSAASPSKKRIRSDSLDTAPHHQNTRKPSPSPPPPFAAHDQMECTSAAAAAAFHHEPARRIREERKPKVSRRYVHADPSDLSLAVKDGYQWRKYGQKVTKDNPCPRAYFRCSFAPSCPVKKKVQRSADDRTILVATYEGDHNHAQPPRHNGGGNKAATRSTPAATEAARPAPPLPLQHQQQQKQEAATGPSSEVARKNLAEHMAVTLTRDPGFKAALVSALSGRILDLSPPRD

SEQ ID NO: 5990 - protein, 179 aa, Zea mays
  unsure (1)..(179): unsure at all Xaa locations
MEALFGSNNHGGHKAADLASLIITQVALEVPRLLGLLAMILHNEIFTSGGDQNLITRILGKSEDETNPENKDDGESDDDNDDEGDDDDAENEEEDDGGDEGSDDNENEEDDDGDDDDPAANGEGGSDDDEDDGGEDEEDDDDDDDDGDDGNEEEEEESEEDEXDDDDDEVPQPPTKKRK

SEQ ID NO: 5991 - protein, 138 aa, Zea mays
QSMAVGTIMVRWVSKYSDPIMATGWHMIIGGLPLLVISVLNHDPALSGHIQDLTWSDILALGYTSIFGSAVSYGVYFYNATRGSLTTLSSLTFLTPMFASVFGYLYLGETFSTVQIGGALLTLVAIYMVNYKSIIGEK

SEQ ID NO: 5992 - protein, 458 aa, Zea mays
MALTTASTVSSPSRIIRRFSSSQDSRPPSSLLHLAPRRGPGNSPRACSWHRLVVRRMGWAARALLGGLSDAGASESDEEEEHVLRVGQREGEIDDAVELSAAAVGPERWDVLGLGQAMVDFSGMVDDEFLDRLGIEKGTRKVINHEERGRVLRAMDGCSYKAAAGGSLSNSLVALARLGSSQSAGYPELNIVMGGSVGSDPLGSFYRAKLRRANVHFLSKPVKDGTTGTVIVLTTPDAQRTMLAYQGTSSTLSYDSDLASLVSKSNVLIVEGYLFELPHTIEAIKQACEDAHKNGAIIAVTASDVSCIKRCYNDFRDIVRNYADILFANANEARALCELPSTDSPMSATRYLSHSVPLVSVTDGMHGSYIGVKGEAIYIPPPQCVAVDTCGAGDAYASGILYGVLRGASDLKGIGLLASRVAAVVVGQQGTRLRVQDADRLAGSFEHHLDSLEFCSDV

SEQ ID NO: 5993 - protein, 154 aa, Zea mays
  unsure (1)..(154): unsure at all Xaa locations
MAAAFMEQALEQAIVCAWILEVPVGCVIVEDGKVISSGSNKTNATRNATRHAEMEAIDVLLREWQSMGLDQPQVAEKFAGCDLYVTCEPCIMCATALSIIGIREVYFGCANDKFGGXGGSIMSLHNGAASSSDELSGSQASTQKVSNALGGIMA

SEQ ID NO: 5994 - protein, 347 aa, Zea mays
VGTGGALSLSVVSSVSIVICNKALMSSLGFNFATTLTSWHLLVTFCSLHVALCMKLFEHKPFDARTVMGFGVLNGISIGLLNLSLGFNSVGFYQMTKLAIIPCTVILETLFFRKKFSRNIKLSLSVLLLGVGVATVTDLQLNVMGSVLSLLAIITTCIAQIMTNTIQKKFKVSSTQLLYQSCPYQALTLFLVGPFLDGFLTNQNVFAFDYTTQVLFFIVLSCLISVSVNFSTFLVIGKTSPVTYQVLGHLKTCLVLTFGYVLLHDPFSWRNILGILIAVIGMVLYSYFCTRETQQKPAEASPQAVQAKEGESNPLISDSLSAAENGGSATDDEPLKVPMWSSKYSKA

SEQ ID NO: 5995 - protein, 318 aa, Zea mays
  unsure (1)..(318): unsure at all Xaa locations
MATAAATAAAAAVSSPAARGAAGAAAASRRGFVTFGGGAARFSPTLRSGRGFSGVQTHVAAVEQAVVKDATKLEAPVVVVTGASRGIGKATALALGKAGCKVLVNYARSSKEAEEVSKEIEASGGEAITFGGDVSKEADVESMMKAALDKWGXIDVLVNNAGITRDTLLMRMKKSQWQDVIDLNLTGVFLCTQAATKVMMKKRKGKIINIASVVGLTGNXAQANYSAAKAGVIGFTKTVAREYASRNINVNAIAPGFIASDMTAELGEELEKKILSTIPLGRYGQPEEVAGLVEFLALNPAASYMTGQVLTIDGGMVM

SEQ ID NO: 5996 - protein, 194 aa, Zea mays
  unsure (1)..(194): unsure at all Xaa locations
MLLSVDNTSAGRQHEVKDLSQEHFGRLEIEMREVEMAVLMACRAECGPYKPFADARISGSLHMTIHXTATSSRPSPRLGVEVXWCSCCISLHARNQRRQPPSLRDSAAXSAEKDXTLEEYWWCTERCLDXVRAVPPDLIEDDGQXATLLIHDRVQGEEDYNKIGKIPDPESTDDAEIKIEITIIRDCVKVDPKN

SEQ ID NO: 5997 - protein, 229 aa, Zea mays
CSLFLCLWLSMLARAATRLYEWEVSYQFKSPDCVRKLSATINGQTPGPTIRATQGDTVEVKVRNSLLTENLAIHWHGIRQIGTPWADGTEGVTQCPILPGDTLTYAFVVDRPGTYMYHAHYGMQRSAGLYGVVVVVVAAAPGAKADDAEPFAYDDEHHVLLNDWWHNSTYELAVGLASVPMVWVGEPHSLLINGRGRFNCSAAAVPGTCNATSPECDTPVFAVVPGKTY

SEQ ID NO: 5998 - protein, 257 aa, Zea mays
MCGGAILAELREPAPRRLTERDIWQQKKKPKSTFSSPRVRTMTSAVARSAKRKRKNLYRGIRQRPWGKWAAEIRDPQKGVRVWLGTFNSPEEAARAYDAEARRIRGKKAKVNFPDAPAVGQKHRSGSASAKASKSSFGQKPIVKGSNSFGCSDLGWENDTKTPDITSIAPISTIAEGDESAFVDSNSNSSFVLPALENSAVDLTDGLTDLESYMRFLLDGGPSDSVDSLLNLDGSQDVGSDMDLWSFDDMPIVGDFF

SEQ ID NO: 5999 - protein, 268 aa, Zea mays
MRIQCDACEAAAATVVCCADEAALCARCDVEIHAANKLASKHQRLPLALGDATAASASSLPRCDVCQEKPAFIFCVEDRALFCRDCDEPIHVPGTLSGNHQRYLATGIRVGFSSVCGAGAGAEGLPPPAPPKGSSKPAAVVSAPAAGATKTTTTVKDTLPQEVPSSPFLPPSGWAVEDLLQLSDYESSDKKDSPLGFKELEWFADIDLFHAHSPAKTTTAEVPELFASPQPASNAGFYKTNGVARQSKKPRMEVPEDDEDYFIVPDLG

SEQ ID NO: 6000 - protein, 894 aa, Zea mays
  unsure (1)..(894): unsure at all Xaa locations
FLRPEVAGRTLADCRGLRTLNLSGNHLVGPFPPDVAALTSLAALNLSNNNFSSDLPADAFTELQQLKVVALSFNHFNGSIPDSLAALPELDVLDLSSNTFSGTIPSSICQGPNSSLRMLYLQNNYLSGAIPESISNCTRLESLDLSLNNINGTLPASLGKLRELRDLILWQNFLEGEIPASLENLDKLEHLILDYNGLTGSIPPELSNCLNWKSLRSNQLSGPIPAWLGQLSNLAILKLSNNSFSGPIPAELGNCQSLVWLDPEQQATGGTAKKLLVLGRXAVPANIGLVIGRPSHVYLRNDELSSECHGKGSLLEFTSVXGPEELSRMPSKELCNFTRVYMGSTEYTFNKNGSMIFLDLSFNQLDSPTREKRLLLHLDSGSKAPEAEIPKELGNMYYLMILEFPCNLLSGVIPPELAGAKKLAVLDLSHNQLEGPIPNSFSTLSLSEINLSNNQLNGSIPELGSLFTFPKISYENNSGLCGFPLLPCGHNAGSSSSDGHRSHRNQASLAGSVAMGLLFSLFCIVGIVIIAVECKKRKQINEEASTSRDIYIDSRSHSGTMNSNWRLSGTNALSVNLAAFEKRLQKLTFXINGFGDVYKAQLKDGKVVAIKKLIHVSGQGDREFTAEMETIGRIKHRNLVPLLGYCKCGEERLLVYDYMRFGSLEDVLHDRKKIGIKLNWAARKKIAIGAARGLAYLHHNCIPHIIHRDMKSSNVLIDEQLEARVSDFGMARMMSVVDTHLSVSTLAGTPGYVPPEYYQSFRCTTKGDVYSYGVVLLELLTGKPPTDSTDFGDDNNLVGWVKQHSKSRLTDLFDPELVKEDPALELELLEHLKIACACLDDRPSKRPTMLKVMAMFKEMQASSTVDSKTSACTDDACFADVEMTTLKEDKEEKD

SEQ ID NO: 6001 - protein, 287 aa, Zea mays
RGRVQTEETKNADKNGPIGIISAIGISILVGWGYILGVTFAVKDIPYLLSPDNDAGGYAIAEVFYLAFKSRYGSGAGGIVCLGVVAVAVYFCGMSSVTSNSRMAYAFSRDGAMPFSSVWHKVNKQEVPINAVWLSALVALCMALPVYSLGSLVAFQAMVSIATIGLYISYALPILFRVTLARKYFVPGPFNLGRYGVLVGWVAVLWVATITVLFSLPVTYPVTKDTLPAAPVAVARPPLPRPRVLAAQRQALVQGPRHQSGRMNMYNWTCIVERLAETEELVANDML

SEQ ID NO: 6002 - protein, 137 aa, Zea mays
  unsure (1)..(137): unsure at all Xaa locations
MTMFRSISMVMLLVALVTFISMVSSAASSPEADFVKKTISSHKIVIFSKSYCPYCNKAKSVFRELDQVPYVVELDEREDGWSIQTALGEIVXGRRTVPQVFINGKHLGGSDDTVDAYESGELXAKLLGVSGNKEAEL

SEQ ID NO: 6003 - protein, 152 aa, Zea mays
  unsure (1)..(152): unsure at all Xaa locations
GRSCPLAELAFIDPWLEDKHHHHHLFHHKKDEEHLAAGGYGESAESTEATVTXVVSTGENKYDEYKKEDKEHKHKQHLGEAGAIAAGAFPLYEKHDAKKDPEHAHRHKIKEEVAAAAAVCYGGFAFHEHHXKKKDHKEADEAGGEKKHHFFG

SEQ ID NO: 6004 - protein, 165 aa, Zea mays
  unsure (1)..(165): unsure at all Xaa locations
RVQSVTCSPSNKLIRPDIPLLARFIIHAREEKHHHHHLFHHKKDEEQLAAGGYGESAEYTXATVTEVVSTGYNEYYEYKKEEKEHKHKQHLREAGAIVAGAFQLYXKHEAKKDPEHAHRHKIEDEVMAEAXVRSGRFTFHXTTQKKKDHTEALEVGSEKKHHLFC

SEQ ID NO: 6005 - protein, 232 aa, Zea mays
MEYAAVGYGYGYGYDERQEPAESADGGGGGDDEYATVLSAPPKRPAGRTKFRETRHPVYRGVRRRGPAGRWVCEVREPNKKSRIWLGTFATPEAAARAHDVAALALRGRAACLNFADSARLLQVDPATLATPDDIRRAAIQLADAASQQDETAAVAADVVAPSQADDVTAAAAAAAAMYGGGMEFDHSYCYDDGMVSGSSDCWQSGAGAGGWHSIVDGDDDDGASDMTLWSY

SEQ ID NO: 6006 - protein, 478 aa, Zea mays; identical to SEQ ID NO: 5656

SEQ ID NO: 6007 - protein, 237 aa, Zea mays
  unsure (1)..(237): unsure at all Xaa locations
IGYLEAGRDGFRHSLPDGVMKLTDLIIAAKVXMLCVSSVIVEYACTAALKHPGDLVIXVLEIPPPSEPSKLCMERLSVLPXNDIVSEAXDLFVTTXTDNKDLLMADHMNNMQNNGLVCHIEPFDDQNDMLGLDTYSGCRCIIIQPHTDRCAFPETHADVVVLADGRLIXNLEMATGHPSFVMCCSFATLAIAQLELWKEKRSALYXEEGGMCSPRTLHDNVAALHLNKLGAKMTKLT

SEQ ID NO: 6008 - protein, 270 aa, Zea mays
  unsure (1)..(270): unsure at all Xaa locations
MDPKMTEVTQMFAPASRRRYTRNDLDACVTLLSQLKVHLTKFPSLPPSFEQTPKAVEELKLARDIYEHAVVLSVKLEDQDAFERDFCQLKPYYMDTCGIIPPSPEEYPILGLNLLRLLVQNRIAEFHTELELLPVKALEHPCIKHAVELEQSFMEGAYNRVLSARQAVPHETYVYFMDLLAKTVRDEIAGCXSEKGYDSLSVSDAKQXLMFSSDQDLHEYITEEHPEWELKNGAVXFFQKAKESQPXKEIPSLQLINQTLSYARELERIV

SEQ ID NO: 6009 - protein, 396 aa, Zea mays
MSRAIATPTLKRLYSSSSSLYSPSSLLRRPLYTSLVDLDTEVEEGSSQQMDPWISSQPSLSLDLRVGLPPLSLHHQAPVAVALPRSKLLVEENFLLPPPKKEPEVAALETELQRMGEENRRLAEALAEVASKYEALRGQYTEMVAAAATACGNHPSSTSEGGSVSPSRKRKSESTDTAPPAQQLLHQHYPAVAPDQTECTSGEPCKRIREAECKPRVSKLHVHADPADLSLVVKDGYQWRKYGQKVTKDNPCPRAYFRCSFAPACPVKKKVQRSADDPTILVATYEGDHNHGQPPPQAQAPHDGSSPGASKKPPSPPRPVAAAPAPLHHQQVQQHQQQQAVGAVKCEPPVAAAASELIRRNLAEQMAMTLTRDPSFKAAFVTALSGRLFEMSPTKD

SEQ ID NO: 6010 - protein, 357 aa, Zea mays; identical to SEQ ID NO: 5542

SEQ ID NO: 6011 - protein, 418 aa, Zea mays
MGSSEPAGNPQIRPLLHPCAALSQLSRLRIQIRRHQRLLLPLLLHHHHQEVQQGGSGSGGDMGRDGGGGVAGGMSDSVLRKVLLSYFYVAVWIFLSFSVIVYNKYILDPKMYNWPFPISLTMVHMGFCSSLAVALVRVLRVVDLPTSPSMTPQFYTSSVVPIGALYAMSLWFSNSAYIYLSVSFIQMLKALMPVAVYSIGVLFKKETFRSSSMLNMLSISFGVAIAAYGEARFDVRGVALQLAAVAFEATRLVLIQILLTSKGISLNPITSLYYVAPCCFCFLLVPWAFVELPRLRAVGTFQPDFFVFGTNSLCAFALNLAVFLLVGKTSALTMNVAGVVKDWLLIAFSWSVIRDTVTPINLFGYGIAFLGVGYYNHVKLQALKAKEAQKKATQADEEAGSLLQERDGHSDRKSDNQA

SEQ ID NO: 6012 - protein, 127 aa, Zea mays
HACRCSCSPGKAKKPLPPIWSEVLRFFVNPHKPMILALSRPDPKKNVTTLLKAYGESRHLRELANLVRTLILGNRHDIEEMSGGAATVLTAVLKLIDRYDLYGCVAYPKHHKQTDVPHIYRLAAKTK

SEQ ID NO: 6013 - protein, 327 aa, Zea mays
  unsure (1)..(327): unsure at all Xaa locations
MGILCLGASSTLLCGEDRNNVLGLGCGNELVEVGSGHDGLDSVVGAVFPVDTDEAVRVXWGRLEYSRRKDAMEWIWKVDSYYRFGPLSLYLAVNYLEXDSLFSYDLPHDKPWMRQLLSVACLALAVKMEETVLPLPVDLQVCDVKFEFEARTIGRMELLVLATLKWRMQAVTPFTFISYFLDKFNGGKPPSMALASRCTEIIIGTLKGSTFLSFRPSEIAAASALAAVSENQVVGSSSALSASEVPINKEMIARCYELLQEQALVRKTGHINGSPSVPQSPIGVLDATCFSFRSEDVRLGSSQSNNISSSSNDNQVSKRRRLSISPI

SEQ ID NO: 6014 - protein, 341 aa, Zea mays
MAPPDAGAAAACGARWVRRDTLLGLALGQFVSLLITATGFASSELARRGINAPTSQSLLNYVLLAVAYGGVLLYRRQPLTIKWYYYLILGIIDVEANYIVVKSYQYTSLTSVMLLDCWSIPCVILLTWVFLKTKYGARKFLGVGVCVLGLILVVFSDVHASDRAKGPNPLKGDLFVILGSMLYACSNVTEEFVIKKSNRVELMAMLGLFGALISAIQISVLEREELHSITWTSGAVLPFLGFAVAMFLFYSAVPVILKLCGATMLNLSLLTSDMWAVLIRIFAYHEKVDWIYFVAFAATAGGIVLYSYKGSNEVEETAQVAGASDEHGKGRDEEAGTRNPA

SEQ ID NO: 6015 - protein, 166 aa, Zea mays
  unsure (1)..(166): unsure at all Xaa locations
MVLSVDKTSSGREYNVXISQQADFGRLEIDVIEREMPGLMTVPRLVRPXNPFADARISESLHMTIQIVVLFETLTELGDDGRWCSWIIFSWQEHVRRRHSARFARRVSTVTAMTSRSSGXCTLRCYLTGEDWPGPELIYDYHEDASVVIHEEALGNDADPKTVETP

SEQ ID NO: 6016 - protein, 287 aa, Zea mays
MNRGRETGGNLRESGLFSGCDGDGGAGMDRKRIKDVLEKHLERSSPSTSRGVVSKERERLAAGKLPASLGKAEKVSDGEEFETDSEDEDSDISGSESEGTSWISWFCTLRGNEFFCEIDDDYIQDDFNLCGLSMQVPYYDYALDLILDIESSDGEIVERKEFIELSAEILYGLIHARYILTSKGLAAMLEKFKNRDFGGCPRVYCCGQPCLPAGQSDVPRSSTVKIYCPKYEELNYPISMYQGSIDGSYFGTTFPHLFLMTYPHLKPQKPPQQYTPRVFGFKHHKPS

SEQ ID NO: 6017 - protein, 199 aa, Zea mays
  unsure (1)..(199): unsure at all Xaa locations
TVPWQHQSFPDEDNVTWQKLAQKADRYHEMSESHXQKVPRTADSKELTGEERNLLSGAYKNAIGARRASWRIISSIQQKEEGRRYDDRPTLLXDYRAKTETEPXPICDGILKLLDTHLVPSSTAPETTVFYLWMTGDYYTYLAEFTTGGERSDSAENTMMRYPVAHDIALGELAPTHPIRIGLRLNFSMCYYETLNVPD

SEQ ID NO: 6018 - protein, 313 aa, Zea mays
GSVYLGTLPDGSRIAVKKLEGIGQGKKEFRSEVTIIGSIHHIHLVKLRGFCAEGAHRLLAYEYMAKGSLDRWIFQRNEDSSLLDWDTRFSIALGTAKGLAYLHHDCESKIIHCDIKPENVLLDDNFLAKVSDFGLAKLMTREQSHVFTTLKGTRGYLAPEWITNYAISEKCDVYSYGMVLLEIISGRKSYDPVEGSEKAHFPSYAFKKLEEGDLRDISDSKLKYKGQDSRIEMAIKVALWCIQEDFYQRPSMSKVVQMLEGVCDVPQPPMSSHIGYRLYANAFKSSSEEGTSSGMSDYNSDALLSAVRLSGPR

SEQ ID NO: 6019 - protein, 216 aa, Zea mays
MAVQGVGRYGGIKVYAVLRDDGAEFAKNNNLEALFHVDDPGPRVPIKKGKFLDVNEALEVVRFDIQYCDWRARHDLLTIMVLHNKVVEVLNPLAREFKSIGTLRKELAELQQELAKAHNQVHLSETRVSSALDKLAHMETLVNDRLLPPDGASSTSTAQPTSLVPSTSSTARVRAKKPPRRGLNVSGPVKPYNPSLKNFWYPVAFSSDLKDDTMVN

SEQ ID NO: 6020 - protein, 319 aa, Zea mays
MPAFKAPAPGFAVRFSPFHENRLLAATSQHFGLVGNGHLIVLDLAGGGPGAAPAPVFSFPTSDALFDCAWSESHDSLCAAASGDGSVRLFDAALPPAQNPVRLLREHAREVHGLDWNPVRRDAFISASWDDTLKLWSPDRPASVRTFRGHEYCVYAAAWSARHPDVFASASGDRTARVWDVRDPAPTLILPAHDHEVLSLDWDKYDPSILATASVDKSIRVWDVRAPRAPIAQLAGHSYAVKRVRFSPHRQGMLMSCSYDMTVCMWDYRAEDALLARYNHHTEFVAGIDMSVLVDGLLASTGWDEMVYIWPFGTDPRAM

SEQ ID NO: 6021 - protein, 393 aa, Zea mays; identical to SEQ ID NO: 917

SEQ ID NO: 6022 - protein, 392 aa, Zea mays
MADAGEGRRVCGMPEKAQLHVAMLALQFGYAGFHVVSRLALNMGISKLVFPVYRNIIALCLLVPFAYFLEKKDRPQLTLNFVVQFFFLALCGITANQGFYLLGLDNTSPTFASAIQNSVPAITFAMAAALRIEKVRLDRRDGVAKVAGTLACVAGASVITLYKGPTIFGPGGGGGLELASTSKAVAGDKNWTLGCVYLIGHCLSWSGWLVLQAPVLKKYPARLSVTSYTCFFGVIQFLIIAAFMERDADAWKFHSGSELFTILYAGFIASGVAFAVQIWCIDRGGPVFVAVYQPVQTLVVAIMASLTMGEKFYLGGIIGAVLIIAGLYLVLWGKSEERARFARDAATLVSGSGDREGLLPAGGGGIRSASKAAASAATQPLLLPSSTSTDNV

SEQ ID NO: 6023 - protein, 356 aa, Zea mays
MGVAGEKFQLGTVGALSLSVVSSVSIVICNKALMSSLGFNFATTLTSWHLLVTFCSLHVALCMKLFEHKPFDARTVMGFGVLNGISIGLLNLSLGFNSVGFYQMTKLAIIPCTVILETLFFRKKFSRNIKLSLSVLLLGVGVATVTDLQLNVMGSVLSLLAIITTCIAQIMTNTIQKKFKVSSTQLLYQSCPYQALTLFLVGPFLDGFLTNQNVFAFDYTTQVLFFIVLSCLISVSVNFSTFLVIGKTSPVTYQVLGHLKTCLVLAFGYVLLHDPFSWRNILGILIAVIGMVLYSYFCTRETQQKPAEASPQAIQAKEGESSPLILDSLSAAENGGSATDDEPLKVPMWSSKYSKA

SEQ ID NO: 6024 - protein, 356 aa, Zea mays
MGVAGEKFQLGTVGALSLSVVSSVSIVICNKALMSSLGFNFATTLTSWHLLVTFCSLHVALCMKLFEHKPFDARTVMGFGVLNGISIGLLNLSLGFNSVGFYQMTKLAIIPCTVILETLFFRKKFSRNIKLSLSVLLLGVGVATVTDLQLNVMGSVLSLLAIITTCIAQIMTNTIQKKFKVSSTQLLYQSCPYQALTLFLVGPFLDGFLTNQNVFAFDYTTQVLFFIVLSCLISVSVNFSTFLVIGKTSPVTYQVLGHLKTCLVLTFGYVLLHDPFSWRNILGILIAVIGMVLYSYFCTRETQQKPAEASPQAVQAKEGESNPLISDTLSAAENGGSATDDEPLKVPMWSSKYSKA

SEQ ID NO: 6025 - protein, 105 aa, Zea mays
MSATKTKGQSIIDENPVAVFSKSYCPYCNQGKQLLSASGAKFYAIELDQVNDGSAIQSVLADITGQRTVPNIFIAQQHIGVNSDLQAKMGKLTPCSRELAPYKRP

SEQ ID NO: 6026 - protein, 531 aa, Zea mays
CVQGTPVKRLCKTQEIITVNGQFPGPTIEVYSGDTLAVRAVNLARYNVTLHWHGLRQLRNGWADGPEFVTQCPIRPGGSYTYRFTVEGQEGTLWWHAHSSWLRATVHGALIIHPRRGVPYPFPKPHTEAPVILAEWWRRDPIAVLRQSMITGAPPNVSDALLINGQPGDLLPCSSQETSIIPVVAGETSLLRIINAAMNTELFVSLAGHRMTVVAADAMYTKPFETDVVLLGPGQTTDVLVTAHAAPGRYYLAARAYASAQGVPFDNTTATAIFQYKNAPGCPKPMLPFLPAFNDTNTATAFSNRLRSPVPVKVPGPVTQEVFTTVGFGLFNCRPGPFCQGPNNTRFGASMNNVSFQLPDTVSLLQAHYHHIPGVFTDDFPALPPVFFDFTSQNVPRALWQPVKGTRLYRVRYGAVVQIVFQDTGIFAAEEHPMHIHGYHFYVLATGFGNYDPRRDAARFNLVDPPSRNTIGVPVGGWAVVRFVADNPGVWLVHCHIDAHLTGGLAMALLVEDGESELEATMAPPLDLPIC

SEQ ID NO: 6027 - protein, 180 aa, Zea mays
MRGAEEERSGTATDAGGEEEKQERSVGLMAGLMDKAKGFVVEKVMQIPKPEAALDHVSFRSISREGVELHSHVDISNPYSHRIPICEITYTFKSAGKVIASGTMPDPGWIAASGSTKLDLPVKVPYDFIVSLMKDLGGDWDIDYMMEVGLTVDLPAIGAFTIPLTTEGEIKLPTFRDLLF

SEQ ID NO: 6028 - protein, 280 aa, Zea mays
MSSAGPPPPLPPWSRLEGQVVLVTGASSGIGRDFCLDLARAGCRVVAAARRADRLRSLCDEINPSAASRAPRAVAVEVDVAAGGSALEAAVQKAWDAFGRIDALVNNAGIRGAVHSPLDWPEDEWDRIIKTNLTGSWLVAKHVCRRMRDAKLKGSVVNITSIAGLNRGHLPGSTGYASSKAAVHYATKIMALELGADRIRVNSIAPGLFKSEITAPLFQKRWLSTVASKIVPLKEHGATDPALTSLVRFLIHEASSYVTGNIFIVDSGATIPGVPIFSSL

SEQ ID NO: 6029 - protein, 204 aa, Zea mays
  unsure (1)..(204): unsure at all Xaa locations
MASHQDKASYQAGETKARTEEKTGQAVGATKDTAQHAKDRAADAAGHAAGKGQDAKEATKQKASDTGGYLGKKTDEAKHKAGETTEATKQKASETTEATKQKAGETTEAARQKAADAMEAAKQKAAEAGQYAKDTGXSPGRDKSSGVIQQATEQVKSAAAGXRDAVMSTLGMGGDXKQGDANTNTNTNTNTNTNKDSSTITRDH

SEQ ID NO: 6030 - protein, 206 aa, Zea mays
MASHQDKASYQAGETKARTEEKTGQAVGATKDTAQHAKDRAADAAGKGQDAKEATKQKASDTGSYLGKKTDEAKHKAGETTEAAKHKAGETTEAAKQKAGETTEAAKQKAGETTEAAKQKAADAMEAAKQKAAEAGQYAKDTAVSGKDKSGGVIQQATEQVKSAAAGAKDAVMSTLGMGGDNKQGDANTNTNTNTNKDSSTITRDH

SEQ ID NO: 6031 - protein, 375 aa, Zea mays
MGAEAAHGHPQQQPPSSLRPGREAAAPPAVVGLQLSALIDHVARVDWSLLDRVPGDRGGSQQVSIDELNHILDEVNAHILPSRNDLTPVTTIAGGSVANTIRGLSAGFGISTGIIGACGDDNQGLLFVNNMSFSGVDLTRLRAKKGHTVQCVCLVDASGNRTMRPCLSSAVKIQANEFRKEDFKGSKWLIVRYAQQNMEQIVEAIRIAKQEGLSVSLDLASFEMVRDSRSKLVNLLETGNIDLCFANEDEAREVIGGSLESDPEEALAFLGKYCKWAVVTLASKGCVAKHGKQVVRVPAIGESNAVDTTGAGDLFASGFLYGLVKGLPLEECCKVGACSGGSVTRALGGEVRPENWQWMYKQMHARGLLLPELKN

SEQ ID NO: 6032 - protein, 678 aa, Zea mays
  unsure (1)..(678): unsure at all Xaa locations
GKLTEEAEEILELLRSTWRTLGITETVHDTCYAWVLFRLWLHGCEQHALKVXLRVIEDGGSESVFSPNDKALLEKHLEFLKEFGVSGGDGMPRGTVENLVSRVRPVINLIKQETRVLIDDLREVTXVAMLNLERTPKPNLGSWVTEMIERHDINIRTXVKNTFLKMAHSVEFKADTTNEHVLASLAEPTKQLSKKDFHIFTPVLVHXNTRTLGVSASLIHKLYGNKLRSFLEHAEHLTEDVVSVFPAADALEQYIMSVMASVTGDDGLDSLCRHKLVPYQIESKSGTLVLRWVNGQLERIETWVKRAADQEVWDPISPQQRHGNSIVEVYRIIEETADQFFAFKVPMRDGELNSLCRGLDKAFQVYTQLVTAPLVDKEDLAPPIPVLTRYKKELGIKAFVKKEVQEVRTVDERKASEITQLTMPKLCVRLNSLYYGISQLSKLEDSINERWARKKSENTNIRRKSEKSKSAVPNQKNQFDGSRKEINTAIDRLCEFTGTKVIFWDLQQPFVENLYRNGVAQARLDTITEVLDLVLNQLCDVIVEQLRDRVVTGLLQACLDGFLRVILDGGSTRVFSPNDAALLEEDLETLKEFFVSGGDGLPRGTVENLVSRVRPVINLIKQETRVLIDDLREVTQGGKSKFGADSKTLLRVLCHRNDSEASHYVKKQFKIPSSAPSA

SEQ ID NO: 6033 - protein, 581 aa, Zea mays
MAISSALPCSLLVAALMLLASVVQVQGITRRYDFNVTMANVTRLCASKSIITVNGQFPGPKIVAREGDRLVIRVTNHAQHNISLHWHGIRQLRTGWADGPAYITQCPIQTGQSYVYNYTVVGQRGTLWWHAHISWLRATVYGPLVILPKLGVPYPFPAPYKEVPVIFGEWWLADTEVVIKQALQLGAGPNVSDAHTINGLPGPLYNCSAKDTYKLKVKPGKTYMLRLINAALNDELFFSVANHSLTVVEVDAVYVKPFTVDTLLIAPGQTTNVLLAAKPSYPGANYYMSAAPYSTARPATFDNTTVAGILEYEMYPDAPRPSAGSFNKALPLYRPTLPQLNDTSFVGNFTAKLRSLATPRYPAAVPRTVDRRFFFAVGLGTHPCPANATCQGPTNTTQFAASVNNVSFVLPTKALLHSHFTGLSSGVYSPDFPVAPLAPFNYTGTPPNNTNVASGTKLMVVPYGANVELVMQGTSILGVESHPLHLHGFNFFVVGQGYGNYDPVNDPPKFNLVDPVERNTVGVPAGGWVAIRFLADNPGVWFMHCHLEAHTTWGLRMAWLVLDGSLPHQKLLPPPSDLPKC

SEQ ID NO: 6034 - protein, 234 aa, Zea mays
MVGSSPLQAVLVAPGVKDRKVLAFKRDALKDKDAVSGLIHSILASSPAQRSAFYVFDLAKVVDLFRAWRRALPDARPCYAVKCNPDPALLGALAALGAGFDCASRAEIEAVLALGVRPGDIVYANPCKPEAHLEYAAEVGVNLTTYDSEEEVAKVRRCHPGCELLLRLKGPDGGDVRVDLGTKYGAHPDEVVPLLRAAQRAGVGVAGVSFHVGSGASNLHVYRGAIQAARAAFD

SEQ ID NO: 6035 - protein, 826 aa, Zea mays
MAPVFFLLPLLLGQILLCAAGDTINSSTPLSGAQKIVSKGNKFTLGFYTPPQGTNTSSNQGNYYIAIWYSNIPLQTTVWMANPDLPVADPTTAALTIGSDGNLVLLDQSKNRQVLWSTNISTSSNSTIAVLQDGGSLDLRDATNSSMVYWRSIDHPTNTWLPGGKLGLNKTTGVSQRLVPWTNTANPSPGLFSLELDPRGTTQYLIQWNDSITYWSSGPWNNNIFSLVPEMTSGYNYDFQFINNATESYFIYSMKDNSIISRFIIDVDGQIKQLTWVPASQSWILFWSQPRTQCEVYALCGAYGSCNLNALPFCNCIRGFSQKVQSDWDLQDYSSGCKRRVPLQCQTNSSSSQAQPDKFYTMANVRLPDNAQTAVAASSQDCQVACLNNCSCNAYTYNSSGCFAWHGDLINLQDQYSGNGGGTLFLRLAASELPGSKRSKAVIIGAVVGGVAAVLIVLSIVAYFLFQKYRRERTLRIPKTAGGTLIAFRYSDLQHVTNNFSERLGGGAFGSVFKGKLPDSTAIAVKRLDGVHQGEKQFRAEVSTIGTVQHVNLVRLLGFCSEGSRRLLVYEFMPKGSLDLQLFLGETTALSWATRYQIALGTARGLNYLHEKCRDCIIHCDVKPENILLDESFVPKVADFGLAKLLGRDFSRVLTTMRGTRGYLAPEWISGVAITAKADVFSYGMMLFELISGRRNSDHGEQHGSTFFPTFAASKLHEGDVRTLLDPKLNGDANADELTRACKVACWCIQDDESARPTTGQIVQILEGFLDVNMPPVPRSLRVLGESPDVINFFSDISSNQTSQTQNSTTSQTRSTTSGSSHLQSP

SEQ ID NO: 6036 - protein, 231 aa, Zea mays
MEYAAVGYGYGYGYDERQEPAESADGGGGGDDEYATVLSAPPKRPAGRTKFRETRHPVYRGVRRRGPAGRWVCEVREPNKKSRIWLGTFATPVAAARAHDVAALALRGRAACLNFADSARLLQVDPATLATPDDIRRAAIQLADAASQQDETAAVAADVVAPSQADDVAAAAAAAAAAAMYGGGMEFDHSYCYDDGMVSGSSDCWQSGGGGWHSSVDGDDDGAGDMTLWSY

SEQ ID NO: 6037 - protein, 236 aa, Zea mays
  unsure (1)..(236): unsure at all Xaa locations
MAGQMGLNQLGPAQIQQIQAQFMFQQQQQQQRGLHAAFLGPRAQPMKQSGSPSPPPPLAPAQSKLYRGVRQRHWGKWVAEIRLPKNRTRLWLGTFDTVEDAALAYDKAVFRLRGDTVRLNFPVLRRGGAHLAGPLHASVDAKLTGICQSLAESKXGGSSGDESAGSPPDSPKCSASASTEGEEESGSAGSPPSPTLAPPVPEMAKLDFTEAPWDETETFHLRKYPSWEIDWDSILS

SEQ ID NO: 6038 - protein, 338 aa, Zea mays
MAAAIDMYKYYNTSAHQIASSSSPSDQELAKALEPFITSASSSSSSSPYHGYSSSPSMSQDSYMPTPSYTSYATSPLPTPAAASSQLPPLYSSPYAAPCMTGQMGLNQLGPAQIQQIQAQFMFQQQQQQRGLHAAFLGPRAQPMKQSGSPPPLAPAPAQSKLYRGVRQRHWGKWVAEIRLPKNRTRLWLGTFDTAEDAALAYDKAAFRLRGDTARLNFPALRRGGAHLAGPLHASVDAKLTAICQSLSESKSKSGSSGDESAASPPDSPKCSASTTEGGGESGSAGSPPPPPPPTLAPPVPVPEMAKLDFTEAPWDETEAFHLRKYPSWEIDWDSILS

SEQ ID NO: 6039 - protein, 345 aa, Zea mays
LMGGQRSFTSHPSVGSTFTFSATLKHSYKDISVDSSRSLPYALPTVFMGVKAILVDGRPVHSAVTRYHLKRLGILLQVVNNMNAVVKAFPGQNGATGSREKASILFIESDFWRPETDVQLLNHLREQKNGQLSDGHKVVLLVTSEADKDKYGSIFDIVMCKPIRASTIASSIQQLLKVEIAERKDNQNRPSFLRSLLVGKNILVVDDNKVNLRVAAAALKKYGANVSCVESGKDAISLLQPPHRFDACFMDVQMPEMDGFEATGQIRQMELKANEERKNKLASIEGSTTAEYHLPVLAMTADVIQATYEECIKSGMDGYVSKPFDEEQLYQAVSRLVVGTTDSAV

SEQ ID NO: 6040 - protein, 234 aa, Zea mays
  unsure (1)..(234): unsure at all Xaa locations
MTAPAELSREENVYMAKLAEQAERYEEMVEFMEKVAKTVDSEELTVEERNLLSVAYKNVIGARRAPWRIISSIEQKEESRGNEDRVTLIKEYRGKIETELSKICDGILKLLETHLVPSSTAPESKVFYLKMKGDYYRYLAEFKSGPERKDAAENTMVAYKAAQDIALAELAPTHPIRLGLAXNFSVFYYEILNSPDRACNLAKQAFDEXIXSELDTLSEKIYQDSTLIMQLLHD

SEQ ID NO: 6041 - protein, 254 aa, Zea mays
  unsure (1)..(254): unsure at all Xaa locations
MASSSTDLADDGFAAPRLFSQGVSYTYDDVIFLPGYIGFPADAVDLSTRLSRRIPLSIPCVASPMDTVSEAAMAAAMASLGAAAVVHCNTDPHAQAAIVRAAKSRRLPFVSSVPFFSPSSAPTLNDFAGSEYALVTERGDSLSRLVGVAVAADAASREVPVXVSEYMRPTPRSASAXFDFEEAATFLGXMKGLDYAPLVSDDGEVVDLITAKDVERIRSYPKLGKPSLGANGKFVVAASIGTREDDKGRLGALV

SEQ ID NO: 6042 - protein, 238 aa, Zea mays
  unsure (1)..(238): unsure at all Xaa locations
MASNSTYLAADGFAAPRLFSQGVSYTYDDVIFLPAYIGFPADAVDLSTRLSRRIPLSIPCVASPMDTVSESAMAAAMASLGAAAVVHCNTDPHAQAAIVRAAKSRRLPFVSSVPFFSPYSAPTLNDFAGSEYALVTERGDSLSRLVGVAVAADAVSREVPVSISEYMRPTPRSASAAFDFEEAATFLADEGLDYAPLVSNDXEVXDLITAKDVERIRSYPXLXKPSLXANXKXVVAAS

SEQ ID NO: 6043 - protein, 223 aa, Zea mays
MASSSPDLADDGFAAPRLFSQGVSYTYDDVIFLPGYIGFPADAVDLSTRLSRRVPLSIPCVASPMDTVSEAAMAAAMASLGAAAVVHCNTEPHSQAAIVRAAKSRRLPFVSSVPFFSPSSSPTLNDFAGSEYALVTERGDSLSRLVGIAVAADAASREVPISVSEYMRPTPRSASSAFDFEEAATFLADEGLDYAPLVSDDGEVVDLITAKDVERIRSYPKLG

SEQ ID NO: 6044 - protein, 238 aa, Zea mays
  unsure (1)..(238): unsure at all Xaa locations
MASSSTDLADDGFAAPRLFSQGVSYTYDDVIFLPGYIGFPADAVDLSTRLSRRIPLSIPCVASPMDTVSEAAMAAAMASLGAAAVVHCNTDPHAQAAIVRAAKSRRLPFVSSVPFFSPSSAPTLNDFAGSEYALVTERGDSLSRLVGVXAVAADAASREVPVSVSEYMRPTPRSASAXFDFEEAATFLADEGLDYAPLVSDDGEXVVDLITAKDVERIRSYPKLGKPSLGANGKFVVA

SEQ ID NO: 6045 - protein, 285 aa, Zea mays
  unsure (1)..(285): unsure at all Xaa locations
SSVLLLFSSLLMELAALSSKGICLDGNHASXELHQTGAGQAPNTMADDEISSLVTSPRQPVQSQESKPELFIMFEGFWLILRSPYLIYISLFLWLSAVVSSVFYFQKVTIVATTISSPTARRRTFALINSFIAVFILAGQLTLTGHILTVAGVTVAICASPFVAASNLVALAVWPTWVAVAVTETIRKVTTYVLTRPGRELLFTVVSQDEKYKAKVCIDVIVQRLGDATAAGIYRWLFSSLEKKTSKVTLFALPLCFLWLVIAFHLGRLQTNLARLQAASAPSYS

SEQ ID NO: 6046 - protein, 242 aa, Zea mays
METAGKVIKCKAAVAWEAGKPLSIEEVEVAPPQAMEVRVKILYTALCHTDVYFWEAKGQTPVFPRILGHEAGGIVESVGEGVTELAPGDHVLPVFTGECKDCAHCKSEESNLCDLLRINVDRGVMIGDGQSRFTIGGKPIFHFVGTSTFSEYTVIHVGCLAKINPEAPLDKVCVLSCGISTGLGATLNVAKPKKGSTVAIFGLGAVGLAAMEGAKMAGASRIIGVDLNPAKYEQAKKFGCTD

SEQ ID NO: 6047 - protein, 248 aa, Zea mays
  unsure (1)..(248): unsure at all Xaa locations
MATAGKVIKCKAAVAWEAGKPLSIEEVEVAPPQAMEVRVKILYTALCHTDVYFWEAKGQTPVFPRILGHEAGGIVESVGEGVTELVPGDHVLPVFTGECKDCAHCKSEESNLCDLLRINVDRGVMIGDGQSRFTINGKPIFHFVGTSTLSEYTVIHVGCLAKINPEAPLDKVCVLSCGISTGLGATLNVAKPKKGSTVAIFGLGAVGLAAMEGAKMAGAAGIIXVVDLNPAKYEQAKKFGCTDFVNPK

SEQ ID NO: 6048 - protein, 246 aa, Zea mays
  unsure (1)..(246): unsure at all Xaa locations
MATAGKVIKCKAAVAWEAGKPLSIEEVEVAPPQAMEVRVKILYTALCHTDVYFWEAKGQTPVFPRILGHEAGGIVESVGEGVTELVPGDHVLPVFTGECKDCAHCKSEESNLCDLLRINVDRGVMIGDGQSRFTIGGKPIFHFVGTSTFSEYTVIHVGCLAKINPEAPLDKVCVLSCGISTGLGATLNVAKPKKGSTVAIFGLGAVGLAAMEGAKMAGASRIIGVDLNPXKYEQAKKXGCTDFVNP

SEQ ID NO: 6049 - protein, 251 aa, Zea mays
  unsure (1)..(251): unsure at all Xaa locations
MATAGKVIKCKAAVAWEAGKPLSIEEVEVAPPQAMEVRVKILYTALCHTDVYFWEAKGQTPVFPRILGHEAGGIVESVGEGVTELVPGDHVLPVFTGECKDCAHCKSEESNLCDLLRINVDRGVMIGDGQSRFTINGKPIFHFVGTSTFSEYTVIHVGCLAKINPEAPLDKVCVLSCGISTGLGATLNVAKPKKGSTVAIFGLGAVGLAAMEGARMAWASRIIGVDLNPXKYEQAKXFGCTDFVNPKDTVA

SEQ ID NO: 6050 - protein, 248 aa, Zea mays
  unsure (1)..(248): unsure at all Xaa locations
MATAGKVIKCKAAVAWEAGKPLSIEEVEVAPPQAMEVRVKILYTALCHTDVYFWEAKGQTPVFPRILGHEAGGIVESVGEGVTELVPGDHVLPVFTGECKDCAHCKSEESNLCDLLRINVDRGVMIGDGESRFTINGKPIFHFVGTSTFSEYTVIHVGCLAKINPEAPLDKVCVLSCGISTGLGATLNVAKPKKGSTVAIFGLGAVGLAAMEGAKMSGASRIIGXVDLNPAKYEQAKKFGCTDFVNPK

SEQ ID NO: 6051 - protein, 235 aa, Zea mays
MATAGKVIKCKAAVAWEAGKPLSIEEVEVAPPQAMEVRVKILYTALCHTDVYFWEAKGQTPVFPRILGHEAGGIVESVGEGVTELVPGDHVLPVFTGECKDCAHCKSEESNLCDLLRINVDRGVMIGDGQSRFTISGKPIFHFVGTSTFSEYTVIHVGCLAKINPSAPLDKVCVLSCGISTGLGATLNVAKPKKGFDGGNFRSWSCRPCCHAKGQDGWGIKDHPCGLEPCKYQQA

SEQ ID NO: 6052 - protein, 251 aa, Zea mays
  unsure (1)..(251): unsure at all Xaa locations
MATAGKVIKCKAAVAWEAGKPLSIEEVEVAPPQAMEVRVKILYTALCHTDVYFWEAKGQTPVFPRILGHEAGGIVESVGEGVTELVPGDHVLPVFTGECKDCAHCKSEESNLCDLLRINVDRGVMIGDGQSRFTINGKPIFHFVGTSTFSEYTVIHVGCLAKINPEAPLDKVCVLSCGISTGLGATLNVAKPKKGSTVAIFGLGAVGLAAMEGAKMSGASGIIXVVDLNPAKYEQAKKFGCTDFVNPRAHQ

SEQ ID NO: 6053 - protein, 239 aa, Zea mays
  unsure (1)..(239): unsure at all Xaa locations
MATAGKVIKCKAAVAWEAGKPLSIEEVEVAPPQAMEVRVKILYTALCHTDVYFWEAKGQTPVFPRILGHEAGGIVESVGEGVTELVPGDHVLPVFTGECKDCAHCKSEESNLCDLLRINVDRGVMIGDGQSRFTINGKPIFHFVGTSTFSEYTVIHVGCLAKINPEAPLDKVCVLSCGISTGLGATLNVAXPKKGSTVAIFGLGAVGLAAMEGARMAGAXRIFGVDLNPXKYEQAKKFG

SEQ ID NO: 6054 - protein, 111 aa, Zea mays
MAMQKAKEIVNSESVVVFSKTYCPYCVRVKELLQQLGAKFKAVELDTESDGSQIQSGLAEWTGQRTVPNVVIGGNHIGGCDATSNLHKDGKLVPLLTEAGAIAGKTATTSA

SEQ ID NO: 6055 - protein, 327 aa, Zea mays
MEAQNVEVAALVQKITALHADIAKLPSLSPSPDANALFTSLVMACVPPNPVDVTKLSPDVQGMREELIRLCSDAEGHLEAHYADMLAAFDNPLDHLGRFPYFSNYIDLSKLEFDLLVRYIPGLAPSRVAFVGSGPLPFSSLVLAARHLPNTLFDNYDRCAAANDRARKLVRADKDLNARMSFHTVDVANLTDELAKYDVVFLAALVGMAAEDKAKVVAHLGRHMADGAALVVRSAHGARGFLYPIVDPEDIRRGGFDVLAVYHPDNEVINSVIIARKMDAHTKGLQNGHAHARGTVPIVSPPCKCCKMEANALQKREEMATTTELSI

SEQ ID NO: 6056 - protein, 189 aa, Zea mays
  unsure (1)..(189): unsure at all Xaa locations
MAAQEQEHEKQQAKTSTTSSLPSSSERSSSSAPNNLREGGVESDEEIRRVPELGGASASASASSGAGKEDGARAVAAGAQGHPPAAGKKRGRAPGDKEQNRLKRLLRNRVSAQQARERKKAYLTELEVRAKDLELRNAELXQRVSXLQNENNXLRQIXKNTTAHASKRSGGGAGGKGGDGGXKXXLAKX

SEQ ID NO: 6057 - protein, 333 aa, Zea mays
MGQQEGHSNPHPDEAALPTTTAAPSPSPSSSRLYTAWLVASWYASNIGVLLLNKYLLSVYGFRFPLLLTACHMSACAVLSTLAQHASPRPRSSSSPRSHRQLARVALLGAVFCASVVAGNVSLRHLPVSFNQAVGATTPFFTALLAYAVAARREACATYAALVPVVAGVAIATGGEPSFHLFGFVMCVAATVGRALKTVLQGILLSSEEEKMDSMDLLRYMAPVAVLLLVPATLAMERDAFGVVAGLAREDPSFLWLLLCNSCLAYFVNLTNFLVTKHTSPLTLQVLGNAKGAVAVVVSILIFRNPVTVVGMLGYGVTVAGVVLYGEAKKRSK

SEQ ID NO: 6058 - protein, 710 aa, Zea mays
MAAKLTRLHSLRERLGATFSSHPNELIALFSRYVHQGKGMLQRHQLLAEFDALFESDKEKYAPFEDILRAAQEAIVLPPWVALAIRPRPGVWDYIRVNVSELAVEELTVSEYLAFKEQLVDEHASSKFVLELDFEPFNASFPRPSMSKSIGNGVQFLNRHLSSKLFQDKESLYPLLNFLKAHNYKGTTMMLNDRIQSLRGLQSALRKAEEYLVSIPEDTPSSEFNHRFQELGLEKGWGDTAKRVHDTIHLLLDLLEAPGPASLEKFLGTIPMMFNVVILSPHGYFAQSNVLGYPDTGGQVVYILDQVRALENEMLLRIKQQGLDITPKILIVTRLLPDAVGTTCGQRLEKVIGTEHTDILRVPFRTENGILRKWISRFDVWPYLETYTEDVANELMREMQTKPDLIIGNYSDGNLVATLLAHKLGVTQCTIAHALEKTKYPNSDIYLDKFDSQYHFSCQFTADLIAMNHTDFIITSTFQEIAGSKDSVGQYESHIAFTLPDLYRVVHGIDVFDPKFNIVSPGADMTVYFPYTETDKRLTAFHSEIEELLYSDVENDEHKFVLKDRNKPIIFSMARLDRVKNMTGLVEMYGKNAHLKDLANLVIVAGDHGKESKDREEQAEFKRMYSLIEEYKLKGHIRWISAQMNRVRNGELYRYICDTKGAFVQPAFYEAFGLTVIEAMTCGLPTIATCHGGPAEIIVNGVSGLHIDPY

SEQ ID NO: 6059 - protein, 663 aa, Zea mays
MAAKLTRLHSLRERLGATFSSHPNELIALFSRYVHQGKGMLQRHQLLAEFDELFESDKEKYAPFEDILRAAQEAIVLPPWVALAIRPRPGVWDYIRVNVSELAVEELTVSEYLAFKEQLVDEHASSKFVLELDFEPFNASFPRPSMSKSIGNGVQFLNRHLSSKLFQDKESLYPLLNFLKAHNYKGTTMMLNDRIQSLRGLQSALRKAEEYLVSIPEDTPSSEFNHRFQELGLEKGWGDTAKRVHDTIHLLLDLLEAPDPASLEKFLGTIPMMFNVVILSPHGYFAQSNVLGYPDTGGQVVYILDQVRALENEMLLRIKQQGLDITPKILIVTRLLPDAVGTTCGQRLEKVIGTEHTDILRVPFRTENGILRKWISRFDVWPYLETYTEDVANELMREMQTKPDLIIGNYSDGNLVATLLAHKLGVTQCTIAHALEKTKYPNSDIYLDKFDSQYHFSCQFTADLIAMNHTDFIITSTFQEIAGSKDSVGQYESHIAFTLPDLYRVVHGIDVFDPKFNIVSPGADMTVYFPYTETDKRLTAFHSEIEELLYSDVENDEHKFVLKDRNKPIIFSMARLDRVKNMTGLVEMYGKNAHLKDLANLVIVAGDHGKESKDREEQAEFKRMYSLIEEYKLKGHIRWISAQMNRVRNGELYRYICDTKGAF

SEQ ID NO: 6060 - protein, 342 aa, Zea mays
MWFGGGPIDAAGALRGFVREAGGCAVVDGGLGTELEAHGADLHDALWSAKCLASAPHLIRKVHLDYLEAGADVIISASYQATIEGFQSRGFSRDESEELLRRSVHVAQEARRVFAAEGDRSSRRGRPPALVAASVGSYGAYRADGSEYSGDYGKSMTKEDLKNFHRRRLQVLAGAGPDLIAFETIPNKLEAQVYAELLEENGIRIPAWFSFTSKDGVNAASGDPINECAAVADSCPRVDAVGVNCTAPRFIHGLILSIKKVTSKPIVVYPNSGETYVAETNEWVDSDGATGTDDFVSRVGEWRRAGAALIGGCCRTSPATVRAIARAVREAEYDDIPAVAVL

SEQ ID NO: 6061 - protein, 342 aa, Zea mays
MWFGGGPIDAAGALRGFVREAGGCAVVDGGLGTELEAHGADLHDALWSAKCLASAPHLIRKVHLDYLEAGADVIISASYQATIEGFQSRGFSRDESEELLRRSVHVAQEARRVFAAEGDRSSRRGRPPALVAASVGSYGAYRADGSEYSGDYGKSMTKEDLKNFHRRRLQVLAGAGPDLIAFETIPNKLEAQVYAELLEENGIRIPAWFSFTSKDGVNAASGDPINECAAVADSCPGVAAVGVNCTAPRFIHGLILSIKKVTSKPIVVYPNSGETYVAETNEWVDSDGATGTDGFVSRVGEWRRAGAALIGGCCRTSPATVRAIARAVREAEYDDIPAVAVL

SEQ ID NO: 6062 - protein, 535 aa, Zea mays
MTTPSTAPAPLASLLLRVSAAAVPVARRRPKSPAAAAAARWEGGGGRRRCRAAVVEEAGVLLPKEGEGEEAPDAAAGRYDWREEWYPLYLAKEVPDDAALPLTVFDRQLVLWRDAHGVLRCHEDRCPHRLAKLSEGQIVDGKLECLYHGWQFDGDGKCVKIPQLPEGAKIPRSACARNYEVRDSQGVVWVWMSDANPPDEGKLPWFEPYARAGFTDLSTVHELPYDHSILLENLMDPAHVPISHDRTDWTAKREDAQPLFFDVTERTPRGFAGYWGRTGTPHLRNLLRFEAPCVLTNTLEFADKDGREQCFSAHFLCRPAGQGKSMLLVRFGSTLRSPLAKVLPSWYFHQNACKVFEQDMGFLSSQNEVLLREKLPTRELYLNLRSSDTWVAEYRKWMDRAGHGMPYYFGHSTLSPPPVPAVVEQAPAGAVAGISASFPAKGGVGMVHAPNPTNRYFRHVVHCKSCRATVKKYTSLKTVFAALAAAALSAAILAATRQWKAVLVAASAVLAAASYACDAVLSLITTNFIRTHRRL

SEQ ID NO: 6063 - protein, 196 aa, Zea mays
  unsure (1)..(196): unsure at all Xaa locations
MAGQSSYSRLAADEAAAAISADDYDSKKLRLLGYEPQLKRNLSLLSNFSVTFSIVSVLTGITTLYGTGLEFGGPVTMVYGWPIAGAFTIVVGLAMAEICSAYPTSGGLYFWSARLCTERRWGPFASWLTGWFNIVGQWAVTTSVDYSLAQLIQVIILLSTGGNXNGGGYLGSKYEVIPIHAAILLGPRVIHSLPIG

SEQ ID NO: 6064 - protein, 151 aa, Zea mays
  unsure (1)..(151): unsure at all Xaa locations
MANASAAQTDGDTMPDSPLLSDDVSVAPQKAGKVRIKILLTALSHTDQYTWSDKDPKGLVPCILGHETAAIVESVXGEGITDVQSDDHVIACYQAGRTECMFCXSGKTNLCXKARLATGVGGMMNDTNSTVSVNGKPIHHFMGTXTFSQYT

SEQ ID NO: 6065 - protein, 236 aa, Zea mays
MRSLRRVLIPLVLLAGLVFRVDDGGGAFLPPPPPALPAPPPRLALNGEAAPEDDGAAVSRSTEIVAAEARSTEFVAPARPKKQSFRELLVRPQPARHEPSSLVSGEAKAETRSVLQFYDNGTIQLVDKLSQSPLWEIATGPPLSDHITTTESGPNYLIYPFNGNENMNGNSTELWEVYNGNSVRLPWKLEEFVARSPYIRGFCCYYRIKVSTVFVVDADSGEIIYRHSIPSALKEL

SEQ ID NO: 6066 - protein, 416 aa, Zea mays
MAMSASSSSRALLRRIGGALLRRSFSSSSAAAAAGYHVAGGPSYMRGAVFWEPGRPLTLEEFRMPRPKAGELLIKTKACGVCHSDLHVLKGELPFSTPCVVGHEITGEVVDHGTHTPAEIINRFPVGSHVVGAFIMPCGNCFYCVKGQEDLCESFFAYNRAKGTLYDGETRLFLRGNGKPVYMYSMGGLAEYCVVPANALAVLPDSLPYTESAILGCAVFTAYGALRHAAEMRPGDSVAVIGVGGVGSSCLQIAKAFGASQVIAVDVLDEKLQNATTLGATHTVNAAKADAVERIKEITDGRGVDVAIEALGKALTFSQCAKSVRDGGKAVMIGLAATNVMGEVDITRLVRRQVKIIGSYGARARQDLPQIVKLAESGAFNLQNTISRKCKFEEANGAYEDLNQGKIVGRAVVEIM

SEQ ID NO: 6067 - protein, 308 aa, Zea mays
RPLGSSMPVKRAHLKPHAADIKRNPHVHELYKLVYRLPENLSWLLAPPEIPKRPASKKKKQKDEIVAGNSFGVILEWEGVVVDDDDPDLEPRVWYVLSLEEGKSFPPDALLKKIEGMRTDQAIAEVLCWSEDSAEIQRLATHKEVIYQKLQGGYYQLRPHVLDFLNTLVGFDIPIAIAAPRSRKSLEEGIKTVGLQGYFDAIIALDDFCLGKPDGEMFEVAAEQLGLEPDVCVVFGNSNLTTESAHNAGMRCVAVAGRHPAYELQSANHVVRWLDQLSIVDLQRLANGEVIGRRGRESDMDMEIVIEE

SEQ ID NO: 6068 - protein, 96 aa, Zea mays
VLVGSHPLTGGVLASLLFVESIGAIGVGGLLVGRSRGFLLLEVPALPVEGNDTTIWGSGESLMFLSAQSMAVGTIMDRWVSKYSDPIMATGWVYYP

SEQ ID NO: 6069 - protein, 92 aa, Zea mays
MHPRSAATVRLCLVCLALLLLTRDVRSRNLVGAVVQKERHKQSHGGHGGATPEPPVEEGSDAGAKRGQLQRDLTRWEEIHTDYIYTQDVKHP

SEQ ID NO: 6070 - protein, 560 aa, Zea mays
MEGITSSSSRSRTKGPADEMWDVQSTTSEVTFKTADKEEATSADGATNSASQTPKNEIRHERKVHKSLWAYVADIIRLGFIQHGDSHDSSHKSVKKSSSNNSQSTEGWLSSQERDNDGTKKKNGSTNTLGGGEQESGVASMSNEEYLHTDTHGLQISETVVEPQVGRSEGDLLPTSSTDDLHISGGRTKQSDAGELRKGNSIDDSTPTYLDITIGHLPERKTASRITTEGSGEFITGKGMLAGTSSVTISAMEAGRSEDGADSIYDPSGAITPYHDSQTQTVMPHENTSTGILGPPALPVGVSTRFEEKNIMQEAPEIIKTGGKDTELKRRNFQRNKQVLKDTFDEWEEAYQRDAEQRKADELFMREALLEAQRAADIWEVPVGAVLVQNGEIIARGCNLVEDHRDSTAHAEIVCIREASNKLKTWRLADTTLYVTLEPCAMCAGAILQARIDTVVWGAPNKLLGADGSWVRLFPGDGQTSTLDSTNQSQAAGPVHPFHPKIAIRRGVLSAECSEIMQQFFQLRRKKKPQSPPQAHRHGHHHPVKFFSKMHHMFGTIFCL

SEQ ID NO: 6071 - protein, 385 aa, Zea mays
PTRPQCNCNQDTYRSFTNMSSTFSSMLVSTLLSNPAIHAAARLAASYWPAAEGNTPIDPNQENPADGVQGRNIGSPPSMVSIVAATVAAASAWWATQGLLPFFAPPVAFPFVPAPSAAFPTVDVPRPSEKDRDCPAENAQIECQEARKQVQFEGLRIAASSESDGSGKGEVSLHTELKLSPAQNADATPTTGAGTNDAFRNKKKQDRSSCGSNTPSSSDVDAGNVPEEDNANEKAKQASCSNSSAGDTNHRRFRSNGSTSDSWKEVSEEGRLAFDALFSREKLPQSFSPPQAVDSKEVAKEEEDEVTTVAVDLNKNATSIDHDDLDTMDEPRASFPNELSHLKLKSRRTGFKPYKRCSVEAKENRVPASDMVGTKRIRLDSEAST

SEQ ID NO: 6072 - protein, 145 aa, Zea mays
MEVNSSGEETVVKVRKPYTITKQRERWTEAEHKHGRAWQRIEEHVGTKTAVQIRSHAQKFFTKLEKEAMNNGTSPGQAHDIDIPPPRPKRKPNSPYPRKSCLSSETQTKELPNDKSTKPNMPLSNGHVKMVGDASLQNFQKELSE

SEQ ID NO: 6073 - protein, 718 aa, Zea mays
MEVNSSGEETVIKVRKPYTITKQRERWTEAEHKRFLEALKLYGRAWQRIEEHVGTKTAVQIRSHAQKFFTKLEKEAINNGTSPGQAHDIDIPPPRPKRKANSPYPRKSGLSSETPTKELPSDKSTKPNMPLSNENVLMAGDASLQKFQRKELSGKESCSEVLNLFRDAPSPSFSSVNKSSSNHGAPIEASKTKIRDMTIMENSSLNPNMQEDVKEINDQEMERLNGTQISSKCEHSHEGYLDISMQQMKLKPESVETTYVDKQTARASHSLAERTGTTSIPVTATEETHSVLTSDQVGINGSMNPSIHPMFPADPKFDSSATPQPFPHNYAAFAPMMQCNCNQDTHRSLVNMSSTFSSMLVSTLLSNPAIHAAARLAASYWPAAEGNTPIDPNQENLADGVQGRSIGSPPSMASIVAATVAAASAWWATQGLLPFFAPPMAFSFVPAPSAAFPTVDVPRPSEKDRDCPAENAQKECQEARKQGQFEGFRVAASSEYDGSGKGEVSVHTELKISPVQNADATSAAGADTTDAFMNKKKQDRSSCGSNTPSSSDVDVDNVPEKEGNGNEKAKQASCSNSSAGDTNHRRFRSSGSTSDSWKEVSEEGRLAFHALFSREKLPQSFSPPQAEGSKEVGKEEEDEVTTVAVDLNKSTTSIDHDLDTIGEPRASFPNELSPLKLKLRRTGFKPYKRCSVEAKENRVPASDEVGTKRIRLDSEAST

SEQ ID NO: 6074 - protein, 102 aa, Zea mays
MAAKQAAEKLISEHLVAVFSKSYCPYCSQAKSVIDKLGLDKSKIGILELDTMGSEGSDIQAYLQEKTSQRTVPNIFINQKHLGGCSDLLDAQKSGKLQQLVK

SEQ ID NO: 6075 - protein, 201 aa, Zea mays
  unsure (1)..(201): unsure at all Xaa locations
MAECKDDDSGRRSPSSSMDSSTHPPALSTASSASRRPPERRDQLSPDLQLGLSLSPASSALLVAETNNSIVPSTPRNQALPDWPPIKPFLRSALTASARRRRTLFVKVYMEGVPIGRKLDMLLLDGYSSLLAKLCHMFKASITXVPHEKAAHVLTYEDHDGDWMMVXDVPXELFLSVKSRCENRQVLDSKLFMRGDSPLSF

SEQ ID NO: 6076 - protein, 488 aa, Zea mays
  unsure (1)..(488): unsure at all Xaa locations
MAPPQTIPRRGLFIGGAWREPCLGRRLPVVNPATEATIGDIPAGTAXRHWSRAPGAVRANFLRAIAAKIKDRKSELALLETLDSGKPLDEASGDMDDVAACFEYYADLAEALDGKQQSPISLPMENFKSYVLKEPIGVVGLITPWNYPLLMATWKVAPALAAGCTTILKPSELASVSCLELGAICMEIGLPPGVLNIITGLGPEAGAPLSSHSHVDKVAFTGSTETGKRIMISAAQMVKPVSLELGGKSPLIVFDDIGDIDKAVEWTMFGIFANAGQVCSATSRLLLHEKIAKKFLDRLVAWAKNIKVSDPLEEGCRLGSVISEGQYEKIKKFISTARSEGATILYGGGRPQHLRRGFFLEPTIITDVSTSMQIWQEEVFGPVICVKEFRTESEAVELANDTHYGLAGAVISNDQERCERISKALHSGIIWINCSQPCFVQAPWGGNKRSGFGRELGEWGLDNYLTVKQVTKYCSDEPWGWYQPPSKL

SEQ ID NO: 6077 - protein, 436 aa, Zea mays
MDMNESGEKGMEGNASSGIPVDWQTQFSAAAFSCAPPPQQQQQQVPMMDSAFASAGLWASTSQAMALSDAGGRSAARAGFLAPVPGFLPQGLAHFPVDSGFIERAARASCFGGGGGGVMAAFGAAADHQPMNSAFSGSSEALLDHQRTKDGSDKGEPELGRNGHDGVLSSEAAAAGDCSSKGTSDSKKRRRPNEVMGGDQVQSSNLPADSANESVHSKDKGEESSLATTTTGPGKSKGKGARETSESQKEDYIHVRARRGQATNSHSLAERLRREKISERMKLLQDLVPGCSKVTGKAVMLDEIINYVQSLQRQVEFLSMKLATVNPRLDLNIEGLLSKDLLRFPGVPSSSLGFSPEMMHPQLQLSQPGLIQGGAAGMANPDVFRRIMQAQLSAKDGSQMPPHALNGAFSDVAQQQMAYPSSQDLSIGPSQDGFQM

SEQ ID NO: 6078 - protein, 206 aa, Zea mays
TLGQDLPDGNLRSLQKKGNVNKDSFSKVMWYAVINYRTWIFVLLYGYCMGVELTTDNVIAEYMYDRFDLDLRVAGTIAACFGMANLVARPMGGIMSDIGARYWGMRARLWNIWILQTAGGAFCLWLGRASTLPVSVVAMVLFSFCAQAACGAIFGVIPFVSRRSLGIISGMTGAGGNFGAGLTQLLFFTSSTYSTGRGLEYMGIMI

SEQ ID NO: 6079 - protein, 258 aa, Zea mays
  unsure (1)..(258): unsure at all Xaa locations
MALSGEKTASGREYKVKDLSQADFGRLELELAEGEMPGLMACRAEFGPSQPFKGARISGSLHMTIQTAGLIETLTALGAEVRWGSCNIFSTQDHAAAAIARDSAAVFAWKGETLEEYWGGTERCLDWGAGGGPDLIVDDGGDATLLIHEGVKAEEEFERSGKVPDPASTDNPEFKIVLTIIRDGLKTDARKYRKMKERLVGVSEETTTGVXRLYQMQESXTLLFPXINVTTRHKEQFDNLYGXHSAPDGSMRATDVMT

SEQ ID NO: 6080 - protein, 485 aa, Zea mays
  unsure (1)..(485): unsure at all Xaa locations
MALSVEKTSSGREYKVKDLSQADFGRXEIELAEVEMPGLMACRAEFGPSKPFAGARISGSLHMTIQTAVLIETLTALGAEVRWCSCNIFSTQDHAAAAIARDSAAVFAWKGETLEEYWWCTERCLDWGEAGGPDLIVDDGGDATLLIHEGVKAEEEYEKTGKIPDPESTDNAEFKIVLTIIRDGLKADPKKYRKMKERLVGVSEETTTGVKRLYQMQETGALLFPAINVNDSVTKSKFDNLYGCRHSLPDGLMRATDVMIAGKVAVVCGYGDVGKGCAAALKQAGARVIVTEIDPICALQALMEGLQVLPLEDVVSEADIFVTTTGNKDIIMVDHMRKMKNNAIVCNIGHFDNEIDMLGLETYPGVKRITIKPQTDRWVFPETNTGIIVLAEGRLMNLGCATGHPSFVMSCSFTNQVIAQLELWKEKSSGKYEKKVYVLPKHLDEKVAALHLGKLGAKLTKLTKSQADYISVPIEGPYKPAHYRY

SEQ ID NO: 6081 - protein, 199 aa, Zea mays
  unsure (1)..(199): unsure at all Xaa locations
MALSVEKTSSGREYKVKDLSQADFGRLEIDLAEVEMPGLMACRAXEFGPSKPFAGARISGSLHMTIXQTAVLQSRPFTALXAEVRWCSCNIFSTQDHALXAVIARDSVSVFAWXKGETLEEYWWCTERCLDWGEAGGPDLIXDDGGDATLLIHEGVQAEEDYEEDXGRSPDPESTDNARXFKIGLTIIREGLKGDPKKY

SEQ ID NO: 6082 - protein, 485 aa, Zea mays; identical to SEQ ID NO: 629

SEQ ID NO: 6083 - protein, 201 aa, Zea mays
  unsure (1)..(201): unsure at all Xaa locations
MVASGGHEDVSFRDNVLQGKDLKTLHQSLEGTDGVDLGHKDIIMVDHMRKMKNNAIVCNIGHFDNEIDMLGLETYPGVKRITIKPQTDXRWVFPETNTGIIVXLAEGRLMNLGCATGHPSFVMSCSFTNQXVIAQLELWKEKSSGKYEKKVYVLPKHXLDEKVVAXHLGKLGAKLTKLAKSQADYISVPIEGPYKPAHYRY

SEQ ID NO: 6084 - protein, 115 aa, Zea mays
  unsure (1)..(115): unsure at all Xaa locations
MGFPMCQRGDSRAPYDEDMALYGAKTSPGREHTDKDLSHADFGRLDIELTKAEMPWLMACRAXFGPSKPFAGARISGSLHMTIHTAGLIETLTALGAEVRWCSCNIFSTQDHAAG

SEQ ID NO: 6085 - protein, 198 aa, Zea mays
VIVTEIDPICALQALMEGLQVLPLEDVVSEADIFVTTTGNKDIIMVDHMRKMKNNAIVCNIGHFDNEIDMLGLETYPGVKRITIKPQTDRWVFPETNTGIIVLAEGRLMNLGCATGHPSFVMSCSFTNQVIAQLELWKEKSSGKYEKKVYVLPKPLDEKVAALHLGKLGAKLTKLTKSQADYISVPIEGPYKPAHYRY

SEQ ID NO: 6086 - protein, 487 aa, Zea mays
  unsure (1)..(487): unsure at all Xaa locations
MALSVEKTSSGREYKVKDLSQADFGRLEIELAEVEMPGLMACRAEFGPSKPFAGARISGSLHMTIQTAVLIETLTALGAEVRWCSCNIFSTQDHAAAAIARDSAAVFAWKGETLEEXYWWCTERCLDWGEAGGPDLIVDDGGDATLLIXHEGVKAEEDYEKTGKXPDPESTDNAEFKIVLTIIRDGLKADPKKYRKMKERLVGVSEETTTGVKRLYQMQETGALLFPAINVNDSVTKSKFDNLYGCRHSLPDGLMRATDVMIAGKVAVVCGYGDVGKGCAAALKQAGARVIVTEIDPICALQALMEGLQVLPLEDVVSEADIFVTTTGNKDIIMVDHMRKMKNNAIVCNIGHFDNEIDMLGLETYPGVKRITIKPQTDRWVFPETNTGIIVLAEGRLMNLGCATGHPSFVMSCSFTNQVIAQLELWKEKSSGKYEKKVYVLPKHLDEKVAALHLGKLGAKLTKLTKSQADYISVPIEGPYKPAHYRY

SEQ ID NO: 6087 - protein, 251 aa, Zea mays
MSDGAGSRTGVAGALGLSVTSSVAIVISFGLLNGISIGLLNLCLGFNSVGFYQMTKLAIIPFTIVLETLFLSKKFSQSIKASLMVLLLGVGIASVTDLQLNLLGSIIAVLTIAATCVGQILTNQIQRRLKVSSTQLLYQSSPYQSAVLLVTGPFVDKLLTKRDVFAFSYTTQVVVFILLSCSIAVCVNFSTFLVIGTTSPVTYQVLGHLKTCLVLSFGYIILKDPFSARNVVGIEMAMGTRDPIPDGYLLH

SEQ ID NO: 6088 - protein, 262 aa, Zea mays
MAASAPTPREEFVYMAKLAEQAERYEEMVEFMEKVSASAESEELTVEERNLLSVAYKNVIGARRASWRIISSIEQKEESRGNEDHVAVIRDYRSKIEAELSNICDGILKLLDTRLVPSAASGDSKVFYLKMKGDYHRYLAEFKTGADRKEAAESTLSAYKAAQDIANTELPPTHPIRLGLALNFSVFYYEILNSPDRACSLAKQAFDEAIAELDTLGEESYKDSTLIMQLLRDNLTLWTSDMQDDGADEIKEAAPKGDGEQN

SEQ ID NO: 6089 - protein, 323 aa, Zea mays
MPAGQPHAHEAAAAACVGSGANHSNHRVPAHSPPPLPAEVVPAYPPPESEDDETWVWTQIKAEARRDADAEPALASFLYATVLSHPSLPRSLSFHLANKLCSSTLLSTLLYDLFLATLTAHPSLRAAVVADLLAAHSRDPACVGFSHCLLNYKGFLAIQAHRVAHVLWAQQRRPLALALQSRVADVFAVDIHPAAVVGKGILLDHATGVVIGETAVVGDNVSILHHVTLGGTGKAVGDRHPKIGDGVLIGAGATILGNVKIGAGAKIGAGSVVLIDVPARSTAVGNPARLIGGKKAEGANEEDMPGESMDHTSFIRQWSDYTI

SEQ ID NO: 6090 - protein, 153 aa, Zea mays
PRGRPGSSFKYPCTCISTSPASGGGITMVAAAAAAFIALVAFGSASSSPKSFVKSTVSAHDVVIFSKSYCPYCKRAKAVFKELELKKEPYVVELDQREDGSEIQDALLEIVGRRTVPQVFVHGKHLGGSDDTVDSYESGKLARLLNIGVKDDL

SEQ ID NO: 6091 - protein, 179 aa, Zea mays
MEGQRSQRWGYLKDKAIATSLAEEEMENSMDGEEDDTGDEDKRKRVMERARGPNTERVPLRLCLVDRCTANLTEAKQYYRRHKVCEVHAKASSATVAGVKQRFCQQCSRFHELAEFDETKRSCRRRLAGHNERRRKISGDSYGEGSGRRAVSLTQTQERNRIDMKLPMTNSPFKRPQIR

SEQ ID NO: 6092 - protein, 309 aa, Zea mays
ASSSSRPVARALTATREFLTGHQGAVNVQGEDQKKLDVVSNEVFSNCLKSSGRTGVIASEEEDVPVAVEQSYSGNYIVVFDPLDGSSNIDAAVSTGSIFGIYNPNDECLADVDDNDTLDSVEQRCIVNVCQPGSNLLAAGYCMYSSSVIFVLTVGTGVYVFTLDPMYGEFVLTQEKVQIPKAGKIYAFNEGNYALWDDKLKLYIGSLKEPGDSGKPYSARYIGSLVGDFHRTLLYGGIYGYPRDKKSKNGKLRLLYECAPMSFIVEQAGGKGSDGHQRILDITPTEIHQRVPLYIGSVEEVDKVEKFLA

SEQ ID NO: 6093 - protein, 84 aa, Zea mays
RFPCCQRVRQSLSRAGSGISIFLHFRSCFAVKEPDADDEETGEREATMASVLALYRRSLVERTKHHLGMLRLGRSSPIDFDFLL

SEQ ID NO: 6094 - protein, 156 aa, Zea mays
  unsure (1)..(156): unsure at all Xaa locations
NTIQKKFKVSSTQLLYXSCPYRALTLFLVGPFLDGFLTNQNVFAFDYTTQVLFFIMLSCLISVSVNFSTFLVIGKTSPVTYKVLGHLKTCLVLTFGYVLLHDLFSWRNILGILIVVIGMVLYLYFCTRETQQIPAEASPQVVQVSVCWNSRSEWCF

SEQ ID NO: 6095 - protein, 223 aa, Zea mays
  unsure (1)..(223): unsure at all Xaa locations
IGYLEAGRVLVQNESLMCNSRCLLYILQLCMIPASXLLEVVFDHVHYSSLHKAHHNAPAFIGXVAPCTNTDVSATARGLIAARIPVCSTAFQQYYVHFLQRKYSLKSFYLLGHXSSIQNMSLLLKLPFAYYLLTGKTVEQVRLSSLGLLFLALSCFIXIGGNLSQFICITGFSCRSFQGLGHMXKTELVQTLELLVFLKHRLNLQTLHVMNLNDLKMIWYSNS

SEQ ID NO: 6096 - protein, 140 aa, Zea mays
  unsure (1)..(140): unsure at all Xaa locations
MADDYAFGHVIRHWDLIPLSVHMXCIGVLRYFVSKVMRSPTTLFVXPTEVSIRYADXIIRKRNLTTKAQDIPGSXFQERKVYYATEENGXLHVPQEYAEKGHADMVSDPHMVMDMMNNNLSMIAPXTLTYVCANVFCSGF

SEQ ID NO: 6097 - protein, 349 aa, Zea mays
MNFGGNGNATIRCKYCRASLSVIPGERAIQCAQCNCVTRIRRADRIPLARPAHVPPAFQRARGKKRAVLVGITYAGMRQGCGDLRGPVNDVKCMRNLLCQRFGFPGECIIMLTDDQRDPFRLPTKENIRMAMHWLVQGCSYGDSLVFHFSGIGAQVADDDGDEADGYDEAICPLDAFQSGPILDDEINEVIVRPLVHGARLHAVVDACYSATVLDLPYLCRMSRNGFWQWEDECPPSGAWKGTSGGHAVLISGYSEGKGNFAMMPDAHASVVGAMTHSFVRTLECQPRGVTYGHLLSSMRAIMKNRGGGCDLQGAIGAPIRTVANFSGVQEPNLSSSETFDIYRKQFVL

SEQ ID NO: 6098 - protein, 342 aa, Zea mays
  unsure (1)..(342): unsure at all Xaa locations
LHACSASLTVCAGERAIQCAQCCGVTRIRRSLSSRLPLPALTRPASVAGFPPCGGRGKKRAVLIGITYGGARRGCGELRGPINDVKCMRQLLCQRFAFPSDGIIMLTDDQKDPFRVPTKDNIRMAMQWLVQGCSSGDSLVFHFSGLGAQVADADCDEQDGYDEAICPVDSFQKGPILDDEINETIVRPLVPGAKLHAVVDACHSDSVLDLPFLCNMSRTGNWQWEDHRPPSGVCKGTSGGQAVLISGYSDGKSKFSMTPEACATVGAMTHSFIKAVECEPQGVTYGRLLTSMKAIMTNXGGCNQQLQGACAPARKVVNFSGVQEPNLSCSEMFDVYRKPFAL

SEQ ID NO: 6099 - protein, 356 aa, Zea mays; identical to SEQ ID NO: 783

SEQ ID NO: 6100 - protein, 231 aa, Zea mays
  unsure (1)..(231): unsure at all Xaa locations
MAQPAELSREENVYMAKLAEQAERYEEMVEFMEKVAKTVDSEELTVEERNLLSVAYKNVIGARRASWRIISSIEQKEESRGNEDRVTLIKDYRGKIEVELTKICDGILKLLDSHLVPSSTAPESKVFYLKMKGDYYRYLAEFKSGTERKDAAENTMVAYKAAQEIALKELPPTHPIRLXLALNFSVFYYEILNSPDRACDLAKQAFDEPISELDSLSEESYQDSTLICSSC

SEQ ID NO: 6101 - protein, 582 aa, Zea mays
  unsure (1)..(582): unsure at all Xaa locations
MATSTMRVAAGVLLVVSALATLARAEDPYLFFEWKVTYGTRSLLGVPQKVILINGEFPGPRINCSSNNNIVVNVFNQLDHPLLFTWNGMQHRKNSWMDGMPGTQCPIAPNTNFTYKWQPKDQIGSFFYFPSIGMQRAAGGYGAISVVSRLLIPVPFDQPPPESDHAVLIGDWYTKDHEVLARQLDAGKSVGRPAGVLINGKGGKDLEAAAPMLTFEAGKTYRLRVCNTGIKASLNFRIQGHDMKLVELEGSHTLQDVYDSLDVXTSAHCLSVLVDADQAPGDYYMVASTRFIHDAKSASAVIRYAGSSGRPAXPNMTEPPAGWAWSINQARSFRWNLTASAARPNPQGSYHYGQINITRTIKVXSARGHIDGKLRYGFNGISHRDTETPLKLAEYFNVTDGVXFSYNQMGDVPPXAVNGPLHVIPNVITAEFRTFIEIVFENPEKSIDSLHLDGYAFFGVGMGPGTWSPEMRKTYNLLDTVSRHTIQVYPRSWTAIMLTFDNAGMWSVRSNVWERYYLGEQFYISVISXPARSLRDEYNMPDXALRCGKVVXGLPLPPILRPRALKTTKAPFSPRVLTIQSN

SEQ ID NO: 6102 - protein, 231 aa, Zea mays
  unsure (1)..(231): unsure at all Xaa locations
MGHEDAVYLAKLAEQAERYEEMVENMKIVAGEDRDLTVEERNLLSVAYKNVIGARRASWRIVTSIEQKEESKGNSSQVTLIKEYRQKIEAELAKICEDILEVLDQHLIPSAKSGESKVFYHKMKGDYHRYLAEFAIGDRRKDSADKSLEAYKAATEVPXNPSFLPPTPIRLGLALNFSVFYYEILDAPXPACHLAKQAFDDAIAELDTLSEESYKDSTLIMQLLRDHLTLW

SEQ ID NO: 6103 - protein, 123 aa, Zea mays
  unsure (1)..(123): unsure at all Xaa locations
MVLYVEKTSTGREYKVKDLSQADFXRLEIALAMVEMPGLMACRAEIGPYKPFSGARISGPFHMTIQTVRLIETLTALGAQVRWCSCNIFSTQDHARCGIVRDWYDAFAWKVETLVEYCGCTER

SEQ ID NO: 6104 - protein, 342 aa, Zea mays
  unsure (1)..(342): unsure at all Xaa locations
MADVHEPLVRRKRKKVLVDYLVKFRWILVIFVVLPISTLIYFNIFLGDMWSAMKSEKKRQKQHDENMQKVVKRLKQRNPKKDGLVCTARKPWIAVGMRNVDYKRARHFEADLSSFRNIXLEIDKERMVAKVEPLXNMGQITRATCPMNLALAVVAELDDLTVGGLINGYGIEGSSHLYGLFSDTVVAMEGTLGFLVSAEIKLIPIKEYMKLTYTPVKGGLKEIAQAYADSLAPRDGDPAKVPDFVEGMVYTESEGVMMTGVHAWKEEAKKKGNKINCEGWWIKPCLYQHAQTALKRGEPEDDIRAGEYYHRHTRCLYWEGKLILPFGDQLWFMFLLGWLMPP

SEQ ID NO: 6105 - protein, 73 aa, Zea mays
HSYQPQYAVSELNEKDFWRMFDASRYEHCRQKYGAVGTFMSVYYKSKKGRKTEKEVQEAEAAILEPAYADEEA

SEQ ID NO: 6106 - protein, 126 aa, Zea mays
MALVRLAFPVFFFLAAAEFAAGTRSPSAFVQNAIYSNRITIFSKTYCPYSMRAKHIFRDLKEDPYVVELDTRVDGRDIQSVLLDLVGRRTVPQVFVNGQHIGGSDDTVNALSNGQLQKLLGKSQSQ

SEQ ID NO: 6107 - protein, 240 aa, Zea mays
MSTAEATREENVYMAKLAEQAERYEEMVEFMEKVAKTADVGELTVEERNLLSVAYKNVIGARRASWRIISSIEQKEESRGNEAYVASIKEYRTRIETELSKICDGILKLLDSHLVPSATAAESKVFYLKMKGDYHRYLAEFKAGAERKEAAENTLVAYKSAQDIALADLPTTHPIRLGLALNFSVFYYEILNSPDRACNLAKQAFDEAIAELDSLGEESYKDSTLIMQLLRDNLTLWTLI

SEQ ID NO: 6108 - protein, 250 aa, Zea mays
PRVRLEAPVVVVTGASRGIGKATALALGKAGCKVLVNYARSSKEAEEVSKEIEASGGEAITFGGDVSKEADVESMMKAALDKWGTIDVLVNNAGITRDTLLMRMKKSQWQDVIDLNLTGVFLCTQAATKVMMKKRKGKIINIASVVGLTGNVGQANYSAAKAGVIGFTKTVAREYASRNINVNAIAPGFIASDMTAELGEELEKKILSTIPLGRYGQPEEVAGLVEFLALNPAASYMTGQVLTIDGGMVM

SEQ ID NO: 6109 - protein, 317 aa, Zea mays
  unsure (1)..(317): unsure at all Xaa locations
MATAAATAAAVVSSPAAPRAGAAAASRRGFVTFGGGAARFSPTLRSGRGFSGVQTHVAAVEQAIVKDATKLEAPVVVVTGASRGIGKATALALGKAGCKVLVNYARSXKEAEEVSKEIEASGGEAITFGGDVSKEADVESMMKAALDKWGTIDVLVNNAGITRDTLLMRMKKSQWQDVIDLNLTGVFLCTQAATKVMMKKRKGKIINIAXPVVGLTGNVGQANYSAAKAGVIGFTKTVAREYASRNINVNAIAPGFIASDMTAELGEELEKKILSTIPLGRYGQPEEVAGLVEFLALNPAASYMTGQVLTIDGGMVM

SEQ ID NO: 6110 - protein, 365 aa, Zea mays
MPKHYRPAGKKKEGNAAKYITRTKAVKYLQISLAVFRKLCILKGVFPREPKKKVEGNHKTYYHMKDIAFLAHDPLIEKFREIKVHRKKVKKAMAKKNRDLADRLLNRPPTYKLDRLIIERYPSFVDALRDLDDCLTMVHLFAALPAIEGERVQVQRIHNCRRLSHEWQAYISRTNSLRKTFISVKGIYYQAEVQGQKITWLTPHALQQVLTDDVDNSNLQNFLKSPQVKWQSLTCRCVQRLKDVFHSIGASSEKFTLSAENLPNTLEYIEGEVEALDEVIGSHADFCALVASRGTATAFLKAGCTHGKIVNRPNYSLSSSDLIDIPSLARSIGNRFMTQIWVNGGRKMTGDEARSHLKPDDEAEV

SEQ ID NO: 6111 - protein, 257 aa, Zea mays
  unsure (1)..(257): unsure at all Xaa locations
MAAAATTSSSSHLLLLSRQQAASLRCRLSFLGQPRRPGRVTAQAPAAKDVRCMAAVDTTAASTAAEETSPKSSSYEIVTLTTWLLQQERTGAIDNEMTIVLASISTACKQIAALVQRAPISNLTGVQGAVNVQGEDQKKLDVVSNEAFSNCLTXKSSGRTGVIASEEEDVPVAVEQSYSGNYIVVFDPLDGSSNIDAAVSTGSIFGIYNPNDECLADVDDNDTLDSVEQRCIVNVCQPGSNLLAAGYCMYSSSVIFV

SEQ ID NO: 6112 - protein, 99 aa, Zea mays
  unsure (1)..(99): unsure at all Xaa locations
MSREENVYMAKLAXQAERYEEMVEYMEKVAKTVDVEELTVEERNLLSVAYKNVIXARRASWRIVSSIEQRXXNXREHVNLIKEYRGKIXAELSNICDGI

SEQ ID NO: 6113 - protein, 191 aa, Zea mays
AGRKKEESRKNEEHVNLIKEYRAKIEAELSNICDGILKLLDSHLVPSSTAAESKVFYLKMKGDYHRYLAEFKTGPERKESAESTMMAYKAAQDIALAELAPTHPIRLGLALNFSVFYYEILNSPDKACNLAKQAFDEAISQLDTLGEESYKDSTLIMQLLRDNLTLWTSDLTEDGADEGKEAPKGEAGDGQ

SEQ ID NO: 6114 - protein, 263 aa, Zea mays
MSREENVYMAKLAEQAERYEEMVEYMEKVAKTVDVEELTVEERNLLSVAYKNVIGARRASWRIVSSIEQKEESRKNEEHVNLIKEYRGKIEAELSNSGSRENTICDGILKLLDSHLVPSSTAAESKVFYLKMKGDYHRYLAEFKTGAERKESAESTMVAYKAAQDIALAELAPTHPIRLGLALNFSVFYYEILNSPDKACNLAKQAFDEAISELDSLGEESYKDSTLIMQLLRDNLTLWTSDLTEDGADEGKDAPKGDAGEGQ

SEQ ID NO: 6115 - protein, 379 aa, Zea mays
MATAGKVIKCRAAVAWEAGKPLSIEEVEVAPPQAMEVRVKILYTALCHTDVYFWEAKGQTPVFPRILGHEAGGIVESVGEGVTELAPGDHVLPVFTGECKECAHCKSEESNMCDLLRINVDRGVMIGDGKSRFTISGQPIFHFVGTSTFSEYTVIHVGCLAKINPEAPLDKVCILSCGISTGLGATLNVAKPAKGSTVAIFGLGAVGLAAMEGARLAGASRIIGVDINPAKYEQAKKFGCTEFVNPKDHDKPVQEVLIELTNGGVDRSVECTGNVNAMISAFECVHDGWGVAVLVGVPHKDDQFKTHPMNFLSEKTLKGTFFGNYKPRTDLPNVVEMYMKKELELEKFITHSVPFSEINTAFDLMLKGESLRCIMRMED

SEQ ID NO: 6116 - protein, 379 aa, Zea mays
  unsure (1)..(379): unsure at all Xaa locations
MSTTGQIIRCKAAVCWEAGKPLVMEEVEVAPPQKHEVRIKILFTSLCHTDVYFWEAKGQTPLFPRIFGHEAGGIVESVGEGVTDLQPGDHVLPIFTGECGDCPHCHSEESNMCDLLRINTERGGMIHDGESRFSINGKPIYHFLGTSTFSEYTVVHSGQVAKINPEAPLDKVCIVSCGLSTGLGATLNVAKPKKGQSVAIFGLGAVGLAAAEGARIAGAGRIIGVDLNPKRFEEAKKFGVTEFVNPKEHDKPVQQVIAEMTNGGVDRSVECTGSIQAMIQAFECVHDGWGVAVLVGVPSKDDAFKTHPMNLLNERTLKGTFFGNYKPKTDIPGVVEKYMNKELELEKFITHTVPFSEINKAFDYMLXGESIRCIITMGA

SEQ ID NO: 6117 - protein, 354 aa, Zea mays
MERGDGGSGRPPAERKAAWRDGAVTYFHLLFYIAISGGQIFFNKWVLSSKEINFPYPVALTLLHMVFSSVVCFAITKVFKIIKIEEGMTTDIYITSVIPIGGMFAMTLWLGNSAYLYISVAFAQMLKAIMPVAVFLLGAAFGLEEMSYKMLSIMSVISVGVIVASVGEITISWVGVVYQMGGVVAEALRLIFIEIFLKKKGVKLNLISMMYYVSPCSAVCLFIPWLFLEKPKMDDSISWNFPPFTLFLNCLCTFVLNMSVFLVISRTSALTARVTGVVRDWSVVLLSAAIFADTQLTFINIIGYAIAIAGVVAYNNYKLKVKPQANPQQGDENKVISGSTQDVVLSVSSAKETS

SEQ ID NO: 6118 - protein, 104 aa, Zea mays
  unsure (1)..(104): unsure at all Xaa locations
REEMAASEGGLLGMGNPLLDIXAVVNYAFLAKYDIKMYNAILAEEKHLPMYDXWLSNSNVEYIAGGATQNSIRVAQWMLXTPGATSYMGSIGKDKVGEEIKKNA

SEQ ID NO: 6119 - protein, 342 aa, Zea mays
MAATEGVLLGMGNPLLDISAVVDDAFLTKYDIKLNNAILAEEKHLPMYDELASKSNVEYIAGGATQNSIRVAQWMLQTPGATSYMGCIGKDKFGEEMKKNAQAAGVTAHYYEDETAPTGTCAVCVVGGERSLIANLSAANCYKSEHLKRPENWALVEKAKYIYIAGFFLTVSPDSIQLVAEHAAANNKVFLMNLSAPFICEFFRDAQEKVLPYADYIFGNETEAKIFAKVRGWETENIEEIALKISQLPLASGKQKRIAVITQGADPVVVAEDGKVKTFPVILLPKEKLVDTNGAGDAFVGGFLSQLVLGKGIEDCVRAGCYAANIIIQRPGCTYPEKPDFN

SEQ ID NO: 6120 - protein, 150 aa, Zea mays
SAREKTRIWLGTFPTPEMAARAHDVAAMALRGRYACLNFADSTWRLPIPATANAKDIQKAAAEAAEAFRPSQTLENTNTKQECVKVVTTTTITEQKRGMFYTEEEEQVLDMPELLRNMVLMSPTHCIGYEYEDADLDAQDAEVSLWSFSI

SEQ ID NO: 6121 - protein, 175 aa, Zea mays
MSSDGGGSQMGVAGALGLSVTSSVAIVICNKYLMSTLEFYFATTLTSWHLLVTFCTLHIAQRLRFFEPKPIDAQTVISFGFLNGISIGLLNLCLGFNSVGFYQMTKLAIIPFTMLLETIFLSKKFSQSIKASLMVLLLGVGIASVTDLQLNLLGSIIAVLTIAATCVWQILTNQI

SEQ ID NO: 6122 - protein, 351 aa, Zea mays
MAPPARWLRREVLVGLALGQFVSLLITSTGFASSELARRGVNAPTSQSLLNYILLALVYGGTLLYKRQNMTIKWYYYLILGIVDVEANYIVVKAYQYTSLTSVMLLDCWSIPCVIVLTWIFLKTKYGLRKFIGVGVCVAGLILVVFSDVHASDRAKGPNPLKGDLLVIGGSMLYAISNVTEEYFVKKSNRIEVMAMLGVFGAIISGIQISILEQKELRSTHWTAGAILPFIGFALAMFLFYSTVPIILKICGATMLNLSLLTSDMWAVLIRIFAYKEKVDWMYFVAFAGTATGLVIYSYRGSRQISEETAQVTQAIDEEAATANSAAQVPGVGDDGPASNKDFSLAATASR

SEQ ID NO: 6123 - protein, 134 aa, Zea mays
  unsure (1)..(134): unsure at all Xaa locations
MAVSAREEFVYMAKLAEQAERYEEMVEFMEKVSAAVDGDELTVEERNLLSVAYKNVIGARRASWRIISSIEQKEESRGNDDHVTAIRDYRSKIETELSGICDGILKLLDSRLVPAAASGDSKVFYLKMKGDYXR

SEQ ID NO: 6124 - protein, 185 aa, Zea mays
  unsure (1)..(185): unsure at all Xaa locations
MVMTLTRHDSGESKEMEGLRAHSEAXALLTLSSTTTGGTGTGTGTGTAAAAEGAFECKTCSKRFPSFQALGGHRTSHTRLQARTLVGDPAERYDDRPAARVHECAVCGLEFSMGQALGGHMRRHRGEGPPPPAAHDDDDDGPAQPDRDMPDLNLPPLDDDDGSQAGPRQSDGGRGSGPQLLNLLV

SEQ ID NO: 6125 - protein, 149 aa, Zea mays
MDHAADTFRTDLMTITRHVLNEQSRHPESRGDLTILLSHIVLGCKFVASAVNKAGLAKLTGLAGETNVQGEEQKKLDVLSNEVFVNALVSSGRTCVLVSEEDEKATFVDPKLRGKYCVCFDPLDGSSNIDCGVSIGTIFGIYMIKTQTP

SEQ ID NO: 6126 - protein, 138 aa, Zea mays
MAEEKHHHHHLFHHKKDEEQAAAGGYGESAEYTEATVTEVVSTGENEYDEYKKEEKQHKHKQHLGEAGAIAAGAFALYEKHEAKKDPEHAHRHKIEEEVAAAAAVGSGGFAFHEHHEKKKDHKDAEEAGGEKKHHFFG

SEQ ID NO: 6127 - protein, 115 aa, Zea mays
MAEEKHHHHHLFHHKKDEEQEEQLAGGGYGESAEYTEATVTEVVSTGENEYDEYKEEKQHKHKQHLGEAGAIAAGAFALYEKHEAKKDPEHAHRHKIEEDRKNVCNSDLLTCLVV

SEQ ID NO: 6128 - protein, 134 aa, Zea mays
MELHKYWGVGGRRCGSCEGAPAAVHCRTCVGGSFLCTTCDARPAHARLGHERVWMCEVCELAPAAVTCKADAAVLCAACDSDIHDANPLARRHARVPVAPIGSEAAAAAVEAMLFGGWRGARGLRRQRQRRREL

SEQ ID NO: 6129 - protein, 313 aa, Zea mays
MELHKYWGVGGRRCGSCEGAPAAVHCRTCVGGSFLCTTCDARPAHARLGHERVWMCEVCELAPAAVTCKADAAVLCAACDSDIHDANPLARRHARVPVAPIGSEAAAAAVEAMLFGTGEAAVSEADEQHAAAEQQQHAHALNLNVEAKDMKLDYLFSELDPYLSVEIPRFQHADSVVPNGAGAAVELDFTCGIGVKHSSYSSYTATSLAHSGSSSEVGVVPEAFGGSGGGSFELDFTRPKPQAYMPYTGTPQSHSVPSVDVEVVPERGDLAAVRPVPLMGESREARLMRYREKRKNRRFEKTIRYASRKAYAE

SEQ ID NO: 6130 - protein, 274 aa, Zea mays
  unsure (1)..(274): unsure at all Xaa locations
MEKLSIAATMFCALVLAALAAAAGGEAAVVEHTFVVHEMNQTHLCNTTKIYVVNGQLPGPTIDITDGDTVVVHVINRLPHGLTIHWHGVRQMRSCWSDGAGFVTECPIPPGGDHVYHFNVTGQVGTLWWHAHVTCLRATVAGAFIIRPKGGMYPFPTPAKDVPIIIGEWWQLDLVELDRRMHDGNFDDNPLSATINGKLGDLSNCSGKPEESFVLDVVRGKTYLLRIVNTALFSEYYFKVAGHTFTVVGADGYYLTPYKTDMVTXAPGEAIDVL

SEQ ID NO: 6131 - protein, 465 aa, Zea mays
MALLRLLAISLLFAVATPVRDIAHDACSSEVKDFQHLNNSSGLHLTLHHPQSPCSPAPLPADLPFSAVLAHDGARIASLAARLAKTPSSRPTLLDESRAGSSSSSPDDESLASVPLGPGTSVGVGNYVTRMGLGTPAKSYVMVVDTGSSLTWLQCSPCVVSCHRQSGPVFNPKASSSYASVSCSAQQCSDLTTATLNPASCSTSNVCIYQASYGDSSFSVGYLSKDTVSFGSTSVPNFYYGCGQDNEGLFGQSAGLIGLARNKLSLLYQLAPSMGYSFSYCLPTSSSSSSGYLSIGSYNPGQYSYTPMASSSLDDSLYFIKMTGIKVAGKPLSVSSSAYSSLPTIIDSGTVITRLPTGVYSALSKAVAGAMKGTPRASAFSILDTCFQGQAARLRVPEVTMAFAGGAALKLAARNLLVDVDSATTCLAFAPARSAAIIGNTQQQTFSVVYDVKNSKIGFAAGGCS

SEQ ID NO: 6132 - protein, 52 aa, Zea mays
MAPRSKAERKAVLGAGAWMFNVVTSVGIIMVNKALMATHGFSFGRSMPNLHS

SEQ ID NO: 6133 - protein, 337 aa, Zea mays
  unsure (1)..(337): unsure at all Xaa locations
MAPGSKAERKAALDAGAWMFNVVTSVGIIMVNKALMATHGXSFATTLTGLHFAMTXTLMTLVMKWLGYIQPSXLPLPELVKFAFFANLSIVGXMNVSLMWNSVGFYQIAKLCIIPVLCILEIMFDKVRYSRDTKLSIVLVLIGVAVCTVTDVSVNSQGLLAAVIAVWSTALQQHYVHHLQWKYSLGSFNLLGHTAPAQAASLLVLGPFVDFWLTNKRVDAFNYTSIVTFFIVLSCIIAVGTNLSQFICIGRFTAVSFQVLGHMKTVLVLTLGFLFFGKEGLNFHVALGMLLAVIGMIWYGNASSKSGGKERQVYPTPSEKTQKHGALSSQSELDQKV

SEQ ID NO: 6134 - protein, 52 aa, Zea mays; identical to SEQ ID NO: 6132

SEQ ID NO: 6135 - protein, 614 aa, Zea mays
MAVMAEVVSTTGAALRSPASQPLPAAVKNADAEKLQFIEEMTSNVDAVQERVLGEILARNAGTEYLAKYGLAAATTDRATFRAKVPMATYEDLQPYIRRIADGDRSPILSGHPVSEFLTSSGTSAGERKLMPTIEDELNRRQLLYSLQMPVMNLYVPGMDKGKALHFLFVKSETKTPGGLAARPVLTSYYKSNHFKNRPFDAYNNYTSPTAAILCADAFQSMYAQMLCGLCQRQDVLRVGAVFASGLLRAIRFLQLNWEQLAEDIEAGSLTPRVTDPSVREAVAGILRADPELAALVRSECSKGDWAGIITRIWPSTKYLDVIVTGAMAQYIPTLKYYSGGLPMACTMYASSECYFGLNLRPMCDPSEVSYTLMPNMCYFEFLPMDSAAASGGDASQLVDLARVEVGREYELVITTYAGLNRYRVGDVLQVTGFHNSAPQFRFVRRKNVLLSIESDKTDEAELQRAVERASALLRPHGAAVVEYTSQAYTKSIPGHYVIYWELLAKGPAAGAAVGEGTLERCCLEMEEALNTVYRQSRVADGSIGPLEIRVVRPGTFEELMDYAISRGASINQYKVPRCVTFPPIIELLDSRVVSSHFSPALPHWTPGQRSDSD

SEQ ID NO: 6136 - protein, 614 aa, Zea mays
MAVMAEVVSTTGAALRSPASQPLPAAVKNADAEKLQFIEEMTSNVDAVQERVLGEILARNAGTEYLAKYGLAAATTDRATFRAKVPMATYEDLQPYIRRIADGDRSPILSGHPVSEFLTSSGTSAGERKLMPTIEDELNRRQLLYSLQMPVMNLYVPGMDKGKALHFLFVKSETKTPGGLAARPVLTSYYKSNHFKNRPFDAYNNYTSPTAAILCADAFQSMYAQMLCGLCQRQDVLRVGAVFASGLLRAIRFLQLNWEQLAEDIEAGSLTPRVTDPSVREAVAGILRADPELAALVRSECSKGDWAGIITRIWPSTKYLDVIVTGAMAQYIPTLKYYSGGLPMACTMYASSECYFGLNLRPMCDPSEVSYTLMPNMCYFEFLPMDSAAASGGDASQLVDLARVEVGREYELVITTYAGLNRYRVGDVLQVTGFHNSAPQFRFVRRKNVLLSIESDKTDEAELQRAVERASALLRPHGAAVVEYTSQAYTKSIPGHYVIYWELLAKGPAGGAAVGEGTLERCCLEMEEALNTVYRQSRVADGSIGPLEIRVVRPGTFEELMDYAISRGASINQYKVPRCVTFPPIIELLDSRVVSSHFSPALPHWTPGQRSDSD

SEQ ID NO: 6137 - protein, 251 aa, Zea mays
HASAALVTGGSKGIGQAVVEELARLGARVHTCARSAADLEECRRRWAEKGLRVTVSVCDVAVRADRERLVLDTVSGAFDGKLDILVNNAALLLLKPAAEWAAEDYARIMATNLESCLHISQLAHPLLLNASVAGGASIVNVSSIASVLGFPQEVMYSVTKGGLNQMTRSLAVEWACDRIRVNCVAPGVIMTDMGKELPAALVEQERSRIPLRRTGEPEEVASLVSFLCMPAASYVTGQVIFVDGGRTISGA

SEQ ID NO: 6138 - protein, 255 aa, Zea mays; identical to SEQ ID NO: 5594

SEQ ID NO: 6139 - protein, 390 aa, Zea mays
WDLEPAGPLPRHKLSPTRTRDLARPNTKASDLSDQRRRFVRVEERREEMAASEGVLLGMGNPLLDISAVVDDAFLAKYDIKLNNAILAEEKHLPMYDELASNSNVEYIAGGATQNSIRVAQWMLQTPGATSYMGCIGKDKFGEEMKKNAQAAGVTAHYYEDETAPTGTCAVCVVGGERSLIANLSAANCYKSEHLKRPENWALVEKAKYIYIAGFFLTVSPDSIQLVAEHAAANNKVFLMNLSAPFICEFFCDAQEKVLPYADFIFGNETEAKIFAKVRGWETENVEEIALKISQLPLASGKQKRTAVITQGADPVVVAEDGKVKTFPVILLPKEKLVDTNGAGDAFVGGFLSRLVQGKSIEDCVTAGCYAANVIIQRPGCTYPEKPDFN

SEQ ID NO: 6140 - protein, 322 aa, Zea mays
  unsure (1)..(322): unsure at all Xaa locations
MAATEGVLLGMGNPLLDISAVVDDAFLTKYDIKLNNAILAEEKHLPMYDELASKSNVEYIAGGATQNSIRVAQWMLQTPGATSYMGCIGKDKFGEEMKKNAQAAGVTAHYYEDETAPTGTCAVCVVGGERSLIANLSAANCXYIAGFFLTVSPDSIQLVAEHAAANNKVFLMNLSAPFICEFFRDAQEKVLPYADYIFGNETXAKIFAKVRGWETENIEEIALKISQLPLASGKQKRIAVITQGADPVVVAEDGKVKTFPVILLPKEKLVDTNGAGDAFVGGFLSQLVLGKGIEDCVRAGCYAANVIIQRPGCTYPEKPDFN

SEQ ID NO: 6141 - protein, 107 aa, Zea mays
MALPKAKEIVSSNSVVVFSKTYCPFCVEVKQLFGNLGVTYKAIELDSEADGSEIQAALVEWTGQRTVPNVFIGGNHIGGCDSTTALHNQGKLVPLLTSAGALAKSTA

SEQ ID NO: 6142 - protein, 296 aa, Zea mays
MERTLITSNLSMSAHASRSSRRVHYISPAASAAAHNSSYRKKKKNAPSPPPSAAATDTVVISPPATDNVQSTAPKQAGRQELEELVAAKTNTSRIATARTSASSQSRAKLRRRPAPAITSLPMAFCSALEEAINTFVDPPVLRPSVDPRNVLSTNFAPVDELPPTPCPVVRGAIPRCLAGGAYIRNGPNPQHLPRGPHHLFDGDGMLHSLLLPTAGSPPSSDPVLCSRYVQTYKYLVERDAGAPVMPNVFSGFHGVAGLARGAVVAARVLTGQMNPAEGVGLANTSLVFFGGRREL

SEQ ID NO: 6143 - protein, 102 aa, Zea mays
  unsure (1)..(102): unsure at all Xaa locations
MGLSEEKTWSGREYKVKDLSKADLGRLEIELDEEEMPGLMVCRAEFGPYKPFDGTRISGALHMTIQTVDLIETLTALGHQVLWXHCNMFFTQEHAGVAIARD

SEQ ID NO: 6144 - protein, 399 aa, Zea mays
  unsure (1)..(399): unsure at all Xaa locations
VGNLVACLLAHKMGVTHCTIAHALEKTKYPNSDLYWKKFEDHYHFSCQFTTDLIAMNHADFIITSTFQEIAGNKDTVGQYESHMAFTMPGLYRVVHGIDVFDPKFNIVSPGADLSIYFPYTESHKRLTSLHPEIEELLYSQTENTEHKFVLNDRNKPIIFSMARLDRVKNLTGLVEXLYGRNKRLQEXLVNLVVVCGDHGNPSEDKDDQAEFKKMFDLIEQYNLNGHIRWISXQMNRVRNGELYRYICDTKGAFVQPAFYEAFGLTVVEAMTCGLPTFATAYGGPAEIIVHGVSGYHIDPYQGDKASALLVDFFDKCQADPSHWSKISQGGLQRIEEKYTWKLYSERLMTLTGVYGFWKYVSNLERRETRRYLEMLYALKYRTMASTVPLAVEGEPSSK

SEQ ID NO: 6145 - protein, 321 aa, Zea mays
MGRDGGGGVAGGMSESVLRKVLLSYLYVAVWIFLSFSVIVYNKYILDPKMYNWPFPISLTMVHMGFCSSLAVALVRVLRVVDLPTSPSMTPQLYTSSVVPIGALYAMSLWFSNSAYIYLSVSFIQMLKALMPVAVYSIGVLFNKETFRSSSMLNMLSISFGVAIAAYGEARFDVRGVALQLAAVAFEATRLVLIQILLTSKGISLNPITSLYYVAPCCLCFLVVPWVFVELPRLRAVGTFQPDFFVFGTNSLCAFALNLAVFLLVGKTSALTMNVAGVVKDWLLIAFSCSAVRDTVTPINLFGYGIAFLGGVYYAHARLTQ

SEQ ID NO: 6146 - protein, 398 aa, Zea mays
  unsure (1)..(398): unsure at all Xaa locations
PASAPRPPRVRSTVEIHRLRAPSPEQREEAGGRGQAMGKEGASGGGGGGDGGMSASVIRKVLVSYMYVAVWIFLPFSVIVYNKYILDPKMYNWPFPISLTMVHMAFCSSLAVALVRVLRVVXLPSSPAMTSQLYLSSVVPIGALYSLSLWFSNSAYIYLSVSFIQMLKALMPVAVYSIGVLFKKETFRSSAMLNMLSISFGVAIAAYGEARFDARGVALQLAAVAFEATRLVLIQILLTSKGISLNPITSLYYVAPCCLAFLVVPWVFVELPRLRAVAGVXRPRGFVFGTNSLCAFALNLAVFLLVGKTSALTMNVAGVVKDWLLIAFSWSVIRDTVTPINLFGYGIAFLGVGYYNHVKLQALKAKEAQKKATQADEEAGSLLQERDGHSDRKSDNQA

SEQ ID NO: 6147 - protein, 134 aa, Zea mays
MERGRSSTSCRSLLLLLLVCFSHGAGAAAAARLLTPLQAAAAVPPPLALHQAESNGATAAAADDGLVMTQEGDADATSNGNDDDEISSVSESETMTGAEEACGTEGNDEEECLQRRLLGDAHLDYIYTQHKGKP

SEQ ID NO: 6148 - protein, 228 aa, Zea mays
  unsure (1)..(228): unsure at all Xaa locations
MSTAGKTITCKAAVAWEAGKPLSIEDIEVAPPKANEVRIQIYYTGVCHTDAYTLSGKDPEGAFPIVLGHEGAGIVESXGEGVTNVKVGDHVVALYTPECKECKFCKSGKTNLCGKIRATQGKGLMPDGTSRFKCKGKDLLHFMGTSTFSQYTVVADISVVAIEHDAPMDRTCLLGCGITTGYGAATITANVQAGDNVAIFGAGCXGLSVVQGAAARKAGKIIRCDVTL

SEQ ID NO: 6149 - protein, 207 aa, Zea mays
MAAPGGLDQDCAQDAAIKLFGRSIPVLHSSVFAATAAAESEVSTKLANDVRSKDGMPCLPNMSLIVKTNPFPSKSNMKNGLQAISSQHGKMEADSNSEEAKNSLQAIISQPGKRYDSKSEEAKTESGGSGQEKVLKKPDKILPCPRCNSMETKFCYFNNYNVNQPRHFCRNCKRYWTARGTMRNVPVGSGRRRNKDPSHHHHFTKGV

SEQ ID NO: 6150 - protein, 521 aa, Zea mays
  unsure (1)..(521): unsure at all Xaa locations
MARGDGGQLELSAGVRGAGGSAATADHVAPISLGRLILAGMVAGGVQYGWALQLSLLTPYVQTLGLSHALTSFMWLCGPIAGLVVQPLVGLYSDRCTARWGRRRPFIXLTGCMLICVAGIVVGFSSDIGAALGDTKEHCSLYHGPRWHAAIVYVLGFWLLDFSNNTVQGPARAMMADLCDHHGPSAANSIFCSWMALGNILGYSSGSTNNWHKWFPFLKTSACCEACANLKGAFLVAVVFLVMCLTITLFFAKEVPYRGNQNLPTKANGEVETEPSGPLAVLKGFKNLPTGMPSVLLVTGLTWLSWFPFILYDTDWMGREIYHGDPKGTNAQISAFDEGVRVGSFGLLLNSIILGFSSFLIEPMCRKVGPRVVWVTSNFMVCVAMAATALISFWSLKDYHGYVQDAITASTSIKAVCLVLFAFLGVPLAILYSVPFAVTAQLAATKGGGQGLCTGVLNISIVIPQVIIALGAGPWDALFGKGNIPAFGVASGFALIGGVVGVFLLPKISKRQFRAVSAGGH

SEQ ID NO: 6151 - protein, 193 aa, Zea mays
MADQANQPTVLHKLGGQFHLRSIISEGVRARNICPSVSSYERRFATRNYMTQSLLGPSMSVSGGINVPVMRTPLCANAPAEKGGKNFMIDFMMGGVSAAVSKTAAAPIERVKLLIQNQDEMIKSGRLSEPYKGIVDCFKRTIKDEGFSSLWRGNTANVIRYFPTQVAHTFHHIFYSVTSVNMLKHHDLSYLSG

SEQ ID NO: 6152 - protein, 213 aa, Zea mays
FVYLIIYLRYLTRADFQEDVLHARVRTNGVVETQFSPLGESKRGGEVYRLYDVGGQRNERRKWIHLFEGVNAVIFCAAISEYDQMLFEDETKNRMMETKELFDWVLKQRCFEKTSFMLFLNKFDIFERKIQKVPLSVCEWFKDYQPTAPGKQEVEHAYEFVKKKFEELYFQSSKPDRVDRVFKIYRTTALDQKLVKKTFKLIDESMRRSREGT

SEQ ID NO: 6153 - protein, 372 aa, Zea mays
  unsure (1)..(372): unsure at all Xaa locations
MNMDKTPIAGDGGGDAGGGGGGSGNGPEMQSSLDAVAPSPTPHTELDISSMPDTPLRKPGHRRALSEIIGLPDDLDLGGPGAGDAPALSDENEEELFSMFLDVDKLNSRCGASESEPSCAMAGGPGEATETSAAASGAAQGQMHHHNRHSMDASSSIDAEHLFGTTVTEGVSPAEAKKAMSAANLAELALIDPKKAKRIINNRQSAARSKERKMRYIAELERKVQFMQREATALXQLALLQRDTAGLTVENGDLKIRLESTEQQIHLQDAXLKMATGQAGNQMMNFAEPPHTFGGANQQVFHHPGQAVPPFLVAMQQQQQLLLPHMNQPLHPLQSQQLHQAATLSIDMEGLPAAPPGQWQWGGDTWSESSSC

SEQ ID NO: 6154 - protein, 226 aa, Zea mays
  unsure (1)..(226): unsure at all Xaa locations
VLDRDHLIRDGVQDDCQNDRKMNERLVGVSEDTTTGVKRLYXMHETGALLFSAINVNDTVTNEXFDYLYGCRHSLPDGLISVTDVMIAGKDCVXCGYVDVHKGSAAALKXGGARVIETXNPPIXALQALMDVLQVLPLWEVVSETDIFMTTTVYKDILMAEHMRNMSNHAIGCNSGHFDNEIDMLGLETXPARKRITIKPQTDRWMLPXTNTDIIVLDEGRLKNLG

SEQ ID NO: 6155 - protein, 211 aa, Zea mays
GDWDPRGRPGDSQPLTVAILASLLFGESIGAIGVGGLVLGVVGLLLLEVPALSVEGNDTTIWGSGESLMFLSAQSMAVGTIMVRWVSKYSDPIMATGWHMIIGGLPLLVISVLNHDPALSGHIQDLTWSDILALGYTSIFGSAVSYGVYFYNATRGSLTTLSSLTFLTPMFASVFGYLYLGETFSTVQIGGALLTLVAIYMVNYKSIIGEK

SEQ ID NO: 6156 - protein, 416 aa, Zea mays
MAAAARPASAHLLLLAPLPSPPRLSHLIHTRRLYALAPARRPAAVRARREPSPPSAPSPSAPADSFDCVGTGSDVECFVDAGAEDAAPLLPALSAGASKDDRKSEGDAAVSASPAGRELWEWASLVSPFFFWGTAMVAMKGVIPRTGPFFVAAIRLLPAGALLVAFAAARGRKQPSGWEAWLAIAAFGLIDAACFQGFLAEGLQKTSAGLGSVIIDSQPLTVAILASLLFGESIGAIGVGGLVLGVVGLLLLEVPALSVEGNDTTIWGSGESLMFLSAQSMAVGTIMVRWVSKYSDPIMATGWHMIIGGLPLLVISVLNHDPALSGHIQDLTWSDILALGYTSIFGSAVSYGVYFYNATRGSLTTLSSLTFLTPMFASVFGYLYLGETFSPVQIGGALLTLVAIYMVNYKSIIGEK

SEQ ID NO: 6157 - protein, 130 aa, Zea mays
MDKLSGSARLMIVSDLDHTMVNVVQLISWSALSYLFGALWESVYCEDSLLVFSTGRSPTLYKELRKEKPMLTPDITIMSVGTEITYGEAMVPDDGWEEYLNNKWDRNIVVAETVSFSELKLQPETEQRPH

SEQ ID NO: 6158 - protein, 118 aa, Zea mays
  unsure (1)..(118): unsure at all Xaa locations
IRLEVSSTYFSRTSTQTVLATLLKDPIELSAYRDRRFKGTQEENEAGLLAWTTLYIGNMSFYTTEEQAYELLYLAGKIKKIMIGLEQNSKIPCXIXFVLYYSREDAENAVKYMSGTML

SEQ ID NO: 6159 - protein, 434 aa, Zea mays
  unsure (1)..(434): unsure at all Xaa locations
SSRPGRAHLGGRWHVRLPLGNSGLRVLCSPFPSDFPTAVTIFTANSPAGAAPSVRPFFRYRTRQSPQRSLSLAPPTQRSASAREEEMASSGYEGILLGMGNPLLDISAVVDEGFLAKYDVKPGNVILAEDKHLPMXTNGFDELASKSNVEYIAGGATQNSIRVAQWMLQIPGASSYIGCIGKDKFGEEMKKNAQAAGINAHYHEDDNAPTGTCAVCVVGGERSLIANLSAANCYKSEHLKKPENWALVEKAKYIYIAGFFLTVSPDSIQLVAEHAAATNKVFMMNLSAPFICEVFRDAQEKALPYVDYIFGNETEARTFAKVRGWEIENVEEIALKISQLPKASGTHKRITVITQGCDPVVVADDGKVKTFPVILLPKEKLVDTNGAGDAFVGGFLSQLVQEKSIDECVRAACYAANVVIQRSGCTYPEKPDFN

SEQ ID NO: 6160 - protein, 430 aa, Zea mays
SSRPGRALAGGRWHVRLPLGISGLRVLCSPWPSDFPTAVTIFTANSPAGAAPSVRPFFRYRTRQSPQRSLSLAPPTQRSASAREEEMASSGYEGILLGMGNPLLDISAVVDEGFLAKYDVKPGNVILAEDKHLPMYDELASKSNVEYIAGGATQNSIRVAQWMLQIPGASSYIGCIGKDKFGEEMKKNAQAAGINAHYHEDENAPTGTCAVCVVGGERSLIANLSAANCYKSEHLKKPENWALVEKAKYIYIAGFFLTVSPDSIQLVAEHAAATNKVFMMNLSAPFICEVFRDAQEKALPYVDYIFGNETEARTFAKVRGWETENVEEIALKISQLPKASGTHKKITVITQGCDPVVVADDGKVKTFPVILLPKEKLVDTNGAGDAFVGGFLSQLVQEKNIDECVRAACYAANVVIQRSGCTYPEKPDFN

SEQ ID NO: 6161 - protein, 434 aa, Zea mays
  unsure (1)..(434): unsure at all Xaa locations
NIASSRPGRAHLGGRWHVRLPLGNSGLRVLCSPFPSYFPTAVTIFTANSPAGAAPSVRPFFRYRTRQSPQRSLSLAPPTQRSASAREEEMASSGYEGILLGMGNPLLDISAVVDEGFLAKYDVKPGNVILAEDKHLPMYDELASKSNVEYIAGGATQNSIRVAQWMLQIPGASSYIGCIGKDKFGEEMKKNAQAAGINAHYHEDDNAPTGTCAVCVVGGERSLIANLSAANCYKSEHLKKPENWALVEKAKYIYIAGFFLTVSPDSIQLVAEHAAATNKVFMMNLSAPFICXEVFRDAQEKALPYVDYIFGNETEARTFAKVRGWEIENVEEIALKISQLPKASGTHKRITVITQGCDPVVVADDGKVKTFPVILLPKEKLVDTNGAGDAFVGGFLSQLVQEKSIDECVRAACYAANVVIQRSGCTYPEKPDFN

SEQ ID NO: 6162 - protein, 647 aa, Zea mays
MESRALLHARPAALPHRAGLRLHLPLLRPRAVSRSPAAKPALQSPLLASRGPFLQRHDAVLGNGFVKRRAASAGGDVSFRAQAAASAAVPAPQPEESTKKLLGIDVKTLKKIVPLGLMFFCILFNYTILRDTKDVLVVTAKGSSAEIIPFLKTWVNLPMAIGFMLLYTKLSNVLSRDALFYTVIFPFIAFFGAFAFVLYPLRDVIHPTALADKLLAALGPSFLGPVAILRIWSFCLFYVMAELWGSVVISVLFWGFANQITTVDEAKEFYPLFGLGANIALIFSGRTVKYFSNLRKTLGPGIDGWEVSLKGMMSIGVLLGLVITSIYWGVNKFVLNDPSLPKADRKKKKEKPKLGMKESLKVLLSSRYVRDLATLVVAYGISINLVEVTWKSKLKAQFPSPNEYSSFMGDFSTATGIATFTMMLLGRIILRKFGWGVAAKITPTVLLLTGVGFFSLILFGQPLTPMLATMGMTPLLAAVYVGAMQNIFSKSAKYSLFDPCKEMAYIPLDEDMKVKGKAAIDVVCNPLGKSGGALIQQFMILTFGSLANSTPYLGGILLVIVLAWLGAASSLDKQFSSLAKQDLEREKAAQDQEKLERSLLSSKPAEGGTGDVLLVEQQTNGSATSKATGTESSPSNSSLPPHSIDRS

SEQ ID NO: 6163 - protein, 332 aa, Zea mays
MGSPRKSDKKAALDFAAWGFNITSSVGIIMVNKALMATHGFSFATTLTGLHLLTTTLMTIVFRWLGLSQPSHLPLPDLIKFVIFSNLSIVGMNVSLMWNSVGFYQIAKLCMIPASCLLEVVFDRVHYSRDTKLSIMVVLVGVAVCTVTDVSVNAKGMLAAVIAVWSTALHQYYVHFLQRKYSLNSFNLLGHTAPAQAGWLPRVRPGADYLLTGKRVDQFSLSSLALFFLALSCFIAIGVNLSQFICIGRFSAVSFQVLGHMKTVLVLSLGFLFFGKEGLNLQVVLGMVLAVLGMIWYGNASAKPGGKERRSILPVRSASLKGSSEEKAGAEK

SEQ ID NO: 6164 - protein, 266 aa, Zea mays
  unsure (1)..(266): unsure at all Xaa locations
PHHHCNGLLASRQRRPQISLSPPCAAVVERSKKMAASNLEGVLLGMGNPLLDISAVVDEAFLAKYDVKPNNAILAEDKHLPMYDELSSKENVEYIAGGATQNSIRVAQWMLQTPGATSYMGCIGKDKYGEEMKSAAKAAGVTAHYYEDEAAPTGTCAVCVVGGERSLIANLSAANCYKSEHLKKPENWALVEKAKYIYIAGFFLTVSPESIQLVAEHAAANNKVFLMNLSAPFICEFFRDAQEKVLPYADYIFGNETXARIFSKSE

SEQ ID NO: 6165 - protein, 268 aa, Zea mays
  unsure (1)..(268): unsure at all Xaa locations
MSPSEPTREESVYMAKLAEQAERYEEMVEFMERVARXPGGAGGGEELSVEERNLLSVAYKNVIGARRASWRIISSIEQKEEGRGNEAHAASIRAYRSKIEAELARICDGILALLDSHLVPSAGGAESKVFYLKMKGDYHRYLAEFKSGAERKDAAESTMNAYKAAQDIALADLAPTHPIRLGLALNFSVFYYEILNSPDRACNLAKQAFDEAISELDSLGEESYKDSTLIMQLLRDNLTLWTSDTNEDAGDEIKEAAAAPKESAPEGQ

SEQ ID NO: 6166 - protein, 139 aa, Zea mays
FYLKMKGDYHRYLAEFKSGAERKDAAESTMNAYKAAQDIALADLAPTHPIRLGLALNFSVFYYEILNSPDRACNLAKQAFDEAISELDSLGEESYKDSTLIMQLLRDNLTLWTSDTNEDGGDEIKEAAAAPKESAPEGQ

SEQ ID NO: 6167 - protein, 181 aa, Zea mays
MSPSEPTREESVYMAKLAEQAERYEEMVEFMERVARYAESKVFYLKMKGDYHRYLAEFKSGAERKDAAESTMNAYKAAQDIALADLAPTHPIRLGLALNFSVFYYEILNSPDRACNLAKQAFDEAISELDSLGEESYKDSTLIMQLLRDNLTLWTSDTNEDGGDEIKEAAAAPKESAPEGQ

SEQ ID NO: 6168 - protein, 266 aa, Zea mays
MSPSEPTREESVYMAKLAEQAERYEEMVEFMERVARSAGGAGGGEELSVEERNLLSVAYKNVIGARRASWRIISSIEQKEEGRGNEAHAASIRAYRSKIETELARICDGILALLDSHLVPSAGGAESKVFYLKMKGDYHRYLAEFKSGAERKDAAESTMNAYKAAQDIALADLAPTHPIRLGLALNFSVFYYEILNSPDRACNLAKQAFDEAISELDSLGEESYKDSTLIMQLLRDNLTLWTSDTNEDGGDEIKDAAAPKESAEGQ

SEQ ID NO: 6169 - protein, 139 aa, Zea mays; identical to SEQ ID NO: 6166

SEQ ID NO: 6170 - protein, 212 aa, Zea mays
MGCPPRLLCCLFLSLSLAAVVARAATRHQEWEISYQFKSPDCVRKLAVTINGETPGPTIRATQGDTVVVRVKNSLLTENVAIHWHGIRQRGTPWADGTEGVTQCPILPGDTFTYAFVVDRPGTYMYHAHYGMQRSAGLNGLIVVAAAPGGPDAEPFRYDGEHDVLLNDWWHKSTYEQAAGLASAPLVWVGEPQSLLINGRGRFVNCSAGACD

SEQ ID NO: 6171 - protein, 134 aa, Zea mays
MRRRGSNSSPLAAAAQLLLLLLLLVAGCIHSAAAAARHLPSPGAPVQALDHQAETGGKAASAGADGAGGLVLQEGGTGNNGDDLSSKTLLETTTTTMGAEACEEGNDKDECVQRRLLVDAHLDYIYTQHKGNKP

SEQ ID NO: 6172 - protein, 46 aa, Zea mays
  unsure (1)..(46): unsure at all Xaa locations
PSTADSEELTVEERNLMSVXYKNATGRRRASWRIISSIEPRPRGEA

SEQ ID NO: 6173 - protein, 453 aa, Zea mays
MVAYLLSKPNGSWKASMKVWVGVGLPAAAAVVVVFLIFAGVAALPAAMAAVVEHTFVVSQVNLTRLCKETLVTVVNGQLPGPAIEVTEGDSVVVHVVNRSPYNMTIHWHGVKQRLNCWADGVPMVTQCPILPGRSFTYRFNVAGQEGTLWWHAHVPCLRATLHGALIIRPRHSPYPFAPKPDREIPVVIGEWWDMDLAQLDRNTMDGFLVDVPTGSTINGKLGDLYSCSGAGRDGFVLEVEPGKTYLLRLMNAALFSEYYLKVAGHRMTVVASDANYVRPYTTDVVAIAPGETMDVLLPADAPPGRSYYMAALAIQAPEPDVQVPPTITRGIVQYRSSSSDVAVDGVVVPAADPAVVMPDMPDQHDTTISFHFHGNLSSLRRRHRVPPARADDHMLVTLSLGSVCRDGGRACARSDSDESIIVGTMNDVSFRAPTAAAMPLLEAHYYGRGDMA

SEQ ID NO: 6174 - protein, 95 aa, Zea mays
MMRRCSIAALAIFLLLLVCSSSSSNCAAAARLLPGAGHLRPLRHAAVGASGDELSAGSETMEACEEGNGKDECVQRQLLLDAHLDYIYTQHKGKP

SEQ ID NO: 6175 - protein, 98 aa, Zea mays
MMRRCSIAALAIFLLLLLLVCSSSSSNCAAAARLLTGAGPLRAAVGASGDELSAGSEVTAQDTMEACEEGNEKDECVQRRLLLDAHLDYIYTQHKGKP

SEQ ID NO: 6176 - protein, 236 aa, Zea mays
  unsure (1)..(236): unsure at all Xaa locations
MATERESKTFLARLCEQAERYDEMVTYMKEVAKIGGELTVDERNLLSVAYKNVVGTRRASWRIISSIEQKEEAKGTDKHVGIIREYRQKIELELEKVCEDVLSVLDESLIPKAETGESKVFYHKMKGDYHRYLAEFASGDKRKSAATAAHDAYKNATDVAQTELTPTHPIRLGLALNFSVFYYEILNSPDRACHLAKQAFDDAIAELDSLSEESYRDSTLIMQLLRDXLTLWTSSD

SEQ ID NO: 6177 - protein, 609 aa, Zea mays
MRLWEEEDDDEDEEGMEVDGEAEDEPGWPCGAPEAGPGETRPAAILVADAAEVDFPVIYVNAAFEAATGYRAHEVLGRNCRFLQFRDPHAQRRHPLVDPMVVSEIRRCLSEGIEFQGELLNFRKDGAPLHNRLRLVPMHGDDGYVTHVIGIQLFSEANIDLSSVSYPVYKQKSSSRPSIQDLNSSPHEHAPKIQSADHCGMLQLSDEVLAHNILSRLSPRDVASIGSVCTRMHELTKNDHLRKMVCQNAWGRDVTVRLEMSTKMVGWGRLARELTTLEAASWRKFTVGGRVEPSRCNFSACAVGNRLVLFGGEGVNMQPMDDTFVLNLEAATPEWRRVKVSASPPGRWGHTLSWLNGSWLVVFGGCGQQGLLNDVFVLDLDAQQPTWREVASEGPPLPRSWHSSCTLDGSKLVVSGGCAESGVLLSDTFLLDLTKEKPAWREIPTSWSPPSRLGHTTSVYGATKLFMFGGLAKSGSLRLRSSDAYTVDVSEDSPQWRQLATTTGFPNVSPPPRLDHVAVSLPCGRIIIFGGSIAGLHSPAQLFLIDPAEEKPIWRILNVPGQPPKFAWGHSTCVVGGTRVLVLGGHTGEEWILNELHELCLASRPDEDG

SEQ ID NO: 6178 - protein, 605 aa, Zea mays
MRLWEEEDEEGMEVDGEAEDEPGWPCGAPEAGLGETRPAAILVADAAEVDFPVIYVNAAFEAATGYRAHEVLGRNCRFLQFRDPHAQRRHPLVDPMVVSEIRRCLSEGIEFQGELLNFRKDGAPLHNRLRLVPMHGDDGYVTHVIGIQLFSEANIDLSSVSYPVYKQKSSSRPSIQDLNSSPHEHAPKIQSADHCGMLQLSDEVLAHNILSRLSPRDVASIGSVCTRMHELTKNDHLRKMVCQNAWGRDVTVRLEMSTKMVGWGRLARELTTLEAASWRKFTVGGRVEPSRCNFSACAVGNRLVLFGGEGVNMQPMDDTFVLNLEAATPEWRRVKVSASPPGRWGHTLSWLNGSWLVVFGGCGQQGLLNDVFVLDLDAQQPTWREVASEGPPLPRSWHSSCTLDGSKLVVSGGCAESGVLLSDTFLLDLTKEKPAWREIPTSWSPPSRLGHTTSVYGATKLFMFGGLAKSGSLRLRSSDAYTVDVSEDSPQWRQLATTTGFPNISPPPRLDHVAVSLPCGRIIIFGGSIAGLHSPAQLFLIDPAEEKPIWRILNVPGQPPKFAWGHSTCVVGGTRVLVLGGHTGEEWILNELHELCLASRPDEDG

SEQ ID NO: 6179 - protein, 129 aa, Zea mays
MSSPREENVYLAKLAEQAERYEEMVEFMEKVAKTVDSEELTVEERNLLSVAYKNVIGARRASWRIISSIEQKEESRGNEDHVAIIKDYRGKIETELSKICDGILNLLDSHLVPAASLAESKVFYLKMKG

SEQ ID NO: 6180 - protein, 193 aa, Zea mays
MSPPISLCVFVLLSSLLAAARAEDPYRFYTWNVTFGDIYPLGVKQQGILINGQFPGPQIDAVTNDNIVINVFNNLPAPFLLSWQGIQQRRSSWQDGVYGTNCPIPPGGNFTYNMQFKDQIGSYYYFPSLAFHKAAGGYGGIRVLSRPRIPVPFDPPAGDFTILAGDWFKLNHTDLKGILDSGNDLPFPDGLLI

SEQ ID NO: 6181 - protein, 198 aa, Zea mays
MAANKGMVAGSHNRNEFVMIRHDGDAPVPAKPTKSANGQVCQICGDTVGVSATGDVFVACNECAFPVCRPCYEYERKEGNQCCPQCKTRYKRQKGSPRVHGDDEEEDVDDLDNEFNYKQGNGKGPEWQLQGDDADLSSSARHDPFLKGLMGRQNRTPTIVIVWSILLASIFSLLWVKIDPFISPTQKTAALGQCGVNC

SEQ ID NO: 6182 - protein, 300 aa, Zea mays
MAAAIDLSGEELMRALEPFIRDASAHGSSPLLHPHQPLSPSSPFSFHQAVAVAAASSYGGNYPFAAPDEAGQLSPSQMQYIQARLHLQRRQAQTSVLGPRAQPMKASASAAPAPARPQKLYRGVRQRHWGKWVAEIRLPRNRTRLWLGTFDTAEEAALAYDQAAYRLRGDAARLNFPDNAASRGPLHASVDAKLQSLCQSIAASKKGAKKPASAAAAASSSAPTSNCSSPSSDDATSSCLESATESSCPSRSPSPSASPGPTVPEMQQLDFSEAPWDEAAGFALTKYPSYEIDWDSLLAN

SEQ ID NO: 6183 - protein, 435 aa, Zea mays
MEMKLTIRRVPTVVSNYQEDADKPRAGCGRNCLGDCCLPASKLPLYAFKLTPAKGSQEDAASTKLLVDILLSEWEDRMTRGLFRYDVTACETKVIPGNLGFVAQLNEGRHLKKRPTEFRVDRVLQPFDPAKFNFTKVGQEEVLFQFENSGGDDSYFLNNAPIIAVDRAPNVIAINVSPIEYGHVLLIPRVLDRLPQRIDPESFLLALQMAAEGGSPYFRLGYNSLGAFATINHLHFQAYYLSVPFPVEKAATHKIPLSEDTKKNGVTVSKLINYPVRGLVFEGGNTLDDLATVVSNACIWLQDNNVPYNVLISDCGKRVFLFPQCYAEKQALGEVSQELLDTQVNPAVWEISGHMVLKRRMDYEEASETSAWKLLAEVSLSEERFEEVKAYIFSAAGLVQYDEEEEEASDGEGPTAYVPVKVTPLPVAEGCLVLP

SEQ ID NO: 6184 - protein, 506 aa, Zea mays
  unsure (1)..(506): unsure at all Xaa locations
MASPAMVPLRQLFVDGEWRPPAQGRRLPVVNPTTEAHIGEIPAGTAEDVDAAVAAARAALKRNRGRDWARAPGAVRAKYLRAIAAKVIERKPGLAKLEALDCGKPYDEAPWDSDDVAGCFECFAHPLSSNIVTGLGPDACAPLSSHANSDKVYFXLVGLIPVRNYPXLMATWXKPAPALAAGKRAMLVFDDXAIDKAVEWTSVWVLLGLSSGVLDNDPVLGPDAGAPLSAHPDVDKVAFTGSFETGKKIMASAAPMVKPVTLELGGKSPIVVFDDVDIDKAVEWTLFGCFWTNGQICSATSRLLIHTKIAKKFNERMVAWAKNIKVSDPLEEGCRLGPVVSEGQYEKIKKFISNAKSQGATILTGGVRPAHLEKGFFIEPTIITDITTSMEIWREEVFGPVLCVKEFSTEDEAIELANDTQYGLAGAVISGDRERCQRLSEEIDAGCIWVNCSQPCFCQAPWGGNKRSGFGRELGEGGIDNYLSVKQVTEYISDEPWGWYQSPSKL

SEQ ID NO: 6185 - protein, 153 aa, Zea mays; identical to SEQ ID NO: 899

SEQ ID NO: 6186 - protein, 397 aa, Zea mays
  unsure (1)..(397): unsure at all Xaa locations
AASKLPLYAFKLTPAKGSQEDAASTKLLVDILLSEWEDRMTRGLFRYDVTACETKVIPGNLGFVAQLNEGRHLKKRPTEFRVDRVLQPFDPAKFNFTKVGQEXVLFQFENSGGDDSYFLNNAPIIAVDRAPNVIAINVSPIEYGHVLLIPRVLDRLPQRIDPESFLLALQMAAEGGSPYFRLGYNSLGAFATINHLHFQAYYLSVPFPVEKAATHKIPLSEDTKKNGVTVSKLINYPVRGLVFEGGNTLDDLATVVSNACIWLQDNNVPYNVLISDCGKRVFLFPQCYAEKQALGEVSQELLDTQVNPAVWEISGHMVLKRRMDYEEASETSAWKLLAEVSLSEERFEEVKAYIFSAAGLVQYDEEEEEASDGEGPTAYVPVKVTPLPVAEGCLVLP

SEQ ID NO: 6187 - protein, 363 aa, Zea mays
MAAKGLREVGRRRASEVGRRCLSGGSAGPPAPAAKRKEGGKAVNLFTAVNQALHIALDTDPRAYVFGEDVGFGGVFRCTTGLADRFGKSRVFNTPLCEQGIAGFAIGLAAMGNRAIAEIQFADYIFPAFDQIVNEAAKFRYRSGNEFNCGGLTIRTPYGAVGHGGHYHSQSPEAFFCHVPGLKVVIPRSPREAKGLLLASIRDPNPVVFFEPKWLYRLAVEEVPEEDYMLPLSEAEVIREGSDITLVGWGAQLAVLKEACEDAAKDGVSCELIDLKTLVPWDKETVEASVKKTGKLLVSHEAPVTGGFGAEIAASIAERCFQRLEAPVARVCGLDTPFPLVYEPFYMPTKNKVLDAIKATVDF

SEQ ID NO: 6188 - protein, 181 aa, Zea mays
  unsure (1)..(181): unsure at all Xaa locations
MADQANQPTVLHKLGGQFHLRSIISEGVRARNICPSVSSYERRFATRNYMTQSLLGPSMSVSGGINVPVMRTPLCANAPAEKGGKNFMIDFMMGGVSAAVSKTAAAPIERVKLLIQNQDEMIKSGRLSEPYKGIVDCFKRTIXKDEGFSSLWRGNTANVIRYFPTQALTFAFKDYFQRLFN

SEQ ID NO: 6189 - protein, 107 aa, Zea mays
  unsure (1)..(107): unsure at all Xaa locations
SXXGHKXXRSXXAXXXPETRXEHXKAXXSXXEXXAXRGATXXGSRRGXAXXXXXDTXNRKGXRGXQKEXQKGXRNAHHXKXRXKEAGXGAXPNEXXSTGXXERPKGE

SEQ ID NO: 6190 - protein, 334 aa, Zea mays
  unsure (1)..(334): unsure at all Xaa locations
MSKARVYTDVNVLRPKEYWDYEALTVQWGEQDNYEVVRKVGRGKYSEVFEGINVNNNEKCIIKILKPVXKKKKIKREIKILQNLYGGPNIVKLLDIVRDQHSKTPSLIFEYVNNTDFKVLYPTLTDYDIRYYIYELLKALDYCHSQGIMHRDVKPHNVMIDHELRKLRLIDWGLAEFYHPGKEYNVRVASRYFKGPELLVDLQDYDYSLDMWSLGCMFAGMIFRKEPFFYGHDNHDQLVKIAKVLGTDGLNVYLNKYRIELDPQLEALVXGRHSRKPWTKFINADNQHLVSHEAIDFLDKLLRYDHQDRLTAREAMTHPYFQQVRAAENSRTRA

SEQ ID NO: 6191 - protein, 403 aa, Zea mays
  unsure (1)..(403): unsure at all Xaa locations
MAAAHYGNGSSTSGGGGGRGRGKPITCKAAVAWGPGVPLSLEEVEVAPPGPMEVRVKVLFTSICHTDLSAWKGECEAQRKYPRILGHEAAGVVESVGEGVEGLAPGDHVVPIFTGECEKCVYCKSDKTNLCGTYRVDPLKSSMVYDDGTRFSXWTSRQATGRPVYHFLNTSTFTEYTVLDAACAVKINPEAPLXRMCLLSCGISTGVGAAWNTANVSARSTVAVFGLGAVGLAVAEGARLRGATRIIGVDVNPSKFTKGKEMGITDFIDPNDICDKPVHEVIREMTDGGVDYSFECTGINDVLREAFLSTHDGWGLTVVLGIHSTPKMVPLHPMELYSRRITGCVFGDFKGKSQLPDLVDKCVNGEVNINFDGFITHKMPFSYINKAFRLLEEGKSLRCLLSL

SEQ ID NO: 6192 - protein, 497 aa, Zea mays
  unsure (1)..(497): unsure at all Xaa locations
MVLSHGVGGSDESVHSTFASRYVRTSLPRYRMPEQSIPKEAAYQIINDELMLDGNPRLNLASFVTTWMEPECDKLIQASVNRNXVDMDEYPVTTELQNRCVNMIAHLFNAXPLGDAETAVGVGTVGSSEAIMLAGLAFKRRWQNKMKAAXKPCDKPNIVTGANVQVCXWEKFARYFEVELKEVKLSDGYYVMDPQKAVXDMVDENTICVAAIXLGSTLNGEFEDVKLLNDLLTKKNAETGWDTPIHVDAASGGVIAPFLYPELEWDFRLPLVKSINVSGHKYGLVYAGIGWCIWRTKADLPEELIFHINYLGADQPTFTLNFSKGSSQVIAQYYQLIRLGFEGYKNIMENCQENAMVLKQGLEKTGKFNIVSKDNGVPLVAFSLKDSSRHNEFEISDFLRRFGWIVPAYTMPPDAQHVTVLRVVIREDFSRTLAERLVLDIEKVLHELDALPARVPSGDLAALAAAESSEREMEKQRQVISLWKRAVLAKKKTNGVC

SEQ ID NO: 6193 - protein, 204 aa, Zea mays
  unsure (1)..(204): unsure at all Xaa locations
ELPAVAAALELWIPRAAGIRHQERERERESSLVPPPPPFMGTSTFSQYTVVHDVSVAKIDPTAPLDKVCLLGCGVPTGLGAVWNTAKVEPGSNVAIFGLGTVGLAVAEGAKTAGASRIIGIDIDSKKYETAKKFGVNEFVNPKDHDKPIQEVIVDLTDGGVDYSFECIGNVSVMRAALECCHKGWGTXSVIXGVXAASGXEXST

SEQ ID NO: 6194 - protein, 108 aa, Zea mays
  unsure (1)..(108): unsure at all Xaa locations
MGVFNATWGSSMGLTMDTTYAGREYKVKDLYQTDLVLLEIDLAKVQMPGHMVXLATFCPSKPFPVTRIWGSLHMTIQTAFLIKTLTELGAEVHWCSCNMLFTQEHAVG

SEQ ID NO: 6195 - protein, 88 aa, Zea mays
MSYYGQQPPVGVPPQQGYPGKDGYPPAGYPPAGYPPPAQGYPQQGYPQQGYPPQYAQPPPQQQQSSGPSFMEGCLAALCCCCLLDACF

SEQ ID NO: 6196 - protein, 76 aa, Zea mays
MSYYGQQPPVGVPPQQGYPGKDGYPPQGYPQQGYPQQGYPPQYAQPPPQQQQSSGPSFMEGCLAALCCCCLLDACF

SEQ ID NO: 6197 - protein, 102 aa, Zea mays
GCVLLGGEGKRRRGAMEAEKKAPAVSDVGAWAMNVVSSVSLIMANKQLMSSSGYAFAFATTLTGFHFTVTALVGWISNATGYSVSKHVPLWELVWYVHPALL

SEQ ID NO: 6198 - protein, 157 aa, Zea mays
  unsure (1)..(157): unsure at all Xaa locations
MEPAEKKPPAVSDLGAWGMNVVSSVGLIMANKQLMSSAGYAFSFATTLTGFHFTVTALVGWISKATGYSASKHVPLWELVWFSLVANASITGMNLSLMLNSVGFYQISKLSMIPVVCLMEWVLNSKHYTTKVISAVVVVAAGVGICTXVTDVEVNAK

SEQ ID NO: 6199 - protein, 424 aa, Zea mays
  unsure (1)..(424): unsure at all Xaa locations
TPSIDIQTLALFKRVCVCLSLASAHPHLHQRPGGTSTAEANRDGRRPAAAHPTPRLLLLLLPGSREAVCCWEAAPAPAPSEAEKKPPAVSGVGPWAMNAAPCLSLILVPRQLMSSSGYAAASATTLTGCHFTVRAFVAWTSDATSYSASKDVSLWELVWXSLVAHTCISGHEPQLHVHLHSDRCQIFQRHMTPAVRLMXWVLTSKHSPTSAKTSVTREAASAXTCNSAAESAKAQKLSCACVAVSCTSLQQITIGSFQKKYNIGSFELLSKTAPIQALSLIILGPFVDYYLNGRSLLNYPFSGGATFFILLSCSLAVFCNMSQYLCIGRFSATSFQVLGHMKTVCVLILGWILFDSALTVKNILGMLLAVMGMVVYSWAVEAEKKAAAPIPRNKGGMLDGEDVPLKARVSGVPAVDLEDGDVKG

SEQ ID NO: 6200 - protein, 344 aa, Zea mays
MEAEKKAPAVSDVGAWAMNVVSSVSLIMANKQLMSSSGYAFAFATTLTGFHFTVTALVGWISNATGYSVSKHVPLWELVWFSLVANTSITGMNLSLMLNSVGFYQISKLSMIPVVCLMEWVLNSKHYTTKVISAVVVVAAGVGICTVTDVEVNAKGFICACVAVFCTSLQQITIGSFQKKYNIGSFELLSKTAPIQAISLIILGPFVDYYLNGRSLLNYPFSGGATFFILLSCSLAVFCNMSQYLCIGRFSATSFQVLGHMKTVCVLILGWILFDSALTVKNILGMLLAVMGMVVYSWAVEAEKKAAAPVPRIKSEMLDGEDVPLKARVSGVPAVDLEDGEMKS

SEQ ID NO: 6201 - protein, 390 aa, Zea mays
MSVLTCVIESMGSSCSRSHSFDEAEAAENAKSADIDRRILQETKAEQHIHKLLLLGAGESGKSTIFKQIKLLFQTGFDEAELRSYTSVIHANVYQTIKILYEGAKELAQVEPDSSKYVLSPDNQEIGEKLSEIGARLEYPSLNKERVQDVRKLWQDPAIQETYSRGSILQVPDCAQYFMENLDRLSEEDYVPTKEDVLHARVRTNGVVETQFSPLGESKRGGEVYRLYDVGGQRNERRKWIHLFEGVNAVIFCAAISEYDQMLFEDETKNRMMETKELFDWVLKQRCFEKTSFMLFLNKFDIFERKIQKVPLSVCEWFKDYQPTAPGKQEVEHAYEFVKKKFEELYFQSSKPDRVDRVFKIYRTTALDQKLVKKTFKLIDESMRRSREGT

SEQ ID NO: 6202 - protein, 617 aa, Zea mays
EQINVTYKIMRRIEAEEWSLDASEIVIASTRQEIEEQWNLYDGFEVMLARKLRALVKRGANCYGRYMPRMVIIPPGVEFGQLIHDFDMYGDEDNQSPASDPSIWFEIMRFFTNPRKPMILAIARPYSEKNIATLVKAFGECHPLRELANLTLIMGNREAISKMNKISAAVLTSVLTLIDEYDLYGQVAYPKLHKHSEVPDIYRLAARTKGAFVNVAYFEQFGVTLIEAAMHGLPVIATKNGAPVEIYQVLENGLLVDPHDQHAIADALYKMLSEKQFWSRCRENGLKNIHQFSWPEHCKNYLSRISSLGPRHPAFACKEDHKVPVKCRKHISIIAVDSVNKEDLIQIIRNSVEATRTGTMSGSTGFVLSTSLTIAELQSVIVRTGMLPTDFDAFICNSGSDIYYPLQSSDVPSNSRVTFALDHNYRSHIEYRWGGEGLRKYLVKWASSVVERRGRTEKQVIFEDSEHSSTYCLAFRVVNPNHLPPLKELQKLMRIQSLRCHALYNHGATRLSVIPMHASRSQALRYLSIRWGIELPNAVVIVGETGDSDYEELFGGLHKTVILKGGFNTPANRIHTVRRYPLQDVVALDSSNIIGIEGFSTGDIRSAMQQQLGIPTQ

SEQ ID NO: 6203 - protein, 134 aa, Zea mays
CRPGVPAQATQGDAIRNYYHDNHVIQDMLVPLYKVGDALEFVHHEMEVYPLWLCPHRLFKLPVKTMIYPEPGFEHQQRQGDTSYAQMFTDVGVYYTPACIFRGEEFDGAESVKRLEQWLIENHSYQPQYAVTEL

SEQ ID NO: 6204 - protein, 299 aa, Zea mays
HASDVIPIFNGECGACAYCESDRTNLCGTYRVDASKSTMVSDGGTRFSVADRVSGRTVPVYHFLNTSTFAEYTVLDAACAVKVNPEAPLQKMCLLSCGISTGVGAVWNTANVSAGSTVAIFGLGAVGLAVAEGARLRGAARIIGVDINPEKFTKGREMGVTDFVDSRASDKPVHEVIREMTHGGVDYSFECTGINGVLREAFVSTHDGWGLTVVLGIHATPKMLPLHPMELFDGRRITACVFGDVKGKSQLPAIVDKCVNGDLDINLDGFITHRMPFSDINKAIQLLEEGKSLRCVLNL

SEQ ID NO: 6205 - protein, 580 aa, Zea mays
MGEVEDMYTQDGTVDMKGNPAVKKGTGNWRACPYILANECCERLAYYGMSTNLVNYMKTRLGQVNSVASNNVTNWQGTCYITPLIGAFFADAYMGRFWTIAIFMIIYIFGLALLTMASSVKGLVPTSCGDKDVCHPTDAQAAVVFVALYLIALGTGGIKPCVSSFGADQFDENDEREKKSKSSFFNWFYFSINIGALVASTVLVYVQTHVGWGWGFGIPAVVMAIAVGSFFVGTPLYRHQKPGGSPLTRIAQVLVACARKWNVAVPADKSRLHETVDGESGIEGSRKLEHSEQLACLDRAAVVTAEDGAEASPWRLCSVTQVEELKSVIRLLPIWASGIVFAAVYSQMSTMFVLQGNTLDQSMGPRFKIPSATLSMVDTISVIVWVPVYDRAIVPLVRSYTGRPRGFTQLQRMGIGLVVSSFSMVAAGVLDIVRLRAIARHGLYGENDIVPISIFWQIPQYFIIGCAEVFTFVGQLEFFYDQAPDAMRSMCSALSLTTVALGNYLSTVLVTIVTHITTRHGRIGWIPENLNRGHLDYFFWLLAVLSLLNFLAYLVIASWYKYKKTADDYPGAKGEHGTEH

SEQ ID NO: 6206 - protein, 416 aa, Zea mays; identical to SEQ ID NO: 1201

SEQ ID NO: 6207 - protein, 237 aa, Zea mays
  unsure (1)..(237): unsure at all Xaa locations
MNMNYGSMGPGAMVRCRQCSSSITAMPGARAVQCMQCSCVTRVSGRGRQQHGYGQGYGNGGGMLMPPMRPTPAFGGGRGKKRAVLIGIKYTNRRSCELRGPINDVKCMRYLLTERFGFPNDCVLILTDEERNPCRQPTKDNIRMAMHWLVQGCSYGDSLVFQFSGLGAQVPDDDGDELDGMDEALCPVDSFQQGPILDDEINEAIVRPLVHGVKLHAIVDACHSATVLDLPYXMHVS

SEQ ID NO: 6208 - protein, 166 aa, Zea mays
MAALATATAVHGSQAAGALAVAAQRLLVLLALAMEAVNNGADIFTEDQQEIIKQFGRIKSETVPENKDAGSDDDDDDDEDEDDETGDADDDDADAGEDFSGEEGEDDDEDDDPEANGDDAGAGSDDDDGDDDDDDGEDGEDDDDDDEDEDEEDEEDEDQPPAKKKK

SEQ ID NO: 6209 - protein, 201 aa, Zea mays
FDADAIPTNEAMKKQIAVASKAMPFYCALPTLSEYMIESGWTRCYFNISEMGFSAYLCYMAMYLIFVEFGIYWMHRELHDIKPLYKHLHATHHIYNKENTLSPFAGLAFHPLDGILQAIPHVLALFLLPTHFRTHIALVFLEGVWTTNIHDCIHGKVWPVMGAGYHTIHHTTYRHNYGHYTVWMDWMFGTLREPDDILKKA

SEQ ID NO: 6210 - protein, 72 aa, Zea mays
FGSAVSYGVYFYNATRGSLTTLSSLTFLTPMFASVFGYLYLGETFSTVQIGGALLTLVAIYMVNYKSIIGEK

SEQ ID NO: 6211 - protein, 143 aa, Zea mays
  unsure (1)..(143): unsure at all Xaa locations
QHMIIGGLPLLVISVLNHDPALSGHIQDLTWSDILALGYTSIFGSAVSYGVYFYNATRGMIVSFPMLYFHDSLLLSGHITTSLSFLGXSLTTLSSLTFLTPMFASVFGYLYLGETFSTVQIGGALLTLVAIYMVNYKSIIGEK

SEQ ID NO: 6212 - protein, 133 aa, Zea mays
TYEAMKKQIAEGSKAMPFYCALPTLSEYMNESGWTRSNCKRTKMEFSAYLCYMAMYHILVEMGIDWDARALIDIKPLYKHWHAFDDNSVNQNTSSPQAELDSQRMDGILQAIPHVLALFCFGTRFRTHIALAC

SEQ ID NO: 6213 - protein, 164 aa, Zea mays
DTRSKLTRVCTKIDPSDTTLAVKDGYQWRKYGQKVTRDNPSPRAYFRCAYAPSCPVKKKVQRSAEDSAVLVATYEGEHNHPSPTRAGELPSSTSINSSGPAITLDLTRNGAGAVRGLEAAAAEVPGLKRLCQEIASPDFRTALVEQMARSLTKDPKFTDALAAA

SEQ ID NO: 6214 - protein, 333 aa, Zea mays
KLRKFLHLSTDRVLDLILSTSTTLTSWHLLVTFCSLHVALWMKFFEHKPFDSRTVMGFGVLNGISIGLLNLSLGFNSVGFYQMTKLAIIPCTVILETLFFRKKFSRSIQMSLSVLLLGVGVATVTDLQLNAVGSILSLLAIITTCIAQIMTNTIQKKFKVSSTQLLYQSCPYQSLTLFLIGPFLDGFLTNQNVFAFNYTSQVVFFIVLSCLISVSVNFSTFLVIGKTSPVTYQVLGHLKTCLVLAFGYVLLHDPFSWRNILGILIAVVGMVLYSYFCTVETQQKNVEVSPQQVKESEAGPLIADSMSKVENGGGVVDDEPLKVPMWSSKYSRE

SEQ ID NO: 6215 - protein, 518 aa, Zea mays
MASADLAEAMEPGKKSNVKYASVCAIMASMACVILGYDIGVMSGAAIYIKKDLKITDVQLEILIGIISLYSLIGSFAGARTSDRIGRRLTVVFAAVIFFVGALLMGFSVNYGMLMVGRFVAGVGVGYGGMIAPVYTAEISPAASRGFLTSFPEVFINLGILLGYLSNYAFAGLPLHLGWRVMLGIGAAPSALLALLVLWMPESPRWLVMKGRLADARAVLEKTSASPEEAAERLADIKVAAGIPKGLDGDVVAVPKERSGGEMQVWRELILSPTPAIRRILLSAVGLHFFQQASGSDSVVLYSPSVFKSAGITDDNKLLDLGVTCAVGVAKTLFIPVATFLLDRAGRRPLLLTSTGGMIVSLVGLGTGLTVVGHHPDAKIPSAVALCIASTLAYVAFFSIGLGPVTGVYNSEIFPLQVRALGFAVGVACNRVTSAVISMTFLSLSKGITIGGSFFLYSGIAAVGWVFFFTCLPETRGRTLEEMGKLFGMPEPDTDMAEAYNAAAKEKAVEMPAVLGND

SEQ ID NO: 6216 - protein, 192 aa, Zea mays
  unsure (1)..(192): unsure at all Xaa locations
HAGGPAEKGGRNFMIDFMMGGVSXAVSKTAAAPIERVKLLIQNQDEMINSGGGSEPYXGIVDCFKRTIKDEGVSSLWRGNTANVIRYFPTQALNFAFKDYFKRGCNFKKIXGWYWKWVAGNLGSGGAAGASSLCFVCSLGYARTRWGNDAXAAQGXGERXFNGLVXVYRETLKADGIAXLYRGFNISCVGII

SEQ ID NO: 6217 - protein, 132 aa, Zea mays
MALEKAKEIIASSPVDLALRKAKETVASHPVVVFSKTYCPFCTRVKQLLAKLGASYKAIELDVESDGAELQSALAEWTGQRTVPNVFVKGERIGGCDATMAMHDGGKLVPLLTEAGAIVTARATATTTTPSL

SEQ ID NO: 6218 - protein, 142 aa, Zea mays
GRDRLDTSARGAHGSREGPGASSPVDLALRKVKETVASHPVVVFSKTYCPFCTRVKQLLAKLGASYKAIELDVESDGAELQSALAEWTGQRTVPNVFVKGERIGGCDATMAMHDGGKLVPLLTEAGAIVTARATATTTTPSL

SEQ ID NO: 6219 - protein, 126 aa, Zea mays
  unsure (1)..(126): unsure at all Xaa locations
MALSVEKTSAERGYKVKDLSQADFGRLEIELAEVEMPGLMACRAEFGPPNPFAGARISRSLHMTIQTAVLIESLTALGGEGRXDPVYFFSTQDHAXGAIARDSAAMFDWNDHTLXQYWGRTERYLD

SEQ ID NO: 6220 - protein, 383 aa, Zea mays
MIGFPPWNCLPTGIAKIAAAAAVVVAALASSGIALPRPRAAPPPSGFGLLMSKAKVYTDVNVLRPKEYWDYEALTVQWGEQDDYEVVRKVGRGKYSEVFEGINVNNNEKCIIKILKPVKKKKIKREIKILQNLCGGPNIVKLLDIVRDQHSKTPSLIFEFVNNTDFKVLYPTLTDYDIRYYIYELLKALDYCHSQGIMHRDVKPHNVMIDHELRKLRLIDWGLAEFYHPGKEYNVRVASRYFKGPELLVDLQDYDYSLDMWSLGCMFAGMIFRKEPFFYGHDNHDQLVKIAKVLGTDGLNSYLNKYHIELDPQLEALVGRHSRKPWLKFMNGDNQHLVSPEAIDFLDKLLRYDHQDRLTAREAMAHPYFLQVRAVENSRTRAQ

SEQ ID NO: 6221 - protein, 373 aa, Zea mays
MTKNSNHDENEFISFEPNQNTKIRFEDADEDEVAEGSGVAGEETPQDESMFDAGESADTAEVTDDTTSADYYFDSYSHFGIHEEMLKDVVRTKTYQNVIYQNKFLIKDKIVLDVGAGTGILSLFCAKAGAAHVYAVECSQMADMAKEIVKANGFSDVITVLKGKIEEIELPTPKVDVIISEWMGYFLLFENMLDSVLYARDKWLVEGGVVLPDKASLHLTAIEDSEYKEDKIEFWNSVYGFDMSCIKKKAMMEPLVDTVDQNQIVTDSRLLKTMDISKMSSGDASFTAPFKLVAQRNDYIHALVAYFDVSFTMCHKLLGFSTGPKSRATHWKQTVLYLEDVLTICEGETITGTMSVSPNKKNPRGGARYPIRP

SEQ ID NO: 6222 - protein, 71 aa, Zea mays
ILCRFRFVEKCKYPEDGSPPRSLRYIGSMVADVHRTLLYGGIFLYPADQKSPNGKLRVLYEVFPMSFLMEQ

SEQ ID NO: 6223 - protein, 177 aa, Zea mays
GPSRPAGKEEKNGLALGNIVALPLSNLKPSLKLSSSSSSCCITKLFPISRINVSPTSVLVRASSSSSFGSRLEDTIKKTVAENPVVVYSKTWCTYSSEVKILFKKLGVDPLVFELDEMGPQGPQLQKVLERITGQHTVPNVFIGGKHIGGCTDTLKLYRKGELEPLLSEANAKKTES

SEQ ID NO: 6224 - protein, 58 aa, Zea mays
MAREENVYMAKLAERAERYDEMVEYTEKVAKTVDVEELTVEEPNLLSVAYNNVIAARR

SEQ ID NO: 6225 - protein, 132 aa, Zea mays
  unsure (1)..(132): unsure at all Xaa locations
MSEEKHHHFFNHHKKDEEQPAGEYGYSETEVVTATGEGEYERYKKEEKEHKHKQHLGEAGAIAAGAFALYEKHEAKKDPRXTAPRHKIPEEVAAAAAVGAGGXVFPEPPEKKKAPKAAEEASGEKKPPPLFG

SEQ ID NO: 6226 - protein, 117 aa, Zea mays
MSEEKHHHFFNHHKKDEEQPAGEYGYSETEVVTATGEGEYERYKKEEKEHKHKQHLGEAGAIAAGAFALYEKHEAKKDPEHAHRHKITEEVAAAAAVGAGGYVFHEHHEKKHHHLFG

SEQ ID NO: 6227 - protein, 379 aa, Zea mays
MATAGKVIKCKAAVAWEAGKPLSIEEVEVAPPQAMEVRVKILFTSLCHTDVYFWEAKGQTPVFPRIFGHEAGGIIESVGEGVTDVAPGDHVLPVFTGECKECAHCKSAESNMCDLLRINTDRGVMIGDGKSRFSINGKPIYHFVGTSTFSEYTVMHVGCVAKINPQAPLDKVCVLSCGISTGLGASINVAKPPKGSTVAVFGLGAVGLAAAEGARIAGASRIIGVDLNPSRFEEARKFGCTEFVNPKDHNKPVQEVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFAEINKAFNLMAKGEGIRCIIRMEN

SEQ ID NO: 6228 - protein, 248 aa, Zea mays
MEEREKLVCLAKLAEQAERYDDMVEFMKNLARMDVDMSAEERHLFSVGFKNTIGAKRASWRIICSHEQKVAADRQTGVMIDAYKKKVEEELRKVCNEVLSVIAIHCLPLASTGENIVFFYKMKGDYYRYLAEFSTGTEKKAASDQSLMAYQHAMVVASSELSPAHQIRLGLALNLSVFFYEIMNSHERACQVAKQAFGEALTEINSGEGVYKDSTLMMQLLKDNLALWTSELTGGEASKGSDDVDMEG

SEQ ID NO: 6229 - protein, 277 aa, Zea mays
KKSKTPQEFFADFMMGGVSAAVAKTAAAPIERIKLLVQNQGEMLKSGRLATPYKGIADCATRTYADEGLVAFWRGNTANVIRYFPTQALNFAFKDYYKSLFSYSQAKDGYALWMAGNLASGGAAGATSLLFVYSLDYARTRLAADNKGAAKGGVAGERQFNGLLDVYKKTLATDGIAGLYRGFLPSVVGIVVYRGLYFGMYDSLKPVVMQGSLQGSFLASFLLGWGVTTGAGIASYPLDTIRRRMMMTSGEKVHYNGMLDAGRQSSRARVSLPSQGS

SEQ ID NO: 6230 - protein, 354 aa, Zea mays
MERGDGGSGRPPAERKAAWRDGAVTYFHLLFYIAISGGQIFFNKWVLSSKEINFPYPVALTLLHMVFSSVVCFAITKVFKIIKIEEGMTTDIYITSVIPIGGMFAMTLWLGNSAYLYISVAFAQMLKAIMPVAVFLLGAAFGLEEMSYKMLSIMSVISVGVIVASVGEITISWVGVVYQMGGVVAEALRLIFIEIFLKKKGVKLNLISMMYYVSPCSAVCLFIPWLFLEKPKMDDSISWNFPPFTLFLNCLCTFVLNMSVFLVISRTSALTARVTGVVRDWSVVLLSAAIFADTQLTFINIIGYAIAIAGVVAYNNHKLKVKPQANPQQGDENKVISGSTQDVVLSVSSAKETS

SEQ ID NO: 6231 - protein, 354 aa, Zea mays; identical to SEQ ID NO: 6230

SEQ ID NO: 6232 - protein, 221 aa, Zea mays
  unsure (1)..(221): unsure at all Xaa locations
MSSTAGKVIKCRAAVAWEPEKPLSIEEIEVAPPQKDEVRLKILYTFFCRTDVYWWDVKGQAPLFPRILGHEGSGIVESVGEGVTNLKPGDHVLPIFTGECGECAHCKSEESNLCELLRINTDRGVMLSDGKTRFSKNGKPIYHFVGTSTFSEYTVCHIGCVAKINPAAPLDKVCVVSCGFCTGFGATVNVAKPKPNSTVAVFGLGAVGLSAXEGARVSGAS

SEQ ID NO: 6233 - protein, 202 aa, Zea mays
  unsure (1)..(202): unsure at all Xaa locations
MDPNTRHRLTHDDSPVINEGLQPTKTSRRTHLLRKLMLIFNKFPNHAPSFNHKPNPVXELKLVRXTYYDHAVAFSGKLHHPDRPXQDFCHLKPYHLHTXGIIPPSPEEHPILELKLLRLVNQTRIPEVHNDLEILPGKGLQHPYNKDAVQLEQSLIXGGYDRESSARQDVTHESYGYLMDLLAKTAKDEIAGCTQQGYDSLS

SEQ ID NO: 6234 - protein, 132 aa, Zea mays
KVLDGFAEILLPASTTLTSWHLLVTFCSLHVALWMKFFEHKPFDSRTVMGFGVLNGISIGLLNLSLGFNSVGFYQMTKLAIIPCTVILETLFFRKKFSRSIQMSLSVLLLGVGVATVTDLQLNAVGSILSLL

SEQ ID NO: 6235 - protein, 354 aa, Zea mays
MGVGGEKFQLGTVGALSLSVVSSVSIVICNKALMSSLGFNFATTLTSWHLLVTFCSLHVALWMKFFEHKPFDSRTVMGFGVLNGISIGLLNLSLGFNSVGFYQMTKLAIIPCTVILETLFFRKKFSRSIQMSLSVLLLGVGVATVTDLQLNAVGSILSLLAIITTCIAQIMTNTIQKKFKVSSTQLLYQSCPYQSLTLFLIGPFLDGFLTNQNVFAFNYTSQVVFFIVLSCLISVSVNFSTFLVIGKTSPVTYQVLGHLKTCLVLTFGYVLLHDPFSWRNILGILIAVVGMVLYSYFCTVETQHKNTEVSPQQVKESEAAPLISDSLSKVENGGGVVDDEPLKVPMWSSKYSRE

SEQ ID NO: 6236 - protein, 355 aa, Zea mays
  unsure (1)..(355): unsure at all Xaa locations
MGVGGEKFQLGTVGALSLSVVSSVSIVICNKALMSSLGFNFATTLTSWHLLVTFCSLHVALWMKFFEHKPFDSRTVMGFGVLNGISIGLLNLSLGFNSVGFYQMTKLAIIPCTVILETLFFRKKFSRSIQMSLSVLLLGXVGVATVTDLQLNAVGSILSLLAIITTCIAQIMTNTIQKKFKVSSTQLLYQSCPYQSLTLFLIGPFLDGFLTNQNVFAFNYTSQVVFFIVLSCLISVSVNFSTFLVIGKTSPVTYQVLGHLKTCLVLAFGYVLLHDPFSWRNILGILIAVVGMVLYSYFCTVETQQKNIEVSPQQVKESEAAPLISDSLSKVENGGGVVDDEPLKVPMWSSKYSRE

SEQ ID NO: 6237 - protein, 176 aa, Zea mays
MAAATAVGGHDRVEAAASSAGAVLAVAVASQRLIGLLALAVQTVNCVAEIYNEDQQEIYKLLYGRIKSENVPEIKAGSDDDDDDEDDEDEDEDDDDDDDDDDEGGDDDDEDDDDEEGGDEDDDPEANGEGGSDDDDDDNDGDDDGNDDDDDEDDDEDEDEEDDDDEEEQPPSKKKK

SEQ ID NO: 6238 - protein, 388 aa, Zea mays
MLPSHLNGHSALGRRRPRLSAAAGESPAAAGVEAAAPLEEHDRIYFQAYSHLGIHETMIKDRVRTDAYHAAIMRHQKFIEGKVVLDVGCGTGILSVFCARAGAKRVYAVEACEIVVQAREIVKANNLTDQIVVIHGRVEDVDLEEKVDVIISEWMGYMLLYESMLPSVLFARDKWLKPGGLILPSHATLFMAPVTNRERYEDSVDFWRDVYGINMSALVPLAKKFTSEEPSIETIGGENVISWPSVFKRFDCYNFTAEEFKSITSKYKVSSMMLAPIHGFGFWFEVEFNEPIESSHNFPSSLDPLEIIQKKRRRSSEDYIVLSTAPEDEPTHWQQTILYFPDPIEVKQDQIIEGSVTVSQSEENPRFLNIHLECFTGGQTLVKDCAMR

SEQ ID NO: 6239 - protein, 203 aa, Zea mays
  unsure (1)..(203): unsure at all Xaa locations
FGSVLSLLXIVTTCIAQIMTNTIQKKFKVSSTQLLYQSCPYQALTLFIVGPFLDGFLTNKNVFAFAYTPQVLFFIVLSCLISVSVNFSTFLVIGKTSPVTYQVLGHLKTCLVLAFGYVLLHDPFSWRNILGILIAEVEMGLYSYFCTREAPKPTEASPQVTQVKEGESDPLIADSLNAAENGAAATTDEPLKVPMWSSKYARA

SEQ ID NO: 6240 - protein, 167 aa, Zea mays
PRVRTNRDSVMAMMEAFVHDPLINWRLFNFNEVPQVSNYGNVHAHTVVSSEEAVANRELMQPQRGARERELLQAVNQLGDANEVLNERAVAVMARMSDKLTGRDFSSGSALAGAGSSIQHGSEHLASGDARDAQPGLSVKVQVQKLILQATSHENLCQNYVGWCPFW

SEQ ID NO: 6241 - protein, 208 aa, Zea mays
MSREDNVYMAKLAEQAERYEEMVEYMEKVAKTVDVEELTVEERNLLSVAYKNVIGARRASWRIISSIEHKEESQSKVFYLKMKGDYHRYLAEFKTGAERKEAAESTMIAYKAAQDIALAELASTHPIRLGLALNFSVFYYEILNSPDKACNLARQAFDEAISQLDTLGEDSYKDSTLIMQLLRDNLTLWTADSTTEDGIEEGNEASKG

SEQ ID NO: 6242 - protein, 210 aa, Zea mays
MSREDNVYMAKLAEQAERYEEMVEYMEKVAKTVDVEELTVEERNLLSVAYKNVIGARRASWRIISSIEHKEESQSKVFYLKMKGDYHRYLAEFKTGAERKEAAESTMIAYKAAQDIALAELASTHPIRLGLALNFSVFYYEILNSPDKACNLAKQAFDEAISELDTLGEESYKDSTLIMQLLRDNLTLWTSDITEEGIEEGKEASKGDAE

SEQ ID NO: 6243 - protein, 443 aa, Zea mays
MAAPSGGGGGGAGEGSSSAAAAATIGVHGVDQVAEAMWQMNLEEAMELGPYPERVGEPDCSYYMRTGMCRFGMTCKFNHPADRKLAVAAARMKGEYPQRIGQPECQYYLKTGTCKFGATCKFHHPREKAAMATRVQLNELGYPLRLNEKECAYYLRTGQCKFGSTCKFHHPQPSTMMVAVRGSVYSPGQSATSPGHHAYQGAVTSWPLSRSASFIASPRWPGHSSYAQVIVPPGLVQVPGWSPYAAQIGSSSSDDQQRTPGAAQYYTGSRQSGTPGIGDRGMFSSYQAGSVPVGLYAVQTENVFPERPDQPECQFYMKTGDCKFGSVCKFHHPRERIIPTPNCALSPLGLPLRPGEPICSFYNRYGMCKFGPNCKFHHPMGNPMYGHASSPTSEAQTSRRMLAHVPSHPEVSPDSGSGRSRRIVHSDSQQIPSVERITEREAS

SEQ ID NO: 6244 - protein, 225 aa, Zea mays
MPYTTACLPAARRSRVVLGVNQLDRAMQPPTTAKRDRAAWEADAGAADTARLLMLLAQAQAQQQQRLLQHAYHHGVAPLFPAGRVFECKTCSRQFPTFQALGGHRASHKRPRALQQQQPVVVADDHDAGLCLGRQPPKPRRVHECPVCGLEFAIGQALGGHMRRHRADAEVRPPPDKARDVAGGICLDLNLTPSENCAKCRSVVVLGAAAGQGVHKALAMLDCSL

SEQ ID NO: 6245 - protein, 381 aa, Zea mays
MASSTQGQVITCKAAVAYEANKPLVVEDVQVAPPQAGEVRIKILSTALCHTDYYTWSGKDPEGLFPCILGHEAAGIVESVGEGVTDVQPGDHVIPCYQAECRDCKMCNSGKTNLCGKVRGATGVGVMMSDRKSRFSVNGKPIYHFMGTSTFSQYTVVHDVSVAKINPQAPLDKVCLLGCGVSTGLGAVWNTAKVEAGSIVAVFGLGTVGLAVAEGAKSAGASRIIGIDIDTKKFDVAKNFGVTEFVDPKEHDNPIQQVLVDLTDGGVDYSFECIGNVSVMRAALECCHKGWGTSVIVGVAASGQEIATRPFQLVTGRVWKGTAFGGFKSRTQVPWLVDKYMKKEIKVDEYITHNMNLADINDAFHLLHEGGCLRCVLAMQI

SEQ ID NO: 6246 - protein, 212 aa, Zea mays
  unsure (1)..(212): unsure at all Xaa locations
MSIRRGSASSGAMRSNSIAADADLARMGYKSELPRHLSMLSVLGLSFAIMAVPYGLSTTMYITLTDGQSVTILWGWVLISLISVSIAASLAEICAVYPTXAGGVYYWSAMMSTPEWAPIAXLGLXGWFNLVGNWTVTLSIXFGGAQLILSAYSLXWREDFAPTAWQKFSGFWAIMLVTFLIXXXFGSKYLDLXHSFAFMNLGASGVIILITL

SEQ ID NO: 6247 - protein, 76 aa, Zea mays; identical to SEQ ID NO: 5156

SEQ ID NO: 6248 - protein, 604 aa, Zea mays; identical to SEQ ID NO: 5821

SEQ ID NO: 6249 - protein, 251 aa, Zea mays
MAEDLVLDTAIRDWVLIPLSVVMVLIGVLRYFVSKLMRSPATSPSPDPKLVKEGQVVIRARNLRTNAQFIPAKAFKARKVYYTNEENGLLHVPKEDAQKAQAAMFSDPNMAMDMMKKNLSMIVPQTLTFAWVNFFFSGFVAAKIPFPLTQRFRGMLQNGIDLSTVDVSYVSSRSWYFLNLFGLRGLFSLILGEENATDDAQKMMQMGGGFGFNPTMSLGAEKDSLDIMQHDWALPKMERHAEDVLKQLLKK

SEQ ID NO: 6250 - protein, 521 aa, Zea mays
  unsure (1)..(521): unsure at all Xaa locations
MGTVGGGELPVADPAAADADRARLQQLGYKQELKRGLSVVSNFAFSFAIISVLTGVTTTYNTGLRYGGPASMTLGWLVVATFNGCVALSMAEICSAYPTSGGLYYWSAKLAGNEWAPLASWVTGWFNIVGQWACTTSVDFSLAQLIQVIILLSTGGANGGGYLASKYVVLAIYTAILVVHGLINSLHIQWLSWFGQLGALWNVAGVFVLVILVPSVAKERASAEFVFTHLNTDNGMGIHSKAYILAVGLLMSQYSSIGYDTSAHMTEETKKAEWSGPMGIVVSVSLLTACSGRVYLLALTSGTADDVPSRWDPTKAPGGNAIAQALYGHFXRRFGSGAGAXLCRAHLAVAIFLCGVASVTSNSRMGYAFSRTGAMPLPQVCXRGHKQGVPFNVRRLSVSVAFVMXALTSLGSQVAFQAMVSITPLGMYIAXRLPIFLRVTTARKLLRTGPFPSGRPLKPVGSVAVLWVALVTVLFCLPVAYPVAKDTFNYTPVAVGGVLVLSLVAWVLHARFWFRGPITNV

SEQ ID NO: 6251 - protein, 229 aa, Zea mays
MDEENVVELLQRYRRDRQVLLNYILSGNLIKKVAMPPGAISLDDVDIDQVSVDYVLNCAKKGEPLDLGDAIRLFHDSLDYPYVNNTGAVDEFYLLTKPEYSGPAPTREPPPIPATAPSSVVVPPPDVEPAPIIVSSPVTATNLPKSQPFDSPTEKELTIDDIEDFEDDEDEFDGRRASRRHQTDASDLSLLLPLFETGITDNDLRETAYEILVAAAGASGGLIVPQKEK

SEQ ID NO: 6252 - protein, 84 aa, Zea mays
LNVRIQSLPCFEQEGMVWIWPRDDPPKATIPSLLPPSGFTVHAEIVMELPVEQGLLLVFSFLDLAHAPFTHTSTFAKGWSVPRS

SEQ ID NO: 6253 - protein, 134 aa, Zea mays
MRGKKSDELEPVDAGDEDDDGGDDGDEDGDFGEEGEEDVSEGEGYDNPKGNETKKQRGDPEENGEEDEEEPEDQEGGGDDDDDDDDDDENGDDEDDDNGDDDEEGVDEEDDDQDEDEEEDDDEDSLQPPKKRKK

SEQ ID NO: 6254 - protein, 592 aa, Zea mays
  unsure (1)..(592): unsure at all Xaa locations
MVAYLLSKPNGSWKASMKVWVGVGLPAAAAVVVVFVLXAGVAALPAAMAAVVEHTFVVSQVNLTRLCKETLVTVVNGQLPGPAIEVTEGDSVVVHVVNRSPYNMTIHWHGVKQRLNCWADGVPMVTQCPILPGRSFTYRIPVVIGEWWDMDLAQLDRNTMDGFLVDVPTGSTINGKLGDLYSCSGAAQDGFVLEVEPGKTYLLRLMNAALFSEYYLKVAGHRMTVVASDANYVRPYTTDVVAIAPGETMDVLLLADAPPGRSYYMAALAIQAPEPDVQVPPTITRGIVQYRSSSGGGDGVVMPDMPDQHDTTISFHFHGNLSSLRRRHRVVPARADDHMLVTLSLGSVCRDGGRACARSDSDESIIVGTMNDVSFRAPTAAAMSLLEAHYFGRGDMAMAAAAGVELRALPDAPLRVFNFTDPAHRPGLXPYGPKEAPLEPTEKQTTVRRFRHGAVVEVVFQDTAVMQSDSNPMHLHGAPALXHDMFVLAHGLGNYDAARDVATYNLLDPPLKNTVVVPRLGWVAVRFVADNPGTWYIHCHFDFHLSMGMVAVFIVEDGSSADTYLPPPPADLPKCGSNKGGLYLPEEFYLQK

SEQ ID NO: 6255 - protein, 711 aa, Zea mays
IRLEDLSALSSYRTLGKLLPLPSHSQWGLHFLAHAHRLHQMKKRPCGVYASLSESGEYYSHRPPTPLLDTVNYPIHMKNLSAKELKQLADELRSDVIFSVSRTGGHLGSSLGVVELTVALHYVFNAPQDKILWDVGHQSYPHKILTGRRDQMHTMRQTNGLSGFTKRSESEFDCFGTGHSSTTISAGLGMAVGRDLKGRKNNVVAVIGDGAMTAGQAYEAMNNAGYLDSDMIVILNDNKQVSLPTATLDGPIPPVGALSSALSRLQSNRPLRELREVAKGVTKRIGGPMHELAAKVDEYARGMISGSGSSLFEELGLYYIGPVDGHNIDDLVAILNEVKSTKTTGPVLIHVITEKGRGYPYAEKAADKYHGVTKFDPPTGKQFKSKATTQSYTTYFAEALIAEAEADKDVVAIHAAMGGGTGMNLFHRRFPTRCFDVGIAEQHAVTFAAGLACEGLKPFCAIYSSFMQRAYDQVVHDVDLQKLPVRFAMDRAGLVGADGPTHCGSFDVTFMACLPNMVVMAPSDEADLFHMVATAAAINDRPSCFRYPRGNGIGVQLPTGNKGTPLEIGKGRILIEGERVALLGYGSAVQNCLAAASLVECHGLRLTVADARFCKPLDRSLIRSLAKSHEVLITVEEGSIGGFGSHVAQFMALDGLLDGKLKWRPIVLPDRYIDHGSPADQLSLAGLTPSHIAATVFNVLGQTREALEVMS

SEQ ID NO: 6256 - protein, 796 aa, Zea mays
DRVEDTLHAHRNELVALLSKYVNKGKGILQPHHILDALDEVQGSGGRALAEGPFLDVLRSAQEAIVLPPFVAIAVRPRPGVWEYVRVNVHELSVEQLTVSEYLRFKEELVDGQHNDPYVLELDFEPFNVSVPRPNRSSSIGNGVQFLNRHLSSIMFRNRDCLEPLLDFLRGHRHKGHVMMLNDRIQSLGRLQSVLTKAEEHLSKLPADTPYSQFAYKFQEWGLEKGWGDTAGHVLEMIHLLLDIIQAPDPSTLEKFLGRIPMIFNVVVVSPHGYFGQANVLGLPDTGGQIVYILDQVRALENEMVLRLKKQGLDVSPKILIVTRLIPDAKGTSCNQRLERISGTQHTYILRVPFRNENGILKKWISRFDVWPYLETFAEDAAGEIAAELQGTPDFIIGNYSDGNLVASLLSYKMGITQCNIAHALEKTKYPDSDIFWKNFDEKYHFSCQFTADIIAMNNADFIITSTYQEIAGSKNTVGQYESHTAFTLPGLYRVVHGIDVFDPKFNIVSPGADMSIYFPHTEKAKRLTSLHGSIENLIYDPEQNDEHIGHLDDRSKPILFSMARLDRVKNITGLVEAFAKCAKLRELVNLVVVAGYNDVNKSKDREEIAEIEKMHELIKTHNLFGQFRWISAQTNRARNGELYRYIADTHGAFVQPALYEAFGLTVVEAMTCGLPTFATLHGGPAEIIEHGVSGFHIDPYHPEQAVNLMADFFDRCKQDPDHWVNISGAGLQRIYEKYTWKIYSERLMTLAGVYGFWKYVSKLERLETRRYLEMFYILKFRELAKTVPLAIDQPQ

SEQ ID NO: 6257 - protein, 506 aa, Zea mays
  unsure (1)..(506): unsure at all Xaa locations
MQHRRKPASAAAPPAAKQPAARRPTARLSLAGLVVSIFLVATFLYNEDVGVSGRARSPDLRVLQEAAHQGVEAEEREVGDRTEAXSRSRSPLTLPIPIPVVALAEEELAEGSSSRRRSKPRSHRHRRRLLPSVAGCDLYRGRWTFDAAGEPGAAVPASAECEFLTEQVTCMRNGRRDDSYQKWRWQPDGCDLPRYDARLLLERLRNKRLMFVGDSLNRNQWESMVCLVQSVVPWGHKTLHKFVNNGSLNVFTAHDYNATVEFYWAPFLVESNSDDPQAHSVMNRVIAWRAIAKHAKNWKGVDYLVFNSYIWWLNTFEMKVIRRHQHQLEKEEEGVRWSKYALVDRPVAYREVLKTWARWVDRHIDPNRTRVFFMGMSPNHVTPWAWGNDGGIKCAMETQPISNNRTGRLDIGTDWRLHGVARGVLARYLRRVPVHFVDITGLSELRKDAHTSVHTLRQGKLLTPEQQADPKTYADCIHWCLPGLPDTWNHFLYAHILSLSSSAQDH

SEQ ID NO: 6258 - protein, 135 aa, Zea mays
  unsure (1)..(135): unsure at all Xaa locations
VRLQSLGAIAACFLCSESFDLTEHEGSNLSPFLLKLFNEWDDRKTRGLFHHDISSCETKVLPGVHNFVATLIEGRDQKKRPTEFTMNQVLQPFVSEKFNFTKVSPLEVIFRFNDTEKDXAQYFDGVPDTVQLLLV

SEQ ID NO: 6259 - protein, 276 aa, Zea mays
MLNLGSKTDKRLTAFHPEIEELIYSDVENSEHKFVLKDKKKPIIFSMARLDRVKNMTGLVEMYGKNARLRELANLVIVAGDHGKESKDREEQAEFKKMYSLIDEYKLKGHIRWISAQMNRVRNGELYRYICDTKGAFVQPAFYEAFGLTVIESMTCGLPTIATCHGGPAEIIVDGVSGLHIDPYHSDKAADILVNFFDKCKADPSYWDKISQGGLQRIYEKYTWKLYSERLMTLTGVYGFWKYVSNLERRETRRYIEMFYALKYRSLASQVPLSFD

SEQ ID NO: 6260 - protein, 268 aa, Zea mays
ETGALLFPAINVNDSVTKSKFDNLYGCRHSLPDGLMRATDVMIAGKVAVVCGYGDVGKGCAAALKQAGARVIVTEIDPICALQALMEGLQVLPLEDVVSEADIFVTTTGNKDIIMVDHMRKMKNNAIVCNIGHFDNEIDMLGLETYPGVKRITIKPQTDRWVFPETNTGIIVLAEGRLMNLGCATGHPSFVMSCSFTNQVIAQLELWKEKSSGKYEKKVYVLPKHLDEKVAALHLGKLGAKLTKLTKSQADYISVPIEGPYKPAHYRY

SEQ ID NO: 6261 - protein, 236 aa, Zea mays
MNSAAPAPIKRAGRPASALLSLLHVSISKAGLARVGQLDRPSLATSRSAGMHASLGMSSSSSSSSRGWSSYSPLLFATLLTLLLCSQLAIAKEQYHEFVVKEATVTRLCGTQQQRIMTVNGQFPGPTVEVAEGDALIVRVRNRGSYNVTVHWHGVRQMRTAWADGPEFVTQCPIRPGTSYTYRFTVAGQEGTLWWHAHSFWLRANRHGALIIRPRAGVPYPFNAGDTPAREITIIL

SEQ ID NO: 6262 - protein, 292 aa, Zea mays
  unsure (1)..(292): unsure at all Xaa locations
MTAGFQLGVIGSLTLSVASSVAIVICNKALISTLGFPFATTLTSWHLMVTFCTLHVAQRLRFFEPKAIDGQTVVLFGLLNGTSIGLLNLSLGFNSIGFYQMTKLAIIPFTVLLETIFLKKRFSETIKFSLLVLLLGVGIASVTDLKLNXLGSVLSGLAIATTCVGQILTNTIQRXLKVSSTQLLYQSAPYQAAIAVXPLAPFVDHLLTXRSVFAHRYTFPVVGFIVLSCLIAVSVNFSTFLVIGTTSPVTYQVLGHLKTCXVLSFGYXLLHDPFTVRNILGILVAIFGMALY

SEQ ID NO: 6263 - protein, 437 aa, Zea mays
PVPAFPGSLRHGGPTAYAKLSSSDGAASVSGVAREEVAAVETLAPPARAVGSDGADRTDPPPHEQQEEAEEGAAKPGASLQQDAPLYKESECSFLTEQVTCTRNGRRDDDYQKWRWQPDGCDLPRFEAKLLLEKLRNKRLMFVGDSLNRNQWESMVCLVQSEAPWDKKSLVKNGSLNVFHLQEYNATVEFYWAPFLVESNSDDPDIHSISDRMIKPTSIAKHAANWEGVDYLIFNTYIWWMNTPQMKTVHGGSFSRKHVKYDEIERVEAYRKVLKTWSRWVEAHIDPKRSTVLFMSVSPVHMQSEGWGSPNAVKCFSEMQPAINYTKKLEVGTDWDLFATAQRVTRSMKKVPVHFVNITALSEIRKDAHTSVHTLRQGKLLTPEQKANPRKFADCIHWCLPGVPDTWNEFVYGHIVSSTPPPQQQQQQKITEDEPHR

SEQ ID NO: 6264 - protein, 118 aa, Zea mays
MASLFKEQAKLSAYRDRRFSGTQEEFDEALRASTTVYIGNVSFYTTEEQLYELFSRAGEIKKIIMGLDKNTKTPCGFCFVLFYSREDTEDAVKYISGTILDDRPIRVDFDWGFQEGRQ

SEQ ID NO: 6265 - protein, 62 aa, Zea mays
PASGQRFLLELEFVQCLANPTYIHYLAQNRYFEDEAFIGYLKYLKYWQRPEYIKYIMYPHCL

SEQ ID NO: 6266 - protein, 258 aa, Zea mays
MKIQCDACEGAAATVVCCADEAALCARCDVEIHAANKLASKHQRLPLEALSAKLPRCDVCQEKAAFIFCVEDRALFCQDCDEPIHVPGTLSGNHQRYLATGIRVGLASASACSDACDAHDSDHHAPPKATIEPPHAAVSAAVQQVPSPPQFLPQGWAVDELLQFSDYESSDKLHKEPTLGFKELEWFADIDLFHEQAPKASRTLAEVPELFGYQAANDAAYYRPAKAAAGGGAGVRQSKKARIEVTDDEDYLIVPDLG

SEQ ID NO: 6267 - protein, 255 aa, Zea mays
  unsure (1)..(255): unsure at all Xaa locations
MKIQCDACEGAAATVVCCADEAALCARCDVEIHAANKLATSXSKHQRLPLEALSASLPRCDVCQEKAAFIFCVEDRALFCRDCDEPIHVPGTLSGNHQRYLATGIRVGFASASSACSDACDAHDDSDHHARPKAAVSSAAQQVPSPPQFLPQGWAVDELLQFSDCESSDKLHKESPLGFKELEWFTDIDLFHGQTPKAGRRLAEVPELFGTQAANGAAYYRPAKATATAGGVRQSKKARTEVIDDEDHLIVPDLG

SEQ ID NO: 6268 - protein, 90 aa, Zea mays
MAEELVLDTAIRDWVLIPLSVVMVLIGVLRYFVSKLMRSPPSASPSPDPKTVKEGQVVIRARNLRNGAQFIPAKAFKVRKLYYTNGEAGL

SEQ ID NO: 6269 - protein, 176 aa, Zea mays
  unsure (1)..(176): unsure at all Xaa locations
MEALFGCNKHGGDKAADLASFIIVQAALEVPRLLGLLAMILHNEIFTSGGDQNLINRILSKNKNATDPENKDDGESDDDNDDEGDDDDAENEEXDDGGDEGSDDNENEEDDDGDDDDPAANGEGGSDDDEDDGGEDEEDDDDDDDDGDDGNEEEEEEDEEDDDDDEVPQPPTKKRK

SEQ ID NO: 6270 - protein, 176 aa, Zea mays
MEALFGSNNHGGHKAADLASLIIAQVALEVPRLLGLLAMILHNEIFTSGGDQNLITRILGKSEDETNPENKDDGESDDDNDDEGDDDDAENEEEDDGGDEGSDDNENEEDDDGDDDDPAANGEGGSDDDEDDGGEDEEDDDDDDDDGDDGNEEEEEESEEDDDDDEVPQPPTKKRK

SEQ ID NO: 6271 - protein, 129 aa, Zea mays; identical to SEQ ID NO: 5152

SEQ ID NO: 6272 - protein, 180 aa, Zea mays
LGTSRPAGARLPGVIIASGGEPSFHLFGFIMCIGATAARALHAPGRVGLLSSDGEKLNSMNLLLYMAPIAVIFLLPATIFMEDNVVGVTIQLAKKDFTIVWLLLFNSCLSYFVNLTNFLVTKHTSALTLQVLGNAKGAVAVVISIMIFRNPVSITGMLGYTLTVFGVILYSESKKRSNKP

SEQ ID NO: 6273 - protein, 324 aa, Zea mays
MTAKGGATPSPGGAGPAAGNGRLFTVGLVTAWYSSNIGVLLLNKYLLSNYGFKYPIFLTMCHMSACALLSYAAIAWLRVVPMQLVRSRVQLAKIAALSLVFCGSVVSGNVSLRYLPVSFNQAVGATTPFFTAVFAYIMTVKRESWITYLTLVPVVTGVIIASGGEPSFHLFGFIMCIGATAARALKTVLQGILLSSDGEKLNSMNLLLYMAPIAVIFLLPATIFMEDNVVGVTIELAKKDFTIVWLLLFNSCLSYFVNLTNFLVTKHTSALTLQVLGNAKGAVAVVVSIMIFRNPVSITGMLGYTLTVFGVILYSESKKRSNKP

SEQ ID NO: 6274 - protein, 269 aa, Zea mays
  unsure (1)..(269): unsure at all Xaa locations
MTAKGGATPSPGGAGPAAGNGRLFTVGLVTAWYPSNIGVLLLNKYLLSNYGFKYPIFLTMCHMSACALLSYAAIAWLRVVPMQLVRSRVQLAKIAALSLVFCGSVVSGNVSLRYLPVSFNQAVGATTPFFTAVFAYVMTVKRESWVTYLTLVPVVTGXHLFGFIMCIGATAARALKTVLQGILLSSDGEKLNSMNLLLYMAPIAVIFLLPATIFMEDNVVGITIQLAKKDFTIVWLLLFNSCLSYFVNLTNFLVTKHTSALTLQVQNTF

SEQ ID NO: 6275 - protein, 324 aa, Zea mays
MAAKGGATPSPGGTGPAAGNGRLFTVGLVTAWYSSNIGVLLLNKYLLSNYGFKYPIFLTMCHMSACALLSYAAIAWLRVVPMQLVRSRVQLAKIAALSLVFCGSVVSGNVSLRYLPVSFNQAVGATTPFFTAVFAYIMTVKRESWITYLTLVPVVTGVIIASGGEPSFHLFGFIMCIGATAARALKTVLQGILLSSDGEKLNSMNLLLYMAPIAVIFLLPATIFMEDNVVGITIQLAKKDFTIVWLLLFNSCLSYFVNLTNFLVTKHTSALTLQVLGNAKGAVAVVISIMIFRNPVSITGMLGYTLTVFGVILYSESKKRSNKP

SEQ ID NO: 6276 - protein, 1059 aa, Zea mays
MAGNDWITSYLEAILDAGGAAGDLSAAAGSGDGRDGTAVEKRDKSSLMLRERGRFSPARYFVEEVISGFDETDLYKTWVRTSAMRSPQERNTRLENMSWRIWNLARKKKQIEGEEASRLSKQRMEFEKARQYAADLSEDLSEGEKGETNNEPSIHDESMRTRMPRIGSTDAIDTWANQHKDKKLYIVLISIHGLIRGENMELGRDSDTGGQVKYVVELARALGSTPGVYRVDLLTRQISAPDVDWSYGEPTEMLSPISSENFGLELGESSGAYIVRIPFGPRDKYIPKEHLWPHIQEFVDGALVHIMQMSKVLGEQIGSGQPVWPVVIHGHYADAGDSAALLSGALNVPMVFTGHSLGRDKLDQILKQGRQTRDEINATYKIMRRIEAEELCLDTSEIIITSTRQEIEQQWGLYDGFDLTMARKLRARIRRGVSCFGRYMPRMIAIPPGMEFSHIAPHDVDLDSEEGNGDGSGSPDPPIWADIMRFFSNPRKPMILALARPDPKKNITTLVKAFGEHRELRNLANLTLIMGNRDVIDEMSSTNAAVLTSALKLIDKYDLYGQVAYPKHHKQSEVPDIYRLAARTKGVFINCALVEPFGLTLIEAAAYGLPMVATRNGGPVDIHRVLDNGILVDPHNQNEIAEALYKLVSDKHLWSQCRQNGLKNIHKFSWPEHCQNYLARVVTLKPRHPRWQKNDVAAEISEADSPEDSLRDIHDISLNLKLSLDSEKSGSKEGNSNALRRHFEDAAQKLSGVNDIKKDVPGENGKWSSLRRRKHIIVIAVDSVQDADFVQVIKNIFEASRNERSSGAVGFVLSTARAISELHTLLISGGIEASDFDAFICNSGSDLCYPSSSSEDMLNPAELPFMIDLDYHSQIEYRWGGEGLRKTLIRWAAEKNKESGQKIFIEDEECSSTYCISFKVSNTAAAPPVKEIRRTMRIQALRCHVLYSHDGSKLNVIPVLASRSQALRYLYIRWGVELSNITVIVGECGDTDYEGLLGGVHKTIILKGSFNTAPNQVHANRSYSSQDVVSFDKQGIASIEGYGPDNLKSALRQFGILKD

SEQ ID NO: 6277 - protein, 224 aa, Zea mays
  unsure (1)..(224): unsure at all Xaa locations
MASPTQRHYFTCTWWQEYXPNKTLVIKDVHVAPPHADKVRDXIVFPVLCXTDHYSWHWKDPDAIFPCILGHEAALIVERRSSQRVSDSAXRDDCVLPCYQTQLNNASFALPLTICLCGEARIGTRVIVMMNDMYVKCSVNGXPFXHFMVTSTFSHYSAXRDVSVAKINPQAPLYKLCLLGCAVPTELGAXRNTAKDESASAVAAFDLATAGLADAEGAKAAGAS

SEQ ID NO: 6278 - protein, 76 aa, Zea mays
LSREENVHMAKLAEYAQRYQEMLEVMEKGPKTVDSEELTVEERNLLSVAYKNAIGARRASCRIISSVHNKEERPRT

SEQ ID NO: 6279 - protein, 160 aa, Zea mays
KIFGGNSRLGCYALAVTIFSLGIFRDYLYNEALADQPTHPALLSPVIKYSAIPLFLTGNVLVVTSMWALGVTGTYLGDYFGILMDEPVTTFPFSVSSSPMYHGSTMSFLATAIWYGKPAGIFLSGLVAVAYSIACKWEDPFTAMIYRKRDEERSRGKKGQ

SEQ ID NO: 6280 - protein, 193 aa, Zea mays
MGRKLALLVGINYPGTKAELKGCHNDVDRMHKCLVDRFGFDEDNITVLLDRGSSGPQPTGANIRHALAKLVGDARRGDFLFFHYSGHGTRLPAETGQDDDTGYDECIVPSDMNLITDQDFRDLVQRVPDGCIFTIVSDSCHSGGLLDKAKEQIGNSTRQNQTQSREPEEERSHSGSGFRSFLKETVRDAFESH

SEQ ID NO: 6281 - protein, 370 aa, Zea mays; identical to SEQ ID NO: 688

SEQ ID NO: 6282 - protein, 226 aa, Zea mays
SLTTPASRTSGTQSPSLLPPSGFTVHAEIVMELPVEHGLLLDNLLDLAHAPFTHTSTFAKGWSVPSLVKFLTPASGLQGYWDPYPIDMEFRPPCMVLSTIGISKPGKLQGKSTRQCSTHLHQLHVCLPSSRNKTRLLYRMSLDFAPWLKHVPLMHLLWSHFAEKVLNEDLRLVLGQQERMIDGANVWNWPVSYDKLGIRYRLWRDAVERGADDRLPFSSTQAESLS

SEQ ID NO: 6283 - protein, 131 aa, Zea mays; identical to SEQ ID NO: 1160

SEQ ID NO: 6284 - protein, 240 aa, Zea mays
QTRVCVTAGRGYFQFVAPCTFFGTPFPQEGQKKAPRVMLVFFCIPVGPGRSRVIWAFPRNVGVWLHHITPRWLYHVGQNLILDSDIFLLHVEERKFAAAGLDNWQRACYVPTSSDAMVVAFRNWFRKFCKNQVGWATLQVDQLPPTRTKDQLMERYWSHVVQCRSCNAALKTMKALEAALQVASVAVVGFLAVAKGTVLTSTVQRAAVVSAAVLCFAASRWLANFIQKNFYFQDYIHAYK

SEQ ID NO: 6285 - protein, 333 aa, Zea mays
  unsure (1)..(333): unsure at all Xaa locations
MAFCGPSVALTFNFAVAVGIIMANKMVMGSVGFKFPIALSLIHYAVAFVLMATLKTLSLLPVAPPSKSTPFSSIFACFYQMAKIAVTPTIVVAEFMLFKKKISTIQAVTLAVVSFGVAVATVTDLEFNFFGACVALAWIVPSAVNKILWSSLQQSGNWTALALMWKTTPITIFFLLTLMPLLDPPGLLLFNWNFRNSCAVIISALFGFLLQWSGALALGATSALSHVVLGQFKTIVIMLSGYLIFGLLCWANSKRXVIMLSGYLIFGSDPGITSVCGAVLALGGMSFYTYLGLKKDPATSGKKAPSRQNSFMERPKVAADDSDDADSEQDDTV

SEQ ID NO: 6286 - protein, 442 aa, Zea mays
  unsure (1)..(442): unsure at all Xaa locations
MTKLPWWRADASELVAVTAMGVWEAVLAGGGRRFIKRKDSDAGETGSHPHHPVLILNIFFKKKDLSAGSVGVDGERRALPLALRGRALEELRSSLYNEMHSAEGAKRQQQRFCGPSVALTFNFAVAVGIXMANKMVMGSVGFKFPIALSLIHYAVAFVLMATLKTLSLLPVAPPSKSTPFSSIFALGAVMSLSTGLANVSLKHNSVGFYQMAKIAVTPTIVVAEFMLFQKKVSSKKAVTLAVVSFGVAVATVTDLEFNFFGACVALAWIVPSAVNKILWSSLQQSGNWTALALMWKTTPITIFFLLTLMPLLDPPGLLLFNWNFRNSCAVIISALFGFLLQWSGALALGATSALSHVVLGQFKTIVIMLSGYLIFGSDPGITSVCGAVLALGGMSFYTYLGLKKDPATSGKKAPSRQNSFMARPKVAADDSDDADSEQDDTV

SEQ ID NO: 6287 - protein, 353 aa, Zea mays
  unsure (1)..(353): unsure at all Xaa locations
FGRNIKESSFFFCPTEKKITYLNRWWFVDWISRFNCNHGKKSLFLSCDADSVWGCQKLEFKFPXLTVSCVHFICSSIGAYIAIKVLRTKPLIEVASEDRWRRIFPMSLVFCVNIVLGNVSLRYIPVSFMQTIKSFTPATTVVLQWLVWRKYFEWRIWASLVPIVGGILVTSVTELSFNTAGFCAALVGCLATSTKTILAESLLHGYKFDSINTVYYMAPLATLILSVPAVALEGGAVLGWLRTHESVGPALAVVVTSGVLAFCLNFSIFYVIHSTTAVTFNVAGNLKVAVAVLASWMVFRNPISAMNALGCGVTLVGCTFYGYVRHRLSQNQAPRARLEMLPLTAVDKQGDKI

SEQ ID NO: 6288 - protein, 525 aa, Zea mays
  unsure (1)..(525): unsure at all Xaa locations
MAGGGEREGAQAMDSGEKRLNELGYKQELRREMTLFKTLAISFSTMTLFTGITPLYGSSLQYAGPAPLVWGWVVVSFFTCFVGVAMAEICSSFPTTGSLYFWAAHLAGPVWGPLASWCCAWLEAIGLIAGIGTQAYAGSQVLQSIILLCTGTNXGGGYLAPRWLFLVMYIGLTLIWAVLNTFALEVIAFLDVISMWWQVIGGTVIVVMLPLVAKTTQPASYVFTHFQTAPDVTGIGSSAYAVVLSFLVSQYSLYGYDAAAHLTEETKGADKNGPIAILSSIGIISVFGWAYILALTFSIQDFSYLYNPNNETAGTFVPAQILYDAFHGRYNSSAGAIVLLFVIWGSFFFGGLSITTSAARVVYALSRDQGVPLSSVWRRIHPRHKVPANAVWLCATVCTLLGLPILRINVVFTAITSIATIGWVGGYAVPIFARMVMREDDFRPGPFYLGRASRPVCLVAFLWICYTCSVFLLPTVYPIKMDTFNYAPIALGVCLGLIMLWWLLDARKWFKGPVRNIDDHNNGKV

SEQ ID NO: 6289 - protein, 196 aa, Zea mays
ANRQSSASSDDGGSAAGSPSRKRPVRSDSLDTAPQHHNRKPPSPYAAAPAPGPDQMECTSAAVTVVAAAAFHHEPARRIREAERKPKVSRRFVHADPSDLSLVVKDGYQWRKYGQKVTKDNPCPRAYFRCSLAPSCPVKKKVQRSADDSAVLVATYEGDHNHARPPQHDGAAKRSSAPPAGEAARPPAQAPAPLPL

SEQ ID NO: 6290 - protein, 222 aa, Zea mays
MDWAYYGSGYSTPASGGGGGDEDAYMTVSSAPPKRRAGRTKFKETRHPVYKGVRSRNPGRWVCEVREPHGRQRIWLGTFETAEMAARAHDVAALALRGRAACLNFADSPRRLRVPAQGAGHDEIRRAAVEAAELFRPQPGERNVGGSEAAAEAAAAAPCAMGSGDLGGGEFPYYPVDDGLEFEMRGYLDMAQGMLIDPPQPAAGQSAWIEDEYECEVSLWSY

SEQ ID NO: 6291 - protein, 232 aa, Zea mays
  unsure (1)..(232): unsure at all Xaa locations
MGYEDSVYLAKLAEQAERYEEMVENMKAVASADQELSVEERNLLSVAYKNVIGARRASWRIVTSIEQKEESKGNEAQVGLIKEYRQKIEAELAKICEDILECLDGHLIPSAESGESKVFYHKMKGDYHRYLAEFAVGDKRKTSADKSLEAYKAATEVAASSLAPTHPIRLGLALNFSVFYYEILNSPDQACQXGQQAFDDAIAELDTLSEESYKDSTLIMQLLRDNLTLWTS

SEQ ID NO: 6292 - protein, 360 aa, Zea mays
  unsure (1)..(360): unsure at all Xaa locations
MADPLVRARPKRKKVLADYLVRLRWIPALFVALPISALIYLSVFLGNTWSAMKSEKRRQKEHQENVKRXERVVKRLKERDPKRDGLVCTARKPWVVVGMRNVDYKRARGREAHRSALSSILEIDAERMVARVESLVSMAQITKATCPMNLSLAVAPELDDLTVGGLINGYGISGSSHVYGLFSDTVVSMEVVLADGQVVRATMDNEHSDLFYGMPWSQGTIGLLVSAEIRLVRVKEYMRLTYTPVRGTLKEIAEAYADSLFLPAKVPDFVEGMVYSSSEGVMMTGVYASEQEARRTKGSGRIINRVGWWFKPWFYQHAETALERGEFVEYIPTREYYHRHTRSLYWEGKLIIPFGKKKKK

SEQ ID NO: 6293 - protein, 112 aa, Zea mays
VSDRSLACVLVLVQGVTKQIGGSVHELAAKVDEYARGMISGPGSSLFEELGLYYIGPVDGHNIDDLITILNDVKSTKTTGPVLIHVVTEKGRGYPYAERAADKYHGTTHHMS

SEQ ID NO: 6294 - protein, 82 aa, Zea mays
MSREENVYMAKWAAQAERYEVMAEYMEKVATTVDVVELTVEERNLMYVAYKNVIGARRASWSTVPCMEQIEEFRRIEKHVHL

SEQ ID NO: 6295 - protein, 288 aa, Zea mays
MNRGRETGGNLRESGLFSGCDGDGGAGMDRKRIKDVLEKHLERSSPSTSRGVVSKERERLAAGKLPASLGKAEKVSDGEEFETDSEDEDSDISGSESEGTSWISWFCTLRGNEFFCEIDDDYIQDDFNLCGLSMQVPYYDYALDLILDIESSDDTYTEERKEFIELSAEILYGLIHARYILTSKGLAAMLEKFKNRDFGGCPRVYCCGQPCLPAGQSDVPRSSTVKIYCPKCEELNYPISMYQGSIDGSYFGTTFPHLFLMTYPHLKPQKPPQQYTPRVFGFKHHKPS

SEQ ID NO: 6296 - protein, 311 aa, Zea mays
MAASVALSSGHRMPAVGLGVWRMEKADIRGLIHTALRVGYRHLDCAADYQNEAEVGDALAEAFQTGLVKREDLFITTKLWNSDHGHVLEACKDSLKKLQLDYLDLYLIHFPVATRHTGVGTTSSALGDDGVLDIDTTISLETTWHAMEELVSMGLVRSIGISNYDIFLTRDCLAYAKIKPAVNQIETHPYFQRDSLVKFCQKHGICVTAHTPLGGSTANTEWFGSVSCLDDPVIKSLAEKYGKTPAQLVLRWGLQRNTVVIPKTSKLERLQENFEVFDFDISGEDMEKMKAVDRKYRTNQPAKFWGIDLFA

SEQ ID NO: 6297 - protein, 323 aa, Zea mays; identical to SEQ ID NO: 845

SEQ ID NO: 6298 - protein, 616 aa, Zea mays
ISDEPAPRCSRFAPRSRPMGGEVPEPRRLSRALSFGCGGVPEEALHLVFGYMDDPRDREAASLVCRLWHRIDALSRKHVTVGFCYAVEPARLLARFPRLESLALKGRPRAAMYGLIPEDFGAYAAPWVAELAAPLDCLKALHLRRMTVTDEDIAVLVHARGHMLQALKLDKCSGFSTDALRLVARSCRSLRTLFLEECIIEDEGSEWLHELAVNNSVLVTLNFYMTELKVEPADLELLAKNCKSLISLKMGDCDLSDLIGFFQTSKALQEFAGGAFFEVGEYTKYEKVIFPPRLCFLGGLTFMGKNEMPVIFPYSTMLKKLDLQFTFLTTEDHCQLIAKCPNLSVLEVRNVIGDRGLEVVAATCKKLRRLRIERGDDDPGQEEQGGVSQIGLTAVAVGCRELEYIAAYVSDITNGALESIGTFCKNLYDFRLVLLDKQKKITDLPLDNGVRALLRNCVKLRRFAFYLRPGGLSDVGLGYIGLYSGNIQYMLLGNVGESDNGLIQFATGCTNLRKLELRGCCFSERALAVAVLQMPSLRYIWVQGYRASRTGQDLMLMARPYWNIEFAPPIPESAYRVMADGQPCVDTHAQVLAYYSLAGRRPDCPQWLVTLHPASL

SEQ ID NO: 6299 - protein, 268 aa, Zea mays
  unsure (1)..(268): unsure at all Xaa locations
MDPKMTEVTQMFARFKAAYARNDLNTCVTLLSQLKVHLTQFPSLPPLFQQTPNIVEELKLARDIYEHAVVLSVKLEDQDAFERDFCQLKPYYMDTCGIIPASPEEYPILGLNLLRLLVQNRIAEFHTELELLPVKALEHPCIKHAVELEQSFMEGAYNRVLSARQAVPHETYVYFIDLLAKTVRDEIAGCSEKGYDSLSVSDAKQMLMFSSDQDLHEYITEEHPEWEIKNGAVFFQKAKESQPCKXEIPSLQLINQTLSYARELERIV

SEQ ID NO: 6300 - protein, 319 aa, Zea mays
MSINSKISNVKGIDLDLWTQDGLPSAQLLKLMRDVVAGLVHLHNLGIIHRDLKPQNVLISAEGPIRAKLSDMGISKHLQDDMTSVSHHGTGIGSSGWQAPEQLRHGRQTRAMDLFSLGCLIFYCITKGKHPFGEYYERDVNIANNRFDLFMVDYIPEAVHLISQLLQPNPEARPTAVYVMHHPLFWSPELRLSFLRDTSDRIEKTSETDLINALESIGPVAFGGKWGEKLDAALVTDMGRYRKYNFESTRDLLRYIRNKSGHYRELSDDLKGILGSLPEGFDHYFASRFPKLLIEVYKVLWVHCKDEEAFSKHFNGSSL

SEQ ID NO: 6301 - protein, 283 aa, Zea mays
  unsure (1)..(283): unsure at all Xaa locations
SLTTPASRTSGTQSPSLLPPSVFTVHAEIVMELPVEHGLLLDNLLDLAHAPFTHTSTFAKGWSVPRYVCIVCIPSIPLLQFVRKLSXLCSFSLVKFLTPASGLQGYWDPYPIDMEFRPPCMVLSTIGISKPGKLQGKSTRQCSTHLHQLHVCLPSSRNKTRLLYRMSLDFAPWLKHVPLMHLLWSHFAEKASLAPSLQLKRNRLHASLAXNLDHAWCCAAQVLNEDLRLVLGQQERMIDGANVWNWPVSYDKLGIRYRLWRDAVERGADDRLPFSSTQAESLS

SEQ ID NO: 6302 - protein, 176 aa, Zea mays
CTSGGEPPCKRVEEECRPRVSKLYVRADPADLSLAVRDGYQWRKYGQKVTKDNPCPRAYFRCSFAPACPVKKKVQRSAHDASVLVATYEGDHTHGPPPSGSGSGSGASSKNAAKPPSPPRRQEAAVAVTAAAAASEMVRRNLAEQMAVTLARDPSFKAALVSALSGRILELSPTKD

SEQ ID NO: 6303 - protein, 173 aa, Zea mays
IGIISVFGWAYILALTFSIQDFSYLYNPNNETAGTFVPAQILYDAFHGRYNSSAGAIVLLFVIWGSFFFGGLSITTSAARVVYALSRDQGVPLSSVWRRIHPRHKVPANAVWLCATVCTLLGLPILRINVVFTAITSIATLGWVGGYAVPIFARMVMRENDFRPGPFYLGRTR

SEQ ID NO: 6304 - protein, 426 aa, Zea mays
IQSAGWNRVHSLLSPTGIVTKLPQPAAATNAERPPASLHLSEWGLSPPSNRSSGTSSTPSFRRRSLQLLLSFPSFNRCNLHFPWSSLINNVSLQPSFKFYRKCLTNCPYFALTMHSTTKPLGSSMPVKRAHLKPHAADIKRNPHVHELYKLVYRLPENLSWLLAPPEIPKRPASKKKKQKDEIVAGNSFGVILEWEGVVVDDDDPDLEPRVWYVLSLEEGKSFPPDALLKKIEGMRTDQAIAEVLCWSEDPAEIQRLATHKEVIYQKLQGGYYQLRPHVLDFLNTLVGFDIPIAIAAPRSRKSLEEGIKTVGLQGYFDAIVALEDFCLGKPDGEMFEVAAEQLGLEPDACVVFGNSNLTTESAHNAGMRCVAVAGRHPAYELQSANHVVRWLDQLSIVDLQRLANGEVIGRRGRESDMDMEIVIEE

SEQ ID NO: 6305 - protein, 145 aa, Zea mays
  unsure (1)..(145): unsure at all Xaa locations
RPGSPAGLCRMNRSGQYVXWEDHRPRSGVWKGTSGGEAISFSGCDDDQTSADTSALSKITSTGAMTFCFIQAIERGQGTTYGSILNSMRSTIRYTGDSXGVGGGAVTSLITMLLTGGSLSAGGLRQEPQLTACEPFDVYAKPFSL

SEQ ID NO: 6306 - protein, 351 aa, Zea mays
  unsure (1)..(351): unsure at all Xaa locations
MMMLIDCSGCRTPLQLPHGAPCIRCAICGAVTHIAPAPPAEPNRGAVQPAPGWAPPPPPVHGRKRAVVCGISYRYSRHELKGCINDAKCMRHLLMTRFNFPDDSIIMLNEEQTDPYXIPTKHNIRMAMYWLVQGCQPGDSLVFHYSGHGSQQRNYSGDEVDGFDETLCPLDFETQGMILDDEINTALVRPLPHGVKLHALIDACHSGTALDLPYLCRMNRSGQYVWEDHRPRSGVWKGTSGGEAISFSGCDDDQTSADTSALSKITSTGAMTFCFIQAIERGQGTTYGSILNSMRSTIRNTGDSAGVGGGAVTSLITMLLTGGSLSAGGLRQEPQLTACEPFDVYAKPFSL

SEQ ID NO: 6307 - protein, 351 aa, Zea mays; identical to SEQ ID NO: 781

SEQ ID NO: 6308 - protein, 556 aa, Zea mays
  unsure (1)..(556): unsure at all Xaa locations
MDSVRSWFQKFQPRDKSKRPVVAARHGKDPGKPPMDDAPSSATKQRVAAAKQYIENHYKTQMKSLQDRKERRWMLERKLQDAEVPVEEQNNILKHLEKKETEYMRLQRHKMGVEDFELLTIIGRGAFGEVRLCREKASKNVYAMKKLKKSEMLRRGQVEHVKAERNLLAEVDSAYIVKLYYSFQDEEFLYLIMEYLPGGDMMTLLMRKDTLTEDEARFYIAETVLAIESIHKHNYVHRDIKPDNLLLDSXGHLKLSDFGLCKPLDSSNFPNLNEPDYMSGKVTTPLPDTTRLSNPSAPRRTQQEQLSHWQKNRRMLAYSTVGTPDYIAPEVLLKKGYGTECDWWSLGAIMYEMLVGYPPFYSEDPMSTCRKIVNWRSHLKFPEEAKLPPEAKALISKLLCNVEHRLGTKGAHEIKAHPWFGGVQWEKLYQMKAAFIPEVNGELDTQNFENFEEIGTQIQSSSKSGPWRKMLPSKDANFVGYTYKNFEIVNDDEVAGIPEVKKKSSKSKRPTIKTLFESMDEEEPVQGSFLGMLPPKEGQPSSHSSVPQERHQPRRK

SEQ ID NO: 6309 - protein, 556 aa, Zea mays
  unsure (1)..(556): unsure at all Xaa locations
MDSVRSWFQKFQPRDKSKRPVVAARHGKDPGKPPMDDAPSSATKQRVAAAKQYIENHYKTQMKSLQDRKERRWMLERKLXDAEVPVEEQNNILKHLEKKETEYMRLQRHKXSGVEDFELLTIIGRGAFGEVRLCREKASKNVYAMKKLKKSEMLRRGQVEHVKAERNLLAEVDSAYIVKLYYSFQDEEFLYLIMEYLPGGDMMTLLMRKDTLTEDEARFYIAETVLAIESIHKHNYVHRDIKPDNLLLDHSGHLKLSDFGLCKPLDSSNFPNLNEPDYISGKVTKPLPDTTWLSNPSAPRRTQQEQLSHWQKNRRMLAYSTVGTPDYIAPEVLLKKGYGMECDWWSLGAIMYEMLVGYPPFYSEDPMSTCRKIVNWRSHLKFPEEAKLPPEAKALISKLLCNVEHRLGTKGAHEIKAHPWFGGVQWEKLYQMKAAFIPEVNGELDTQNFENFEEIGTQIQSSSKSGPWRKMLPSKDANFVGYTYKNFEIVNDDEVAGIAELKKKSSKPKRPTIKTMFERMDEEEPVQGSFLSMLPPEGQPSSHSSVPQEKYQPRRK

SEQ ID NO: 6310 - protein, 433 aa, Zea mays
MVLDLNVASPADSGTSSSSVLNSADGGFRFGLLGSPVDDDDCSGEMAPGASTGFMTRQLFPSPTPPAEPEPEPVAAPVPVWQPQRAEDLGMAQRPVAPAKKTRRGPRSRSSQYRGVTFYRRTGRWESHIWDCGKQVYLGGFDTAHAAARAYDRAAIKFRGLDADINFSLSDYEDDLKQMRNWTKEEFVHILRRQSTGFARGSSKYRGVTLHKCGRWEARMGQLLGKKYIYLGLFDSEVEAARAYDRAALRFNGREAVTNFEPSSYNAGDNNLRDTETEAIDDGDAIDLDLRISQPNVQDPKRDNTLAGLQPTCDSPESSNTMASQPMSSSSPWPGYHQNPAVSFHHQRLYSSACHGFFPNHQVQERPVERRPELGAQPFPSWAWQAQGSPHVPLHHSAASSGFSTAAGANGGMPLPSHPPAQFPTTTNPFFFP

SEQ ID NO: 6311 - protein, 241 aa, Zea mays
MGRKRAVLVGINYAGTKAELKGCHNDVARMRRCLVDRFGFDDDGAAIRVLSDADRAAPQQQPTGANIRRELARLVADARPGDSLFFHYSGHGTRLPAETGQDDDTGYDECIDPSDMNLITDQDFTELVQKVPDGCLFTIVSDSCHSGGLLDKAKEQIGHSTKQNKAQQGKREERSESGSGGFRSFLKQTVRDAFESQGVHLPRRGGQQGSYDDAESEEPSLDFGTDGHVKNRSLPLSTFIE

SEQ ID NO: 6312 - protein, 310 aa, Zea mays
MTPAAGEYRSREASVLEELFRSYRDPNLSSSGDNNSERNDHLGRQLTGQGAWSPGDSSDNDAESWAASGSAAAGTSASHTRHCRSLSVDSIMGNLNFGGLDQVSLRVPPLSPVADASVSLSRTGTGASGGAVATASSQPANGEFSESEMKKIMANDRLAELALVDPRRVKRILANRISAAKSKERKVKYMGELERKVRVLQMETSTLSSKAASSQRECEALRILNNEMKIRLQAMEQQAQLKDALNEALTAEVQRLKQIAGEASDPHVPNMSRKIVEQQLQKQPSEAQLAEQQQPQESEEFKAQQKQWNH

SEQ ID NO: 6313 - protein, 328 aa, Zea mays
MKLLALSSVMAPSPVFASAPEEKGFSGFMIDFMMGGVSAAVSKTAAAPIERVKLLIQNQDEMLKTGRLSEPYKGIGDCFGRTIRDEGFVSLWRGNTANVIRYFPTQALNFAFKDHFKRMFNFKKDKDGYWKWFAGNLASGGAAGACSLFFVYSLDYARTRLANDAKAAKKGGERQFNGLVDVYRKTLASDGIRGLYRGFNISCVGIIVYRGLYFGMYDSLKPVLLVGTLQDNFLASFLLGWGITIGAGLASYPIDTVRRRMMMTSGEAVKYNSSLDAFKQIVAKEGTKSLFKGAGANILRAVAGAGVLAGYDKLQVVVFGKKYGSGGG

SEQ ID NO: 6314 - protein, 381 aa, Zea mays
  unsure (1)..(381): unsure at all Xaa locations
MADELRSTSVGQKFHGQSVLLSRISSYSAMNNPVFNNAYSAYNVPQRSYHGMNATAGLSSVMAPSPVFASAPKEKGFSGFMIDFMMGGVSAAVSKTAAAPIERVKLLIQNQDEMLKTGRLSEPYKGIGDCFGRTIRDEGFVSLWRGNTANVIRYFPTQALNFAFKDHFKRMFNFKKDKDGYWEXFAGNLASGGAAGACSLFFGYXSLDYARTRLANDAKAAKKGGEKQFNGLVDVYRKTLASDGIRGLYRGFNISCVGIIVYRGLYFGMYDSLKPVLLVGTLQDNFLASFLLGWGITIGAGLASYPIDTVRRRMMMTSGEAVKYNSSLDAFKQIVAKEGTKSLFKGAGANILRAVAGAGVLAGYDKLQVIVFGKKYGSGGG

SEQ ID NO: 6315 - protein, 380 aa, Zea mays
MADELRSTSVGQKFHGQSVLLSRISSYSAMNNPLFNNAYSAYNVPQRSYHGMNATAGLSSVMAPSPVFASAPKEKGFSGFMIDFMMGGVSAAVSKPSAAPIERVKLLIQNQDEMLKTGRLSEPYKGIGDCFGRTIRDEGFVSLWRGNTANVIRYFPTQALNFAFKDHFKRMFNFKKDKDGYWKWFAGNLASGGAAGACSLFFVYSLDYARTRLANDAKAAKKGGERQFNGLVDVYRKTLASDGIRGLYRGFNISCVGIIVYRGLYFGMYDSLKPVLLVGTLQDNFLASFLLGWGITIGAGLASYPIDTVRRRMMMTSGEAVKYNSSLDAFKQIVAKEGTKSLFKGAGANILRAVAGAGVLAGYDKLQVVVFGKKYGSGGG

SEQ ID NO: 6316 - protein, 708 aa, Zea mays
  unsure (1)..(708): unsure at all Xaa locations
MRPSAAAAPLPPSSSEKAATGARVEAAVVESQVVERLVELVSEIAAVSDHLSNGVSSSCNLSRRIRLLVPMLEEAKEAPTPLTVASKAALRRLREALHAARDLLQLGSSGSKIFLVLDREKIMKTFQDVTARLEHALAAISFDELNISDEVREQVELVHTQFKRAKERSDSSDDDLFNELMSLCNSSSSDSVDPDTLRRLSEKLQLVTIYDLNHESLTLHEMASGGDPGAVVEKMSMLLKRIKDFVQTEDPEXRPQASTATISTNDNSACPVIPDDFRCPISLDLMKDPVIVATGQTYERGYIEMWLEAGHDTCPKTQQKLANKSLTPNYVLRSLITQWCEANGIEPPKRPAQLRDAPLSCSXAEHSNVLELLRRLARRPGEDQRGSAGMLRQLAKRSAENRACIGDAGAIPILVSLLSTTDVSTQEHVVTALLNLSIYEENKARIISSGAVPGIVHVLKRGSMEARENSAATLFSLSIVDENKVTIGCSGAIPALVQLLSNGSQRGKKDAATALFNLCIYQGNKGKAVRAGLVPILLELLMETESGMVDEALAILAILSGHPEGKTAIGAASAIPVLVGVIRNGSPRNKENAAAVMVHLCSGEQQQQHLAEAQEQGIVSLLEELAESGTDRGKRKAVQLLERMNRFLKQQSQAEAEAEAMAQAHAQAQAQAQAQAQAQPQILVQAQAHADMQAERSLLPTSSDISDR

SEQ ID NO: 6317 - protein, 236 aa, Zea mays
AARGGGPDLPVMLTFLEFYETLLGFVNFELYHSINVNYPPILDPRLEALAAELYALSRYMSSGRLPGNPESNGLIEDKETENNKESSKTDESELRLAQLQHQLPANEPGALMHLVEESTADDTEEESVKECRTLFKDLKFYLSREVPRESLLFIIPAFGGTVSWEGEGAPFDETDQDITHQIVDRPTQSHVFLSRHYVQPQWIFDCVNILKVIPTDDYIVGRVPPPHISPFVDNDK

SEQ ID NO: 6318 - protein, 785 aa, Zea mays
YSRSTGKGALTSPFKLLKSNHLGVVLTFTVYKYDLPPNATPQERIHATLGYLGASFDVPSLVDKLLEQLASKRKIVVNLYDTTNHTSPIEMYGSDFTPSGDLHISSIDFGDPTRKHEMHCRFKHEPSLPWSAIIISTAVAIIVLLVGHIIYATLNSLEKAEHDYRVMRELKGQAEAADIAKSQFLATVSHEIRTPMNGVLGMLQMLMDTELDTTQQDFVVTAQESGKVLINLINEVLDLAKIESGRIELEAVPFDVRDILDNVISLFYDKSQAKGIELAVLVSDQVPDVLIGDPWRFRQIITNLVGNSMKFTEQGHIFVQVHLVKELNRKGNNFCDVSAHNREILYDSDNSMLWNTLSGLEVADSWRSLENFTMFKNSNGETDTIRLAVRVEDTGIGITKDAQMRIFTPFMQADSSTSRTYGGTGIGLSITKRLVELMGGEIGFTSKSGVGSTFSFTAIFKENRGCPGDMKRYYSEPTPLDFQGMRALIIDGRSARAEVTMYHLRRLGIQCSLVATSESESASSALMKACTSSKNNPDMVLVDTEAWGKGSGLAFYHRFVDCQLKGAHKFSQPMPKTILLGSSISPVESDYLRLTGFGDCIRKPLRLSTIVACLRKTLGVGVTRQQSRDQSLVLQSVLTGKQILVVDDNAVNRKVAAGSLKKYGSKVTCVDSGSDAIDMLKPPHTFDACFMDVQMPEMDGFEATRLIRSIEKKINDMIMMGEISANNYGNKAHWHVPILAMTADVIQATFEKCMQCGMDGYVSKPFEEQQLYFAVAHFLETDETE

SEQ ID NO: 6319 - protein, 339 aa, Zea mays
MVGTAAGSAEEAVRRWVDAAGGRLVLDGGLATELEANGANLNDPLWSAKCLLSSPHLIRKVHMDYLEAGANIIITASYQATIQGFESKGFSKEQSEKLLTKSVEIALEAREMFLKEHLEKSTPIQHPVLVAASLGSYGAYLADGSEYSGDYGEAGTKEFLKDFHRRRLQVLAEAGPDLIAFETIPNKLEAEAYVELLEECNINIPAWFSFNSKDGVHIVSGDSLIECATIADKCAKVGAVGINCTPPRFIHGLILSIRKVTDKPILIYPNSGERYDGEKKEWVESTGVSDGDFVSYVNEWCKDGAVLIGGCCRTTPNTIRAIHRTLNKSPNKQQLPAVE

SEQ ID NO: 6320 - protein, 430 aa, Zea mays
MDDAGRPPPHAPVAVTASASASATAAPAPPQPSATAAVDRSSPDPDALYEEGMWQQMAMDSGATMQPGSYPERPGEPDCTYYLRTGLCRFGMSCRFNHPPDRNLAIASARMKGEYPERAGQPECQYYLKTGTCKFGPTCKFHHPREKAGIAGRVQLNTSGYPLRPNEKECAYYLKTGHCKYANTCKFHHPELFNVVPSSRGSPIYTSVHSSASAGPQSYTGTMPSWAFPRASFIPSPRWQSPSNYAPMIVPQGLVQMQSWNSYTGQLQSPGAQQTYGSSQQGEASTGNQGMLSPYRPSSFPVPQYALQRENVFPERPDEPECQYYMKTGDCKFGAVCKFHHPRVRSLPPPDCVLSPMGLPLRPGEELCKFYSRYGICKFGANCKFDHPTVVAPMVYAYGFSASASPASASTNVPMARRLLGSPPGSGYTS

SEQ ID NO: 6321 - protein, 431 aa, Zea mays
  unsure (1)..(431): unsure at all Xaa locations
MDDAGRPPPHAPVAVTASASASATAAPAPPQPSATAAVDRSSPDPDALYEEGMWQQMAMDSGATMQPGSYPERPGEPDCTYYLRTGLCRFGMSCRFNHPPDRNLAIASARMKGEYPERAGQPECQYYLKTGTCKFGPTCKFHHPREKAGIAGRVQLNTSGYPLRPNEKECAYYLKTGHCKYANTCKFHHPELFNVVPSSRGSPIYTSVHSSASAGPQSYTGTMPSWTFPRASFIPSPRWQSPSNYAPMIVPHGLVQMPSWNSYTGQLQSPGAQQTYGSSQQGEASTGNQGMLSPYRSSSFPVPQYALQRDNVFPERPDEPECQYYMKTGDCKFGAVCKFHHPRVRSLPPPDCVLSPMGLPLRPGEELCKFYSRYGICKFGANCKFDHPTVVAPMGXYAYGFSASASPASASTNVPMARRLLGSPPGSGYTS

SEQ ID NO: 6322 - protein, 471 aa, Zea mays
MGSLPLLAACCSLLLTVAAPARDSTTSVCPSQISDFPHRNSSGLHLTLHHPQSPCSPAPLPSDLPFSTVLTHDDARVAHLASRLAASDPPSRRPTSLRKQKKAAGGASGGHHLDDDSLASVPLSPGTSVGVGNYVTQLGLGTPSTSYAMVVDTGSSLTWLQCSPCVVSCHRQVGPLFDPRASSTYASVRCSASQCDELQAATLNPSACSASNVCIYQASYGDSSFSVGYLSTDTVSFGSTSYPSFYYGCGQDNEGLFGRSAGLIGLARNKLSLLYQLAPSLGYSFSYCLPTAASTGYLSIGPYNTGHYYSYTPMASSSLDASLYFITLSGMSVGGSPLAVSPSEYRSLPTIIDSGTVITRLPTAVHTALSKAVAQAMAGAQRAPAFSILDTCFEGQASQLRVPTVAMAFAGGASMKLTTRNVLIDVDDSTTCLAFAPTDSTAIIGNTQQQTFSVIYDVAQSRIGFSAGGCS

SEQ ID NO: 6323 - protein, 333 aa, Zea mays
  unsure (1)..(333): unsure at all Xaa locations
MSALKKSDKKAALDFAAWSFNVTTSVGLIMVNKALMATYGFSFATTLTGLHFVTTTLMTIVFRWLGLSQPSHLPLADLVKFVIFSNLSIXVGMNVSLMWNSVGFYQIAKLCMIPASCLLEVVFDHVHYSRDTKLSIMVVLIGVAVCTVTDVSVNARGLIAAVIAVWSTALQQYYVHFLQRKYSLNSFNLLGHTAPAQAGSLLLVGPFADYLLTGKRVDHFSFSSLALFFLALSCFIAMGVNLSQFICIGRFSAVSFQVLGHMKTVLVLSLGFLFFGKEGLNLQVVLGMVLAVLGMIWYGNASAKPGGKERRSILPVRSASLKGSSEEKAGAEK

SEQ ID NO: 6324 - protein, 336 aa, Zea mays
MGIWDSILPGGGRRFIKRKDSDAGEAGRALEELRGSLYNDFHTSEGARRQQQKLCGPIVALTFNFVVAVGIIMANKMVMGAVGFNFPVALSLIHYLFAFALMSVLKALYLLPIASPSKSTPFSSLFALGAVMSFSTGLANISLKHNSVGFYQMAKIAVTPTIVVAEFILFKKKVSLRKVSTLVVVSFGVAVATVTDLEFNFFGACVALAWIIPSAVNKILWSNLQQSGNWTALALMWKTTPITIFFFIVLMPLLDPPGLLSFSWDFKNSSTIIISALFGFLLQWSGALALGATSALAHVVLGQFKTIVIMLSGYLVFKSDPGFTSLCGAVIALAGI

SEQ ID NO: 6325 - protein, 208 aa, Zea mays
MDPKLVEVTQLFDRFKASNFDVCATLLSQLKVLLTKFPSLPPLFQQTPNAVEELKLAREIYEQAVILSVKMEDQDAFERDFCQLKPYYMDTCGIIPPSSVEYPIMGANLLRLLVQNRIAEFHTELELLPTKALDNAYIKHGVELEQSFMEGAYNRVLSARQTAPHETYIYFMDLLVKTVRDEIAGCSEKGYDYLSINDAKQMFKFSSD

SEQ ID NO: 6326 - protein, 245 aa, Zea mays
  unsure (1)..(245): unsure at all Xaa locations
MNCGRGPAPATMVRCRQCSASVAAPPGACAVQCAQCCCVTRVGGAGRQLSVMRPIPNFGGGRGKKRAVLVGIKYTKTRACELRGPINDVKCMRYILTERFGFANDCVLILTDEERDPCRQPTKANIRMAMHWLVQGCSSGDSLVFQFSGAGAQVPDCDGDERDGMDEAICPVDSFQQGPILDDEINHAIVRPLVHGVKLHAIVDACHSATVLDLPYRCTFSNSTGXLSWMDKRPLNAACKGTSGG

SEQ ID NO: 6327 - protein, 332 aa, Zea mays
MSKARVYTDVNVLRPKEYWDYEALTVQWGEQDNYEVVRKVGRGKYSEVFEGINVNNNEKCIIKILKPVKKKKIKREIKILQNLYGGPNIVKLLDIVRDQHSKTPSLIFEYVNNTDFKVLYPTLTDYDIRYYIYELLKALDYCHSQGIMHRDVKPHNVMIDHELRKLRLIDWGLAEFYHPGKEYNVRVASRYFKGPELLVDLQDYDYSLDMWSLGCMFAGMIFRKEPFFYGHDNHDQLVKIAKVLGTDGLNVYLNKYRIELDPQLEALVGRHSRKPWTKFINADNQHLVSHEAIDFLDKLLRYDHQDRLTAREAMTHPYFQQVRAAENSRTRA

SEQ ID NO: 6328 - protein, 102 aa, Zea mays
MSATKTKVQSIIDENPVAVFSKSYCPYCRQAKQLLSDSGAKFYAIELDQVDDGSAIQSTLGEMTGQTTVPNIFIAQKHIGGNSDLQSKKGQLNNLLKEAGAV

SEQ ID NO: 6329 - protein, 550 aa, Zea mays
LGMLQMLMDTDLDTTQQDYVRTAQASGKTLVSLINEVLDQAKIESGKLELEVVPFDLRTVCDDILSLFCGKAQEKGLELAVFVSDQVPQTLIGDPGRIRQIITNLVGNSIKFTEKGHIYLTVHVVEEIMHCLEVETGTQYTNTLSGYPVANRKRSWENFRLFSRELNSSEMPFAPIASDSISLMISVEDTGAGIPFDAQSRVFTPFMQVGPSIARIHGGTGIGLSISKCLVGLMRGEIGFASKPQVGSTFTFTAVLTRVHSSRNENKSSEFKEINALVVDHRPVRAKVTKYHLQRLGVQTELTTDLDQYISKNNCGSQIAKLVLIDKETWLKESHSMPLLVTKLRNKDQPDSTKLFLLENPKSSVKSNSHIFREYNLNVIMKPLRASMLQVSLQRALGGIDKLHCRNGVVGNSTLGSLLHKKRIIVVDDNIVNLKVAAGALKKYGAEVTCADSGKKAITLLKPPHSFDACFMDIQMPEMDGFEATKRIRVMERDLNEQIERGEAPPECAGLRQWRTPILAMTADVIQATHEQCLKSEMEGNVSKMSEYEQ

SEQ ID NO: 6330 - protein, 111 aa, Zea mays; identical to SEQ ID NO: 1945

SEQ ID NO: 6331 - protein, 618 aa, Zea mays
  unsure (1)..(618): unsure at all Xaa locations
EQINVTYKIMRRIEAEEWSLDASEIVIASTRQEIEEQWNLYDGFEVMLARKLRALVKRGANCYGRYMPRMVIIPPGVEFGQLIHDFDMYGDEDNQSPASEPSIWFEIMRFFTNPRKPMILAIARPYSEKNIATLVKAFGECHPLRELANLTLIMGNREAISKMNKISAAVLTSVLTLIDEYDLYGQVAYPKLHKHSEVPDIYRLAARTKGAFVNVAYFEQFGVTLIEAAMHGLPVIATKNGAPVEIYQVLENGLLVDPHDQHAIADALYKMLSEKQFWSRCRENGLKNIHQFSWPEHCKNYLSRISSLGPRHPAFACKEDHKVPVKCRKHISIIAVDSVNKEDLIQIIRNSVEATRTGTMSGSTGFVLSTSLTIAELQSVIVRTGMLPTDFDAFICNSGSDIYYPLQSSDVPSNSRVTFALDHNYRSHIEYRWGGEGLRKYLVKWASSVVERRGRTXEKQVIFEDSEHSSTYCLAFKVINPNHLPPLKELQKLMRIQSLRCHALYNHGATRLSVIPIHASRSQALRYLSICWGIELPDAVVIVGETGDSDYEELFGGLHKTVILKGGFNTPANRIHTVRRYPLQDVVALDSSNIIAIEGFSTGDIRSAMQQQLGIPTR

SEQ ID NO: 6332 - protein, 293 aa, Zea mays
ILFLDENDEELFSMFLDVDKLNSSCGASSEAEAESSSAAGGGGEGAELADAPRPRHQHSQSMDGSMSIKAEQLVGAPGMEGMSSAEAKKAVSAAKLAELALVDPKRAKRIWANRQSAARSKERKMQYIGELELKVQTLQTEATTLSAQLALLQRDTTGLTTENSELKIRLQTMEQQVHLQDALNDTLKTEVQRLKVATGQVGNGGGGMMLNFGAMPRLVGGNQQMFHSSQAMQSVLATHQLQQLQLHSQPQQQQLHSLQLQQVARDLKMKGHLGGQGQWGDGKSGSGSRSSGS

SEQ ID NO: 6333 - protein, 206 aa, Zea mays
  unsure (1)..(206): unsure at all Xaa locations
MSKPLLDIFAVPNDTFLTRKDIKLNNAILAEDKHLPMYDEXTRKRNGEYMXHXPTHNSITRAQXMIQTPAATSYMPXIGKDKIGEXMKNNCQAGXGTAHYYEDETAPTGTCAVCVDGGETSLIAXCERQTVDNLXHLERPXNCXLTEKVKYIYIAGLFISESADSIQLVVXSDAKNNKVFLMNLSAPFICELLRDAQKNDLPYADY

SEQ ID NO: 6334 - protein, 103 aa, Zea mays
MRRRGSNSSPLAAAAQLLLLLLLLTGGKAASAGADGAGGLVLQEGGTGNGDELSSSTLLETTTTTMGAEACEEGNDKDECLLTRRLLVDAHLDYIYTQHKGKP

SEQ ID NO: 6335 - protein, 82 aa, Zea mays
  unsure (1)..(82): unsure at all Xaa locations
PNLDLCKLXSLTFRASDNLKYPSMDLAYAAGRAGGTMTGVLSAANEKAVELFIDEKYDPFFCISTFTCFVLDKSLHIFHVIL

SEQ ID NO: 6336 - protein, 492 aa, Zea mays
  unsure (1)..(492): unsure at all Xaa locations
MATTRPRGGGGAASGALVMAIVVLLLLPPYGAGAEECEDGGISSRARAGDRVEALPGQPAVAFAQYSGYVAVDRDRGRALFYWLTEAVGDDAAAKPLVLWLNGGLFSSSISEIGPFRIKTSLILNXYSWNRAYRQANLLFLESPAGVGFSYANTTSDLRXSGDERTAASAPCPRDTKTRCVAQFPPSPHLVSWMSRFPQYRHRDFYIAGESYAGHYVPQLARKIVEYNEASPHPFINLKGILVGNAVTDNYYDNIGTVTYWWTHAMISDRTYKAILRWCNFSSSSISRPCNRAMSYAMNHEFGDIDQYXIYTPSCAAAACQXNATVLRFKNTLVRRRRSSGYDPCTETYAERYYNRMDVQRAMHANTTGIPYRWTACSDVLIKTWQDSEFSMLPTYKKLMKAGLRIWVFSGDTDSVVPVTATRFAISHLGLKIKTRWYPWYSAGQVGGWSEVYEGLTFASVRGAGHEVPLFQPRRAFRMFRSFLAGEPLPKS

SEQ ID NO: 6337 - protein, 471 aa, Zea mays
MGSLPLLAACCSLLLTVAAPARDSTTSVCASQIGDFPHRNSSGLHLTLHHPQSPCSPAPLPSDLPFSTVLTHDDARVAHLASRLAASDPPSRRPTSLRKQKKAAGGASGGHHLDDDSLASVPLSPGTSVGVGNYVTQLGLGTPSTSYAMVVDTGSSLTWLQCSPCVVSCHRQVGPLFDPRASSTYTSVRCSASQCDELQAATLNPSACSASNVCIYQASYGDSSFSVGYLSTDTVSFGSTSYPSFYYGCGQDNEGLFGRSAGLIGLARNKLSLLYQLAPSLGYSFSYCLPTAASTGYLSIGPYNTGHYYSYTPMASSSLDASLYFITLSGMSVGGSPLAVSPSEYSSLPTIIDSGTVITRLPTAVHTALSKAVAQAMAGAQRAPAFSILDTCFEGQASQLRVPTVAMAFAGGASMKLTTRNVLIDVDDSTTCLAFAPTDSTAIIGNTQQQTFSVIYDVAQSRIGFSAGGCS

SEQ ID NO: 6338 - protein, 95 aa, Zea mays
  unsure (1)..(95): unsure at all Xaa locations
ENLSTTLHAPHLTDVQRNHLPDAYKNANWVHRDAWAIASSVALXEETLFNEKHGILITEYXGKIHAEHTKSCDVIVDLTDSHLVTTATAAESNAI

SEQ ID NO: 6339 - protein, 180 aa, Zea mays
  unsure (1)..(180): unsure at all Xaa locations
INGYGIEGSSHIYGLFADTGEAYEIVLAXGHLVPATRDNEYSDLYYAIPWSQGTLGLLVAXEIRLIKVKEYMXLTYIPXXGDLQALXQGYXXSFAXPXDXDKXXXPXXXECMXXXPXXXXDXXXXXXXXEEXKPTLRGLRPYIILFTRPVRPRSFRLSVLLVPALPLPPRSFPASTPLPS

SEQ ID NO: 6340 - protein, 276 aa, Zea mays; identical to SEQ ID NO: 1177

SEQ ID NO: 6341 - protein, 264 aa, Zea mays
MDKEKSPAPPPSGGLPPPSGRYSAFSPNGSSFAMKAESSFPPLTPSGSNSSDANRFSHDISRMPDNPPKNLGHRRAHSEILTLPDDLSFDSDLGVVGAADGPSFSDDTDEDLLYMYLDMEKFNSSATSTSQMGEPSEPTWRNELASTSNLQSTPGSSSERPRIRHQHSQSMDGSTTIKPEMLMSGNEDVSGVDSKKAISAAKLSELALIDPKRAKRIWANRQSAARSKERKMRYIAELEGGPGTQLRPRGIASLAAFKRLTEKL

SEQ ID NO: 6342 - protein, 413 aa, Zea mays
MAMGCCYGDFFDKAKPYLAMISLQFGYAGMNVITKVSLNHGMSHYVLVVYRHAFATVSIAPFALILERKVRPNMTWSVFLQIFVLALLGPVIDQNFYYAGLKFTGPTFACAMSNILPAMTFVMAVIFRMEKVDLKKVRCQAKVAGTLVTVAGAMMMTLYKGPLMKMAWTSSGHAHGGGGGAEAAVIDPSGREWFLGSLFVIVATLAWASLFILQAHTLKQYAAPLSLTTLICFVGTLQAIVVTFAMEHRPSVWTIGFDMNLLAAAYAGIVTSSIAYYVQGLVIQKTGPVFASAFSPLMMIIVAVMGSFILAEKIFLGGVLGAVLIVIGLYSVLWGKHKETQDKEDDETTELPVVAIMASKTNGVVYDDDDDVVFVKEIAAAGAGAVGGDDSECRKATGVVKSSSRGHGAAGAV

SEQ ID NO: 6343 - protein, 120 aa, Zea mays
  unsure (1)..(120): unsure at all Xaa locations
KTGSVRKYNAKDLPQVDFGRIKLELAKVEMPRLMTSNAEIXTIEPFKSARSSASLHTTIQSAAPMKTLSGLGTEARXSSRNMXSTQDDTACRIEHYSVAVXLWKGDTLEEHWWCTERCLH

SEQ ID NO: 6344 - protein, 139 aa, Zea mays
  unsure (1)..(139): unsure at all Xaa locations
CSFIRCAAPGSIARCDLHGRAGGRSTTREENVYMAKLVDQAERDDEMDEYMEKAPKTVDAQQLTVEDXNLLSAAYHNAIAARRASWRIASYIEQKDESRKNEEHGNLINEYPGKIDAELSNICHGILNLLESHLMHCST

SEQ ID NO: 6345 - protein, 210 aa, Zea mays
MENGKRDRDDMEVQPSPRKPRVLLAASGSVAAIKFGNLCHCFTEWAEVRAVVSKSSLHFLDKLSLPPEVTLYTDEEEWSSWNKIGDPVLHIELRRWADVMVIAPLSANTLAKIAGGMCDNLLTCIIRAWDYSKPLFVAPAMNTLMWNNPFTERHLLSLDELGITLIPPIKKRLACGDYGNGAMAEPSLIYSTVRLFWESQGHQQSGGGTS

SEQ ID NO: 6346 - protein, 221 aa, Zea mays
  unsure (1)..(221): unsure at all Xaa locations
MSPAEPTRDESVYMAKLAEQAERYEEMVEFMERVAKATGGAXKEEGRGNDAHAATIRSYRSKIEAELAKICDGILALLDSHLVPSAGAAESKVFYLKMKGDYHRYLAEFKSGGERKEAAESTMNAYKAAQDIALADLAPTHPIRLGLALNFSVFYYEILNSPDRACNLAKQAFDEAISELDSLGEESYKDSTLIMQLLRDNLTLWTSDTNEDDVDEIKEAP

SEQ ID NO: 6347 - protein, 205 aa, Zea mays
  unsure (1)..(205): unsure at all Xaa locations
MSPAEPTRDESVYMAKLAEQAERYEEMVEFMERVAKATGGAGPGEELSVEERNLLSVAYKNVIGARRASWRIISSIEQKEEGRGNDAHAATIRSYRSKIEAELAKICDGILALLDSHLVPSAGAAESKVFYLKMKGDYHRYLAEFKSGGXERKEAAESTMNAYKAAQDIALADLAPTHPIRLGLAFNFSVFYYEILNSPDRACNL

SEQ ID NO: 6348 - protein, 270 aa, Zea mays
MGRGKVQLKRIENKINRQVTFSKRRNGLLKKAHEISVLCDAEVAVIVFSPKGKLYEYASDSRMDKILERYERYSYAEKALISAESESEGNWCHEYRKLKAKIETIQRCHKHLMGEDLESLNPKELQQLEQQLESSLKHIRSRKSHLMAESISELQKKERSLQEENKILQKELSERQKAVASRQQQQQQVQWDQQTQVQVQTSSSSSSFMMRQDQQGLPPPQNICFPPLSIGERGEEVAAAAQQQLPPPGQAQPQLRIAGLPPWMLSHLNA

SEQ ID NO: 6349 - protein, 271 aa, Zea mays; identical to SEQ ID NO: 5634

SEQ ID NO: 6350 - protein, 534 aa, Zea mays
TIPMMFNVVILSPHGYFAQSNVLGYPDTGGQVVYILDQVRALENEMLLRIKQQGLDITPKILIVTRLLPDAAGTTCGQRLEKVIGTEHTDIIRVPFRNENGILRKWISRFDVWPYLETYTEDVSSEIMKEMQAKPDLIIGNYSDGNLFATLFAHKLGVTQCPIDHALERTKYPNSDIYLDKFDSQYHFSCQFTADLIAMNHTDFIITSTFQEIAGSKDTVGQYESHIAFTLPGLYRVVHGIDVFDPKFNIVSPGADMSVYYPYTETDKRLTAFHPEIEELIYSDVENFEHKFVLKDKKKPIIFSMARLDRVKNMTGLVEMYGKNARLRELANLVIVAGDHGKESKDREEQAEFKKMYSLIDEYNLKGHIRWISAQMNRVRNAELYRYICDTKGAFVQPAFYEAFGLTVIESMTCGLPTIATCHGGPAEIIVDGVSGLHIDPYHSDRAADILVNFFEKCKADPSYWDKISQGGLQRIYEKYTWKLYSERLMTLTGVYGFWKYVSNLERRETRRYLEMFYALKYRSLASAVPLSYD

SEQ ID NO: 6351 - protein, 138 aa, Zea mays
MASLFKDPSKLSVYRDRRFPGTQEEFEAALLASLTVYVGNMSFYTTEEQAYELFSRAGEIKKIIMGLDKNTKTPCGFCFVLYYSREDAEDAVKYISGTMLDDRPIRVDFDWGFEEGRQWGRGRSGGQVRDEYRTDYDP

SEQ ID NO: 6352 - protein, 167 aa, Zea mays; identical to SEQ ID NO: 5612

SEQ ID NO: 6353 - protein, 368 aa, Zea mays
FGSSRTYGGTGIGLSISKCLVELMGGQINFVSRPHVGSTFTFTAVLKRCDRSAIGDSKPVMLHPLPSSFKGLSALLVDRRPVRATVTKYHLQRLGIACDVVATIELALGVLSGRNGSSLTSMKQPCMLLIESDSWGFNIDVSLRSRLLEMKQNGHTHVLPKIILLAAAESGKLKEHYAVDSVITKPLKASALAACLFQTLGIKQSSNERSDNSGSLYGLLLGKNILVVDDNKVNLRVAAGTLKKFGAKVECVESGKDALALLQVPYKFHLCLMDIQMPEMDGFEATKQIRAMEAKANEQAVACDDSEIDGATRAARWRLPVLAMTADVIQATHEECTKCGMDGYVTKPFEEKQLFQALQKFLDPGMSC

SEQ ID NO: 6354 - protein, 418 aa, Zea mays
MASSSHSLIHPSSFDMFCPRSSHDASSRLPSPTQVPELAVALRPASHSSVQPPSSTAYIFACPAGATAPLIHPCTSATPQLPPLLPSLAVPLPATSDPFPAPDPDARTSGLLYYAILAAAPMDPWIGQPSLSLDLNVGLPTAARPPATTTTAEVLVEEDFLAVKKDREVQVQALEAELRRAGEENRRLSDMLRAVVAKYAELQGQVNGMAAPVVSTAGNSAAAAAANRQSSASSDDGGSAAGSPSRKRPVRSDSLDTAPQHHNRKPPSPYAAAPAPGPDQMECTSAAVTIVAAAAAYHHEPARRIREAERKPKVSRRFVHADPSDLSLVVKDGYQWRKYGQKVTKDNPCPRAYFRCSLAPSCPVKKKVQRSADDSAVLVATYEGEHNHARPPQHDGGAKRSSAPPAGEAARPPAPLPL

SEQ ID NO: 6355 - protein, 288 aa, Zea mays
MDPWIGQPSLSLDLNVGLPTAARPPATTTTAEVLVEEDFLAVKKDREVQVQALEAELRRAGEENRRLSDMLRAVVAKYAELQGQVNGMAAPVVSTAGNSAAAAAANRQSSASSDDGGSAAGSPSRKRPVRSDSLDTAPQHHNRKPPSPYAAAPAPGPDQMECTSAAPARRIREAERKPKVSRRFVHADPSDLSLVVKDGYQWRKYGQKVTKDNPCPRAYFRCSLAPSCPVKKKVQRSADDSAVLVATYEGDHNHARPPQHDGAAKRSSAPPAGEAARPPAQAPAPLPL

SEQ ID NO: 6356 - protein, 374 aa, Zea mays
MLGAARRQLGSGPMLGQVLRRLRPAAAAEVARGYSAAAKEMTVRDALNSALDEEMSADPSVFLMGEEVGEYQGAYKISKGLLDRYGPDRVLDTPITEAGFTGIGVGAAYHGLRPVIEFMTFNFSMQAIDHIINSAAKSNYMSAGQISGPFGFRGPNGAAAGVGAQHSQCYAAWFAHVPGLKVLTPYSSEDARGLLKAAIRDPDPVIFLENELLYGESFPVSAEVLDSSFCLPIGKAKIEREGKDVTITAFSKMVGYALQAAEILSKEGISAEVINLRSIRPLDRAAINASVRKTNRLVTVEEGFPQHGIGAEICMSVVEESFAYLDAPVERIAGADVPMPYAANLERMAVPQVDDIVRAAKRACYRAVPMAAAA

SEQ ID NO: 6357 - protein, 170 aa, Zea mays
ECLLVLAEAGPDGIVFETIPNKLEAQAYVELLDECNISIPAWFSFNSKDGVHIVSGDSLIECATIANGCSKVGAVGINCTPPRFIHGLILFIRKVTDKPILIYSNSGERYDAEKKEWVESTGVSDGDFVSYVNEWCKDGAVLIGGCCRTTSNTIKAISRSLNQRHSSLIY

SEQ ID NO: 6358 - protein, 261 aa, Zea mays
  unsure (1)..(261): unsure at all Xaa locations
AAAGRYDWREEWYPLYLAKEVPXDAALPLTVFDRQLVLWRDAHGVLRCHEDRCPHRLAKLSEGQIVDGKLECLYHGWQFDGDGKCVKIPQLPEGAKIPRSACARNYEVRDSQGVVWVWMSDANPPDEGKLPWFEPYARAGFTDLSTVHELPYDHSILLENLMDPAHVPISHDRTDWTAKREDAQPLFFDVTERTPRGFVGYWGRTGTPYLRNLLRFEAPCVLTNTLEFADKDGREQCFSAHLLCRPAGQGKSMLLVRFGST

SEQ ID NO: 6359 - protein, 403 aa, Zea mays
MFTGAAGGIGNLPRPRRPRLGGIGHGGVMVSPQGQVALGAHPHLAAPPCTDYDVAYFKAYSHIGVHEEMLKDHVRTSTYRNAIMHHKDLISGKVVLDVGCGTGVLSIFCAFAGATRVYAVDASDIAFQAMEIVRENELSDKVVVLHGRIEDVDIEEKVDVIISEWMGYMLLYESMLGSVIFARDKWLKPGGLILPSHASLYMAPVTNSQRYHDSIYFWRDVYGIKMSSMMPLAKLCAFMEPSVETISGENVLTWPAVVAQVDCYSARAQKLETITAAFKFTSMLQAPLHGFAFWFDVEFNGPVRQKSKKQPSQSLDENTQNASPSNRKRKPDVSIVLSTAPEDAPTHWQQTLLYLFEPIELNKDQIIEGSVTISQSQQHARFLNICLKYFTGDQWYVKESVMR

SEQ ID NO: 6360 - protein, 422 aa, Zea mays
MGAKRAVLVGINYQGTKAELKGCHNDVARMRRCLVDRFGFDESGIRVLIDDGSAPQPTGANIRRELARLVGDARPGDLLFFHYSGHGIRLPAETGKDDDTGYDECIVPCDMNLITDQDFTELAQKVPSGCLFTIVSDSCHSGGLLDKTKEQIGHSTKQKQKQTQTQTQSRELEERSPSGTSFREFLKGTVREAFESQGIHLPHRSRSHQQGSGHGDDGDQESRYINTADAHVKNRSLPLSTLIEMLKEKTGKDDIDVGSIRLTLFNLFKDDASPKIKKFMKVMLNKLQQGQHGGIVGFMGALAQEVLKAKLDGKEEEEFDPAMKQHVHSDQEVYAGTTARVPSNGVLISGCQTDQTSADATTPKGVSYGALSNAIQAILAERGTVTNKELVLKARKMLSKQGYTQQPGLYCSDENASAAFIC

SEQ ID NO: 6361 - protein, 100 aa, Zea mays
ILCRFRFVDKCKYPEDGSPPRSLRYIGSMVADVHRTLLDGGIFLYPADQKSPDGKLRVLYEVFPMSFLMEQAGGQAFTGKQRVCFSFPFSDPNPQLKNLD

SEQ ID NO: 6362 - protein, 341 aa, Zea mays
MDHAAEAQRTDLMTITRHALNEQGRHPESRGDFTILLSHIVLGCKFVASAVNKAGLAKLIGLAGETNVQGEEQKKLDVLSNEVFVKALVSSGRTCVLVSEENEAAIFVDAPLRGKYCVCFDPLDGSSNIDCGVSIGTIFGIYMVKDKDNVTLEDVLQPGTNMLAAGYCMYGSSCTLVLSTGNGVNGFTLDPSLGEFILTHPNIKIPKKGKIYSVNEGNAKNWDGPTAKFVEKCKYPEDGSPPRSLRYIGSMVADVHRTLLYGGIFLYPADQKSPNGKLRVLYEVFPMSFLMEQAGGQAFTGKQRALELAPAKLHDRSPVFLGSYDDVEEIKALYASMSNSG

SEQ ID NO: 6363 - protein, 242 aa, Zea mays
  unsure (1)..(242): unsure at all Xaa locations
MDHAAEAQRTDLMTITRHALNEQSRHPESRGDFTILLSHIVLGCKFVASAVNKAGLAKLIGLAGETNVQGEEQKKLDVLSNEVFVKALVSSGRTCVLVSEENEAAIFVDAPLRGKYCVCFDPLDGSSNIDCGVSIGTIFGIYMIKDKDNATLEDVLQPGTHMIAAGYCMYGSSCTLVLSTGNGVNGFTLDPSLGEFILTHPNIKIXNKGKIYSVNERNARNWDAPTAKYVERCKFPQDGSSP

SEQ ID NO: 6364 - protein, 225 aa, Zea mays
MASRQDQASYHAGEAKARAEEKTGYVVGAAQDKAREAKDTASDAAGRAMGRGGDAKEATKEKAYEAKDAASDATGRAMDKGRGAAEATKEKGYEAKDNAADTAQQTGSYIAQTAEAAKQKAAGAAQYTIDTARAGTEQTGSYIGQTAEAAKQKAGAAAQYAMDTAVAGKDKTGSLLVQAGETVKGAAVGAKDAVMNTIGMGGGTNGSTDVTAKDTSTYKPGTRDY

SEQ ID NO: 6365 - protein, 479 aa, Zea mays
  unsure (1)..(479): unsure at all Xaa locations
MAKPPPPTSTSDPALPTTATTTSSAPKSSSRPSPRPRGLLDPLAASARSLLASARRSPVTTLAAAFFLLALVMYGEDARTIAELSIDDYLYPDADLYNVSGLPALALPPLTCDLSSGRCVFDNXSVPAYREKDCTFLTKQVSCLANGRPDDMWQYWRWQPNERSLPTFDARRFMEAMRGKRLMFVGDSLNRNQWESLVCLVQSILSKGRKKIVKRGSFNTFYAKEYRATLEFYWAPFLVESNSDNPNFHIIHXRDHRCPSRIEAHTKHWKDVDYLIFNTYIWWMNTADIKVRRSNSRYWSENDEVPRIEAYGRVFKTWSDWLNDNIDPARTSVFFMTISPPHLSPQNWGNPDGIKCVGETLPYQNYSQPLDLYHDMRLYDLVVKVASSMEKVPVTVIDITRMSDYRKDAHTSLYTIRQGKLLTPKQKADPEKFADCIHWCLPGVPDVWNQILYTRILSKSSWHSNFSPPPSQSLPLPPQ

SEQ ID NO: 6366 - protein, 511 aa, Zea mays
  unsure (1)..(511): unsure at all Xaa locations
MEAPSLTKPNDPTKPSNTSSTLSLEGGPGEASPLRKMFAVASIAAGIQFGWALQLSLLTPYVQLLGVPHAAASFIWLCGPISGLVVQPIVGYYSDHCTSRFGRRRPFILGGALAVAIAVFLIGYAADIGHSAGDDITKKTRPRAVGVFVIGFWILDVANNMLQGPCRAFLADLAAGDQQKTRIANGFFSFFMAVGNVLGYAAGSYSGLHKIFPFTETKACDVFCANLKSCFFFSILLLLFLATVALLYVKDKQVEAIPLDDATQPSCFFQLFGALKELKRPMWMLMLVTAVNWVGWFPYFLFDTDWMGREVYGGTAGEDAYAKGVRVGSLGLMVNAVVLGFMSLAVEPLGKMVGGVKRLWAIVNFILAIGFGMTVVITKVAEHQRRMNPAAVGHPSEGVVVGSMVFFGVLGVPLXITFSVPFALASIYCSASGAGQGLSLGVLNLAIVVPQMVVSALSGPWDSLFGGGNLPAFMVGAAAAALSAIMAIVLLPTPKPADEAKASSMMAGGFH

SEQ ID NO: 6367 - protein, 261 aa, Zea mays
  unsure (1)..(261): unsure at all Xaa locations
SLNICARDENVYMDKVAEQAEQDEEMAEYMXNAAKTAHVQHLTXQDRNLLSXAYKNVTAARRASWRIASXSIEPQEEPRTNEEHVNLIKEYRGKIEAELSNICDGILKLLDSHLVPSSTAAESKVFYLKMKGDYHRYLAEFKTGAERKESAESTMVAYKAAQDIALAELAPTHPIRLGLALNFSVFYYEILNSPDKACNLAKQAFDEAISELDSLGEESYKDSTLIMQLLRDNLTLWTSDLTEDGADEGKDAPKGDAGEGQ

SEQ ID NO: 6368 - protein, 223 aa, Zea mays
MTWNRSAADGGGSSAGTTAGDDTGLARLRELGYKQELKRDLSVLSNFAFSFSIISVLTGITTLYNTGLNFGGPATMTFGWFVAGAFTMAVGASMAEICSSFPTSGGLYYWSARLSGKRWAPFASWITGWFNGVGQWAVTTSVDYSLAQLIQVIILLATGGKNGGGYLASKYMVIGFHAAILLSHAVINSLPITFLSFFGQFAAAWNMLGNHSTFFYGGNDGGG

SEQ ID NO: 6369 - protein, 201 aa, Zea mays
TPSGVFVILMLIGYIIYAAWNRYDSVTEDCRKMKALKKRAEAADVAKSQFLATVSHEIRTPMNGVLGMLDMLLDTELKSTQRDFAQTAQICGKALISLINEVLDRAKIEAGKLELESVPFDLRSILDEVVSLFSSKSREKGIELAVYVSERVPEILLGDPGRFRQIITNLVGNSIKFTERGHIFVQVHLADHSNLATEPKV

SEQ ID NO: 6370 - protein, 247 aa, Zea mays
  unsure (1)..(247): unsure at all Xaa locations
MADLQTPLVRPKRKKVLVDYLVQFRWILVIFVVLPASALIYFNIYLGDMWSAMKSEKKRQKEHEDNVQKVVKRLKQRNPKKDGLVCTARKPWIAVGMRNVDYKRVRHFEVDLSAFRNILEIDPERMVAKVEPLVNMGQISRATCPMNLSLAVVAELDDLTVGGLINGYGIEGSSHIYGLFSDTVVALEIVLADGRVVRATKDNEYSDLFYGXPWSQGTLGFLVSAEIKLIPIREYMRLTYTPVKGPL

SEQ ID NO: 6371 - protein, 176 aa, Zea mays
  unsure (1)..(176): unsure at all Xaa locations
MVVDTVSASTSIIAPHLFDHRSRGAGASHHHLRRTFHVVACRHLPTAFAGRRLVARVTRQPSSRLADWPVRALAMGVTKEVRASPRREYRGIPGDGGDMGDVFGVTSPTPSWPPRNRADDPKLHNPLLRLERMGCGWLGVIFEWEGVXLEDDAELESRAWLTLAQEEGXKSPPSAF

SEQ ID NO: 6372 - protein, 360 aa, Zea mays
  unsure (1)..(360): unsure at all Xaa locations
FFFFLLPCPRCNSADTKFCYFNNYNAKQPRHFCKRCQRYWTAGGAMRNVPVGAGRRKNKNAAASHSHLLHRTTTTANGAMLSFAPPGPGLACLCLDLAAQFGHLAPVRDAAGTPSRPCTCSEGSTDRDGTSSVVDESAASGDGPVQLHHHPASVNTGWPPYSSPPPAAPYFSPGISIPVYPAAPGYWGCMVPGAWSLPWPVQPQPPSSRSQGQGLSSSSSPPPPTTTTIGTPSVSSSSGAADFDSHALGLGLGKHPRDRDGDDGRKRNGSAHGSGSAKVWAPKTIRIDDVDEVARSSIWSLVGVRGDREQQGAAAQVXKLGTVFEPRGLQATKKAMATSSPLLHANPVALTRSVAFHEGS

SEQ ID NO: 6373 - protein, 245 aa, Zea mays; identical to SEQ ID NO: 1093

SEQ ID NO: 6374 - protein, 312 aa, Zea mays
MSGKQQDKSFMGMPGFVVDFLMGGVSAAVSKTAAAPIERVKLLIQNQDEMLKSGRLDRKYGGIVECFSRTAKNEGVLSLWRGNTANVIRYFPTQALNFAFRDTYKSMFAYKKERDGYAKWMAGNLASGGAAGATSLLFVYSLDYARTRLANDAKSAKKGGERQFNGLVDVYKKTLASDGIAGLYRGFMPSVAGIVVYRGLYFGMYDSIKPVVLTGNLQGNFFASFALGWIVTTGAGIASYPLDTIRRRMMMTSGEAVKYKNTMDAARQIVAKEGVKSLFKGAGANILRGVAGAGVLSIYDQLQVLLFGKAFK

SEQ ID NO: 6375 - protein, 215 aa, Zea mays
IRLESMFAYKKERDGYAKWMAGNLASGGAAGATSLLFVYSLDYARTRLANDAKSAKKGGERQFNGLVDVYKKTLASDGIGGLYRGFMPSVAGIVVYRGLYFGMYDSIKPVLLTGSLEGNFLASFALGWAVTTGAGIASYPLDTIRRRMMMTSGEAVKYKGTMDAARQIVAAEGVKSLFKGAGANILRGVAGAGVLSIYDQAQLILFGKKFKGGSG

SEQ ID NO: 6376 - protein, 515 aa, Zea mays
MASADLAEAMEPGKKSNVKYASVCAIMASMACVILGYDIGVMSGAAIYIKKDLKITDVQLEILIGIISLYSLFGSFAGARTSDRIGRRLTVVFAAVIFFVGALLMGFSVNYGMLMVGRFVAGVGVGYGGMIAPVYTAEISPAASRGFLTSFPEVFINLGILLGYLSNFAFARLPLHLGWRVMLGIGAVPSALLALLVFCMPESPRWLVLKGRLADARVVLERTSATPEEAAARLADIKAAAGIPRDLDGDVVAVPNKGRDGGSSETQVWKQLILSPTPAVRRILLSAVGLHFFQQASGSDSVVQYSARLFKSAGITDDNKLLGVTCAVGVTKTFFILVATFLLDRAGRRPLLLTSTGGMIVSLIGLGTGLTVVGHHPDAKIPSAVALCIASTLAYIAFFSIGLGPITGVYTSEIFPLQVRALGFAVGVASNRVTSAVISMTFLSLSKAITIGGSFFLYSGIAAVAWVFFFTCLPETRGRTLEEMGKLFGMPDTGMAEEAEDAAAKEKVVELPSSK

SEQ ID NO: 6377 - protein, 252 aa, Zea mays
  unsure (1)..(252): unsure at all Xaa locations
MATAGKVIKCKAAVAWEAGKPLSMEEVEVAPPQAMEVRVKILFTSLCHTDVYFWEAKGQTPMFPRIFGHEAGGIVESVGEGVTELAPGDHVLPVFTGECKECPHCKSAESNMCDLLRINTDRGVMIGDGKSRFSIDGKPIYHFVGTSTFSEYTVMHVGCVAKINPEAPLDKVCVLSCGISTGLGASINVAKPPKGSTVAIFGLGAVGLAAAEGARIAGASRXIIGVDLNAXSRFEEARKFGCTEFVNPKDHT

SEQ ID NO: 6378 - protein, 314 aa, Zea mays
LACLQHFSINNLGDPFIESNYGVHSRQFEVGVLDWFARLWELEKDEREVFPDGILYASHCADFQRKLLQNRDKPAIINVNIGTTVKGAVDDLDLVIKTLEENGFKDRFYIHCDGALFGLMIPFVKKAPQVTFKKPIGSVSVSGHKFVGCPMPCGVQITRLEHINALSSNVEYLASRDATIMGSRNGHAPIFLWYTLNRKGYRGFQKEVQKCLRNAHYLKDRLKEAGIGAMLNELSSTVVFERPKDEEFVRRWQLACEGNIAHVVVMPSVNIDKLDYFLNELVDKRATWYQDGISQPPCIARDVGVENCLCGLHK

SEQ ID NO: 6379 - protein, 142 aa, Zea mays
IGYLEAGLACEGLKPFCAIYSSFLQRGYDQVVHDVDLQKLPVRFAMDRAGLVGADGPTHCGAFDVAYMACLPNMVVMAPSDEAELCHMVATAAAIDDRPSCFRYPRGNGVGVPLPPNYKGTPLEVGKGRILWGGPRAGCSLS

SEQ ID NO: 6380 - protein, 139 aa, Zea mays
IGYLEAGLACEVLKPFCAIYSSFLQRGYDQVVHDVDLQKLPVRFAMDRAGLVGADGPTHCGAFDVAYMACLPNMVVMAPSDEAELCHMVATAAAIDDRPSCFRYPRGNGVGVPLPPNYKGTPLEVGKGRILLEGDPGGR

SEQ ID NO: 6381 - protein, 303 aa, Zea mays
  unsure (1)..(303): unsure at all Xaa locations
PVFSCSARYDELASKSNVEYIAGGATHSARGVAQWMLQIPGASSYIGCIGKDKFGEEMKKNAQAAGINAHYHEDDNAPTGTCAVCVVGGERSLIANLSAANCYKSEHLKKPENWALVEKAKYIYIAGFFLTVSPDSIQLVAEHAAATNKVFMIPRAPPRVXEVFRDAQEKALPYVDYIFGNETEARTFAKVRGWEIENVEEIALKISQLPKASGTHKRITVITQGCDPVVVADDGKVKTFPVILLPKEKLVDTNGAGDAFVGGFLSQLVQEKSIDECVRAACYAANVVIQRSGCTYPEKPDFN

SEQ ID NO: 6382 - protein, 324 aa, Zea mays
MSSQTGGGKESDAGPGQHRQMQSLARQGSLYNLTLDEVQNHLGEPLLSMNFDELLKSVFPDGVDSDGAVTGKPDRTSSLQRQGSILMPPQLSKKTVDEVWKGIQGGPETSTVVDGLQRRERHPTLGEMTLEDFLVKAGVVTEGLVKDSADFPSNMDTAGSSVVVAAASSLNPGAQWLQQYQQQVLGSQQLSLAGSYMASQLRPQPLSIATGATLDSIYSDDQITSPSFGALSDPQTPGRKRGALGEVVDKVVERRQKRMIKNRESAARSRARKQAYTNELENKVFRLEEENKRLKKQQELDEILSSAPPPEPKYQLRRTGSAAF

SEQ ID NO: 6383 - protein, 481 aa, Zea mays
MATTRPRGGGGAASGALVMAIVVLLLLPPYGAGAEECEDGGISSRARAGDRVEALPGQPAVAFAQYSGYVAVDRDRGRALFYWLTEAVGDDAAAKPLVLWLNGGPGCSSVAYGASEEIGPFRIKPNGTGLFLNKYSWNREANLLFLESPAGVGFSYANTTSDLKTSGDERTAQDALQFLVSWMSRFPQYRHRDFYIAGESYAGHYVPQLARKIVEYNEASPHPFINLKGILVGNAVTDNYYDNIGTVTYWWTHAMISDRTYKAILRWCNFSSSSISRPCNRAMSYAMNHEFGDIDQYSIYTPSCAAAAARANATVLRFKNTLVRRRRSSGYDPCTETYAERYYNRMDVQRAMHANTTGIPYRWTACSDVLIKTWQDSEFSMLPTYKKLMKAGLRIWVFSGDTDSVVPVTATRFAISHLGLKIKTRWYPWYSAGQVGGWSEVYEGLTFASVRGAGHEVPLFQPRRAFRMFRSFLAGEPLPKS

SEQ ID NO: 6384 - protein, 293 aa, Zea mays
KVSFLVDKQGAQEVMDYLPKKLNRRGVNVKIVYSRGNALHVLPRGAGKGQALVYLLKKLDSSGKPPKNTLVCGDSGNDAELFGVPSVHGVMVCNAQEELVQWYQENARDNPRIIQATERCAAGIMQAIGHLGLGPNVSARDLVGFPAYYPNNNKKGAAATAKPADVVVRFYVLYEKWRRGELPSSNSSSSSAMRYLHPNGTIIHPCGSERSLHASIDALLSSCYGDKKNFRVWVDRLVTSPIGTSSWLARFDSWEMEGGVRYCCRTTILLNIKSPEGLELTHIHKTWVQGHSA

SEQ ID NO: 6385 - protein, 302 aa, Zea mays
  unsure (1)..(302): unsure at all Xaa locations
MGGFVKTQKTNAYFKRFQVKFKRRRAGKTDYRARIRLINQDKNKYNTPKYRFVVRFTNKDIIAQIVSASITGDIILAAAYSRELPRYGLEVGLTNYAAAYCTGLLLARRVLKIRDLDQEYEGNVEATGEDFSVEPAEERRPFRALLDVGLIRTTTGNRVFGALKGALDGGLDIPHSDKRFAGFKKDDKQLDADIHRKYIYGLHVAEYMKNLADEEPEKYQAHFSEYIKKGIEADDMEALYKKVHAAIXRADPSMAKSTKAQPKEHKRHNPKKLTYEQRKARLVERLNALNSSGGVDDDEDDE

SEQ ID NO: 6386 - protein, 174 aa, Zea mays
  unsure (1)..(174): unsure at all Xaa locations
MMMLIDCSRCRTPLQXPHGAPCIRCAICGAITHVAPAPPVEPNRGAVQPPPGWGPPPPPVHGRKRAVVCGISYRHSRYELKGCINDVKCMRHLLMTRFNFPDDSIIMLNGRLKKKDKYMNMLAWPFWIIYDVQVENXDNQKEEEQTDPYKIPTKHNIGMAMYWLVQGCQPGDSL

SEQ ID NO: 6387 - protein, 582 aa, Zea mays
MRLPLPLLALVCCALMARQHCAAAAGKGKARHLRWEISNMFWSPDCEEKVVIGINGQFPGPTIRARAGDTVHVQLRNALHTEGVVIHWHGIRQIGTPWADGTAAISQCAINPEETFTYRFVVDKPGTYFYHGHYGMQRAAGLYGSLVVDVAEGEEEPFQYDGELNLLLSDWYHESIHTQMVALSSRPFRWIGEPQSLLINGRGQFNCSLAAAHTQGATNQCAATAANTQCAPVVLPVQPNKTYRLRVASTTSLASLNLAIGNHKLTVVEADGNYVDPFVVDDIDLYSGDSYSVLLTTDQDTSSNYWVSVGVRGRLPKTAPALAVLNYRPNRASDLPALAPPVTPAWDDYGHSKAFTYRIRARAGTPPPPPTAARRIELLNTQNRMDGRIRWSINNVSMVLPATPYLGSLKMGLKSTLAAARPAETFSREYDVTLPPPNPNTTVGDNVYVLAHNTTVDVLLQNANALSRNVSEVHPWHLHGHDFWVLGYGDGAYRGDAADEARLNLRDPPLRNTAVIFPYGWTMLRFVADNPGVWAFHCHIEPHLHMGMGVIFAEAVDLVAKVPNEAVSCGATATALMAGGHL

SEQ ID NO: 6388 - protein, 225 aa, Zea mays
MKERLVGVSEETTTGVKRLYQMQESGTLLFPAINVNDSVTKSKFDNLYGCRHSLPDGLMRATDVMIAGKVAVVCGYGDVGKGCAAALKQAGARVIVTEIDPICALQALMEGIQILTLEDVVSDADIFVTTTGNKDIIMVDHMRKMKNNAIVCNIGHFDNEIDMNGLETYPGVKRITIKPQTDRWVFPETNTGIIVLAEGRLMNLGCATGHPSFVMSCSFTNQVIA

SEQ ID NO: 6389 - protein, 344 aa, Zea mays
MGILCLGASSTLLCGEDRNNVLGLGCGNELVEVGSGHDGLDSVVGAVFPVDTDEAVRALLEKETDHKPQDGYAERLERGGLEYSWRRDAMDWICKVHSYYRFGPLSLYLAVNYLDRFLSSYDLPHDKPWMRQLLSVACLALAVKMEETVLPLPVDLQVCDVKFEFEARTIGRMELLVLATLKWRMQAVTPFTFISYFLDKFNGGKPPSMALASRCTEIIIGTLKGSTFLSFRPSEIAAASALAAVSENQVVGSSSALSASEVPINKEMIARCYELLQEQALVRKTGHINGSPSVPQSPIGVLDATCFSFRSEDVRLGSSQSNNISSSSNDNQVSKRRRLSISPI

SEQ ID NO: 6390 - protein, 356 aa, Zea mays
MGRSPCCEKIGLKKGPWTPEEDQKLLAYIQEHGHGSWRALPVKAGLQRCGKSCRLRWTNYLRPDIKRGKFSLQEEQTIIQLHALLGNRWSAIATHLPNRTDNEIKNYWNTHLKKRLAKMGIDPVTHKSISGTRIGTTNDKSTKAAASLSHMAQWESARLEAEARLARESKIRTATPTPTALHAQPTILPASAASPCLDVLHAWQGAKIDLESPTSTLTFTGSNGGTLPTPRTNGLDVSESNCAMSHQRSDELEDEENDWQIFSKHQLLELDSKEREEDFIGCEEPWFSEMAGVGAGFTGMLLGVSNEHDASECWGESNNGQTERSNQASDEEDKNYWNGVLDMVNSELTPKSPPFV

SEQ ID NO: 6391 - protein, 205 aa, Zea mays
TSSRSRTENTEHKFVLNDRNKPIIFSMARLDRVKNLTGLVELYGRNKRLQELVNLVVVCGDHGNPSKDKEEQAEFKKMFDLIEQYNLNGHIRWISAQMNRVRNGELYRYICDTKGAFVQPAFYEAFGLTVVEAMTCGLPTFATAYGGPAEIIVHGVSGFHIDPYQGDKASALLVDFFDKCQAEPSHWSKISQGGLQRIEEKYALT

SEQ ID NO: 6392 - protein, 224 aa, Zea mays
MASNQNQASYHAGETKARNEEKTGQVMGATKDKAGQTTEATKQKAGETTEATKQKAAETTEAAKQKASETAEATKQKAAEAKDKTAQTAQAAKEKTYETAQSAKERAAQGKDQTASTLGEKTEAAKQKAAETTEAARQKAAEATEAAKQKASETAQYTKESAVAGKDKTGSVLQQAGETVVNAVVGAKDAVANTLGMGGDNTNTTKDNTTGATTKDTTTTTRNH

SEQ ID NO: 6393 - protein, 616 aa, Zea mays
  unsure (1)..(616): unsure at all Xaa locations
MAVMAEVVSTTGAALRSPATQQPAAAGAAKGTDAEKLQFIEDMTSNVDAVQERVLGEILARNADTEYLSSRCGLAGATDRATFRAKVPMATYEDLQPYIRRIADGDRSPILSGHPVSEFLTSSGTSGGERKLMPTIEDELNRRQLLYSLQMPVMNLYVPGMDKGKALHFLFVKSETKTPGGLAARPVLTSYYKSNHFRNRTRPLPXNILIEKSPTAAILCAXFQSMYAQMVCGLCQRQDVLRVGAVFASGLLRAIRFLQLNWEQLAEDIEAGSLTPRVTDPSVREAVAGILRPDPAVAELVRSECSGGDWAGIVTRIWPNTKYLDVIVTGAMAQYIPTLKHYSGGLPMACTMYASSECYFGLNLRPMCDPSEVSYTLMPNMCYFEFLPMGGAVDASQLVDLGRVERGREYELVITTYAGLNRYRVGDVLQVTGFHNSAPQFRFVRRKNVLLSIESDKTDEAELQRAVERASALLRPHGAAVVEYTSQAYTKSIPGHYVVYWELLQAKGGAAVDGETLEGCCLEMEEALNAVYRQSRVADGSIGPLEIRVVRPGTFEELMDYAISRGASINQYKVPRCVTFPPIIELLDSRVVSSHLSPALPHWTAGQRSGSGSGSD

SEQ ID NO: 6394 - protein, 253 aa, Zea mays; identical to SEQ ID NO: 5611

SEQ ID NO: 6395 - protein, 68 aa, Zea mays
  unsure (1)..(68): unsure at all Xaa locations
MSPSEPTREESVYMAKLAEXAERYEEMVEFMERVARYAGAAGGGDQLSVEERNLLSGPYKNVIGARRA

SEQ ID NO: 6396 - protein, 181 aa, Zea mays
MAYGKRSRQKAEEMVWLPDGADVARFLLLFSGHQHYHGDGMAASAPERVFECKTCNRQFPSFQALGGHRASHKKPRLSDGVDAAAAEPPKPKVHGCSICGLEFAIGQALGGHMRRHRAADQTDGGSLGTGLTPKYDSGKTAASPAELVLDLNAVPELEEEQDHAKLELSIEPVAVVDFHAR

SEQ ID NO: 6397 - protein, 252 aa, Zea mays
  unsure (1)..(252): unsure at all Xaa locations
SRPAGIELPLSATPLIADSINDRKRKERLDSVSEETTTIVXRLYHMYESGVLLFPAINVYDSPTDSKIDNLYGCRHSLPDGLMRATDAXIAVKVTVVCGYIDVDNDCAAVLKQDVVRAIVDEIDPICGLQDLMEGLQNLLLXMLALKTDIFXVTTNGNKDIIMPDHMKKIKNNAVVCNIGHFDNENDMLLLEYYPEDXRINIKPHTDRCVFPDNNTAIIVLDXGRLMNLGCATDHPNSDMLWSFTNHVIAQL

SEQ ID NO: 6398 - protein, 235 aa, Zea mays
  unsure (1)..(235): unsure at all Xaa locations
MCGGAIISEFIPHRGAKRGLCAEDIWPHAAADFDDLLHAHAHAHGHDDDDFAAAASFHPDQEPPARKRERKTMYRGIRRRPWGKWAGEIRDPAKGARVWLGTFATAEAAARAYGXAARRIRGAKAKVNFPNEDPPPEYDDDDDGHAHAHAAAAQGMLAMSAGGGRDDHLVDYDVVDVMGMGGFFQHHAYVPDAVAQQEQVPTVAYVHHQPPPQQPQGAAGMDMWTFDAINTPVPM

SEQ ID NO: 6399 - protein, 315 aa, Zea mays
MSSAEPQKVLGMPPFVADFLMGGVSAAVSKTAAAPIERVKLLIQNQDEMLKTGRLDRKYNGIGDCFKRTMADEGVMSLWRGNTANVIRYFPTQALNFAFRDKFKKMFGYKKDKDGYAMWMAGNLASGGAAGATSLLFVYSLDYARTRLANDAKNAKSGGDRQFNGLVDVYKKTLASDGIAGLYRGFMPSVAGIVVYRGLYFGMYDSIKPVVLTGSLEGNFLASFALGWAVTTGAGIASYPLDTIRRRMMMTSGEAVKYKGTMDAARQIVAAEGVKSLFKGAGANILRGVAGAGVLSIYDQAQLILFGKKFKGGSG

SEQ ID NO: 6400 - protein, 175 aa, Zea mays
MEALFGCNKHGGDKAADLASFIIVQAALEVPRLLGLLAMILHNEIFTSGGDQNLINRILSKNKNATDFENKDDGESDDDNDEEGDDEDAENQEDDGGDEGSDDNGNEEEDDDDDDDDPAANGEGGSDDDDDGGEDEEEEDDDDDDGDDGNEEEEEESEEDDDDDEVPQPPTKKRK

SEQ ID NO: 6401 - protein, 129 aa, Zea mays
  unsure (1)..(129): unsure at all Xaa locations
MSWEDNAYLHKLDAQVERHEXMVDHMENVAKTVYVEELTVDEHNLLSVDYHNVIGDRRASWSIISSIXHKEDSRNNEEPVIQIKEYRGKIGAEMSNICDGILKVIDSHLVTSSTGAEAKVVYLLMKGDY

SEQ ID NO: 6402 - protein, 319 aa, Zea mays
MSINSKISNVKGIDVELWTQDGLPSAQLLKLMRDVVAGLVHLHNLGIIHRDLKPQNVLISAEGPIRAKLSDMGISKHLQDDMTSVSHHGTGIGSSGWQAPEQLRHGRQTRAMDLFSLGCLIFYCITKGKHPFGEYYERDVNIANNRFDLFMVDYIPEAVHLISQLLQPNPEARPTAVYVMHHPLFWSPELRLSFLRDTSDRIEKTSETDLINALESIGPVAFGGKWGEKLDAALVTDMGRYRKYNFESTRDLLRYIRNKSGHYRELSNDLKGILGSLPEGFDHYFASRFPKLLIEVYKVLWVHCKDEEAFSKHFNGSSL

SEQ ID NO: 6403 - protein, 925 aa, Zea mays
MRSLRGVLIPLVLLAGLAFRVDDGGAALLPLPPPALPASPSRLALPGGTPKDDGAAASRSTEVVTAGVRSTEIVAPVGPKKQSLRELLVRPQPARHEPSSLVSGEAKAETRSVLQFYDNGTIQLVDKLSQSPLWEIATGPPLSDHITTTESGPNYLIYPFNGNENMNGNSTELWEVYNGNSVRLPWKLEEFVARSPYIRDSVVTIGSKVSTVFVVDADSGEIIYRHSIPSALKELEGPGVEGAPSKLNVRTSDDSDNIIVLVRTDYSLSASDLGNHLFNWTRTSFTANYYVKYKHPDMLDQSSCLQGDIPCIRTEGLPLALPDLNSANVIVLKDGTPFVSMHGSDALEPVQTPRKLPNTAGKSNILLDDSQNQTHDVARSHAISADPEATLNPTRNTSGWLFPLFPIFLVTGYLLSLISASKSCRQFMIQLIEPFTHNKKSVDIRGRSEGTPKKRKTRKKDGLVNSSETLTASDKECSDTGGSTEAPMKNSALTDALGGRQIGKVYVSNKEIGRGSNGTIVFEGSYDGRQVAVKRLLRSHNDIAEKETRNLIISDHDPNIVRLYGCDHDSDFVYISLERCHCSLADLIQKQSYLSSGESISNNEVSMSINSKISNVKGIDVELWTQDGLPSAQLLKLMRDVVAGLVHLHNLGIIHRDLKPQNVLISAEGPIRAKLSDMGISKHLQDDMTSVSHHGTGIGSSGWQAPEQLRHGRQTRAMDLFSLGCLIFYCITKGKHPFGEYYERDTNIVNNRFDLFVVDYIPEAVHLISQLLQPNPETRPTAVYVMHHPLFWSPELRLSFLRDTSDRIEKTSETDLINALESIGPVAFGGKWGEKLDAALVTDMGRYRKYNFESTRDLLRYIRNKSGHYRELSNDLKGILGSLPEGFDHYFASRFPKLLIEVYKVLWVHCKDEEAFSKHFNGSSL

SEQ ID NO: 6404 - protein, 444 aa, Zea mays
TRRKRRRRAARPRRRRRDLAQRRPCWSSASSSGAIATRPGADEDEDATPSPPPRHRHQHQQQLVTRELFPAGAGPPAPTPRHWAELGFFRADLQQQQAPGPRIVPHPHAAPPPAKKSRRGPRSRSSQYRGVTFYRRTGRWESHIWDCGKQVYLGGFDTAHAAARAYDRAAIKFRGVDADINFNLSDYEDDMKQMGSLSKEEFVHVLRRQSTGFSRGSSRYRGVTLHKCGRWEARMGQFLGKKYIYLGLFDSEVEAARAYDKAAIKCNGREAVTNFEPSTYHGELPTEVADVDLNLSISQPSPQRDKNSCLGLQLHHGPFEGSELKKTKIDDAPSELPGRPRQLSPLVAEHPPAWPAQPPHPFFVFTNHEMSASGDLHRRPAGAVPSWAWQVAAAAPPPAALPSSAAASSGFSNTATTAATTAPSASSLRYCPPPPPPSSHHHPR

SEQ ID NO: 6405 - protein, 314 aa, Zea mays
EVQHVDAVFTSLGLLYSFCVSDYLPWLLGLDLDGHEKMVKEANERVTRLHDAVIDERWRLWKSGDRRELEDFLDVLIMLKDAEAGRPVLSIEEVKALLMDITFASMDNPSNAVEWALAEMVNNPTMLKKAVDEIDSVVGQERLVQEHDIPRLNYTKACIREAFRLHPVAPFNVPHVAVADATVAGYRIPKGSHVILSRTGLGRNPDVWDDPLRFDPERHIPLSPEMEVSLVERDLRFISFSTGRRGCIAAALGTDMTIMLFARLLQGFSWSKMTGVAAIDLSESRHNTFMARPLVLQAKPRLPAHLYPGILLCK

SEQ ID NO: 6406 - protein, 522 aa, Zea mays
MERVAAAKKSIESHYRSQMKNIQERKERRFRLERQLASSQVPKEQQINLMKDLERKETEYMRLKRHKICVEDYELLTVTGDMRLKEHKICVDDFELLTIIGRGAFGEVRLCREKTSGNIYAMKKLKKSDMVVRGQVEHVRAERNLLAEVASHCIVKLYYSFQDTEYLYLIMEYLPGGDIMTLLMREDTLTEHVARFYIAETILAIQSIHKHNYIHRDIKPDNLLLDKNGHMKLSDFGLCKPIDCSKLSTLNEDEPMGDDNMRESMDIDSSLSNTANGRRWRSQHEQLQHWQMNRRKLAFSTVGTPDYIAPEVLLKKGYGMECDWWSLGAIMYEMLVGYPPFYADDPITTCRKIVHWRNHLKFPEDAKLSNEARDLICRLLCDVDHRIGSAGADQIKAHPWFQGVAWDKLYEMEAAFKPQVNDELDTQNFMKFEELENPPAKTGSGPSRKMMLNSKDLSFVGYTYKNFDAVKAIKISDLQRNSSLTRPSIGSIFGPSGMDSPMEPNGRDTHMHTVSSGDPMIP

SEQ ID NO: 6407 - protein, 338 aa, Zea mays
MVGTAEGGAERAVRRWVDAAGGRLVLDGGLATELEANGADLNDPLWSAKCLLSSPHLIRKVHMDYLEAGANIIITASYQATIQGFESKGFSKEQSENLLTKSVQIAVEAREMFLKEHLEKSTPIQHPILVAAALGSYGAYLADGSEYSGDYGEAGTKEFLKDFHRRRLQVLAEAGPDLIAFETIPNKLEAQAYVELLEECNINIPSWLSFNSKDGVHIVSGDSLIECTTIADKCAKVGAVGINCTPPRFIHGLILSIRKVTDKPILIYPNSGERYDGEKKEWVESTGVSDGDFVSYVNEWCKDGAALIGGCCRTTPNTIRAIQRTLNQGCNKHQLPVA

SEQ ID NO: 6408 - protein, 355 aa, Zea mays
MVGTAEGGAERAVRRWVDAAGGRLVLDGGLATELEANGADLNDPLWSAKCLLSSPHLIRKVHMDYLEAGANIIITASYQATIQGFESKGFSKEQSENLLTKSVQIALEAREMFLKEHLEKSTPIQHPILVAAALGSYGAYLADGSEYSGDYGEAGTKEFLKDFHRRRLQVLAEAGPDLIAFETIPNKLEAQAYVELLEECNINIPSWLSFNSKDGVHVVSGDSLIECATIADKCAKVGAVGINCTPPRFIHGLILSIRKVTDKPILIYPNSGERYDGEKKEWVESTGVSDGDFVSYVNEWCKDGAALIGGCCRTTPNTIRAIHRTLNQGCHKHQLPVGCSIDLCSTPDALLPAVP

SEQ ID NO: 6409 - protein, 182 aa, Zea mays; identical to SEQ ID NO: 5814

SEQ ID NO: 6410 - protein, 266 aa, Zea mays; identical to SEQ ID NO: 6168

SEQ ID NO: 6411 - protein, 268 aa, Zea mays; identical to SEQ ID NO: 5447

SEQ ID NO: 6412 - protein, 419 aa, Zea mays
MAEAWGKLHLPSHPQIVTAQASPPHVPRPHLVHAANTISTQPELLTCSTVHPPPSHNADHTYSLPHRTPRRAPRSFGRHVIPLTCGPRTRCPGFASSNAPTRPPIASPTSAQTRRFRSTGSSAPPTTVRPSVLPATPIRRPVPSHHTLPPLAAMSPSEPTREESVYMAKLAEQAERYEEMVEFMERVARSAGGAGGGEELSVEERNLLSVAYKNVIGARRASWRIISSIEQKEEGRGNEAHAASIRAYRSKIETELARICDGILALLDSHLVPSAGGAESKVFYLKMKGDYHRYLAEFKSGAERKDAAESTMNAYKAAQDIALADLAPTHPIRLGLALNFSVFYYEILNSPDRACNLAKQAFDEAISELDSLGEESYKDSTLIMQLLRDNLTLWTSDTNEDGGDEIKDAAAPKESAEGQ

SEQ ID NO: 6413 - protein, 332 aa, Zea mays
MGRSPCCEKEAGLKKGPWTSEEDQKLLAFIEQHGHGCWRSLPAKAGLRRCGKSCRLRWTNYLRPDIKRGKFTLQEEQTIIQLHALLGNRWSSIATHLPKRTDNEIKNYWNTHLKKRLAKMGIDPVTHKARADVVGGSSGAGNNSGARYRAAAHLSHTAQWESARLEAEARLAREARLRALASPPPPPGPGPGPAFSGLESPTSTLSFSESVLFASAAHDTHALTSRAYAEAFGAEQQQRFADTAAAADAAPGFLAGVLLGCSVAGAEKGFAASSTDASVCEQQQEEEDKGYWSSILNMVNSSMSSSTSSLTSDAVTDPAAAYLPPATAAAEF

SEQ ID NO: 6414 - protein, 722 aa, Zea mays
MDDESKSAPKSDVNTDAGAEAAAAAAPLPPSSSETAETEARVEAADGESQVVERLVELVSEIAAISDFRNSYRRQFCNLSRRIRLLVPMLEEAKEAPTPLTVASEAALRRLREALHAARDLLQLGSSGSKIFLVLDREKIMKTFQDVTASLEQALAGISFDELNISDEVREQVELVHTQFKRAKERSDSSDDDLFNELMSLCNSSSSDSVDPDTLRRLSEKLQLVTIYDLNHESLTLHEMASGGDPGAVVEKMSMLLKRIKDFVQTEDPEMGAQASTATISTNDNSACPVIPDDFRCPISLDLMKDPVIVATGQTYERGYIEMWLEAGHDTCPKTQQKLANKSLTPNYVLRSLITQWCEANGIEPPKRPAQLRDAPLSCSAAEHSNVLELLQKLSSQNLEDQRGSAGMLRQLAKRSAENRACIGDAGAIPILVSLLSTTDVSTQEHVVTALLNLSIYEENKARIISSGAVPGIVHVLKRGSMEARENSAATLFSLSIVDENKVTIGCSGAIPALVQLLSNGSQRGKKDAATALFNLCIYQGNKGKAVRAGLVPILLELLMETESGMVDEALAILAILSGHPEGKTAIGAASAIPVLVGVIRNGSPRNKENAAAVMVHLCSGEQQQQHLAEAQEQGIVSLLEELAESGTDRGKRKAVQLLERMNRFLKQQSQAEAEAEAMAQAHAHAQAQAQAQPQILVQAQAHADMQAERSLLPTSSDISDR

SEQ ID NO: 6415 - protein, 232 aa, Zea mays
  unsure (1)..(232): unsure at all Xaa locations
MLLNPASMLDTIRQHLLEEPPAAADESFGILVADQWSDSLPFRTDDADDMVVFGALQDAFAYGWLPDGSFAHVKPEPVRSPDSSFYSYXAPASAASRTRSSHCPAARGRRQGRRGVSQRPWGRVGAENGDPGRTGARAGLGTYDTARDAALAYDRAPCRRRGSRALLNFPLRIGSGDKRPSPAPPEPATSSDSSSSSASGSHKRRKQGEAAAANMALALVPPPSQLNRAPEP

SEQ ID NO: 6416 - protein, 262 aa, Zea mays
  unsure (1)..(262): unsure at all Xaa locations
MADRANHPSVMQKFGGQFHLASSFSEGVRARNICPSVPSYERRFTTSSYMTQNLGISVPMMSSSPLFANAPPEKKGVKNFAIDFLMGGVSAAVSKTAAAPIERVKLLIQNQDEMIKAGRLSEPYKGIGDCFGRTIKDEGFGSLWRGNTANVIRYFPTQALNFAFKDYFKRMFNFKKDKDGYWKWFGGNLASGGAAGASSLXFFVYSLDYARTRLANDAKAXKGGGDRQFNGLVDVYRKTLKSXDGIAGLYRGFTSPVLNHCL

SEQ ID NO: 6417 - protein, 111 aa, Zea mays
MMIRRGSSNISSPLALLCLLLLLLLLVCSSSNCAAAARLLPAGPLPPLRAAAPSGGDEHSAASEVTTQDTTKGAAEACEEGNDDKDECVQRRLLLDAHLDYIYTQHKGNKP

SEQ ID NO: 6418 - protein, 221 aa, Zea mays
  unsure (1)..(221): unsure at all Xaa locations
MATSEPVQESLVVHYSQPSRPRVLLAASGSVAAIKFESLCRSFSEWADVRAVATTPSLHFVDRSSLPSGIVLYTDDDEWSTWKKIGDEVLHIELRKWADVMVIAPLSANTLAKIAGGLCDNLLTCIVRAWDYSKPLFVAPAMNTLMWNNPFTERHLHTINQLXGIALIPPVTKRLACGDYGNGAMAETSQIHTSVRLACKTQPHDASSSLAGPVSNNRPSS

SEQ ID NO: 6419 - protein, 220 aa, Zea mays
MATSEPVQESLVVHYSQPSRPRVLLAASGSVAAIKFESLCRSFSEWADVRAVATTSSLHFVDRSSLPSGIVLYTDDDEWSTWKKIGDEVLHIELRKWADVMVIAPLSANTLAKIAGGLCDNLLTCIVRAWDYSKPLFVAPAMNTLMWNNPFTERHLHTINQLGIALIPPVTKRLACGDYGNGAMAETSQIHTAVRLACKTQPHDASSSLAGPVSNNRPSS

SEQ ID NO: 6420 - protein, 220 aa, Zea mays
MATSEPVQESLVVHYSQPSRPRVLLAASGSVAAIKFESLCRSLSEWADVRAVATTSSLHFVDRSSLPSGIVLYTDDDEWSTWKKIGDEVLHIELRKWADVMVIAPLSANTLAKIAGGLCDNLLTCIVRAWDYSKPLFVAPAMNTLMWNNPFTERHLHTINQLGIALIPPVTKRLACGDYGNGAMAETSQIHTSVRLACKTQPHDASSSLAGPVSNNRPSS

SEQ ID NO: 6421 - protein, 220 aa, Zea mays
MATSEPVQESLVVHYSQPSRPRVLLAASGSVAAIKFESLCRSFSEWADVRAVATTSSLHFVDRSSLPSGIVLYTDDDEWSTWKKIGDEVLHIELRKWADVMVIAPLSANTLAKIAGGLCDNLLTCIVRAWDYSKPLFVAPAMNTLMWNNPFTERHLHTINQLGIALIPPVTKRLACGDYGNGAMAETSQIHTSVRLACKTQPHDAGSSLAGPVSNNRPSS

SEQ ID NO: 6422 - protein, 220 aa, Zea mays; identical to SEQ ID NO: 5911

SEQ ID NO: 6423 - protein, 220 aa, Zea mays; identical to SEQ ID NO: 5911

SEQ ID NO: 6424 - protein, 278 aa, Zea mays
MYICRSGVLQILKLNCKMASAELSREENVYMAKLAEQAERYEEMVEFMEKVAKTVDSEELTVEERNLLSVAYKNVIGARRASWRIISSIEQKEEGRGNEDRVTLIKDYRGKIETELTKICDGILKLLESHLVPSSTAPESKVFYLKMKGDYYRYLAEFKTGAERKDAAENTMVAYKAAQDIALAELAPTHPIRLGLALNFSVFYYEILNSPDRACSLAKQAFDEAISELDTLSEESYKDSTLIMQLLRDNLTLWTSDISEDPAEEIREAPKRDSSEGQ

SEQ ID NO: 6425 - protein, 261 aa, Zea mays
MASAELSREENVYMAKLAEQAERYEEMVEFMEKVAKTVDSEELTVEERNLLSVAYKNVIGARRASWRIISSIEQKEEGRGNEDRVTLIKDYRGKIETELTKICDGILKLLESHLVPSSTAPESKVFYLKMKGDYYRYLAEFKTGAERKDAAENTMVAYKAAQDIALAELAPTHPIRLGLALNFSVFYYEILNSPDRACSLAKQAFDEAISELDTLSEESYKDSTLIMQLLRDNLTLWTSDISEDPAEEIREAPKHDSSEGQ

SEQ ID NO: 6426 - protein, 261 aa, Zea mays
MASAELSREENVYMAKLAEQAERYEEMVEFMEKVAKTVDSEELTVEERNLLSVAYKNVIGARRASWRIISSIEQKEEGRGNEDRVTLIKDYRGKIETELTKICDGILKLLETHLVPSSTAPESKVFYLKMKGDYYRYLAEFKTGAERKDAAENTMVAYKAAQDIALAELAPTHPIRLGLALNFSVFYYEILNSPDRACSLAKQAFDEAISELDTLSEESYKDSTLIMQLLRDNLTLWTSDISEDPAEEIREAPKRDSSEGQ

SEQ ID NO: 6427 - protein, 261 aa, Zea mays; identical to SEQ ID NO: 6425

SEQ ID NO: 6428 - protein, 123 aa, Zea mays
  unsure (1)..(123): unsure at all Xaa locations
ASSSTYLADDGFAAPLLXGVSYTYDDVIFLPGYIGFPADAVDLSXRLSRRIPLSIPCVASPMDTVSEAAMAAAMASLGIAAVVHCNTEPHAQAAIVRAAKSRRLPFVSAIVVQLEATNPVTDA

SEQ ID NO: 6429 - protein, 191 aa, Zea mays
  unsure (1)..(191): unsure at all Xaa locations
MASAELSREENVYMAKLAEQAERYEEMVEFMEKVAKTVDSEELTVEERNLLSVAYKNVIGARRASWRIISSIEQNEEGRGNEDRVTLIKDYPGKIETELTKICDGILKLLETHLVPSSTAPESKVFYLKMKGDYYRYLAEFKTGAERKXAAENTMVAYKAAQDLALAELAPTHPIRLGLALNFSVFYYENL

SEQ ID NO: 6430 - protein, 261 aa, Zea mays; identical to SEQ ID NO: 6426

SEQ ID NO: 6431 - protein, 261 aa, Zea mays; identical to SEQ ID NO: 6426

SEQ ID NO: 6432 - protein, 261 aa, Zea mays; identical to SEQ ID NO: 6426

SEQ ID NO: 6433 - protein, 205 aa, Zea mays
  unsure (1)..(205): unsure at all Xaa locations
MPRMAPTRPCLALARWVLLAAVAARLAGADDPYRYFTWIVTYGPINPLGTTQQGILINGQFPGPRIDCVTNDNLIVNVVNNLDEPFLITWNGIKQRKNSWQDGVAGTNCPIPPGANYTYKFQAKDQIGTFTYFPSVALHRAAGGFGALTVXYQRPAIPVXPYPAPAGDFTLXLVGDWDLAGHDQLRQTLGSXXALPVPRTRCSST

SEQ ID NO: 6434 - protein, 238 aa, Zea mays
  unsure (1)..(238): unsure at all Xaa locations
MAPRPWWSPLALPLGPIVALLVLACCVAEASVVEHTFNVGNLSVSQLCQPPRVITAVNGQLPGPAIHAREGDTVVVHLVNQSPYNITIHWHGIFQRGTPWADGPAMVTQRPVKPGGNYTYRFNATAQEGTLWWHAHISFLRATVYGALVLRPRAGADAYPFPKPHAEXPXLLGEWWNDNVYDLQQMAFLTGRPARSADAYTINGKPGDLYNCSXGNQTYRGQVXSNETYLLRIINAAL

SEQ ID NO: 6435 - protein, 256 aa, Zea mays
  unsure (1)..(256): unsure at all Xaa locations
MSREENXYMAKLAEXAERYXEMVEYXEKVAXTVXVEXLTVEERNPXSXAYKNXXWARRASXRIVSSIEQXEEXRKNEEHVNLIKEYRGKIXAXXSXXCXGILKXPXSHXVPXSXXAESKXFYLKXKGDYHRXLAEFKTCXERKESXXXTXVAXXAAQDXSLAEPAXTHXIRLGLAXNFSXFYYENXNXPDKACNLAKQXFXEXISXLDSLCEEXXKDSTXIMXLXRDNLTLWTTDLTEDGAEEGKNAXKXEAGEGQ

SEQ ID NO: 6436 - protein, 174 aa, Zea mays
MAAAEPSGSSQPGAPGRWSLHGKTALVTGGTRGIGRAVVEELAALGVAVHTCSRKEAELGERLKEWEARGFRVTTSVCDLSVREQRERLIADVAERFGGKLNILVNNVGTNIRKPTTEFSAEDYSFLMATNLESAYHLCQLAHPLLKASGLGSIVFISSVCGLVAVFSGTLYAM

SEQ ID NO: 6437 - protein, 558 aa, Zea mays
PRVRLEAPDPSTLEKFLGTIPMVFNVVILSPHGYFAQANVLGYPDTGGQVVYILDQVRAMENEMLLRIKQCGLDITPKILIVTRLLPDATGTTCGQRLEKVLGTEHCHILRVPFRTENGIVRKWISRFEVWPYLETYTDDVAHEIAGELQANPDLIIGNYSDGNLVACLLAHKMGVTHCTIAHALEKTKYPNSDLYWKKFEDHYHFSCQFTTDLIAMNHADFIITSTFQEIAGNKDTVGQYESHMAFTMPGLYRVVHGIDVFDPKFNIVSPGADLSIYFPYTESHKRLTSLHPEIEELLYSQTENTEHKFVLNDRNKPIIFSMARLDRVKNLTGLVELYGRNKRLQELVNLVVVCGDHGNPSKDKEEQAEFKKMFDLIEQYNLNGHIRWISAQMNRVRNGELYRYICDTKGAFVQPAFYEAFGLTVVEAMTCGLPTFATAYGGPAEIIVHGVSGYHIDPYQGDKASALLVDFFDKCQAEPSHWSKISQGGLQRIEEKYTWKLYSERLMTLTGVYGFWKYVSNLERRETRRYLEMLYALKYRTMASTVPLAVEGEPSSK

SEQ ID NO: 6438 - protein, 183 aa, Zea mays
  unsure (1)..(183): unsure at all Xaa locations
IDEGLSSLRTPNTANVIRYFPTLALNFACRDYFDSVLNFDKDRDAYCEGIASTLASGDAAAASXSLSCVYSLDYARTSVVTDAKTAKVXGDSGFNELEDVYRKTLICDGMAGLYRGFIISCGAINAYRDLDFGLYDSIEPVVLTGNLHYNFLCSLALYCLITNVAVLASYPNDTVRSTDDDDI

SEQ ID NO: 6439 - protein, 125 aa, Zea mays
ISFSSSMEVGIVPDNMATTDMPSSGILLTPAGAISLFSSGPPLQMPLHLASMDREARVLRYREKKKSRKFEKTIRYATRKTYAEARPRIKGRFAKRSSDMDVEVDQMFSAAALSSDGSYGTVPWF

SEQ ID NO: 6440 - protein, 336 aa, Zea mays
GVEGAPSKLNVRTSDDSDNIIVLVRTDYSLSASDLGNHLFNWTRTSFTANYYVKYKHPDIPCIRTEGLPLALPDLNSANVIVLKDGTPFVSMHGSDALEPVQTPRKLPNTAGKSNILMDDSQNQTHDVARSHAISADPEATLNPTRNTSGWLFPLFPIFLVTGYLLSLISASKSCRQLMIQLIEPFTHNKKSVDIRGRSEGTPKKRKTRKKDGLVNSSETLTASDKECSDTGGSTEAPMKNSALTDALGGRQIGKVYVSNKEIGRGSNGTIVFEGSYDGRQVAVKRLLRSHNDIAEKETRNLIISDHDPNIVRLYGCDHDSDFVYISLERCHCRHA

SEQ ID NO: 6441 - protein, 116 aa, Zea mays
  unsure (1)..(116): unsure at all Xaa locations
CFTFFVCKLAFNSKISLEIRVDSEKYEELIEFMEKVAKTVDSEEHYVLSIAYKIVXGTQCASWCIISSIEXGEEGRVNVDCVSLIEDYHNKIEVELIKICDGILKLLDSHRFRLIN

SEQ ID NO: 6442 - protein, 193 aa, Zea mays
  unsure (1)..(193): unsure at all Xaa locations
AGRKKEESRKNEEHVNLIKEYRAKIEAELSNICDGILKLLDSHLVPSFTAAESKVFYLKMKGDYHRYLAEFKTGPERKESAESTMMAYKAAQDIALAELAPTHPIRLGLALNFSVFYYEILNSXPDKACTLAKQAFDEAISQLDTXLGEESYKDSTLIMQLLRDNLTLWTSDLTEDGADEGKEAPKGEAGDGQ

SEQ ID NO: 6443 - protein, 141 aa, Zea mays
CLHIGHFDNEIDMNGLETYPGVKRITIKPQTDRWVFPETKTGIIVLAEGRLMNLGCATGHPSFVMSCSFTNQVIAQLELWNEKATGKYEKKVYVLPKHLDEKVAALHLGKLGARLTKLTKSQSDYISIPVEGPYKPAAYRY

SEQ ID NO: 6444 - protein, 211 aa, Zea mays
  unsure (1)..(211): unsure at all Xaa locations
MPTNLVFFWGNIFLGHPCPLLGSPLQKTGVDSTCQGSMAPGSKAERKAALDAXAWMFNVVTSVGIIMVNKALMATHGFSFATTLTGLHFAMTTLMTLVMKWLXYIQPSYLPLPELVKFAFFANLSIVGMNVSLMWNSVGFYQIAKLCIIPVLCILEIIFDKVRYSRDTKLSIVLVFIGVAVCTVTDVSVNSQGLLAAVIAVWSTALQQHAF

SEQ ID NO: 6445 - protein, 313 aa, Zea mays
  unsure (1)..(313): unsure at all Xaa locations
MGKEGASDGGMSESVIRKVLVSYMYVAVWIFLSFSVIVYNKYILDPKMYNWPFPISLTMVHMAFCSSLAVALVRVLRVVDLPSSPAMTSQLYISSVLPIGALYSLSLWFSNSAYIYLSVAFIQMLKALMPVAVYSIGVLFKKESFKSSAMLNMLSISFGVAIAAYGEARFDARGVALQLAAVAFEATRLVLIQILLTXRRISLNPITSLYYVALPSFXLVGQTLGSSSSCVAGVVKDWLLIAFSWSVIRDTVTPINLFGYGIAFLGVGYYNHVKLQALKAKVEQKKATQADEEAGSLLQERDGHSDRKSDNQA

SEQ ID NO: 6446 - protein, 313 aa, Zea mays
  unsure (1)..(313): unsure at all Xaa locations
MGRNGGGGVAGGMSESGLRKVLLSYLYVAGGIFLSFSVIVYNKYILDPKMYNWPFPISLTMGHMGFCSSLAVALVRVLRVVDLPTSPSMTPQLYTSSVVPXFRSSAMLNMLSISFGVAIAAYGEARFDARGVALQLAAVAFEATRLVLIQILLTSKGISLNPITSLYYVXXXXXXXXXVPWVFVELPRLRAVAGGFQPDLFVFGTNSLCAFALNLAVFLLVGKTSALTMNVAGVVKDWLLIAFSWSVIRDTVXXVNLFGYGIAFLGVGYYNHVKLQALKAKEAQKKAAQADEEAGSLLQERDSHGDRKTDNQA

SEQ ID NO: 6447 - protein, 418 aa, Zea mays
RGRIPRSPTSSALSLSDPRPRLLLLLPSFVPSRSPSQSRVEIHRLRAPSPEQCEEAGGQRPAMGKEGASDGGMSESVIRKVLVSYMYVAVWIFLSFSVIVYNKYILDPKMYNWPFPISLTMVHMAFCSSLAVALVRVLRVVDLPSSPAMTSQLYVSSVLPIGALYSLSLWFSNSAYIYLSVSFIQMLKALMPVAVYSIGVLFKKETFKSSAMLNMLSISFGVAIAAYGEARFDARGVALQLAAVAFEATRLVLIQILLTSKGISLNPITSLYYVAPCCLALPRPEPLLFLASTSFPDVVLKMYSDRLLIGTVICAFALNLAFFLLVGKTSALTMNVAGVVKDWLLIAFSWSVIRDTVTPVNLFGYGIAFLGVGYYNHVKLQALKAKEAQKKAAQADEEAGSLLQERDSHGDRKTDNQA

SEQ ID NO: 6448 - protein, 445 aa, Zea mays
  unsure (1)..(445): unsure at all Xaa locations
MWPAAPSSAQDPSLLEPGRAPNSPVTYYLLCPLTLRSASSAPPPPPPPPFLRSFQISLPVESRDPPPPRPLTGAARGSGGARCQPWARKGPATRGMSESVIRKVLVSYMYVAVWIFLSFSVIVYNKYILDPKMYNWPFPISLTMVHMAFCSSLAVALVRVLRVVDLPSSPAMTSQLYVSSVLPIGALYSLSLWFSNSAYIYLSVSFIQMLKALMPVAVYSIGVLFKKETFKSSAMLNMXLSISFGVAIAAXYGEARFDARGVALQXLAAVAFEATRXLVLIQILLTSKGXISLNPITSLYYVAPCCLAFLVVPWVFVELPRLRAVGIFQPDLFVFGTNSLCAFALNLAVFLLVGKTSALTMNVAGVVKDWLLIAFSWSVIRDTVTPINLFGYGIAFLGVGYYNHVKLQALKAKEAQKKAAQADEEAGSLLQERDSHGDRKTDNQA

SEQ ID NO: 6449 - protein, 242 aa, Zea mays
MASLFKDPSKLSAYRDRRFKGTQEEYEAALLASTTLYIGNMSFYTTEEQAYELFSRAGEIKKIIMGLDKNSKTPCGFCFVLYYSREDAEDAVKYISGTMLDDRPIRVDFDWGFEEGRQWGRGRSGGQVRDEYRTDYDPGRGGYGKMVLRELEAQRELVDYGGSFQPNAPPPYERSERKRGHGDSHRNDRGDYQRKRYRNDDRSAPEESKRAPDSDPAEKNPRFREKGDSDEEEDDYDGKRRR

SEQ ID NO: 6450 - protein, 197 aa, Zea mays
DAWAQPPSSPSVRRTSPHHRLTKTLIPSRHGGCCGDGDEDDDGEGGDEEDDDEEVDGEEKEAAGVVEISDEDDDDGDGEADDDDDDDGDDDDDDDEDSDDEEEVDGEDDQEAGLGTEYLVQPLGRAEDEEHSSDFEPEENGEDADDEEIDEEDDDGEDSVKAQTSTKRKRSGDDEEDDDDGDDDGDDDDDGRPPSKR

SEQ ID NO: 6451 - protein, 211 aa, Zea mays
MKPAVEAEADERAAEEMAPKKAAAAKKAAEEVEVEEVVDGDEAVDGEGDGDEDDDGEGGDEEDDDEEVDGEEKEAAGVVEISDEDDDDGDGEADDDDDDDGDDDDDDDEDSDDEEEVDGEDDQEEELGTEYLVQPLGRAEDEEHSSDFEPEENGEGADDEEIDEEDDDGEDSVKAQTSTKRKRSGDEEEEDDDDGDDDGDDDDDGRPPSKR

SEQ ID NO: 6452 - protein, 109 aa, Zea mays
  unsure (1)..(109): unsure at all Xaa locations
ERSSIAELTSANCYRTEHLGRPENCALHQMAEHIYIAGLFLTXPPDSIQLVSEHAATYIMVFLMNLSATFICEFFRDAQEKVLLYADYIFHYQTEAEIFAKVRXWQTDN

SEQ ID NO: 6453 - protein, 135 aa, Zea mays
PAWFSFNSKDGVHIVSGDSLIECTTIADKCAKVGAVGINCTPPRFIHGLILSIRKVTDKPILIYPNSGERYDGEKKEWVESTGVSDGDFVSYVNEWCKDGAVLIGGCCRTTPNTIRAIHRTLNKSPNKQQLPAVE

SEQ ID NO: 6454 - protein, 230 aa, Zea mays
  unsure (1)..(230): unsure at all Xaa locations
MRVVSALADQVCLCACTRPLPRTSSKNMSLSLERSSSVVRDVATPAPPATSGASAPYPRAGAGASLSLPGAAAAHGHSQYLPLNEDDSLDMVLFDVLREASGSASTSAAAPATYQPPSSLPTLKALASGAARRGSRTAYAPKAATAGRHYRGVRRRPWGKYAAEIRDPARHGARLWLGTFATAEEAAAAXDRAAVRMRGAKALLNFPPAVAGCGSAATATAKQAGLTEAK

SEQ ID NO: 6455 - protein, 232 aa, Zea mays
  unsure (1)..(232): unsure at all Xaa locations
QADFGRLEIELAEVEMPGLMACRTEFGPSQPFKGAKITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEEFAKNGTIPDPNSTDNAEFQLVLTIIKESLKTDPLKYTKMKERLVGVSEETTTGVKRLYQMQANGTLLFLLLMVMIWYPRASSTTCXDAALTGRWLM

SEQ ID NO: 6456 - protein, 259 aa, Zea mays
MDRKRIKDALEKHLERSSPFTSRGVVSKERERLAAGKLPSSLGKAEVSDGEEFETDSEDSDVSGSEGEDTSWISWFCTLRGNEFFCEIDDDYIQDDFNLCGLSNQVPYYDYALDLILDIESSNDDGFTEEQNELIESSAEMLYGLIHARYILTSKGLAAMLEKFKNYDFGRCPRVYCCGQPCLPAGQSDVPRSSTVKIYCPKCEELNYPRSKYQGNIDGSYFGTTFPHLFLMTYSHLKPQKPSQQYTPRVFGFKLHKPS

SEQ ID NO: 6457 - protein, 383 aa, Zea mays
MAEDRSPKPIHCKAAVCRAAGEPLTIEEIVVDPPKAYEIRIRVICTSLCHTDITFWKAKVAPVFPRILGHEAYGVVESVGEHVEGFAAGDTVVPTFLGQCERCASCASEHSNVCDAVPFVIGPGMRRDGTTRFRDARGSPLHDLLAVSSFSEYTVVDVNQVVKVDPAVPPKLACLLSCGAGTGVGAAWRSAKVEPGSTVAIFGLGSVGLAVVQGAKMCGASKIIGVDLNPDKEEVGRSFGVTDFVNPSQLDKRSVVEVIVEMTGGGVDYSFECIGVPSVMTDAFRCTKMGKGKTIVLGLGRDSDEVCLPSLELLFGRCVMGSLFGGLKPKTHIPVLAKKCMDKELQLDALVTHELGLQDINKAFDLLLQGKSLRCILWMDKDK

SEQ ID NO: 6458 - protein, 383 aa, Zea mays
MAEDRSPKPIHCKAAVCRAAGEPLTIEEIVVDPPKAYEIRIRVVCTSLCHTDITFWKAKVAPVFPRILGHEAYGVVESVGEHVEGFAAGDTVVPTFLGQCERCASCASEHSNVCDAVPFVIGPGMRRDGTTRFRDARGSPLHDLLAVSSFSEYTVVDVNQVVKVDPAVPPKLACLLSCGAGTGVGAAWRSAKVEPGSTVAIFGLGSVGLAVVQGAKMCGASKIIGVDLNPDKEEVGRSFGVTDFVNPSQLDKRSVVEVIVEMTGGGVDYSFECIGVPSVMTDAFRCTKMGKGKTIVLGLGRDSDEVCLPSLELLFGRCVMGSLFGGLKPKTHIPVLAKKCMDNELQLDALVTHELGLQDINKAFDLLLQGKSLRCILWMDKDK

SEQ ID NO: 6459 - protein, 270 aa, Zea mays
CDAVPFVIGPGMRRDGTTRFRDARGSPLHDLLAVSSFSEYTVVDVNQVVKVDPAVPPKLACLLSCGAGTGVGAAWRSAKVEPGSTVAIFGLGSVGLAVVQGAKMCGASKIIGVDLNPDKEEVGRSFGVTDFVNPSQLDKRSVVEVIVEMTGGGVDYSFECIGVPSVMTDAFRCTKMGKGKTIVLGLGRDSDEVCLPSLELLFGRCVMGSLFGGLKPKTHIPVLAKKCMDKELQLDALVTHELGLQDINKAFDLLLQGKSLRCILWMDKDK

SEQ ID NO: 6460 - protein, 234 aa, Zea mays
IGYLEAGRAYDLPHDKPWMRQLLSVACLALAVKMEETVLPLPVDLQVCDVKFEFEARTIGRMELLVLATLKWRMQAVTPFTFISYFLDKFNGGKPPSLALASRCTDIIIGTLKGSTFLSFRPSEIAAASALAAVSENQVVGSSSALSASEVPINKVMIARCYELLQEQALVRKTGHVNGSPSVPQSPIGVLDATCFSFRSEDARLVSSQSNNISSSSSNDNQVSKRRRLSISPI

SEQ ID NO: 6461 - protein, 253 aa, Zea mays; identical to SEQ ID NO: 5820

SEQ ID NO: 6462 - protein, 168 aa, Zea mays
SLTAAGGLRKIGLGDTYESPSLIGIHYEGQFFEFVPWTGTVSWDIGLWGLWKMSGENKTHLVEIEATTAESGTALRAPTIEAGLVPACKDTCYGDLRLQLWEKKYDGSKGEMILDATSNMAALEVGGGPWFNGWKGTTVVNEVVNNIVGTPVDVESLLPIPFLKPPGL

SEQ ID NO: 6463 - protein, 224 aa, Zea mays
MDHAAEAQRTDLMTITRHALNEQGRHPESRGDFTILLSHIVLGCKFVASAVNKAGLAKLIGLAGETNVQGEEQKKLHALSHEVFGEALVSSGRTCVLVSEENEAAIFVDAPLRGKYCVCFDPLDGSSNIDCGVSIGTIFGIYMIKDKDNATLEDVLQPGTDMIAAGYCMYGSSCTLVLSTGNGVNGFTLDPSLGEVILTHPHIKIPNKGKIYSVNEGNARNWDA

SEQ ID NO: 6464 - protein, 745 aa, Zea mays
  unsure (1)..(745): unsure at all Xaa locations
HILRAGYERIVLPPWVALAIRPRPGWSGNYIRVNVSELAVEELSVSEYLAFKEQLVDGQSNSNFVLELDFEPFNASFPRPSMSKSIGNGVQFLNRHLSSKLFQDKESLYPLLNFLKAHNYKGTTMMLNDRIQSLRGLQSSLRKAEEYLLSVPQDTPYSEFNHRFQELGLEKGWGDTGEAXVLDTLHLLLDLLEAPDPANLEKFLGTIPMMFNVVILSPHGYFAQSNVLGYPDTGGQVVYILDQVRALENEMLLRIKQQGLDITPKILIVTRLLPDAAGTTCGQRLEKVIGTEHTDIIRVPFRNENGILRKWISRFDVWPYLETYTEDVSSEIMKEMQAKPDLIIGNYSDGNLVATLLAHKLGVTQCTIAHALXEKTKYPNSDIYLDKFDSQYHFSCQFTADLIAMNHTDFIITSTFQEIAGSKDTXVGQYESHIAFTLPGLYRVXHGIDVFDPKFNIVSPGADMSVYYPYTXETDKRLTAFHPEIEELINSDVENSEHKFVLKDKKKPIIFSMXARLDRVKNMTGLVEMYGKNARLRELANLVIVAGDHGKESKDREEHAEFKKMYSLIDEYKLKGHIRWISAQMNRVXRNGELYRYICDTKGAFVQPAFYEAFGLTVIESMTCGLPTIAXTCHGGPAEIIVDGVSGLHIDPYHSDKAADILVNFFDKCKADPSYWDKISQGGLQRIYEKYTWKLYSERLMTLTGVYGFWKYVSNLERRETRRYIEMFYALKYRSLASQVPLSFD

SEQ ID NO: 6465 - protein, 802 aa, Zea mays
MAAKLTRLHSLRERLGATFSSHPNELIALFSRYVHQGKGMLQRHQLLAEFDALFDSDKEKYAPFEDILRAAQEAIVLPPWVALAIRPRPGVWDYIRVNVSELAVEELSVSEYLAFKEQLVDGQSNSNFVLELDFEPFNASFPRPSMSKSIGNGVQFLNRHLSSKLFQDKESLYPLLNFLKAHNYKGTTMMLNDRIQSLRGLQSSLRKAEEYLLSVPQDTPYSEFNHRFQELGLEKGWGDTAKRVLDTLHLLLDLLEAPDPANLEKFLGTIPMMFNVVILSPHGYFAQSNVLGYPDTGGQVVYILDQVRALENEMLLRIKQQGLDITPKILIVTRLLPDAAGTTCGQRLEKVIGTEHTDIIRVPFRNENGILRKWISRFDVWPYLETYTEDVSSEIMKEMQAKPDLIIGNYSDGNLVATLLAHKLGVTQCTIAHALEKTKYPNSDIYLDKFDSQYHFSCQFTADLIAMNHTDFIITSTFQEIAGSKDTVGQYESHIAFTLPGLYRVVHGIDVFDPKFNIVSPGADMSVYYPYTETDKRLTAFHPEIEELIYSDVENSEHKFVLKDKKKPIIFSMARLDRVKNMTGLVEMYGKNARLRELANLVIVAGDHGKESKDREEQAEFKKMYSLIDEYKLKGHIRWISAQMNRVRNGELYRYICDTKGAFVQPAFYEAFGLTVIESMTCGLPTIATCHGGPAEIIVDGVSGLHIDPYHSDKAADILVNFFDKCKADPSYWDEISQGGLQRIYEKYTWKLYSERLMTLTGVYGFWKYVSNLERRETRRYIEMFYALKYRSLASQVPLSFD

SEQ ID NO: 6466 - protein, 802 aa, Zea mays
MAAKLTRLHSLRERLGATFSSHPNELIALFSRYVHQGKGMLQRHQLLAEFDALFDSDKEKYAPFEDILRAAQEAIVLPPWVALAIRPRPGVWDYIRVNVSELAVEELSVSEYLAFKEQLVDGQSNSNFVLELDFEPFNASFPRPSMSKSIGNGVQFLNRHLSSKLFQDKESLYPLLNFLKAHNYKGTTMMLNDRIQSLRGLQSSLRKAEEYLLSVPQDTPYSEFNHRFQELGLEKGWGDTAKRVLDTLHLLLDLLEAPDPANLEKFLGTIPMMFNVVILSPHGYFAQSNVLGYPDTGGQVVYILDQVRALENEMLLRIKQQGLDITPKILIVTRLLPDAAGTTCGQRLEKVIGTEHTDIIRVPFRNENGILRKWISRFDVWPYLETYTEDVSSEIMKEMQAKPDLIIGNYSDGNLVATLLAHKLGVTQCTIAHALEKTKYPNSDIYLDKFDSQYHFSCQFTADLIAMNHTDFIITSTFQEIAGSKDTVGQYESHIAFTLPGLYRVVHGIDVFDPKFNIVSPGADMSVYYPYTETDKRLTAFHPEIEELIYSDVENSEHKFVLKDKKKPIIFSMARLDRVKNMTGLVEMYGKNARLRELANLVIVAGDHGKESKDREEQAEFKKMYSLIDEYKLKGHIRWISAQMNRVRNGELYRYICDTKGAFVQPAFYEAFGLTVIESMTCGLPTIATCHGGPAEIIVDGVSGLHIDPYHSDKAADILVNFFDKCKADPSYWDKISQGGLQRIYEKYTWKLYSERLMTLTGVYGFWKYVSNLERRETRRYIEMFYALKYRSLASQVPLSFD

SEQ ID NO: 6467 - protein, 650 aa, Zea mays
MDFDMECNSLSWNNLDEESLYPLLNFLKAHNYKGTTMMLNDRIQSLRGLQSSLRKAEEYLLSVPQDTPYSEFNHRFQELGLEKGWGDTAKRVLDTLHLLLDLLEAPDPANLEKFLGTIPMMFNVVILSPHGYFAQSNVLGYPDTGGQVVYILDQVRALENEMLLRIKQQGLDITPKILIVTRLLPDAAGTTCGQRLEKVIGTEHTDIIRVPFRNENGILRKWISRFDVWPYLETYTEDVSSEIMKEMQAKPDLIIGNYSDGNLVATLLAHKLGVTQCTIAHALEKTKYPNSDIYLDKFDSQYHFSCQFTADLIAMNHTDFIITSTFQEIAGSKDTVGQYESHIAFTLPGLYRVVHGIDVFDPKFNIVSPGADMSVYYPYTETDKRLTAFHPEIEELIYSDVENSEHKFVLKDKKKPIIFSMARLDRVKNMTGLVEMYGKNARLRELANLVIVAGDHGKESKDREEQAEFKKMYSLIDEYKLKGHIRWISAQMNRVRNGELYRYICDTKGAFVQPAFYEAFGLTVIESMTCGLPTIATCHGGPAEIIVDGVSGLHIDPYHSDKAADILVNFFDKCKADPSYWDKISQGGLQRIYEKYTWKLYSERLMTLTGVYGFWKYVSNLERRETRRYIEMFYALKYRSLASQVPLSFD

SEQ ID NO: 6468 - protein, 548 aa, Zea mays
SRSPDPANLEKFLGTIPMMFNVVILSPHGYFAQSNVLGYPDTGGQVVYILDQVRALENEMLLRIKQQGLDITPKILIVTRLLPDAAGTTCGQRLEKVIGTEHTDIIRVPFRNENGILRKWISRFDVWPYLETYTEDVSSEIMKEMQAKPDLIIGNYSDGNLVATLLAHKLGVTQCTIAHALEKTKYPNSDIYLDKFDSQYHFSCQFTADLIAMNHTDFIITSTFQEIAGSKDTVGQYESHIAFTLPGLYRVVHGIDVFDPKFNIVSPGADMSVYYPYTETDKRLTAFHPEIEELIYSDVENSEHKFVLKDKKKPIIFSMARLDRVKNMTGLVEMYGKNARLRELANLVIVAGDHGKESKDREEQAEFKKMYSLIDEYKLKGHIRWISAQMNRVRNGELYRYICDTKGAFVQPAFYEAFGLTVIESMTCGLPTIATCHGGPAEIIVDGVSGLHIDPYHSDKAADILVNFFDKCKGDPSYWDKISQGGLQRIYEKYTWKLYSERLMTLTGVYGFWKYVSNLERRETRRYIEMFYALKYRSLASQVPLSFD

SEQ ID NO: 6469 - protein, 344 aa, Zea mays
  unsure (1)..(344): unsure at all Xaa locations
MTNLPWWRADASELVAVTAMGVWEAVLAGGGRRFIKRKDSDAGETGRALEELRSSLYNEMHSAEGAKRQQQRFCGPSVALTFNFAVAVGIIMANKMVMGSVGFKFPIALSLIHYAVAFVLMATLKTLSLLPVAPPSKSTPFSSIFALGAVMSLSTGLANVSLKHNSVGFYQMAKIAVTPTIVVAEFMLFQKKVSSKKIILTFQAVTLAVVSFGVAVATVTDLEFNFFGACVALAWIVPSAVNKILWSXLQQSGNWTALAYVMFFLSLIQIIHNFIPLLTQIIHYXTRLMWKTTPITIFFLLTLMPLLDPPGLLLFNWNFRNSCAVIISALFGFLLQWSGALALG

SEQ ID NO: 6470 - protein, 256 aa, Zea mays
HDVHAMRAVLLARFGFAPADVTVLTDYQHGRGGGGGVLPTGAAVRRALDDMVARAAPGDVLFFHFSGHGTLVPPVGGGPRRRRDDEAIVPCDFNLITDVDFRELVDRVPRGATFTMASDSCHSGGLIDQEKEQIGPTAGGADRPSLPLPLGARGRFLPYAAVLGHLSAASGVAATHQHHLHVADHLLALFGADASAKFQLQVLHRHGHGHHGSTGGADAGILLSGCQTDETSADVAQDDDAALGGRACGAFSAALQ

SEQ ID NO: 6471 - protein, 616 aa, Zea mays
MAVMAEVVSTTGAALRSPATQQPAAAGAAKGTDAEKLQFIEDMTSNVDAVQERVLGEILARNADTEYLSSRCGLAGATDRATFRAKVPMATYEDLQPYIRRIADGDRSPILSGHPVSEFLTSSGTSGGERKLMPTIEDELNRRQLLYSLQMPVMNLYVPGMDKGKALHFLFVKSETKTPGGLAARPVLTSYYKSNHFRNRPFDAYNNYTSPTAAILCADAFQSMYAQMLCGLCQRQDVLRVGAVFASGLLRAIRFLQLNWEQLAEDIEAGSLTPRVTDPSVREAVAGILRADPELAALVRSECSKGDWAGIITRIWPSTKYLDVIVTGAMAQYIPTLKYYSGGLPMACTMYASSECYFGLNLRPMCDPSEVSYTLMPNMCYFEFLPMDSAAASGGDASQLVDLARVEVGREYELVITTYAGLNRYRVGDVLQVTGFHNSAPQFRFVRRKNVLLSIESDKTDEAELQRAVERASALLRPHGAAVVEYTSQAYTKSIPGHYVIYWELLAKGPAAGGAVGEGTLERCCLEMEEALNTVYRQSRVADGSIGPLEIRVVRPGTFEELMDYAISRGASINQYKVPRCVTFPPIIELLDSRVVSSHFSPALPHWTPGQRSDSD

SEQ ID NO: 6472 - protein, 186 aa, Zea mays
ADGGVVLPDRTSLRLTAIEDAEYKEDKIEFWNNVYGFDMSCIKKQAMMEPLVDTVDANQIVTNCQLLKTMDISKMTPGDVSFTVPFKLVAERNDYIHALVAYFDVSFTKCHKLMGFSTGPRSKATHWKQTVLYLEDVITICQGESLSGSMTVTPNKSNPRDIDIKLKYSINGHRCQVSRTQFYKMR

SEQ ID NO: 6473 - protein, 552 aa, Zea mays
MADGNAGGAARVLFSILGLALALPLPLLVAGDDPYRFFTWTVTYGDIYPLGVKQQGILINNQFPGPQIEAVTNDNLIINVFNKLNEPFLLSWSGLQQRRNSFEDGVAGTTCPIPPGSNFTYIMQAKDQIGTYYYFPSLAFHKAAGGFGGIRVLSRPQIPVPFPPPAADYTVLIGDWYKANHTDLRYVLDSGVALGFPDGLLINGRGLNGYTFNVQPGRTYRFRITNVGLATSLNIRFQGHTMKLVEVEGSHTMQTTYSSLDVHLGQSYSVLLTADQPGYDYAVVVSTRFTSRIISTTAVLRYANSAGRAPGPLPGGPTIQIDWSLNQARSIRWNLTASGPRPNPQGSYHYGLVPVTRTIRLANSAATISGKRRYAVNGVSYVGPDTPLKVADYYKIGGVFSVGTIADSPPAYGGAAYLRTSVMGASYRDYVEVVFENGEDEVQSWHIDGYAFWVVGMDGGKWSSASRQGYNLRDGVSRYTVQVYPRSWTAIYMPLDNVGMWNVRSENWARQYLGQQFYLRVWTPSTSLRDEYPIPKNALLCGRAAGRRTRPL

SEQ ID NO: 6474 - protein, 485 aa, Zea mays; identical to SEQ ID NO: 668

SEQ ID NO: 6475 - protein, 288 aa, Zea mays
MASRQQHPTSYHAGETKARAEEKTGQVMGAAQEKGREAKHKASDAADRAMGMGHDAREATREKARAAADRTMGMGHDAGETAKDRAYRAKDAASGAAVRARDTASDAAGAAGDRAHDGAQQTGSYVAQTAEAARQKAAGAALYAKDTVVAGKDKTGALLQQAGEKVMSTAVGAKDTVVSTAVGAKDTVVSTAVGAKDAMMNSLGMAGENKDGTTTTDAGKDTSTHEPVVSSNPCARGCWCPCRRCWWWCRPCSRRPCRASSRPWLRRCCPCPWPWPCPCLWPRPCSSP

SEQ ID NO: 6476 - protein, 115 aa, Zea mays
GWHMIIGGLPLLVISVLNHDPALSGHIQDLTWSDILALGYTSIFGSAVSYGVYFYNATRGSLTTLSSLTFLTPMFASVFGYLYLGETFSPVQIGGALLTLVAIYMVNYKSIIGEK

SEQ ID NO: 6477 - protein, 131 aa, Zea mays
MSEEKHHHFFNHHKKDEEQPAGEYGYSETEVVTATGEGEYERYKKEEKEHKHKQHLGEAGAIAAGAFALYEKHEAKKDPEHAHRHKITEEVAAAAAVGAGGYVFPEPPEKKKAPKDAEEASGEKKPPPLFG

SEQ ID NO: 6478 - protein, 602 aa, Zea mays
  unsure (1)..(602): unsure at all Xaa locations
MERTLITSNLSMSAHASRSSRRVHYISPAASAAAHNSSYRKKKKNAPSPPPSAAATDTVVISPPATDNVQSTAPKQAGRQELEELVAAKTNTSRIATARTSAPSQSQAKLRRRPAPAITSLPMAFCSALEEAINTFVDPPALRPSVDPRNVLSTNFAPVDELPPTPCPVVRGAIPRCLAGGAYIRNGPNPQHLPRGPHHLFDGDGMLHSLLLPTAGSPPSSDPVLCSRYVQTYKYLVERDAGAPVMPNVFSGFHGVAGLARGAVVAARVLTGQMNPAEGVGLANTSLAXFMGMTAHPKRTPVTGEVFAFRYGPVPPFVTYFRFDPAGNKGPDVPIFSVQQPSFLHDFAVTERYAIFPEIQIVMQPMGMVTGGAPVGSDSGKVPRLGVLPKYATDESEMRWFEVPGFNMMHSLNAWEEADGEELVLVAPNVLSVEHALERMELVHSCVEKVRMNLRTGAVSRTPLSAGNLDFGVIHPGYLGRRNRYGYLGIGDPMPKISGVAKLDLDRAGTGDCTVARRDFGPGCFAGEPFFVPDDVEGDGNEDDGYLVCYVHNERTGENQFVVMDARSPQLDIVAEVQLPARVPYGFHGMFVTQAELQAQQQ

SEQ ID NO: 6479 - protein, 336 aa, Zea mays
  unsure (1)..(336): unsure at all Xaa locations
MEDGGKAPAGLGTLRAVLAILQWWGFNVTVIIMNKWIFQITDXRDLDWKLDFKFPLTVSCVHFICSSIGAYIAIHVLKAKPLIQVEPEDRWKRIFPMSFVFCINIVLGNVSLRYIPVSFMQTIKSFTPATTVILQWLVWSKHFEWRIWASLVPIVGGILLTSVTELSFNIFGFCAAMVGCLATSXKTILAESLLHGYKFDSINTVYYMAPFATMILALPAMVLEGGGVMNWFYTHDSIVPALTIILGSGVLAFCLNFCIFYVIHSTTAVTFNVAGNLKVAVAVLVSWSIFRNPISAMNAIGCGITLVGCTFYGYVRHLISQRQAAAPGSLGTAQAS

SEQ ID NO: 6480 - protein, 51 aa, Zea mays
ANRSEIYTYEAAWHMYSMNWSVRRDKKYRLAIASLLEQVTNRVEVVQLDEA

SEQ ID NO: 6481 - protein, 448 aa, Zea mays; identical to SEQ ID NO: 833

SEQ ID NO: 6482 - protein, 138 aa, Zea mays
MAEEKHHHHHLFHHKKDEEQAAAGGYGESAEYTEATVTEVVSTGENEYDEYKKEEKQHKHKQHLGEAGAIAAGAFALYEKHEAKKDPEHAHRHKIEEEVAAAAAVGSGGFAFHEHHEKKKDHKEAEEAGGEKKHHFFG

SEQ ID NO: 6483 - protein, 380 aa, Zea mays
  unsure (1)..(380): unsure at all Xaa locations
MATAGKVIKCKAAVAWEAGKPLSIEEVEVAPPQAMEVRVKILFTSLCHTDVYFWEAKGQTPVFPRIFGHEAGGIIESVGEGVTDVAPGDHVLPVFTGECKECAHCKSAESNMCDLLRINTDRGVMIADGKSRFSINGKPIYHFVGTSTFSEYTVMHVGCVAKINPQAPLDKVCVLSCGISTGLGASINVAKPPKGSTVAVFGLGAVGLAAAEGARIAGASRIIGVDLNPSRFEEARKFGCTEFVNPKDHNKPVQEVLAEMTNGGVDRSVECTGNINAMIQAFECVHDGWGVAVLVGXVPHKDAEFKTHPMNFLNERTLKGTFFGNYKPRTDLPNVVELYMKKELEVEKFITHSVPFAEINKAFDLMAKGEGIRCIIRMEN

SEQ ID NO: 6484 - protein, 387 aa, Zea mays
MADQANQPTVLHKLGGQFHLRSIISEGVRARNICPSVSSYERRFATRNYMTQSLWGPSMSVSGGINVPVMQTPLCANAPAENGRKNFMIDFMMGGVSAAVSKTAAAPIERVKLLIQNQDEMIKSGRLSEPYKGIVDCFKRTIKDEGFSSLWRGNTANVIRYFPTQALNFAFKDYFKRLFNFKKDRDGYWKWFAGNLASGGAAGASSLFFVYSLDYARTRLANDAKAAKGGGERQFNGLVDVYRKTLKSDGIAGLYRGFNISCVGIIVYRGLYFGLYDSIKPVVLTGNLQDNFFASFALGWLITNGAGLASYPIDTVRRRMMMTSGEAVKYKSSLDAFQQILKKEGPKSLFKGAGANILRAIAGAGVLSGYDQLQILFFGKKYGSGGA

SEQ ID NO: 6485 - protein, 153 aa, Zea mays
  unsure (1)..(153): unsure at all Xaa locations
VGIIVYRGLYFGLYDSIKPVVLTGNLPGLSNFCLFLYIACGFVVXAIICFSLLQDNFFASFALGWLITNGAGLASYPIDTVRRRMMMTSGEAVKYKSSLDAFQQILKKEGPKSLFKGAXGGNILRAIAGGGVLSGYDQLQILFFGKKYGSGGA

SEQ ID NO: 6486 - protein, 164 aa, Zea mays
  unsure (1)..(164): unsure at all Xaa locations
RLGCQGRGERQFMGLXDVXRKTLKSDGIAGLTXGFNISCVGIIVXRGLYFGLYDSIKPVVLTGNLQDNFFASFALGWLITNGAGLASYPIDTVRRRMMMTSGEAVKYKSSLDAFQQILKKEGPKSLFKGAGANILRAIAGAGVLSGYDQLQILFFGKKYGSGGA

SEQ ID NO: 6487 - protein, 261 aa, Zea mays; identical to SEQ ID NO: 6426

SEQ ID NO: 6488 - protein, 154 aa, Zea mays
  unsure (1)..(154): unsure at all Xaa locations
MARPQQRYRGVRQRHWGSWVSEIRHPLLKARIWLGTFETAEDAARAYDEAARIMCGPRARTNFPADANGPPPSFLSAALVDKLHRFNLASVQAAQRQREAAAAAAAAAATSRARDASDAAXTQWGGGGRSLEEQHVEQMIEELLDSDFSMEICC

SEQ ID NO: 6489 - protein, 357 aa, Zea mays
MGRDGGGGVAGGMSDSVLRRGGLSYFYVAVWIFLSFSVIVYNKYILDPKMYNWPFPISLTMVHMGFCSSLAVALVRVLRVVDLPTSPSMTPQLYTSSVVPIGALYAMSLWFSNSAYIYLSVSFIQMLKALMPVAVYSIGVLFNKETFRSSSMLNMLSISFGVAIAAYGEARFDVRGVALQLAAVAFEATRLVLIQIPLTSKGISLNPITSLYYVAPCCLCFLVVPWVFVELPRLRAVGTFQPDFFVFGTNSLCAFALNLAVFLLVGKTSALTMNVAGVVKDWLLIAFSWSVIRDTVTPINLFGYGIAFLGVAYYNHVKLQALKAKEAQKKAAQADEEVGSLLQERDGHGDHKSDNQA

SEQ ID NO: 6490 - protein, 400 aa, Zea mays
MESMAQERDALDSPALSIDKRLRSDAVESPLVDDATQPKEGADGYPVKVRKPYTITKQREKWTEEEHGKFLEALKLYGRSWRQIQEHIGTKTAVQIRSHAQKFFSKVVREPGASNSIEIPPPRPKRKPLHPYPRKCADSTVTNAPMGEPKNAPVSSPSGSDQENGSPVSVLSAMQSDAFGSSISNPSTGGTSPASSDDGNNLSEEDSSRVQETSLKLFGKTVIIPDPKKVCSSDGGAGDDTQEVMQTSWVGGGVAAYPAHNGWFLPFHSFPAHMYESGDARISPLHMWWPYYGFPAGHPRGFGTGLLNEGAIESDADNSPSVETNSDRTGNVHVQTTTPTIHNNAVKESVGPVEMPESGPSIELKPSANSAFVRVKPSSSVSGDQSLVRGFVPYKRCKVE

SEQ ID NO: 6491 - protein, 90 aa, Zea mays
MPAGVVSVLFAALLAAPWLRRGVVYSNEYLDVVAGLVHLHDLGIIHRDLKPQNVLISAGGPIRAKLSDMGISKHLQDDMTSVSHHGTGKE

SEQ ID NO: 6492 - protein, 248 aa, Zea mays
  unsure (1)..(248): unsure at all Xaa locations
MASSSSSRLLLLLLPCLALTLLGAADAEVHHHEFVIQETPVKRLCKTHNIITVNGQYPGPTLEVREGDTLVINVVNRAQYNATIHCXGIRQIRTGWADGPEFVTQCPIRPGGSYKYRFTIQGQEGTLWWHAHSSWLRATVYGALIIRPRENKTYPFAKPSREVPVILGEWWDANPIDVIREAQRTGGGPNVSDAFTINGQPGDLYKCSNKETTAIPVKAGETALLRFINAALKHELFVTIAQHKDDGR

SEQ ID NO: 6493 - protein, 634 aa, Zea mays
MDGCDCIEPLWPTDDLLVKYQYISDFFIALAYFSIPLELIYFVKKSSFFPYRWVLIQFGAFIVLCGATHLINLWTFTTHTKTVAMVMTIAKVSTAVVSCATALMLVHIIPDLLSVKTRELFLKNKAEELDREMGLIRTQEETGRHVRMLTHEIRSTLDRHMILKTTLVELGRTLGLEECALWMPSRSGSSLQLSHTLHHQITVGSSVPINLPVINQVFSSNRAIIIPHTSPLARIRPLTGRYVPPEVAAVRVPLLHLSNFQINDWPELSAKSFAIMVLMLPSDSARKWHVHELELVEVVADQVAVALSHAAILEESMRARDLLMEQNVALDLARREAEMAIRARNDFLAVMNHEMRTPMNAIIALSSLLLETELTPEQRLMVETVLKSSNLLATLINDVLDLSKLEDGSLELEIKAFNLHAVFKEVMGFIKPIASIKRLSVSVMLAPDLPLCAIGDEKRLMQTILNISGNAVKFTKEGHITLVASIVKADSLREFRTPEFHPTASDDHFYLKVQVKDTGCGIGPQDLPHVFTKFAHPQSGGNRGFNGSGLGLAICKRFVSLMGGHIWIDSEGTGRGCTATFVVKLGVCDNTNTYQQQLIPLVWPSSADSDLRAPKPLPDGRGSTPLKSRYQRSV

SEQ ID NO: 6494 - protein, 187 aa, Zea mays
IFRGKDGRPGCVQNTCAHRACPLHLGSVNEGRIQCPYHGWEYSTDGKCEKMPSTNMLNVHIQSLPCFEQEGTVWIWPKDDPPKATILSLLPRSGFTCSLLMQGVHGLGGGWRLGSSMAASSSCSTTRHSSSPRASAPLQVLHIIGREDRVQIDDARRLHRRAVTPAAMMPPYGTPPPYAAMYAQGTP

SEQ ID NO: 6495 - protein, 121 aa, Zea mays
IFRGKDGRPWCVQNTCAHRACPLHLGSVNEGRIQCPYHGWEYSTDGKCEKMPSTNMLNVHIQSLPCFEQEGTVWIWPRDDPPKATIPSLLPRSGFTCSLLMQGVHGLGGGWRLGSSMAASS

SEQ ID NO: 6496 - protein, 212 aa, Zea mays
LACLQDAFAYGWLPDGSFAHVKPEPVRSPDSSYYSYDGSCFGGLPYPDPRREEAAAAVARGKHYRGVRQRPWGKFAAEIRDPAKNGARVWLGTYDTAEDAALAYDRAAYRMRGSRALLNFPLRIGSEIAAAAAGDKRPLALPEPATSSDSSSSSSSTGGSPKRRKRGEAAAANMAMALVPPPSQLSRPAQPWFPAAPVEQAAMPPRVEQLVI

SEQ ID NO: 6497 - protein, 373 aa, Zea mays
MLGVARRRLGSGCVLAQLAQALRPAAAPARTYSAAAKEITVREALGSALDEEMSADPSVFLMGEEVGEYQGAYKISKGLLDKYGPDRVLDTPITEAGFTGIGVGAAYHGLRPIVEFMTFNFSMQAIDHIINSAAKSNYMSAGQISVPIVFRGPNGAAAGVGAQHSQCYAAWYAHVPGLKVLAPYSAEDARGLLKAAIRDPDPVVFLENELLYGESFPVSAEVLDSSFCLPIGKAKIERQGKDVTITAFSKMVGYALQAADILAKEGISAEVINLRSIRPLDRATINASVRKTNRLVTVEEGFPQHGIGAEICMSVVEDSFEYLDAPVERIAGADVPMPYAANLERMAVPQVDDIVRAAKRACYRAAVPMAATA

SEQ ID NO: 6498 - protein, 305 aa, Zea mays
  unsure (1)..(305): unsure at all Xaa locations
LGPSRPAGYKLDRLVLERXPTFVDALRDLDDCLTMVHLFAALPAVDGERVEVKRIHNCRRLSYGCLTFISVKGIYYQAEXQGQKITWLTPHALQQVLTDDVDFNVMLSFLEFYETLLGFVNFKIYHSINVNYPPILDPRLEALAVELYALCRYMSAGSRRMIGNSQTDEVMEDKDEKSKAEEVIEEEKVVKNKASSKADESEFRLAQLQHQLPTNEPGALMNLVEESTADDADDDDTKDCKGLFKNLKFYLSREVPRESLLFIIPAFGGTVSWEGEGAPFKEIDEDITHQVDSICNNLLHQSLTI

SEQ ID NO: 6499 - protein, 103 aa, Zea mays
MHGRTAMAVACLLCMTALLLVQDVQSRRLLWTEQEKKQTHGGLVGNHGAADRRSTSLEPCSGAMGGGGTGSADKQGEFPCDDDTSKWTELHTDYIYTQDFKHP

SEQ ID NO: 6500 - protein, 211 aa, Zea mays
  unsure (1)..(211): unsure at all Xaa locations
MDKLSGSARLMIVSDLDHTMVDHHDEENLSLLRFGALWESVYCEDSLLVFSTGRSPTLYKELRKEKPMLTPDITIMSVGTEITYGEAMVPDDGWEEYLNNKWDRNIVVAETVSFSELKLQPETEQRPHKVSFFVDKKNAQEVIKSVAERLDKCGLDAKIIYSGGQDLDILPQGAGKGQALAYLLXKLSSCGKRPXTPCCGDSGNDAEYSAS

SEQ ID NO: 6501 - protein, 271 aa, Zea mays
MGRGKVQLKRIENKINRQVTFSKRRNGLLKKAHEISVLCDAEVAVIVFSPKGKLYEYATDSRMDKILERYERYSYAEKALISAESESEGNWCHEYRKLKAKIETIQKCHKHLMGEDLESLNPKELQQLEQQLDSSLKHIRSRKSHLMAESISELQKKERSLQEENKALQKELAERQKAVASRQQQAAVQWDQQTHAQAQTSSSSSSFMMRQDQQGLPPPHNICFPPLTMGDRGEELAAAAAAQQQQPLPGQAQPQLRIAGLPPWMLSHLNA

SEQ ID NO: 6502 - protein, 249 aa, Zea mays
MTAGFQLGVIGSLTLSVASSVAIVICNKALISTLGFPFATTLTSWHLMVTFCTLHVAQRLRFFEPKAIDGQTVVLFGLLNGTSIGLLNLSLGFNSIGFYQMTKLAIIPFTVLLETIFLKKRFSETIKFSLLVLLLGVGIASVTDLKLNCLGSVLSGLAIATTCVGQILTNTIQRKLKVSSTQLLYQSAPYQAAILFATGPFVDHLLTGRSVFAHRYTFPVVGFIVLSCLIARTYAHMYYGRKGDPQGTT

SEQ ID NO: 6503 - protein, 255 aa, Zea mays
  unsure (1)..(255): unsure at all Xaa locations
MAAVGAPGSSLHGVTGREPAFAFSTEHEEAASNGGKFDLPVDSEHKAKSVRLFSVANPHMRTFHLSWISFFTCFVSTFAAAPLVPIIRDNLNLTKADIGNAGVASVSGSIFSRLTMGAVCDLLGPRYGCAFLIMLSAPTVFCMSLIDDAAGYIAVRFLIGFSLATFVSCQYWMSTMFSSKIIGTVNGLAAGWGNMGXRRHAAHXMPLVYDVIRKCGATPFTAWRLAYFVPGLMHVVMGVLVLTLGQDLPDGNLRS

SEQ ID NO: 6504 - protein, 153 aa, Zea mays
GRVGGRVGRKTLKSDGIAGLDRGFNISCVGIIVYRGLYFGLYDSIKPVVLTGSLQDNFFASFALGWLITNGAGLASYPIDTVRRRMMMTSGEAVKYKSSLDAFQQILKKEGPKSLFKGAGANILRAIAGAGVLSGYDQLQILFFGKKYGSGGA

SEQ ID NO: 6505 - protein, 601 aa, Zea mays
LNSIPAPANATPSALIRSRRRRHSRARPMDSARSWLQKLQPRDKDRERGAKTPAPASPNGGAGNSARMAAAAGEEALSSATKQKVAAAKQYIENHYKSQMKSLQERKERRWMLERKLADADVSEEEQNNILKDLEKKETEYMRLRRHKMGVDDFELLTIIGRGAFGEVRLCREKATSNVYAMKKLKKSEMLRRGQVEHVRAERDLLAEVDSPYIVKLYCSFQDDEFLYLIMEYLPGGDMMTLLMRKDTLTEDESKFYVAETILAIESIHKRIYIHRDIKPDNLLLDRSGHLKLSDFGLCKPLDSSCFPNLSDLDYAAGKSTNPSSDGDKQSSNSTAPRRTQQEQLLHWQKNRRMLAYSTVGTPDYIAPEVLLKKGYGMECDWWSLGAIMFEMLVGYPPFYSEDPMSTCRKIVNWRSHLKFPEEASLSLEAKDLISKLLCNVDQRIGTKGAHEIKAHPWFAGVEWEKLYQMEAAFIPEVNDELDTQNFEKFEETAPPMQTSSKAGPWRKMLSSKDVNFVGYTYKNFEIVNDPELPGIAELKKTNNKPKRPTIKSLFETADSEDQPSDGSFLNLLPTQLELPESLEPSPHSSISSEDSQARNR

SEQ ID NO: 6506 - protein, 216 aa, Zea mays
  unsure (1)..(216): unsure at all Xaa locations
MTHPSSPSSSAPPPPPAAAAAAAAAEATSLAPGFRFHPTDEELVSYYLKRKVLGRPLKVDAIAEVDLYKLEPWDLPPRSRLRSRDSQWYFFSRLDRKHANRARTNRATSGGYWKTTGKDREVRHGPRVVGMKKTLVFHAGRAPKGERTNWVMHEYRLEGDAAGEIPQDSFVVCRIFQKAGPGPQNGAQYGAPXVEEEWGGDDAVGLLPVGDAAVDP

SEQ ID NO: 6507 - protein, 196 aa, Zea mays
  unsure (1)..(196): unsure at all Xaa locations
MASHQDKASYQAGETKARTEEKTGQAVGATKDTAQHAKDRAADAAGHAAGKGQDAKEATKQKASDTGSYLGKKTDEAKHKAGETTEATKQKAGETTEATKQKAGETTEAARQKAADAMEAAKQKAAEAGQYAKDTAVSGKDKSGGVIQQATGAXVRARAAGAKDAVMSTLGMGGDDKQGDANTNTNKDSSTITRDH

SEQ ID NO: 6508 - protein, 533 aa, Zea mays
MASSPDLFPNVTFSDVSEAAAGPAAEGATAAFGLGAATGAPRLSLVKAEAEPTVEIDLADAQVFKLGPMEWLCVCDESEAKAGVEEKSFSRAIKVVLRTEAESKAFSLAFQQWKHQVISGKAGERLENGSIIASKSKFDTKIEASSAKMYFHYYGQLLHQQNMLQDFVRTGTYYAAVMENRSDFEGRVVVDVGAGSGILSLFAAQAGARHVYAVEASEMAENAQRLMSGNPSLGQRITVIRGKVEEVELPEKADILISEPMGTLLVNERMLESYVIARDRFLAPDGKMFPTTGRIHMAPFSDEYLYVEIANKALFWQQHNFFGVDLTPLHGSAFQGYFSQPVVDAFDPRLLISPPIYHTLDFTSMKEEELYEIDIPLSFVASVGTRVHGLACWFDVLFNGSTVQRWLTTAPGSPTTHWYQLRCVLSQPLYVMAGQEITGHLRLVAHSAQSYTIYLTMSAKMWGVGAEQGGILQTSTGKLELKEPYYRLSQPQSCTLPQDQQQQQLPSLQAQGSEQQMQEGLSPAFTIDQDCLN

SEQ ID NO: 6509 - protein, 216 aa, Zea mays
  unsure (1)..(216): unsure at all Xaa locations
AVLTQPPCSYEYGQFNDADAIPTNEAMKKQIAVASKAMXXXCALPTLSEYMIESGWTRCYFNISEMXXXAYLCYMAMYLXXXXXXXXWMHRELHDIKPLYKHLHATHHIYNKENTLSPFAGLAFHPLDGILQAIPHVLALFLLPTHFRTHIALVFLEGVWTTNIHDCIHGKVWPVMGAGYHTIHHTTYRHNYGHYTVWMDWMFGTLREPEDILKKA

SEQ ID NO: 6510 - protein, 253 aa, Zea mays; identical to SEQ ID NO: 5820

SEQ ID NO: 6511 - protein, 262 aa, Zea mays
  unsure (1)..(262): unsure at all Xaa locations
VCSFIDMAREENVYMAKLAEQAERYEEMVEYMEKVAKTVDVEELTVEERNLLSVAYKNVIGARRASWRIVSSIEQKEESRKNEEHVNLIKEYRAKIEAELSNICDGILKLLDSHLVPSSTXPESKVFYLKMKGDYHRYLAEFKTGPERKESAESTMMAYKAAQDIALAELAPTHPIRLGLALNFSVFYYEILNSPDKACNLAKQAFDEAISQLDTLXEESYKDSTLIMQLLRDNLTLWTSDLTEDGADEGKEAPKGEAGDGQ

SEQ ID NO: 6512 - protein, 392 aa, Zea mays
MADAGEGRRVCGMPEKAQLHVAMLALQFGYAGFHVVSRLALNMGISKLVFPVYRNIIALCLLVPFAYFLEKKDRPQLTLNFVVQFFFLALCGITANQGFYLLGLDNTSPTFASAIQNSVPAITFAMAAALRIEKVRLDRRDGVAKVAGTLACVAGASVITLYKGPTIFGPSASGGLELAATSKAVAGDKNWTLGCVYLIGHCLSWSGWLVLQAPVLKKYPARLSVTSYTCFFGVIQFLIIAAFMERDADAWKFHSGSELFTILYAGFIASGVAFAVQIWCIDRGGPVFVAVYQPVQTLVVAIMASLTMGEKFYLGGIIGAVLIIAGLYLVLWGKSEERARFARDAATLVSGTGDREGLLPAGGGGIRSASKAAASAATQPLLLPSSTSTDNV

SEQ ID NO: 6513 - protein, 252 aa, Zea mays
  unsure (1)..(252): unsure at all Xaa locations
MSREENVYMAKLAEQAERYEEMVEYMEKVAKTTDVQELTVEERNLLSVAFKNVIAAPRASWRIISSIEQKEESRKNEEHVAQIKEYRGKIEAELSNICDGILKLLDTHLVPSSTATESKVFYLKMKGDYHRYLAEFKTGAERKESAESTMVAYKAAQDIALAELPPIHPIRLGLALNFSVFYYEIQNSPDKACNLAKXAFDEAISQLDMLGEDSYKDSNLIMQLLRDNLTLWTEDGIEEGLESSKGDAGEGQ

SEQ ID NO: 6514 - protein, 458 aa, Zea mays
CAAVTLIGFSADLGYILGDTTEHCRTYKGSRFRAAIVFILGFWMLDLANNTVQGPARALLADLSGPDQCNSANAIFCSWMAVGNILGFSAGASGEWHKWFPFLTTRACCEACGNLKAAFLVAGVFLLLCMSVTLYFAEESPLDPKDTQGLSDSAPLLNGSRDAAHASNEPNNERFPNGHVGLNNVSANNNTEEFTNVNSNTENGGVFNDGPGAVLVNILTRMRHLPPGMHSVLLVMALTWLSWFPFFLFDTDWMGREVYHGDPNGDLSERKAYDNGVREGAFGLLLNSVVLGVGSFLVDPLCRMIGARLVWAISNFTVFICMMATTILSWISSDLYSSKLHHIIGANKTVKITALVVFSLLGLPLSITYSVPFSVTAELTAGTGGGQGLATGVLNLAIVVPQIVVSLGAGPWDALYGGGNTPAFVLASVFSLAAGVLAVLKLPKLSNSYQSAGFHGFG

SEQ ID NO: 6515 - protein, 256 aa, Zea mays
ACLQAVEVSSNEYEPSEKDVIFAEGVTQGNGLAFIEFTLDDRSPMSEPYIDNSEAHSQPLTKYQLIRVSAKGMNDGCKWVEMFEDVRMVIFCVALSDYDQLGPPVSGSSRPLVNKMMQSKELFEATIRQPCFCDTPFVLVLNKYDLFEEKINRAPLSSCEWFNDFCPVRTHHNNQSLAHQAYYYVAMKFKDLYSAQTNRKLFVWQARARERQTVDEAFKYIREVLKWEEEKDDNCYQEESFYSTTEMSSSPFIRAE

SEQ ID NO: 6516 - protein, 232 aa, Zea mays
  unsure (1)..(232): unsure at all Xaa locations
ACLQAVEVSSNEYEPSEKDVIFAEGVTQGNGLAFIEFTLDDRSPMSEPYIDNSEAHSQPLTKYQLIRVSAKGMNDGCKWVEMFEDVRMVIFCVALSDYDQLGPPXPCFCDTPFVLVLNKYDLFEEKINRAPLSSCEWFNDFCPVRTHHNNQSLAHQAYYYVAMKFKDLYSAQTNRKLFVWQARARERQTVDEAFKYIREVLKWEEEKDDNCYQEESFYSTTEMSSSPFIRAE

SEQ ID NO: 6517 - protein, 175 aa, Zea mays
  unsure (1)..(175): unsure at all Xaa locations
MAPGSKAERKAALDGXAWMFNVVTSVGIIMVNKALMXATHGFSFATTLTGLHFAMTTLMTLVMKWLGYIQPSYLPLPELVKFAFFANLSIVGMNVSLMWNSVGFYQIAKLCIIPVLCILEIIFDKVRYSRDTKLSIVLVLIGVAVCTVTDVSVNSQGLLAAVIAVWSTALQQHAF

SEQ ID NO: 6518 - protein, 411 aa, Zea mays
  unsure (1)..(411): unsure at all Xaa locations
PPPPPPPATAAPAPPQPSATAAVDRSSPDPDALYEEGMWQQMAMDSGATMQPGSYPERPGEPDCTYYLRTGLCRFGMSCRFNHPPDRNXMKGEYPERAGQPECQYYLKTGTCKFGPTCKFHHPREKAGIAGRVQLNTSGYPLRPNEKECAYYLKTGHCKYANTCKFHHPELFNVVPSSRGSPIYTSVHSSASAGPQSYTGTMPSWAFPRASFIPSPRWQSPSNYAPMIVPQGLVQMQSWNSYTGQLQSPGAQQTYGSSQQGEASTGNQGMLSPYRPSSFPVPQYALQRENVFPERPDEPECQYYMKTGDCKFGAVCKFHHPRVRSLPPPDCVLSPMGLPLRPGEELCKFYSRYGICKFGANCKFDHPTVVAPMVYAYGFSASASPASASTNVPMARRLLGSPPGSGYTLSI

SEQ ID NO: 6519 - protein, 117 aa, Zea mays
MRRRSGSMPLPLAAAALLLLLVCFFHCSAAARLLPPSPVPAQLVHRETGVGGLALQEGGVGNGDELSISGDEMMAAEVEEGAVACEADDDEDDGCMQRRLLQNAHLDYIYTQHKGKP

SEQ ID NO: 6520 - protein, 261 aa, Zea mays
  unsure (1)..(261): unsure at all Xaa locations
MAAAQLSRDENAHMGKLAEHAQRYEEMVDLLHNVPNTGDSDELAVQERNLLSAAYHNVIGARRASWSIISSIEQNEEGRGYEDRATLLTDYRGKIETELTNICDGILXVLETLLVPSSTGPELKVFYLEMNGDYYRYLAEFKTGAERKDAAENTMVAYKAAQDIALAELAPTHPIRLGLALNFSVFYYEILNSPDRACSLAKQAFDEAISELDTLSEESYKDSTLIMQLLRDNLTLWTSDISEDPAEEIREAPKRDSSEGQ

SEQ ID NO: 6521 - protein, 172 aa, Zea mays
  unsure (1)..(172): unsure at all Xaa locations
ETREIVYTSRTTADSPQLTVKERNLLSAAYNTPIVARPTSWPIISSFKNNEEAPCSFFLVTLINXDILAQIETDLTKICDVIXELLETHLAPSSTAPESKDFYLKMKGDYYRYLAEFKTGAERKDAAENTMVAYKAVQDIALAELAPTHPIRLGLALNFSVFYYEILNSPDR

SEQ ID NO: 6522 - protein, 95 aa, Zea mays
CVSSSQTIGSFQKKYNIGSFELLSKTAPIQAISLIILGPFVDYYLNGRSLLNYPFSGGATFFILLSCSLAVFCNMSQYLCIGRFSATSFQVLGHM

SEQ ID NO: 6523 - protein, 447 aa, Zea mays
LASASSRPASGGATILPSPAGSPRTPPPLQIDHDDRENLSLLRFEALWEAEFAQDSLLVFSTGRTPVSYKGLRRDKPLVTPDVTIMSVGTVIAYGEEMVRDVGWEERLDSDWDRAVVVEETARLPQLTRMQPERNQGPHKVSFFVDKQGAQEVMDYLPKKLERRGVDVKIVYSSGNALDVLPRGAGKGQALVYLLKKLDSNGKPPKNTLVCGDSGNDAELFGVPSVHGVMVCNAQEELVQWYQENARDNPRIIQATERCAAGIMQAIGHLGLGPNVSARDLVGFPAYYPNNNKKGAAATAKPADVVVRFYVLYEKWRRGELPSSNYFSSSSAMRYLKSITHPNGTIIHPCGSERSLHASVDALLSSCYGDKKNFRVWVDRLVTSPIGTSSWLARFDSWEMEGGVRYCCRTTILLNIKPESPEGLELTHIHKTWVQGHSAGPGSALVF

SEQ ID NO: 6524 - protein, 601 aa, Zea mays
GSRLKNSKVNLADAKAICLMECPNPAVDGLNYICDYPEGNIDLSVDDWINRDYDYYEFLTPDMKNSSLQLQGPCYPIIFPTVNVYWSCQFIARASNVSLKHWHETGGVSIDENILIDKTVHKAIDSRSAVLKRYIADIGKSWPVFIVCGGILPVFLSVIWLLMIRYFVAAMTWITVVLFNALVISVTMFFYIKAGWIGNDPLTVVIGESDPYVHISGREISHLHTITILMTAVMIIAFLSSIAIVRRILIATPVLKVAAKVIGEVQALIAFPLLPCLILSILYMFWFSATLHLFSSGQVVRNDCNTDCCSYDLKLGKVNCDNCCGYSIHYTPHISIAILFHLFGCYWATQFILACSSTVVAGSVASYYWARGEISHDIPFLTVVSSLKRLMRYSLGSVALGSLVVSVVEWVRFILECLRRKLKLVDSARESCFGKATSSSSECCLGCIDWTLKSVNRNAYIMIAITGKGFFKASVLATGLIMKNILRIGKVNVIGDVILFLGKLCVSLFCALFAFLMLDTHKYKSAHNKISSPVIPVLVTWALGYVVAKLFFAVVEMSIDTIILSFCQDAEEHQGNAQYAPPALMETLDEQGELQRLTQGP

SEQ ID NO: 6525 - protein, 261 aa, Zea mays
  unsure (1)..(261): unsure at all Xaa locations
MSREDNVYMAKLAEQAERYEEMVEYMEKVAKTVDVEELTVEERNLLSVAYKNVIGAXRRASWRIISSIEHKEESRKNEEHVIQIKEYRGKIEAELSNICDGILKLIDSHLVPSSTAAESKVFYLKMKGDYHRYLAEFKTGAERKEAAESTMIAYKAAQDIGVXPELASTHPIRLGLALNFSVFYYEILNSPDKACNLARAXPFDEAISQLDTLGEDSYKDSTLIMQLXLRDNLTLWTADSTTEDGIEEGNEASKGDAGEGQ

SEQ ID NO: 6526 - protein, 332 aa, Zea mays
MSKARVYADVNVLRPKEYWDYEALTVQWGEQDDYEVVRKVGRGKYSEVFEGINVNNNEKCIIKILKPVKKKKIKREIKILQNLCGGPNIVKLLDIVRDQHSKTPSLIFEYVNNTDFKVLYPTLTDYDIRYYIYELLKALDYCHSQGIMHRDVKPHNVMIDHELRKLRLIDWGLAEFYHPGKEYNVRVASRYFKGPELLVDLQDYDYSLDMWSLGCMFAGMIFRKEPFFYGHDNHDQLVKIAKVLGTDGLNVYLNKYRIELDPQLEALVGRHSRKPWLKFMNADNQHLVSPEAIDFLDKLLRYDHQERLTALEAMTHPYFQQVRAAENSRTRA

SEQ ID NO: 6527 - protein, 521 aa, Zea mays; identical to SEQ ID NO: 5802

SEQ ID NO: 6528 - protein, 174 aa, Zea mays
MAPGSKAERKAALDAGAWMFNVVTSVGIIMVNKALMATHGFSFATTLTGLHFAMTTLMTLVMKWLGYIQPSYLPLPELVKFAFFANLSIVGMNVSLMWNSVGFYQIAKLCIIPVLCILEIIFDKVRYSRDTKLSIVLVFIGVAVCTVTDVSVNSQGLLAAVIAVWSTALQQHAF

SEQ ID NO: 6529 - protein, 145 aa, Zea mays
  unsure (1)..(145): unsure at all Xaa locations
MPTNLEFFWGNIFLGHPCPLLGSPLQKTGVDSTCQGSMAPGSKAERKAALYAGSXMFNVVTSAGIIMVNKALMATHGFSFATTLTGLHFAMTTLMTLVMKXLGYIHPSYLSVPELVKFAFFANLSIVXMNVSLMWDSVGFYQIAK

SEQ ID NO: 6530 - protein, 244 aa, Zea mays
MENQGPKPIRCKAAVCRAAGEPLAIEEVVVDTPKAHEVRIRIICTSLCHSDVTFWRMKDLPDNIPRIFGHEAFGVVESVGEQVDEFAAGDAVVPTFLGQCSECVDCRSARSNMCSKYRFAVRPGMPRDGTTRFTDGQGRPLHHFFGVSSFAEYTVVDVNQVVKLNPAVPPALACLLSCGASTGVGAAWKQAKVEPGSSVAIFGLGAVGLAVAEGARICGASKIIGVDINPEKCELGKHICPCLD

SEQ ID NO: 6531 - protein, 243 aa, Zea mays
WEAIRSSRRTCPRTGNEQPQPSRTVEEGEDSSLATTTTGPGKSKGKGARETSESQKEDYIHVRARRGQATNSHSLAERLRREKISERMKLLQDLVPGCSKVTGKAVMLDEIINYVQSLQRQVEFLSMKLATVNPRLDLNIEGLLSKDLLRFPGVPSSSLGFSPEMMHPQLQLSQPGLIQGGAAGMANPDVFRRIMQAQLSAKDGSQMPPHALNGAFSDVAQQQMAYPSSQDLSIGPSQDGFQM

SEQ ID NO: 6532 - protein, 209 aa, Zea mays
TRRSAPRPPTRCSSSRATCGGQKAVAKKNRDLADRLLNRPPTYKLDRLVLERYPTFVDALRDLDDCLTMVHLFAALPAVDGERVEVKRIHNCRRLSHEWQAYISRTHSLRKTFISVKGIYYQAEVQGQKITWLTPHALQQVLTDDVDFNVMLSFLEFYETLLGFVNFKLYHSINVNYPPILDPRLEALAAELYALCRYMSACFRRMIGN

SEQ ID NO: 6533 - protein, 136 aa, Zea mays
  unsure (1)..(136): unsure at all Xaa locations
MPKHYXPAGKKKEGNAAKYITRTKAVNYLQVSLAIFRKLCILKGVFPRQPKKKVEGNHKTYYHTKDIAFLAHGPFGSQKFRXEIKVHRRKVKKAVXLXKNRDLADRLLNRXPPTYKAWIGGPWKRYPNNSGLNGSL

SEQ ID NO: 6534 - protein, 697 aa, Zea mays
  unsure (1)..(697): unsure at all Xaa locations
IFCFPQNLIKIPTQKPTEETSVARAANHPPSSPVRFLMEPLPSATAAGVGGPGPGYPESTESSPRSRGGDSWDEPFPSSAAAAAAAAGGGGRLRLMCSFGGRIVPRPTDKSLCYLGGETRIVAVDRHASLADVHARLSRSLLGGRPFTLKYQLPNEDLDSLISVSTDEDLDNLVDEYDRIAATSSGGGTSRTSRIRLFLFPAKPESSSSLGSLLDDSSKSENWFVDALNSAISGSLDGIPRGISTDSASVNCLLGLEDDXSVHSRSGVTNSAPTEDQRASQPKAPRRAPPLLAAGAGRHPHDVQSVPDSPMLDKNSSFGSTSSAPSLSNLPPIRVRPEDRPSDARIMQPTAVEDHFAQMGISEQQLPMYIQAQQQVPIPAMTGMSPSEASSRMFSDDDKSDHGGGGGRKPQPPKQDVPPVVDPTNRAVYYNDRSPPAELKRDMPVGTEAASYRLPVSAPDAAAAAAATAATQAPPGYVLAQMHAPPPPQQPPPQQQPQQPAPQQIVAAGNQHFIHNPATGTFIPIQSYYHHPVHQQAPQTMQRQQQAPTFDPNTGMYYVPMQQNAHQAYGVPPGAQVTLPPPTLVDTTPKPTVPIPQMAVRPELQQPGVYRTTAAATPXPAPNAAPGYAGMAYHHVIQSHHHHHPAPQPVANMAGNYGYEFADPTRPQVYYSQAAAPPTLPQYPPIVSPDAGQAEKH

SEQ ID NO: 6535 - protein, 274 aa, Zea mays; identical to SEQ ID NO: 1176

SEQ ID NO: 6536 - protein, 107 aa, Zea mays
MAVHGGDYLRRFVAETEWYNEVVLSAVAPGDWWRGLPHPVQSWMRNCVGGYLLYFISGFLWCFVIYYWKRHAYIPKGNVGCAHGTSVLSKGGTIRAKVGVPLEPVGG

SEQ ID NO: 6537 - protein, 332 aa, Zea mays
  unsure (1)..(332): unsure at all Xaa locations
MSKARVYTDVNVLRPKEYWDYEALTVQWGEQDNYEVVRKVGRGKYSEVFEGINVNNNEKCIIKILKPXXXXXXXXXXKILQNLYGGPNIVKLLDIVRDQHSKTPSLIFEYVNNTDFKVLYPTLTDYDIRYYIYELLKALDYCHSQGIMHRDVKPHNVMIDHELRKLRLIDWGLAEFYHPGKEYNVRVASRYFKGPELLVDLQDYDYSLDMWSLGCMFAGMXFRKEPXXYGHDNHDQLVKIAKVLGTDGLNVYLNKYRIELDPQLEALVGRHSRKPWTKFINADNQHLVSHEAIDFLDKLLRYDHQDRLTAREAMTHPYFQQVRAAENSRTRA

SEQ ID NO: 6538 - protein, 205 aa, Zea mays
  unsure (1)..(205): unsure at all Xaa locations
RLALSVENTSSGREYKVKDLSQADFGRLEIELAEVEMPGLMACWGEFGPSKPFAGARISGSLHMTIQTAVLIETLTALGAEVRWCSCNIFSTQDHAAAAIARDSAAVFAWKGETLEEYWWCTERCLDWGEAGGPDLIVDDGGDATLLIHEGVKVEEDYEKTGKIPDPESTDNAEFKIVLTIIRDGLKGDPXEYRKMNDRLVGVSE

SEQ ID NO: 6539 - protein, 474 aa, Zea mays
  unsure (1)..(474): unsure at all Xaa locations
MPKPPPPTSDPSLPTTTTTSTPKSSSRPAPAGLLDPLAASGRSLLASARRSPVTTLAGAFFLLALVMYGEDARTIAELSIDDYLYPDADLYNVSGLPPLALPPPTCDLSSGRWVFDNASVPAYREKDCTFLTKQVTCLANGRPDDMWQYWRWQPSDCSLPTFDARRFMEAMRGKRLMFVGDSLNRNQWESLVCLVQPILSKGRKKIVKRGSLNTFYAKEYRATLEFYWAPFLVESNSDNPNFHSIKERIISPERIEAHARNWKDVDYLIFNTYIWWMNTADIKVRRPNSRYWSENDEVPRIEAYGRVFKTWSDWLNNNIDPARTSVFFMTISPIHISPQNWGNPGGIRCVKETLPYQNYSQPLDLYHDMRLYDLVIKVASSMEKVPVSVINITKMSDYRKDAHASVYTIRQGKLLTXPKQKADPEKFADCIHWXCLPGVPDVWNQILYTRILSKSPWRSNFSPPPSQSTPLPPQ

SEQ ID NO: 6540 - protein, 354 aa, Zea mays
FGSSSCQFTADIIAMNNADFIITSTYQEIAGSKNTVGQYESHTAFTLPGLYRVVHGIDVFDPKFNIVSPGADMSIYFPHTEKAKRLTSLHGSIENLIYDPEQNDEHIGHLDDRSKPILFSMARLDRVKNITGLVEAFAKCAKLRELVNLVVVAGYNDVNKSKDREEIAEIEKMHELIKTHNLFGQFRWISAQTNRARNGELYRYIADTHGAFVQPAFYEAFGLTVVEAMTCGLPTFATLHGGPAEIIEHGVSGFHIDPYHPEQAANLMADFFERCKQDPDHWVKISGAGLQRIYEKYTWKIYSERLMTLAGVYGFWKYVSKLERLETRRYLEMFYILKFRELAKTVPLAIDQPQ

SEQ ID NO: 6541 - protein, 501 aa, Zea mays
MASSSTDLADDGFAAPRLFSQGVSYTYDDVIFLPGYIGFPADAVDLSTRLSRRIPLSIPCVASPMDTVSEAAMAAAMASLGAAAVVHCNTDPHAQAAIVRAAKSRRLPFVSSVPFFSPSSAPTLNDFAGTEYALVTERGDSLSRLVGVAVAADAASREVPVSVSEYMRPTPRSASAAFDFEEAATFLADEGLDYAPLVSDDGEVVDLITAKDVERIRSYPKLGKPSLGASGKFVVAASIGTREDDKGRLEQLVKAGANAIVIDSSQGNSIYQLDMIKFAKKMYPEVDLIGGNVVTIAQAQNLIQAGVDGLRVGMGSGSICTTQEVCAVGRGQATAVYKVSSYAKDHNVPVIADGGISNSGHIVKALSLGASTVMMGSFLAGSHEAPGTYEYKDGRRVKKYRGMGSLEAMTKGSDARYLGDTLKLKVAQGVVGAVADKGSVLRFIPYTMQAVKQGLQDLGADSLQSAHDLLRSETLRLEVRTGAAQAEGGIHGLVSYEKKAF

SEQ ID NO: 6542 - protein, 497 aa, Zea mays
  unsure (1)..(497): unsure at all Xaa locations
SADLAAVGFAGPRLFSLGVSYTYDDVIFLPGYIGFPADAVDLSTRLSRRVPLSTPCPXVASPMDTVSEAAMAAAMASLGAAAVVHRNTEPHAQAAIVRAAKSRRLPFVSSVPFFSPSSAPTLNGFAGSDYALVTERGDSLSRLVGVAVAADAVSRDVPVAVSEYMRMRQTPRSASASFDFEEAAAFLDEGLDYAPLVSDDGEVVDLITVKDVERIRSYPKLGKPSLGVDGKFVVAASIGTREDGKGRLERLVKAGANAIVIDSSQGNSIYQLDMIKFAKKMYPEVDFIGGNAVTIAQAQNLIQAGADGLRVGMGSGSICTTQEVCAVGRGQATSVYKVSSYANDHNVPVIADGGISNSGHIVKALSLGASTVMMGSFLAGSYEAPGTYEYKDGRRVKKYRDMGSLEAMTKGSDVKYLGDTFKLKVAHGVVGAVADKGSVLRFIPYTMQAVGQGXGADSLRSAHDLLRSETLRLEVRTGAAQVEGGIHGLVSYEKKAF

SEQ ID NO: 6543 - protein, 371 aa, Zea mays
  unsure (1)..(371): unsure at all Xaa locations
MDTVSEAAMAAAMASLGAAAVVHRNTEPHAQAAIVRAAKSRRLPFVSSVPFFSPSSAPTLNGFAGSDYALVTERGDSLSRLVGVAVAADAVSRDGLDYAPLVSDDGEVVDLITVKDVERIRSYPKLGKPSLGVDGKFVVAASIGTREDGKGRLERLVKAGANAIVIDSSQGNSIYQLDMIKFAKKMYPEVDFIGGNAVTIAQAQNLIQAGADGLRVGMGSGSICTTQEVCAVGRGQATSVYKVSSYANDHNVPVIADGGISNSGHIVKALSLGASTVMMGSFLAGSYEAPGTYEYKDGRRVKKYRDMGSLEAMTKGSDVKYLGDTFKLKVAHGVVGAVADKGSVLRFIPYTMQAVGQGXGADSLRSAHDLL

SEQ ID NO: 6544 - protein, 261 aa, Zea mays; identical to SEQ ID NO: 6425

SEQ ID NO: 6545 - protein, 370 aa, Zea mays
  unsure (1)..(370): unsure at all Xaa locations
MAMMVDPPNGMASQGKHYYTMWQTLFEIDTKYVPIKPIGRGAYGIVCSSVNRETNEKVAIKKINNVFDNRVDALRTLRELKLLRHLRHENVIALKDIMMPAHRRSFKDVYLVYELMDTDLHQIIKSSQPLSNDHCQYFLFQLLRGLKYLHSAGILHRDLKPGNLLVNANCDLKICDFGLARTNNTKGQFMTEYVVTRWYRAPELLLCCDNYGTSIDVWSVGCIFAELLGRKPIFPGTECLNQLKLIVNVLGTMGEADLAFIDNPKARKYIKSLPYAPGAPFTGMYPQAHPLAIDLLQKMLVFDPSKRISXVTEALEHPYMSPLYDPSANPPAQVPIDLDIDENLGVDMIREMMWQEMIHYHPEVLTRISM

SEQ ID NO: 6546 - protein, 112 aa, Zea mays; identical to SEQ ID NO: 5393

SEQ ID NO: 6547 - protein, 227 aa, Zea mays
  unsure (1)..(227): unsure at all Xaa locations
MADELRSTSGQKFHGQSVLLSRISSYSAMNNPVFNNAYSAYNVPQRSYHGMNATAGLSSVMAPSPVFASAPKEKGFSGFMIDFMMGGVSAAVSKXAAAPIERVKLLIQNQDEMLKTGRLSEPYKGIGDCFGRTIRDEGFVSLWRGNTANVIRYFPTQVPHAIPSNHFFWCYVIIIHAHMFALAKPKFSILLQALNFAFKDHFKRMFNFKKDKDGYWKWFAGNLASGG

SEQ ID NO: 6548 - protein, 184 aa, Zea mays
  unsure (1)..(184): unsure at all Xaa locations
MTNTIQKKFKVSSTQLLYQSCPYQSLTLFLIGPFLDGFLTNQNVFAFNYTSQVVFFIVLSCLISVSVNFSTFLVIGKTSPVTYQVLGHLKTCLVLAFGYVLLHDPFSWRNILGILIAVVGMVLYSYFCTVETQQKNVEVSPQQVKEXEAGPLIADSMSKVENGGGGVDDEPLKVPMWSSKYSRE

SEQ ID NO: 6549 - protein, 525 aa, Zea mays
  unsure (1)..(525): unsure at all Xaa locations
MAAVGAPGSSLHGVTGREPAFAFSTEHEEAASNGGKFDLPVDSEHKAKSVRLFSVANPHMRTFHLSWISFFTCFVSTFAAAPLVPIIRDNLNLTKADIGNAGVASVSGSIFSRLTMGAVCDLLGPRYGCAFLIMLSAPTVFCMSLIDDAAGYIAVRFLIGFSLATFVSCQYWMSTMFSSKIIGTVNGLAAGWGNMGXRRHAAHXMPLVYDVIRKCGATPFTAWRLAYFVPGLMHVVMGVLVLTLGQDLPDGNLRSLQKKGNVNKDSFSKVMWYAVINYRTWIFVLLYGYCMGVELTTDNVIAEYMYDRFDLDLRVAGTIAACFGMANIVARPMGGIMSDMGARYWGMRARLWNIWILQTAGGAFCLWLGRASTLPVSVVAMVLFSFCGQAACGAIFGVIPFVSRRSLGIISGMTGAGGNFGAGLTQLLFFTSSTYSTGRGLEYMGIMIMACTLPVVFVHFPQWGSMFFPPSATADEEGYYASEWNDDEKSKGLHSASLKFAENSRSERGKRNVIQADAAATPEHV

SEQ ID NO: 6550 - protein, 114 aa, Zea mays
GMYDSLKPVLLTEKLQDNFFASLALGWMITNGASLASYPLDTIRRRMMMTSGEAVKYKSSMDAFAQIVRNEGPKSLFKGAGANVLRAIAGAGALAGYDQLQLIFFGKKYGSGGA

SEQ ID NO: 6551 - protein, 182 aa, Zea mays; identical to SEQ ID NO: 5814

SEQ ID NO: 6552 - protein, 338 aa, Zea mays; identical to SEQ ID NO: 846

SEQ ID NO: 6553 - protein, 111 aa, Zea mays
CRQLLPFLLLWLFTKVGTYLTRPVPSCCHAESNGATAAAADDGLVMTQEGDADATSNGNDDDEISSVSESETMTGAKEACGTEGNDKEECLQRRLLGDAHLDYIYTQHKGK

SEQ ID NO: 6554 - protein, 276 aa, Zea mays
QSSLPCLSLCQRQRPTPTPTLPPAAGEHRQSTVTAVDVPLPQVRPAPAARAQPSGRQVPGSVPRSKRRKNQVKKVVCHVPADGSSSDMWAWRKYGQKPIKGSPYPRGYYRCSSSKGCAARKQVERSRADPNTFILTYTGEHNHAAPTHRNSLAGTTRNKFPSSAAPPPPPPSPSPSPASTSTAGLSPTTPLRTPSMEEEEMDDDDDELLVEDMEMVGEDELLFLNIDADAEADSGAPLEPMPSLFDVVDEPFLNSPWVTATSSAGEPATGAAGARS

SEQ ID NO: 6555 - protein, 332 aa, Zea mays
  unsure (1)..(332): unsure at all Xaa locations
MKIQCDACEGAAATVVCCADEAALCARCDVEIHAANKLASKHQRLPLEALSASLPRCDVCQVRTSPAHCACATRGTRQAGTSXNEATTPPRARSQEKAAFIFCVEDRALFCRDCDEPIHVPGTLSGNHQRYLATDIRVGFASASSACSDACDAHDDSDHHAPPKAAVSSAAQQVPSPPQFLPQGWAVDELLQFSDCESSDKARRXRKLRSMTNNLPACTHRLMHGLVCVCVLQLHKESPLGFKELEWFTDIDLFHEQTPKAGRRLAEVPELSGTQAXAHSPAKTAMAELFASPQPVSNAGFYKANGARLFKKSRMEVPDDDDEDYFIVPDLG

SEQ ID NO: 6556 - protein, 261 aa, Zea mays
MRIQCDACEAAAATVVCCADEAALCARCDVEIHAANKLASKHQRLPLALGDAAALPASLPRCDVCQERPAFIFCVEDRALLCRDCDEPIHVPGTLSGNHQRYLATGIRVGFSSVCGASAEGLPPAPPKGSSKPAAVVSAPAAGTTTKTRTVKDALPQEVPSSPFLPPSGWAVEDLLELSDYESSDKKDSSLGLKELEWFEDIDLFHAHSPAKTAMAEFFASPQPVSNAGFYKANGARLFKKSRMEVPDDDDEDYFIVPDLG

SEQ ID NO: 6557 - protein, 312 aa, Zea mays
MLIFLGGCWPACLHWKPRPTLGRSRPKGPCHWLSPPGRRAAAGRLEAPFPTGGMRIQCDACEAAAATVVCCADEAALCARCDVEIHAANKLASKHQRLPLGDAAALPASLPRCDVCQERPAFIFCVEDRALLCRDCDEPIHVPGTLSGNHQRYLATGIRVGFSSVCGASAEGLPPAPPKGSSKPAAVVSAPAAGTTTKTRTVKDALPQEVPSSPFLPPSGWAVEDLLELSDYESSDKKDSSLGLKELEWFEDIDLFHAHSPAKTAMAEFFASPQPVSNAGFYKANGARLFKKSRMEVPDDDDEDYFIVPDLG

SEQ ID NO: 6558 - protein, 269 aa, Zea mays
RAGPGSIDCRQRGGAAIKIQCDACEGAAATVVCCADEAALCARCDVEIHAANKLASKHQRLPLEALSASLPRCDVCQEKAAFIFCVEDRALFCRDCDEPIHVPGTLSGNHQRYLATGIRVGFASASSACSDACDAHDDSDHHAPPKAAVSSAAQQVPSPPQFLPHGWAVDELLQFSDCESSDKLHKESPLGFKELEWFTDIDLFHGQTPKAGRRLAEVPELFGTQAANGAAYYRPAKATATAGTGVRQSKKARTEVTDDEDHLIVPDLG

SEQ ID NO: 6559 - protein, 370 aa, Zea mays; identical to SEQ ID NO: 688

SEQ ID NO: 6560 - protein, 275 aa, Zea mays
RAELARANGVTDIVEVIQGTVEDVDLPEKVDVIISEWMGYFLLRESMFDSVICARDRWLKPDGVMYPSHARMWLAPIRTGLGDKKREDFDIAMDDWSLFVQDTQTYYGVNMNALTKAYRAEHEKYYLKSSIWNNLHPNQVIGQPAAIKEIDCLTATVDEIREVRAQVTLPIRMEARLSALAGWFDVHFRGSAQNPGVEEVELTTAPDEHGGTHWGQQVFLLTPPLSVTKGDNVNVSFSMVRSKENHRLMDMEFTYELHELSGRKHPAVKTKMYLE

SEQ ID NO: 6561 - protein, 435 aa, Zea mays
MEMKLTIRRVPTVVSNYQEDADKPRAGCGRNCLGDCCLPASKLPLYAFKLSPAKGSQEDAASTKLLVDILLSEWEDRMTRGLFRYDVTACETKVIPGNLGFVAQLNEGRHLKKRPTEFRVDRVLQPFDPAKFNFTKVGQEEVLFQFENSGGDDSYFLNNAPIIAVDRAPNVIAINVSPIEYGHVLLIPRVLDRLPQRIDPESFLLALQMAAEGGSPYFRLGYNSLGAFATINHLHFQAYYLSVPFPVEKAATHKIPLSEDTKKNGVTVSKLINYPVRGLVFEGGNTLDDLATVVSNACIWLQDNNVPYNVLISDCGKRVFLFPQCYAEKQALGEVSQELLDTQVNPAVWEISGHMVLKRRMDYEEASETSAWKLLAEVSLSEERFEEVKAYIFSAAGLVQYDEEEEEASDGEGPTAYVPVKVTPLPVAEGCLVLP

SEQ ID NO: 6562 - protein, 179 aa, Zea mays
MFFLQWFLQVSPIEYGHVLLIPRVLDRLPQRIDPESFLLALQMAAEGGSPYFRLGYNSLGAFATINHLHFQAYYLSVPFPVEKAATHKIPLSEDTKKNGVTVSKLINYPVRGLVFEGGNTLDDLATVVSNACIWLQDNNVPYNVLISDCAKRVFLFPQVNPLNVVATLDCDGRGAVHSR

SEQ ID NO: 6563 - protein, 123 aa, Zea mays
MFLQLINYYVKEKYTLRYTGGMVPDVNQIIVKEKGIFTNVTSPTAKAKLRLLFEVAPLGFLMEKAGGYSSDGKQSVLDRVINELDERTQVAYGSKNEIIRFEETLYGSSRLAASATATARALI

SEQ ID NO: 6564 - protein, 974 aa, Zea mays
MGGKYRAARTKRWWRGLAAAGWVLTAVVCSAVMHWTLRRDSMDRAEERLVSMCEERARMLQEQFGVTVNHVHAIAILISTFNFEKSPPAIDQDTFAKYTARTSFERPLLNGVAFAQRVFHHEREMFESQQGWVMNTMQREPAPPQVEYAPVIFSQDTVSYLARIDMMSGEEDRENIFRARTTGKAVLTNPFRLLGSNHLGVVLTFAVYRPDLPADASVEQRVEATIGYLGGAFDVESLVENLLSKLAGNQDIVVNVYDVTNASDAMVLYGPSSLDEQVPFLHVSMLDFGDPFRKHEMRCRYRQKLPMPWSAITNPLGTFVIWMLLGYSIAAAYSRYDKVTEDCRKMEELKTQAEAADVAKSQFLATVSHEIRTPMNGVLGMLDMLLGTDLTMTQKDYAQTAQMCGRALITLINDVLDRAKIEAGKLELEAVPFDLRSLMDDVVSLFSSKSREKCIELAVFVCDNVPKVVIGDPWRFRQILTNLVGNAVKFTERGHVFVRVCLAENSNMEANQVLHGAMNGKGGRVESTANGAFNTLSGFEAADRRNSWQYFKLLLSDKESLLDDLESENSNQSDSDRVTLAISIEDTGVGIPLQAQDRVFTPFMQADSSTSRNYGGTGIGLSISKCLAELMGGQISFTSHPSVGSTFTFSATLKHSYKDISGDSSRSLTEALPTAFKGMKAILVDGRPVRSAVTRYHLKRLGILLQVVNNMNAVVKAFPGQNGAAGSREKASILFIESDFWRPETDVQLLNHLREQKNGQLSDGHKVVLLVTSEADKDKYGSIFDIVMCKPIRASTIASSIQQLLKVEIAERKDNQNRPSFLRSLLVGKNILVVDDNKVNLRVAAAALKKYGANVSCVESGKDAISLLQPPHRFDACFMDVQMPEMDGFEATGQIRQMELKANEERKNKLASIEGSTTAEYHLPVLAMTADVIQATYEECIKSGMDGYVSKPFDEEQLYQAVSRLVVGTTDSAV

SEQ ID NO: 6565 - protein, 625 aa, Zea mays
VIALLIGYIVHATAKRIARVEDDFQEMSLLKKRAEDADIAKSQFLATVSHEIRTPMNGVLGMLQMLMDTDLDTTQQDYVRTAQASGKTLVSLINEVLDQAKIESGKLELEVVPFDLRTVCDDILSLFCGKAQEKGLELAVFVSDQVPQTLIGDPGRIRQIITNLVGNSIKFTEKGHIYLTVHVVEEIMHCLEVETGTQYTNTLSGYPVANRKRSWENFRLFSRELNSSEMPFAPIASDSISLMISVEDTGAGIPFDAQSRVFTPFMQVGPSIARIHGGTGIGLSISKCLVGLMRGEIGFASKPQVGSTFTFTAVLTRVHSSRNENKSSEFKEINALVVDHRPVRAKVTKYHLQRLGVQTELTTDLDQYISKNNCGSQIAKLVLIDKETWLKESHSMPLLVTKLRNKDQPDSTKLFLLENPKSSVKSNSHIFREYNLNVIMKPLRASMLQVSLQRALGGIDKLHCRNGVVGNSTLGSLLHKKRIIVVDDNIVNLKVAAGALKKYGAEVTCADSGKKAITQLKPPHSFDACFMDIQMPEMDGFEATKRIRVMERDLNEQIERGEAPPECAGLRQWRTPILAMTADVIQATHEQCLKSEMDGYVSKPFEGEQLYREVARFFQNQDQVQ

SEQ ID NO: 6566 - protein, 161 aa, Zea mays
SSVSHLFLFNRFIQSPPWPWMAITTSIGTLVIALLIGYIVHATAKRIARVEDDFQEMSLLKKRAEDADIAKSQFLATVSHEIRTPMNGVLGMLQMLMDTDLDTTQQDYVRTAQASGKTLVSLINEVLDQAKIESGKLELEVVPFDLRTVCDDILSLFCGKA

SEQ ID NO: 6567 - protein, 246 aa, Zea mays
MALSVEKTSSGREYKVKDLSQADFGRLEIELAEVEMPGLMACRAEFGPSKPFAGARISGSLHMTIQTAVLIETLTALGAEVRWCSCNIFSTQDHAAAAIARDSAAVFAWKGETLEEYWWCTERCLDWGEAGGPDLIVDDGGDATLLIHEGVKAEEDYEKTGKIPDPESTDGLKADPKKYRKMKERLVGVSEETTTGVKRLYQMQETGALLFPAINVNDSVTKSKFDNLYGCRHSLPDGLMRATDVM

SEQ ID NO: 6568 - protein, 145 aa, Zea mays
  unsure (1)..(145): unsure at all Xaa locations
MALSEEKTSSGRXYKDKDLSQADFGRLEIELADDEMPGLMACRAEFGPYKPFAGARISESLHMTIQTAVLIKTLTALGAQVHWCSCNILFTHDHAAGAIWRDSLVVFGWNGETLEEYWWRTERWLDXREAYGPHLILDNGWDDTL

SEQ ID NO: 6569 - protein, 471 aa, Zea mays
MGSLPLLAACCSLLLTVAAPARDSTTSVCASQIGDFPHRNSSGLHLTLHHPQSPCSPAPLPSDLPFSTVLTHDDARVAHLASRLAASDPPSRRPTSLRKQKKAAGGASGGHHLDDDSLASVPLSPGTSVGVGNYVTQLGLGTPSTSYAMVVDTGSSLTWLQCSPCVVSCHRQVGPLFDPRASSTYASVRCSASQCDELQAATLNPSACSASNVCIYQASYGDSSFSVGYLSTDTVSFGSTSYPSFYYGCGQDNEGLFGRSAGLIGLARNKLSLLYQLAPSLGYSFSYCLPTAASTGYLSIGPYNTGHYYSYTPMASSSLDASLYFITLSGMSVGGSPLAVSPSEYSSLPTIIDSGTVITRLPTAVHTALSKAVAQAMAGAQRAPAFSILDTCFEGQASQLRVPTVAMAFADGASMKLTTRNVLIDVDDSTTCLAFAPTDSTAIIGNTQQQTFSVFYDVAQSRIGFSAGGCS

SEQ ID NO: 6570 - protein, 358 aa, Zea mays
  unsure (1)..(358): unsure at all Xaa locations
MGRDGGGGVAGGMSESVLRKVLLSYLYVAVWIFLSFSVIVYNKYILDPKMYNWPFPISLTMVHMGFCSSLAVALVRVLRVVDLPTSPSMTPQLYTSSVVPIGALYAMSLWFSNSAYIYLSVSFIQMLKALMPVAVYSIGVLFNKETFRSSSMLNMLSISFGVAIAAYGEARFDVRGVALQLAAVAFEATRLVLIQILLTSKGISLNPITSLYYVAPCCLCFLVVPWVFVELPRLRAVGTFQPDFFVFGTNSLCAFALNLAVFLLVGKTSALTMNVAGVVKDWLLIAFSWSVIXRDTVTPINLFGYGIAFLGVAYYNHVKLQALKAKEAQKKAAQADEEVGSLLQERDGHGDHKSDNQA

SEQ ID NO: 6571 - protein, 407 aa, Zea mays
STVDLQTLIMGNRDVIDEMSSTNAAVLTSALKLIDKYDLYGQVAYPKHHKQSEVPDIYRLAARTKGVFINCALVEPFGLTLIEAAAYGLPMVATRNGGPVYIHRVLDNGILVDPHNQNVIAEALYKRVSDKHLWSQCRQNGLVNIHKFSWPEHCQNYLARVVTLKPRHPRWQKNDVAAEISEADSPEDSLRDIHDISLNLKLSLDSEKSGSKEGNSNALRRHFEDAAQKLSGVNDIKKDVPGENGKWSSLRRRKHIIVIAVDSVQDADFVQVIKNIFEASRNERSSGAVGFVLSTARAISELHTLLISGGIEASDFDAFICNSGSDLCYPSSSSEDMLNPAELPFMIDLDYHSQIEYRWGGEGLRKTLIRWAAEKNKESGQKIFIEDEECSSTYCISFKVSNTAGMQ

SEQ ID NO: 6572 - protein, 358 aa, Zea mays
LLTFTTHVYLSFNYFQGVFINCALIEPFGLTLIEAAAYGLPMVATRNGGPVDIHRVLDNGILVDPHNQNEIAEALYKLVSDKHLWSQCRQNGLKNIHKFSWPEHCQNYLARVVTLKPRHPRWQKNDVAAEISEADSPEDSLRDIHDISLNLKLSLDSEKSGSKEGNSNALRRHFEDAAQKLSGVNDIKKDVPGENGKWSSLRRRKHIIVIAVDSVQDADFVQVIKNIFEASRNERSSGAVGFVLSTARAISELHTLLISGGIEASDFDAFICNSGSDLCYPSSSSEDMLNPAELPFMIDLDYHSQIEYRWGGEGLRKTLIRWAAEKNKESGQKIFIEDEECSSTYCISFKVSNTAGMQ

SEQ ID NO: 6573 - protein, 515 aa, Zea mays
MELAGAASPHPPPESHVAPPRPPPQPPEEDLCEDRGDMSVTGEKPCTHRESDVGQTNSCSLNNSSECENHTPSNDEISEPESNLEMAKTDQGGDVPSGEKVLKKPDKILPCPRCNSMDTKFCYYNNYNIKQPRHFCKSCQRYWTAGGSMRNIPVGAGRRKSKSSSASCRSVLIPVPGSSSVANPGGEASLFPLSVKANQAAVSFGPDSPLCTSMASVLKIGGGGEQVKSCSPASAAAQPRNGETQTQTCAPSSAATTPSDGPGNGLQKGAESAHQNQNQNQNGIIGHSNGVTPVHPIPFFPGPPFVYPWSPAWNGIPAMAAAVCAAPATAEAAISSEHGTASSTVQWNVPPAIVPVLPPGFCGPIPVPVIPPPSVWPLITPWPNAAWSAPWLGPSASVPPGSSRSSGSSTCSDSGCGSGSPVLGKHSRESRPQGDEKAERRCLWIPKTLRIDDPVEAAKSSIWTTLGIEPGDRGMFRPFQSKHGRQQELQASGAARALQANPAALSRSQSFQETT

SEQ ID NO: 6574 - protein, 224 aa, Zea mays
MELAGAASPHPPPESHVAPPRPPPQPPEEDVCEDRGDMSVTGEKACTHRESDVGQTNSCSLNNSSECENHTASNDEISEPESNLEMAKTEGGDAPSGENVLKKPDKILPCPRCNSMDTKFCYYNNYNIKQPRHFCKSCQRYWTAGGSMRNIPVGAGRRKSKSSSASCRSVLIPVPGSSSVANPGGEASLFPLSVKANQTCHICSVQYDWQHRCCCCTRQRAPLL

SEQ ID NO: 6575 - protein, 162 aa, Zea mays
  unsure (1)..(162): unsure at all Xaa locations
MARPQQRYRGVRQRHWGSWVSEIRHPLLXDRARLGLKARIWLGTFETAEDAARAYDEAARIMCGPRARTNFPADANGPPPSFLSAALVDKLHRFNLASVQAAQRQREAAAAAAAAAATSAPATPPTPPATQWGGGGRSLEEQHVEQMIEELLDSDFSMEICC

SEQ ID NO: 6576 - protein, 335 aa, Zea mays
  unsure (1)..(335): unsure at all Xaa locations
MEDAKMGNGATIRAVLAILQWWGFNVTVIIINKWIFQKLEFKFPLTVSCVHFICSSIGAYIAIKVLRTKPLIEVASEDRWRRIFPMSLVFCVNIVLGNVSLRYIPVSFMQTIKSFTPATTVVLQWLVWRKYFEWRIWASLVPIVGGILVTSVTELSFNTAGFXAALVGCLATSTKTILAESLLHGYKFDSINTVYYMAPLATLIXLSVPAVALEGGXVLGWLRTHESVGPALAVVVTSGVLAFCLNFSIFYVIHSTTAVTFNVAGNLKVAVAVLASWMVFRNPISAMNALGCGVTLVGCTFYGYVRHRLSQNQAPRARLEMQMLPLTVDKQGDKI

SEQ ID NO: 6577 - protein, 332 aa, Zea mays
MSKARVYADVNVLRPKEYWDYEALTVQWGEQDDYEVVRKVGRGKYSEVFEGINVNNNEKCIIKILKPVKKKKIKREIKILQNLCGGPNIVKLLDIVRDQHSKTPSLIFEYVNNTDFKVLYPTLTDYDIRYYIYELLKALDYCHSQGIMHRDVKPHNVMIDHELRKLRLIDWGLAEFYHPGKEYNVRVASRYFKGPELLVDLQDYDYSLDMWSLGCMFAGMIFRKEPFFYGHDNHDQLVKIAKVLGTDGLNAYLNKYRIELDPQLEALVGRHSRKPWLKFMNADNQHLVSPEAIDFLDKLLRYDHQERLTALEAMTHPYFQQVRAAENSRTRA

SEQ ID NO: 6578 - protein, 332 aa, Zea mays
MSKARVYADVNVLRPKEYWDCEALTVQWGEQDDYEVVRKVGRGKYSEVFEGINVNNNEKCIIKILKPVKKKKIKREIKILQNLCGGPNIVKLLDIVRDQHSKTPSLIFEYVNNTDFKVLYPTLTDYDIRYYIYELLKALDYCHSQGIMHRSRPAGNVMIDHELRKLRLIDWGLAEFYHPGKEYNVRVASRYFKGPELLVDLQDYDYSLDMWSLGCMFAGMIFRKEPFFYGHDNHDQLVKIAKVLGTDGLNAYLNKYRIELDPQLEALVGRHSRKPWLKFMNADNQHLVSPEAIDFLDKLLRYDHQERLTALEAMTHPYFQQVRAAENSRTRA

SEQ ID NO: 6579 - protein, 344 aa, Zea mays; identical to SEQ ID NO: 919

SEQ ID NO: 6580 - protein, 366 aa, Zea mays
  unsure (1)..(366): unsure at all Xaa locations
MEAEKKPPAVSDVGAWAMNVVSSVSLIMANKQLMSSSGYAFAFATTLTGFHFTVTALVGWISNATGYSVSKHVPLWELVWFSLVANTSITGMNLSLMLNSVGFYQISKLSMIPVVCLMEWVLNSKHYTTKVISAVIVVAAGVGICTVTDVEVNAKGFICACVAVFCTSLQQITIGSFQKKYNIGSFELLSKTAPIQALSLIILGPFVDYYLNGPVIXNYPFSGGATFFILLSCSLAVFCNMSQYLCIGRFSATSFQVLGHMKTVCVLILGWILFDGPHPENILVGMLLAVMGMVVYSWGVEAEKRHGSGEEGGSPGPPDQERNARRRGRTSQGQGERRARSRPRGRRDEELAAAAAADSFILLVLL

SEQ ID NO: 6581 - protein, 344 aa, Zea mays
MEAEKKAPAVSDVGAWAMNVVSSVSLIMANKQLMSSSGYAFAFATTLTGFHFTVTALVGWISNATGYSVSKHVPLWELVWFSLVANTSITGMNLSLMLNSVGFYQISKLSMIPVVCLMEWVLNSKHYTTKVISAVVVVAAGVGICTVTDVEVNAKGFICACVAVFCTSLQQITIGSFQKKYNIGSFELLSKTAPIQAISLIILGPFVDYYLNGRSLLNYPFSGGATFFILLSCSLAVFCNMSQYLCIGRFSATSFQVLGHMKTVCVLILGWILFDSALTVKNILGMLLAVMGMVVYSWAMEAEKKAAAPVPRIKSEMLDGEDVPLKARVSGVPAVDLEDGEMKS

SEQ ID NO: 6582 - protein, 136 aa, Zea mays
GCVLLGGEGKRRRGAMEAEKKAPAVSDVGAWAMNVVSSVSLIMANKQLMSSSGYAFAFATTLTGFHFTVTALVGWISNATGYSVSKHVPLWELVWFSLVANTSITGMNLSLMPATSFQVLGPHLDRVRADPRLDPV

SEQ ID NO: 6583 - protein, 185 aa, Zea mays
  unsure (1)..(185): unsure at all Xaa locations
MEAEKKAPAVSDVGAWAMNVVSSVSLIMANKQLMSSSGYAFAFATTLTGFHFTVTALVGWISNATGYSVSKHVPLWELVWFSLVANTSITGMNLSLMLNSVGFYQISKLSMIPVVCLMEWVLNSKHYTTKVISAVVVVAAGVGICTVTDVEAXARGFICPCARGICTPIQQIVRFSFFTPLFFGL

SEQ ID NO: 6584 - protein, 143 aa, Zea mays
  unsure (1)..(143): unsure at all Xaa locations
IHYSWGESKHHHHHLFHHKKDEEQLAPRRYXKSAEYTAATVTEGVPTADNXYNEYKKEEKEHKHKQHLGEAGAIAAGAFALYXEKHEANKDLEHAHRHKIHDEVSAAAARCSGGFAFHEHHXKKKDHKEAEEAXGEKKHHFFG

SEQ ID NO: 6585 - protein, 138 aa, Zea mays
  unsure (1)..(138): unsure at all Xaa locations
MAEEKHHHHHLCHHKKDEEQIAVGGYGESAVYTEATVTAVVFTGENXFDXYKKEEKEHKHKQHLRXAGAIDACTLKLYQKHEAKNDPEHAHLHMIEEDVAVEDDVGSGGFSFHEHHXKKKDHKEAIEVCCQNKHHLFV

SEQ ID NO: 6586 - protein, 384 aa, Zea mays
MGIWDSILPGGGRRFIKRKDSDAGEAGRALEELRGSLYNDFHTSEGARRQQQKLCGPIVALTFNFVVAVGIIMANKMVMGAVGFNFPVALSLIHYLFAFALMSVLKALYLLPIASPSKSTPFSSLFALGAVMSFSTGLANISLKHNSVGFYQMAKIAVTPTIVVAEFILFKKKVSLRKVSTLVVVSFGVAVATVTDLEFNFFGACVALAWIIPSAVNKILWSNLQQSGNWTALALMWKTTPITIFFFIVLMPLLDPPGLLSFSWDFKNSSTIIISALFGFLLQWSGALALGATSALAHVVLGQFKTIVIMLSGYLVFKSDPGFTSLCGAVIALAGMSVYTYLGMKESAASGRRNSLNSRQNSHLKKPKAIIDGENPETKPMDSV

SEQ ID NO: 6587 - protein, 333 aa, Zea mays
  unsure (1)..(333): unsure at all Xaa locations
MAAAIDMYKYYNTSAHQIASSSSPSDQELAKALEPFITSASSSSSSSPYHGYSSSPSMSQDSYMPTPSYTSYATSPLPTPAAASSQLPPLYSSPYAAPCMTGQMGLNQLGPAQIQQIQAQFMFQQQQQQRGLHAAFLGPRAQPMKQSGSPPPLAPAPAQSKLYRGVRQRHWGKWVAEIRLPKNRTRLWLGTFDTAEDAALAYDKAAFRLRGDTARLNFPALRRGGAHLAGPLHASVDAKLTAICQSLSESKSKSGSSGDESAASPPDSPKCSASADXGEEESGSAGSPPSPTLAPPVPEMAKLDFTEAPWDETETFHLRKYPSWEIDWDSILS

SEQ ID NO: 6588 - protein, 525 aa, Zea mays
MAGGGEREGAQAMDSGEKRLNELGYKQELRREMTLFKTLAISFSTMTLFTGITPLYGSSLQYAGPAPLVWGWVVVSFFTCFVGVAMAEICSSFPTTGSLYFWAAHLAGPVWGPLASWCCAWLEAIGLIAGIGTQAYAGSQVLQSIILLCTGTNTGGGYLAPRWLFLVMYIGLTLIWAVLNTFALEVIAFLDVISMWWQVIGGTVIVVMLPLVAKTTQPASYVFTHFQTAPDVTGIGSSAYAVVLSFLVSQYSLYGYDAAAHLTEETKGADKNGPIAILSSIGIISVFGWAYILALTFSIQDFSYLYNPNNETAGTFVPAQILYDAFHGRYNSSAGAIVLLFVIWGSFFFGGLSITTSAARVVYALSRDQGVPLSSVWRRIHPRHKVPANAVWLCAAVCTLLGLPILRINVVFTAITSIATIGWVGGYAVPIFARMVMREDDFRPGPFYLGRASRPVCLVAFLWICYTCSVFLLPTVYPIKMDTFNYAPIALGVCLGLIMLWWLLDARKWFKGPVRNIDDHNNGKV

SEQ ID NO: 6589 - protein, 222 aa, Zea mays
  unsure (1)..(222): unsure at all Xaa locations
MAAGFQIGVIGSLALSVASSVSIVLCNKALISTLGFPFATTLTSWHLMVTFCTLHVAQRLRFFEPKAIDGQTVILFGLLNGTSIGLLNLSLGFNSIGFYQMTKLAIIPFTVLLETIFLKKRFSESIKLSLLVLLLGVGIASVTDLKLNLLGSILSXLAIATTCVGPILTNXIQKRLKVSLTQPLYPAAPYQAGILFATGPFVDQLLTDRSVFAHKYSAPVLV

SEQ ID NO: 6590 - protein, 205 aa, Zea mays
  unsure (1)..(205): unsure at all Xaa locations
MAAGFQIGVIGSLALSVASSVSIVLCNKALISTLGFPFATTLTSWHLMVTFCTLHVAQRLRFFEPKAIDGQTVILFGLLNGTSIGLLNLSLGFNSIGFYQMTKLAIIPFTVLLETIFLKERFSESIKLSLLVLLPGVGIASVTDLQLNLLGSILSXLAIATTCVGPILTNTXQKRLKVSLTQLLYHLRLPXRNSVASGAFVDQLL

SEQ ID NO: 6591 - protein, 328 aa, Zea mays; identical to SEQ ID NO: 5713

SEQ ID NO: 6592 - protein, 319 aa, Zea mays
MPAFKAPAPGFAVRFSPFHENRLLAATSQHFGLVGNGHLIVLDLAGGGPGAAPTPVFSFPTSDALFDCAWSESHDSLCAAASGDGSVRLFDAALPPAQNPVRLLREHAREVHGLDWNPVRRDAFISASWDDTLKLWSPDRPASVRTFRGHEYCVYAAAWSARHPDVFASASGDRTARVWDVRDPAPTLILPAHDHEVLSLDWDKYDPSILATASVDKSIRVWDVRAPRAPIAQLAGHGYAVKRVRFSPHRQGMLMSCSYDMTVCMWDYRAEDALLARYNHHTEFVAGIDMSVLVDGLLASTGWDEMVYIWPFGTDPRAM

SEQ ID NO: 6593 - protein, 332 aa, Zea mays
  unsure (1)..(332): unsure at all Xaa locations
MAPGSKAERKAALDAGAWMFNVVTSVGIIMVNKALMATHGFSFATTLTGLHFAMTTLMTLVMKWLGYIQPSYLPLPELVKFAFFANLSIVGMNVSLMWNSVGFYQIAKLCIIPVLCILEIMFDKVRYSRDTKLSIVLVLVGVAVCTVTDVSVXNSQGLLAAAIAVWSTALQQHYVHHLQWKYSLGSFNLLGHTAPAQAASLLVLGPFVDFWLTXKRVDAFNYTSIVTFFIVLSCIIAVGTNLSQFICIGRFTAVSFQVLGHMKTVLVLTLGFFFFGKEGLNFHVALGMFLAVIGMIWYGNASSKPGGKERQVYSTPSEKTREAWGAVIPIRA

SEQ ID NO: 6594 - protein, 198 aa, Zea mays
MAECKDDDSGRRSPSSSMDSSTHPPALSTASSASRHPAERRDQLSADLQLGLSLSPASSALLVAETNNSIVPSTPRNQALPDWPPIKPFLRSALTASARRRRTLFVKVYMEGVPIGRKLDMLLLDGYSSLLAKLCHMFKASITYADAVEYHQRVPHEKAAHVLTYEDHDGDWMMVGDVPWELFLGSVKKLRIAKTDRC

SEQ ID NO: 6595 - protein, 320 aa, Zea mays
  unsure (1)..(320): unsure at all Xaa locations
QLGRLPEARGDVTVLLSHXVLGCKFVAAAVNKAGLAKLIGLAGETNVQGEEQKKLDVLSNEVFVKALVSSGRTCVLVSEENEEAIFVDPALRGKYCVCFDPLDGSSNIDCGVSIGTIFGIYMVKDKDNVTLEDVLQPGTNMLAAGYCMYGSSCTLVLSTGNGVNGFTLDPSLGEFILTHPNIKIPKKGKIYSVNEGNAKNWDGPTAKFVEKCKYPEDGSPPRSLRYIGSMVADVHRTLLYGGIFLYPADQKSPNGKLRVLYEVFPMSFLMEQAGGQAFTGKQRALELAPAKLHDRSPVFLGSYDDVEEIKALYASMSNSG

SEQ ID NO: 6596 - protein, 238 aa, Zea mays
IISFRVSTKLANDVRSKDGMPCLPNMSLIVKTNPFPSKSNMKNGLQAISSQHGKMEADSNSEEAKNSLQAIISQPGKRYDSKSEEAKTESGGSGQEKVLKKPDKILPCPRCNSMETKFCYFNNYNVNQPRHFCRNCKRYWTAGGTMRNVPVGSGRRRNKDPSHHHHFTKVCDYTIATNGDVSDATQRQSVAAKLCLLQGSGKQNETACKSVSPVSNIKEQNNADLISLVSGDNKEEKS

SEQ ID NO: 6597 - protein, 253 aa, Zea mays; identical to SEQ ID NO: 5611

SEQ ID NO: 6598 - protein, 117 aa, Zea mays
AGRAGASSVKISLYLHLDLTVSAHDVVIFSKSYCPYCKRAKAVFKELELKKEPYVVELDQREDGSEIQDALLEIVGRRTVPQVFVHGKHLGGSDDTVDSYESGKLARLLNIGVKDDL

SEQ ID NO: 6599 - protein, 139 aa, Zea mays
  unsure (1)..(139): unsure at all Xaa locations
FYLKMKGVYLXYLAEFKSGAERKDAAESTMNAYKAAQDIALADLAPTHPIRLGLALNFSVFYYEILNSPDRACNLAKQAFDEAISELDSLGEESYKDSTLIMQLLRDNLTLWTSDTNEDGXDEIKEAAAAPKESAPEGQ

SEQ ID NO: 6600 - protein, 274 aa, Zea mays
  unsure (1)..(274): unsure at all Xaa locations
MAAAATTSSSSHLLLLSRQQAASLRCRLSFLGQPRRPGRVTAQAPAAKDVRCMAAVDTTAASTAAAETSPKSSSYEIVTLTTWLLQQERTGAIDNEMTIVLASISTACKQIAALVQRAPISNLTGVQGAVNVQGEDQKKLDVVSNEVFSNCLKSSGRTGVIASEEEDVPVAVEQSYSGNYIVVFDPLDGSSNIDAAVSTGSIFGIYNPNDECLADVDDNDTLDSVEQRCIVNVCQPGSNRPARRYXFVLMQDLVQIPKAGKTYAFREGNYALWD

SEQ ID NO: 6601 - protein, 277 aa, Zea mays
MAAAATTSSSSHLLLLSRQQAASLRCRLSFLGQPRRPGRVTAQAPAAKDVRCMAAVDTTAASTAAAETSPKSSSYEIVTLTTWLLQQERTGAIDNEMTIVLASISTACKQIAALVQRAPISNLTGVQGAVNVQGEDQKKLDVVSNENHSRTYNTTLDRARAQVFSNCLKSSGRTGVIASEEEDVPVAVEQSYSGNYIVVFDPLDGSSNIDAAVSTGSIFGIYNPNDECLADVDDNDTLDSVEQRCIVNVCQPGSNLLAAGYCMYSSSVILVLTVGTG

SEQ ID NO: 6602 - protein, 322 aa, Zea mays
RMKGEYPERVGQPECQYYLKTGTCKFGPTCKFHHPREKAGIAGRVQLNTLGYPLRPNEKECAYYLKTGQCKYANTCKFHHPELFNAVPSSRGSPIYTSVHSSASAGPQSYTGTMSSWTFPRASFIPSPRWQSPSNYAPMIVPHGLVQVPSWNSYPGQLQSPGAQQTYGSSQQGEASAGNQGMLSPYRSSSFPVPQYALQRDNVFPERPDEPECQYYMKTGDCKFGAVCKFHHPRVRSQPPPDCVLSPMGLPIRPGEELCKFYSRYGICKFGANCKFDHPTMAAPMGVYAYGFSGSASVAPASTNAPMTRRLLGSPSGSGYMS

SEQ ID NO: 6603 - protein, 160 aa, Zea mays
SIVDLQLDYLDLYLIHFPVATRHTGVGTTSSALGDDGVLDIDTTISLETTWHAMEELVSMGLVRSIGISNYDIFLTRDCLAYAKIKPAVNQIETHPYFQRDSLVKFCQKHGICVTAHTPLGGSTANAEWFGTVSCLDDPVIKVVAISNLSIVSSGANAVC

SEQ ID NO: 6604 - protein, 241 aa, Zea mays
SSRLLPPPPSSQGPSSPRRRQSPSPAASAVLQGKKKEGNAAKYITRTKAVKYLQISLAVFRKLCILKGVFPREPKKKVEGNHKTYYHMKDIAFLAHDPLIEKFREIKVHRKKVKKAMAKKNRDLADRLLNRPPTYKLDRLIIERYPSFVDALRDLDDCLTMVHLFAALPAIEGERVQVQRIHNCRRLSHEWQAYISRTNSLRKTFISVKGIYYQAEVQGQKITWLTPHALQQVLTDDVDFM

SEQ ID NO: 6605 - protein, 266 aa, Zea mays
PRVRAVVKAFPGQNGATGSREKASILFIESDFWRPETDVQLLNHLREQKNGQLSDGHKVVLLVTSEADKDKYGSIFDIVMCKPIMASTIASSIQQLLKVEIAERKDNQNRPSFLRSLLVGKNILVVDDNKVNLRVAAAALKKYGANVSCVESGKDAISLLQPPHRFDACFMDVQMPEMDGFEATGQIRQMELKANEERKNKLASIEGSTTAEYHLPVLAMTADVIQATYEECIKSGMDGYVSKPFDEEQLYQAVSRLVVGTTDSAV

SEQ ID NO: 6606 - protein, 234 aa, Zea mays
MASLFKDPSKLSAYRDRRFKGTQEEYEAALLASTTLYIGNMSFYTTEEQAYELFSRAGEIKKIIMGLDKNSKTPCGFCFVLYYSREDAEDAVKYISGTMLDDRPIRVDFDWGFEEGRQWGRGRSGGQVRDEYRTDYDPGRGGYGKMVLRELEAQRELVDYGGSFQPNAPPPYERSERKRGHGDSHRNDRGDYQRKRYRNDDRSAPEESKRAPDSDPAEKNPRFREKGDSDEKRG

SEQ ID NO: 6607 - protein, 92 aa, Zea mays
MASLFKDPSKLSAYRDRRFKGTQEEYEAALLASTTLYIGNMSFYTTEEQAYELFSRAGEIKKIIMGLDKNSKTPCGFCFVLCGPLPFLDTSR

SEQ ID NO: 6608 - protein, 127 aa, Zea mays
QEEYEAALLASTTLYIGNMSFYTTEEQAYELFSRAGEIKKIIMGLDKNSKTPCGFCFVLYYSREDAEDAVKYISGTMLDDRPIRVDFDWGFEEGRQCGRGRSGGQVVPWSYSNKYTWGSSMLYAYIL

SEQ ID NO: 6609 - protein, 254 aa, Zea mays
MTYKIMCRIEAEELSLDASEIVIASTRQEIEEQWNLYDGFEVILARKLRARVKRGANCYGRFMPRMVIIPPGVEFGHIIHDFDMDGEEENPCPASEDPPIWSQIMRFFTNPRKPMILAVARPYPEKNITTLVKAFGECRPLRELANLTLIMGNREAISKMHNMSAAVLTSVLTLIDEYDLYGQVAYPKHHKHSEVPDIYRLAARTKGAFVNVAYFEQFGVTLIEAAMNGLPIIATNNGAPVEINQVLNNGLLVD

SEQ ID NO: 6610 - protein, 266 aa, Zea mays; identical to SEQ ID NO: 6168

SEQ ID NO: 6611 - protein, 200 aa, Zea mays
KQRICRSIRLDAQAFKDRDPACAQYSWALLYLKGYQSLQSYRIANILWNQGRKVLALALQSRISEVFAVDIHPAAKIGEGILLDHGTGLVIGETAVVGNWVSLMQGVTLGGTGKEHGDRHPKIGQGALIGASATILGNINVGEGAMIAAGSLVLKDVPPHSMAVGNPAKVVGYTEKEDPSLTMKHDARRDYFEHAAIRLR

SEQ ID NO: 6612 - protein, 253 aa, Zea mays
MDVKCRRLEGKVAIVTASTMGIGLAIAERLGLEGAAVVISSRKQKNVNEAVEGLRAKGITAVGAVCHVSDAQQRKSLIETAVKSFGHIDILVSNAAANPSVDSILEMKESVLDKLWDINVKASILLIQDAAPHLRKGSSVIIISSIAGYNPEQGLTMYGVTKTALFGLTKALAGEMGPDTRVNCVAPGFVPTRFASFLTENETIRKELNERTKLKRLGTVEDMAAAAAFLASDDASYITAETIVVAGGVQSRL

SEQ ID NO: 6613 - protein, 403 aa, Zea mays
MTNLPWWRADASELVAVTAMGVWEAVLAGGGRRFIKRKDSDAGETGRALEELRSSLYNEMHSAEGAKRQQQRFCGPSVALTFNFAVAVGIIMANKMVMGSVGFKFPIALSLIHYAVAFVLMATLKTLSLLPVAPPSKSTPFSSIFALGAVMSLSTGLANVSLKHNSVGFYQMAKIAVTPTIVVAEFMLFQKKVSSKKAVTLAVVSFGVAVATVTDLEFNFFGACVALAWIVPSAVNKILWSSLQQSGNWTALALMWKTTPITIFFLLTLMPLLDPPGLLLFNWNFRNSCAVIISALFGFLLQWSGALALGATSALSHVVLGQFKTIVIMLSGYLIFGSDPGITSVCGAVLALGGMSFYTYLGLKKDPATSGKKAPSRQNSFMARPKVAADDSDDADSEQDDTV

SEQ ID NO: 6614 - protein, 251 aa, Zea mays; identical to SEQ ID NO: 6249

SEQ ID NO: 6615 - protein, 435 aa, Zea mays
  unsure (1)..(435): unsure at all Xaa locations
MVLDLNVASPADSGTSSSSVLNSADGGFRFGLLGSPVDDDDCSGEMAPGASTGFMTRQLFPSPTPPAEPEPEPVAAPVPVWQPQRAEDLGMAQRPVAPAKKTRRGPRSRSSQYRGVTFYRRTGRWESHIWDCGKQVYLGGFDTAHAAARAYDRAAIKFRGLDADINFSLSDYEDDLKQMRNWTKEEFVHILRRQSTGFARGSSKYRGVTLHKCGRWEARMGQLLGKKYIYLGLFDSEVEAARXAYDRAALRFNGREAVTNFEPSSYNAGDNNLRDTETEAIDDGDAIDLDLRISQPNVQDPKRDNTLAGLQPTCDSPESSNTMASQPMSSSSPWPGYHQNPAVSFHHQRLYSSACHGFFPNHQVQERPVERRPELGAQPFPSWAWQAQGSPHVPLHHSAASSGFSTAAGANGGMPLPXSHPPAQFPTTTNPFFFP

SEQ ID NO: 6616 - protein, 219 aa, Zea mays
MGEEAVDDYELHMVCYGSDEDERVMEWESGLPGADELTPLSQPLVPPGLAAAFRIPPEPGRTLLDLHRASEATVARLRRAPPSSPGTSSSPHGHQEARGGEGADSAAATTTNSNRRPRLVWTPQLHKRFVDVVAHLGIKKAVPKTIMELMNVEGLTRENVASHLQKYRLYVKRMRGQGPSPSDHIFAPTPVHGVAVGMVPMVSGQAYHYLYNGGGGGDR

SEQ ID NO: 6617 - protein, 242 aa, Zea mays
CCADEAALCARCDVENHAANKLASKHQRLPLEALSAKLPRCDVCQEKAAFIFCVEDRALFCRDCDEPIHVPGTLSGNHQRYLATGIRVGLASASACSDACDAHDSDHHAPPKATIEPPHAAVSAAVQQVPSPPQFLPQGWAVDELLQFSDYESSDKLHKEPTLGFKELEWFADIDLFHEQAPKASRTLAEVPELFGYQAANDAAYYRPAKAAGGGGAGVRQSKKARIEVTDDEDYLIVPDLG

SEQ ID NO: 6618 - protein, 258 aa, Zea mays
MKIQCDACEGAAATVVCCADEAALCARCDVEIHAANKLASKHQRLPLEALSAKLPRCDVCQEKAAFIFCVEDRALFCQDCDEPIHVPGTLSGNHQRYLATGIRVGLASASACSDACDAHDSDHHAPPKATIEPPHAAVSAAVQQVPSPPQFLPQGWAVDELLQFSDYESSDKLHKEPTLGFKELEWFADIDLFHEQAPKASRTLAEVPELFGYQAANDAAYYRPAKAAGGGGAGVRQSKKARIEVTDDEDYLIVPDLG

SEQ ID NO: 6619 - protein, 201 aa, Zea mays
  unsure (1)..(201): unsure at all Xaa locations
SRRFVLVESTIEEMALSEGVILWMENPLLDISAVVDDAFLANYDIKLNNAILGEEKHLPMYDDLANYSCDEYIAGGDTQNSIRDGQWMLHNSWCQQVYLRCIVKLQRGDEMKKNAQAAGRTAHDHDDDTAPTGTCAACEADGDRPLDCNLPAVMXYKSEDLKRPDNXLLAEKAKYIYIGGFLLTVSPDSIQLDDEHAASNN

SEQ ID NO: 6620 - protein, 596 aa, Zea mays
MVVWQSFDNPTDVLLSGGYLGFNKINGNINSLGIHFNLSFDATRRRGFIIQYPEGRRFAGAFPEWMDILEDGNYTLIFNDTYTYIRLDDTSFVRFGKQGDCDSILWSAPESLCDYDPYCGPYSLCTLSGSGSCICPVGFNSVSTDAWITAGCSRNDSLNCENVEVTFYPIDGIHRYPLEAFALEVTNMSECESACLRDCTCTAFAYNASCLLWFSELRNTIVLDSGLNGIRMYVRTAARQQSGSGTVPPFSFWKRVPLEWMIGVITLIVISLILLLRCRSKPYSARTVGDHGSLVVFSFAQIKNSTKRFSEKLGEGGFGCVFKGMLPGCTPVAVKKLKDHRQDEKQFRAEVRTIGMIQHINIVRLLGFCAEGSGRFLVYEYMANGSLSSHLFSKSSSKLSWELHYSIALGIARGLAYLHEGCVDELCPKIADFGMAKLLGRDYSRVLTTVRGTIGYLAPEWISGLPITHKADVYSFGMILLEILSGRRNSEKIEEGRFTYFPSYVAVKLSEGDDVMWLLDSSLESNADAEQLQRACRVACWCIQDAEDHRPMMGQAVHMLEGAMDAQVPPVPRSLQNYVGVEDSTTAEFYISEGSC

SEQ ID NO: 6621 - protein, 420 aa, Zea mays
NWVPRGRQGDPSQLLPPLQSHLLHHPHTAADLIPPPLEESAEPTEGDHMGAEAAHPQQQPPSSVRPGREAAAPAVLGLQLSALIDHVARVDWSLLDRVPGDRGGSQQVSIVELNHILNEVNTHILPSHNDLTPVTTIAGGSVANTIRGLSAGFGISTGIIGACGDDNQGLLFVNNMSFSGVDLTRLRAKKGHTAQCVCLVDASGNRTMRPCLSSAVKIQANEFRKEDFKGSKWLIVRYAQQNMEQIVEAIRIAKQEGLSVSLDLASFEMVRDSRSKLVNLLETGNIDLCFANEDEAREVIGGSLESDPEEALAFLGKYCKWAVVTLASKGCMAKHGKQVVRVPAIGESNAVDTTGAGDLFASGFLYGLVKGLPLEECCKVGACSGGSVTRALGGEVRPENWQWMYKQMHARGLLLPELKN

SEQ ID NO: 6622 - protein, 271 aa, Zea mays; identical to SEQ ID NO: 5634

SEQ ID NO: 6623 - protein, 436 aa, Zea mays
VVLFDQTDANPKADAASRPARCPDWLRPEMLQCPIALDLMTDPVTVSTGQTYDRESITRWIKAGCHTCPVTGERLRTADVVPNAALRGIIERMLLSNGVSLPDPSSSGHRHGALGNTAVPFGPAAAGAARLAVAYVVAQLSMGSTAERRKATCEARKLCKHNMFYRACLVEANAVPWLLCLLSSTDASVQDNAVASLLNLSKHPRGRAALFEAGGVGLVVDVINVGARAEARQNAAAVLFYLSSNAEHAEEIGRIPEAIPTLVQLIRDGAHRGRKNAMVSLYGLLQCASNHGKAVGAGAVSALAGLLSGDRDDLASDAVTLLARLAEQPAGAQAVLARPGLVARVVEALATSASRSGKDHCVALLVSLCRHGGDKVVALLGRMPGLMSSLYTLVADGSPQTCKRARALLNLIHRHYEMDGQQPASEVPGERVVRVL

SEQ ID NO: 6624 - protein, 476 aa, Zea mays
PKILIVTRLLPDAAGTTCGQRLEKVIGTEHTDIIRVPFRNENGILRKWISRFDVWPYLETYTEDVSSEIMKEMQAKPDLIIGNYSDGNLVATLLAHKLGVTQCTIAHALEKTKYPNSDIYLDKFDRQYHFSCQVTADLIGMNHTDFIITSTFQEIAGRKDTVGQYESHIAFTLPGLYRVVHGIDVFDPKFNIVSPGADMSVYYPYTETDKRLTAFHPEIEELIYSDVENSEHKFVLKDKKKPIIFSMARLDRVKNMTGLVEMYGKNARLRELANLVIVAGDHGKESKDREEQAEFKKMYSLIDEYKLKGHIRWISAQMNRVRNGELYRYICDTKGAFVQPAFYEAFGLTVIESMTCGLPTIATCHGGPAEIIVDGVSGLHIDPYHSDKAADILVNFFDKCKADPSYWDKISQGGLQRIYEKYTWKLYSERLMTLTGVYGFWKYVSNLERRETRRYIEMFYALKYRSLASQVPLSFD

SEQ ID NO: 6625 - protein, 189 aa, Zea mays
  unsure (1)..(189): unsure at all Xaa locations
QRCIVNVCQPGSTHWAPRGCPGSSSVIFVLTVGTGVYVFTLDPMYGEFVLTVXPEEVQIPKAGKIYAFNEGNYALWDDKLKLYMDSLKEPGDSGKPYSARYIGSLVGDFHRTLLYGGIYGYPRDKKSKNGKLRLLYECAPMSFIVEQAGGKGSDGHQRILDITPTEIHQRVPLYIGSVEEVDKVEKFLA

SEQ ID NO: 6626 - protein, 551 aa, Zea mays
MTEGLCLSKHLTNCVHSNLSFSRFLQFRDPHAQRRHPLVDPMVVSEIRRCLSEGIEFQGELLNFRKDGAPLHNRLRLVPMHGDDGYVTHVIGIQLFSEANIDLSSVSYPVYKQKSSSRPSIQDLNSSPHEHAPKIQSADHCGMLQLSDEVLAHNILSRLSPRDVASIGSVCTRMHELTKNDHLRKMVCQNAWGRDVTVRLEMSTKMVGWGRLARELTTLEAASWRKFTVGGRVEPSRCNFSACAVGNRLVLFGGEGVNMQPMDDTFVLNLEAATPEWRRVKVSASPPGRWGHTLSWLNGSWLVVFGGCGQQGLLNDVFVLDLDAQQPTWREVASEGPPLPRSWHSSCTLDGSKLVVSGGCAESGVLLSDTFLLDLTKEKPAWREIPTSWSPPSRLGHTTSVYGATKLFMFGGLAKSGSLRLRSSDAYTVDVSEDSPQWRQLATTTGFPNVSPPPRLDHVAVSLPCGRIIIFGGSIAGLHSPAQLFLIDPAEEKPIWRILNVPGQPPKFAWGHSTCVVGGTRVLVLGGHTGEEWILNELHELCLASRPDEDG

SEQ ID NO: 6627 - protein, 279 aa, Zea mays
MAAAINLPGPSEDLMRAMESFMQDDAPSPLAMPPAPSFPAAAAHGAQYPATHLSPAQMQFIQAQLHLQRNPGLGPRAQPMKPAVPVPPAPAPQRPVKLYRGVRQRHWGKWVAEIRLPRNRTRLWLGTFDTAEQAALAYDQAAYRLRGDAARLNFPDNAESRAPLDPAVDAKLQAICATIAAASSSSKNSKAKSKAMPINASVLEAAAASPSNSSSDEGSGSGFGSDDEMSSSSPTPVVAPPVADMGQLDFSEVPWDEDESFVLRKYPSYEIDWDALLSN

SEQ ID NO: 6628 - protein, 114 aa, Zea mays
  unsure (1)..(114): unsure at all Xaa locations
MAREENVYMAXXAXXAERYEKMVEYXEKVAXTVXVEELTGEEXNXLXVAYXNGIWGXPCFIGXIXSSIXXXXKPRXNDXHXXLXKVPRTSFEPNVMSSSPPKPSAWAKIGVSPS

SEQ ID NO: 6629 - protein, 282 aa, Zea mays
MSPPCCYVLQRRGSWRCHCCCPRSGPRSPARRACEAAATRRTAAAVSTAPGRRHGHLRPFLRGVDVNRAPAGETRRGSCSEDDEEPGGASSSPNSTLSSSLSGKRAAPARSGGEVADHTPRAGGGSDDEDSGGGSRKKLRLSKDQAAVLEESFKEHNTLNPKQKAALAKQLNLKPRQVEVWFQNRRARTKLKQTEVDCEFLKRCCETLTEENRRLQREVAELRALKLVAPHHYARMPPPTTLTMCPSCERLASASASADQAGRAGPCWGPLPVFVDGPARRP

SEQ ID NO: 6630 - protein, 156 aa, Zea mays
  unsure (1)..(156): unsure at all Xaa locations
NWFPRAPPEFCSFIDLPXEXXXXMLXLSVAAPXGYXXMXENMXKXXKXXHXXEXTGXXRXLLXVAYXNEIDAXXDXWXXGSXXXQNXXXRXNXQHVNLILEYRDEYRGXLMNICDVILXLLDSHXVPSSTGGEXKVFXLXMYGDYNXXPAEXXXGX

SEQ ID NO: 6631 - protein, 372 aa, Zea mays
  unsure (1)..(372): unsure at all Xaa locations
MDPNDAFSAAHPFRWDLGPPAHAAPAPAPPPPPLAPLLLPPHAPRELEDLVAGYGVRPSTVARISELGFTASTLLGMTERELDDMMAALAGLFRWDVLLGERFGLRAALRAERGRVTALXRAAATSGAARGARDAGRRRVGGTAGKKVKGGDVGARKGKKARRKKELRPLDVLDDENDGDEDGGGSESTESSAGGSGGGERQREHPFVVTEPGEVARAKKNGLDYLFHLYEQCRVFLLQVQSLAKLGGHKSPTKVTNQVFRYANKCGASYINKPKMRHYVHCYALHCLDEEASNALRRAYKSRGENVGAWRQACYAPLVEIAARHGFDIDAVFAAHPRLAVWYVPTRLRQLCHQARGSHAHAAAGLPPPPMF

SEQ ID NO: 6632 - protein, 98 aa, Zea mays
MARRATVMVLAAALAVLLLASSSSKTAPVASAARDDPSAAAAAAVTSSRDLQKDGSAAAAEGKGKEKECEGANDEDECMMRRTLAAHTDYIYTQQHHG

SEQ ID NO: 6633 - protein, 337 aa, Zea mays
MRPDTAASASPTPKKKPDSKAALDLASWSFNVTTSVGLIMVNKALMATYGFTFATTLTGLHFATTTVMTLVFRWVGLSQPSQLPLPDLAKFVVFSNLSIVGMNVSLMWNSVGFYQVAKLCMIPASCLLEVVLDRVHYSRDTRLSIAVVLAGVAVCTVTDVSVNARGLVAAVVAVWSTALQQYYVHFLQRKHSLNSFSLLGHTAPAQAGSLLLAGPFVDYLLTGQRVDHFSFSSLALLFLALSCFIAIGVNLSQFICIGRFSAVSFQVLGHMKTVLVLSLGFLFFGKEGLSLQVVVGMALAVLGMVWYGNASAKPGGKERRGKDLPVSLKQDKDDTDK

SEQ ID NO: 6634 - protein, 480 aa, Zea mays
MEWLRGKCIGKGAFGTVHLAVDTATGRAFAVKSVDSKSAPAAAMACLESEIRILRRLSSPHVVAYLGDDGATATTRNLHMELVPGGSATEAARGGLAERGARGVLRSVAAALRYLHEEAGVVHGDVKGRNVLLGCRDGDAAQCCGAKLADFGAARLVSDAAPARGPRGTPAWMAPEVARGGAATPASDVWALGCTALELLTGSRPWSELGGAADVGELLLLVGFGGQRPAIPAWLPDACRDFLDKCLRRDAGQRWSCAQLLRHPFLSADAGETWPSPSPSPRAVLDWAPSDSDSEPMSSAEAESMHEVMARAKGRLAELASNGPRTSWDWHWDEVEWGSGPTRAADTWAPPPSYEAQRNGDASAPVPSTAAFSGGRDRDVLVLGSGSGSGLPCGHGRPGYHSHCCRYKCGFGRQWPRGRIEGDDADAREGSGDRCEKGSWGGSSAPTDSIQRRWSSGSFPNPRLAEPWALAFHVLKVARG

SEQ ID NO: 6635 - protein, 222 aa, Zea mays
MQFIQAQLHLQRNPGLGPRAQPMKPAVPVPPAPAPQRPVKLYRGVRQRHWGKWVAEIRLPRNRTRLWLGTFDTAEQAALAYDQAAYRLRGDAARLNFPDNAESRAPLDPAVDAKLQAICATIAAASSSSKNSKAKSKAMPINASVLEAAAASPSNSSSDEGSGSGFGSDDEMSSSSPTPVVAPPVADMGQLDFSEVPWDEDESFVLRKYPSYEIDWDALLSN

SEQ ID NO: 6636 - protein, 529 aa, Zea mays
MRIPRRKGGAGPLAVGVPSRRAQVAAVFALAALLGVSVLYDNAHIAASLRRHGGPRTYAKLSSFEGATAVPSIAKEEAAAAVARATESVPVHGADRADSPPHERQEEIEERASKPGATAGSSLQDAPLIEEVVQGGSGGHDGDGDGDGGAQAQEQPPAPGTCDLYKGRWVYDESRAPLYKESDCSFLTEQVTCMRNGRRDDDYQKWRWQPDGCDLPRFEAKLLLEKLRNKRLMFVGDSLNRNQWESMVCLVQSEAPWDKKSLVKNGSLNVFHLQEYNATVEFYWSPFLVESNSDDPDIHSISDRMIKPTSIAKHAANWEGVDYLIFNTYIWWMNTPQMKTLHGGSFSRKHVKYDEIERVEAYRKVLKTWSRWVEAHVDPKRTTVLFMSVSPVHMQSEGWGSPNAVKCFSETQPAISYNKKLEVGTDWDLFATAQRVTRSMKKVPVHFVNITALSEIRKDAHTSVHTLRQGKLLTPEQKANPRKFADCIHWCLPGVPDTWNEFVYGHIVSSTPPPQQQQQQKITEDEPHR

SEQ ID NO: 6637 - protein, 142 aa, Zea mays
  unsure (1)..(142): unsure at all Xaa locations
VCSFIDXXREENXYMAKLXEQAERYEEMXEHMEXVAKTVDVEELTVEERNLLXGAYKNVIGAXRASXRXVSSIEQKEEXXXNXXHVNLIKXYXAXXXAELTXYPVXAFLXLLDSHLXAFLXXVXESXGLLRXXXXGXYHXXC

SEQ ID NO: 6638 - protein, 258 aa, Zea mays; identical to SEQ ID NO: 829

SEQ ID NO: 6639 - protein, 261 aa, Zea mays; identical to SEQ ID NO: 5720
  unsure (1)..(261): unsure at all Xaa locations

SEQ ID NO: 6640 - protein, 133 aa, Zea mays
MGTAFSSSSSSSSSTPESRAMALAKAKEIVASAPVVVFSKSYCPFCVQVKKLFTQLGASFKAIELDTESDGTEIQSALAEWTGQRTVPNVFINGKHIGGCDDTIALNKGGKLVALLTEAGAISGSSSKTTVTA

SEQ ID NO: 6641 - protein, 164 aa, Zea mays
DYLDLYLIHFPVATRHTGVGTTSSALGDDGVLDIDTTISLETTWHAMEELVSMGLVRSIGISNYDIFLTRDCLAYAKIKPAVNQIETHPYFQRDSLVKFCQKHGICVTAHTPLGGSTANAEWFGTVSCLDDPVIKVVAISNLPIVSQFWCQCGLLTLPLWLLWQ

SEQ ID NO: 6642 - protein, 386 aa, Zea mays
  unsure (1)..(386): unsure at all Xaa locations
MEIVATRSPACCAAVSFSQSYRPKASRPPTTFYGESVRVNTARPLSARRQSKAASRAALSARCEIGDSLEEFLTKATPDKNLIRLLICMGEAMRTIAFKVRTASCGGTACVNSFGDEQLAVDMLANKLLFEALEYSHVCKYACSEEVPELQDMGGPVEGGFSVAFDPLDGSSIVDTNFTVGTIXFGVWPGDKLTGVTGGDQVAAAMGIYGPRTTYIVALKDCPGTHEFLLLDEGKWQHVKDTTTIGEGKMFSPGNLRATFDNPEYDKLINYYVKEKYTLRYTGGMVPDVNQIIVKEKGIFTNVTSPTAKAKLRLLFEVAPLGFLMEKAGGYSSDGKQSVLDRVINELDERTQVAYGSKNEIIRFEETLYGSSRLAASATATARALI

SEQ ID NO: 6643 - protein, 115 aa, Zea mays
  unsure (1)..(115): unsure at all Xaa locations
RIHRLASAVFPEPVHATPGSLSFLIXRXEXVYMAXLXEQAERXEEMXXYTXKVAXTVXXEEXTVXEXNXXXXAXQNXTGXXRXSXXXVXSIXXKEXPXXNEXHXXLIKXXXAKXG

SEQ ID NO: 6644 - protein, 665 aa, Zea mays
  unsure (1)..(665): unsure at all Xaa locations
MSAPKLDRNPSIRDRVEDTLHAHRNELVALLSKYVNKGKGILQPHHILDALDEVQGSGGRALAEGPFLDVLRSAQEAIVLPPFVAIAVRPRPGVWEYVRVNVHELSVEQLTVSEYLRFKEELVDGQYVLLYSAPPFSALILRASLFSXGPVCFVGIEFHFGNYNLDKTNVFRLYTGKLKNEMVLRLKKQGLDVSPKILIVTRLIPDAKGTSCNQRLERISGTQHTYILRVPFRNENGILKKWISRFDVWPYLETFAEDAAGEIAAELQGTPDFIIGNYSDGNLVASFIXKMGSCKITQCNIAHAQDYSQIQTVTILRIYDEKYHSFAXNFTADIIAMNTADWIITCTYPEWXLAAKTDSLGRVLLLDSHALVAVRLWEVSPGAACPYTFHIEKAKRLTSLHGSIENLIYDPEQNDEHIGHLDDRSKPILFSMARLDRVKNITGLVEAFAKCAKLRELVNLVVVAGYNDVNKSKDREEIAEIEKMHELIKTHNLFGQFRWISAQTNRARNGELYRYIADTHGAFVQPAFYEAFGLTVVEAMTCGLPTFATLHGGPAEIIEHGVSGFHIDPYHPEQAANLMADFFDRCKQDPDHWVKISGAGLQRIYEKYTWKIYSERLMTLAGVYGFWKYVSKLERLETRRYLEMFYILKFRELAKTVPLAIDQPQ

SEQ ID NO: 6645 - protein, 802 aa, Zea mays; identical to SEQ ID NO: 6466

SEQ ID NO: 6646 - protein, 212 aa, Zea mays
  unsure (1)..(212): unsure at all Xaa locations
GQPAPAERTGRIRRLESHVKNAEDEERTLEESLEAKGVLLARAHEESKDLLKLLFKSFVDVLTERLPPVSVDGEIPNLRSGDQNVNFAAQNSEAATMEIDNENGADNNSEPNERNTKNAYNVGELEQWCLCTLGYLKSFSRQYASEIWSNIAMLDEVFVGDVHPLIRKAAFXVCADLPMKGLILEFDTIPIFFIELSVLYLYDRGQLFSLFN

SEQ ID NO: 6647 - protein, 328 aa, Zea mays
  unsure (1)..(328): unsure at all Xaa locations
MEAEKKPPAVSDVGAWAMNVVSSVSLIMANKQLMSSSGYAFAFATTLTGFHFTVTALVGWISNATGYSVSKHVPLWELVWFSLVANTSITGMNLSLMLNSVGFYQISKLSMIPVVCLMEWVLNSKHYTTKVISAVIVVAAGVGICTVTDVEVNAKGFICACVAVFCTSLQQITIGSFQKKYNIGSFELLSKTAPIQALSLIILGXPFVDYYLNGPVIVELXLFQEGQLSSYCRFSATSFQVLGHMKTVCVLILGWILFDSALTVKNILGMLLAVMGMVVYSWAVEAEKKAAAPIPRNKGGMLDGEDVPLKARVSGVPAVDLEDGDVKG

SEQ ID NO: 6648 - protein, 344 aa, Zea mays
MEAEKKPPAVSDVGAWAMNVVSSVSLIMANKQLMSSSGYAFAFATTLTGFHFTVTALVGWISNATGYSVSKHVPLWELVWFSLVANTSITGMNLSLMLNSVGFYQISKLSMIPVVCLMEWVLNSKHYTTKVISAVIVVAAGVGICTVTDVEVNAKGFICACVAVFCTSLQQITIGSFQKKYNIGSFELLSKTAPIQALSLIILGPFVDYYLNGRSLLNYPFAGRATFFILLSCSLAVFCNMSQYLCIGRFSATSFQVLGHMKTVCVLILGWILFDSALTVKNILGMLLAVMGMVVYSWAVEAEKKAAAPIPRNKGGMLDGEDVPLKARVSGVPAVDLGDGDVKG

SEQ ID NO: 6649 - protein, 281 aa, Zea mays
MLLNPASMLDTIRQHLLEEPPAAADESFGILVADQWSDSLPFRTDDADDMVVFGALQDAFAYGWLPDGSFAHVKPEPVRSPDSYYSSSYDGSCFGGLPYPEQPLTPGSEGEAAATPSPRREEAAAAVARGKHYRGVRQRPWGKFAAEIRDPAKNGARVWLGTYDTAEDAALAYDRAAYRMRGSRALLNFPLRIGSEIAAAAAGDKRPLALPEPATSSDSSSSSSSTGGSPKRRKRGEAAAANMAMALVPPPSQLSRPAQPWFPAAPVEQAAMPPRVEQLVI

SEQ ID NO: 6650 - protein, 770 aa, Zea mays
  unsure (1)..(770): unsure at all Xaa locations
QAPSARVARVDLLTWQFIAPSFDPGYGEPHEMLALTSFMNFXCERGLNIGAHIIRIPFGPKEKHLAKENIWPFIQEFFDGALGHIVRMSKTLGEETGSVCPVWPAVIHGHYASAGVAAALLSGALNVPMVFTGHFLGKDKLEGLLKQGRQTREQINVTYKIMRRIEAEELSLDASEIVIASTRQEIEEQWNLYDGFEVMLARKLRALVKRGANCYGRYMPRMVIIPPGVEFGQLIHDFDIYGDEDNPSPASEDPSIWFEIMRFFTNPRKPMILAIARPYSEKNIATLVKAFGECHPLRELANLTLIMGNREAISKMNKISAAVLTSVLTLIDEYDLYGQVAYPKLHKHSEVPDIYRLAARTKGAFVNVAYFEQFGVTLIEAAMHGLPVIATKNGAPVEIYQVLENGLLVDPHDQHAIADALYKMLSEKQFWSRCRENGLKNIHQFSWPEHCKNYLSRISSLGPRHPAFACKEDHKVPVKCRKHISIIAVDSVNKEDLIQIIRNSVEATRTGTMSGSTGFVLSTSLTIAELQSVIVRTGMLPTDFDAFICNSGSDIYYPLQSSDVPSNSRVTFALDHNYRSHIEYRWGGEGLRKYLVKWASSVVERRGRTEKQVIFEDSEHSSTYCLAFKVINPSHLPPLKELQKLMRIQSLRCHALYNHGATRLSVIPIHASRSQALRYLSICWGIELPDAVVIVGETGDSDYEELFGGLHKTVILKGGFNTPANRIHTVRRYPLQDVVALDSSNIIGIEGFSTGDIRSAMQQQLGIPTQ

SEQ ID NO: 6651 - protein, 542 aa, Zea mays
SSRLLPPPPSSQGPSSPRRRQSPSPAASAVLQGKKKEGNAAKYITRTKAVKYLQISLAVFRKLCILKGVFPREPKKKVEGNHKTYYHMKDIAFLAHDPLIEKFREIKVHRKKVKKAMAKKNRDLADRLLNRPPTYKLDRLIIERYPSFVDALRDLDDCLTMVHLFAALPAIEGERVQVQRIHNCRRLSHECLTFISVKGIYYQAEVQGQKITWLTPHALQQVLTDDVDFNVMLSFLEFYETLLGFVNFKIYHSINVNYPPILDPRLEALAVELYALCRYISAGSRRMIGNSQTDEVMEDKDEKSKAEEVIEEEKVVKNKASSKADESEFRLAQLQHQLPTNEPGALMNLVEESTADDADDDDTKDCKGLFKNLKFYLSREVPRESLLFIIPAFGGTVSWEGEGAPFKEIDEDITHQRLKDVFHSIGASSEKFTLSAENLPNTLEYIEGEVEALDEVIGSHADFCALVASRGTATAFLKAGCTHGKIVNRPNYSLSSSDLIDIPSLARSIGNRFMTQIWVNGGRKMTGDEARSHLKPDDEAEV

SEQ ID NO: 6652 - protein, 435 aa, Zea mays
PGLRGRRRWRHGTAGRGGGPGASCCRCGAGPSRGRCRPSRSGGGPPHPLVRSPRTDGLGRSRFVRLNALLASCRVGGVELGAAGERLQVGTAVSVSLAVVSRVSFVICNKCSMISLGYIFVTTFTSWLLLVFLGSLHVAVCVKLFEHKPFDARTVMGFGVLNGISIGLLNLSLGFNSDGFYQMTKLAIIPCTVILETLFFRKKFSRNIKLSLSVLLLGVGVATVTDLQLNVMGSVLSLLAIITTCIAQIMTNTIQKKFKVSSTQLLYQSCPYQALTLFLVGPFLDGFLTNQNVFAFDYTTQVLFFIVLSCLISVSVNFSTFLVIGKTSPVTYQVLGHLKTCLVLTFGYVLLHDPFSWRNILGILIAVIGMVLYSYFCTRETQQKPAEASPQAVQAKEGESNPLISDSLSAAENGGSATDDEPLKVPMWSSKYSKA

SEQ ID NO: 6653 - protein, 190 aa, Zea mays
MAAHQDSAAAGGRPPRRPRVLLAASGSVAAIKFEVLCRSVAEWADVHAVATASALEFIDVASFPGGVPLYTDDQEWSSWKRVGDKVLHIELRRWADVLVIAPLSANTLAKVAGGLCDNLLTCVVRAWDYSKPVYVAPAMNTFMWDNPFTARHLAVLRDLGMSVVPPVNGAMAEPSEICKTLMLFFGPQHL

SEQ ID NO: 6654 - protein, 139 aa, Zea mays
MSPSEPTREESVYMAKLAEQAERYEEMVEFMERVARYAGGAGGGDELSVEERNLLSVAYKNVIGARRASWRIISSIEQKEEGRGNEAHAASIRAYRSKIEAELARICDGILALLDSHLVPSAGACALKLPAIAIAAVFN

SEQ ID NO: 6655 - protein, 340 aa, Zea mays
  unsure (1)..(340): unsure at all Xaa locations
MTSCGCLMLEKVEGDASAKTRVKAAPGAGAGAWCGSCAGDWRGRSEAIFPIYVMGSSRESTVAAARGIVDSPEDPIWVAVKAEAKSEAEKEPILSSFLYASVLSHDCLERALSFVLANRLEDPTLLATQLIDIFNDVMLNNKDICRSIRLDAQAFKDRDPACAQYSWALLYLKGYQSLQSYRIANILWNQGRKVLALALQSRISEVFAVDIHPAAKIGEGILLDHGTGLVIGETAVVGNWVSLMXGVTLGGTGKEHGDRHPKIGQGALTHASATILGNINVGEGAMIAAGSLVLKDVPPHSMAVGNPAKVVGYTEKEDPSLTMKHDARRDYFEHAAIRLR

SEQ ID NO: 6656 - protein, 132 aa, Zea mays; identical to SEQ ID NO: 6217

SEQ ID NO: 6657 - protein, 347 aa, Zea mays; identical to SEQ ID NO: 5967

SEQ ID NO: 6658 - protein, 335 aa, Zea mays
MAPGSKAERKAALDAGAWMFNVVTSVGIIMVNKALMATHGFSFATTLTGLHFAMTTLMTLVMKWLGYIQPSYLPLPELVKFAFFANLSIVGMNVSLMWNSVGFYQIAKLCIIPVLCILEIMFDKVRYSRDTKLSIVLVLVGVAVCTVTDVSVNSQGLLAAVIAVWSTALQQHYVHHLQWKYSLGSFNLLGHTAPAQAASLLILGPFVDFWLTNKRVDAFNYTSIVTFFIVLSCIIAVGTNLSQFICIGRFTAVSFQVLGHMKTVLVLTLGFLFFGKEGLNFHVALGMLLAVIGMIWYGNASSKSGGKERQVYPTPSEKTQKHGALSSQSELDQKV

SEQ ID NO: 6659 - protein, 683 aa, Zea mays
MAPVSLPPGFRFHPTDEELIICYLKRKINGRQIELEIIPEVDLYKCEPWDLPEKSFLPSKDLEWYFFSPRDRKYPNGSRTNRATKSGYWKATGKDRKVSSHRRAVGMKKTLVYYRGRAPHGSRTDWVMHEYRLDERECETDTGLQDAYALCRVFKKTAPGPKIIEHYGAVHHPIEQTQWMGSSVERSPTLDLSSDVRGDDFDSSSFSFPTEAPMDSSMHGGLFGMQMSAPHEDSKWMQFLSEDAFNATNPFFTNPASSSFSCLPSKVDVALECARLQHRLSLPPLEVEDFPHDVSLDTKASVLRSSNPNNEVDILQEFLSVASASQELINGTSSSYAAEMWAGAGTSSTSGTHYVNELSSLFEFGVKAKEEADNFYHMDCIGTSAGFSPKPVRVDEPVRLVEIADMEEFKEEKRRVENLRGVRLHNNDDLGEIPTDCCITQYPISDTADISGEAGHLTNPTSAGGLDTAPIFSQSQPDDFAIGFSDDADPNASFDLCERVDVKHGLFVSTVGVPKTFFHHVEPSKKVSFHLNNNPVASDDDVSKATGKSRSPIISVMTTKDSGSSFSVFSKLKALIRDKFLVKKLPSSCQRSLLGSKETAAVSELLQMVVSSLLLTPTEVQGATTERKDFLLVMARVKIETTGGLGRRRPKPAEAFVGLFAGNEHQQRRNPRRRRKSSLVSRL

SEQ ID NO: 6660 - protein, 152 aa, Zea mays
  unsure (1)..(152): unsure at all Xaa locations
EDVYRKXTTQTAGIVGLYRGFRHILCXGIMAYRSLHYRXLYNCIKPDALTGSLXDNFFASFALGWLITNGAGLASYPIDTVRRRMMMTSGEAVKYKSSLDAFQQILKKEGPKSLFKGAGANILRAIAGAGVLSGYDQLQILFFGKKYGSGGA

SEQ ID NO: 6661 - protein, 165 aa, Zea mays
  unsure (1)..(165): unsure at all Xaa locations
MSLPADPCPPPSPAAASWPGSPGSRRRASPIGRSGRWLWGSRRRSGPALAGSIGGSPGMVAIWGNVGVTSPTPSWPPRNRADDPKLHNPLLRLERMGCGWLGVIFEWXEGVIVEDDAELEGQAWLTLAQXEEGKSPPPRFCVXGRVEGMKNEQAXISEVLCWSRD

SEQ ID NO: 6662 - protein, 220 aa, Zea mays; identical to SEQ ID NO: 5911

SEQ ID NO: 6663 - protein, 221 aa, Zea mays; identical to SEQ ID NO: 5614

SEQ ID NO: 6664 - protein, 1068 aa, Zea mays
MAGNEWINGYLEAILDSHTSSRGAGGGGGGGDPRSPTKAASPRGAHMNFNPSHYFVEEVVKGVDESDLHRTWIKVVATRNARERSTRLENMCWRIWHLARKKKQLELEGIQRISARRKEQEQVRREATEDLAEDLSEGEKGDTIGELAPVETTKKKFQRNFSDLTVWSDDNKEKKLYIVLISVHGLVRGENMELGRDSDTGGQVKYVVELARAMSMMPGVYRVDLFTRQVSSPDVDWSYGEPTEMLCAGSNDGEGMGESGGAYIVRIPCGPRDKYLKKEALWPYLQEFVDGALAHILNMSKALGEQVGNGRPVLPYVIHGHYADAGDVAALLSGALNVPMVLTGHSLGRNKLEQLLKQGRMSKEEIDSTYKIMRRIEGEELALDASELVITSTRQEIDEQWGLYDGFDVKLEKVLRARARRGVSCHGRYMPRMVVIPPGMDFSNVVVHEDIDGDGDVKDDIVGLEGASPKSMPPIWAEVMRFLTNPHKPMILALSRPDPKKNITTLVKAFGECRPLRELANLTLIMGNRDDIDDMSAGNASVLTTVLKLIDKYDLYGSVAFPKHHNQADVPEIYRLAAKMKGVFINPALVEPFGLTLIEAAAHGLPIVATKNGGPVDITNALNNGLLVDPHDQNAIADALLKLVADKNLWQECRRNGLRNIHLYSWPEHCRTYLTRVAGCRLRNPRWLKDTPADAGADEEEFLEDSMDAQDLSLRLSIDGEKSSLNTNDPLWFDPQDQVQKIMNNIKQSSALPPSMSSVAAEGTGSTMNKYPLLRRRRRLFVIAVDCYQDDGRASKKMLQVIQEVFRAVRSDSQMFKISGFTLSTAMPLSETLQLLQLGKIPATDFDALICGSGSEVYYPGTANCMDAEGKLRPDQDYLMHISHRWSHDGARQTIAKLMGAQDGSGDAVEQDVASSNAHCVAFLIKDPQKVKTVDEMRERLRMRGLRCHIMYCRNSTRLQVVPLLASRSQALRYLSVRWGVSVGNMYLITGEHGDTDLEEMLSGLHKTVIVRGVTEKGSEALVRSPGSYKRDDVVPSETPLAAYTTGELKADEIMRALKQVSKTSSGM

SEQ ID NO: 6665 - protein, 274 aa, Zea mays; identical to SEQ ID NO: 1176

SEQ ID NO: 6666 - protein, 173 aa, Zea mays
MLMSPGKAKKPLPPIWSEVLRFFVNPHKPMILALSRPDPKKNVTTLLKAYGESRHLRELANLKEDTMLQTLILGNRHDIEEMSGGAATVLTAVLKLIDRYDLYGCVAYPKHHKQTDVPHIYRLAAKTKVRRPFILFFLKRAFYGSAFKKAVNSSQTAIPLLGHQLTVSERRQL

SEQ ID NO: 6667 - protein, 340 aa, Zea mays
MPAGFQIGVIGSLALSVASSVAIVFCNKALISTLGFPFATTLTSWHLMVTFCTLHVAHRLHFFEPKAIDGQTVILFGLLNGTSIGLLNLSLGFNSIGFYQMTKLAIIPFTVLLETIFLNKRFSESIKLSLLVLLLGVGIASITDLKLNMLGSILSGLAIATTCVGQILTNTIQKRLKVSSTQLLYQSAPYQAGILFATGPFVDQLLTDRSVFAHKYSAPVLGFIVLSCLIAVSVNFSTFLVIGTTSPVTYQVLGHLKTCLVLSFGYTLLHDPFTLRNILGILIAIFGMALYSYFSVREGKKKSANDALPVSQMADKEAEPLLATKDNNDTKKANGLSHDC

SEQ ID NO: 6668 - protein, 224 aa, Zea mays
MAAGFQIGVIGSLALSVASSVSIVLCNKALISTLGFPFATTLTSWHLMVTFCTLHVAQRLRFFEPKAIDGQTVILFGLLNGTSIGLLNLSLGFNSIGFYQMTKLAIIPFTVLLETIFLKKRFSESIKLSLLVLLLGVGIASVTDLKLNLLGSILSGLAIATTCVGQILTNTIQKRLKVSSTQLLYQSAPYQAAILFASGPFVDQLLTNRSVFAHKYSATVLVWS

SEQ ID NO: 6669 - protein, 261 aa, Zea mays; identical to SEQ ID NO: 6426

SEQ ID NO: 6670 - protein, 163 aa, Zea mays
MADELCSMSVGQKFHGQSVLLSRISSYSAMNNPVFNNAYSAYNVPQRSYHGMNATAGLSSVMAPSPVFASAPKEKGFSGFMIDFMMGGVSAAVSKTAAAPIERVKLLIQNQDEMLKTGRLSEPYKGIGDCFGRTIRDEGFVSLWRGNTANVIPYFPTQALNFA

SEQ ID NO: 6671 - protein, 379 aa, Zea mays
MATAGKVIKCKAAVAWEAGKPLSIEEVEVAPPQAMEVRVKILFTSLCHTDVYFWEAKGQTPVFPRIFGHEAGGIIESVGEGVTDVAPGDHVLPVFTGECKECAHCKSAESNMCDLLRINTDRGVMIADGKSRFSINGKPIYHFVGTSTFSEYTVMHVGCVAKINPQAPLDKVCVLSCGISTGLGASINVAKPPKGSTVAVFGLGAVGLAAAEGARIAGASRIIGVDLNPSRFEEARKFGCTEFVNPKDHNKPVQEVLAEMTNGGVDRSVECTGNINAMIQAFECVHDGWGVAVLVGVPHKDGEFKTPPMNFLNERTLKGAFFGNYKPRPDLPNVVELYIKKELEVEKFITPRVPFAEINKGFDLMAKGEGIRCIIRMEK

SEQ ID NO: 6672 - protein, 255 aa, Zea mays
MATAGKVIKCKAAVAWEAGKPLSIEEVEVAPPQAMEVRVKILYTALCHTDVYFWEAKGQTPVFPRILGHEAGGIVESVGEGVTELVPGDHVLPVFTGECKDCAHCKSEESNLCDLLRINVDRGVMIGDGQSGFTINGKPIFHFVGTSTFSEYTVIHVGCLAKINPEAPLDKVCVLSCGISTGLGATLNVAKPKKGSTVAIFGLGAVGLAAMEGARMSGASRIIGVDINPAKYEQAITKLINAILGLIFLHQSSSD

SEQ ID NO: 6673 - protein, 659 aa, Zea mays
  unsure (1)..(659): unsure at all Xaa locations
SRLAGTKRIPTGKLFEFLSSNQSWSNFGCDCIGSLLPFEDLLIMYHYTSVSFIALVYFSIPLELIYFVKKSSFFLYSRVLIQFGAFIVLCSAAHLINLGTFTTHANTSEIVITIARVTTAVVSCATTLMLVHIIPDLLSVKSRELFLKKXAEELDRVLVLRKTHKDADRHVKMLTHEIRSTLDRHTILKTTLVELGRTLASGGXALWMPSRSGSSLQLSHTLHHQITVGSSVPINLPVINQVFSSNRAIIIPHTSPLARIRPLTGRYVPPEVAAVRVPLLHLSNFQINDWPELSAKSFAIMVLMLPSDSARKWHVHELELVEVVADQVAVALSHAAILEESMRARDLLMEQNVALDLARREAEMAIRARNDFLAVMNHEMRTPMNAIIALSSLLLETELTPEQRLMVETVLKSSNLLATLINDVLDLSKLEDGSLELEIKAFNLHAVFKEVMGFIKPIASIKRLSVSVMLAPDLPLCAIGDEKRLMQTILNISGNAVKFTKEGHITLVASIVKADSLREFRTPEFHPTASDDHFYLKVQVKDTGCGIGPQDLPHVFTKFAHPQSGGNRGFNGSGLGLAICKRFVSLMGGHIWIDSEGTGRGCTATFVVKLGVCDNTNTYQQQLIPLVWPSSADSDLRAPKPLPDGRGSTPLKSRYQRSV

SEQ ID NO: 6674 - protein, 103 aa, Zea mays
  unsure (1)..(103): unsure at all Xaa locations
MXREENVYMAKLAEQAERYEEMVDIWRRWLRTVXDVEXLPXEERNLXLSVAXXNXVIGAXPAXWXLVXSIEKKGGEPRESLSGGKSKNSVEWPLEWLPTLSLE

SEQ ID NO: 6675 - protein, 436 aa, Zea mays
MPCLEQIPMATGETAVDRREDHRDMDLSGEEHVRPKARKPYTITKRRERWTEDEHGQFLEALQLHGRAWRRIQVHIGTKTAVQIRSHAQKFFTKVVRESSPGSNASAGAAPAIQIPPPRPKRKPAHPYPRKADGAAKKPAPELKRLEKTSLRDRVRDEGSPTSVLASARTASRAEVSGSLVANSSSASRSPALSDAGSDERGDGGGSLASSVDREDGCASPRTRAPCTKVLCHAHEVSRLGSGAPVVKLFGNKVVVVKVKDLETDTPPASVAEAARNGSPPNGAAGASSWKPWPELTCLVPRRDGFAAQPVVSPPCAVFYYPQASAASAQEHQQASEPLDHRRAQREGSSPTGSSVASSAAAESRHGPVQENASDGYAALRAAIPRPTKRVSSASFGGRGFVPYKRCAAESEAARPVALALAPGEEADGDLTRLCL

SEQ ID NO: 6676 - protein, 630 aa, Zea mays
  unsure (1)..(630): unsure at all Xaa locations
MGGGLDEAVKVVDLEDGEGEEEAEAAAAEGSSMEMGMLPRMPVRVLLAEGDDSTRHVISALLRKXCGYRVAAAXDGVKAWDLLKEKSFKVDLVLTEVELPLMSGFLLLSTIMEHDASKNIPVIMMSSHDSVSMVFKCMLKGAADFLVKPIRKNELRNLWQHVWRKQLANGGPNVQHIQREENLAERIQQKTGVTKADNLDRDVPCKNRECSEQESDAQSSCTRSELEAESKQTDNILEYKQSTQRHLSIPSHKNVELNGQTKIQRAKGNNLIPASEDDLSPKKRTCLNENNSERASRDMELVHIMENQQKYNTQWEVDTMRTTSRGNDEKGSIPAHQLELSLRRTDYGKLENHEKNDRRTLNHSTSSAFSLYNCRAVPTLGNAGDGQLCSTSETLVDVENKNGDSADPSQDMTETNRPPIRVVPVPVQGLTFDGQPFWNGTPVASLFYSQSTPPIWNSKTSMWQESTPQATSLPQKSPQNEPNEMGAKPVINAGEQFAMGPPSASGKQLHVEILNDDPRHISPMTGESGISTVLDSTRNTLSSSGCDSISNQITAPTESSNVYKDVPETPSAEGSRHLSQREAALNKFRLKRKDRCFEKKVRYQSRKLLAEQRPRVKGQFVRQDHSIQGS

SEQ ID NO: 6677 - protein, 445 aa, Zea mays
  unsure (1)..(445): unsure at all Xaa locations
PRVRGSFASVDCTALHLLPAAEFSWSRAMAMSSSRALLRRIGGALRRRSFSDAAAGPDSAAVGYHVAGGPSYMRGAVFWEPGRPLTLEEFHMPRPKAGELLIKTKACGVCHSDLHVLKGELPFSSPCVVGHEITGEVVDHGTHTPAEIISRFPVGSHVVGAFIMPCGNCFYCVKGQEDLCESFFAYNRAKGTLYDGETRLFLRGNGKPVYMYSMGGLAEYCVVPANALAVLPASLPYTESAILGCAVFTAYGALRHAAEMRAGDSVAVIGVGGVGSSCLQIAKAFGASEVIAVDVLDEKLRNATTLGATHTVNAAKEDAVERIKEITGGRGVDVAVEALGKALTFSQCAXRVRDGGKAVMIGLXATNVVGEVDITRLVRRQVKIIGSYGARARQDLPQIVKLAESGAFSLRNTVSRKCRFEEANGAYEDLDQGKIVGRAVVEIME

SEQ ID NO: 6678 - protein, 328 aa, Zea mays
  unsure (1)..(328): unsure at all Xaa locations
MPAMGKEGASDGGMSESVIRKVLVSYMYVAVWIFLSFSVIVYIKYILDPLMYNWPFPISLTMAHMDFXVVPTCALYAMSAWFSNSAYIYLSVSFIQMLKALMPVAVYSIGVLFKKETFRSSSMLNMLSISFGVAIAAYGEARFDVRGVALQLAAVAFEATRLVLIQILLTSKGISLNPITSLYYVAPCCFCFLLVPWAFVELPRLRAVGTFQPDFFVFGTNSLCAFALNLAVFLLVGKTSALTMNVAGVVKDWLLIAFSWSVIRDTVTPINLFGYGIAFLGVGYYNHVKLQALKAKEAQKKATQADEEAGSLLQERDGHSDRKSDNQA

SEQ ID NO: 6679 - protein, 416 aa, Zea mays
  unsure (1)..(416): unsure at all Xaa locations
WVPRGRPDVASTLLRSRPKSARTRARSKFPGHLPPLPSHSQIRVLGSSSSSLPSRSPSQSRVEIHRLRAPSPEQREEAGGQRPAMGKEGASDGGMSESVIRKVLVSYMYVAVWIFLSFSVIVYNKYILDPKMYNWPFPISLTMVHMAFCSSLAVALVRVLRVVDLPSSPAMTSQLYISSVLPIGALYSLSLWFSNSAYIYLSVAFIQMLKALMPVAVYSIGVLFKKESFKSSAMLNMLSISFGVAIAAYGEARFDARGVALQLAAVAFEATRLVLIQILLTXSKGISLNPIISLYYVAIFCSGFEIQIKSIRRFGNMHLLCWRTLSCYLFINTFDLXGRGPFLTTSLCPLSTFICSTSRLGPPNVLLFMVXWWLFFKLHELPVKEAQKKAAQADEEVGSLLQERDGHGDHKSDNQA

SEQ ID NO: 6680 - protein, 326 aa, Zea mays
RGRIPRSPTSSALSLSDPRPRLLLLLPSFVPSRSPSQSRVEIHRLRAPSPEQCEEAGGQRPAMGKEGASDGGMSESVIRKVLVSYMYVAVWIFLSFSVIVYNKYILDPKMYNWPFPISLTMVHMAFCSSLAVALVRVLRVVDLPSSPAMTSQLYVSSVLPIGALYSLSLWFSNSAYIYLSVSFIQMLKALMPVAVYSIGVLFKKETFKSSAMLNMLSISFGVAIAAYGEARFDARGVALQLAAVAFEATRLVLIQILLTSKGISLNPITSLYYVAPCCLDLPRHRNAVFVDLSLICAVPRFICPASRLGTKNVLLQIVNLVVIFKI

SEQ ID NO: 6681 - protein, 477 aa, Zea mays
MVLMNLAVAAALPSVTPRTGVVLPRSSRRHCPRGVVPRAASSSVSSFTSPSAAAAPIYTPTPQDRSLRTPHSGYHFDGTARPFFEGWYFKVSIPECRQSFCFMYSVENPLFRDGMSDLDKLLYRPRFTGVGAQILGADDKYICQFSEKSNNFWGSRHELMLGNTFISNKESTPPQGEVPPQDFSRRVLEGLQVTPIWHQGFIRDDGRSNYVPNVQTARWEYSTRPVYGWGDVKSKQLSTAGWLAAFPFFEPHWQICMARGLSTGWIEWDGERFEFENAPSYSEKNWGGGFPRKWYWIQCNVFPGASGEVSLTAAGGLRKIGLGDTYESPSLIGIHYEGQFFEFVPWTGTVSWDIGLWGLWKMSGENKTHLVEIEATTAESGTALRAPTIEAGLVPACKDTCYGDLRLQLWEKKYDGSKGEMILDATSNMAALEVGGGPWFNGWKGTTVVNEVVNNIVGTPVDVESLLPIPFLKPPGL

SEQ ID NO: 6682 - protein, 347 aa, Zea mays; identical to SEQ ID NO: 922

SEQ ID NO: 6683 - protein, 153 aa, Zea mays
MKRLTQDEDQEQEQEPGVVVSVAQGVTLLLARSGGGGGGGEPRASPRVFECKTCSRRFPSFQALGGHRASHKRPRAAPAKARPHGCGVCGVEFALGQALGGHMRRHHRAVAEECEARDGAAASAHGMDVDDAEAKPEEEATGLLRFDLNIAPS

SEQ ID NO: 6684 - protein, 253 aa, Zea mays
KCYVVLCSLQNRDKPINVNIGTTVKGAVDDLDLVIKTLEENGFKDRFYIHCDGALFGLMIPFVKKAPQVTFKKPIGSVSVSGHKFVGCPMPCGVQITRLEHINALSSNVEYLASRDATIMGSRNGHAPIFLWYTLNRKGYRGFQKEVQKCLRNAHYLKDRLKEAGIGAMLNELSSTVVFERPKDEEFVRRWQLACEGNIAHVVVMPSVNIDKLDYFLNELVDKRATWYQDGISQPPCIARDVGVENCLCGLHK

SEQ ID NO: 6685 - protein, 102 aa, Zea mays
MHGRTAMAVACLLCMTALLLVQDVQSRRLLWTEQEKKQSHGGLGNHGAADRRSTSLEPCSGAMGGGGTGSADKQGEFPCDDDTSKWTELHTDYIYTQDFKHP

SEQ ID NO: 6686 - protein, 156 aa, Zea mays
  unsure (1)..(156): unsure at all Xaa locations
ERWSLKAKTVLVTGGTKGIGHAIVEEFAGFGAVIHTCARNEYELNECLSKWQKKGFQVTGSVCDASLRPEREKLMQTVSSMFXAKLDIXINNLGAIXXNPTLDYXXQEDFXFHISXNLKNLXYHPEPALRILLXKASGMGGXINFSWPXIAGSCPA

SEQ ID NO: 6687 - protein, 246 aa, Zea mays
MDSVPSPSSSTRATAAPGPCCRFDALRRACARHAAAAARAAGWALGALLTCVFAVVGSLVGIFIGAFMGMSTESGMFRGAGVGAVSGAVFSIEAVESCIEIWRSSHSGKYSILYVLDIISSLFSGRIVWEKVSPALQRAVQSQMSLMSTPFIDNNDLFETGSTGGMSRALIDRIPKMRFSAASNCDKETDSSCCSVCLQDFGAQQFVRALPQCQHIFHVRCIDNWLLRHASCPLCRAGVHIDHIHM

SEQ ID NO: 6688 - protein, 437 aa, Zea mays
MDRLGGSARLLLVSDLDQTMIDHDDRENLSLLRFEALWEAEFAQDSLLVFSTGRTPVSYKGLRRDRPLVTPDVTIMSVGTVIAYGEEMVRDVGWEERLDSDWDRAIVVEETARLPQLARMQPERNQGPHKVSFFVDKQGAQEVMDYLPKKLERRGVHVKIVYSSGNALDVLPRGAGKGQALVYLLKKLDSNGKPPKNTLVCGDSGNDAELFGVPSVHGVMVCNAQEELVQWYQENARDNPRIIQATERCAAGIMQAIGHLGLGPNVSARDLVGFPAYYPNNNKKGAAATAKPADVVVRFYVLYEKWRRGELPSSNYFSSSSAMRYLKSITHPNGTIIHPCGSERSLHASVDALLSSCYGDKKNFRVWVDRLVTSPIGTSSWLARFDSWEMEGGVRYCCRTTILLNIKPESPEGLELTHIHKTWVQGHSAGPGSALVF

SEQ ID NO: 6689 - protein, 711 aa, Zea mays
MVLGGGPLGAIIGRYPSSSAAAGDDEQGDPGPGGGVIRHDRKCRDWPFLVLFAAFWVAMIVNSSFGFNQGNPLRLTYGLDYKGNICGSRHADPDLYQLDVRYWVNPNQVYQSGLKTSHIELPDAKTICLMECPLPAEDGLNFVCDYPEGDIRLSVDDWIDRDYDYFEYLTPDMRNSSLQLQGPCYPVIFPSVNVYWSCQFIARASNASLKHWKDMGGVTIDENMLIDRTIHDAINSKSAVMKRYVADIGKSWPVVILCGGLLPLFLSMIWLLMVRFFVAGMSWITVVVFNALVVSVTMFFYIKAGWIGHDPLTVVIGESDPYVSIGGRERNHLHAASVLMTVIMILAFLTSIAIARRIMKATSVLKVAAKVVGEVQALIIFPVVPYLILAIFYTFWFSAALHLFSAGQVIQNDCNTDCCSYDLKLGKVNCDRCCGYTIHYTPHIGIAILFHLFGCYWATQFFIGCSSTIIAGSVASYYWARGEISHDIPFHTVVSSLKRLLRYSLGSVALGSLIVSIVEWVRFILESLRRRLKFVDSARGSRFGKTVSSSSQCCLGCIDWTLKSVNRNAYVMIAITGKGFCKASVLATGLIMNNVLRVGKVNVIGDVILLLGKLCVSLLCALFAFLMLDEHKYRSGHNKISSPLVPVLLSWALGYIVAKLFFAVVEVSIDTMVLSFCQDSEEHQGNARYAPPLLIETLDEESELRRLTQGP

SEQ ID NO: 6690 - protein, 253 aa, Zea mays; identical to SEQ ID NO: 5820

SEQ ID NO: 6691 - protein, 439 aa, Zea mays
  unsure (1)..(439): unsure at all Xaa locations
MEAALAACALPSLRILNTKPRFRCSFSNPSLPISPNSLITRKSSRFTTAVSSPPSSSAATSTNSPPEPEALFEPGSDKFDWYANWYPVMPICDLDKKVPHGKKVMGIDLVVWWDRNEKQWKVMDDTCPHRLAPLSDGRIDQWGRLQCVYHGWCFNGSGDCKLIPQAPPDGPPGHTFKQACVAVYPSTVQHEIIXWFWANSDPKYKNIIETNKPPYIPELEDPSFTKLMGNRDIPYGYDVLVENLMDPAHVPYAHYGLMRFPKPKEKIDREGGKPLEINVKKLDNKGFFSKQEWGYSNFIAPCVYRSSTDPLPEQEHEYPAPAASDKAALSKRRLSLIFICIPVSPGRSRLIWTFPRNFGVFIDKIVPRWVFHIGQNTILDSDLHLLHVEERKILERGPENWQKACFIPTKSDANVVTFRRXFNKYSEARGGARTQSNYP

SEQ ID NO: 6692 - protein, 132 aa, Zea mays
  unsure (1)..(132): unsure at all Xaa locations
MGXSVEKTXSGREXKXKDXXEADFGRLXXELAEVEMPXLMGCXAXIGPXKXXXXXRISGFLHMTXQTAVLIETLTALGAEVRWXSCNIFSTQXHAAAAIXGDSAAVVCWKGETXLXEYWWXXERCLDWXRXG

SEQ ID NO: 6693 - protein, 246 aa, Zea mays
  unsure (1)..(246): unsure at all Xaa locations
MDPVPAPSSSRRAAAAPGPCCRFDALRRACAGNAAAAARAAGWAIGALLTCIFAVVGSLVGIFIGAFMGMSTESGMFRGAGVGAVSGAVFSIEAVESCIEIWRSSHSGKYSILFVLDIISSLFSGRIVWEKVSPALQRAVQSQMSLMSTPFIDNSDLFETGSTGGMSRALIDRIPKTRFSAARHCAQGTDSSCXSVCLQDFGAQQFVRALPQCQHIFHVRCIDNWLLGHASCPICRAGVHIAHIHM

SEQ ID NO: 6694 - protein, 739 aa, Zea mays
  unsure (1)..(739): unsure at all Xaa locations
LPASLGKLRELRDLILWQNLLEGEIPASLENLVRLEHLILDYNGLTGGIPRELSKCKELNWISLASNQLSGPIPAWLGQLSNLAILKLSNNSFSGPIPAELGNCQSLVWLDLNSNQLKGSIPAELAKQSGKMNVGLVLGRPYVYLRNDELSSECHGKGSLLEFTSIRPEELSRMPSKELCNFTRVYMGSTEYTFNKNGSMIFLDLSFNQLDSEIPKELGNMYYLMILNLGHNLLSGVIPPELAGAKKLAVLDLSHNQFQGPIPNSFSTLSLSEINLSNNQLNGSIPELGSLFTFPKISYENNSGLCGFPLLPCGHNAGSSSSDGHRSHRNQASLAGSVAMGLLFSLFCIVGIVIIAVECKKRKQINEEASTSRDIYIDSRSHSGTMNSNWRLSGTNALSVNLAAFEKRLQKLTFNDLIVATNGFHNDSLVGSGGFGDVYKAQLKDGKVVAIKKLIHVSGQGDXRKFTAEMETIGRIKHRNLVPLLGYCKCGEERLLVYDYMRFGSLEDVLHDRKKIGIKLNWAARKKIAIGAARGLAYLHHNCIPHIIHRDMKSSNVLIDEQLEARVSDFGMARMMSVVDTHLSVSTLAGTPGYVPPEYYQSFRCTTKGDVYSYGVVLLELLTGKPPTDSTDFGEDNNLVGWVKQHSKSKLADLFDPVLLVEDPALELELLEHLKIACACLDDRPSKRPTMLKVMAMFKEMQASSAVDSKTSACTVAVDDACFGDVEMTTLKEDKEEKD

SEQ ID NO: 6695 - protein, 518 aa, Zea mays
  unsure (1)..(518): unsure at all Xaa locations
MASAPLPAAIEPGKKGNVKFAFACAILASMTSILLGYDIGVMSGASLYIKKDLKISDVKLEILMGILNVYSLIGSFAAGRTSDWIGRRYTIVFAAVIFFAGAFLMGFAVNYWMLMFGRFVAGIGVGYALMIAPRVHXPEVSPASARGFLTSFPEVFINFGILLGYVSNYAFSRPPGSAWGWRVMLGIGRGPPSVVLALMVLGXGPRSPRWLVMKGRLADAKVVLGKTSDTPEEAAERLADIKAAAGIPQELDGDVVAVPKKRDSEEARVWKELILXPTPAMRRILLSGIGIHFFQQASXGIDAVVLYSPRVFKAAGITSDNQLLGTTCAVGVTKTLFILVATFLLDRVGRRPLLLSSVGGMIFSLVGLAAGLTVIGHYQDEKIPWAIGVAIASTMAYVAFFSIGLGPITWVYSSEVFPLHVRAMGCALGVASNRLTSGVISMTFISLSKAITIGGAFFLYAGVAVLAWVFFFTFLPETRGRTLEAMSKLFGATDDELKPQDGATKDKQKLELAATGTN

SEQ ID NO: 6696 - protein, 493 aa, Zea mays
  unsure (1)..(493): unsure at all Xaa locations
LFNGSSNHFSGNLDESISNFTQLSFLDIHNNSLTGSLPFSLSDLSYLNYLDLSSNDFNGPAPCGICNIVGLTFADFSGNHIGMSGLVDCAAEGFCTGKGFDRKALNSSDRVRRAAIICVSILTVVIVLVFLVVYLKRRLLRSRPLALVPVSKAKATIEPTSSDELLGKKFREPLSINLATFEHALLRVTADDIQKATENFSKVHIIGDGGFGTVYRAALPEGRRVAIKRLHGGHQFQGDREFLAEMETIGKVKHPNLVPLLGYCVCGDERFLIYEYMENGSLEMWLRNTGXDPQSARGTIIRHEKQHSKKRQGSWKGRFSKQKEGTFPTSNHSNVTAFFLNXNVSDFGLARIISACETHVSTDIAGTAGYIPPEYALTMKSSTKGDVYSFGVVMLELLTGRPPTGQEEGEGGGNLVGWVRWMMAHGKEGELFDPCLPVSSVWRVQMAHVLAIARDCTVDEPWKRPTMLEVVKGLKMAETIECGPLVVTVTKDM

SEQ ID NO: 6697 - protein, 45 aa, Zea mays
MLLKIKRVPTVVSNYQKDETVEEGGCGRNCLSKCCINGARLPLYT

SEQ ID NO: 6698 - protein, 381 aa, Zea mays
MASPTQGQVITCKAAVAYEPNKPLVIEDVQVAPPQAGEVRVKILFTALCHTDHYTWSGKDPEGLFPCILGHEAAGIVESVGEGVTDVQPGDHVIPCYQAECKECKFCKSGKTNLCGKVRSATGVGVMMNDMKSRFSVNGKPIYHFMGTSTFSQYTVVHDVSVAKINPQAPLDKVCLLGCGVPTGLGAVWNTAKVESGSVVAVFGLGTVGLAVAEGAKAAGASRVIGIDIDNKKFDVAKNFGVTEFVNPKEHDKPIQQVLVDLTDGGVDYSFECIGNVSIMRAALECCHKGWGTSVIVGVAASGQEISTRPFQLVTGRVWKGTAFGGFKSRTQVPWLVDKYMKKEIKVDEYITHNMNLADINDAFHLLHEGGCLRCVLAMQI

SEQ ID NO: 6699 - protein, 572 aa, Zea mays
MASSSSSRLLLLLLPCLALTLLGAADAEVHHHEFVIQETPVKRLCKTHNIITVNGQYPGPTLEVREGDTLVINVVNRAQYNATIHWHGIRQIRTGWADGPEFVTQCPIRPGGSYKYRFTIQGQEGTLWWHAHSSWLRATVYGALIIRPRENKTYPFAKPSREVPVILGEWWDANPIDVIREAQRTGGGPNVSDAFTINGQPGDLYKCSNKETTAIPVKAGETALLRFINAALNHELFVTIAQHKMTVVATDASYTKPFTTSVLMLAPGQTTDVLVTMDQPPTRYYVAARAYVSGQNVAFDNTTTTAVLEYDCGCASDFGPKIQPAFPAALPAFNDTSAATAFAAGIRSPDRVRVHENGDEYLFFTVGLGLFNCKPGQLCAGPNNNTRFAASMNNVSFVFPQTDSLLHAHYYKIPGVFTTDFPAYPPVQFDYTGQNVSQALWQPVPATKLYPLRFGSVVQLVLQDTSIVTPENHPIHIHGYDFFILAEGFGNFDPKKDVEKFNYVDPPQRNTVAVPVNGWAVIQFVADNPGVWLMHCHLDVHITWGLAMAFLVEDGYGELQSLEPPPVDLPMC

SEQ ID NO: 6700 - protein, 168 aa, Zea mays
  unsure (1)..(168): unsure at all Xaa locations
MPPPQSGMTLCRLPKATLGLPLSLPSLLYRPSLSLAARRTKAVSARASSSSPSPDSSFGSRMEDSVKKTVADNPVVIYSKSWCSYSMEVKSLFKRIGVQPHVIELDNLGAQGPQLQKVLERLTGQSTXVPNVFIGGKHVGGCTDTVKLYRKGELASMLSDLDINIDNS

SEQ ID NO: 6701 - protein, 546 aa, Zea mays
  unsure (1)..(546): unsure at all Xaa locations
MNTVALLSLAPQLLIKPSLTCFSRKGVGRYGGIKVYAVLRDDGAEFAKNNNLEALFHVDDPXGPRVPIKKGRFLDVNEALEVVRFDXIQYCDWRAXRHDLLTIMVLHNKVVEVLNPLAREFKSIGTLRKELAELQQELAKAHNQVHLSETRVSSALDKLAHMETLVNDRLLPPDGASSTSTAQPTSLVPSTSSTARVRAKKPPRRGLNVSGPVKPYNPSLKNFWYPVAFSSDLKDDTMVPIACFEEQWVIFRGKDGRPGCVQNTCAHRACPLHLGSVNEGRIQCPYHGWEYSTDGKCEKMPSTKMLNVRIQSLPCFEQEGMVWIWPGDDPPKATIPSLLPPSGFTVHAEIVMELPVEHGLLLDNLLDLAHAPFTHTSTFAKGWSVPSLVKFLTPASGLQGYWDPYPIDMEFRPPCMVLSTIGISKPGKLEGKSTXQCSTHLHQLHVCLPSSRNKTRLLYRMSLDFAPWLKHVPLMHLLWSHFAEKAFLNEDLRLVLGQQERMINGANVWNWPVSYDKLGVRYRLWRDTVERGSERLPFSNQAESGS

SEQ ID NO: 6702 - protein, 538 aa, Zea mays
MAESGESSPNSAAATDDTHHEMPEAGAAAAAVHAQPRPPPPPSKVRLMVSYGGRIQPRPNDNQLAYVNGETKILSLERPLCFPDFAARLAALVGNAADVRVKYQLPGEDLDALVSVTNDEDLEHLVHEYDRLHVHRHATASSAGSSRGGSAPRLRVFLFPVQSPPPPPQPAGILEPKVEQRQWFVDALNTVLLPSSKQDPPPVPPQQQKQEQESVFAQQSPPPQAKHEAVFVQQSPPQPQTVVQMQMPPPQHVVLAAASPDYLFGLDNGFVHPPAVKVKDPAGDPPAVRESVPVELPAKNEDRHPIPNPAGDNVAVSPAEYQRQIPGLEKLQVADNAAHQPPPPAPAPAPAPSLAPTPVPAALPRNGSDDSLTRGYPLATPTPNSSAEYYLPKFPEKPPVPPPPQSSAPPPPTYLQVQGRYTSVAPGSGADRGPVFFIPAPHGYFAATASPGATSYPAVYAVAPPSTAANGSAASPAASNATAYSPAPTQVAYDSNGRAIYYTSMLPQYPSAVNGMSSAGAVLGTEPVNPVAVKPTVS

SEQ ID NO: 6703 - protein, 382 aa, Zea mays
  unsure (1)..(382): unsure at all Xaa locations
SWRWPVGGWVADQGCVRLGAAEIRHEGQLHRFIHRYLSLFQLQGKPSSKWQPSMDIMALNARDEEQYGNNHLGLGLSLSLGLGVATAAPVEVEPPPPPAAAAAAAAASYQRRAHHLPPRXQWWKWNGPGLFFGTTMDPSLERNQQQQQPAAARHGHEMPFLRGVDVNRAPAGETRRGSCSEDDEEPGGASSSPNSTLSSSLSGKRAAPARSGGEVADHTPRAGGGSDDEDSGGGSRKKLRLSKDQAAVLEESFKEHNTLNPKQKAALAKQLNLKPRQVEVWFQNRRARTKLKQTEVDCEFLKRCCETLTEENRRLQREVAELRVLKLVAPHHYARMPPPTTLTMCPSCERLASASASADQAGRAGPCWGPLPVFVDGPARRP

SEQ ID NO: 6704 - protein, 342 aa, Zea mays
LVPRAGTRRSQSDIPFGFAQLSPPLPPPAPVKREVTAAADGCRSDGGGGDDAALYDLVNAYMDLDGLDPLNSSEDRHDDRDSRASGTRAGSAAESSENEAESQSTSADRKDGGKSRHCRSLSIDSFMGKLSFAAGEESPKLPLPSPGGSLTRSGSGSLEGGAVALFNMEFTNGEFTDSEKKKIMANERLAEIALTDPKRVKRILANRQSAARSKERKMRYIQELEHKVQVLQTEATTLSAQLTMLQRDSAGLATQNNELKIRLQAMEQQAQLRDALNEALTAEVQRLKLATGEVTDGRMPKGLQQQMNSQMLQIQQLQVQQQAPQAQQQGQRQQQQQPQKSA

SEQ ID NO: 6705 - protein, 521 aa, Zea mays
  unsure (1)..(521): unsure at all Xaa locations
MRIPRRKGVAGPLAVGVPSRRAQVAAVFALATLLGVSVLYDAAHIAASLPRLRPPAPYAKLSSSDGAASVSGVAREEVATVETLAPPARAPVDGADRADPPPHERQQEAEAGAAKPGASLQQDAPLTEEVVEGGSGGHGGGGSQEQEQDQAQGTCDLYKGRWVYDESRAPLYKESECSFLTEQVTCTRNGRRDDDYQKWRWQPDGCDLPRFEAKLLLEKLRNKRLMFVGDSLNRNQWESMVCLVQSEAPWDKKSLVKNGSLNVFHLQEYNATVEFYWAPFLVESNSDDPDIHSISDRMIKPTSIAKHAANWEGVDYLIFNTYIWWMNTPQMKTXGGSFSRKHVKYDEIERVEAYRKVLKTWSRWVEAHIDPKRSTVLFMSVSPVHMQSEGWGSPNAVKCFSETQPAINYTKKLEVGTDWDLFATAQRVTRSMKKVPVHFVNITALSEIRKDAHTSVHTLRQGKLLTPEQKANPRKFADCIHWCLPGVPDTWNEFVYGHIVSSTPPPQQQQQQKITEDEPHR

SEQ ID NO: 6706 - protein, 308 aa, Zea mays
  unsure (1)..(308): unsure at all Xaa locations
MRKSRVNPSRQERSGGMATPRRLIRERAEAAGATLGAVRPHEIPPLMSAAATFFFVSQPLIHLAVVLPSRSCKVTIRHFGVLPLRDEGAISMGLDTLPGLFAGSLLLTVVAAPIASLAFSLPSIPKPKALVMIHRFFSISLLAFFVLWYTSTPGQSGPTSQSSEGGSDKPAGWRNQSWFYIVVRISLFLWVALLNLITISSTWARVIDVMDSXVQSGSRLFGFIGAGATLGQLFGSLFAASMAWLGPFLLLFSSLLMELAALSSKGMCIDENHASAELCQIGAGQAPNTMADDEISASNGDNDEWSEV

SEQ ID NO: 6707 - protein, 331 aa, Zea mays
MSEEAARAGVEESIGQRRRRDGRGEAAAAAAPRRVWEFERDLVAGALMGGAVHTVVAPIERVKLLLQTQDGNAALLGRARKFRGFADCVARTVRDEGVLSLWRGNGTAVIRYYPSVALNFSLKDLYRSILKDAGTSSDNKFTSIALSNFFAGAAAGCTTLVLIYPLDIAHTRLAADIGRTDTRQFRGIRHFIQTIYKKNGIRGIYRGLPASLHGMVVHRGLYFGGFDTAKDVLVPLESPLWQRWVAAQAVTSMAGLISYPLDTVRRRMMMQSGMEVQMYSSTLDCWRKIYRLEGIRSFYRGALSNMFRSTGAAAILVLYDEVKKFMDRGRL

SEQ ID NO: 6708 - protein, 364 aa, Zea mays
KEKPGQYEHHYAFTMPGLCRYATGINVFDPKFNIAAPGADQSIYFPFTQKQKRLTDLHPQIEELLYSKQDTGEHRGYLADRNKPIIFSMARLDKVKNITGLVEWYGQNKKLRDLVNLVVVAGLLEASQSKDREEIEEINRMHSLIDKYQLKGQIRWIKAQTDRVRNGELYRCIADTRGAFVQPALYEAFGLTVIEAMNCGLTTFATNQGGPAEIIVDGVSGFHINPTNGREASNKIAEFFQKCKEDPSYWNKVSTAGLQRIYECYTWKIYATKVLNMGSTYGFWKTLNKEERVAKQRYLQMFYNLQFRNLAKTVPRLFEHPPPQAPAGAGPSTMTVTRPKERKTQTRIQRIMTSLMGQKPATSE

SEQ ID NO: 6709 - protein, 283 aa, Zea mays
MAPAAPYGGAESQRQADLLKQEGNAFFRKERLSAAIDAYTGAITLCPNVAVYWTNRALCYRKRNEWTRVEEDCRTAIQLDSQSVKAHYMLGLSLVNSQRLSEGIKSLEKSLELGRGAHPASYMVEEIWQELSKAKYIEWESLSRDRTCQLQKLKCICSVSFRVACKEALTSYNSLDNPAAGAPVEQLNELEEVFKKAAKTDTPAEVPDHLCCKITLDIFRDPVITPSGITYERAVLLDHLQTVGRFDPVTREALEPHQLVPNLAIKEAVHAFLSEHGWAYKIR

SEQ ID NO: 6710 - protein, 483 aa, Zea mays
  unsure (1)..(483): unsure at all Xaa locations
CSCMKGFSVRSPRDWELGDRRDGCARNTQLDCASDTGLTDRFFAVQGVRLPQDANKMQAATSGDECSGICLRDCSCTAYSYWNGDCSVWRGKLYNVKQQSDASSSGDGETLYIRLAAKEVAMQKRGISVGVAVGVAIGATAAASILLAGLMIRLRKAKWFPRTLQDAQAGIGIIAFRYADLQRATRNFSERLGGGSFGSVFKGCYLGDPVTLLAAKRLDGCXQGEKXFTAEVNSVGIIQHINLVRLIGFCCEDDKRLLVYEYMPNHSLDLHLFKANGTVLDWNLRYQQAIGVARGLTYLHTSCRDCIIHCDIKPENILLDASFVPKIADFGMAKVLGREFSHAVTTMRGTIGYLAPEWISGTAVTSKVDVYSYGMVLFEVISGRKNSSPEYFGDGDYSSFFPMQVARKLRSGHVESLVDEKLQGDVNLKEVERVCKAACWCIQENESARPTMAEVVQFLEGLSDLGMPPLPRLLNAVTGGSPT

SEQ ID NO: 6711 - protein, 293 aa, Zea mays
  unsure (1)..(293): unsure at all Xaa locations
MDHAADAHRTDLMTITRHVLNEQSRNPESRGDFTILLSHIVLGCKFVASAVNKAGXAQLIGLAGETXNVQGEEQNKLDVLSNEVFVKALVSSGRTCVLVSEEDEEATFVDPKLRGRYCVCFDPLDGSSNIDCGVSIGTIFGIYINSARXVKDKDNVTLEDVLQPGTNMLAAGYCMYGSSCTLVLSTGNGVNGFTLDPSXLGEFILTHPDIKIPKKGXKIYSVNEGNAKNWDAPTAKFVKKCKYPEDGSPPRSLRYIGSMVADVHRTLLYGGIFLYPAXDEKNPNGKLSSSASS

SEQ ID NO: 6712 - protein, 147 aa, Zea mays
EAIFVDPALRGKYCVCFDPLDGSSNIDCGVSIGTVCHCHSRWCFKPSYHRDIYTRARCYIRICSLQIFGIYMVKDKDNVTLEDVLQPGTNMLAAGYCMYGSSCTLVLSTGNGVNGFTLDPSLGEFILTHPNIKVNDKKNSTLLFFPG

SEQ ID NO: 6713 - protein, 276 aa, Zea mays
MDEENVVELLQRYRRDRQVLLNYILSGNLIKKVAMPPGAISLDDVDIDQVSVDYVLNCAKKGEPLDLGDAIRLFHDSLDYPYVNNTGAVDEFYLLTKPEYSGPAPTREPPPIPATAPSSVVVPPPDVEPAPIIVSSPVTATNLPKSQPFDSPTEKELTIDDIEDFEDDEDEFDGRRASRRHQTDASDLSLLLPLFETGITDNDLRETAYEILVAAAGASGGLIVPQKEKKKEKRHRLMRKLGRSKSESVDINTQRQPGLVGLLETMRAQLGITESM

SEQ ID NO: 6714 - protein, 293 aa, Zea mays
MRGGGAGPTAAFMSDEPPPADAEEVEENSGAEEEDEETVVEQDDDELELGLCLGSKQQQQQHPPPCRILTARDLQPRSLSPDSSVSSSSPAAGAGTAAPSKRAKADAAPNSPGTVASGHPQSFGVVGWPPIRTFRMNSLFNQAKENASEAGAKKPIVEPDMQEDKEESKKGRTVGWVKVNMEGDIIGRKVDLNAHRSYKTLASALELMFMKPSIGLCTSSSSKTLKLLDSSSEYQLTYEDRDGDWMLVGDVPWEMFVGSVKRLKIMRTSDAKGLGPRFQGSHRPTAACTRGRT

SEQ ID NO: 6715 - protein, 172 aa, Zea mays
HFGVVGWPPIRTFRMNSLFNQAKENASEAGAKKPIVEPDMQEDKEESKKGRTVGWVKVNMEGDIIGRKVDLNAHRSYKTLASALELMFMKPSIGLCTSSSSKTLKLLDSSSEYQLTYEDRDGDWMLVGDVPWEMFVGSVKRLKIMRTSDAKGLGPRFQGAHRPTAACTRGRT

SEQ ID NO: 6716 - protein, 693 aa, Zea mays
SSRKEFEEMSEQYVAVTKKEKRRRACYRCGKRKWESKESCLVCDARYCGYCVLRMMGSMPEGRKCVNCIGQPIDESKRSKLGKNSRTLSRLLSPLEVRQILKAEKECQANQLRPEQLIVNGCPLRPEELTDLLSCSRPPQKLKPGKYWYDKESGLWGKEGEKPDRIISSNLNFTGKLQVNASNGNTQVYMNGREITKIELKVLKVANVQCPRDTHFWVYDDGRYEEEGQNNIKGKIWESALARFACALFSLPVPPGNSNGTRDEVPYTARAVPDYLDQKRIQKLLLLGPPGAGTSTIFKQAKYLYGTRFTQEELEGIKLMIQSNMFKYLGILLEGRERFEEEALSRLNYTISQGEETQHDENKANGSNSCIYSINARLKKFSDWLLDIIAMGDLDAFFPAATREYAPFVDEMWKDPAIQATFKRKEELHFLPDVAEHFLSRAVEVSSNEYEPSEKDVIFAEGVTQGNGLAFIEFTLDDRSPMSEPYIDNSEAHSQPLTKYQLIRVSAKGMNDGCKWVEMFEDVRMVIFCVALSDYDQLGPPVSGSSRPLVNKMMQSKELFEATIRQPCFCDTPFVLVLNKYDLFEEKINRAPLSSCEWFNDFCPVRTHHNNQSLAHQAYYYVAMKFKDLYSAQTNRKLFVWQARARERQTVDEAFKYIREVLKWEEEKDDNCYQEESFYSTTEMSSSPFIRAE

SEQ ID NO: 6717 - protein, 646 aa, Zea mays
RPGRDRRQLLALSRRIRLLGPFAEELREARRGSAEQEEQERALAPLADALEEALDLLQLGRDGSRIFLVLPTAPATVRFHESIAQLEQALCDFPYDKLDISDEAREQVELVHAQLKRAKERVDMPDDEFYNELCSLYNKSHDPSAELDILGRLSEKLHLTTIADLTQESLALHEMVASGGGNDPGEHIEKMSMLLKKIKDFVQTQNPETGPLVTAKPMGSNGKPRPVNVPDEFRCPISLELMKDPVIVATGQTYERALIEKWLASGHHTCPSTQQRMPNTTLTPNYVLRSLITQWCEANGIDPPKRPTQQPDRPTSSCSSSERASIDALLSKLCSADPEEQRSAAAELRLLAKRNANNRICIAEAGAIPLLLSLLSSSDLQTQEHAVTALLNLSIHEDNKASIILSGAVPGIVHVLKNGSMEARENAAATLFSLSVVDEYKVTIGGTGAIPALVVLLSEGRQRGKKDAAAALFNLCIYQGNKGRAIRAGLVPLVMGLVTNPTGALLDEAMAILSILSSHPEGKAAIGAAEPVPVLVEMIAGGSPRNRENAAAVMLHLSASVRQSAHLARAQECGIMAPLRELALNGTGRGKRKAVQLLERMSRFLVQQQEDAVDPRVQELEEIERQLAAFGPGVTEADVLQQLGAL

SEQ ID NO: 6718 - protein, 412 aa, Zea mays
MAWGALRSRVLPLPAPAATAAPHGLFLRFLLSTAVPHHGHHHRRRRLAPTAYAAAAAAAAEAPLPMTPRFGRATRQPGGAASVARVYADANAQRPKEYWDYESLDIQWGKQDGYEVLRKVGRGKYSEVFEGFRAGSDERCVIKILKPVKKKKIKREIKILQNLYGGPNIVKLLDIVRDDESKTPSLIFEHVNNTDFKVLYPALSDYDVRYYIFELLKALDYCHSRGIMHRDVKPHNVMIDHEKRQLRLIDWGLAEFYHPKMEYNARVASRCYKGPELLVDLLDYDYSLDLWSLGCMFAAMIFRVDPFFSGQDNYDQLVKIAEVLGTGDLYNYLEKYGLQLDPQLERLIGRHNRKPWPKFVNARNRHLATPEAIDLVDKLLRYDHQKRPTAKETMAHPYFNPVRSPESKTNSQ

SEQ ID NO: 6719 - protein, 540 aa, Zea mays
FDLRSILDDVISLFSSKSREKGIELAVYVSERVPELLLGDPGRFRQIITNLVGNSIKFTERGHIFVQVHLADHSNLATEPKVESVANGMNGHKDEKTAVATSVSLNTLSGFEAADSRNSWENFKLLLSYEKNEMPYESVSDKVTLVVSVEDTGIGIPLDAQAKVFTPFMQADSSTSRTYGGTGIGLSISKCLVELMGGQINFVSRPHVGSTFTFTAVLKRCDRSAIGDSKPVMLHPLPSSFKGLSALLVDRRPVRATVTKYHLQRLGIACDVVATIELALGVLSGRNGSSLTSMKQPCMLLIESDSWGFNIDVSLRSRLLEMKQNGHTHVLPKIILLAAAESGKLKEHYAVDSVITKPLKASALAACLFQTLGIKQSSNERSDNSGSLYGLLLGKNILVVDDNKVNLRVAAGTLKKFGAKVECVESGKDALALLQVPYKFHLCLMDIQMPEMDGFEATKQIRAMEAKANEQAVACDDSEIDGATRAARWRLPVLAMTADVIQATHEECTKCGMDGYVTKPFEEKQLFQALQKFLDPGMSC

SEQ ID NO: 6720 - protein, 323 aa, Zea mays
MPAGQPHAHEAAAAACVGSGANHSNHRVPAHSPPPLPAEVVPAYPPPESEDDETWVWTQIKAEARRDADAEPALASFLYATVLSHPSLPRSLSFHLANKLCSSTLLSTLLYDLFLATLTAHPSLRAAVVADLLAAHSRDPACVGFSHCLLNYKGFLAIQAHRVAHVLWAQQRRPLALALQSRVADVFAVDIHPAAVVGKGILLDHATGVVIGETAVVGDNVSILHHVTLGGTGKAVGDRHPKIGDGVLIGAGATILGNVKIGAGAKIGAGSVVLIDVPARSTAVGNPARLIGGKKAEGANDEDMPGESMDHTSFIRQWSDYTI

SEQ ID NO: 6721 - protein, 463 aa, Zea mays
MALTTASTVSSPSRIIRRFSSSQDSRPPSSLLHLAPRRGTGNSPRACSWHRLVVRRMGWAARALLGGLSDAGASESDEEEEHALRVGQREGEIDDAVELSATAVGPERWDVLGLGQAMVRATLVDFSGMVDDEFLDRLGIEKGTRKVINHEERGRVLRAMDGCSYKAAAGGSLSNSLVALARLGSSQSAGYPELNIVMGGSVGSDPLGSFYRAKLRRANVHFLSKPVKDGTTGTVIVLTTPDAQRTMLAYQGTSSTLSYDSDLASLVSKSNVLIVEGYLFELPHTIEAIKQACEDAHKNGAIIAVTASDVSCIKRCYNDFRDIVRNYADILFANANEARALCELPSTDSPMSATRYLSHSVPLVSVTDGMHGSYIGVKGEAIYIPPPQCVAVDTCGAGDAYASGILYGVLRGASDLKGIGLLASRVAAVVVGQQGTRLRVQDADRLAGSFEHHLDSLEFCSDV

SEQ ID NO: 6722 - protein, 178 aa, Zea mays
MPPPPPPPQQQQQQSGMTLCRLPTATLGLPLSLPCLLPRSRPRLCFAARHARAVAARASSSSPSPDSSFGSRMEESVKKTVADNPVVIYSKSWCSYCMEVKALFKRIGVQPHVIELDHLGAQGPQIQKVLERLTGQSTVPNVFIGGKHVGGCTDTVKLYRKGELASMLSGLDININNS

SEQ ID NO: 6723 - protein, 312 aa, Zea mays
MAAATAAAAALASPAGLSTSLARRGLVSFAPALRPGPDRSSRAVALLGVRTHVTAVDQAIVKGDTKLEGPVVVVTGASRGIGKATALALGKAGCKVLVNYARSSKEAEEVSKEIEASGGQAITFGGDVSKEADVESMIKVAVDTWGTIDVLVNNAGITRDTLLMRMKKSQWQDVIDLNLTGVFLCTQAATKVMMKKKKGRIINIASVVGLTGNAGQANYAAAKAGVIGFTKTVAREYASRNINANVIAPGFIASDMTAELGEELEKKILSTIPLGRYGRPEDVAGLVEFLALSPAASYITGQVLTIDGGMVM

SEQ ID NO: 6724 - protein, 371 aa, Zea mays
MNKDKAPMPGDGGPSDGLPPQSTRRVGAPPSSSTPPLECDISRMPDFPTRSTGHRRAHSEILGLPDDLDLSAPGGGEGPSLSDENDEELFSMFLDVDKLNSSCGASSEAEAESSSAAGGGGEGAELADAPRPRHQHSQSMDGSMSIKAEQLVGAPGMEGMSSAEAKKAVSAAKLAELALVDPKRAKRIWANRQSAARSKERKMQYIGELELKVQTLQTEATTLSAQLALLQRDTTGLTTENSELKIRLQTMEQQVHLQDALNDTLKTEVQRLKVATGQVGNGGGGMMLNFGAMPRLVGGNQQMFHSSQAMQSVLATHQLQQLQLHSQPQQQQLHSLQLQQVARDLKMKGHLGGQGQWGDGKSGSGSRSSGS

SEQ ID NO: 6725 - protein, 239 aa, Zea mays
  unsure (1)..(239): unsure at all Xaa locations
MEEREKLVCLAKLAEQAERXYDDMVECMKNLARMEVDMSADGRDLVSVGFKNTIGAKRASXRIICSHEQKVAADRQTGCEDRXKIAMKYSQALILIIFGSPVLMVASYCLIGGKVSANNKXAGLRTVTGLKAASDRSFMAYQHAMVVASSELSPAHQIRLGLALNLSVFFYEIMNSHERACQVAKQAFDEALTEINSGEGVYKDSTIMMQLLKDNLALWTSELTGGEASKGSDDVDMEG

SEQ ID NO: 6726 - protein, 180 aa, Zea mays; identical to SEQ ID NO: 1072

SEQ ID NO: 6727 - protein, 181 aa, Zea mays
MSTTEDERSGAAAEAGGGEEERRERSVGLMAGLVDRAKGFVVEKVAQIPKPEAALDRVSFQSISREGVELHSHVDVSNPYSHRIPICEITYTFKSAGKVIASGMMPDPGWIAASGSTKLELPVKVPYDFILTLMKDLGGDWDIDYLLEVGLTIDLPVIGAFTIPLTTEGEIKLPTFRDLLF

SEQ ID NO: 6728 - protein, 380 aa, Zea mays
MELAGAASPHPPPESHVAPPRPPPQPPEEDVCEDRGNMSVTGEKPCTHRESDVGQTNSCSLNNSSECENHTPSNDEISEPESNLEMAKTDQGGDVPSGEKVLKRPDKILPCPRCNSMDTKFCYYNNYNIKQPRHFCKSCQRYWTAGGSMRNIPVGAGRRKSKSSSASCRSVLIPVPGSSSVANPGGEASLFPLSVKANQAAVSFGPDSPLCTSMASVLKIGGGGEQVKSCSPASAAAAAQPRNGETQTQTCAPSSAATTPSDGPGNGSQKGAESAHQNQNQNGIIGHSNGVTPVHPIPFFPGPPFVYPWSPAWNGIPAMAAAVCAAPATAEAEAAISSEHGTASSTVQWNVPPAIVPVLAARFCGPIPVPVIPPPSVWFS

SEQ ID NO: 6729 - protein, 253 aa, Zea mays
MKIQCDACEGAAATVVCCADEAALCARCDVEIHAANKLASKHQRLPLEALSASLPRCDVCQEKAAFIFCVEDRALFCRDCDEPIHVPGTLSGNHQRYLATGIRVGFASASSACSDACDAHDDSDHHAPPKAAVSSAAQQVPSPPQFLPQGWAVDELLQFSDCESSDKLHKESPLGFKELEWFTDIDLFHEQTPKAGRRLAEVPELSGTQAANDAAYYRPAKATATAGAGVRQSKKARTEVTDDEDHLIVPDLG

SEQ ID NO: 6730 - protein, 273 aa, Zea mays
MGRGKVQLKRIENKINRQVTFSKRRNGLLKKAHEISVLCDAEVAVIVFSPKGKLYEYATDSRMDKILERYERYSYAEKALISAESESEGNWCHEYRKLKAKIETIQKCHKHLMGEDLESLNPKELQQLEQQLDSSLKHIRSRKSHLMAESISELQKKERSLQEENKALQKELAERQKAVASRQQQQQQQVQWDQQTHAQAQTSSSSSSFMMRQDQQGLPPPHNICFPPLTMGDRGEELAAAAAAQQQQPLPGQAQPQLRIAGLPPWMLSHLNA

SEQ ID NO: 6731 - protein, 472 aa, Zea mays
MAALKASFRGELSAASFLDSSRGPLVQHKVDFTFQRKGKRAISLRRTCCSMQQAPPPAWPGRAVAEPGRRSWDGPKPISIVGSTGSIGTQTLDIVAENPDKFRVVALAAGSNVTLLADQVKTFKPKLVAVRNESLVDELKEALADCEEKPEIIPGEQGVIEVARHPDAVTVVTGIVGCAGLKPTVAAIEAGKDIALANKETLIAGGPFVLPLAHKHKVKILPADSEHSAIFQCIQGLSEGALRRIILTASGGAFRDWPVDRLKDVKVADALKHPNWNMGRKITVDSATLFNKGLEVIEAHYLFGAEYDDIEIVIHPQSIIHSMVETQDSSVLAQLGWPDMRLPILYTLSWPDRIYCSEVTWPRLDLCKLGSLTFRAPDNVKYPSMDLAYAAGRAGGTMTGVLSAANEKAVELFIDEKISYLDIFKVVELTCNAHRNELVTSPSLEEIVHYDLWARRYAASLQPSSGLSPVPA

SEQ ID NO: 6732 - protein, 526 aa, Zea mays
MTWNRSAADGGGSSAGTTAGDDTGLARLRELGYKQELKRDLSVLSNFAFSFSIISVLTGITTLYNTGLNFGGPATMTFGWFVAGAFTMAVGASMAEICSSFPTSGGLYYWSARLSGKRWAPFASWITGWFNVVGQWAVTTSVDYSLAQLIQVIILLATGGKNGGGYLASKYMVIGFHAAILLSHAVINSLPITFLSFFGQFAAAWNMLGVFVLMVAVPTVATERASAEFVFTHFNTDNGAGIRSNLYIFVLGLLMSQYTLTGYDASAHMTEETKNADKNGPIGIISAIGISILVGWGYILGVTFAVKDIPYLLSPDNDAGGYAIAEVFYLAFKSRYGSGAGGIVCLGVVAVAVYFCGMSSVTSNSRMAYAFSRDGAMPFSSVWHKVNKQEVPINAVWLSALVALCMALPVYSLGSLVAFQAMVSIATIGLYISYALPILFRVTLARKYFVPGPFNLGRYGVLVGWVAVLWVATITVLFSLPVTYPVTKDTLNYTPVAVGGLLFLVLASWLLSARHWFKGPVTNLDG

SEQ ID NO: 6733 - protein, 259 aa, Zea mays
MAAAAAAAGTREEMVYMAKLAEQAERYEEMVEFMEKVAAAAELTVEERNLLSVAYKNVIGARRASWRIVSSIEHKEETRGAAGHAAAARGYRARVEAELSGICAGILRLLDERLVPAAAAVDARVFYLKMKGDYHRYLAEFKTGAERKDAADSTLAAYQAAQDIAVKELPPTHPIRLGLALNFSVFYYEILSSPDRACSLAKQAFDEAISELDSLGEESYKDSTLIMQLLRDNLTLWTSDMQEDGGDEMRDANKPDEEQ

SEQ ID NO: 6734 - protein, 384 aa, Zea mays
MAAADASSLPPSAITCRAAVAWGPGQPLVMEEVEVAPPGPMEIRVKVVSTSVCRSDVTAWQSKAQLDLFPRVFGHEASGVVESVGEGVTEFQVGDHVLTVFIGECKSCKHCVSGKSNMCQKLGLERKGVMHSDQKTRFSVKGKPVYHYCAVSSFSEYTVVHSGCAVKVGLTVPMDRVCLLSCGVSAGLGAVWNVANVSKGSSVAIFGLGTVGLSVAQGAKLRGASKIIGVDTNPEKQEKGKSFGVTDFINPDELSEPVQQVIKRITDGGVDYSFECVGDSGVVSTALQSCSDGWGVTVTLGLPKGKLEVSTHYAFLLSGRTLKGSMFGGWKPKSDLPSLVDKYAAKEIQVDGLVTHDIPFNEINKALELMLENKCLRCVIHMPR

SEQ ID NO: 6735 - protein, 351 aa, Zea mays
MMMLIDCSRCRTPLQLPHGAPCIRCAICGAITHVAPAPPVEPNRGAVQPPPGWGPPPPPVHGRKRAVVCGISYRHSRYELKGCINDVKCMRHLLMTRFNFPDDSIIMLNEEQTDPYKIPTKHNIGMAMYWLVQGCQPGDSLVFHYSGHGAQQRNYNGDEVDGFDETLCPLDFETQGMIVDDDINTALVRPLPRGVKLHAFIDACHSGTALDLPYLCRMNRSGQYVWEDHRPPSGVWKGTSGGEAISFSGCDDDQTSADTSALSKVTSTGAMTFGFIQAIERGQGTTYGSILNSMRSTIRNTDDSAGVGGGAVTSLITMLLTGGSLSAGGLRQEPQLTACEPFDVYAKPFSL

SEQ ID NO: 6736 - protein, 220 aa, Zea mays; identical to SEQ ID NO: 6419

SEQ ID NO: 6737 - protein, 508 aa, Zea mays
MAGDGMEVSASGGGGGNKQPQISLLGLFLACMVAGGVQYGWALQLSLLTPYVQTLGIPHALTSVMWLCGPIAGLLVQPCVGLYSDKCTSKLGRRRPFIFTGCIIICISVIVIGFSSDIGYALGDTTEDCNVYTGKRLHAALFFVMGFWLLDFSNNTVQGPARALMADLAGSHGPSTANAIFVSWMAIGNILGYSSGSTDKWHTWFPFLQTRACCEACANLKAAFLVSVVFLGLSTVVTMIFAREVPLDPAAAAKQDEAGESSGPFAVFKGMKNMPPGMPQVLIVTGLTWLSWFPFILFDTDWMGREMYHGRPDGSPEEVARFQEGVRQGAFGLLLNSVVLGASSFLIEPMCRKLTAKVVWVMSSFLVCVAMALVTVLSSWSLGDIGGNVQDAAAVDKGLKTTALAIFVFLGFPFAVLCSVPFAVTAQLAAAKGGGQGLCTGVLNISIVVPQMVIAIGSGPWDELFGKGNIPAFGLAAVFAFTAAVAGIIMLPKQPKTSFRSVSMGGGH

SEQ ID NO: 6738 - protein, 339 aa, Zea mays
MVVTAAGSAEEAVRRWVDAAGGRLVLDGGLATELEANGADLNDPLWSAKCLLSSPHLIRKVHMDYLEAGANIIITASYQATIQGFESKGFSKEQSENLLTKSVEIALEAREMFLKEHLEKSTPIQHPVLVAASLGSYGAYLADGSEYSGDYGEAGTKEFLKDFHRRRLQVLAEAGPDLIAFETIPNKLEAEAYVELLEECNINIPAWFSFNSKDGVHIVSGDSLIECTTIADKCAKVGAVGINCTPPRFIHGLILSIRKVTDKPILIYPNSGERYDGEKKEWVESTGVSDGDFVSYVNEWCKDGAVLIGGCCRTTPNTIRAIHRTLNKSPNKQQLPAVE

SEQ ID NO: 6739 - protein, 535 aa, Zea mays
  unsure (1)..(535): unsure at all Xaa locations
MASSPDLFPNVTFSDVSEAAAGPAAEGATAAFGLGAATGAPRLSLVKAEAEPTVEIDLADAQVFKLGPTEWLCVCDESEAKDGVEEKSFSRAIKVVLRTEAESKAFSLAFQRWQHQVISGKAGERLENXGSIIASKNKFDTKIEASSAKMYFHYYGQLLHQQNMLQDFXVRTGTYYAAVMENRSDFEGRVVVDVGAGSGILSLFAAQAGARHVYAVEASEMAENAQRLMSGNPSLGHRITVIKGKVEEVVLPEKADILISEPMGTLLVNERMLESYVIARDRLLAPDGKMFPTTGRIHMAPFSDEYLYVEMANKALFWQQHNFFGVDLTPLHGSAFQGYFSQPVVDAFDPRLLISPPTYHTLDFTSMKEEELYEINIPLSFVASVGTRVHGLACWFDVLFNGSTVQRWLTTAPGSPTTHWYQLRCVLSQPLYVMAGQEITGHLRLVAHSAQSYTIYLTMSAKMWGVGAEQGGILQTSTGKLELKEPYYRLSQPQSCTLPQDQQQQQLPSLQAQGSEQQMQEGLSPAFTIDQDCLN

SEQ ID NO: 6740 - protein, 525 aa, Zea mays
  unsure (1)..(525): unsure at all Xaa locations
MELAGAASPHPPPESHVAPPRPPPQXTPEEDFCEDRGDLSVTGEKPCTHRESDVGQTNSCSLNNSSECENHTPSNDEISEPESNLEMAKTDQGGDVPSGEKVLKKPDKILPCPRCNSMDTKFCYYNNYNIKQPRHFCKSCQRYWTXAGGSMRNIPVGAGRRKSKSSSASCRSVLIPVPGSSSVANPXAGEASLFPLSVKANQAAVSFGPDSPLCTSMASVLKIGGGGEQVKSCSPASAAAAAQPRNGETQTQTCAPSSAATTPSDGPGNGLQKGAESAHQNQNQNQNGIIGHSNGVTPVHPIPFFPGPPFVYPWSPAWNGIPAMGXAVCAAPATAEAEAAISSEHGTASSTVQWNVPPAIVPVLPPGFCGPIPVPVIPPPSVWPLITPWPNAAWSAPWLGPSASVPPGSSRSSGSGSSTCSDSGCGSGSPVLGKHSRESRPQGDEKAERRCLWIPKTLRIDDPVEAAKSSIWTTLGIEPGDRGMFRPFQSKHGRQQELQASGAARALQANPAXALSRSQSFQETT

SEQ ID NO: 6741 - protein, 520 aa, Zea mays
MRATIPALSLLVTPRLPSLAVPLAGGRLRVGGRPRTRLRVAAPTSVPGEAAEQAEPSTSAPESGEKFSWRDHWYPVSLVEDLDPSRPTPFQLLNRDLVIWKEPKSGEWVALDDRCPHRLAPLSEGRIDETGCLQCSYHGWSFDGSGACTKIPQAMPEGPEARAVRSPKACAIKFPTLVSQGLLFVWPDENGWEKAAATKPPMLPKEFEDPAFSTVTIQRDLFYGYDTLMENVSDPSHIEFAHHKVTGRRDRARPLTFRMESSGAWGYSGANSGNPRITATFEAPCYALNKIEIDTKLPIFGDQKWVIWICSFNIPMAPGKTRSIVCSARNFFQFTMPGKAWWQLVPRWYEHWTSNLVYDGDMIVLQGQEKIFLAATKESSTDINQQYTKITFTPTQADRFVLAFRTWLRKFGNSQPEWFGNPTQEALPSTVLSKREMLDRYEQHTLKCSSCKGAYNAFQNLQKVFMGATVVCCAAAGIPPDVQLRLLIGAAALVSAAVAYAFHELQKNFVFVDYVHADID

SEQ ID NO: 6742 - protein, 607 aa, Zea mays
MATMARSGAVKLCCCTSALLLLCCFLLPGALAEERFYEFVVRGTPVKRLCKTQEIITVNGQFPGPTIEVYSGDTLAVRAVNLARYNVTLHWHGLRQLRNGWADGPEFVTQCPIRPGGSYTYRFTVEGQEGTLWWHAHSSWLRATVHGALIIHPRRGVPYPFPKPHTEAPVILAEWWRRDPIAVLRQSMITGAPPNVSDALLINGQPGDLLPCSSQETSIIPVVAGETSLLRIINAAMNTELFVSLAGHRMTVVAADAMYTKPFETDVVLLGPGQTTDVLVTAHAAPGRYYLAARAYASAQGVPFDNTTATAIFQYKNAPGCPTTSGAGAGAGAGAGTFSGPVGRSSRSSGYLGRAGPQPMLPFLPAFNDTNTATAFSNRLRSPVPVKVPGPVTQEVFTTVGFGLFNCRPGPFCQGPNNTRFGASMNNVSFQLPDTVSLLQAHYHHIPGVFTDDFPALPPVFFDFTSQNVPRALWQPVKGTRLYRVRYGAVVQIVFQDTGIFAAEEHPMHIHGYHFYVLATGFGNYDPRRDAARFNLVDPPSRNTIGVPVGGWAVVRFVADNPGVWLVHCHIDAHLTGGLAMALLVEDGESELEATVAPPLDLPICVL

SEQ ID NO: 6743 - protein, 203 aa, Zea mays
  unsure (1)..(203): unsure at all Xaa locations
MASHQDKASYQAGETKARTEEKTGQAVGATKDTAXXAKDRAADAAGHAAGKGQDAKEATKQKASDTGSYLGKKTDEAKHKAGEXTEATXQKAGETTEATKQKAGETTEAARQKAADAMEAAKQKAAEAGQYAKDTAVSGKDKSGGVIQQATEQVKSAAAGAKDAVMSTLGMGGDDKQGDANTNTNTNTNTNTNKDTXTITRDH

SEQ ID NO: 6744 - protein, 172 aa, Zea mays
MATATAVGGPDRVETAASSAAAVLAVAVASQRLLGLLALAVQTVNVGAEIYNKDQRAIYKLLSGRIKSENVPENKDGSDDDDDDDDDEDNDDEGGDDDDDAEEEFSGEEDGGDDDDEDDDPEANGEGGSDNDNDDDEDGDDDGDEDDEGDEDDEDEDDDEDDEDQPPSKKKK

SEQ ID NO: 6745 - protein, 460 aa, Zea mays
VFSEVLFFIYLLPPIIFNAGFQVKKKQFFRNFMTITLFGAVGTMISFFTISLGAIAIFSRMNIGTLDVGDFLAIGVIFFATDSVCGLQGLHQDETPFLYSLVFGEGVVNDATSVVLFNALQNFDLNHIDVAVVLNFLGNFCYLFVSSTLLGVFTGLLSAYIIKKLYIGRHSTDREVALMMLMAYLSYMLAELLDLSGILTVFFCGIVMSHYTWHNVTESSRVTTKHAFATLSFIAETFLFLYVGMDALDIEKWEFASDSPGKSIGISSILLGLVLVGRAAFVFPLSFLSNLTKKSPLEKITFRQQIVIWWAGLMRGAVSIALAYNKFTRSGHTELHGNAIMITSTITVVLFSTMVFGMMTKPLIRLLLPACSNTATSEPSSPKSLHSPLLTSMQGSDIETGSAQIVRPSSLRMLLSKPTHTVHYYWRKFDDALMRPMFGGRGFVPFSPGSPTEQSVHDGR

SEQ ID NO: 6746 - protein, 287 aa, Zea mays
MASRQQHPTSYHAGETKARAEEKTGRVQRVNESLLSKLREGKLTVSLDPIFYPSSAMASRQQHPTSYHAGETKARAEEKTGQVMGATQEKGREAKHKASDASDRAMGMGHDAMEATREKARAAADRTMGMGHDAGEAAKDRAYRAKDAASGAAGRARDTASDAAGAAGDRARDGAQQTGSYVAQTAEAARQKAAGAALYAKDTVVAGKDKTGALLQQAGEKVMSTAVGAKDTVVSTAVGAKDTVVSTAVGAKDAMMNSLGMAGEDKDGTTTTDAGKDTSTRKPGRDY

SEQ ID NO: 6747 - protein, 191 aa, Zea mays
  unsure (1)..(191): unsure at all Xaa locations
MVVDTVSASTSIIAPHLFDHRSRGAGASHHHLRRTFHVVACRPLPTAFAGRRLVARVTRQPSSRLADWPVRALAMGVTKEVRASPRREYRGIPXMVATWGDVGVTSPTPSWPPRNRADDPKLHNPLLRLERMXGCGWLGVIFEWEGVIVEDDAELERQAWLTLAQXEEGKSPPPAFVLRRVEGMKNEQAEF

SEQ ID NO: 6748 - protein, 230 aa, Zea mays; identical to SEQ ID NO: 5906

SEQ ID NO: 6749 - protein, 211 aa, Zea mays
MEALVGRYWGLGGRRCGACGGSPAAAHCRTCPGGAYLCAGCDAGHARAGHERVWVCEVCECAPAAVTCRADAAALCAACDADIHDANPLARRHERVPVQPIGAAADPAAEKAALLFGLAAEGKDGGDDDAAKVVVDASKLDLLFADDVVDPFLAQDFARFPHADSVVPNDGSSCGAAVDFDFGGGVAVAAKQPSYSSYTAASLGHSVSVPF

SEQ ID NO: 6750 - protein, 231 aa, Zea mays
PTRPVAAHCRTCPGGAYLCGGCDAGHARAGHERVWVCEVCECAPAAVTCRADAAALCAACDADIHDANPLARRHERVPVQPIGAAADPAAEKAALLFGLAAEGKDGGDAAKVVVDASKLDLLFADDVVDPFLAQDFARFPHADSVVPNDGSNCGAAVDFDFGGGVAVAAKQPSYSSYTAASLGHSGSSSEVGLVPDVMCGRGGSVTGGVIELDFAQSKAAYLPYAATPTHS

SEQ ID NO: 6751 - protein, 372 aa, Zea mays
MDSSGGGGGAQIKGMATHGGRYVLYNVYGNLFEVSSKYAPPIRPIGRGAYGIVCAAVNSQSGEEVAIKKVGNAFDNHIDAKRTLREIKLLRHMDHENILALKDVIRPPTRENFNDVYIVTELMDTDLHQIVRSNQPLTDDHCQYFLYQLLRGLKYVHSANILHRDLKPSNLFLNANCDLKIADFGLARTTSETDLMTEYVVTRWYRAPELLLNCSQYTAAIDVWSVGCILGEIVTRQPLFPGRDYIQQLKLITELIGSPDDASLGFLRSDNAKRYMKQLPQFPRQDFRLRFRNMSPGAVDLLERMLVFDPSRRITVDEALHHPYLASLHEINDEPTCPAPFSFDFEQPSFTEAHIKELIWRESLAFNPEPPY

SEQ ID NO: 6752 - protein, 382 aa, Zea mays
QLVIETRSAAAATMAPEKLKLLVGVLALQFLLAGFHIVSRAALNMGISEIVFMVYRNLISLALLAPFAYFLEKKDRPPLTFSLLVEFFLLALCGITANQGFYLLGLYHLSPTYASAIQNTVPAITFAMAAVLRLEQVDLSRRHGLAKVVGTVVSIGGATVITLYKGLPLLHHSDDLHVKSSPVTLSSSSGSPILNWTLGCVFILGHCLSWSGWMVLQVPVLKRYPARLSVLSLTCIFGLLQFLAIAAFTEEDLSRWKVRSGGELFTILYAGLVASGVAFALQIWCIDRGGPLFTAVFQPVQTVAVAVMASAILGDQLYTGGIIGAVLIVIGLYFVLWGKSAEKKGARNLLQDQLAQGADVTRHLLGGEASAKDEEAAPAMLA

SEQ ID NO: 6753 - protein, 685 aa, Zea mays
SRGRGAAARKGRTCCRRCGKSKWESKESCIVCDARYCGHCLLRAMGSMPEGRKCVTCIGQPIDEAKRSRLGKGSRILSRLLSPLEVRQILKVEKECQANQLRPEQLLVNGFPLDDEEMTDLLSCQRPPGNLKPGRYWYDKESGLWGKEGEKPDSIISTNLNFNGKLQPDASNGTAQVFINGREITKIELRILKIAKVQCPRDTHFWVYHDGGYEEEGQNNIKGKIWESPLTRFACALVSLPVPPTNFDATKDEAPYSSKTVPDYLDHKRIQKLLILGSPGAGTSTIFKQAKLLYGNRFTDEELENIKLMIQSNMFKYLGILLEGRERFEEEALAVPNHPSSVGDDPQQDESKSSSSNSCIYSINAKLKKFSDWLLDIIATGDLDTFFPAATREYAPVVDELWKDPAIQATYKRKDELHFLPDAAEYFLSRAVEVSSNEYEPSEKDVIYAEGVTQGNGLAFIDFTLDDRSPMSESFGDNHDAYPQQPVNKYQLIRVSAKGMNEGCKWVEMFEDVSMVIFSVALSDYDQLGAPASGSSRTLVNKMIQSRDLFEATIRQPCFRDTPFLLLLNKYDAFEEKIGRSPLSSCEWFGDFCPLRTHHNSQSLAQQAFYYVAIKFKDLYAASTGRKLFVWQTRARDRPTVDEAFRYVREVLRWEDERGVAGYCPDESFYSTTELSSSRLIAAAQ

SEQ ID NO: 6754 - protein, 401 aa, Zea mays
  unsure (1)..(401): unsure at all Xaa locations
MSFRSLIQDMKDEFGSISRHXWRSRSHRSAGNAARAVAAGPSEAMDQSCWSQLPPELLREVLVRIEASESWWPARKDVVSGAGVCRTWRGIMKEAVRVPEVSGKLTFPISLKQPGPRDGTLKCFIRRNRTTQTYYLYIGLTEALADDGKFLLAARKCRKPTCTDYLISLDKVDMSKGSSTYIGKLRSNFLGTKFTVYDAHPPYDGAAVSKSRSARVVGLKQVSPRVPAGNYPVSHISYELNVLGSRGPRRMNCVMDSIPASAVKEGGKTPTQTEFPLSSLDSFPSFPFFRSKSARIDSSTSQSSSQREDRLVLKNKSPRWHEQLQCWCLNFRGRVTVASVKNFQLVASEDNGPESQESDKVILQFGKIGKDLFTMDYGYPISAFQAFAICLSSFDTKIACE

SEQ ID NO: 6755 - protein, 678 aa, Zea mays
  unsure (1)..(678): unsure at all Xaa locations
GKLTEEAEEILELLRSTWRTLGITETVHDTCYAWVLFRQFVLTGEQGLLKVVIDHLRKIPLKEQRGPQERLHLKSLRSSVDAEGSYQDFTFFQSFLSPIQKWTDKKLNDYHLHFSEGSSLMADVVTVAMLTRRILGEENDKVAESPDTDQIDRYITSSVKNTFLKMAHSVEFKADTTNEHVLASLAEETKKLLKKDTAIFTPVLTKWHPQAAVVSASLIHKLYGNKLRPFLEHAEHLTEDVVSVFPAADALEQYIMSVMASVTGDDGLDSLCRHKLVPYQIESKSGTLVLRWVNGQLERIETWVKRAADQEVWDPISPQQRHGNSIVEVYRIIEETADQFFAFKVPMRDGELNSLCRGLDKAFQVYTQLRQXPAVYKEDLAPPIPVLTRYKKELGIKAFVKKEVQEVRTVDERKASEITQLTMPKLCVRLNSLYYGISQLSKLEDSINERWARKKSENTNIRRKSEKSKSAVPNQKNQFDGSRKEINTAIDRLCEFTGTKVIFWDLQQPFVENLYRNGVAQARLDTITEVLDLVLNQLCDVIVEQLRDRVVTGLLQACLDGFLRVILDGGSTRVFSPNDAALLEEDLETLKEFFVSGGDGLPRGTVENLVSRVRPVINLIKQETRVLIDDLREVTQGGKSKFGADSKTLLRVLCHRNDSEASHYVKKQFKIPSSAPSA

SEQ ID NO: 6756 - protein, 432 aa, Zea mays
MGEGRAGDGLIKLFGKTIPVPETAAVGEAAKDIQQSGGSGSGTTDPKGQENNVQDSTGSPPQQEVADTEDSSADKQQGEAGNPKEKLKKPDKILPCPRCNSMDTKFCYYNNYNINQPRHFCKNCQRYWTAGGAMRNVPVGAGRRKSKSASATSHFLQRVRAGLPVDPLVCAAAKTNGTVLSFGSAMSSLDLTEQMKQLKEKLVPIAGDERSVGSRTQGPSAKAEDPDRKENVTADKSARVVQHPCMTNGVAMWPFSCAPPVPASACYGPGSIAIPFYPAAAAAAAYWGCMVPGAWSGAWPPHSGQSETGSSITSASPAASTKSNICFTPGKHPRDRDEEGGAKGNGKVWVPKTIRIDDVDEVARSSILSLIGIGGDKAGKDGGRGCKLARVFEQNEEAARTATPHSAAINGLPFLQGNPAALSRSLTFQEGS

SEQ ID NO: 6757 - protein, 901 aa, Zea mays
MDHVPALVLAGCCFLALLPGWACGLGSMSSIAVSYGEDGPVFCGLNSDGSHLVACFGADASVLYGAPPNIPFLGLTAGDGFVCGLLLDTRQPYCWGSNSYVKSGVPQPMVEGARYSELSAGDNHLCALRAAQDGGRGSSAATSLIDCWGYNMTATHAVDEAVSTVSAGSVFNCGLFARNRTVFCWGDETVSGVVGLAPRDLHFQSIGAGGYHVCGVLENAQVFCWGRSLEMQQVVPSSAIGDGDVNIVPMDAMSTVVGGRFHACGIRSLDHQVACWGFTLHNSTSPPKGLKMYALVAGDYFTCGVPAETSLMPRCWGNSGPLALPMAVPPGICVPTACSHGYYEYVNHGEVGSIKVCKPANSRLCLPCSTGCPEGLYESSPCNATADRVCQFDCLKCVTDECLSFCLSQKRTKSRKLMAFQMRIFVAEIVFAVVLVLSVSVTTCLYVRHKLRHCQCSNRELRLAKSTAYSFRKDNMKIQPDMEDLKIRRAQEFSYEELEQATGGFSEDSQVGKGSFSCVFKGILRDGTVVAVKRAIKASDVKKSSKEFHNELDLLSRLNHAHLLNLLGYCEDGSERLLVYEFMAHGSLYQHLHGKDPNLKKRLNWARRVTIAVQAARGIEYLHGYACPPVIHRDIKSSNILIDEDHNARVADFGLSILGPADSGTPLSELPAGTLGYLDPEYYRLHYLTTKSDVYSFGVVLLEILSGRKAIDMQFEEGNIVEWAVPLIKAGDIFAILDPVLSPPSDLEALKKIASVACKCVRMRGKDRPSMDKVTTALEHALALLMGSPCIEQPILPTEVVLGSSRMHKVSQMSSNHSCSENELADGEDQGIGYRAPSWITFPSVTSSQRRKSSASEADIVGRRATDGRNVGSSIGDGLRSLEEEIAPASPQENLYLQHNF

SEQ ID NO: 6758 - protein, 324 aa, Zea mays
DAWADAWADAWAKISNVKGMDVELWTHDGLPSAQLLKLMRDVVAGLVHLHDLQIILTDFIPQNVLISAGGPIRAKLSDMGISKHLQDDMTSVSHHGTGFGSSGWRAPEQLRHGRQTRAMDLFSLGCLIFYCITKGKHPFGEYYERDVNIANNRFDLFMVDYIPEAVHLISHLLQPNPEARPTAVYVMHHPLFWSPELRLSFLRDTSDRIEKTSETDLINTLESIGSLAFGGKWGEKLDAALVTDMGRYRKYNFESIRDLLRYIRNKSGHYRELSDDLKGILGSLPEGFDRYFASRFPKLLIEVYKVLWVHCKDEEAFSKYFKGS

SEQ ID NO: 6759 - protein, 95 aa, Zea mays
MMRRCSIAALAIFLLLLVCSSSSSNCAAAARLLPGAGHLRPLRHAAVGASGDELSAGSETMEACEEGNGKDECVQRRLLLDAHLDYIYTQHKGKP

SEQ ID NO: 6760 - protein, 112 aa, Zea mays
MMRRCSIAALAIFLLLLVCSSSSSNCAAAARLLPGAGHLRPLRHAAVGASGDELSAGSETMEACEEGNGKDECVQRQLLLDAHLDYIYTRHFDSASATAPLRKKLVCGGNIL

SEQ ID NO: 6761 - protein, 357 aa, Zea mays
  unsure (1)..(357): unsure at all Xaa locations
MGVAGEKFQLGTVGALSLSVVSSVSIVICNKALMSSLGFNFATTLTSWHLLVTFCSLHVALCMKLFEHKPFDARTVMGFGVLNGISIGLLNLSLGFNSVGFYQMTKXLAIIPCTVILETLFFRKKFSRNIKLSLSVLLLGVGVATVTDLQLNVMGSVLSLLAIITTCIAQIMTNTIQKKFKVSSTQLLYQSCPYQALTLFLVGPFLDGFLTNQNVFAFDYTTQVLFFIVLSCLISVSVNFSTFLVIGKTSPVTYQVLGHLKTCLVLTFGYVLLHDPFSWRNILGILIAVIGMVLYSYFCTRETQQKPAEASPQAVQAKEGESNPLISDSLSAAENGGSATDDEPLKVPMWSSKYSKA

SEQ ID NO: 6762 - protein, 161 aa, Zea mays
MKNVAKCDTWCELQNPVNHRVFERKLRPKPLGRGHACLGVTQFPVFFFLAAAEFAAGTRSPSAFVQNAIYSNRITIFSKTYCPYSMRAKHIFRDLKEDPYVVELDTRVDGRDIQSVLLDLVGRRTVPQVFVNGQHIGGSDDTVNALSNGQLQKLLGKSQSQ

SEQ ID NO: 6763 - protein, 587 aa, Zea mays
MAGAERAEAVALEQGLLDPEESNQLVYTGDGSVDFSGNPVVKERTGRWKACPFILGNECCERLAYYGISTNLVTYLTKKLHAGNASAASSVTTWSGTCYLTPLIGAILADAYWGRYWTIATFSTVYFIGMTLLTLSASVPMLMPPSCEGSFCPAASPFQYTVFFLGLYLIALGTGGIKPCVSSFGADQFDDTDPAERIQKGSFFNWFYFSINIGALISSSFLVWVQDNVGWGLGFGIPTVFMGLAIISFFSGTSLYRFQKPGGSPITRVCQVIVASLRKWNVPVPEDSSLLYELPNGVSTIEGSRQIEHTDELRCLDKAATVTEVDVKTADFNNPWRICTVTQVEELKILVRMFPVWATTIVFSAVYAQMSTMFVEQGMVLDPSLGSFKIPPASLSTFDTLSVIICVPMYDYIVVPIARRFTGNERGFTELQRMGIGLVISIMAMSVAAVLEIKRLAVAREAHLVDQNVPVPLSIFWQIPQYFLIGLAEIFTFIGALEFFYDQSPDAMRSLCSALNLLTTAFGNYLSTFILTMVAYFTTRGGNPGWIPDNLNEGHLDYFFLLIAGISFLNLIVYVLCAGKYKSKKAA

SEQ ID NO: 6764 - protein, 268 aa, Zea mays
MADTGDVAAAAEASARPAGSSSTQPLAGRVAIVTGASRGIGRAIATHLSSLGASLVLGYAARADEAGALAASLPRAVAVRADVSDEAGARSLFDAADEAFGGAHILVASAGVLDDTYPAVAGTATEAFDRVLAVNLRGAFLCLREAANRLRRGGGGRIVAVTSSVVGSLPPRFGAYTASKAAVEALVRTMAKELGGTRVTANCVAPGATATDMFFKGKSEAMVRHAVETNPMQRLGEPGDIAPVVGFLCTDAAEWVNGQVIRANGGYV

SEQ ID NO: 6765 - protein, 392 aa, Zea mays; identical to SEQ ID NO: 6022

SEQ ID NO: 6766 - protein, 394 aa, Zea mays
MADSGEGRRVCGMPEKAQLHVAMLLLQFGYAGFHVVSRLALNMGISKLVFPVYRNIIALCLLVPFAYFLEKKDRPQLTLNFVVQFFLLALCGITANQGFYLLGLDNTSPTFASAIQNSVPAITFAMAAALRIEKVRLDRRDGVAKVAGTLACVAGASVITLYKGPTIFGPSGSGGGGGGLELAAVGGDKNWTLGCVYLIGHCLSWSGWLVLQAPVLKKYPARLSVTSYTCFFGVIQFLVIAAFMERDAEAWKFHSGSELFTILYAGFIASGVAFAVQIWCIDRGGPVFVAVYQPVQTLVVAIMASLTLGEKFYLGGIIGAVLIVAGLYLVLWGKSEERARVARDAVSGGDREGLLVAAAAGGGGGGIVRSAGNKAASAATQPLLLPSSTPTDNV

SEQ ID NO: 6767 - protein, 393 aa, Zea mays; identical to SEQ ID NO: 917

SEQ ID NO: 6768 - protein, 414 aa, Zea mays
  unsure (1)..(414): unsure at all Xaa locations
MAAAATTSSSSHLLLLSRQQAASLRCRLSFLGQPRRPGRVTAQAPAAKDVRCMAAVDTTAASTAAAETSPKSSSYEIVTLTTWLLQQERTGAIDNEMTIVLASISTACKQIAALVQRAPISNLTGVQGAVNVQGEDQKKLDVVSNEVFSNCLKSSGRTGVIASEEEDVPVAVEQSYSGNYIVVFDPLDGSSNIDAAVSTGSIFGIYNPNDECLADXDDNDTLDSVEQRCIVNVCQPGSNLLAAGYCMYSSSVIFVLTVGTGVYVFTLDPMYGEFLLTQEKVHIPKAGKIYAFNEGNYALWDDXKLKLYMDSLKEPGDSGKPYSARYIGSLVGDFHRTLLYGGIYGYPRDKKSKNGKLRLLYECAPMSFIVEQAGGKGSDGHQRILDITPTEIHQRVPLYIGSVEEVDKVEKFLA

SEQ ID NO: 6769 - protein, 255 aa, Zea mays; identical to SEQ ID NO: 5594

SEQ ID NO: 6770 - protein, 599 aa, Zea mays
MGGEAPEPRRLTRALSIGGGDGGWVPEEMLQLVMGFVEDPRDREAASLVCHRWHRVDALSRKHVTVPFCYAVSPARLLARFPRLESLAVKGKPRAAMYGLIPDDWGAYARPWITELAAPLECLKALHLRRMVVTDDDLAELVRARGHMLQELKLDKCTGFSTHGLRLVARSCRSLRTLFLEECQIDDKGSEWIHDLAVCCPVLTTLNFHMTELEVMPADLKLLAKSCKSLISLKISDCDLSDLIEFFQFATALEEFAGGTFNEQGELSKYVNVKFPSRLCSLGLTYMGTNEMPIMFPFSAILKKLDLQYTFLTTEDHCQLIAKCPNLLVLAVRNVIGDRGLGVVADTCKKLQRLRIERGDDEGGVQEEQGGVSQVGLTAIAVGCRELEYIAAYVSDITNGALESIGTFCKKLYDFRLVLLDREERITDLPLDNGVRALLRGCTKLRRFALYLRPGGLSDAGLGYIGQCSGNIQYMLLGNVGETDDGLISFALGCVNLRKLELRSCCFSERALALAILHMPSLRYVWVQGYKASQTGRDLMLMARPFWNIEFTPPNPKNGGWLMEDGEPCVDSHAQILAYHSLAGKRLDCPQSVVPLYPA

SEQ ID NO: 6771 - protein, 364 aa, Zea mays
MELHKYWGVGGRRCGSCEGAPAAVHCRTCVGGSFLCTTCDARPAHARLGHERVWMCEVCELAPAAVTCKADAAVLCAACDSDIHDANPLARRHARVPVAPIGSEAAAAAVEAMLFGTGEAAASEADEQHAAAEHAHAHAHALNLNVEAKDMKLDYLFSELDPYLSVEIPRFQHADSVVPNGAGAAVELDFTCGIGVKHSSYSSYTATSLAHSGSSSEVGVVPEAFGGSGSGGGSFELDFTRPKPQAYMPYTGTPQSHSVPSADVEVVPERGDLAAVRPVPLMGESREARLMRYREKRKNRRFEKTIRYASRKAYAETRPRIKGRFAKRADHDGDADADDAEAEAEAAVPMSYVLDFGYGVVPSF

SEQ ID NO: 6772 - protein, 494 aa, Zea mays
MELDLNVAEVAPEKPAAALEASDSGSSGSSVLNAEAASAGGGGPAPGEEGSSSTPAVLEFSILRSDSDAAGADADDGDATPSPPRHHHQQLVTRELFPAPQHWAELGFFRAGPQQQPDIRVLPHPHPHPPPPPPAQPQPAKKSRRGPRSRSSQYRGVTFYRRTGRWESHIWDCGKQVYLGGFDTAHAAARAYDRAAIKFRGVDADINFNLSDYDDDMKQMKSLSKEEFVHALRRQSTGFSRGSSKYRGVTLHKCGRWEARMGQFLGKKYIYLGLFDSEVEAARAYDKAAIKCNGREAVTNFEPSTYDGELLLTAEASAEVADDVDLNLSISQPASSQSPKRDKNCLGPQLHHHHGRPFDGSAVLKKTKIDAPSELSSAGRPHRSFLPHLVAAEHLPPRSHPFFITHHESDASRRDPSWAAAAAWKVTAAAPPPPTTTLLPLPLPSTSSAAASSGFSNTATTAAAAPSAASSRRFDPPPPSSSSSSSHHHHHHRR

SEQ ID NO: 6773 - protein, 465 aa, Zea mays
PRVRREAISKMHNMSAAVLTSVLTLIDEYDLYGQVAYPKHHKHSEVPDIYRLAARTKGAFVNVAYFEQFGVTLIEAAMNGLPIIATKNGAPVEINQVLNNGLLVDPHDQNAIADALYKLLSDKHLWSRCRENGLTNIHQFSWPEHCKNYLSRILTLGPRSPAIGNREERSNTPISGRKNIIVISVDSVNKEDLVRIIRNAIEVIHKENMSGSTGFVLSTSLTISEIHSLLLSGGMLPTDFDAFICNSGSNIYYPSHSGETSNNSKITFALDQNHQSHIEYRWGGEGLRKYLVKWATSVVERKGRTERQIIFEDPEHSSAYCLAFRVVNPNHLPPLKELRKLMRIQSLRCNALYNHSATRLSVVPIHASRSQALRYLCIRWGIEVPNVAVLVGESGDSDYEELLGGLHRTVILKGEFNIAANRIHTVRRYPLQDVVALDSSNIIGVDGYTTDDLRSALQQMGILAR

SEQ ID NO: 6774 - protein, 332 aa, Zea mays
MSTLKKSDKKAALDFAAWSFNVTTSVGLIMVNKALMATYGFSFATTLTGLHFVTTTLMTILFRWLGLSQPSHLPLADLVKFVIFSNLSIVGMNVSLMWNSVGFYQIAKLCMIPASCLLEVVFDHVHYSRDTKLSIMVVLIGVAVCTVTDVSVNARGLIAAVIAVWSTALQQYYVHFLQRKYSLNSFNLLGHTAPAQAGSLLLVGPFADYLLTGKRVDQFSLSSLALFFLALSCFIAIGVNLSQFICIGRFSAVSFQVLGHMKTVLVLSLGFLFFGKEGLNLQVVLGMVLAVLGMIWYGNASAKPGGKERRSILPVRSASLKGSSEEKAGAEK

SEQ ID NO: 6775 - protein, 360 aa, Zea mays
  unsure (1)..(360): unsure at all Xaa locations
MNKPIPSRGWLQVGKVQRTRLRLYKPRPGPALASPFNSITSFPSTQAHRHTAHSSLNSPPASSAHHHKPNRELSPSRSFHSRMLLNPASMLDTIRQHLLEEPPAAADESFGILVADQWSDSLPFRTDDADDMVVFGALQDAFAYGWLPDGSFAHVKPEPVRSPDSYYSSSYDGSCFGGLPXGAATDARQRGREAAATPSPRREEAAAAVARGKHYRGVRQRPWGKFAAEIRDPAKNGARVWLGTYDTAEDAALAYDRAAYRMRGSRALLNFPLRIASEIAAAAAGDKRPLALPEPATSSDSSSTGGSPKRRKRGEAAAANMAMALVPPPSQLSRPAQPWFPAAAPVEQAAMPPRVEQLVI

SEQ ID NO: 6776 - protein, 506 aa, Zea mays; identical to SEQ ID NO: 792

SEQ ID NO: 6777 - protein, 320 aa, Zea mays
MEGDEKSAGGAPAYWGLGARPCDACGAEAARLYCRADAAFLCAGCDARAHGAGSRHARVWLCEVCEHAPAAVTCRADAAALCASCDADIHSANPLARRHERLHVAPFFGALADAPKPFASAAPPKATDDDGSNEDEAASWLLPEPDHGQKEGATTEVFFADSDPYLDLDFARSMDEIKTIGVQQSGSPELDLAGTKLFYSDHSVNHSVSSSEAAVVPDAASGMAPMVAVVSRGLEREARLMRYREKRKSRRFEKTIRYASRKAYAETRPRIKGRFAKRTPGAGEDTLEEHEEMYSSAAAAVAALMAPGGADADYGVVPTY

SEQ ID NO: 6778 - protein, 321 aa, Zea mays
  unsure (1)..(321): unsure at all Xaa locations
MDLPVLIVTKDDAITSSPFLGTQINISINQFHNPLASAAIVTGNNNCEMATVETSGTAIGSSGRWALHGKTALVTGGTRGIGRAVVEELAALGAAVHTCSRKAEELGERIKEWEARGFSVTGSVCDLSXEDQRERLLREVADRFGGKLNILVNNVGTNIRKPTTEFTAEEYSFLMATNLESAYHLCQIAHPLLKLSGSGSIIFISSVAGAIGIFSGTIYAMTKGAINQLTKNLACEWAKDNIRANSVAPWYITTSLTEGILANKNFEEQVVSRTPLGRVGEPGEVSALVAFLCMPGSTYISGQTIAVDGGMTVNGFYPPKP

SEQ ID NO: 6779 - protein, 398 aa, Zea mays
MAANGKSSLANGASTGGKPIKCKAAVAWGPGEPLVMEEVEVAPPGRLEVRVKLLFTSICHTDLSFLKGENELHRKFPRILGHEAAGVVESVGDGVEDLAAGDHVIPIFNGECGACAYCESDRTNLCGTYRVDASKSTMVSDGGTRFSVADRVSGRTVPVYHFLNTSTFAEYTVLDAACAVKVNPEAPLQKMCLLSCGISTGVGAVWNTANVSAGSTVAIFGLGAVGLAVAEGARLRGAARIIGVDINPEKFTKGREMGVTDFVDSRASDKPVHEVIREMTHGGVDYSFECTGINGVLREAFVSTHDGWGLTVVLGIHATPKMLPLHPMELFDGRRITACVFGDVKGKSQLPAIVDKCVNGDLDINLDGFITHRMPFSDINKAIQLLEEGKSLRCVLNL

SEQ ID NO: 6780 - protein, 592 aa, Zea mays
MDEAAGLLLQEEGGGGDQEALLLPLPQDVGLYTGDGSVDVKGRPALKGTTGNWKACFFILGNECCERLAYYGIAKNLVTYLKVKLHLGNLEAARHVTTWQGTCYLTPLVGGILADSRWGKYWTIAVFSSVYFIGLAILTLSASVPALQPPSCLRTVCPEASLLQYGIFFGGLYMIALGTGGIKPCVSSFGADQFDDTDQAERAKKGSFFNWFYFCINIGSFISGTMIVWIQDNTGWGIGFAIPTIFMALAISFFFSASNKYRFQKPGGSPLTRVCQVVIAAFRKWHIEVPHDTSLLYEVDGQTSAIEGSRKLEHTNELEFLDRAAVISSADLKSESFTDPWKLCTVTQVEELKILIRMFPIWATTIIFSAVYAQNSSMFIEQGMVLDKRIGSFNIPPASLSTFDVISVIMWVPLYDRILVPLARKFTGREKGFSELQRMGIGLVLSILAMVSAALVELKRLEIARSEGLIHEKAAVPMSILWQIPQYFLVGAAEVFTCIGQVEFFYDQAPDAMRSLCSALALITVSLGNYISSIILTLVSYITTQGGDPGWIPDNLNEGHLDQFFWLIAGISFVNLIVYMGCAVRYRYKKAS

SEQ ID NO: 6781 - protein, 421 aa, Zea mays
MGGRKIALMVGINYPGTKAELKGCYNDVDRMRRCLVDRFGFDEADIRVLTDADRSAPQPTGANIRRALARLVGDARPGDFLFFHYSGHGTRLPAETGQHDDTGYDECIVPCDMNLITDQDFRELVQKVPEGCLFTIVSDSCHSGGLLDSAKEQIGNSTKQNKTQSREPDEPRHSGSGSGFRSFLKETVRDVFESEGIHIPHSRRHGDDDQDDGYAQPTGNGRTKNRSLPLSTLIEMLKEQTGKDDIDVGSIRMTLFNIFGDDASPKIKKFMKVMLGKFHQGQSGEQGSGGGGVFGMVGALAQEFLKAKLEGKEEEAFKPALEQEVHSVDEVYAGSKAWAPNNGILISGCQTNQTSADATTPQGVSFGALSNAIQTILADKHGKVTNKDLVMKARELLSKQGYTQQPGLYCSDEHVHVAFIC

SEQ ID NO: 6782 - protein, 315 aa, Zea mays
MAAAAAAAAAVSSPIAPRAVAAAASRRGFVTFGGGAARSSPTLRSGRGFSGVQTHVAAVEQAVVKDATKLEAPVVVVTGASRGIGKATALALGKAGCKVLVNYARSSKEAEEVSKEIEASGGEAITFGGDVSKEADVESMMKAALDKWGTIDVLVNNAGITRDTLLMRMKKSQWQDVIDLNLTGVCLCTQAATKVMMKKKKGKIINIASVVGLTGNVGQANYSAAKAGVIGFTKTVAREYASRNINVNAIAPGFIASDMTAELGEELEKKILSTIPLGRYGQPEEVAGLVEFLALSPAASYMTGQVLTIDGGMVM

SEQ ID NO: 6783 - protein, 306 aa, Zea mays
MRRRRRRLRCPSPCASRRGFVTFGGGAARFSPTLRSGRGFSGVQTHVAAVEQAIVKDATKLEAPVVVVTGASRGIGKATALALGKAGCKVLVNYARSSKEAEEVSKEIEASGGEAITFGGDVSKEADVESMMKAALDKWGTIDVLVNNAGITRDTLLMRMKKSQWQDVIDLNLTGVFLCTQAATKVMMKKRKGKIINIASVVGLTGNVGQANYSAAKAGVIGFTKTVAREYASRNINVNAIAPGFIASDMTAELGEELEKKILSTIPLGRYGQPEEVAGLVEFLALNPAASYMTGQVLTIDGGMVM

SEQ ID NO: 6784 - protein, 416 aa, Zea mays
MAMSASSSSRALLRRIGGALLRRSFSSSSAASAGYHVAGGPSYMRGAVFWEPGRPLTLEEFRMPRPKAGELLIKTKACGVCHSDLHVLKGELPFSTPCVVGHEITGEVVDHGTHTPVEIINRFPVGSHVVGAFIMPCGNCFYCVKGQEDLCESFFAYNRAKGTLYDGETRLFLRGNGKPVYMYSMGGLAEYCVVPANALAVLPDSLPYTESAILGCAVFTAYGALRHAAEMRPGDSVAVIGVGGVGSSCLQIAKAFGASQVIAVDVLDEKLQNATTLGATHTVNAAKDDAVERIKEITDGRGVDVAIEALGKALTFSQCAKSVRDGGKAVMIGLAATNVMGEVDITRLVRRQVKIIGSYGARARQDLPQIVKLAESGAFNLQNTISRKCKFEEANGAYEDLNQGKIVGRAVVEIME

SEQ ID NO: 6785 - protein, 738 aa, Zea mays
QFIGNTTTSCARNKDIEVTGYDVTNASDAMVLYGPSSLDEQVPFLHVSMLDFGDPFRKHEMRCRYRQKLPMPWSAITNPLGTFVIWMLLGYSIAAAYSRYDKVTEDCRKMEELKTQAEAADVAKSQFLATVSHEIRTPMNGVLGMLDMLLGTDLTMTQKDYAQTAQMCGRALITLINDVLDRAKIEAGKLELEAVPFDLRSLMDDVVSLFSSKSREKCIELAVFVCDNVPKVVIGDPWRFRQILTNLVGNAVKFTERGHVFVRVCLAENSNMEANQVLHGAMNGKGGRVESTANGAFNTLSGFEAADRRNSWQYFKLLLSDKESLLDDLEGENSNQSDSDRVTLAISIEDTGVGIPLQAQDRVFTPFMQADSSTSRNYGGTGIGLSISKCLAELMGGQISFTSHPSVGSTFTFSATLKHSYKDISGDSSRSLTEALPTAFKGMKAILVDGRPVRSAVTRYHLKRLGILLQVVNNMNAVVKAFPGQNGAAGSREKASILFIESDFWRPETDVQLLNHLREQKNGQLSDGHKVVLLVTSEADKDKYGSIFDIVMCKPIRASTIASSIQQLLKVEIAERKDNQNRPSFLRSLLVGKNILVVDDNKVNLRVAAAALKKYGANVSCVESGKDAISLLQPPHRFDACFMDVQMPEMDGFEATGQIRQMELKANEERKNKLAPIEGATTAEYHLPVLAMTADVIQATYEECIKSGMDGYVSKPFDEEQLYQAVSRLVVGTTDSAV

SEQ ID NO: 6786 - protein, 353 aa, Zea mays
  unsure (1)..(353): unsure at all Xaa locations
MNMGGVSPSTVRCKHCSTQLTVCPGERAIQCTQCCGVTRIRRRRVQRPAAAPPTTGFPRARGKKRALLIGITYAGTRRGCGQLRGALNDVKCMRQLLCQRFAFPSDCIIMLTDDQKDPFRLPTKDNIRLGMQWLVEGSSEGDSLVFHFSGLGAQVADDDGDELDGYDEAICPMDSFQKGPILDDEINETMVRPLVHGVKLHAVVDACHSATVLDLPFCCNMSRSGSWQWKDESPPSGAYRGTSGGKAMLISGYSDGKXSPAWPVRRNQEACATMGAMTHSFITAVEREPQGVTYGRLLTSMKAIMTNSGGCAVQGPIGAGAAALEDANFSGVEEPNLSSLDKFDIYRMAFGAE

SEQ ID NO: 6787 - protein, 311 aa, Zea mays
MHHSPPGLPSLAVHFFLHHSHLISGVILFVLASLVVVGWVLASWEYRPRGGAAMKIQCDACEGAAATVVCCADEAALCARCDVEIHAANKLASKHQRLPLEALSAKLPRCDVCQEKAAFIFCVEDRALFCRDCDEPIHVPGTLSGNHQRYLATGIRVGLASASACSDACDAHDSDHHAPPKATIEPPHAAVSAAVQQVPSPPQFLPQGWAVDELLQFSDYESSDKLHKEPTLGFKELEWFADIDLFHEQAPKASRTLAEVPELFGYQAANDAAYYRPAKAAGGGGAGVRQSKKARIEVTDDEDYLIVPDLG

SEQ ID NO: 6788 - protein, 1754 aa, Zea mays
MEYSAKTSLPLYTFGIIFPCRCQRFNTNQQKEQVRLQKKGAKRKPKCSLVWCTRLSSVPPDSVRCTTRQCPVHQGESAQTPQLRVSEAQLRYNSPDCPVCHWTVRCTSGATTIYAQRSTLTDEQCSTVSRQKSEQQRMIEMAADVGLLGRVLPNKAKQRYSLYADDVGVFIRADKEDLKVLKKILEVFEGFSRLKINFDKTEIFPIRYPQTLWPDLMDVFPGKYSKFPREYLGLPLHFRNVRRIDVQPLIGKINKRLAGWKGRLLSKADLFNASTIVTIGNGKMADFWGSSWIEGHAPKNIAPKLYKKARRKNISVFKALRNNYWMQFCAPFSREEEPASLSLGDWVLQSLQFPPALPVLPHAPLCLSVSLASLLQTPARRPGRGGVMVFKGRFFSSRHKSSESSSSPDGSNSPRTPTSAPASASAASPASSSSSRSDKKKTKSETPKKRDKLFGSAATAPKSAASSASSSPAGDGRKGSVPHHRDAGVGGGGGASAAALSPILASSLGLNRIKTRSGPLPQEGQRMAAVIGSSNLSRGQGQAEPSAASAGVGGRKGVTSWADTSSSSRGKGKTTELPMRSTAGTSLGPVGKSAVKAKPSAQRNHSGDLRTPTHIPEAACAYDPCETPKESESPRFKAIMQATSAPRKRLPADIKSFSHELNSKGVRPFPFLKPRGIYNLKEVIKVIHVRFEKAKEEVNSDLAVFAGDLVSVMEKYADSHPEWKDALEDLLILARTCCVMTPGEFWLQCEGIVQDLDDHRQELSMGVLKKLYTRMLFILTRCTRLLQFHKESGFAEDEVVIDQRDKIIQSADRQILTQSGVGDTTSRASKSEARKSYSQEQHNLKWKRSQEIKPVNLLPPLDTDVKKVADSPTKERISSWKPFPSPVTKVPKESTPTKLESPNKKTDAHSTVSSHVELSSPVESLPQQQLPVKHQHKTSWGHWSDQPNISEEGSIMCRICEEYVPTQYVEDHSRVCAIADRCDKKGVSVDERLIRVAEMLEKMVESYSPKDLPNAAVSPDVAKVSSSSINEESDGPSPKLSDWSRRGSADMLDYLQETDNTISLDDIKNLPSMTCKTRFGPKSDHGMATSSAGSMTPRSPLTPRSNHIDMLLAGKNAINESGDLPQEARLPTSGIRAMVIVGDVPRRERFRRSASTHMTFLNAQGCDGAHADLLQGLTRLSVQEAEGQGAAAGARGRAGVGWREERAGLAAPERKIVELADIARCIANTPLDEESALSQMVTCIEDLQEIVNRRKHEALTVQTFGTRIEKLHREKYLQLCDSVDMDKVDSASTIMDEEDDVVRSLRASPVHPVKDRTSIDDFEIMKPISRGAFGRVFLAKKRTTGDLFAIKFYVLVSPSDPQYVYSKQVLRKADMIRKNAVESILAERDILITVRNPFVVRFFYSFTSRENLYLVMEYLNGGDLYSLLRNLGCLDEDVARVYLAEVVLALEYLHSMHIVHRDLKPDNLLIAHDGHIRLEKLTDFGLSKVGLINSTDLSGPAVSGASLYGDDEPQMNELEQMDHRARRQNRSAVGTPDYLAPEILLGTGHGCSADWWSVGVILFELIVGIPPFNAEHPEAIFENIMNRKIPWPHVPEEMSFDAQDLIDRLLTEDPHQRLGANGASEVKQHPFFKDISWDTLARQKAAFVPSSDSAFDTSYFTSRYSWNQSDENIYEAYELEDSSDNGSLSGSSSCVSNQDDMGEDSTGLNEFESSANVNYSFSNFSFKNLSQLASINYDLLTKGLKDDPPPRTEM

SEQ ID NO: 6789 - protein, 135 aa, Zea mays
VSNYKFHPSLDRNSDSSALTYHAMSLVLQFFLALSCFIAIGVNLSQFICIGRFSAVSFQVLGHMKTVLVLSLGFLFFGKEGLNLQVVLGMVLAVLGMIWYGNASAKPGGKERRSILPVRSASLKGSSEEKAGAEK

SEQ ID NO: 6790 - protein, 332 aa, Zea mays
MSALKKSDKKAALDFAAWSFNVTTSVGLIMVNKALMATYGFSFATTLTGLHFVTTTLMTIVFRWLGLSQPSHLPLADLVKFVIFSNLSIVGMNVSLMWNSVGFYQIAKLCMIPASCLLEVVFDHVHYSRDTKLSIMVVLIGVAVCTVTDVSVNARGLIAAVIAVWSTALQQYYVHFLQRKYSLNSFNLLGHTAPAQAGSLLLVGPFADYLLTGKRVDHFSFSSLALFFLALSCFIAIGVNLSQFICIGRFSAVSFQVLGHMKTVLVLSLGFLFFGKEGLNLQVVLGMVLAVLGMIWYGNASAKPGGKERRSVLPLRSASLKGSSEEKGGAEK

SEQ ID NO: 6791 - protein, 754 aa, Zea mays
RPIPALDDDSIQEILISYHNATLSAKDWGKAWHIWALFNTEVMSRYTFRGRPDIAGKYVVAAVTGYFYSIACASTTKGVDDSLQDILRLLTLWFNHGDTSEVQTALQKGFSLVKIEMWLVVLPQIIARIHSNNRVVRELIQSLLVRIGKGHPQALMYPLLVACKSISILRQRAAQEVVDKIRQHSGGLVDQAQLVSKELIRVAILWHEMWHEALEEASRMYFGEHNIEGMLAVLEPLHAMLERGDETIKENAFIQAYGHELLEAHECCLKYRATGEDAELTKAWDLYYHVFRRIDKQLPSLTTLDLHSVSPELLKCRKLELAVPGTYAADSPLVTIEYFVPQLIVITSKQRPRKLTIHGSDGNDYAFLLKGHEDLRQDERVMQLFGLVNTLLENSRKTSEKDLSIQRYAVIPLSPNSGLIGWVPNCDTLHALIREYRDARKIFLNQEHRLMLAFAPDYDHLPLIAKVEVFQHALQNTEGNDLAKVLWLKSRTSEVWLERRTNYARSLAVMSMVGYLLGLGDRHPSNLMLDRYSGKILHIDFGDCFEASMNREKFPEKVPFRLTRMLVKAMEVSGIEGTFRTTCENVMQVLRTNRDSVMAMMEAFVHDPLINWRLFNFNEVPQVSNYGNVHAHTVVSSEEAVANRELMQPQRGARERELLQAVNQLGDANEVLNERAVAVMARMSDKLTGRDFSSGSALAGAGSSIQHGSEHLASGDARDAQPGLSVKVQVQKLILQATSHENLCQNYVGWCPFW

SEQ ID NO: 6792 - protein, 654 aa, Zea mays
MDGCDCIEPLWPTDDLLVKYQYISDFFIALAYFSIPLELIYFVKKSSFFPYRWVLIQFGAFIVLCGATHLINLWTFTTHTKTVAMVMTIAKISTAVVSCATALMLVHIIPDLLSVKTRELFLKNKAEELDREMGLIRTQEETGRHVRMLTHEIRSTLDRHTILKTTLVELGRTLGLEECALWMPSRSGSSLQLSHTLRHQITVGSSVPMNLPVVNQVFSSNRAIIIPHTSSLARVRPLAGRYVPPEVAAVRVPLLHLSNFQINDWPELSAKSFAIMVLMLPSDSARKWHVHELELVEVVADQVRAVSFAMVTITYYFHPEKDVAVALSHAAILEESMRARDLLMEQNVALDLARREAEMAIRARNDFLAVMNHEMRTPMNAIIALSSLLLETELTPEQRLMVETVLKSSNLLATLINDVLDLSKLEDGSLELEIKAFNLHAVFKEVMGFIKPIASIKRLSVSVMLAPDLPLCAIGDEKRLMQTILNISGNAVKFTKEGHITLVASIVKADSLREFRTPEFHPTASDEHFYLKVQVKDTGCGVSPQDLPHVFTKFAHPQSGGNRGFNGSGLGLAICKRFVSLMGGHIWIDSEGTGRGCTATFVIKLGVCDNTNTYQQQLVPLVWPSSADSNLSAPKVLPDGRGSVSLKSRYQRSV

SEQ ID NO: 6793 - protein, 634 aa, Zea mays
MDGCDCIEPLWPTDDLLVKYQYISDFFIALAYFSIPLELIYFVKKSSFFPYRWVLIQFGAFIVLCGATHLINLWTFTTHTKTVAMVMTIAKVSTAVVSCATALMLVHIIPDLLSVKTRELFLKNKAEELDREMGLIRTQEETGRHVRMLTHEIRSTLDRHTILKTTLVELGRTLGLEECALWMPSRSGSSLQLSHTLHHQITVGSSVPINLPVINQVFSSNRAIIIPHTSPLARIRPLTGRYVPPEVAAVRVPLLHLSNFQINDWPELSAKSFAIMVLMLPSDSARKWHVHELELVEVVADQVAVALSHAAILEESMRARDLLMEQNVALDLARREAEMAIRARNDFLAVMNHEMRTPMNAIIALSSLLLETELTPEQRLMVETVLKSSNLLATLINDVLDLSKLEDGSLELEIKAFNLHAVFKEVMGFIKPIASIKRLSVSVMLAPDLPLCAIGDEKRLMQTILNISGNAVKFTKEGHITLVASIVKADSLREFRTPEFHPTASDDHFYLKVQVKDTGCGIGPQDLPHVFTKFAHPQSGGNRGFNGSGLGLAICKRFVSLMGGHIWIDSEGTGRGCTATFVVKLGVCDNTNTYQQQLIPLVWPSSADSDLRAPKALPDGRGSTPLKSRYQRSV

SEQ ID NO: 6794 - protein, 249 aa, Zea mays; identical to SEQ ID NO: 987

SEQ ID NO: 6795 - protein, 299 aa, Zea mays
MAATIDLSGEELMRALEPFIRDASAHGSSPLLHPHQPLSPSSPFSFHQAVAAASSYGGNYPFAAADEAGQLSPSQMQYIQARLHLQRRQAQTSVLGPRAQPMKASASAAPAPARPQKLYRGVRQRHWGKWVAEIRLPRNRTRLWLGTFDTAEEAALAYDQAAYRLRGRTRRASTSDNAASRGPLHASVDAKLQSLCQSIAASKKGAKKPASAAAAASSSAPTSNCCSSPSSDDATSSCLESATESSCPSPSPSPSASPGPTVPEMQQLDFSEAPWDEAAGFALTKYPSYEIDWDSLLAN

SEQ ID NO: 6796 - protein, 719 aa, Zea mays; identical to SEQ ID NO: 842

SEQ ID NO: 6797 - protein, 193 aa, Zea mays
  unsure (1)..(193): unsure at all Xaa locations
MAPGGSGERWSLAGATALVTGGKLDILVNNAALLLLKPAAEWAAXDYARIMATNLESRLHISQLAHPLLLNASVAGGASIVNVSSIASVLGFPQEVMYSVTKGGLNQMTRSLAVEWACDRIRVNCVAPGVIMTDMGKELPAALVEQERSRIPLRRTGEPEEVASLVSFLCMPAASYVTGQVIFVDGGRTISGA

SEQ ID NO: 6798 - protein, 263 aa, Zea mays; identical to SEQ ID NO: 700

SEQ ID NO: 6799 - protein, 263 aa, Zea mays
MAPGGSGERWSLAGATALVTGGSKGIGQAVVEELARLGARVHTCARSAADLEECRRRWAEKGLRVTVSVCDVAVRADRERLVLDTVSGAFDGKLDILVNNAALLLLKPAAEWAAEDYARIMATNLESCLHISQLAHPLLLNASVAGGASIVNVSSIASVLGFPQEVMYSVTKGGLNQMTRSLAVEWACDRIRVNCVAPGVIMTDMGKELPAALVEQERSRIPLRRTGEPEEVASLVSFLCMPAASYVTGQVIFVDGGRTISGA

SEQ ID NO: 6800 - protein, 260 aa, Zea mays
  unsure (1)..(260): unsure at all Xaa locations
MDRKRIKDALEKHLERSSPSTSRGVVSKERERLAAGKLPSSLGKAEVSDGEEFETDSEDSDVSGSEGEDTSWISWFCTLRGNEFFCEIDDDYIQDDFNLCGLSNQVPYYDYALDLILDIESSNDDGFTEEQNELIESSAEMLYGLIHARYILTSKGLAAMXLEKFKNYDFGRCPRVYCCGQPCLPAGQSDVPRSSTVKIYCPKCEELNYPRSKYQGNIDGSYFGTTFPHLFLMTYSHLKPQKPSQQYTPRVFGFKLHKPS

SEQ ID NO: 6801 - protein, 384 aa, Zea mays
MDRRKGGNRDTNGSLVEATASRLRVESDEEAEEVGMEVEESFDAGVEDEQAAAEVIGSEKTSADYYFDSYSHFGIHEEMLKDVVRTKTYQNVITQSSFLIKNKVVLDVGAGTGILSLFCAKAGAKHVYAIECSQMADMAQEIVKSNGYSDVITVIKGKVEEIELPVPKVDVIISEWMGYFLLFENMLNTVLYARDKWLADGGVVLPDRTSLRLTAIEDAEYKEDKIEFWNNVYGFDMSCIKKQAMMEPLVDTVDANQIVTNCQLLKTMDISKMTPGDASFTVPFKLVAERNDYIHALVAYFDVSFTKCHKLMGFSTGPRSKATHWKQTVLYLEDVITICQGESLSGSMTVTPNKSNPRDIDIKLKYSINGHRCQVSRTQFYKMR

SEQ ID NO: 6802 - protein, 248 aa, Zea mays
  unsure (1)..(248): unsure at all Xaa locations
MPFAPIASDSISLIISVEDTGVGIPFDAQSRVFTPFMQVGPSIARIHGGTGIGLSISKCLVGLMRGEIGFASKPQVGSTFTFTAVLTRAHSSRNENKSSEFKGINALVVDHRPVRAKVAAGALKKYGAEVTCADSGKKAITQLKPPHSFDACFMDIQMPEMDGFEATKRIRVMERDLNEQIERGEAPPECAGLRQWRTPILAMTADXIQATHEQCLKSEMDGYVSKPFEGEQLYREVARFFQNQDQVQ

SEQ ID NO: 6803 - protein, 479 aa, Zea mays
PQTLIGDPGRIRQIITNLVGNSIKFTEKGHIYLTVHVVEEIMHCLEVETGTQYTNTLSGYPVANRKRSWENFRLFSRELNSSEMPFAPIASDSISLMISVEDTGAGIPFDAQSRVFTPFMQVGPSIARIHGGTGIGLSISKCLVGLMKGEIGFASKPQVGSTFTFTAVLTRVHSSRNENKSSEFKEINALVVDHRPVRAKVTKYHLQRLGVQTELTTDLDQYISKNNCGSQIAKLVLIDKETWLKESHSMPLLVTKLRNKDQPDSTKLFLLENPKSSVKSNSHIFREYNLNVIMKPLRASMLQVSLQRALGGIDKLHCRNGVVGNSTLGSLLHKKRIIVVDDNIVNLKVAAGALKKYGAEVTCADSGKEAITLLKPPHNFDACFMDIQMPEMDGFEATKRIRVMERDLNEQIECGEAPPECVGVRQWRTPILAMTADVIQATHEQCLKSEMDGYVSKPFEGEQLYREVARFFLNQDQVQ

SEQ ID NO: 6804 - protein, 74 aa, Zea mays
  unsure (1)..(74): unsure at all Xaa locations
PNLDLCKLXSLTFRASDNLNYPSMARAYAAGRAGGTMTGVLSAANENAVELFIDEKXSYLDILFFAYRLLPALF

SEQ ID NO: 6805 - protein, 324 aa, Zea mays
  unsure (1)..(324): unsure at all Xaa locations
MTAKGGATPSPGGAGPAAGNGRLFTVGLVTAWYSSNIGVLLLNKYLLSNYGFKYPIFLTMCHMSACALLSYAAIAWLRVVPMQLVRSRVQLAKIAALSLVFCGSVVSGNVSLRYLPVSFNQAVGATTPFFTAVFAYVMTVKRESWVTYLTLVPVVTGVIIASGGEPSFHLFGFIMCIGATAARALKTVLQGILLSSDGEKLNSMNLLLYMAPIAVIFLLPATIFMEDNVVGITIQLAKKDFTIVWLLLFNSCLSYFVNLTNFLVTKHTSALTLQVLGNAKGAVAVVISIMIFRNPVSITGMLGYTLTXXGVILYSESXXRSNKP

SEQ ID NO: 6806 - protein, 377 aa, Zea mays; identical to SEQ ID NO: 978

SEQ ID NO: 6807 - protein, 363 aa, Zea mays
MAAKGLREVGRRRAAEVGRRCLSGGSAGPPAPAAKRKEGGKAVNLFTAVNQALHIALDTDPRAYVFGEDVGFGGVFRCTTGLADRFGKSRVFNTPLCEQGIAGFAIGLAAMGNRAIAEIQFADYIFPAFDQIVNEAAKFRYRSGNEFNCGGLTIRTPYGAVGHGGHYHSQSPEAFFCHVPGLKVVIPRSPREAKGLLLASIRDPNPVVFFEPKWLYRLAVEEVPEEDYMLPLSEAEVIREGSDITLVGWGAQLAVLKEACEDAAKDGVSCELIDLKTLVPWDKETVEASVKKTGKLLVSHEAPVTGGFGAEIAASIAERCFQRLEAPVARVCGLDTPFPLVYEPFYMPTKNKVLDAIKATIDF

SEQ ID NO: 6808 - protein, 358 aa, Zea mays
MVPGYDCAASVLLCAEDNAAILGLDDDGEESSWAAAATPPRDTVAAAAATGVAVDGILTEFPLLSDDCVATLVEKEVEHMPAEGYLQKLQRRHGDLDLAAVRKDAIDWIWKVIEHYNFAPLTAVLSVNYLDRFLSTYEFPEGRAWMTQLLAVACLSLASKIEETFVPLPLDLQVAEAKFVFEGRTIKRMELLVLSTLKWRMHAVTACSFVEYFLHKLSDHGAPSLLARSRSSDLVLSTAKGAEFVVFRPSEIAASVALAAIGECRSSVIERAASSCKYLDKERVLRCHEMIQEKITAGSIVLKSAGSSISSVPQSPIGVLDAAACLSQQSDDATVGSPAVCYHSSSTSKRRRITRRLL

SEQ ID NO: 6809 - protein, 253 aa, Zea mays; identical to SEQ ID NO: 5611

SEQ ID NO: 6810 - protein, 519 aa, Zea mays
  unsure (1)..(519): unsure at all Xaa locations
MASADLAEAMEPGKKSNVKYASVCAIMASMACVILGYDIGVMSGAAIYIKKDLKITDVQLEILIGIISLYSLFGSFAGXRTSDRIGRRLTVVFAAVIFFMGALLMGFSVNYGMLMVGRFVAGVGVGYGGMIAXPVYTAXEISPAASRGFLTSXFPEVFINLGILLGYLSNYAFAXLPLHLGWRVMLGIGAXAPSALLAAPWVFCMPEXSPRWLVMKGRLADARAVLEKTSASPEEAAERLADIKVAXAGIPKDLDGDVVTVPKERNSGEMQVWKDLILSPTPAIRRILLSAVGLHFFQQASGCDSVVLYSPSVFRGAGITGDNKLLGVTCAVGVTKTLFILVATFLLDRVXGRRPLLLTSTGGMVISLISLGTALTXVVGHHPDAKIPSVVALCIASTLAFVAFFSIGLGPITGVYNSEIFPLQLRALGFAVGVACNRVTSAVISMTFLSLSKAITIGGSFFLYSGIAAVGWVFFFTXLPETRGRTLEEMGKLFGMPDTDMAEADDTAAKEKVVEMSTK

SEQ ID NO: 6811 - protein, 453 aa, Zea mays
  unsure (1)..(453): unsure at all Xaa locations
MDKLSGSARLMIVSDLDHTMVNVVQLISWSALSYLYVNSSFFWDGYNLQVDHHDEENLSLLRFGALWESVYCEDSLLVFSTGRSPTLYKELRKEKPMLTPDITIMSVGTEITYGEAMVPDDGWEEYLNNKWDRNIVVAETVSFSELKLQPETEQRPHKVSXFFVDKKNAQEVIKSVAERLDKCGLDAKKIYSGGQDLDILPQGAGKGQALAYLLKKLSSCGKPPNNTLVCGDSGNDAELFSIPGVHGVMVSNAQEELLQWYTENAKDNPKIIHSNERCAAGIIQAIGHFKLGPNISPRDLQFPYAKEASFKPTDAVVKFYVLYEKWRRAEVPKSDSVIKYFKNITHANGVTIHPAGLELSLHASIDALGSCYGDKEGRKYRAWVDRLFITQTGSDSWVGRFDLWESEGDVRVCSLSSLALILKAESPEGFVLTHIQKTWLNGYSSGVEQAFKL

SEQ ID NO: 6812 - protein, 423 aa, Zea mays
MDKLSGSARLMIVSDLDHTMVDHHDEENLSLLRFGALWESVYCEDSLLVFSTGRSPTLYKELRKEKPMLTPDITIMSVGTEITYGEAMVPDDGWEEYLNNKWDRNIVVAETVSFSELKLQPETEQRPHKVSFFVDKKNAQEVIKSVAERLDKCGLDAKIIYSGGQDLDILPQGAGKGQALAYLLKKLSSCGKPPNNTLVCGDSGNDAELFSIPGVHGVMVSNAQEELLQWYTENAKDNPKIIHSNERCAAGIIQAIGHFKLGPNISPRDLQFPYAKEASFKPTDAVVKFYVLYEKWRRAEVPKSDSVIKYFKNITHANGVTIHPAGLELSLHASIDALGSCYGDKQGRKYRAWVDRLFITQTGSDSWVGRFDLWESEGDVRACSLSSLALILKAESPEGFVLTHIQKTWLNGYSSGVEQAFKL

SEQ ID NO: 6813 - protein, 457 aa, Zea mays
MSVAEKRGTSWQDAMIQEPARCPNGGGEMDICDMRHVGGLGCVKGCLIEEGIKQCFDVLSWACNSVLALYRRSLVERTKHHLGYPYNLDFDYGALTQLQHFSINNLGDPFIESNYGVHSRQFEVGVLDWFARLWELEKDEYWGYITNCGTEGNLHGILVGREVFPDGILYASRESHYSVFKAARMYRMDCVKVDTLMSGEIDCADFQRKLLQNRDKPAIINVNIGTTVKGAVDDLDLVIKTLEENGFKDRFYIHCDGALFGLMIPFVKKAPQVTFKKPIGSVSVSGHKFVGCPMPCGVQITRLEHINALSSNVEYLASRDATIMGSRNGHAPIFLWYTLNRKGYRGFQKEVQKCLRNAHYLKDRLKEAGIGAMLNELSSTVVFERPKDEEFVRRWQLACEGNIAHVVVMPSVNIDKLDYFLNELVDKRATWYQDGISQPPCIARDVGVENCLCGLHK

SEQ ID NO: 6814 - protein, 398 aa, Zea mays
  unsure (1)..(398): unsure at all Xaa locations
ILFFGSGWWAAWFGALGAGVFLRSPGYLPVLLRPAAAGCRWGWPGQKFQLGTVGALSLSVVSSVSIVICNKALMSSLRFNFATTLTSWHLLVTFCSLHVALCMKLFEHKPFDARTVMGFGVLNGISIGLLNLSLGFNSVGFYQMTKLAIIPCTVILETLFFRKKFSRNIKLSLSVLLLGVGVATITDLQLNVVGXSVLSLLAIITTCIAQIMTNTIQKKFKVSSTQLLYQSCPYQALTLFLVGPFLDGFLTNQNVFAFDYTTQVLFFIVLSCLISVSVNFSTFLVIGKTSPVTYQVLGHLKTCLVLAFGYVLLHDPFSWRNILGILIAVIGMVLYSYFCTRETQQKPAEASPQAILQAKEGESNPLILDSLSAAENGGSATDDEPLKVPMWSSKYSKA

SEQ ID NO: 6815 - protein, 333 aa, Zea mays
  unsure (1)..(333): unsure at all Xaa locations
MDHAADAHRTDLMTITRHVLNEQSRNPESRGDFTILLSHIVLGCKFVASAVNKAGLAQLIGLAGETNVQGEEQKKLDVLSNEVFVKALVSSGRTCVLVSEEDEEATFVDPKLRGRYCVCFDPLDGSSNIDCGVSIGTIFGIYIIKDKDNVTLEDVLQPGKNMLAAGYCMYGSSCTLVLSTGTGVNGFTLDPSLGEFILTHPDIKIPKKGKIYSVNEGNAKNWDAPVAKFVEKCKYPKDGSPPRSLRYIGSMVADVHRTLLYGGVFLYPADEKNPNGKLRILYEVFPMSFLMEQAGGQSFTGKERXPIFLGSYDDVEEIKALYAEQAKSSSASS

SEQ ID NO: 6816 - protein, 359 aa, Zea mays
  unsure (1)..(359): unsure at all Xaa locations
MNMGGRSPAATTIRCKYCSASLTVCAGERAIQCAQCCGVTRIRRSLSSRLPLPALTRPASVAGFPPCGGRGKKRAVLIGITYGGARRGCGELRGPINDVKCMRQLLCQRFAFPSDGIIMLTDDQKDPFRVPTKDNIRMAMQWLXQGCSSGDSLVFHFSGLGAQVADADCDEQDGYDEAICPXDSFQKGPILDDEINETIVRPLVPGAKLHAVVDACHSDSVLDLPFLCNMSRTGNWQWEDHRPPSGVCKGTSGGQAVLISGYSDGKSKFSMTPEACAAVGAMTHSFIKAVECLAPRXGQPSGRLLTSMKAIMTNAGRLQASSCRCACAPARKVVNFSGVQEPNLSCSEMFDVYRKPFAL

SEQ ID NO: 6817 - protein, 143 aa, Zea mays
SGHIVKALSLGASTVMMGSFLAGSHEAPGTYEYKDGLRVKKYRGMGSLEAMTKGSDARYRGRTLKLKVAQGGGGAVADKGSVLRFIPYTMQAVKQGLQDLGADSLQSAHDLLRSETLRLEVRTGAAQAEGGIHGLESYVKKAF

SEQ ID NO: 6818 - protein, 83 aa, Zea mays
  unsure (1)..(83): unsure at all Xaa locations
GDTLKLKVXQGVXGAVHDKGSVLRFIPYTMQAVKQGLQDLGADSVQSAHDLLRSETLRLEVRTGPAQAEGGIHGLVSHVKKAF

SEQ ID NO: 6819 - protein, 111 aa, Zea mays
DKDGCRVKKYRGMGSLEAMTKGSDARYLGDTLKLKVAQGVVGAVADKGSVLRFIPYTMQAVKQGLQDLGADSLQSAHDLLRSETLRLEVRTGAAQAEGGIHGLVSYVKKAF

SEQ ID NO: 6820 - protein, 248 aa, Zea mays
MEEREKLVCLAKLAEQAERYDDMVEFMKNLARMDVDMSAEERHLFSVGFKNTIGAKRASWRIICSHEQKVAADRQTGVMIDAYKKKVEEELRKVCNEVLSVIAIHCLPLASTGENIVFFYKMKGDYYRYLAEFSTGTEKKAASDQSLMAYQHAMVVASSELSPAHQIRLGLALNLSVFFYEIMNSHERACQVAKQAFDEALTEINSGEGVYKDSTIMMQLLKDNLALWTSELTGGEASKGSDDVDMEG

SEQ ID NO: 6821 - protein, 431 aa, Zea mays
RVPTKLVCPRSALSPTSYKTGAKTALPAIPSHLLHHRHIAADLIPPPLEESAEPTEGDHMGAEAAHPQQQPPSSVRPCREAAAPAVLGLQLSALIDHVARVDWSLLDRVAGDRGGSQQVSIVELNHILNEVNTHILPSHNDLTPITTIAGGSVANTIRGLSAGFGISTGIIGACGDDNQGILFVNNMSFSGVDLTRLRAKKGHTAQCVCLVDASGNRTMRPCLSSAVKIQANEFRKEDFKGSKWLIVRYAQQNMEQIIEAIRIAKQEGLSVSLDLASFEMVRDSRSKLINLLETGNIDLCFANEDEAREVIGGGLESDPEEALAFLGKYCKWAVVTLASKGCMAKHGKQVVQVPAIGESNAVDTTGAGDLFASGFLYGLVKGLPLEECCMVGACSGGSVTRALGGEVRPENWQWMYKQMHARGMLLPELKN

SEQ ID NO: 6822 - protein, 375 aa, Zea mays; identical to SEQ ID NO: 5813

SEQ ID NO: 6823 - protein, 124 aa, Zea mays
LLIILQFFILLSCSLAVFCNMSQYLCIGRFSATSFQVLGHMKTVCVLILGWILFDSALTVKNILGMLLAVMGMVVYSWAVEAEKKAAAPIPRNKGGMLDGEDVPLKARVSGVPAVDLEDGDVKG

SEQ ID NO: 6824 - protein, 344 aa, Zea mays
MEAEKKPPAVSDVGAWAMNVVSSVSLIMANKQLMSSSGYAFAFATTLTGFHFTVTALVGWISNATGYSVSKHVPLWELVWFSLVANTSITGMNLSLMLNSVGFYQISKLSMIPVVCLMEWVLNSKHYTTKVISAVIVVAAGVGICTVTDVEVNAKGFICACVAVFCTSLQQITIGSFQKKYNIGSFELLSKTAPIQALSLIILGPFVDYYLNGRSLLNYPFSGGATFFILLSCSLAVFCNMSQYLCIGRFSATSFQVLGHMKTVCVLILGWILFDSALTMKNILGMLLAVMGMVVYSWAVEAEKKAAAPIPRNKGGMLDGEDVPLKARVSGVPAVDLEDGDVKG

SEQ ID NO: 6825 - protein, 228 aa, Zea mays
  unsure (1)..(228): unsure at all Xaa locations
MAMMVDPPNGIGNQGKHYYSMWQTLFEIDTKYVPIKPIGRGAYGIVCSSINRETNEKVAIKKIHNVFDNRVDALRTLRELKLLRHLRHENVIALKDIMMPIHRRSFKDVYLVYELMDTDLHQIIKSPQGLSNDHCQYFLFQLLRGLKYLHSAEILHRDLKPGNLLVNANCDLKICDFGLARTNSSKGQFMTEYVVTRWYRAPELLLCCDXYGTSIDVWSGWCIFAELL

SEQ ID NO: 6826 - protein, 599 aa, Zea mays
MGGEAPEPRRLTRALSIGGGDGGWVPEEMLQLVMGFVEDPRDREAASLVCHRWHRVDALSRKHVTVPFCYAVSPARLLARFPRLESLAVKGKPRAAMYGLIPDDWGAYARPWITELAAPLECLKALHLRRMVVTDDDLAELVRARGHMLQELKLDKCTGFSTHGLRLVARSCRSLRTLFLEGCQIDDKGSEWIRDLAVNCPVLATSHVEIQCCQNRTVDLELLAKSCKSLISLKIGDCDLSDLIGFFQSATALEEFAGGTFNGQGELTKYGDVKFPSRICSLGLTFMGANEMPIMFPFSAILKKLDLQYTFLTTEDHCQLIAKCPNLLVLAVRNVIGDRGLGVVADTCKKLQRLRIERGDDEGGVQEEQGGVSQVGLTAIAVGCRELEYIAAYVSDITNGALESIGTFCKKLYDFRLVLLDREERITDLPLDNGVRALLRGCTKLRRFALYLRPGGLSDAGLGYIGQCSGNIQYMLLGNVGETDDGLISFALGCVNLRKLELRSCCFSERALALAILSMPSLRYVWVQGYKASQTGRDLMLMARPFWNIEFTPPSSQNAGRLIEDGEPCVDSHAQILAYGSLAGKRLDCPQSVVTLYPA

SEQ ID NO: 6827 - protein, 520 aa, Zea mays
  unsure (1)..(520): unsure at all Xaa locations
MARGDGGQLAELSAGVRGAAAVVDHVAPISLGRLILAGMVAGGVQYGWALQLSLLTPYVQTLGLSHALTSFMWLCGPIAGLVVQPLVGLYSDRCTSRWGRRRPFILTGCMLICVAVIVVGFSSDIGAALGDTXKEHCSLYHGPRWHAAIVYVLGFWLLDFSNNTVQGPARAMMADLCDHHGPSAANSIFCSWMALGNILGYSSGSTNNWHKWFPFLKTSACCEACANLKGAFLVAVVFLVLCLTVTLIFAKEVPYRANENLPTTKAGGEVETEPTGPLAVLKGFKDLPPGMPSVLLVTAITWLSWFPFILYDTDWMGREIYHGDPKGSNAQISAFNEGVRVGAFGLLLNSVILGFSSFLIEPMCRKVGPRVVWVTSNFMVCVAMAATALISFWSLRDYHGYVQDAITANASIKAVCLVLFAFLGVPLAILYSVPFAVTAQLAATRGGGQGLCTGVLNISIVIPQVIIALGAGPWDALFGKGNIPAFGVASAFALVGGVVGVFLLPKISKRQFRAVSAGGH

SEQ ID NO: 6828 - protein, 520 aa, Zea mays
MARGDGELELSVGVRGTGGAAAAAADHVAPISLGRLILAGMVAGGVQYGWALQLSLLTPYVQTLGLSHALTSFMWLCGPIAGLVVQPLVGLYSDRCTARWGRRRPFILIGCMLICLAVIVVGFSSDIGAALGDTKEHCSLYHGPRWHAAIVYVLGFWLLDFSNNTVQGPARAMMADLCGHHGPSAANSIFCSWMALGNILGYSSGSTNNWHKWFPFLMTNACCEACANLKGAFLVAVVFLVMCLTITLFFAKEVPYRGNQNLPTKANGEVETEPSGPLAVLKGFKNLPTGMPSVLLVTGLTWLSWFPFILYDTDWMGREIYHGDPKGSNAQISAFDEGVRVGSFGLLLNSIVLGFSSFLIEPMCRKVGPRVVWVTSNFMVCVAMAATALISFWSLKDYHGYVQDAITASTSIKAVCLVLFAFLGVPLAILYSVPFAVTAQLAATKGGGQGLCTGVLNISIVIPQVIIALGAGPWDALFGKGNIPAFGVASGFALIGGVVGVFLLPKISKRQFRAVSAGGH

SEQ ID NO: 6829 - protein, 809 aa, Zea mays
MSAPKLDRNPSIRDRVEDTLHAHRNELVALLSKYVNKGKGILQPHHILDALDEVQGSGGRALADGPFLDVLRSAQEAIVLPPFVAIAVRPRPGVWEYVRVNVHELSVEQLTVSEYLRFKEELVDGQHNDPYVLELDFEPFNVSVPRPNRSSSIGNGVQFLNRHLSSIMFRNRDCLEPLLDFLRGHRHKGHVMMLNDRIQSLGRLQSVLTKAEEHLSKLPADTPYSQFAYKFQEWGLEKGWGDTAGHVLEMIHLLLDIIQAPDPSTLEKFLGRIPMIFNVVVVSPHGYFGQANVLGLPDTGGQIVYILDQVRALENEMVLRLKKQGLDVSPKILIVTRLIPDAKGTSCNQRLERISGTQHTYILRVPFRNENGILKKWISRFDVWPYLETFAEDAAGEIAAELQGTPDFIIGNYSDGNLVASLLSYKMGITQCNIAHALEKTKYPDSDIFWKNFDEKYHFSCQFTADIIAMNNADFIITSTYQEIAGSKNTVGQYESHTAFTLPGLYRVVHGIDVFDPKFNIVSPGADMSIYFPHTEKAKRLTSLHGSIENLIYDPEQNDEHIGHLDDRSKPILFSMARLDRVKNITGLVEAFAKCAKLRELVNLVVVAGYNDVNKSKDREEIAEIEKMHELIKTHNLFGQFRWISAQTNRARNGELYRYIADTHGAFVQPAFYEAFGLTVVEAMTCGLPTFATLHGGPAEIIEHGVSGFHIDPYHPEQAANLMADFFERCKQDPDHWVKISGAGLQRIYEKYTWKIYSERLMTLAGVYGFWKYVSKLERLETRRYLEMFYILKFRELAKTVPLAIDQPQ

SEQ ID NO: 6830 - protein, 354 aa, Zea mays; identical to SEQ ID NO: 6235

SEQ ID NO: 6831 - protein, 348 aa, Zea mays
  unsure (1)..(348): unsure at all Xaa locations
MGVGGEKFQLGTVGALSLSVVSSVSIVICNKALMSSLGFNFATTLTSWHLLVTFCSLHVALWMKFFEHKPFDSRTVMGFGVLNGISIGLLNLSLGFNSVGFYQMTKLAIIPCTVILETLFFRKKFSRSIQMSLSVLLLGXVGVATVTDLQLNAVGSILSLLAIITTCIAQIMTNTIQKKFKVSSTQLLYQSCPYQSLTLFLIGPFLDGFLTNQNVFAFNYTSQVVFFIVLSCLISVSVNFSTFLVIGKTSPVTYQVLGHLKTCLVLAFGYVLLHDPFSWRNILGILIAVVGMVLYSYFCTVETQQKCVEVSPQQXKIARQPPLIADSMSKGENGGGGLWMKKPFERYP

SEQ ID NO: 6832 - protein, 354 aa, Zea mays
MGVGGEKFQLGTVGALSLSVVSSVSIVICNKALMSSLGFNFATTLTSWHLLVTFCSLHVALWMKFFEHKPFDSRTVMGFGVLNGISIGLLNLSLGFNSVGFYQMTKLAIIPCTVILETLFFRKKFSRSIQMSLSVLLLGVGVATVTDLQLNAVGSILSLLAIITTCIAQIMTNTIQKKFKVSSTQLLYQSCPYQSLTLFLIGPFLDGFLTNQNVFAFNYTSQVVFFIVLSCLISVSVNFSTFLVIGKTSPVTYQVLGHLKTCLVLAFGYVLLHDPFSWRNILGILIAVVGMVLYSYFCTVETQQKNVEVSPQQVKESEAGPLIADSMSKVENGGGGVDDEPLKVPMWSSKYSRE

SEQ ID NO: 6833 - protein, 505 aa, Zea mays; identical to SEQ ID NO: 791

SEQ ID NO: 6834 - protein, 619 aa, Zea mays
  unsure (1)..(619): unsure at all Xaa locations
ISDEPAPRGSRFAPLSRPMGGEVPEPRRLSRALSFGCGGVPEEALHLVFGYMDDPRDREAASLVCRLWHRIDALSRKHVTVGFCYAVEPARLLARFPRLESLALKGRPRAAMYGLIPEDFGALRXAPWVAELAAPLDCLKALHLRRMTVTDEDIAVLVRARGHMLQVLKLDKCSGFSTDALCLVARSCRSLRTLFLEECIIEDEGSEWLHELAVNNSVLVTLNFYMTELKVEPADLELLAKNCKSLISLKMGXCDLSDLIGFFQTSKALQEFAGGXAFFEVGEYTKYEKVIFPPRLCFLGGLTFMGKNEMPVIFPYSTMLKKLDLQFTFLTTEDHCQLIAKCPNLSVLEVRNVIGDRGLEVVAATCKKLRRLRIERGDDDPGQEEQGGVSQIGLTAVAVGCRELEYIAAYVSDITNGALESIGTFCKNLYDFRLVLLDKQKKITDLPLDNGVRALLRNCVKLRRFAFYLRPGGLSDVGLGYIGLYSGNIXQYMLLGNVGESDNGLIQFATGCTNLRKLELRGCCFSERALAVAVLQMPSLRYIWVQGYRASRTGQDLMLMARPYWNIEFAPPIPESAYRVMADGQPCVDTHAQVLAYYSLAGRRPDCPQWLVTLHPASL

SEQ ID NO: 6835 - protein, 555 aa, Zea mays
  unsure (1)..(555): unsure at all Xaa locations
MDSVRSWFQKFQPRDKSKRPVVAARHGKDPGKPPMDDAPSSATKQRVAAAKQYIENHYKTQMKSLQDRKERRWMLERKLQDAEVPVEEQNNILKHLEKKETEYMRLQRHKMGVEDFELLTIIGRGAFGEVRLCREKVSKNVYAMKKLKKSEMLRRGQVEHVKAERNLLAEVDSAYIVKLYYSFQDEEFLYLIMEYLPGGDMMTLLMRKDTLTEDEARFYIAETVLAIESIHKHNYVHRDIKPDNLLLDHSGHLKLSDFGLCKPLDSSNFPNLNEPDYMSGKVTTPLPDTTRLSNPSAXRRTQQEQLSHWQKNRRMLAYSTVGTPDYIAPEVLLKKGYGTECDWWSLGAIMYEMLVGYPPFYSEDPMSTCRKIVNWRSHLKFPEEAKLPPEAKALISKLLCNVEHRLGTKGAHEIKAHPWFGGVQWEKLYQMKAAFIPEVNGELDTQNFENFEEIGTQIQSSSKSGPWRKMLPSKDANFVGYTYKNFEIVNDDEVAGIAELKKKSSKPKRPTIKTMFERMDEEEPVQGSFLSMLPPEGQPSSHSSVPQEKYQPRRK

SEQ ID NO: 6836 - protein, 548 aa, Zea mays
MESEMADAPAAAIPAAAAEPLAAVAEEGEGEAEGEAPAEAAVGSTLTMERVAAAKKFIENHYRSQMKTIQERKERRFKLERQLASSQVPKEQQIDLIKDLERKETEYMRLKRHKICVDDFELLTIIGRGAFGEVRLCREKTSGNIYAMKKLKKSDMVVRGQVEHVRAERNLLAEVASHCIVKLYYSFQDTEYLYLIMEYLPGGDIMTLLMREDTLTEHVARFYIAETILAIQSIHKHNYIHRDIKPDNLLLDKNGHMKLSDFGLCKPIDCSKLSTLNEDEPMGDDNMRESMDIDSSLSNTANGRRWRSQHEQLQHWQMNRRKLAFSTVGTPDYIAPEVLLKKGYGMECDWWSLGAIMYEMLVGYPPFYADDPITTCRKIVHWRNHLKFPEDAKLSNEARDLICRLLCDVDHRIGSAGADQIKAHPWFQGVAWDKLYEMEAAFKPQVNDELDTQNFMKFEELENPPAKTGSGPSRKMMLNSKDLSFVGYTYKNFDAVKAIKISDLQRNSSLTRPSIGSIFGPSGMDSPMEPNGRDTHMHTVSSGDPMIP

SEQ ID NO: 6837 - protein, 410 aa, Zea mays
  unsure (1)..(410): unsure at all Xaa locations
ALCIWCPLRSRSISAGTVPVRHGGRTGSPKPIHCKAAVCRAAGEPLTIEEIVVDPPKAYEXRIRVICTSLCHTDITFWKAKVAPVFPRILGHEAYGVVESVGEHVEGFAAGDTVVPTFLGQCERCASCASEHSNVCDGGAVRHRPRDAARRHHXRFRDRAGGAPLHDLLAVSSFSEYTXVVDVNQVVKGRTPAVPPKLACLLSXAAPAPGVGAAWRSAKVEPGSTVAIFGLGSVGLAVVQGAKMCGASKIIGVDLNPDKEEVGRSFGVTDFVNPSQLDKRSVVEVIVEMTGGGVDYSFECIGXPSVMTDAFRCTKMGKGKTIVLGLGRDSDEVCLPSLELLFGRCVMGSLFGGLKPKTHIPVLAKKCMDKELQLDALVTHELGLQDINKAFDLLLQGKSLRCILWMDKDK

SEQ ID NO: 6838 - protein, 209 aa, Zea mays
RRRSSPTARRCTRSCSPRRRRSSQRSPLRRNACPAAVVQGAKMCGASKIIGVDLNPDKEEVGRSFGVTDFVNPSQLDKRSVVEVIVEMTGGGVDYSFECIGVPSVMTDAFRCTKMGKGKTIVLGLGRDGDEVCLPSLELLFGRCVMGSLFGGLKPKTHIPVLAKKCMDNELQLDALVTHELGLQDINKAFDLLLQGKSLRCILWMDKDK

SEQ ID NO: 6839 - protein, 419 aa, Zea mays
  unsure (1)..(419): unsure at all Xaa locations
MDDAGRPPPHAPVAVTASASASATAAPAPPQPSATAAVDRSSPDPDALYEEGMWQQMAMDSGATMQPGSYPERPGEPDCTYYLRTGLCRFGMSCRFNHPPDRNLAIASARMKGEYPERAGQPECQYYLKTGTCKFGPTCKFHHPREKAGIAGRVQLNTSGYPLXPGHCKYANTCKFHHPELFNVVPSSRGSPIYTSVHSSASAGPQSYTGTMPSWAFPRASFIPSPRWQSPSNYAPMIVPQGLVQMPSWNSYTGQLQSPGAQQTYGSSQQGEASTGNQGMLSPYRSSSFPVPQYALQRENVFPERPDEPECQYYMKTGDCKFGAVCKFHHPRVRSLPPPDCVLSPMGLPLRPGEELCKFYSRYGICKFGANCKFDHPTVVAPMVYAYGFSASASPASASTNVPMARRLLGSPPGSGYTS

SEQ ID NO: 6840 - protein, 397 aa, Zea mays
MDDAGRPPPHAPVAVTASASASATAAPAPPQPSATAAVDRSSPDPDALYEEGMWQQMAMDSGATMQPGSYPERPGEPDCTYYLRTGLCRFGMSCRFNHPPDRNLAIASARMKGEYPERAGQPECQYYLKTGTCKFGPTCKFHHPREKAGIAGRVQLNTSGYPLRPNEKECAYYLKTGHCKYANTCKFHHPELFNVVPSSRGSPIYTSVHSSASAGPQSYTGTMPSWAFPRASFIPSPRWQSPSNYAPMIVPQGLVQMPSWNSYTGQLQSPGAQQTYGSSQQGEASTGNQGMLSPYRSSSFPVPQYALQRENVFPERPDEPECQYYMKTGDCKFGAVCKFHHPRVRSLPPPDCVLSPMGLPLRPGEELCKFYSRYGICKFGANCKFDHPTVVAPMVYA

SEQ ID NO: 6841 - protein, 311 aa, Zea mays
MAASVALSSGHRMPAVGLGVWRMEKADIRGLIHTALRVGYRHLDCAADYQNEAEVGDALAEAFQTGLVKREDLFITTKLWNSDHGHVLEACKDSLKKLQLDYLDLYLIHFPVATRHTGVGTTSSALGDDGVLDIDTTISLETTWHAMEELVSMGLVRSIGISNYDIFLTRDCLAYAKIKPAVNQIETHPYFQRDSLVKFCQKHGICVTAHTPLGGSTANAEWFGTVSCLDDPVIKSLAEKYGKTPAQLVLRWGLQRDTVVIPKTSKAERLQENFDVFGFDISGEDMERMKAVDRKYRTNQPAKFWGIDLYA

SEQ ID NO: 6842 - protein, 311 aa, Zea mays
MAASVALSSGHRMPAVGLGVWRMEKADIRGLIHTALRVGYRHLDCAADYQNEAEVGDALAEAFQTGLVKREDLFITTKLWNSDHGHVLEACKDSLKKLQLDYLDLYLIHFPVATRHTGVGTTSSALGDDGVLDIDTTISLETTWHAMEELVSMGLVRSIGISNYDIFLTRDCLAYAKIKPAVNQIETHPYFQRDSLVKFCQKHGICVTAHTPLGGSTANAEWFGTVSCLDDPVIKSLADKYGKTPAQLVLRWGLQRDTVVIPKTSKVERLQENFDVFGFDISGEDMERMKAIDRKYRTNQPAKFWGIDLYA

SEQ ID NO: 6843 - protein, 321 aa, Zea mays
MDPWISSQPSLSLDLRVGLPPLSLHQAPVAVALARPKVLVEENFLLPPKKEPEVAAALESELRRMSEENRRLAEALAAVVSKYEALRSQHTEMVAASSASEGGSVSPSRKRKSESADTAPVQRLHQQHAAADLSECTSGGEPPCKRVVRDRAEEVEEEEECRPRVSKLYVRADPADLSLAVRDGYQWRKYGQKVTKDNPCPRAYFRCSFAPACPVKKKVQRSAHDASVLVATYEGDHTHGPPPSGSGSGSGASSKNAAKPPSPPRRQEAAVAVTAAAAASEMVRRNLAEQMAVTLARDPSFKAALVSALSGRILELSPTKD

SEQ ID NO: 6844 - protein, 347 aa, Zea mays; identical to SEQ ID NO: 5967

SEQ ID NO: 6845 - protein, 272 aa, Zea mays
MDPWISSQPSLSLDLRVGLPPLSLHQAPVAVALARPKVLVEENFLLPPKKEPEVAALETELRRMSEENRRLAEALAAVASKYEALRSQHKEMVSAAPAGGNASSASEGGSVSPSRKRKSESADTAPAPAQRPHPAADLSECTSGGEPPCKRVVRDRAEEVEEEEECRPRVTKLYVRADPADLSLAVRDGYQWRKYGQKVTKDNPCPRAYFRCSFAPACPVKKKVQRSAHDASVLVATYEGDHTHAPPPSGSGKNAAKPPSPARRQEAAVAVT

SEQ ID NO: 6846 - protein, 332 aa, Zea mays; identical to SEQ ID NO: 6327

SEQ ID NO: 6847 - protein, 332 aa, Zea mays; identical to SEQ ID NO: 6526

SEQ ID NO: 6848 - protein, 501 aa, Zea mays
MPPRTAPAATSTPPRKVPLRKLLRAASVACGVQFGWALQLSLLTPYVQELGIPHAFASLVWLCGPLSGLLVQPLVGHLSDRIGPAASPLGRRRPFIAAGAACIAAAVLTVGFSADLGRLFGDDVTPGSTRLGAICVYLVGFWLLDVGNNGTQGPCRAFLADLTENDPRRTRIANAYFSLFMALGNILGYATGAYSGWYSIFPFTVTESCGISCANLKSAFLLDIIVLVITTYTTVTSVQEPQTFGSDEAQNPGAEQEAFLWELFGSLRYFTLPIWMVLIVTALTWMAWFPFTLFDTDWMGREIYRGSPDNPGETQRYHDGVRMGSFGLMLNSVVLGFTSVVLEKLCRKWGAGLVWGVSNILMTLCFLAMLVITYVAKNMDYPSSGAPPTGIVVASLVVFTILGAPLAITYSIPYAMAASRVENLGLGQGLAMGILNLAIVIPQVIVSLGSGPWDQLFGGGNAPAFAVAAGASFIGGLVAILGLPRARIASSSSRRRGGTHR

SEQ ID NO: 6849 - protein, 383 aa, Zea mays
MIGASPWNRLPSGIAKPAAAAAVVVAALASSFLALPRPRAAPPPAGSGPLMSKAKVYTDVNVLRPKEYWDYEALTVQWGEQDDYEVVRKVGRGKYSEVFEGINVNNNEKCIIKILKPVKKKKIKREIKILQNLCGGPNIVKLLDIVRDQHSKTPSLIFEFVNNTDFKVLYPTLTDYDIRYYIYELLKALDYCHSQGIMHRDVKPHNVMIDHELRKLRLIDWGLAEFYHPGKEYNVRVASRYFKGPELLVDLQDYDYSLDMWSLGCMFAGMIFRKEPFFYGHDNHDQLVKIAKVLGTDGLNAYLNKYHIELDPQLEALVGRHSRKPWSKFMNADNQHLVSPEAIDFLDKLLRYDHQDRLTAREAMAHPYFLQVRAVENSRTRPQ

SEQ ID NO: 6850 - protein, 139 aa, Zea mays
  unsure (1)..(139): unsure at all Xaa locations
MVALLGRRIGVAAAAAAFIALVAFGSASSSPKSFVKSTVSAHDVVIFSKSYCPYCKRAKAVFKELELKKEPYVVELDQREDGSEIQDALLEIVGRRTVPQVFVHGKHLGGSDGTLFLXVDSYESGKLARLLNIGVKDDL

SEQ ID NO: 6851 - protein, 590 aa, Zea mays
ASRHLSTDGRHGEVEDMYTQDGTVDMKGNPAVKKGTGNWRACPYILANECCERLAYYGMSTNLVNYMKTRLGQVNSVASNNVTNWQGTCYITPLIGAFFADAYMGRFWTIAIFMIIYIFGLALLTMASSVKGLVPTSCGDKDVCHPTDAQAAVVFVALYLIALGTGGIKPCVSSFGADQFDENDEREKKSKSSFFNWFYFSINIGALVASTVLVYVQTHVGWGWGFGIPAVVMAIAVGSFFVGTPLYRHQKPGGSPLTRIAQVLVACARKWNVAVPADKSRLHETVDGESVIEGSRKLEHSEQLACLDRAAVVTAEDGAEASPWRLCSVTQVEELKSVIRLLPIWASGIVFAAVYSQMSTMFVLQGNTLDQSMGPRFKIPSATLSMVDTISVIVWVPVYDRAIVPLVRSYTGRPRGFTQLQRMGIGLVVSIFSMVAAGVLDIVRLRAIARHGLYGEDDIVPISIFWQIPQYFIIGCAEVFTFVGQLEFFYDQAPDAMRSMCSALSLTTVALGNYLSTVLVTIVTHITTRHGRIGWIPENLNRGHLDYFFWLLAVLSLLNFLAYLVIASWYKYKKTADDYPGAKGEHGTEH

SEQ ID NO: 6852 - protein, 251 aa, Zea mays; identical to SEQ ID NO: 865

SEQ ID NO: 6853 - protein, 374 aa, Zea mays
MLGAARRQLGSGPMLGQVLRRLRPAAAAEVARGYSAAAKEMTVRDALNSALDEEMSADPSVFLMGEEVGEYQGAYKISKGLLDKYGPDRVLDTPITEAGFTGIGVGAAYQGLRPVIEFMTFNFSMQAIDHIINSAAKSNYMSAGQISVPIVFRGPNGAAAGVGAQHSQCYAAWFAHVPGLKVLTPYSSEDARGLLKAAIRDPDPVIFLENELLYGESFPVSAEVLDSSFCLPIGKAKIERGGKDVTITAFSKMVGYALQAAEILSKEGISAEVINLRSIRPLDRAAINASVRKTNRLVTVEEGFPQHGIGAEICMSVVEESFEYLDAPVERIAGADVPMPYAANLERMAVPQVDDIVRAAKRACYRAVPMAAAA

SEQ ID NO: 6854 - protein, 357 aa, Zea mays; identical to SEQ ID NO: 5395

SEQ ID NO: 6855 - protein, 436 aa, Zea mays
PSPHNPDPIPQIATLGHLPIPRSPTSSALSLSDPRPRLLLLLLLLPSFVPSRSPSQSRVEIHRLRAPSPVQREEAGGQRPAMGKEGASDGGMSESVIRKVLVSYMYVAVWIFLSFSVIVYNKYILDPKMYNWPFPISLTMVHMAFCSSLAVALVRVLRVVDLPSSPAMTSQLYVSSVLPIGALYSLSLWFSNSAYIYLSVSFIQMLKALMPVAVYSIGVLFKKETFKSSAMLNMLSISFGVAIAAYGEARFDARGVALQLAAVAFEATRLVLIQILLTSKGISLNPITSLYYVAPCCLAFLVVPWVFVELPRLRAVGIFQPDLFVFGTNSLCAFALNLAVFLLVGKTSALTMNVAGVVKDWLLIAFSWSVIRDTVTPINLFGYGIAFLGVGYYNHVKLQALKAKEAQKKAAQADEEAGSLLQERDSHGDRKTDNQA

SEQ ID NO: 6856 - protein, 357 aa, Zea mays; identical to SEQ ID NO: 5542

SEQ ID NO: 6857 - protein, 357 aa, Zea mays; identical to SEQ ID NO: 5542

SEQ ID NO: 6858 - protein, 145 aa, Zea mays
MGPICGVPDFKMRGKKSDELEPVDAGDEDDDGGDDGDEDGDFGEEGEEDVSEGEGYDNPKGNETKKQRGDPEENGEEDEEEPEDQEGGGDDDDDDDDDDENGDDEDDDNGDDDEEGVDEEDDDQDEDEEEDDDEDSLQPPKKRKK

SEQ ID NO: 6859 - protein, 264 aa, Zea mays
LAPLALVLLAFQRARGYERAVLVGITYAGMRQGCGDLRGPVNDVKCMRNLLCQRFGFPGECIIMLTDDQRDPFRLPTKENIRMAMHWLVQGCSYGDSLVFHFSGIGAQVADDDGDEADGYDEAICPLDAFQSGPILDDEINEVIVRPLVHGARLHAVVDACYSATVLDLPYQCRMSRNGFWQWEDESPPSGAWKGTSGGHAVLISGYSEGKGNFAMVRDMIHTYILLIELCCLASIYIPNMHMLLLGRRAACRCPTPTRRSSGP

SEQ ID NO: 6860 - protein, 349 aa, Zea mays
  unsure (1)..(349): unsure at all Xaa locations
MNFGGNGNATIRCKYCRASLSVIPGERAIQCAQCNCVTRIRRADRIPLARPAHVPPAFQRARGKKRAVLVGITYAGARRGCGDLRGPVNDVKCMRNLLCQRFGFPGECIIMLTDDQRDPFRLPTKENIRMAMHWLVQGCSYGDSLVFHFSGIGAQVADDDGDEADGYDEAICPLDXSRAGPILDDEINEVIVRPLVHGARLHAVVDACYSATVLDLPYQCRMSRNGFWQWEDESPPSGAWKGTSGGHAVLISGYSEGKGNFAMMXTPHASVVGAMTHSFVRTLECQPRGVTYGXLLSSMRAIMKNRGGGCDLQGAIGAPIRTVANFSGVQEPNLSSSETFDIYRKQFVL

SEQ ID NO: 6861 - protein, 349 aa, Zea mays
MNFGGNGNATIRCKYCRASLSVIPGERAIQCAQCNCVTRIRRADRIPLARPAHVPPAFQRARGKKRAVLVGITYAGARRGCGDLRGPVNDVKCMRNLLCQRFGFPGECIIMLTDDQRDPFRLPTKENIRMAMHWLVQGCSYGDSLVFHFSGIGAQVADDDGDEADGYDEAICPLDAFQSGPILDDEINETIVRPLVHGARLHAVVDACYSATVLDLPYQCRMSRNGFWQWEDESPPSGAWKGTSGGHAVLISGYSEGKGNFAMMPDAHASVVGAMTHSFVRTLECQPRGVTYGHLLSSMRAIMKNRGGGCDLQGAIGAPIRTVANFSGVQEPNLSSSETFDIYRKQFVL

SEQ ID NO: 6862 - protein, 267 aa, Zea mays
MDPKMTEVTQMFARFKAAYARNDLNTCVTLLSQLKVHLTQFPSLPPLFQQTPNIVEELKLARDIYEHAVVLSVKLEDQDAFERDFCQLKPYYMDTCGIIPASPEEYPILGLNLLRLLVQNRIAEFHTELELLPVKALEHPCIKHAVELEQSFMEGAYNRVLSARQAVPHETYVYFIDLLAKTVRDEIAGCSEKGYDSLSVSDAKQMLMFSSDQDLHEYITEEHPEWEIKNGAVFFQKAKESQPCKEIPSLQLINQTLSYARELERIV

SEQ ID NO: 6863 - protein, 373 aa, Zea mays
MLGVARRRLGSGCVLAQLAQALRPAAAPARTYSAAAKEITVREALNTALDEEMSADPSVFLMGEEVGEYQGAYKISKGLLDKYGPDRVLDTPITEAGFTGIGVGAAYHGLRPIVEFMTFNFSMQAIDHIINSAAKSNYMSAGQISVPIVFRGPNGAAAGVGAQHSQCYAAWYAHVPGLKVLAPYSAEDARGLLKAAIRDPDPVVFLENELLYGESFPVSAEVLDSSFCLPIGKAKIERQGKDVTITAFSKMVGYALQAADILAKEGISAEVINLRSIRPLDRATINASVRKTNRLVTVEEGFPQHGIGAEICMSVVEDSFEYLDAPVERIAGADVPMPYAANLERMAVPQVDDIVRAAKRACYRAAVPMAATA

SEQ ID NO: 6864 - protein, 383 aa, Zea mays
MATAGKVIKCRGACRDVGGRQTAVHRGGGGSAAAGHGGAYQDPLHRALPHRRLLLGGQGANPGVPEDLRTRSGRVCFHLPSVGEGVTDVAPGDHVLPVFTGECKECAHCKSEESNMCDLLRINVDRGVMIGDGKSRFTISGQPIFHFVGTSTFSEYTVIHVGCLAKINPEAPLDKVCILSCGISTGLGATLNVAKPAKGSTVAIFGLGAVGLAAMEGARLAGASRIIGVDINPAKYEQAKKFGCTEFVNPKDHDKPVQEVLIELTNGGVDRSVECTGNVNAMISAFECVHDGWGVAVLVGVPHKDDQFKTHPMNFLSEKTLKGTFFGNYKPRTDLPNVVEMYMKKELELEKFITHSVPFSEINTAFDLMLKGESLRCIMRMED

SEQ ID NO: 6865 - protein, 381 aa, Zea mays
MASPTQGQVITCKAAVAYEPNKPLVIEDVQVAPPQAGEVRVKILFTALCHTDHYTWSGKDPEGLFPCILGHEAAGIVESVGEGVTDVQPGDHVIPCYQAECKECKFCKSGKTNLCGKVRSATGVGVMMNDMKSRFSVNGKPIYHFMGTSTFSQYTVVHDVSVAKINPQAPLDKVCLLGCGVPTGLGAVWNTAKVESGSVVAVFGLGTVGLAVAEGAKAAGASRVIGIDIDNKKFDVAKNFGVTEFVNPKEHDKPIQQVLVDLTDGGVDYSFECIGNVSVMRAALECCHKGWGTSVIVGVAASGQEIATRPFQLVTGRVWKGTAFGGFKSRTQVPWLVDKYMKKEIKVDEYITHNMNLADINDAFHLLHEGGCLRCVLAMQI

SEQ ID NO: 6866 - protein, 381 aa, Zea mays; identical to SEQ ID NO: 1187

SEQ ID NO: 6867 - protein, 562 aa, Zea mays; identical to SEQ ID NO: 1174

SEQ ID NO: 6868 - protein, 245 aa, Zea mays; identical to SEQ ID NO: 1093

SEQ ID NO: 6869 - protein, 245 aa, Zea mays; identical to SEQ ID NO: 1093

SEQ ID NO: 6870 - protein, 245 aa, Zea mays; identical to SEQ ID NO: 1093

SEQ ID NO: 6871 - protein, 245 aa, Zea mays; identical to SEQ ID NO: 5982

SEQ ID NO: 6872 - protein, 270 aa, Zea mays
  unsure (1)..(270): unsure at all Xaa locations
MFFLQWFLQVSPIEYGHVLLIPRVLDRLPQRIDPESFLLALQMAAAGPAPFFRLGYNSLGAFATINHLHFQAYYLSVPFPVEKAATHKIPLSEDTKKNGVTVSKLINYPVRGLVFEGGNTLDDLATVVSNACIWLQDNNVPYNVLISDCGKRVFLFPQCYAEKQALGEVSQELLDTQVNPAVWEISGHMVLKRRMDYEEAPETSAWKLXLAEVSLSEERFEEVKAYIFSAAGLVQYDEEEEEASDGEGPTAYVPVKVTPLPVAEGCLVLP

SEQ ID NO: 6873 - protein, 435 aa, Zea mays; identical to SEQ ID NO: 6561

SEQ ID NO: 6874 - protein, 276 aa, Zea mays; identical to SEQ ID NO: 1177

SEQ ID NO: 6875 - protein, 203 aa, Zea mays
MFQHQQQRGLHAAFLGPRAQPMKQSGSPPAQSKLYRGVRQRHWGKWVAEIRLPKNRTRLWLGTFDTAEGAALAYDEAAFRLRGDTARLNFPSLRRGGGARLAGPLHASVDAKLTAICQSLAGSKNSSSSDESAASLPDSPKCSASTEGDEDSASAGSPPSPTQAPPVPEMAKLDFTEAPWDETEAFHLRKYPSWEIDWDSILS

SEQ ID NO: 6876 - protein, 380 aa, Zea mays
MADELRSTSVGQKFHGQSVLLSRISSYSAMNNPVFNNAYSAYNVPQRSYHGMNATAGLSSVMAPSPVFASAPKEKGFSGFMIDFMMGGVSAAVSKTAAAPIERVKLLIQNQDEMLKTGRLSEPYKGIGDCFGRTIRDEGFVSLWRGNTANVIRYFPTQALNFAFKDHFKRMFNFKKDKDGYWKWFAGNLASGGAAGACSLFFVYSLDYARTRLANDAKAAKKGGERQFNGLVDVYRKTLASDGIRGLYRGFNISCVGIIVYRGLYFGMYDSLKPVLLVGTLQDNFLASFLLGWGITIGAGLASYPIDTVRRRMMMTSGEAVKYNSSLDAFKQIVAKEGTKSLFKGAGANILRAVAGAGVLAGYDKLQVVVFGKKYGSGGG

SEQ ID NO: 6877 - protein, 387 aa, Zea mays; identical to SEQ ID NO: 5791
  unsure (1)..(387): unsure at all Xaa locations

SEQ ID NO: 6878 - protein, 619 aa, Zea mays
MPKHYRPAGKKKEGNAAKYITRTKAVNYLQVSLAIFRKLCILKGVFPRQPKKKVEGNHKTYYHTKDIAFLAHDPLIEKFREIKVHRRKVKKAVAKKNRDLADRLLNRPPTYKLDRLVLERYPTFVDALRDLDDCLTMVHLFAALPAVDGERVEVKRIHNCRRLSHEWQAYISRTHSLRKTFISVKGIYYQAEVQGQKITWLTPHALQQVLTDDVDFNVMLSFLEFYETLLGFVNFKLYHSINVNYPPILDPRLEALAAELYALCRYMSAGSRRMIGNSQTDEVMEDKDEKSKAEEVIKEEKVVKNKASSKADESELRLAQLQHQLPTNEPGALMNLVEESTADDADDDDTKDCKGLFKNLKFYLSREVPRESLLFIIPAFGGTVSWEGEGAPFKEIDEDITHQIVDRPTQSHVFLSREYVQPQWVFDCVNARIILPTEGYLVGRVPPPHLSPFVDNDAEGYMPEYAETIKRLQAAARNEVLPLPGIGDEDLDNSLVAAMMDRTASNEAAEKKRKLEMLEKQYIDELKKEIDGVAFSSLSNKEADKSPNAKDDTQSDREEDASKQEEDDDDDIGTALMSRKQRGLYKAMKMGKEKKKEKVELLKKRKKNADSGASSKKRH

SEQ ID NO: 6879 - protein, 712 aa, Zea mays
  unsure (1)..(712): unsure at all Xaa locations
MEVNSSGEETVIKVRKPYTITKQRERWTEAEHKRFLEALKLYGRAWQRIEEHVGTKTAVQIRSHAQKFFTKLEKEAINNGTSPGQAHDIDIPPPRPKRKANSPYPRKSGLSSETPTKELPSDKSTKPNMPLSNENVLXQKFQRKELSGKESCSEVLNLFRDAPSPSFSSVNKSSSNHGAPIEASKTKIRDMTIMENSSLNPNMQEDVKEINDQEMERLNGTQISSKCEHSHEGYLDISMQQMKLKPESVETTYVDKQTARASHSLAERTGTTSIPVTATEETHSVLTSDQVGINGSMNLSIHPMFPADPKFDSSATPQPFPHNYAAFAPMMQCNCNQDTHRSLVNMSSTFSSMLVSTLLSNPAIHAAARLAASYWPAAEGNTPIDPNQENLADGVQGRSIGSPPSMASIVAATVAAASAWWATQGLLPFFAPPMAFSFVPAPSAAFPTVDVPRPSEKDRDCPAENAQKECQEARKQGQFEGFRVAASSEYDGSGKGEVSVHTELKISPVQNADATSAAGADTTDAFMNKKKQDRSSCGSNTPSSSDVDVDNVPEKEGNGNEKAKQASCSNSSAGDTNHRRFRSSGSTSDSWKEVSEEGRLAFHALFSREKLPQSFSPPQAEGSKEVGKEEEDEVTTVAVDLNKSTTSIDHDLDTIGEPRASFPNELSPLKLKLRRTGFKPYKRCSVEAKENRVPASDEVGTKRIRLDSEAST

SEQ ID NO: 6880 - protein, 712 aa, Zea mays; identical to SEQ ID NO: 6879
  unsure (1)..(712): unsure at all Xaa locations

SEQ ID NO: 6881 - protein, 720 aa, Zea mays; identical to SEQ ID NO: 643

SEQ ID NO: 6882 - protein, 424 aa, Zea mays
  unsure (1)..(424): unsure at all Xaa locations
SAKKKKKKKKKKKKTPPWSGLLSKRAAPLYNSSSGAGTPTPPAYSALLQTKLNPILARVHDGGSRRWWGPAEGGAERXAVRRWVDXAAGGRLVLDGGLATELEANGADLNDPLWSAKCLLSSPHLIRKVHMDYLEAGANIIITASYQATIQGFESKGFSKEQSENLLTKSVQIALEAREMFLKEHLEKSTPIQHPILVAAALGSYGAYLADGSEYSGDYGEAGTKEFLKDFHRRRLQVLAEAGPDLIAFETIPNKLEAQAYVELLEECNINIPSWLSFNSKDGVHVVSGDSLIECATIADKCAKVGAVGINCTPPRFIHGLILSIRKVTDKPILIYPNSGERYDGEKKEWVESXTGVSDGDFVSYVNEWCKDGAALIGGCCRTTPNTIRAIHRTLNQGCHKHQLPVGCSIDLCSTPDALLPAVP

SEQ ID NO: 6883 - protein, 1074 aa, Zea mays; identical to SEQ ID NO: 1025

SEQ ID NO: 6884 - protein, 300 aa, Zea mays
MSDGAGSRTGVAGALGLSVTSSVAIVICNKYLISTLGFFFATTLTSWHLMVTFFTLYVAQRLRFFEPKPIDARTVISFGLLNGISIGLLNLCLGFNSVGFYQMTKLAIIPFTIVLETLFLSKKFSQSIKASLMVLLLGVGIASVTDLQLNLLGSIIAVLTIAATCVGQILTNQIQRRLKVSSTQLLYQSSPYQSAVLLVTGPFVDKLLTKRDVFAFSYTTQVVVFILLSCSIAVCVNFSTFLVIGTTSPVTYQVLGHLKTCLVLSFGYIILKDPFSARNVVGIEMAMGTRDPIPGGYLLH

SEQ ID NO: 6885 - protein, 565 aa, Zea mays
  unsure (1)..(565): unsure at all Xaa locations
MATTTRVAAAATGVLLVLSALATLARAEDPYLFFEWKVTYGTKSLLGVXPQKVILINGEFPGPRINCSSNNNIVVNVFNQLDHPLLFTWNGMQHRKNSWMDGMPGTQCPILPNTNFTYKWQPKDQIGSFFYFPSIGMQRGGGAATGPISVVSRLLIPVPFXSPRPENDHVVLIGDWXTKDHEVLXRQIDARQGRGAAPAGVLINGKGGKDLEAAPAFTFEAGKTYRLRVCNTGIKXSLNFRIQGHYMKLVELEGXSHTLQNTYDSLDVHVGHCLSVLVDAXQKPGDYYMVASTRFIHDAKSASAVIRYAGSSAPPAXNMTEPPAGWAWSINQARSFRWNXLTASAARPNPQGSYHYGQINITRTIKVMVSRGHIDGKLRYGFNGISHRDPETPVKLAEYFNVTDGVFSYNQMGRRAPRRERVPSMXIPNVITAEFRTFIEIVFENPEKSIDSLHVDGYAFFGVGMGPGKWSPEVRKTYNLLDTVSRHTIQVYPRSWTAIMLTFDNAGMWSVHSNIWERYYLGEQFYISVVSPARSLRDEYNMPDNALRCGKVVGLPLPPSYAPAR

SEQ ID NO: 6886 - protein, 268 aa, Zea mays
  unsure (1)..(268): unsure at all Xaa locations
MDPKMTEVTQMFARFKAAYARNDLNTCVTLLSQLKVHLTQFPSLPPLFQQTPNIVEELKLARDIYEHAVVLSVKLEDQDAFERDFCQLKPYYMDTCGIIPASPEEYPILGLNLLRLLVQNRIAEFHTELELLPAKALEHPCIKHAVELEQSFMEGAYNRVLSARQAVPHETYVYFIDLLAKTVRDEIAGCSEKGYDSLSVSDAKQMLMFSSDQDLHEYITEEHPEWEIKNGAVFFQKAKESQXPCKEIPSLQLINQTLSYARELERIV

SEQ ID NO: 6887 - protein, 340 aa, Zea mays; identical to SEQ ID NO: 1193

SEQ ID NO: 6888 - protein, 196 aa, Zea mays
  unsure (1)..(196): unsure at all Xaa locations
MAAQEQEQEQEKQQAKTSTTSSLPSSSERSSSSARNNLTEGGAESDEEIRRVPEMGGASASASSGAGADERPKGEDGKQXAGGGGGAAXAGGKKRGRTAGDKEQNRLKRLLRNRVSAQQARERKKAYLTELEAKAKGLELRNAELEQRVSTLQNENNTLRQILKNTTAHASKRSGGGGGGGGKGGDGGKKHHLAKS

SEQ ID NO: 6889 - protein, 333 aa, Zea mays
MLLSADLQWAHSLHSPVNTGRTWSPGATSVTPSPTLSMIPPGDHVLPVFTGECKECAHCKSAESNMCDLLRINTDRGVMIADGKSRFSINGKPIYHFVGTSTFSEYTVMHVGCVAKINPQAPLDKVCVLSCGISTGLGASINVAKPPKGSTVAVFGLGAVGLAAAEGARIAGASRIIGVDLNPSRFEEARKFGCTEFVNPKDHNKPVQEVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFAEINKAFDLMAKGEGIRCIIRMEN

SEQ ID NO: 6890 - protein, 379 aa, Zea mays; identical to SEQ ID NO: 5489

SEQ ID NO: 6891 - protein, 381 aa, Zea mays
  unsure (1)..(381): unsure at all Xaa locations
MATAGKVIKCKAAVAWEAGKPLSIEEVEVAPPQAMEVRVKILFTSLCHTDVYFWEAKGQTPVFPRIFGHEAGGIIESVGEGVXTDVAPGXDHVLPVFTGECKECAHCKSAESNMCDLLRINTDRGVMIADGKSRFSINGKPIYHFVGTSTFSEYTVMHVGCVAKINPQAPLDKVCVLSCGISTGLGASINVAKPXKGSTVAVFGLGAVGLAAAEGARIAGASRIIGVDLNPSRFEEARKFGCTEFVNPKDHNKPVQEVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFAEINKAFDLMAKGEGIRCIIRMEN

SEQ ID NO: 6892 - protein, 379 aa, Zea mays; identical to SEQ ID NO: 5489

SEQ ID NO: 6893 - protein, 131 aa, Zea mays
PRVRRYLAEFKSGAERKDAAESTMNAYKAAQDIALADLAPTHPIRLGLALNFSVFYYEILNSPDRACNLAKQAFDEAISELDSLGEESYKDSTLIMQLLRDNLTLWTSDTNEDGGDEIKDAAAPKESAEGQ

SEQ ID NO: 6894 - protein, 272 aa, Zea mays
  unsure (1)..(272): unsure at all Xaa locations
MSPSEPTREESVYMAKLAEQAERYEEMVEFMERVARYRRGAPAXGEELSVEERNLLSVAYKNVIXARRASWRIISSIEQKEEGRGNEAHAASIRXYRSKIEAELARICDGILALLDSHLVPSAXGAESKVFYLKMKGDYHRYLAEFKSGAERKDAXAESTMNAYKAAQDIALADLAPTHPIRLGXLALNFSVFYYEILNSPDRACNLAKQAFDEAISELDSLGEESXYKDSTLIMQLLRDNLTLWTSDTNEDGGDEIKEAAAAPKESAPEGQ

SEQ ID NO: 6895 - protein, 349 aa, Zea mays
  unsure (1)..(349): unsure at all Xaa locations
MAAKRGRASLGMGNPLLDISAXVVDDAFLXKYDIKLNNAILAXEEKHLAYGIDELASNSNVEYIXAGGATQNSXFRVAQWMLQXTPGATSYMGCIGKDKFGEEMKKNAQAAGVTAHYYEDETAPTGTCAVCVVGGERSLIANLSAANCYKSEHLKRPENWALVEKAKYIYIAGFFLTVSPDSIQLVAEHAAANNKVFLMNLSAPFICEFFYDAQEKVLPYADFIFGNETEAKIFAKVRGWETENVEEIALKISQLPLASGKQKRIAVITQGADPVVVAEDGKVKTFPVILLPKEKLVDTNGAGDAFVGGFLSRLVQGKSIEDCVTAGCYAANVVIQRPGCTYPEKPDFN

SEQ ID NO: 6896 - protein, 380 aa, Zea mays
  unsure (1)..(380): unsure at all Xaa locations
TRPRTRGRARALALSSNTSLRSQSPAPPLRSXEGRREEMAATEGVLLGMGNPLLDISAVVDDAFLTKYDIKLNNAILAEEKHLPMYDELASKSNVEYIAGGATQNSIRVAQWMLQTPGATSYMGCIGKDKFGEEMKKNAQAAGVTAHYYEDETAPTGTCAVCVVGGERSLIANLSAANCYKSEHLKRPENWALVEKAKYIYIAGFFLTVSPDSIQLVAEHAAANNKVFLMNLSAPFICEFFRDAQEKVLPYADYIFGNETEAKIFAKVRGWETENIEEIALKISQLPLASGKQKRIAVITQGADPVVVAEDGKVKTFPVILLPKEKLVDTNGAGDAFVGGFLSQLVLGKGIEDCVRAGCYAANVIIQRPGCTYPEKPDFN

SEQ ID NO: 6897 - protein, 182 aa, Zea mays
MKGAERFIRNTFFLTVSPDSIQLVAEHAAANNKVFLMNLSAPFICEFFRDAQEKVLPYADYIFGNETEAKIFAKTENIEEIALKISQLPLASGKQKRIAVITQGADPVVVAEDGKVKTFPVILLPKEKLVDTNGAGDAFVGGFLSQLVLGKGIEDCVRAGCYAANIIIQRPGCTYPEKPDFN

SEQ ID NO: 6898 - protein, 195 aa, Zea mays
MASHQDKASYQAGETKARTEEKTGQAVGATKDTAQHAKDRAADAAGHAAGKGQDAKEATKQKASDTGGYLGKKTDEAKHKAGETTEATKQKASETTEATKQKAGETTEAARQKAADAMEAAKQKAAEAGQYAKDTAVSGKDKSGGVIQQATEQVKSAAAGAKDAVMSTLGMGGDDKQGDANTNTNKDSSTITRDH

SEQ ID NO: 6899 - protein, 493 aa, Zea mays
MVLSHGVGGSDESVHSTFASRYVRTSLPRYRMPEQSIPKEAAYQIINDELMLDGNPRLNLASFVTTWMEPECDKLIQASVNKNYVDMDEYPVTTELQNRCVNMIAHLFNAPLGDAETAVGVGTVGSSEAIMLAGLAFKRRWQNKMKAAGKPCDKPNIVTGANVQVCWEKFARYFEVELKEVKLSDGYYVMDPQKAVDMVDENTICVAAILGSTLNGEFEDVKLLNDLLTKKNAETGWDTPIHVDAASGGFIAPFLYPELEWDFRLPLVKSINVSGHKYGLVYAGIGWCIWRTKADLPEELIFHINYLGADQPTFTLNFSKGSSQVIAQYYQLIRLGFEGYKNIMENCQENATVLKQGLEKTGKFNIVSKDNGVPLVAFSLKGSSRHNEFEISDFLRRFGWIVPAYTMPPDAQPVTVLRVVIREDFSRTLAERLVLDIEKVLHELDALPARVPSGDLAALAAAESSEREMEKQRQVISLWKRAVLAKKKTNGVC

SEQ ID NO: 6900 - protein, 186 aa, Zea mays
MASHQDKASYQAGETKARTELDVQEKTGQAVGATKDTAQHAKDRAADAAGHAAGKGQDAKEATKQKASDTGSYLGKKTDEAKHKAGETTEATKQKAGETTEAAKQKAADAMEAAKQKAAEAGQYAKDTAVSGKDKSGGVIQQATEQVKSAAAGAKDAVMSTLGMGGDDKQGDANTNKDSSTITRDH

SEQ ID NO: 6901 - protein, 197 aa, Zea mays
MASHQDKASYQAGETKARTEEKTGQAVGATKDTAQHAKDRAADAAGHAAGKGQDAKEATKQKASDTGSYLGKKTDEAKHKAGETTEATKQKASETTEATKQKAGETTEAARQKAADAMEAAKQKAAEAGQYAKDTAVSGKDKSGGVIQQATEQVKSAAAGAKDAVMSTLGMGGDDKQGDANTNTNTNKDSSTITRDH

SEQ ID NO: 6902 - protein, 253 aa, Zea mays; identical to SEQ ID NO: 6729

SEQ ID NO: 6903 - protein, 242 aa, Zea mays; identical to SEQ ID NO: 6449

SEQ ID NO: 6904 - protein, 262 aa, Zea mays
  unsure (1)..(262): unsure at all Xaa locations
MASAELSREENVYMAKLAEQAERYEEMVEFMEKVAKTVDSEELTVEERNLLSVAYKNVIGARRASWRIISSIEQKEEGRGNEDRVTLIKDYRGKIETELTKICDGILKLLETHLVPSSTAPESKVFYLKMKGDYYRYLAEFKTGAERKDAAENTMVAYKAAQDIALAELAPTHPIRLGLALNFSVFYYEILNSPDRACSLAKQAXFDEAISELDTLSEESYKDSTLIMQLLRDNLTLWTSDISEDPAEEIREAPKRDSSEGQ

SEQ ID NO: 6905 - protein, 266 aa, Zea mays
  unsure (1)..(266): unsure at all Xaa locations
MASAELSREENVYMAKLAEQAERYEEMVEFMEKVAKTVDSXELTVEERNLLSVAYKNVIGARRASWRIISSIEQKEEGRGNEDRVTLIKDYRGKIETELTKICDGILKLLESHLVPSSTAPESKVFYLKMKGDYYRYLAEFKTGAERKDAAENTMVAYKAAQDIXALAELAPTHPIRLGLALNFSVFYYEILNSPRSRPGSLAKQXAFDEAISELDTLSEESYKDSTLIMQLLRDNLTLWXTSDISEDPXAEEIREAPKHDSSEGQ

SEQ ID NO: 6906 - protein, 261 aa, Zea mays
MASAELSREENVYMAKLAEQAERYEEMVEFMEKVAKTVDSEELTVEERNLLSVAYKNVIGARRASWRIISSIEQKEEGRGNEDRVTLIKDYCGKIETELTKICDGILKLLESHLVPSSTAPESKVFYLKMKGDYYRYLAEFKTGAERKDAAENTMVAYKAAQDIALAELAPTHPIRLGLALNFSVFYYEILNSPDRACSLAKQAFDEAISELDTLSEESYKDSTLIMQLLRDNLTLWTSDISEDPAEEIREAPKHDSSEGQ

SEQ ID NO: 6907 - protein, 261 aa, Zea mays; identical to SEQ ID NO: 6426

SEQ ID NO: 6908 - protein, 577 aa, Zea mays
  unsure (1)..(577): unsure at all Xaa locations
SGQDWPEALQQSHAPRHQCKSPDPSTLEKFLGTIPMVFNVVILSPHGYFAQANVLGYPDTGGQVVYILDQVRAMENEMLLRIKQCGLDITPKILIVTRLLPDATGTTCGXQRLEKVLGTEHCHILRVPFRTENGIVRKWISRFEVWPYLETYTDDVAHEIAGELQANPDLIIGNYSDGNLVACLLAHKMGVTHCTIAHALEKTKYPNSDLYWKKFEDHYHFSCQFTTDLIAMNHADFIITSTFQEIAGNKDTVGQYESHMAFTMPGLYRVVHGIDVFDPKFNIVSPGADLSIYFPYTESHKRLTSLHPEIEELLYSQTENTEHKFVLNDRNKPIIFSMARLDRVKNLTGLVELYGRNKXRLQELVXNLVVVCGDHGNPSKDKEEQAEFKKMFDLIEQYNLNGHIRWISAQMNRVRNGELYRYICDTKGAFVQPAFYEAFGLTVVEAMTCGLPTFATAYGGPAEIIVHGXVSGYHIDPYQGDKXASALLVDFFDKCQAEPSHWSKISQGGLQRIEEKYTWKLYSERLMTLTGVYGFWKYVSNLERRETRRYLEMLYALKYRTMASTVPLAVEGEPSSK

SEQ ID NO: 6909 - protein, 789 aa, Zea mays
  unsure (1)..(789): unsure at all Xaa locations
MGEGAGDRVLSRXLHSVRERIGDSLSAHPNELVAVFTRLKNLGKGMLQPHQIIAEYNNAIPEAEREKLKDGAFEDVLRAAQEAIVIXPPWVALAIRPRPGVWEYVRVNVSELAVEELRVPEYLQFKEQLGGRKAPTTTFGLELDFEPFNASFPRPSLSKSIGXMGVQFLNRHLSSKLXFHDKGEHVPLCSTSFRAHNYKGDXPMMLNDRIRSLSALQXGCAEERAEEHLSTXLQADTPYSEFHHRFQELGLEKGWGDCAKRAQETIHLLLDLLEAPDPSTLEKFLGTIPMVFNVVILSPHGXYFAQANVLGYPDTGGQVVYILDQVRAMENEMLLRIKQCGXLDITPKILIVTRLLPDATGTTCGQRLEKVLGTEHCHILRVPFRTENGIVRKWISRFEVWPYLETYTDDVAHEIAGELQANPDLIIGNYSDGNLVACLLAHKMGVTHCTIAHALEKTKYPNSDLYWKKFEDHYHFSCQFTTDLIAMNHADFIITSTFQEIAGNKDTVGQYESHMAFTMPGLYRVVHGIDVFDPKFNIVSPGADLSIYFPYTESHKRLTSLHPEIEELLYSQTENTEHKFVLNDRNKPIILVCYLQIGGARLDRVKNLTGLVELYGRNKRLQELVNLXVVVCGDHGNPSKXDKEEQAEFKKXMFDLIEQYNLDGHIXRWISAQMNRVRNGELYRYICDTKGAFVQPAFYEAXFGLTVVEAMTCGLPTFATAYGGPGRDHRARRVWLPHRPLXPGRQGVGPARGLLRQVPGGPEPLEQDLPRAGSSVSRRSTPGSSTRRG

SEQ ID NO: 6910 - protein, 816 aa, Zea mays
MGEGAGDRVLSRLHSVRERIGDSLSAHPNELVAVFTRLKNLGKGMLQPHQIIAEYNNAIPEAEREKLKDGAFEDVLRAAQEAIVIPPWVALAIRPRPGVWEYVRVNVSELAVEELRVPEYLQFKEQLVEEGPNNNFVLELDFEPFNASFPRPSLSKSIGNGVQFLNRHLSSKLFHDKESMYPLLNFLRAHNYKGMTMMLNDRIRSLSALQGALRKAEEHLSTLQADTPYSEFHHRFQELGLEKGWGDCAKRAQETIHLLLDLLEAPDPSTLEKFLGTIPMVFNVVILSPHGYFAQANVLGYPDTGGQVVYILDQVRAMENEMLLRIKQCGLDITPKILIVTRLLPDATGTTCGQRLEKVLGTEHCHILRVPFRTENGIVRKWISRFEVWPYLETYTDDVAHEIAGELQANPDLIIGNYSDGNLVACLLAHKMGVTHCTIAHALEKTKYPNSDLYWKKFEDHYHFSCQFTTDLIAMNHADFIITSTFQEIAGNKDTVGQYESHMAFTMPGLYRVVHGIDVFDPKFNIVSPGADLSIYFPYTESHKRLTSLHPEIEELLYSQTENTEHKFVLNDRNKPIIFSMARLDRVKNLTGLVELYGRNKRLQELVNLVVVCGDHGNPSKDKEEQAEFKKMFDLIEQYNLNGHIRWISAQMNRVRNGELYRYICDTKGAFVQPAFYEAFGLTVVEAMTCGLPTFATAYGGPAEIIVHGVSGYHIDPYQGDKASALLVDFFDKCQAEPSHWSKISQGGLQRIEEKYTWKLYSERLMTLTGVYGFWKYVSNLERRETRRYLEMLYALKYRTMASTVPLAVEGEPSSK

SEQ ID NO: 6911 - protein, 847 aa, Zea mays
  unsure (1)..(847): unsure at all Xaa locations
MGEGAGDRVLSRLHSVRERIGDSLSAHPNELVAVFTRLKNLGKGMLQPHQIIAEYNNAIPEAEREKLKDGAFEDVLRAAQEAIVIPPWVALAIRPRPGVWEYVRVNVSELAVEELRVPEYLQFKEQLVEEGPNNNFVLELDFEPFNASFPRPSLSKSIGNGVQFLNRHLSSKLFHDKESMYPLLNFLRAHNYKGMTMMLNDRIRSLSALQGALRKAEEHLSTLQADTPYSEFHHRFQELGLEKGWGDCAKRAQETIHLLLDLLEAPDPSTLEKFLGTIPMVFNVVILSPHGYFAQANVLGYPDTGGXVVYILDQVRAMENEMLLRIXKQCGLDITPKILIVTQVAPXDPTGTTCGQRLEKVLGTEHCHILRVPFRTENGIVSQVDLRELKVWPYLETYTDDVAHEIAGELQANPDLIIGNYSDGNLXVACLLAHQDGVXTHCTIAHALEKTKYPNSDLYWKKFEDHYHFSCQFTTDLIAMNHADFIHXITSTFQEIAGNKDTVGQYESHMXAFTMPGLYRVVHGIXDVFDPKFNIVSPGADLSIYFPYTXESHKRLTSXLHPEIEELLYSQTENTEHKFVXLTTANKPIIFSMARLDRVKNLTGLVEXLYGRNKRLQEPGEPSWVVCGDHGNPSKXDKEEQAEFKKXMFDLIEQYNPERAHPAWISAQMNRVRNGELYRYICDTKGAFVQPAFYEAFGLTVVEAMTXCGLPTFATAYXGGPAEIIVHGVSGYHIDXPYQGDKASALLVDFFDKCQADPSHWSKISXQGGLQRIEEKYTWKLYSERLMTLTGVYGFWKYVSNLERRETXRRYLEMLYALKYRTMASTVPLAVEGRALPASDARRRPQT

SEQ ID NO: 6912 - protein, 257 aa, Zea mays
MSREDNVYMAKLAEQAERYEEMVEYMEKVAKTVDVEELTVEERNLLSVAYKNVIGARRASWRIISSIEHKEESRKNEEHVIQIKEYRGKIEAELSNICDGILKLIDSHLVPSSTAAESKVFYLKMKGDYHRYLAEFKTGAERKEAAESTMIAYKAAQDIALAELASTHPIRLGLALNFSVFYYEILNSPDKACNLARQAFDEAISQLDTLGEDSYKDSTLIMQLLRDNLTLWTADSTTEDGIEEGNEASKGDAGEGQ

SEQ ID NO: 6913 - protein, 252 aa, Zea mays
MSREENVYMAKLAEQAERYEEMVEYMEKVAKTTDVQELTVEERNLLSVAYKNVIAAPRASWRIISSIEQKEESRKNEEHVAQIKEYRGKIEAELSNICDGILKLLDTHLVPSSTATESKVFYLKMKGDYHRYLAEFKTGAERKESAESTMVAYKAAQDIALAELPPIHPIRLGLALNFSVFYYEIQNSPDKACNLAKEAFDEAISQLDMLGEDSYKDSNLIMQLLRDNLTLWTEDGIEEGLESSKGDAGEGQ

SEQ ID NO: 6914 - protein, 465 aa, Zea mays
  unsure (1)..(465): unsure at all Xaa locations
MAQRAGKTRIHRSRPIGRPARARGATRRGGGVAEIKRLYPGRHRPLFLKVRSRGRRPDRLPFPASGAQGQANSFEVVMADQANQPTVLHKLGGQFHLSSSFSEGVRARNICPSFSPYERRFATRNYMTQSLWGPSMSVSGGINVPVMPTPLFANAPAEKGGKNFMIDFMMGGVSAAVSKTAAAPIERVKLLIQNQDEMIKSGRLSEPYKGIADCFKRTIKDEGFSSLWRGNTANVIRYFPTQALNFAFKDYFKRLFNFKKDRDGYWKWFAGNLASGGAAGASSLFFVYSLDYARTRLANDAKAAKGGGDRQFNGLVDVYRKTLKSDGIAXGLYRGFNISCVGIIVYRGLYFGLYDSIKPVVLTGSLQDNFFASFALGWLITNGAGLASYPIDTVRRRMMMTSGEAVKYKSSLDAFQQILKKEGPKSLFKGAGANILRAIAGAGVLSGYDQLQILFFGKKYGSGGA

SEQ ID NO: 6915 - protein, 308 aa, Zea mays
PTRLDHLIMIDFMMGGVSAAVSKTAAAPIERVKLLIQNQDEMIKSGRLSEPYKGIADCFKRTIKDEGFSSLWRGNTANVIRYFPTQALNFAFKDYFKRLFNFKKDRDGYWKWFAGNLASGGAAGASSLFFVYSLDYARTRLANDAKAAKGGGDRQFNGLVDVYRKTLKSDGIAGLYRGFNISCVGIIVYRGLYFGLYDSIKPVVLTGSLQDNFFASFALGWLITNGAGLASYPIDTVRRRMMMTSGEAVKYKSSLDAFQQILKKEGPKSLFKGAGANILRAIAGAGVLSGYDQLQILFFGKKYGSGGA

SEQ ID NO: 6916 - protein, 258 aa, Zea mays
  unsure (1)..(258): unsure at all Xaa locations
MADQANQPTVLHKLGGQFHLRSIISEGVRARNICPSVSSYERRFATRNYMTQSLLGPSMSVSGGINVPVMRTPLCANAPAEKGGKNFMIDFMMGGVSAAVSKTAAAPIERVKLLIQNQDEMIKSGRLSEPYKGIVDCFKRTIKXDEGFSSLWRGNTANVIRYFPTQALNFAFKDYFXKRLFNFKRDRDGYMGKWVCWQPGPLGGAAGASSFVFCVLPWTTRRTRVGNDAKAAQGGGXRQFMGLVDVYARTQSDGICWL

SEQ ID NO: 6917 - protein, 170 aa, Zea mays
MQEQAASSRPSSSERSSSSGHHVDMEVKEGMESDDEIRRVPELGLELPGASTSGREAGPGAAGADRALAQSSTAQASARRRVRSHADKEHKRLKRLLRNRVSAQQARERKKAYLTDLEVKVRDLEKKNSEMEERLSTLQNENQMLRQILKNTAVNRRGSGSTASGEGHGQ

SEQ ID NO: 6918 - protein, 168 aa, Zea mays
MQEQPASSRPSSSERSSSSAHHMDMEVKEGMESDEEIRRVPELGLELPGASTSGREVGPGAAGADRALAQSSTAQASARRRVRSPADKEHKRLKRLLRNRVSAQQARERKKAYLTDLEVKVKDLEKKNSEMEERLSTLQNENQMLRQILKNTTVSRRGSGSTASGEGQ

SEQ ID NO: 6919 - protein, 186 aa, Zea mays
KRSLVRRKAVNLIKEYRGKIEAELSNICDGILKLLDSHLVPSSTAAESKVFYLKMKGDYHRYLAEFKTGAERKESAESTMVAYKAAQDIALAELAPTHPIRLGLALNFSVFYYEILNSPDKACNLAKQAFDEAISELDTLGEESYKDSTLIMQLLRDNLTLWTSDLTEDGADECKEASKGDAGEGQ

SEQ ID NO: 6920 - protein, 186 aa, Zea mays
  unsure (1)..(186): unsure at all Xaa locations
AGRKKEESRKNEEHVNLIKEYRAKIEAELSNICDGILKLLDSHLVPSSTAAESKVFYLKMKGDYHRYLAEFKTGPERKESAESTMMAYKAAQDIALAELAPTHPIRLGLALNFSVFYYEILNSPDKACNLAKQAFDEAISQLDTLGEESYKDSTLIMQLLRDNLTLWTSDLTEXDGADEGKEAPKG

SEQ ID NO: 6921 - protein, 256 aa, Zea mays
  unsure (1)..(256): unsure at all Xaa locations
MSREENVYMAKLAEQAERYEEMVEYMEKVAKTVDVEELTVEERNLLSVAYKNVIGARRASWRIVSSIEQKEESRKNEEHVNLIKEYRGKIEAELSNICDGILKLLDSHLVPSSTAAESKVFYLKMKGDYHRYLAEFKTGAERKESAESTMVAYKAAQDIALAELAPTHPIRLGLALNFSVFYYEILNSPDKACXLAKQAFDEAISELDSLGEESYKDSTLIMQLLRDNLTLWTSDLTEDGADEGKDAPKGDAGEGQ

SEQ ID NO: 6922 - protein, 256 aa, Zea mays
MSREENVYMAKLAEQAERYEEMVEYMEKVAKTVDVEELTVEERNLLSVAYKNVIGARRASWRIVSSIEQKEESRKNEEHVNLIKEYRGKIEAELSNICDGILKLLDSHLVPSSTAAELKVFYLKMKGDYHRYLAEFKTGAERKESAESTMVAYKAAQDIALAELAPTHPIRLGLALNFSVFYYEILNSPDKACNLAKQAFDEAISELDSLGEESYKDSTLIMQLLRDNLTLWTSDLTEDGADEGKDAPKGDAGEGQ

SEQ ID NO: 6923 - protein, 430 aa, Zea mays
  unsure (1)..(430): unsure at all Xaa locations
LGTSRPAAIQTAVLIETLTALGAEVRWCSCNIFSTQDHAAAAIARDSAAVFAWKGETLEEYWWCTERCLDWGEAGGPDLIVDDGGDATLLIHEGVKAEEDYEKTGKIPDPESTDNAEFKIVLTIIRDGLKADPKKYRKMKERLVGVSEETTTGVKRLYQMQETGALLFPAINVNDSVTKSKFDNLYGCRHSLPDGLMRATDVMIAGKVAVVCGYGDVGKGCAAALKQAGARVIVTEIDPICALQALMEGLQVLPLEDVVSEADIFVTTTGNKDIIMVDHMRKMKNNAIVCNIGHFDNEIDMLGLETYPGXVKRITIKPQTDRWVFPETNTGIIVLAEGRLMNLGCATGHPSFVMSCSFTNQVIAQLELWKEKSSGKYEKKVYVLPKHLDEKVAALHLGKLGAKLTKLTKSQADYISVPIEGPYKPAHYRY

SEQ ID NO: 6924 - protein, 134 aa, Zea mays
MSEEKHHHFFHHHKKDGEEQPTGEYGYSETVAAEVVTTGEDEYEKYKKEEKEHKHKQHLGEAGAIAAGAFALYEKHEAKKDPEHAHRHKITEEVAAAAAVGAGGYAFHEHHEKKKDHKDADEASGEKKHHHLFG

SEQ ID NO: 6925 - protein, 145 aa, Zea mays
MAEEKHHHHHLFHHKKDEEQLEQPVAGGGYGYGEAAEYTETTVTEVVSTGGEDEYDTYKKEEKEHKHKQHLGEAGAIAAGAFALYEKHEAKKDPEHAHRHKIEEEIAAAAAVGSGGFAFHEHHEKKKDHKEAEEAAGEKKHHFFG

SEQ ID NO: 6926 - protein, 131 aa, Zea mays; identical to SEQ ID NO: 1069

SEQ ID NO: 6927 - protein, 152 aa, Zea mays
LRPVHPSSSSFHYPWLRRSTTHHHLFHHKKDEEQAAAGGYGESAEYTEATVTEVVSTGENEFDEYKKEEKEHKHKQHLGEAGAIAAGAFALYEKHEAKKDPEHAHRHKIEEEVAAAAAVGSGGFAFHEHHEKKKDHKEAEEAGGEKKHHFFG

SEQ ID NO: 6928 - protein, 631 aa, Zea mays
MGGGADEVVKVVDSEDGEGEEEEAEAAAAEGSSKETPMLPRMPVRVLLAEGDDSTRHVISALLRKCGYRVAAASDGVKAWDILKEKSFNIDLVLTEVELPLMSGFLLLSTIMEHDASKNIPVIMMSSHDSVSMVFKCMLKGAADFLVKPLRKNELRNLWQHVWRKQLANGGPDVQHIQEENLAERMEQKTGVTKADNLNSDGPHKNRECSEQESDAQSSCTRSELEAESKQTNNILEYMQSTERHLFIRSHKDLELNGETKTRTKGNNLIPTREDDLLPKKRTCLNDNDSERTSRDMELVHIMDNQQKHDTQRDVDTMRTTSRGNDEKNSIPAHQLELSLRRTDYGKLENHEKNDRRTLNHSTSSAFYLYNCRTASSLGNAGDGQLCSTSETLVDVENRNGDLAALSEDTTETNRPPIRVVPFPVPVQCFTFDGQPFWNGTPVASPFYPQSAPPIWNSKTPTWQESTPQATSLPQKSQQNEPVEMDAKPVENAEEQFVVGPPSASGKQLHVEIPKDGLRHISPVTGESGISTVLDSTRNTLSSSGCDSTSNRITASTEPSSNVYRGVPETARAEGLRHLSQREAALNKFRLKRKDRCFEKKVRYQSRKLLAEQRPRVKGQFVRQDHSIQGS

SEQ ID NO: 6929 - protein, 179 aa, Zea mays
MDTAFLSPPLARNLVYDEFAGLIQRVAALPDVDDFFWEKDPTPILDTIDAPIHLKNLSSKELKQLADEVRSEIAFIMSRKCQPCGADRSVVELTIAIHYVFNAPMDKILWDAGQHAYAHKILTGRRSLFHTITQKNGLSGFTSRFESEYDPFGAGHGCNSLSAGLGTALICSLLSCMAN

SEQ ID NO: 6930 - protein, 190 aa, Zea mays
MAAHQDSAAAGGRPPRRPRVLLAASGSVAAIKFEVLCRSVAEWADVQAVATASALEFIDVASFPGGVPLYTDDQEWSSWKRVGDKVLHIELRRWADVLVIAPLSANTLAKVAGGLCDNLLTCVVRAWDYSKPVYVAPAMNTFMWDNPFTARHLAVLRDLGMSVVPPVNGAMAEPSEICKTLMLFFGPQHL

SEQ ID NO: 6931 - protein, 126 aa, Zea mays
RIICCIEQNEEGRGNDDRVTLIKDYRGEIETELTTICDGILKLLESHLEADFTAPESNVYYLKMNGDYYRYYDEFKTEAERKDATENTMVAYMAAHDIAQDDLAATHAITLGLTLNLSVIYYEILN

SEQ ID NO: 6932 - protein, 93 aa, Zea mays
  unsure (1)..(93): unsure at all Xaa locations
MALYVDNTSYGREYNVQDLXQAHLARLEIDLAQVEMPELMACPAQFGPSKPFAGARISASLHMTIHTGELIETLTALDAEVRWCSCNIFFTQD

SEQ ID NO: 6933 - protein, 68 aa, Zea mays
  unsure (1)..(68): unsure at all Xaa locations
RRCFIGNIDLARDENEHMAKLDEQAXKVXELVETMVKVAKTVYVXDLSDEQRKLLTDVYQNAIGALTT

SEQ ID NO: 6934 - protein, 329 aa, Zea mays
  unsure (1)..(329): unsure at all Xaa locations
MGVAGEKFQLGTVGALSLSVVSSVSIVICNKALMSSLRFNFATTLTSWHLLVTFCSLHVALCMKLFEHKPFDARTVMGFGVLNGISIGLLNLSLGFNSVGFYQMTKLAIIPCTVILETLFFRKKFSRNIKLSLSVLLLGVGVATITDLQLNLMGSVLSLLAIITTCIAQIMTNTIQKKFKVSSTQLLYXSCPYRALTLFLVGPFLDGFLTNQNVFAFDYTTQVLFFIMLSCLISVSVNFSTFLVIGKTSPVTYKVLGHLKTCLVLTFGYVLLHDLFSWRNILGILIVVIGMVLYLYFCTRETQQIPAEASPQVVQVSVCWNSRRSEWCF

SEQ ID NO: 6935 - protein, 149 aa, Zea mays
  unsure (1)..(149): unsure at all Xaa locations
TSACVAYVSSVHVSSCQIQFASSCYYCARSLCERKTSTGQEFQVKDLVHADYGXLDIELAEXKCPXLIACRYXIGPSKHLTYSRIYXDADMTIHTVVLIETLTDLGANVRWCSCNIFSTQDHAGDVIVHDLIGGFAWNVETPDDYWMCT

SEQ ID NO: 6936 - protein, 92 aa, Zea mays
TFSTDRRLEYMGIMIMACTLPVVFVHFPQWGSMFFPPSATADEEGYYASEWNDDEKSKGLHSASLKFAENSRSERGKRNVIQADAAATPEHV

SEQ ID NO: 6937 - protein, 219 aa, Zea mays
  unsure (1)..(219): unsure at all Xaa locations
MEEREKLVCLAKLAEQAERYDDMVEFMKNLARMDVDMSAEERHLFSVGFKNTIGAKRASWRIICSHEQKVAADRQTGVMIDAYKKKVEEELXRKGDYYRYLAEFSTGTEKKAASDQSLMAYQHAMVVASSELSPAHQIRLGLALNLSVFFYEIMNSHERACQVAKQAFDEALTEINSGEGGYKDSTLMMQLLKDNLALWTSELTGGEASKGNDDVDMEG

SEQ ID NO: 6938 - protein, 425 aa, Zea mays
TLFLEECIIEDEGSEWLHELAVNNSVLVTLNFYMTELKVEPADLELLAKNCKSLISLKMGDCDLSDLIGFFQTSKALQEFAGGAFFEVGEYTKYEKVIFPPRLCFLGGLTFMGKNEMPVIFPYSTMLKKLDLQFTFLTTEDHCQLIAKCPNLSVLEVRNVIGDRGLEVVAATCKKLRRLRIERGDDDPGQEEQGGVSQIGLTAVAVGCRELEYIAAYVSDITNGALESIGTFCKNLYDFRLVLLDKQKKITDLPLDNGVRALLRNCVKLRRFAFYLRPGGLSDVGLGYIGLYSGNIQYMLLGNVGESDNGLIQFATGCTNLRKLELRGCCFSERALAVAVLQMPSLRYIWVQGYRASRTGQDLMLMARPYWNIEFAPPIPESAYRVMADGQPCVDTHAQVLAYYSLAGRRPDCPQWLVTLHPASL

SEQ ID NO: 6939 - protein, 435 aa, Zea mays
MGEGRAGDGLIKLFGKTIPVPETAAVGEAAKDIQQSGGSGSGTTDPKGQENNVQDSTGSPPQQEVADTEDSSADKQQGEAGNPKEKLKKPDKILPCPRCNSMDTKFCYYNNYNINQPRHFCKNCQRYWTAGGAMRNVPVGAGRRKSKSASATSHFLQRVRAGLPVDPLVCAAAKTNGTVLSFGSAMSSLDLTEQMKQLKEKLVPIAGDERSVGSRTQGPSAKAEDPDRKENVTADKSARVVQHPCMTNGVAMWPFSCAPPVPASACYGPGSIAIPFYPAAAAAAAAAAYWGCMVPGAWSGAWPPHSGQSETGSSITSASPAASTKSNICFTPGKHPRDRDEEGGAKGNGKVWVPKTIRIDDVDEVARSSILSLIGIGGDKAGKDGGRGCKLARVFEQNEEAARTATPHSAAISGLPFLQGNPAALSRSLTFQEGS

SEQ ID NO: 6940 - protein, 484 aa, Zea mays
MLDDGWHRATPPHHRPYSPIKLRTEKGEDGQRIGIEKHLRSPPPPSLLLLRPSPSVASTPKMDKLSGSARLMIVSDLDHTMVDHHDEENLSLLRFGALWESVYCEDSLLVFSTGRSPTLYKELRKEKPMLTPDITIMSVGTEITYGEAMVPDDGWEEYLNNKWDRNIVVAETVSFSELKLQPETEQRPHKVSFFVDKKNAQEVIKSVAERLDKCGLDAKIIYSGGQDLDILPQGAGKGQALAYLLEKLSSCGKPPNNTLVCGDSGNDAELFSIPGVHGVMVSNAQEELLQWYTENAKDNPKIIHSNERCAAGIIQAIGHFKLGPNISPRDLQFPYAKEASFKPTDAVVKFYVLYEKWRRAEVPKSDSVIKYFKNITHANGVTIHPAGLELSLHASIDALGSCYGDKQGRKYRAWVDRLFITQTGSDSWVGRFDLWESEGDVRVCSLSSLALILKAESPEGFVLTHIQKTWLNGYSSGVEQAFKL

SEQ ID NO: 6941 - protein, 69 aa, Zea mays
TTRPKTEHLVELTDEERNVLAVAYKNVIAARRASWRIEPSIEQKEDSHKNNKHVNLIKEYRAKIEALLN

SEQ ID NO: 6942 - protein, 268 aa, Zea mays
MADTGDVAAAAEASARPAGSSSTQPLAGRVAIVTGASRGIGRAIATHLSSLGASLVLGYAARADEAGALAASLPRAVAVRADVSDEAGARSLFDAADEAFGGAHILVASAGVLDDTYPAVAATATEAFDRVLAVNLRGAFLCLREAANRLRRGGGGRIVAVTSSVVGSLPPRFGAYTASKAAVEALVRTMAKELGGTRVTANCVAPGATATDMFFKGKSEAMVRHAVETNPMQRLGEPGDIAPVVGFLCTDAAEWVNGQVIRANGGYV

SEQ ID NO: 6943 - protein, 489 aa, Zea mays
HASATHVYLSFNYFQGVFINCALIEPFGLTLIEAAAYGLPMVATRNGGPVDIHRVLDNGILVDPHNQNEIAEALYKLVSDKHLWSQCRQNGLKNIHKFSWPEHCQNYLARVVTLKPRHPRWQKNDVAAEISEADSPEDSLRDIHDISLNLKLSLDSEKSGSKEGNSNALRRHFEDAAQKLSGVNDIKKDVPGENAKWSSLRRRKHIIVIAVDSVQDADFVQVIKNIFEASRNERSSGAVGFVLSTARAISELHTLLISGGIEASDFDAFICNSGSDLCYPSSSSEDMLNPAELPFMIDLDYHSQIEYRWGGEGLRKTLIRWAAEKNKESGQKIFIEDEECSSTYCISFKVSNTAAAPPVKEIRRTMRIQALRCHVLYSHDGSKLNVIPVLASRSQALRYLYIRWGVELSNITVIVGECGDTDYEGLLGGVHKTIILKGSFNTAPNQVHANRSYSSQDVVSFDKQGIASIEGYGPDNLKSALRQFGILKD

SEQ ID NO: 6944 - protein, 148 aa, Zea mays
DSWVKIALTIIRDWLKADPGKYRTMKQRLDCVSDDTTTVVKRLYQMHETDARLFPAINVNDSVTKSTLDNLYGCRHSLSDGLMMATDVMIAGMAAAVCGYGDDCKGRAAGLKHADARVIETEIDPICTLHALMDGLKVLASEDTVSEA

SEQ ID NO: 6945 - protein, 121 aa, Zea mays
  unsure (1)..(121): unsure at all Xaa locations
HASAHSYALACGWATTETRAGIIALAEDTLTNLGCATAXSASSDMYSSFTDQVIVQLGLWKEXSSDKYETNVYVLPMHIDENDAALQLGKLDAILTNLTKSHDDYISVPIEGTYKXAHYRD

SEQ ID NO: 6946 - protein, 102 aa, Zea mays
  unsure (1)..(102): unsure at all Xaa locations
EEFKEALADCXEKPEFIPGEQGVIQVAGHSDAVTVVTRIVGXACLKTTVCCIXTGQDIKLSNIETLIAXVLLELPLAHKHKMTNIPGDANRFAIYHIIQSLY

SEQ ID NO: 6947 - protein, 59 aa, Zea mays
  unsure (1)..(59): unsure at all Xaa locations
ARILYSGRPPRVLLDILYPTLPVVDLHRHHAPSNAIARAPYSACHICTTXDDMQALIWY

SEQ ID NO: 6948 - protein, 125 aa, Zea mays; identical to SEQ ID NO: 5871

SEQ ID NO: 6949 - protein, 175 aa, Zea mays
MVAAGRNRAERWNLAGATALVTGGSKGIGHAIVEELAGFGARVHTCSRNAAELEECRRRWDEKGLQVTVSACDVSARADRERLVATVGATFGGRLDILVNNAGQSLFKRTAECTGEDYSRIMATNLESCFHLSQFVHPFLRLVSGRGGGSVVHVFSDAGFVGLPALSSTSCPRAP

SEQ ID NO: 6950 - protein, 629 aa, Zea mays
MLLPPHGGGPAPRLRCRPRARHHEAHHFTCFKAQTHKKGGAVVIILTMGARRGLRRGQAAVAAVFSACPFLALAVLLALPELAAGDTHYYTFNVQMTNVTRLCVTKSIPTVNGEFPGPKLVVREGDRLVVKVHNHINYNVSFHWHGVRQLRNGWADGPSYITQCPIQGGQSYVYDFTVTGQRGTLWWHAHFSWLRVHLYGPLVILPKRGEGYPFPRPYKEVPVLFGEWFNADTEAVINQALQTGAGPNVSDAYTFNGLPGPTYNCSSKDTYKLKVKPGRTYMLRLINSALNDELFFGIANHTLTVVEADASYVKPFTVSTLVISPGQTMNVLLTTAPSPASPAYAMAIAPYTNTQGTFDNTTAAAVLEYAPTTTRNNTLPPLPALPLYNDTGAVSNFSRNFRSLNSARYPARVPVAVDRHLLFTVGLGTDPCPYTNQTCQGPNGTKFAASVNNNSFFRPRTALLEAHYRRRYAGVLLADFPTAPPHPFNYTGTPPNNTFVQHGTRVVPLRFNASVELVLQGTSIQGAESHPLHLHGYNFFVVGQGFGNFDPVNDPPGYNLADPVERNTISVPTAGWVTVRFLADNPGVWLMHCHFDVHLSWGLSMAWLVNDGPLPNEKMLPPPSDLPKC

SEQ ID NO: 6951 - protein, 395 aa, Zea mays
MDYNFDTSVLDEDVAGRGGREGSCPPAWARACDGCRAAPSVVYCHADTAYLCASCNSRVHAANRVASRHERVRVCEACECAPAVLACRADAAALCAACDAQVHSANPLAGRHQRVPVLPLPAAAVPAASVLAEAAATAAAVAGDKDEEVDSWLLLTKDPDDDDKNHNCSSNNNNISSNTSTFYADVDEYFDLVGYSSYCDNHINSNTKQYGMQEQQLLLHKEFGDKEGSEYVVPSQVGQQQSGYHRVIGTEQAASMTPGVSAYTDSISNSISFSSSMEVGIVPDNMATTDMPSSGILLTPAGAISLFSSGPPLQMPLHLASMDREARVLRYREKKKSRKFEKTIRYATRKTYAEARPRIKGRFAKRSSDMDVEVDQMFSAAALSSDGSYGTVPWF

SEQ ID NO: 6952 - protein, 212 aa, Zea mays
MHTCRQHMAGCKQDDDAGGRSPSSSSMDSSSSTHPPALSAASSSGFRPTTTERRDDLSTDLQLGLCSLSPAASSALLVVAESKSVLSTPRGSRTTQDWPPIKPFLRSALTASARRRRRTLFVKVYMEGVAIGRKLDLLLLDGYDSLLAKLRHMFKASITFADAMEYHQRVPHEKPAHVLTYEDRDGDWMMVGDVPWELFLGSVKKLRICKNR

SEQ ID NO: 6953 - protein, 458 aa, Zea mays; identical to SEQ ID NO: 5992

SEQ ID NO: 6954 - protein, 143 aa, Zea mays
  unsure (1)..(143): unsure at all Xaa locations
YAGGRSLTSTSRILLDRGRSRLVSFCRHAFWYEEMVECMEKVSMTVDSEELTVEEGSLLFVAYKNVIGARRDLLGIIYFSELEEVGLGNEDLVILIKDYRGXIETELTQDCDGILKLVETYIVSVFTFXEFKXFYVKMKGDYY

SEQ ID NO: 6955 - protein, 123 aa, Zea mays
  unsure (1)..(123): unsure at all Xaa locations
FQDVDSEELXVESEPLSVAYKNVIGALRASWRIICYIVHIEEGRGNVDPLTLIKDYRGXIETELTKICDGILMLFETTLEPXSMAANAKXFYIRMEGDGYIYLDEFKTGAERKDAXENTMVKF

SEQ ID NO: 6956 - protein, 722 aa, Zea mays
MDTAFLSPPLARNLVYDEFAVLHPTSYPFHTLRYLRCNPMYSRPLLTIAPASPSRGLIQRVAALPDVDDFFWEKDPTPILDTIDAPIHLKNLSSKELKQLADEVRSEIAFIMSRKCQPCGADRSVVELTIAIHYVFNAPMDKILWDAGQHAYAHKILTGRRSLFHTITQKNGLSGFTSRFESEYDPFGAGHGCNSLSAGLGMAVARDINGRKNRIVTVISNWTTMAGQVYEAMGHAGFLDSNMVVILNDSCHTLLPKADGGAKMSVNAFSSALSKIQSSKGFRRFREAAKGLAKWFGKGMHEFAAKVDEYARGMIGPHGATLFEELGLYYIGPIDGRNIDDLICVLKEVASLDSTGPVLVHVITGTENDTGGIIGSAINAVEEGPSNSSPDLLKFLGTGLSRTYNDCFVEALTAEAENDKRIVVVHGGMGIDRSLRLFQSRFPDRFFDLGIAEQHAVTFSAGLACGGLKPFCIIPSTFLQRAYDQIIEDVDMQKIPVRFAITNAGLVGSEGPTNSGPFDITFMSCLPNMIVMSPSNEDELIDMVATAAMIEDRPICFRYPRGAIVGTSGSVTYGNPFEIGKGEILVEGKEIAFLGYGEVVQRCLIARSLLSNFGIQATVANARFCKPLDIDLIRTLCQQHSFLITVEEGTVGGFGSHVSQFISLDGLLDGRTKWRPIVLPDRYIEHASLAEQLDLAGLTAHHIAATALTLLGRHRDALLLMK

SEQ ID NO: 6957 - protein, 314 aa, Zea mays
  unsure (1)..(314): unsure at all Xaa locations
MDPNDAFSAAHPFRWDLXCPPAPAAPAPPPPPPPAPQLLPHAPLLSAPRELEDLVAGYGVRPSTVARISELGFTASTLLGMTERELDDMMAALAGLFRWDVLLGERFGLRAALRAERGRVMSLGGRFHTGSTLDAASQEVLSDERDAAASGGLAEGEAGRRMVTTGKKKGKKGVGARKGKKARRKKELRPLDVLDDENDGDEDGGGGGSDSTESSAGGSGGGERQREHPFVVTEPGEVARAKKNGLDYLFHLYEQCRVFLLQVQSLAKLGGHKFPTKVTNQVFRYAKKCGASYINKPKMRHYVHCYALHCLDED

SEQ ID NO: 6958 - protein, 82 aa, Zea mays
  unsure (1)..(82): unsure at all Xaa locations
MGLCAEKTSSGREYKGKGLSQADFGRLXIELSEVEMPGLMASRAEFGPSKPFAGARISRSLHMTIQTDVLIGNPTALGAQVI

SEQ ID NO: 6959 - protein, 340 aa, Zea mays
MSAGFQLGVIGSLALSVASSVAIVICNKALISTLGFPFATTLTSWHLMVTFCTLHVAHRLHFFEPKAIDGQTVILFGLLNGTSIGLLNLSLGFNSIGFYQMTKLAIIPFTVLLETIFLNKRFSESIKLSLLVLLLGVGIASITDLKLNMLGSILSGLAIATTCVGQILTNTIQKRLKVSSTQLLYQSAPYQAGILFATGPFVDQLLTDRSVFAHKYSAPVLGFIVLSCLIAVSVNFSTFLVIGTTSPVTYQVLGHLKTCLVLSFGYTLLHDPFTLRNILGILIAIFGMALYSYFSVREGKKKSANDALPVSQMADKEAEPLLATKDNNDTKKANGLSHDC

SEQ ID NO: 6960 - protein, 71 aa, Zea mays
  unsure (1)..(71): unsure at all Xaa locations
PASKLSIVLVFIGVAVCTVTDVSVNSQGXLAAVIAVWSTALQQHVSIVISKPVHCSYICILHLFLICAIFL

SEQ ID NO: 6961 - protein, 447 aa, Zea mays
MALLVRRARRAATKAAVSLAGRTGSVELAIPAHFRCPISLDLMRDPVTAPAGITYDRESIEAWLDTGRATCPVTHAPLRHEDLVPNHAIRRVIQDWCVANRSRGVERIPTPKIPVTPVQASELLFDLAGSARRRDAAARCVEVVTKIKVLARDSERNRSCFASIGTGRVLAAAYESLAAAAADAAAPAGRVLEDILAALVCMMPLDEEAARTLALPTSLGSLVAIAENGSLAGRLNAVLAIKEVVSCDGAATDLSGKVDEIVDALAKIIKSPICPQATKAGMVATYHLALYDERVAARLAAAGLVPVLVEVLVDADKSMSEKALAVLDAVLASEEGRASARAHALAVPMLIKKMFRVSDLATQLAVSAMWRLGKAHSDGEDDGAVTRCLVEALGVGAFQKLLLLLQVGCRDATKEKATELLKLLNKYKSVGECVDAVDFRGLNKLSS

SEQ ID NO: 6962 - protein, 123 aa, Zea mays
LEVDYLLTGQRVDHFSFSSLALLFLALSCFIAIGVNLSQFICIGRFSAVSFQVLGHMKTVLVLSLGFLFFGKEGLSLQVVVGMALAVLGMVWYGNASAKPGGKERRGKDLPVSLKQDKDDTDK

SEQ ID NO: 6963 - protein, 261 aa, Zea mays
  unsure (1)..(261): unsure at all Xaa locations
RGRVQTEETKNADKNGPIGIISAIGISILVGWGYILGVTFAVKDIPYLLSPDNDAGGYAIAEVFYLAFKSRYGSGAGGIVCLGVVAVAVYFCGMSSVTSNSRMAYAFSRDGAMPFSSVWHKVNKQEVPINAVWLSALVALCMALPSLGSLVAFQAMVSIATIGLYISYALPILFRVTLARKYFVPGPFNLGRYGVLGGXVAVLWXGSTITVLSSLPVTYPATKDTLDYTPVAGGELLFLVLASSLINARHWFKGPVTNLDG

SEQ ID NO: 6964 - protein, 250 aa, Zea mays
  unsure (1)..(250): unsure at all Xaa locations
MLLNPASVLDTIRQHLLEEPAAAADESFGSLVADQWSGSLPFRTDDADDMVVFGALQDAFAYGWLPDGSFVHVKPEPVRSPDSSSYSYDGSCFGGXPGPGAAADARRRGRSGLRQRPWGKVAAEIRDPARNGARVWLGTYDTAEDAALAYDRAAYRMRGSRALLNFPLRIGSGDKRPSPAPPEPATSSDSSSSSASGSHKRRKRGEAAAANMAMALVPPPSQLNRPAQPWFPAAPVEQAAMAPRVEQIVV

SEQ ID NO: 6965 - protein, 440 aa, Zea mays
  unsure (1)..(440): unsure at all Xaa locations
MWPAAPSSAQDPSLLEPGRAPNSPVTYLLCPLTLRSASSAPPPPFLRSFQISLPVESRDPPPPRPLTGAARGSGGGQRPAMGKEGASDGGMSESVIRKXVLVSYMYVAVWIFLSFSVIVYNKYILDPKMYNWPFPISLTMVHMAFCSSLAVALVRVLRVVDLPSSPAMTSQLYVSSVLPIGALYSLSLWFSNSAYIYLSVSFIQMLKALMPVAVYSIGVLFKKETFKSSAMLNMLSISFGVAIAAXYGEARFDAXRGVALQLAAVAFEATRLVLIQILLTXSKGISLNPITSLYYVAXCCLAFLVVPWXFVELPRLRAVGIFQPDLFVFGTNSLCAFALNLAVFLLVGKTSALTMNVAGVVKDWLLIAFSWSVIRDTVTPINLFGYGIAFXLGVGYYNHVKLQALKAKEAQKKAAQADEEAGSLLQERDSHGDRKTDNQA

SEQ ID NO: 6966 - protein, 190 aa, Zea mays
DIVMCKPIRASMIASSIQQLLKVEMPERRDNQNRPSFLRSLLVGKNILVVDDNKVNLRVAAAALKKYGANVSCVESGKDAISLLQPPHCFDACFMDVQMPEMDGFEATRQIRQTEMRVNEERKNKLVLIEGSTFVEYHLPVLAMTADVIQATYEKCIKSGMDGYVSKPFDEEQLYQAVSRLIVGTTDSTV

SEQ ID NO: 6967 - protein, 604 aa, Zea mays
MQGLAPPTSVSIHRHLPARSRARASNSVRFSPRAVSSVPPAECLQAPFHKPVADLPAPSRKPAAIAVPGHAAAPRKADGGKKQLNLFQRAAAAALDAFEEGFVANVLERPHGLPSTADPAVQIAGNFAPVGERPPVHELPVSGRIPPFIDGVYARNGANPCFDPVAGHHLFDGDGMVHALRIRNGAAESYACRFTETARLRQERAIGRPVFPKAIGELHGHSGIARLALFYARAACGLVDPSAGTGVANAGLVYFNGRLLAMSEDDLPYHVRVADDGDLETVGRYDFDGQLGCAMIAHPKLDPATGELHALSYDVIKRPYLKYFYFRPDGTKSDDVEIPLEQPTMIHDFAITENFVVVPDHQVVFKLQEMLRGGSPVVLDKEKTSRFGVLPKHAADASEMAWVDVPDCFCFHLWNAWEDEATGEVVVIGSCMTPADSIFNESDERLESVLTEIRLDARTGRSTRRAVLPPSQQVNLEVGMVNRNLLGRETRYAYLAVAEPWPKVSGFAKVDLSTGELARFEYGEGRFGGEPCFVPMDPAAAHPRGEDDGYVLTFVHDERAGTSELLVVNAADIRLEATVQLPSRVPFGFHGTFITGQELEAQAA

SEQ ID NO: 6968 - protein, 266 aa, Zea mays; identical to SEQ ID NO: 6168

SEQ ID NO: 6969 - protein, 490 aa, Zea mays
MFSFTTKGCLPYRTGPAGSAQATRFHAHGREAISKMHNMSAAVLTSVLTLIDEYDLYGQVAYPKHHKHSEVPDIYRLAARTKGAFVNVAYFEQFGVTLIEAAMNGLPIIATKNGAPVEINQVLNNGLLVDPHDQNAIADALYKLLSDKHLWSRCRENGLTNIHQFSWPEHCKNYLSRILTLGPRSPAIGNREERSNTPISGRKNIIVISVDSVNKEGLVRIIRNAIEVIHKENMSGSTGFVLSTSLTISEIHSLLLSGGMLPTDFDAFICNSGSNIYYPSHSGETSNNSKITFALDQNHQSHIEYRWGGEGLRKYLVKWATSVVERKGRTERQIIFEDPEHSSAYCLAFRVVNPNHLPPLKELRKLMRIQSLRCNALYNHSATRLSVVPIHASRSQALRYLCIRLGIEVPNVAVLVGESGDSDYEELLGGLHRTVILKGEFNIAANRIHTVRRYPLQDVVALDSSNIIGVDGYTTDDLRSALQQMGILAR

SEQ ID NO: 6970 - protein, 376 aa, Zea mays
MVQLLPALVALALLLVRPVADAAMAKYTFTVGSMQISQLCSSTSIIAVNGQLPGPSIEVNEGDDVAVKVVNNSPYNVTIHWHGVLQLMTPWADGPSMVTQCPIQPSSSYTYRFSVPGQEGTLWWHAHSSFLRATVYGAFIIRPRRGNAYPFPAPDKEVPIVLGEWWNRNVVDVESDAILAGQLPAQSDAFTVNGKTGLLYQCANETFTAVVEPSTRVLLRVVNAGLNSHLFFKLAGHNFTVVAVDAGYTSNLNTDTLVLAPGQTVDALVTTAAAPGSYYMAVLAHDTMSPLAFAASDTTTATAILQYNGTSSTNPPAMPAMPSSSDSGTANAFYFGLRGLGAPAVPAPVDVSMTIELGLGQLPCDPSQTRCNGTAA

SEQ ID NO: 6971 - protein, 286 aa, Zea mays
  unsure (1)..(286): unsure at all Xaa locations
MGRGKVQLKRIENKINRQVTFSKRRSGLLKKAHEISVLCDAEVALIIFSTKGKLYEYSTDSCMDKILDRYERYSYAEKVLISVESETQMRHQRIGLTQSRSVFIEPKALDSNQSLLKRXDKGNWCHEYRKLKAKVETIQKCQKHLMGXEDLETLNLKELQQLEQQLESSLKHIRTRKNQLMLESISELQRKEKSLQEENKVLQKEKAXSCLQLAEKQKAQRKQVQWGQTQQQTSSSSSCFVIREAAPTTNISIFPVAAGGRLVEGAAAQPQARVGLPPWMLSHLSS

SEQ ID NO: 6972 - protein, 211 aa, Zea mays
  unsure (1)..(211): unsure at all Xaa locations
IPASYPRVSGGNKKRALLVGVSYTGTAHELKGTVNDVKEMRRLLCDRFGFPGACILELTEKESDPTRVPTRENLLRAMRWLVEGSSSGDSLVFHFSGHGVQKLDMNDDEVDGYNEALCPMDFERSGKILDDEINDTIVRPLGKGVKLHAIVDTCHSGTILDLPYLCRMSRXRIARPFVSRTGYWQWENHARPSGMLTKRPNGGLAISISGC

SEQ ID NO: 6973 - protein, 1142 aa, Zea mays
  unsure (1)..(1142): unsure at all Xaa locations
MKRKQQQKHCAALQRSSGRNLGHGGRQRRSDLEARTGRLVSARLVGVGVVGVWSRLGGSSGEGAEMAANKGMVAGSHNRNEFVMIRHDGDAPGSAKPTKSANGQVCQICGDSVGVSATGDVFVACNECAFPVCRPCYEYERKEGNQCCPQCKTRYKRQKGSPRVHGDEDEEDVDDLDNEFNYKQGNGKGPEWQLQGDDADLSSSARHEPHHRIPRLTSGQQISGEIPDASPDRHSIRSPTSSYVDPSVPVPXVRIVDPSKDLXNSYGLNSVDWKERVESWRVKQDKNMMQVTNKYPEARGGDMEGTGSNGEXMQMVDDARLPLSRIVPISSNQLNLYRVVIILRLIILCFFFQYRVSHPVRDAYGLWLVSVICEVWFALSWLLDQFPKWYPINRETYLDRLALRYDREGEPSQLAPIDVFVSTVDPLKEPPLITANTVLSILSVDYPVDKVSCYVSDDGSAMLTFESLSETAEFARKWVPFCKKHNIEPRAPEFYFAQKIDYLKDKIQPSFVKERRAMKREYEEFKVRINALVAKAQKVPEEGWTMADGTAWPGNNPRDHPGMIQVFLGHSGGLDTDGNELPRLVYVSREKRPGFQHHKKAGAMNALIRVSAVLTNGAYLLNVDCDHYFNSSKALREAMCFMMDPALGRKTCYVQFPQRFDGIDLHDRYANRNIVFFDINMKGLDGIQGPVYVGTGCCFNRQALYGYDPVLTEADLEPNIVIKSCCGRRKKKNKSYMDSQSRIMKRTESSAPIFNMEDIEEGIEGYEDERSVLMSQRKLEKRFGQSPIFIASTFMTQGGIPPSTNPASLLKEAIHVISCGYEDKTEWGKEIGWIYGSVTEDILTGFKMHARGWQSIYCMPPRPCFKGSAPINLSDRLNQVLRWALGSVEILLSRHCPIWYGYNGRLKLLERLAYINTIVYPITSIPLIAYCVLPAICLLTNKFIIPEISNYAGMFFILLFASIFATGILELRWSGVGIEDWWRNEQFWVIGGTSAHLFAVFQGLLKVLAGIDTNFTVTSKASDEDGDFAELYVFKWTSLLIPPTTVLVINLVGMVAGISYAINSGYQSWGPLFGKLFFSIWVILHLYPFLKGLMGRQNRTPTIVIVWSILLASIFSLLWVKIDPFISPTQKAAALGQCGVNC

SEQ ID NO: 6974 - protein, 203 aa, Zea mays
MSDVENPGVGGKPPPYKDPDNGSQRFLLELEFVQCLANPTYIHYLAQNRYFEDEAFIGYLKYLKYWQRPEYIKYIMYPHCLFFLELLQNANFRNAMAHPTNKELAHRQQYFFWKNYRNNRLKHIIPRPPPEPAPSQAPATLPLQASVPTPVAPPVPAPTSSMPPVVAGGASAMSPMQFVGTPGTNMPKNDMRNAMDNRKRKMG

SEQ ID NO: 6975 - protein, 356 aa, Zea mays; identical to SEQ ID NO: 811

SEQ ID NO: 6976 - protein, 488 aa, Zea mays
MAETGESSPNPAAAPEDTHHEGSEVPAAAVAAVHAQPQLQPQPRPPPQPSKVRLMVSYGGRIQPRPHDNQLAYVNGETKILSLERPVLFADFAARLTTLVGNARDVCVKYQLPGEDLDALISVTNDEDLEHLVVEYDRAHNNGPAAGSGSGRGGATPRLRVFLFPVQPPPPPPPAGLLEPKADQRLYIVEALNTVSLPSSKLDPPPVPSHQSSPPQQQKRESVFAQQSSSPPPPPPQAKHEAVENVPVEIPAKNDDRHPNPAGDHVAVSPVVSPAEYQRQIQELEKLQVADNATHQPPPPATAPAPTHGPVPAALPRNGSDDSLARAYPPVTATPTSNAEYYIPKFPEKPPVPPLSSAPPPTTYVQVQGRYASVAPGSGADHAPVFFIPAPHGYFAAAASPGATSYPAVYAVAPPSATANGSAPSAAVSNATAYAPAPTQVAYDSNGRAIYYTSMLPQYPSAVNGMSAPGGVLGTEPAKQVAVKPTVS

SEQ ID NO: 6977 - protein, 277 aa, Zea mays
  unsure (1)..(277): unsure at all Xaa locations
MSVRSLLAQPIPSLFAPAPAPSRARRNRRTSRRRFLAATKLTMDGTSFDLTEHEGSNLSPFLLKLFNEYKHERSLQWDDRKTRGLFHHDISSCETKVLPGVHNFVATLIEGRDQKKRPTEFTMNQVLQPFVSEKFNFTKVSPLEVIFRFNDTEKDPAQYFDGVPDTVSASSSAILINVSPIGYCHVLLTPKIQDCLPQRIDQESFLIAMYVARGAKTPFFRVGYNSLXGFATINHLHFQAYYLKVQYPVEKAITEKLKTLXNSVSIFHLVDYQSMAL

SEQ ID NO: 6978 - protein, 344 aa, Zea mays
MEDGGKAPAGLGTLRAVLAILQWWGFNVTVIIMNKWIFQKLDFKFPLTVSCVHFICSSIGAYIAIHVLKAKPLIQVEPEDRWKRIFPMSFVFCINIVLGNVSLRYIPVSFMQTIKSFTPATTVILQWLVWSKHFEWRIWASLVPIVGGILLTSVTELSFNIFGFCAAMVGCLATSTKTILAESLLHGYKFDSINTVYYMAPFATMILALPAMVLEGGGVMNWFYTHDSIVPALTIILGSGVLAFCLNFSIFYVIHSTTAVTFNVAGNLKVAVAVLVSWSIFRNPISAMNAIGCGITLVGCTFYGYVRHLISQRQAAAPGSLGTAQARNQTEMLPLVVDEKQEKV

SEQ ID NO: 6979 - protein, 253 aa, Zea mays
MDVKCRRLEGKVAIVTASTMGIGLAIAERLGLEGAAVVISSRKQKNVNEAVEGLRAKGITAVGAVCHVSDAQQRKSLIETAVKSFGHIDILVSNAAANPSVDTILEMKESVLDKLWDINVKASILLIQDAAPHLRKGSSVIIISSIAGYNPEQGLTMYGVTKTALFGLTKALAGEMGPDTRVNCVAPGFVPTRFASFLTENETIRKELNERTKLKRLGTVEDMAAAAAFLASDDASYITAETIVVAGGVQSRL

SEQ ID NO: 6980 - protein, 242 aa, Zea mays
MAGQMGLNQLGPAQIQQIQAQFMFQQQQQQRGLHAAFLGPRAQPMKQSGSPSPPPALAPAQSKLYRGVRQRHWGKWVAEIRLPKNRTRLWLGTFDTAEDAALAYDKAAFRLRGDTARLNFPALRRGGAHLAGPLHASVDAKLTAICQSLSESKSKSGSSGDESAASPPDSPKCSASTTTGEGEEESGSAGSPPPPPPPTLAPPVPVPEMAKLDFTEAPWDETEAFHLRKYPSWEIDWDSILS

SEQ ID NO: 6981 - protein, 338 aa, Homo sapiens
MADQAPFDTDVNTLTRFVMEEGRKARGTGELTQLLNSLCTAVKAISSAVRKAGIAHLYGIAGSTNVTGDQVKKLDVLSNDLVMNMLKSSFATCVLVSEEDKHAIIVEPEKRGKYVVCFDPLDGSSNIDCLVSVGTIFGIYRKKSTDEPSEKDALQPGRNLVAAGYALYGSATMLVLAMDCGVNCFMLDPAIGEFILVDKDVKIKKKGKIYSLNEGYAKDFDPAVTEYIQRKKFPQIIQLLMGPGMWAPWWLMFIALWSTEGYFCTPLTRRAPMERLRLLYECNPMAYVMEKAGGMATTGKEAVLDVIPTDIHQRAPVILGSPDDVLEFLKVYEKHSAQ

SEQ ID NO: 6982 - protein, 335 aa, Pseudomonas fluorescens
MALSKEVPEFDIDDEVLLMESSIDMDSMSNNEGATPPSVRTKSKSSASLKQHKYIDYTRALDATQLYLNEIGFSPLLSPEEEVHFARLSQSGDPAGRKRMIESNLRLVVKIARRYVNRGLSLLDLIEEGNLGLIRAVEKFDPERGFRFSTYATWWIRQTIERAIMNQTRTIRLPIHVVKELNVYLRAARELTQKLDHEPSPEEIANLLEKPVAEVKRMLGLNERVSSVDVSLGPDSDKTLLDTLTDDRPTDPCELLQDDDLSQSIDQWLSELTEKQREVVVRRFGLRGHESSTLEDVGLEIGLTRERVRQIQVEGLKRLREILEKNGLSSESLFQ

SEQ ID NO: 6983 - protein, 373 aa, Gallus gallus
FLQDPDEEIAKIEMSRKKQYENQLSWNNINKDPHMLIPTPDKDDDPVGVDYSHFIHLNVASTRSSPLPILGDWANRDDVWKNMINKEETYVRDKLYMQRHPLLQPKMRTILLDWLMEVCEVYKLYRETFYLAQDFFDRFMATQQNVVKTLLQLIGISSLFIAAKLEEIYPPKLHQFAYVTDGACTEDEILSMELIIMKALNWNLNPLTVVSWLNIYMQVAYLNELYEVLLPQYPQQIFVQIAELLDLCVLDIGCLEYTYGVLAASALYHFSSSELMQKVSGYEWCEIEECVKWMVPFAMAIREVGSSKSKHFRGIAPEDLHNIQTHINSLDLLDKAQAKQAILAEQNRTSPFPTGVLTPPQSSKKQPAGLKPI

SEQ ID NO: 6984 - protein, 330 aa, Sesbania rostrata
MSSLHYSLVTLLLLGVVMLTTPVLANYYEPPPIEKPPTYEPPPTYEKPPPVYKPPIFPPPYEKPPPVYSPPYEKPPPVYPPPYEKPPPVYPPPYEKPPPEYQPPHEKPPPEYQPPHENPPPEYQPPHEKPPPEYQPPHEKPPPEYQPPHEKPPPEYQPPHEKPPPEYQPPQEKPPPVYPPPYEKPPHEKPPSYEKPPPYEKPPHEKPPYEKPPHEKPPHEKPPYDKPPYEKPPHEKPPHEKPPHEKPPPEYKPPHEKPPPEYKPPHEKPPPYEKPPHEKPPPEYKPPHEKPPPPEYPPYVKPPPEYKPPHEKPPGYNPPPYGHYPPSKKN

SEQ ID NO: 6985 - protein, 414 aa, Petroselinum crispum
NSARGNTDDVKAVKPEKLSSPPPPAAPDQSNSHVYPDWAAMQAYYGPRVALPPYFNPAVASGQSPHPYMWGPPQPVMPPYGVPYAALYAHGGVYAHPGVPLAASPMSMDTHAKSSGTNEHGLIKKLKGHDDLAMSIGNGKADSSEGEMERTLSQSKETEGSSDGSNENSKRAAVNGRKRGRDEAPNMIGEVKIETQSSVIPSPRAKSEKLLGITVATPMVAGKVVGTVVSPSMTSSLELKDSPKEHAVNSPAGGQQPSTMMPNDSWLHNDRDLKRERRKQSNRESARRSRLRKQAEAEELAIKVDSLTAENMALKAEINRLTLTAEKLTNDNSRLLEVMKNAQAERAADVGLGNNNEKKASTLSTANLLSRVDNAGSGDRDEGESDVYEKTTKSGAKLHQLLDANPRTDAVAAG

SEQ ID NO: 6986 - protein, 103 aa, Psammechinus miliaris
  unsure (1)..(103): unsure at all Xaa locations
MSGRGKGGKGLGKGGAKRHRKVLRDNIQGITKPAIRRLXXXXXXXXISGLIYEETRGVLKXXXXXXXXXXXXXXXXXXXXXXXXXXXXXXXXXXGRTLYGFGG

SEQ ID NO: 6987 - protein, 503 aa, Salmo trutta
MPPGFQHLGGETVTGTLALSVFTAVLGSFQFGYNIGVINAPQKIIEADYNATWVHRYGELIPTATLTTPWSLSVAIFSIGGMISSFCVGVISEWLGRRKAMLINNLFAFIGGSLMGMAKISRSFEMMILGRFVIGAYCGLASGLVPMYVGEIAPTSLRGALGTLHQLAIVTGILIAQVLGLESLLGSEELWPVLVGVTVLPTVLQMALLPFCPESPRFLYIIRCQEHHAKSGLRRLTGRQEVGDMLAEMKEEKRRMDMERKVSIAELFRSPMYRQPIIIAILLQLSQQLSGVNAVFYYSTSIFQKAGVQSPVYATIGAGVVNSAFTVVSLFLVERTGRRTLHMLGLFGMCGCAIVMTIALALLDSVPWMSYISMLAIFGFVAFFEVGPGPIPWFFVAELFSQGPRPAAMAVAGFSNWTANFIIGFGFQYLAELCGPYVFLIFAVLLLFFLIFTFFRVPETRGKTFDQISTSFSQHPPAMMDLDMELGKRSTELDYLGGEGSLD

SEQ ID NO: 6988 - protein, 386 aa, Solanum tuberosum
MADMNQHPTVFQKAANQLDLRSSLSQDVHARYGGVQPAIYQRHFACGNYSNAGLQRGQATQDLSLITSNASPVFVQAPQEKGLAAFATDFLMGGVSAAVSKTAAAPIERVKLLIQNQDEMLKAGRLSEPYKGIGECFGRTIKEEGFGSLWRGNTANVIRYFPTQALNFAFKDYFKRLFNFKKDRDGYWKWFAGNLASGGAAGASSLFFVYSLDYARTRLANDAKASKKGGERQFNGLVDVYRKTLKSDGIAGLYRGFNISCVGIIVYRGLYFGMYDSLKPVLLTGNLQDSFFASFGLGWLITNGAGLASYPIDTVRRRMMMTSGEAVKYKSSLDAFSQIVKNEGPKSLFKGAGANILRAVAGAGVLAGYDKLQVLVLGKKYGSGGA

SEQ ID NO: 6989 - protein, 182 aa, Plasmodium falciparum
AGGIAEMAGLPSEVRERTDILDAAGNTTAAIGKGFAIGSAALVAFALFGAYASSANLRHVNILNSWVIIGLLIGAMLPYLFSALTMKSVAIAANSVLNECLKQFPLILEGKQKPDYEKCIKISTDASLRQMIVPGLISVFSPLIIGMLMGKYATAGLLIGIILSGIQLAFSSTNSGGAWDNA

SEQ ID NO: 6990 - protein, 458 aa, Leishmania mexicana
MSAEIESHILKKYEIQTQLGQGAYGIVWRALERKHNRVVALKKIYDAFQNSTDAQRTFREIMFLHRLHHPNIIRLLHVHRAFNDRDIYLVFEYMETDLHVVIRANILEGIHKQFIIYQLLKTMKFLHSAEILHRDMKPSNLLVNSDCTMKVADFGLARSILSLEGEQASRPVLTDYIATRWYRPPEILLGSTRYTKGVDMWSVGCILGELMLGKPMFPGRSTTNQLELICSVTGMPSAADVAATNSQFANAMLRDIHCAHRRTFAELLPSASADALNLIERLMCFNPNRRLSAAEALEHPYVAAFHRPDDEPVAPEPITVSLPDSQRLPLAKYRDAIYEQIASLRRISTSTDHRHRAERHGAGGTASRKTSASGGGGAAGGSRGGTGTSGATRPATSCSSSTAARAAPQRSVVKPTSTSGVNESSSSKAYGRPGFRSVASTSSGLESRPVEREAAVRK

SEQ ID NO: 6991 - protein, 388 aa, Leishmania mexicana
MHKSNQELSVPKVVGDFKVYNVSGSPFEVPSKYTLLKILGMGAYGIACSCLDGDTGEKVSIKKCRDVFRDVEDGKRVLREIDMMRFFHHENLLNVVNILPPLKCEYHSFEDVYVVTPLMDVDMNVVLRSRQVLEESHMQYFVYQILRGLKYLHSANVAHRDLKPANLVTNISCELKIIDFGLSRSVDVPYSELTDYVITRWYRPPELLLENTNYSTAVDIWSVGCIFAEMYNRKPVFPGRNTMDQLRMIAQHIGKPPASIVEHREALEKLNELPGGSLNIPKLVPGLAGNTEGIDFLSKMWTLDPSKRPTAADMLAHPYLAHLHDEEDEPACPCPFLWAHESTPMGVSELRRAFWADIVDYNPSLEHATPPATTAGGSSSKNGSGHHH

SEQ ID NO: 6992 - protein, 363 aa, Leishmania mexicana
MTQLVPLAELPSGKKIYSVRGQRFEVDRQYDLVKVVGFGACGTVCSAVVNGSGERVAIKRLSRVFGDLREGKRILREMEIMTSLKHNNLIRLHHFMRPQSKETFEDIYLVMDLYDTDLNRIIRSRQKLTDEHLQYFMIQAFRGLHYLHSAKVMHRDLKPSNLLVNADCALAICDFGLARDDQVMSSSDLTQYVVTRWYRPPEVLGMGSNQYTSAVDVWSLGLIFAELMVGRALLPGTDYIGQLVMIVNLLGSPSIDDMEFLSSEAKAFILSQPHRPALSFRDLFPMATEEATDLLSKLLVFHPARRLTAKQVMEHPYFSKYRDAAEEADAPDPFVWNHSHIETKEQLREDLWRVVEAHSQLNE

SEQ ID NO: 6993 - protein, 386 aa, Leishmania mexicana
MTSKAAVNGSFGSSANAVQLISTQRGRKVYCVRGQNFDIDDTYTVTSVIGHGAYGVVCAALDDRTFKEVAIKRVSRVFEDLIDGRRIWREILLLRILKECGCRNVLRLIRVLPPRDPIMEFRDLYLVTDLYDIDLFSIIRHNKCESIDLLRRISVRVLRCLADMHSMGIVHRDIKPSNILLRDEKNAEEAIVCDFGLARAGLHKLSEPLDLTDYVVTRWYRPPELLLMCPYSYPIDVWAVGCVMAEYAMQRPLFAGRDYIHQLQFVLSSIPITGVDFIERSSSSSGLANMNEIAKKCKGTRPLPQLLSKLPKDGLELVTEMLAFEPDKRITAQEALKHPFFSSVGGPDCKSYPAPPELDLGFDMHAEVSECQLRRAIWDEVQYYKK

SEQ ID NO: 6994 - protein, 1106 aa, Leishmania mexicana
MEAYETLGILGEGTYGVVVKARSRVTGKLVAIKRFKQTEQDEHVRKTSSREVRMLQLLQHPNVIRLEDVFRREGKLYLVFEFIDHTILQLLESTTRGFHRHELRRYTYQLLRGIEFCHNQNIIHRDVKPENVLIDESGLLKLCDFGFARQTSAKGKYTDYVATRWYRAPELLVGDVAYGKPVDVWALGCMFAELSDGQPLFPGESDLDQLCLIMQTCGPVPQRLVFIFMHNPLYNGISFPHTDILYTLKDRYHRESNDWIEFLSSCLHTDPAQRLTCTELMELPYFTRDGFRDRYEAELRAATGLPQLRSTPTTSAPSTQRRAPDQAAALGGDIKADAVVPPHTRRSSENISPALQGQQPPTAKNSFSEPHISKTALKPAAHDANPGKGKGAGAPTLRLTSPHKTASEHPLQLPMILNVSSERAIAAALTDYLNQMPTSSSTVVSSPAQATPAEVAEAFTKADPLSRSCGAALPLQTSQTINASTTRDKKKKRNSSLAETELHRRSSASISNDTEYAVTTDGTKGEPARHISDHPRASATLPPNGVRDGGDSHEPRREGEKTNVSPPLPSHGVAESNMRALLTTAAPGKDGGETAVLSHRALKPASAEKAAATTATAFSPPPLTATHGAPLAECLQDLPALSLHLPRHLQSERQTPAAEQPQPHTSLSAETSMSSFHVRTRNPLAAASSVNDGVSHGKANIETTGSSVAKPRLGLSNSSVSTAASEVKKRKSARHKSNTSRLQDKAVGPVSGSASRRPVPGNASDVVAYRAGFASVVNSLKSTVSQSLSHVLGQQQRHRLLSPESDGVHTAEPHLHGVGAGPSAPDSTRNRNVDATGPQPRKERRCKPLAASTHALQGSDQRHRQQSQPRLDGPLHPDGGASQRATATLMALSALRNVSGPPPAKSAGDANKSSYVHHTRSHTNNNGGETVIPVVGGDGNDTNTCVTSRARRPIVACAVHGNNRDSDELMATRRVQKKNAVATHGRTGNGAVGSIGCTDSSTTSSYQATSIMYGAPYHPFARASKVDGDVCGAQQRQTLQRLKKKIADHRGSGIANTTSSIGSRHSLTPARQIQHQPQLAKEDGGSGDGKTPQFNAATAASPDTGI

SEQ ID NO: 6995 - protein, 371 aa, Leishmania mexicana
MSSKSIPQSPASDGAHRYAHVNVNKPSSYWDYDSLRVQWNSPDRYEVVQKIGRGKYSDVFLGVDTKVLRQVVIKVLKPVKKKKILRELMVLQTLKGGPNIVELFDVVREPNSKTPSFVFEYVKSCDFRTVFPTFTDLEVRSYIFQVLMALEYAHSHGIMHRDVKPNNVCLDYKTGKLKLIDWGLAEFYHPATSYNARVASRYFKGPELLVELPMYDYRLDMWSLGCMLAAMIFIREPFFRGKDNTDQLVRIVKVLGTDDLQVYLKKHNASLPPVLEATLGYHAKKPWRSFVNGQNEHLCPPEALAFLDKLLQYDHMKRIQAAEAMMDPYFDPVRPKDFTLDRITVGAENGGGGASVCNEENEHKRAPRIES

SEQ ID NO: 6996 - protein, 614 aa, Ralstonia metallidurans
MRRDRLSGILLPNLPRRRFVQGLAAGGVMAGLSALGGTAWAQSSGLPESASSGTAPVLTGTEFDLVIAESVVNFTGTPRVATTINGMLPGPTLRWRQGDTVTIRVTNRLHEHTSIHWHGIILPFQMDGVPGISFAGIAPGETFTYQFKVEQTGSYWYHSHSGFQEMTGVYGGIVIDPATGVDGVRADRDYTILLSDWTDEDPMRVLSKLKVQSDYYNYIKPTVFDFFRDVSNDGVKSAFEKRKMWNEMRMNPTDLADLSGATLTYLTNGVTPAGNWTGLFKPGEKVRLRFINGSGNTFYDVRIPGLKLKVIQVDGQNLEPVSVDEFRFGPGETYDVLVEPRDDAYTIFSQSMDRTGYARGTLAVRAGLNAQVPAVDKPEWLTMSDMMGGMGGMGGMDHSKMDMGGMNQGSMAGMNHGAMTMDHSQHAMGGMAMDASLKVPSTKARHAKTEYGANTDMRVDMARTNLDDPGIGLRNNGRRVLTLADQHTIGGPLDKRGPAREVELHLTGNMERYSWSIDGVEYGKSTPVRFKYGERLRVILHNDTMMTHPMHLHGMWSELESPDGSFQARRHTIPVQPAPGFSFLVTADALGRWAWHCHLMLHMDAGMFREVLVA

SEQ ID NO: 6997 - protein, 221 aa, Homo sapiens
MEAGGFLDSLIYGACVVFTLGMFSAGLSDLRHMRMTRSVDNVRFLPFLTTEVNNLGWLSYGALKGDGILIVVNTVGAALQTLYILAYLHYCPRKRVVLLQTATLLGVLLLGYGYFWLLVPNPEARLQQLGLFCSVFTISMYLSPLADLAKVIQTKSTQCLSYPLTIATLLTSASWCLYGFRLRDPYIMVSNFPGIVTSFIRFWLFWKYPQEQDRNYWLLQT

SEQ ID NO: 6998 - protein, 384 aa, Nicotiana tabacum
MGLLCSRNKGYNQADDEENTQTADIERRIEQETKADKHIQKLLLLGAGDSGKSTIFKQIKLLFQTGFDEAELKNYIPVIHANVYQTIKVLHDGSKELAQSELEASKYLLSAENKDIGEKLSEIGGRLDYPHLTKDLVQDIEALWKDPAIQETILRGNELQVPDCAHYFMENLQRFSDINYVPSKEDVLFARIRTTGVVEIQFSPVGENKKSGEVYRLFDVGGQRNERRKWIHLFEGVTAVIFCAAISGYDQTLFEDERKNRMMETKELFEWVLKQPCFEKTSFMLFLNKFDIFEQKALKVPLNVCEWFKDYQSVSTGKQEIEHAYEFVKKKFEESYFQCTAPDRVDRVFKIYRTTALDQKLVKKTFKLVDETLRRRNLFEAGLL

SEQ ID NO: 6999 - protein, 261 aa, Hordeum vulgare; identical to SEQ ID NO: 5363

SEQ ID NO: 7000 - protein, 586 aa, Hordeum vulgare
EFNHRFQELGLEKGWGDTAKRVHDTIHLLLDLLEAPDPASLEKFLGTIPMMFNVVILSPHGYFAQSNVLGYPDTGGQVVYILDQVRALENEMLLRIKQQGLDITPKILIVTRLLPDAVGTTCGQRLEKVIGTEHTDILRVPFRTENGILRKWYSRFDVWPYLETYTEDVAKQLMREMQTKPDLIIGNYSDGNLVATLLAHKLGVTQCTIAHALEKTKYPNSDIYLDKFDSQYHFSCQFTADLIAMNHTDFIITSTFQEIAGSKDSVGQYESHIAFTLPDLYRVVHGIDVFDPKFNIVSPGADMTVYFPYTETDKRLTAFHSEIEELLYSDVENDEHKFVLKDRNKPIIFSMARLDRVKNMTGLVEMYGKNAHLKDLANLVIVAGDHGKESKDREEQAEFKRMYSLIEEYKLKGHIRWISAQMNRVRNGELYRYICDTKGAFVQPAFYEAFGLTVIEAMTCGLPTIATCHGGPAEIIVDGVSGLHIDPYHSDKAADILVNFFEKSTADPSYWDKISQGGLKRIYEKYTWKLYSERLMTLTGVYGFWKYVSNLERRETRRYLEMFYALKYRSLAAAVPLAVDGESSGN

SEQ ID NO: 7001 - protein, 263 aa, Lolium perenne
MASSSSVLLVVALFAVFLGSAHGIAKVPPGPNITAEYGDKWLDAKSTWYGKPTGAGPKDNGGACGYKDVDKAPFNGMTGCGNTPIFKDGRGCGSCFEIKCTKPESCSGEAVTVTITDDNEEPIAPYHFDLSGHAFGSMAKKGEEQKLRSAGELELQFRRVKCKYPDGTKPTFHVEKASNPNYLAILVKYVDGDGDVVAVDIKEKGKDKWIELKESWGAVWRIDTPDKLTGPFTVRYTTEGGTKSEVEDVIPEGWKADTSYSAK

SEQ ID NO: 7002 - protein, 263 aa, Lolium perenne
MASSSSVLLVVALFAVFLGSAHGIAKVPPGPNITAEYGDKWLDAKSTWYGKPTGAGPKDNGGACGYKNVDKAPFNGMTGCGNTPIFKDGRGCGSCFEIKCTKPESCSGEAVTVTITDDNEEPIAPYHFDLSGHAFGSMAKKGEEQNVRSAGELELQFRRVKCKYPDDTKPTFHVEKASNPNYLAILVKYVDGDGDVVAVDIKEKGKDKWTELKESWGAVWRIDTPDKLTGPFTVRYTTEGGTKSEFEDVIPEGWKADTSYSAK

SEQ ID NO: 7003 - protein, 360 aa, Mus musculus
MSQERPTFYRQELNKTIWEVPERYQNLSPVGSGAYGSVCAAFDTKTGHRVAVKKLSRPFQSIIHAKRTYRELRLLKHMKHENVIGLLDVFTPARSLEEFNDVYLVTHLMGADLNNIVKCQKLTDDHVQFLIYQILRGLKYIHSADIIHRDLKPSNLAVNEDCELKILDFGLARHTDDEMTGYVATRWYRAPEIMLNWMHYNQTVDIWSVGCIMAELLTGRTLFPGTDHIDQLKLILRLVGTPGAELLKKISSESARNYIQSLAQMPKMNFANVFIGANPLAVDLLEKMLVLDSDKRITAAQALAHAYFAQYHDPDDEPVADPYDQSFESRDLLIDEWKSLTYDEVISFVPPPLDQEEMES

SEQ ID NO: 7004 - protein, 364 aa, Mus musculus
MSGPRAGFYRQELNKTVWEVPQRLQGLRPVGSGAYGSVCSAYDARLRQKVAVKKLSRPFQSLIHARRTYRELRLLKHLKHENVIGLLDVFTPATSIEDFSEVYLVTTLMGADLNNIVKCQALSDEHVQFLVYQLLRGLKYIHSAGIIHRDLKPSNVAVNEDCELRILDFGLAPQADEEMTGYVATRWYRAPEIMLNWMHYNQTVDIWSVGCIMAELLQGKALFPGNDYIDQLKRIMEVVGTPSPEVLAKISSEHARTYIQSLPPMPQKDLSSVFHGANPLAIDLLGRMLVLDSDQRVSAAEALAHAYFSQYRDPDDEPEAEPYDESVEAKERTLEEWKELTYQEVLSFKPLEPSQLPGTHEIEQ

SEQ ID NO: 7005 - protein, 407 aa, Schizosaccharomyces pombe
MGCMSSKYADTSGGEVIQKKLSDTQTSNSSTTGSQNARVPVLENWLNIVLRGKPQNVESSGVRVKGNSTSGGNDIKVLLLGAGDSGKTTIMKQMRLLYSPGFSQVVRKQYRVMIFENIISSLCLLLEAMDNSNVSLLPENEKYRAVILRKHTSQPNEPFSPEIYEAVHALTLDTKLRTVQSCGTNLSLLDNFYYYQDHIDRIFDPQYIPSDQDILHCRIKTTGISEETFLLNRHHYRFFDVGGQRSERRKWIHCFENVTALLFLVSLAGYDQCLVEDNSGNQMQEALLLWDSICNSSWFSESAMILFLNKLDLFKRKGSHFPIQKHFPDYQEVGSTPTFVQTQCPLADNAVRSGMYYFYLKFESLNRIASRSCYCHFTTATDTSLLQRVMVSVQDTIMSNNLQSLMF

SEQ ID NO: 7006 - protein, 913 aa, Trypanosoma cruzi
MESKKFVYYFGGQKADGNRDMKELLGGKGANLAEMVNLGIPVPPGFTITTEVCGIYQRTKGLPQEVVEQVKANVRRVEADMGTKFGDVENPLLFSVRSGAAASMPGMMDTVLNLGMNKATAEAWIRRAPHLERFVYDSYRRFITMYADIVMQVGREDFEEAIGHMKEKRGTKFDTDLTAKDLKELTEEYLVLFQRKTGFPFPEDPMTQLFAAINAVFRSWGNPRAVVYRRLNNITGLLGTAVNVQAMVFGNINDRSATGVAFSRSPSTGENFFFGEYLVNAQGEDVVAGIRTPQQIGQSLSLRWAKGHGVSEEERRHRYPSMEETMPENYRLLCEIRAKLENHYRDMQDIEFTVQDGRLWMLQCRNGKRTIHAAVRVAIDMVREGLITKEEAVLRIDPLQVDHLMHPNIEPGAAKSNKPIGKGLAASPGAAVGQIVFDADSAKEWSARGKKVIMVRLETSPEDLAGMDAARGILTARGGMTSHAAVVARGMGKCCVSGCGDLVIKGKQFTLSGRVFREGDYITLDGSKGLIYAGQLKLQSPNLKGDFETILQWCREVKRLGVRANADTPNDATKARSFGAEGVGLCRTEHMFFEGSRIDAIREMILADTLEGRKAAIQKLLPVQRGDFLGIFRAMKGLPVTIRLLDPPLHEFVPHEDAAQAELAKKMNVSAEKIRNRVKSLHEMNPMLGHRGCRLGITYPEVYNMQVQAIMEAAVAVSKEGCKVVPEIMIPLVGKKEELTFTKQQAVKTAEETLAAAGQRVDYIVGTMIEVPRAAITADQIAEEADFFSFGTNDLTQMGCGFSRDDAGSFLRHYCSLGIYSKDPFESIDQEGVGELVRIAVQKGRRVKPMLKMGICGEHGGDPTTIGFCHKVGLNYVSCSPFRVPVATVAAAHAALKEKRQMEQKYKAIAAKL

SEQ ID NO: 7007 - protein, 604 aa, Lycopersicon esculentum
MDAVSIRVPYKNLKQQEVELTNVDESRFAQLEIRSDSSSPRVSNGEMNDSNLPLPPPPVRNSLLTLILSCTVAAGVQFGWALQLSLLTPYIQTLGIEHAFSSFIWLCGPITGLVVQPCVGIWSDKCHSKYGRRRPFIFIGAVMISIAVIIIGFSADIGYLLGDTKEHCSTFKGTRSRAAIVFVVGFWMLDLANNTVQGPARALLADLSGPDQRNTANAVFCSWMAVGNILGFSAGASGGWHRWFPFLTNRACCEPCGNLKAAFLVAVVFLTLCTLVTLYFANEVPLSPKQYKRMSDSAPLLDSPQNTGFDLSQSKRELQYRNSVANNESEMGHVADNSPKNEEQRPDKDQGDSFADSPGAVLVNLLTSLRHLPPAMHSVLIVMALTWLSWFPFFLFDTDWMGREVYHGDPKGEADEVNAYNQGVREGAFGLLLNSVVLGVSSFLIEPMCKWIGSRLVWAVSNFIVFVCMACTAIISVVSISANTQGVQHVIGATRSTQIAALVVFSLLGIPLAVTYSVPFSITAELTADAGGGQGLAIGVLNLAIVVPQMVVSLGAGPWDALFGGGNIPAFALASLAALAAGIFAMLRLPNLSSNFKSTGFHFG

SEQ ID NO: 7008 - protein, 651 aa, Glomus mosseae
  unsure (1)..(651): unsure at all Xaa locations
GILTHAQQNPNLQDLQLKENWYEKLNRWEDALTAYEKRRTDDPNDNEATLGVMRCLHSLGDMDGLSELVQEKWPEAETEMRKSIATYAAAGAWSLGQWGLMEDYIKNIKSDNYYRPFYQAIIALHKNQYSEAVRYIDKTRDLLDTELTALVGESYNRAYNVVVRVQMLAELEEIITYKQYAQGVPRNVDVWQQILKVRALVISPKENMEMWIKFANLCRKSDRLEFAEKTLKLLLVGDQKLELIHPSILARXSPQVVYAHLKWMWASXVREEALEFLRDFTTRMSNNDRVGNNGLLARCYLKKGEWQKVLQDDWDRETVPDILQSYLLATQYDKDWYKAWHAWALANLEVISFYEKLKSAENNTPADQTITSVTEEISGDIQQEVLRYVYRPFKGFFRSIALSRGNCLQDTLRLLTLWFKYGYQEEVCSAIKEGYGSVNIDTWLEVIPQLIARIHAPDQKVRRLIHDLLAEVGKEHPQALIYPLTVASKSQSFNRQTAASSVMDKLRAHSAVLVEQALLVSQELIRVAILWHEIWMENLEEASRLFFIERNFEAMFNILDELQERLDRGPETLREVAFVQAYGRELQEAGGWCKKYKQTGDMTFLSQAWQIYHEMFKKITAQVGTITTLELQYVSPKLLAARDLELAVPGP

SEQ ID NO: 7009 - protein, 527 aa, Pseudomonas stutzeri
DQAGKSPNAVRYHGGDEIILQGFHWNVVREAPNDWYNILRQQAATIAADGFSAIWMPVPWRDFSSWSDGSKSGGGEGYFWHDFNKNGRYGSDAQLRQAASALGGAGVKVLYDVVPNHMNRGYPDKEINLPAGQGFWRNDCADPGNYPNDCDDGDRFIGGDADLNTGHPQVYGMFRDEFTNLRSQYGAGGFRFDFVRGYAPERVNSWMTDSADNSFCVGELWKGPSEYPNWDWRNTASWQQIIKDWSDRAKCPVFDFALKERMQNGSIADWKHGLNGNPDPRWREVAVTFVDNHDTGYSPGQNGGQHHWALQDGLIRQAYAYILTSPGTPVVYWDHMYDWGYGDFIRQLIQVRRAAGVRADSAISFHSGYSGLVATVSGSQQTLVVALNSDLGNPGQVASGSFSEAVNASNGQVRVWRSGTGSGGGEPGALVSVSFRCDNGATQMGDSVYAVGNVSQLGNWSPAAALRLTDTSGYPTWKGSIALPAGQNEEWKCLIRNEANATQVRQWQGGANNSLTPSEGATTVGRL

SEQ ID NO: 7010 - protein, 186 aa, Haloarcula marismortui
ATGPRYKVPMRRRREARTDYHQRLRLLKSGKPRLVARKSNKHVRAQLVTLGPNGDDTLASAHSSDLAEYGWEAPTGNMPSAYLTGLLAGLRAQEAGVEEAVLDIGLNSPTPGSKVFAIQEGAIDAGLDIPHNDDVLADWQRTRGAHIAEYDEQLEEPLYSGDFDAADLPEHFDELRETLLDGDIEL

SEQ ID NO: 7011 - protein, 68 aa, Gillichthys seta
  unsure (1)..(68): unsure at all Xaa locations
AAGIXFXAXXRAGTREGSVMMQVHVDTEKGGLTLNENFLVDFGKEPDGPALAHELRYPGGDCTSDIWI

SEQ ID NO: 7012 - protein, 375 aa, Arabidopsis thaliana
MSASSSSFEQPQVITCNAAVAWRAGEPLVMEEVEVSPPQPLEIRIKVVCTSLCRSDLSAWESQSLLPRIFGHEAAGIVESIGEGVTEFEKGDHVLAVFTGECGSCRHCISGKSNMCQVLGMERKGLMHSDQKTRFSIKGKPVYHYCAVSSFSEYTVVHSGCAVKVDPLAPLHKICLLSCGVAAGLGAAWNVADVQKGSSVVIFGLGTVGAKLRGAAQILGVDINPAKAEQAKTFGVTDFINSNDLSEPIPQVIKRMTGGGADFSFECVGDTGIATTALQSCSDGWGMTVTLGVPKAKPEVSAHYGLFLSGKSLKGTLFGGWKPKSDLPSLIDKYMNKEIMIDEFITHNLSFDEINKAFVLMREGKCLRCVLHMPK

SEQ ID NO: 7013 - protein, 568 aa, Homo sapiens
MPSTDLLMLKAFEPYLEILEVYSTKAKNYVNGHCTKYEPWQLIAWSVVWTLLIVWGYEFVFQPESLWSRFKKKCFKLTRKMPIIGRKIQDKLNKTKDDISKNMSFLKVDKEYVKALPSQGLSSSAVLEKLKEYSSMDAFWQEGRASGTVYSGEEKLTELLVKAYGDFAWSNPLHPDIFPGLRKIEAEIVRIACSLFNGGPDSCGCVTSGGTESILMACKAYRDLAFEKGIKTPEIVAPQSAHAAFNKAASYFGMKIVRVPLTKMMEVDVRAMRRAISRNTAMLVCSTPQFPHGVIDPVPEVAKLAVKYKIPLHVDACLGGFLIVFMEKAGYPLEHPFDFRVKGVTSISADTHKYGYAPKGSSLVLYSDKKYRNYQFFVDTDWQGGIYASPTIAGSRPGGISAAAWAALMHFGENGYVEATKQIIKTARFLKSELENIKGIFVFGNPQLSVIALGSRDFDIYRLSNLMTAKGWNLNQLQFPPSIHFCITLLHARKRVAIQFLKDIRESVTQIMKNPKAKTTGMGAIYGMAQTTVDRNMVAELSSVFLDSLYSTDTVTQGSQMNGSPKPH

SEQ ID NO: 7014 - protein, 570 aa, Saccharomyces pastorianus
MSHVNASYAHSQGSSTSVSRVEMEKPATKEVFEDPTPKKFELDDDEAGKTSSVFNPDLNLEEEVRALDELGDSFKRDRSFWGKMKALEFEVEFENKKNMVLMLGTFAAFAGILSGIDQSIISGASIGMNKMLHLSTHEASLVSSLMPLGAVAGSILLTPFSEYFGRKKSLAISCVFYTIGAIVCAAASNHHEMYAGRFLIGVGVGLEGGGIGVYIAESVPSSVRGSLVSLYQFNIALGELFGYIVGVIFFDVKGGWRYMVGSSLVFSTTLFIGLLFLPESPRWLMHKGRVGESWNVWKRLRDVKEEGNKIEFLELRDVASHDRELHANESRFQSLFDLVRVPRNRRALVYSCMMIGLGQLTGINAIMYYMSTLMKNIGFDDKQSVAMSMVGGAALLIGTVPAILWMDRFGRRTWAMTIIIFIVGLVLVGVGYQINLKTHMAAAEGVYLTGQIIYNMAFGSYAALTWVLPSESFSLGTRSAGMTVSSALLYLFAFTVTYNFEKMKEAMTYTGLTLGFYGGIALAIGIPYQLLCMPETKNRTLEEIDDIFEKPTSQIIKENIAYLKKGQLSY

SEQ ID NO: 7015 - protein, 301 aa, Sinorhizobium meliloti
MARNTLPTIAAGEGGLNRYLDEIRKFPMLEPQEEYMLAKRYQEHDDRKAAHKLVTSHLRLVAKIAMGYRGYGLPIGEVISEGNVGLMQAVKKFEPDRGFRLATYAMWWIKAAIQEYILRSWSLVKMGTTANQKRLFFNLRRLKGRIQALDEGDLKPEQVKEIATTLKVSEEKVVSMNRRLSGDASLNAPIKASEGDSGQWQDWLVDDHDNQEQILIEQDELESRRGLLANAMKVLNDRERRIFEARRLTEEPITLEDLSTEFDISRERVRQIEVRAFEKVQEAVRKAALERASALRVVEGA

SEQ ID NO: 7016 - protein, 342 aa, Oryza sativa (japonica cultivar-group); identical to SEQ ID NO: 3406

SEQ ID NO: 7017 - protein, 214 aa, Oryza sativa (japonica cultivar-group)
MKDEHLHYISERSPHLKRLVMPAWNRITKFGICQAIQRWEELESLTMPTIGHPPYIMEEIARSCKNFAELKVMGSFDDLFASAIATHLPKLKVLSLRCSKVTMSALLWLLDNMANLEVLNISHCLLFEIVANGRRQVIHELDDQTLQKASRLREFHHCQSRSCLACQRMMADEGIMRWYRYEDWFWRRDEVSSLDLQDYGKLFDAECEALTAVE

SEQ ID NO: 7018 - protein, 224 aa, Oryza sativa (japonica cultivar-group)
MTFSGTQDKCNACDKTVHFIDLLTADSIPYHKSCFRCSHCKGTLSMCSYSSMDGVLYCKTHFEQLFKETGTFKKNFPSGTKANSEQAKIPSKLSSVFCGTQDKCTACKKTVYPLEKMTMEGECYHRTCFKCAHGGCLLTNASYASHNGILYCQNHFWQLFKKSGSYDNLLKPASAAAENTVESEVAVAEPAKEDPETEEAAKEEEEEASPEQVAEAVVEDQEHS

SEQ ID NO: 7019 - protein, 1300 aa, Alcelaphine herpesvirus 1
MVLLRSGLGTRPGEEDCDGGPSTRTRGHGPLGPNIKSAAGIGGKFPPSPQGRKRKKGPKKSGGKKKKRKVTGEGPGGGEGPGGGEGPGGGEGPGGGEGPGGGEGPGGGEVPGGGEVPGGGEGPGGGEGPGGGEGPGGGEGPGGNSRKRKRGDGSKKHGGKKKKKTTVTGEGGSGPEGPERDDPDGPGSQEGPKREEGPLGPDGPEGPEGPEGEGPEGLEGPKGEGPEGPEGPEGDSPDGPGAQEGPEGLEGPEGDEGPEGPEGPEGEGPEGPEGPKGDSPDGPGAQEGPEGPGGPDEDEGPEEPEGPEGEGPEGPEGEGPEGLEGPEGEGPEGPEGPEGDSPDGPDAQEGPEGPGGPDEDEGPEEPEGPEGEGPEGPEGPEGEGPEGPEGPEGEGPEGLEGPEGEGPEGPEGPEGDSPDGPGAQEGPEGPEGPEGEGPEGLEGPEGEGPEGPEGPEGEGPEGPEGPEGEGPERPEGPEGEGPEGPEGPEGEGPEGPEGPERDSPDGPGAQEGPEGPEGPEGEGPEGLEGPEGEGPEGPEGPEGEGPEGPEGPEGEGPEGPEGPERDSPDGPGAQEGPEGPEGPEEDEGPEGPEGPEGEGPEGPEGEGPEGLEGPEGDEGPEEPEGPEGDSPDGPGAQEVPEGPKGPEGECQSGPSSCEGQQVPKGPDGPEEGSSGPGSSEGEGPSGPGSSEGQQVPKGAEGSEGEGPCRPGGPDEDGDPEGPDGTEGEGPCGPGGPDEDGDPEGPDGTEGEGPCGPGGPDEDGDPEESEGTEDDIKVGLTELLGSMKLDSSDSDSDNSSDSANRRALEGVCGSHSSSKDSDDEEEEEEEEEEEEEEEEDDEEEEEDDEEEEEDDEEEEEDDEEEEEDDEEEEEDDEEEEEEEVIIITSSGEDGCGSSDVVCVGEEKGEGEKGKGREEDGGEGGEGGEGGEGGEGGEGGEGGEGGEGGEGGEGGEGGEGGEGGEGGEGGEGGEGGEGGEGGEGGEGGEGGEGGEGGEGGEGGEGGEGGEGGEGGERGKGGEGGEGGEGGEGGEGSEEDKKPFPCPRSPGVSGFYDLTWSSSDRSTEGSRGSPGPDDLDGRPGSQGPPTLSPQGFPGSGYGSNYDDDREPPVLSPQCGGPSGNEGDESDPDSSREPPDLSPQNPPEGDNGNESDSDPSYQPLGGSSSSSEDDDPGEGTSQGPPKRPPKHHPQTKRAQGKTLGLDPLYDPRQKAATFSLHLGCPTKDPLVRLSRMIRTLHPEGPHSSIFFTGGQYVVVFYVTSYFEAKKLKDFIIREQNRNPLQGRVNVSLARHYPPFPFPHE

SEQ ID NO: 7020 - protein, 365 aa, Trypanosoma brucei
MDIPQELACPTEDRRLYVVRGQTFEVGRSHKLVKFIGSGSYGSVCSAVDEDSGERVAIKRIQRVFSDLKEGKRILREMDILTSLHHTNLVRLRQFIRPVRKDDFSDIYIVMDLYDTDLHRIIRSRQSLTNEHYQYLMIQAFRGLFYLHTAKVIHRDLKPSNLLVNADCTLAICDFGLARDDQCTQTSALTEYVVTRWYRPPEVLGMGSHRYTNAVDVWSLGLIFAELMVGKTLLPGSDYIHQLIMIVHLLGTPASEDMEFLSEEAKNFLLAQPFQEARPFTELFPAATPEAADLLSKLLVFHPDKRLTAKEVIEHAYFAKFRNPAAETGAKEPYVWRHNEGLTLEGLREEMWRIILAHSPGPKGD

SEQ ID NO: 7021 - protein, 383 aa, Arabidopsis thaliana
MGGYHVSPGGFMRGAVYREPNKPLTIEEFHIPRPKSNEILIKTKACGVCHSDLHVMKGEIPFASPCVIGHEITGEVVEHGPLTDHKIINRFPIGSRVVGAFIMPCGTCSYCAKGHDDLCEDFFAYNRAKGTLYDGETRLFLRHDDSPVYMYSMGGMAEYCVTPAHGLAPLPESLPYSESAILGCAVFTAYGAMAHAAEIRPGDSIAVIGIGGVGSSCLQIARAFGASDIIAVDVQDDKLQKAKTLGATHIVNAAKEDAVERIREITGGMGVDVAVEALGKPQTFMQCTLSVKDGGKAVMIGLSQAGSVGEIDINRLVRRKIKVIGSYGGRARQDLPKVVKLAESGIFNLTNAVSSKYKFEDAGKAFQDLNEGKIVSRGVVEIL

SEQ ID NO: 7022 - protein, 577 aa, Arabidopsis thaliana
MEIPSLNKQQEFTLASVTDLTSPSSSLSSSPVVATFSCVNEVKELRFQESKSSDGFSFDLSSTQLFKLGPLQFTCVSDGSISSAKEKSSFSRGVVIKFRDEKDSKEFCDSFEECKKDDAVKQGSALPNGTVVSANKSKFDDKIEAASAKMYFHYYGQLLHQQNMLQDYVRTGTYHAAVMENRSDFSGRVVVDVGAGSGILSMFAALAGAKHVYAVEASEMAEYARKLIAGNPLLAERITVIKGKIEDIELPEKADVLISEPMGTLLVNERMLETYVIARDRFLSPNGKMFPTVGRIHMAPFADEFLFVEMANKALFWQQQNYYGVDLTPLYVSAHQGYFSQPVVDAFDPRLLVAPSMFHVIDFTMMTVKLFPTLDSVPRCFLKIEDTFLSCYFYVQSSLFSEWHDPNSITVKFFSQEEQFYEIDIPLKFTASVCTRIHGLACWFDVLFDGSTVQRWFTTAPGAPTTHWYQIRCVLSQPIHVMAGQEITGRLHLIAHSAQSYTINLTLSAKMWGPGANQGGILQTSSCKLDLKEPYYRMSQPQVYPTQEPPAQSQDIHIHSDDLEELELLQQNANAQL

SEQ ID NO: 7023 - protein, 333 aa, Arabidopsis thaliana
MSPEEELQSNVSVASSSPTSNCISRNTLGGLKEHNYLGLSDCSSVGSSTLSPLAEDDKATISLKATELTLGLPGSQSPARDTELNLLSPAKLDEKPFFPLLPSKDEICSSSQKNNASGNKRGFSDTMDQFAEAKSSVYTEKNWMFPEAAATQSVTKKDVPQNIPKGQSSTTNNSSSPPAAKAQIVGWPPVRSYRKNTLATTCKNSDEVDGRPGSGALFVKVSMDGAPYLRKVDLRSYTNYGELSSALEKMFTTFTLGQCGSNGAAGKDMLSETKLKDLLNGKDYVLTYEDKDGDWMLVGDVPWEMFIDVCKKLKIMKGCDAIGLGKVYSSLCS

SEQ ID NO: 7024 - protein, 368 aa, Arabidopsis thaliana
MGFLWRTRSNEKKITPVLSWPESEPESEITIPPEFQSLIQRIPTPRVPLMPCEVYEISRKLSSATRRGDYEKCGVIIEKIKKLGDESEKNRKCVNENSVGWVLCDCFDKFSGDEKLTFMLNEILSLLTWMFPIGLEGISKLASATSFRCVAGLLKSTDDSVRQNAAFIMKEILSLDETRVHSFAVENGVAEALVKLIRDSVSSSSTKSSLIAIYQMVLQKPEIASEFLEIGLVSITVEMIVDAENSVCEKALAVLDAICETEHGREEVRKNALVMPLLVKKIAKVSELATRSSMSMILKLWKTGNTVAVEDAVRLGAFQKVLLVLQVGYGEETKEKATELLKMMNTQMKLMSDCVDSLKEFKYIKKPF

SEQ ID NO: 7025 - protein, 213 aa, Arabidopsis thaliana
MTDPHTARTIVGIVGNVISFGLFCAPIPTMVKIWKMKSVSEFKPDPYVATVLNCMMWTFYGLPFVQPDSLLVITINGTGLFMELVYVTIFFVFATSPVRRKITIAMVIEVIFMAVVIFCTMYFLHTTKQRSMLIGILCIVFNVIMYAAPLTVMKLVIKTKSVKYMPFFLSLANFMNGVVWVIYACLKFDPYILVNPHIYLYCLELKSLHLKKD

SEQ ID NO: 7026 - protein, 88 aa, Arabidopsis thaliana
MKLLGEYEPEKLQTLFSAYIKKGVEAESIEEMYKKVHAAIRAEPNHKKTEKPATKEHKRYDLKKLTYEERKNKLIERVKALNGASGDW

SEQ ID NO: 7027 - protein, 332 aa, Serratia entomophila
MSQNTLKVNELHDDADFDENGTEAESFDEKALVEEEASENDLAEEELLSQGVTQRVLDATQLYLGEIGYSPLLTAEEEVYFARRALRGDVPSRRRMIESNLRLVVKIARRYSNRGLALLDLIEEGNLGLIRAVEKFDPERGFRFSTYATWWIRQTIERAIMNQTRTIRLPIHIVKELNVYLRTARELSHKLDHEPSAEEIAEQLDKPVHDVSRMLRLNERMPSVDTPLGGDSEKALLDILADEKDNGPEDTTQDDDMKQSIVKWLFELNAKQREVLARRFGLLGYEAATLEDVGREIVLTRERVRQIQVEGLRRLREILQMQGLSIEALFRE

SEQ ID NO: 7028 - protein, 221 aa, Arabidopsis thaliana
MSLVIYNYRKTFWRIFKKKSVEEFSYVPYVATVMNCMLWVFYGLPVVHKDSILVSTINGVGLVIELFYVGVYLMYCGHKKNHRRNILGFLALEVILVVAIILITLFALKGDFVKQTFVGVICDVFNIAMYGAPSLAIIKVVKTKSVEYMPFLLSLVCFVNAGIWTTYSLIFKIDYYVLASNGIGTFLALSQLIVYFMYYKSTPKEKTVKPSEVEISATERV

SEQ ID NO: 7029 - protein, 939 aa, Arabidopsis thaliana
MRGSALLDLILFLLVSPLAHSFKGSEISKFYDKSISNQISQSDRLVFFRFFSFDSFDISSIGSFLYIGFDLIRKCQHLFDLVSKLTPLYKSEFLTNYNDRDIYRESGYVLVSTVDGSISLVDMSSQKLDWTFHTNEPIYSSYQAPHYHYTTDEERSSVLGDDFYMDCDKDWRLYNSSVRKGKRVNEIVDASEFIGTLPYTSTDRIVLGKKDTSVFLLDWKTGKLVKRYRMDELYSNTVVENDKEKAIVLSKEAPLLFGSGFKKSEDFPELVYIERKDFKIQCISKFGDVLWSVSYAKMEAKLQNHESVQFISGLSSSVGKNQFPLSYTTSVPMVQLRNVKYETLFPRLGFLDEALYLPFQDRKPNQLAIGDGNQLTLPGNKEAEEVLSLPLPETVISQITDIIDGSTKQAGFASKFSGLIVLIFGFCVTMLSVCGLFFYRLRQSIRIKEPYVSEVPIATPKKKKSKKNGTTKAVHKKENGFISGGNKDPSHEENEKRLLTAFPGLNNSSAEGYRVGKLFVSNKEIAKGSNGTVVLEGSYEGRLVAVKRLVQSHHDVAQKEILNLMASDKHSNIVRWYGVDQDEHFIYISLELCACSLNDLIYASSALLESPMASSSIHSIQINPIFENGKGVELWKENGHPSPVLLKLMRDIVAGLVHLHDIGIVHRDLKPQNVLIVKNSSLCAKLSDMGISKRLPADTSALTRNSTGSGSSGWQAPEQLRNERQTRAVDLFSLGCVLFFCMTGGKHPYGDNYERDVNVLNDQKDLFLIESLPEAVHLLTGLLNPDPNLRPRAQDVMHHPLFWNSDMRLSFLRDASDRVELENREEGSQLLAALESTAAVTLNGRWDEKLDSIFLDNIGRYRRYKFDSIRDLLRVIRNKLNHYRELPKELQELLGSVPEGFERYFSSRFPKLLIQVYTVLFDYCNNEEFFFKYSKTTVF

SEQ ID NO: 7030 - protein, 887 aa, Arabidopsis thaliana
MTLLKRKFSYKSRQSCHYETNQNQRENLRFILLVIGLKVHNTMEMTSGSLGNGIPEAMGQNRGNIKRCLEKYIENGRRVMKLNELMDEMEIVINDVTQRRRVMEGDLGKILCFTQEAVVIPPNVAFAVRGTPGNWQYVKVNSSNLSVEALSSTQYLKLKEFLFDENWANDENALEVDFGALDFTLPWLSLSSSIGNGLSFVSSKLGGRLNDNPQSLVDYLLSLEHQGEKLMMNETLNTARKLEMSLILADVFLSELPKDTPFQAFELRFKECGFEKGWGESAGRVKETMRILSEILQAPDPQNIDRFFARVPRIFNVVIFSVHGYFGQTDVLGLPDTGGQVVYILDQVKALEDELLQRINSQGLNFKPQILVVTRLIPDAKKTKCNQELEPIFGTKYSNILRIPFVTENGILRRWVSRFDIYPYLERFTKDATTKILDILEGKPDLIIGNYTDGNLVASLMANKLGITQATIAHALEKTKYEDSDIKWKEFDPKYHFSSQFTADLISMNSADFIIASTYQEIAGSKERAGQYESHMSFTVPGLYRVVSGINVFDPRFNIAAPGADDSIYFPFTAQDRRFTKFYTSIDELLYSQSENDEHIGYLVDKKKPIIFSMARLDVVKNLTGLTEWYAKNKRLRDLVNLVIVGGFFDASKSKDREEISEIKKMHSLIEKYQLKGQFRWITAQTDRTRNGELYRSIADTRGAFVQPAHYEAFGLTVIEAMSCGLVTFATNQGGPAEIIVDGVSGFHIDPSNGEESSDKIADFFEKSGMDPDYWNMFSNEGLQRINECYTWKIYANKVINMGSTYSYWRHLNKDQKLAKQRYIHSFYNLQYRNLVKLLVFYFCVKTIPILSDIPEPPPLPPKPLLEANTAAIEFQVVWCLSSLLNK

SEQ ID NO: 7031 - protein, 569 aa, Arabidopsis thaliana
MNNRGNNDDLDHHYGVFNGNFFLNDLRTSQENQNKIIRFDFESCFFVIDFERRMTSRKKSVLDNTSPMIWKTVSERKSSPGIEGLNLSSFDRPMAPTTEIRELRVFLATWNVGGRTPNNDLNLEDFLLVEGTADLYICGFQEIVPLSAGNVLVVEDNEPAAKWLALISQALNKPKQESVYSNAAYSASRTTTCSSSSCGSEESRAPSSLSFFQRPNLKVLSRNYRVDSSLLKTCNCPVIDTSVGWEARRSKRFSDPSTDSSNNVEPENFRVHENFLFDDVPATTKMPGQMSYRLIASKQMVGLFLSVWARRELIPHISHLRLDSVGRGIMGRLGNKGCIAISMSLHQTSFCFVCSHLASGEKEGDELRRNADVAEILKHTQFPKLTKNPNCHAPERIIDHDRVLWLGDLNYRVALTYEETRVLLEDNDWDTLLERDQLNMERGAGRVFSGFQEGQIFFAPTYKYSQNSDAYAGEMTKSKKKRRTPACVIVWIWNVCRCDRILWKGEGIEQLSYIRGESRFSDHRPVCAIFAVEVDVKSLNKGRFRKGYSCAAVRLVEDVAIPQRHSFYD

SEQ ID NO: 7032 - protein, 917 aa, Pseudomonas fluorescens
MLKKLGIKGRVLLLTLLPTSLMALVLGGYFTWMQLSDLQTQLLQRGEMIAEQLASLVAPAMGNHNTQMLERIATQALEQQDVRAVSLLAPDRSLLAHAGPSMLNPPPAGNSSHMMQRSGSDATRYQLPVFGRHRNLAGDLIPDESDRLLGWVELELSHSGMLLRGYRSLFASLLLIAAGLAGTALLAVRMGRTINNPLTQIKQAVAQLKDGNLETRLPPLGSQELDELASGINRMASTLQNAQEELQHSIDQATEDVRQNLETIEIQNIELDLARKEALEASRIKSEFLANMSHEIRTPLNGILGFTHLLQKSELTPRQLDYLGTIEKSADSLLGIINEILDFSKIEAGKLVLDSIPFNLRDLLQDTLTILAPAAHAKQLELVSLVYRDTPLSLVGDPLRLKQILTNLVSNAIKFTREGTIVARAMLEEEHEDSVQLRISIQDTGIGLSNQDVRALFQAFSQADNSLSRQPGGTGLGLVISKRLIEQMGGEIGVDSTPGEGSEFWISLNLPKTRDDAEDLPGPPLLGRRVAVLENHELARQALQHQLEDCGLEVTPFNTLEALTNGITGVHQSEQAIDLAVLGITTNDMSPERLSQHIWDLEHLGCKVLVLCPTTEQTLFHLSVPNPHSQLQAKPACTRKLRRALSDLVTPRRARSEPEETLSSRAPRVLCVDDNPANLLLIQTLLEDMGAKVLAVDNGYAALNAIQTEPFDLVMMDVQMPGMDGRQSTEAIRQWESERHGTPLPIVALTAHAMANEKRALLQSGMDDYLTKPISERQLAQVVLKWTGLALRNQGPERASERPELGLELQVLDQDEGLRLAAGKADLAADMLAMLLASLDADREAIKAARAANDQNALIERVHRLHGATRYCGVPQLRAACQRSETLLKQEDAKAFAALDELDHAIGRLAAEARTNA

SEQ ID NO: 7033 - protein, 442 aa, Hydra vulgaris
MVILRNYIQKRIVPFHQLIAGIFFMSGGRVRTTTLVDTGKNMSPSNNGGIRITRDKDGSKVTSVLATTASYPDQTEEISYCDTKVIGNGSFGVVYQAKIVDSTDMIAIKKVLQDKRFKNRELQIWRKLDHCNIAKLRHFFYTNGEKKDEVYLNLVMDYMPETVYRVARHYTKNRQTIPIIYIKLYVYQLFRPLAYIHSLGVCHRDIKPQNLLLNPDSGVLQLCDFGSAKVLIPGEPNVAYICSRYYRAPELIFGATDYTVNIDTWSAGCVLAELLLGQPIFPGDSGVDQLVEIIKVLGTPTREQIREMNQHYTEFRFPQIKPHPWSRVFRAKSPSDAISLTSQLLEYTPSSRCSPLEACAHPFFDELRVEGVRLPNNKEMPKLFNFSAQELSSKPSFSPSYSPLVKKHQSSTSLASTPSTISNQVNTTDSNKTSINISTEAS

SEQ ID NO: 7034 - protein, 709 aa, Narcissus pseudonarcissus
MAVNGSLFSSQAANFTLLRTPFSSSACRGQFHVGASGSEGERKLSVKKEKNTSKIVYSGEKPAVPLLDTINDPAHMKNLSTQDLEQLASELRLDIVHSVSKTGGHLSASLGVVDLTVVLHHVFDTPDDKIIWDVGHQAYAHKILTGRRSRMHTLRQTSGLAGFPKRDESVHDAFGAGHSSTSISAGLGMAVARDLLGKSNHVISVIGDGVMTAGQAYEAMNNVGYLDSNLIVVLNDNKQVSLPTATLNGPATPVGALSGALAKLQASAKFRQLREAAKCITKQIGGQAHEVAAKVDEYARGMISASGASLFEELGLYYIGPVDGHNVEDLVAIFKKVKAMPSPGPVLVHIVTEKGKGYPPAEAAADKMHGVVKFDPKTGKQFKTKFPTLSYTQYFAESLVKEAEVDEKIVAIHAAMGGGTGLNFFQKKFPDRCFDVGIAEQHAVTFAAGLATEGLKPFCAIYSSFLQRGYDQVVHDVDLQKLPVRFALDRAGLVGADGPTHCGAFDVTYMACLPNMIVMAPSDEAELMHMVATAAAIDDRPSCFRFPRGNGVGVALPSDYKGTPLEIGKGRILMEGDKVAILGYGSIVQSCLKAAGSLRERGISATVADGRFCKPLDSELIRRLVNEHEILITVEEGSIGGFASHVSHFLSLNGLLDGHLKLRSMVLPDRYIDHGAPKDQIEEAGLSSKHIAGTVLSLLGRPMEAFQLQ

SEQ ID NO: 7035 - protein, 483 aa, Emericella nidulans
MDFAKLLVASPEVNPNNRKALTIPVLNPFNTYGRVFFFSWFGFMLAFLSWYAFPPLLTVTIRDDLDMSQTQIANSNIIALLATLLVRLICGPLCDRFGPRLVFIGLLLVGSIPTAMAGLVTSPQGLIALRFFIGILGGTFVPCQVWCTGFFDKSIVGTANSLAAGLGNAGGGITYFVMPAIFDSLIRDQGLPAHKAWRVAYIVPFILIVAAALGMLFTCDDTPTGKWSERHIWMKEDTQTASKGNIVDLSSGAQSSRPSGPPSIIAYAIPDVEKKGTETPLEPQSQAIGQFDAFRANAVASPSRKEAFNVIFSLATMAVAVPYACSFGSELAINSILGDYYDKNFPYMGQTQTGKWAAMFGFLNIVCRPAGGFLADFLYRKTNTPWAKKLLLSFLGVVMGAFMIAMGFSDPKSEATMFGLTAGLAFFLESCNGAIFSLVPHVHPYANGGSSPAWWVDSGTSAVSSSPSSSAIVITTTRAASGF

SEQ ID NO: 7036 - protein, 602 aa, Lycopersicon esculentum
MASAVLASRNESSWAQSGGAGGGFMGKTPYSHTQLNPNHNPNPKKKQKQFHHTSNGRHMDDSPAVTQTASDDAYSFNQRPIESTTNVDGLNFGGYLTFNVVSYNKAEVNELRSRLMAEVEQIRNLKDRIESGQLSTTNPRSQGKSKKQSGNKRPTPSGSSKDLKKLPNGVENRNFGNPGGVDGVKAIGTESMMKECRQILAKLMKHKNGWIFNIPVDAEALGLHDYHQIIKRPMDLGTVKSNLAKNFYPSPFEFAADVRLTFNNALLYNPKTDQVNAFAEQLLGRFEDMFRPLQDKMNKLEGGRRDYHPVDELQGSSWNHIPTPERVKKPKPTPVPNISKKQERMQNHSSASTPSLPVPPPNPPARQQSPLSTPSPVRAPAAKPQSAAKVPTMGKQPKPRAKDPNKREMNMEEKHKLGVGLQSLPQEKMPQLVQIIRKRNEHLAQDGDEIELDIEALDTETLWELDRFVTNWKKMVSKTKRQALMNNLGPPSASAAASAATTSVAEADGPTTSEKNDSFKKAKKGDVGEEDVEIEDDEPATHFPPVEIEKDEGGGRDQENGGGGGSSSSSSSSSSSSGSSSSSDSDSGSSSGSDSDADDAHS

SEQ ID NO: 7037 - protein, 156 aa, Brassica oleracea var. acephala
AQTNWSMEYSRLKAKIELLERNQRHYLGKDLESISIKELQNLEQQLDTSLKHIRSRKNQLMHESLNHLQRKEKEILEENSMLAKQIKERESILRTHQNQSEQQNRSHHVAPQPQPQLNPYMASSPFLNMGGMYQGEYPTAVRRNRLDLTLEPIYNC

SEQ ID NO: 7038 - protein, 156 aa, Brassica oleracea var. acephala
AQTNWSMEYSRLKAKIELWERNQRHYLGEDLESISIKELQNLEQQLDTSLKHIRSRKNQLMHESLNHLQRKEKEILEENSMLAKQIKERESILRTHQNQSEQQNRSHHVAPQPQPQLNPYMASSPFLNMGGMYQGEYPTAVRRNRLDLTLEPIYNC

SEQ ID NO: 7039 - protein, 156 aa, Brassica oleracea var. acephala
AQTNWSVEYSRLKAKIELLERNQRHYLGEDLESISIKELQNLEQQLDTSLKHIRSRKNQLMHESLNHLQRKEKEILEENSMLAKQIKERESILRTHQNQSEQQNRSHHVAPQPQPQLNPYMASSPFLNMGGMYQGEYPTAVRRNRLDLTLEPIYNC

SEQ ID NO: 7040 - protein, 156 aa, Brassica oleracea var. italica
AQTNWSVEYSRLKAKIELLERNQRHYLGEDLESISIKELQNLEQQLDTSLKHIRSRKNQLMHESLNHLQRKEKEILEENSMLAKQIRERESILRTHQNQSEQQNRSHHVAPQPQPQLNPYMASSPFLNMGGMYQGEYPTAVRRNRLDLTLEPIYNC

SEQ ID NO: 7041 - protein, 130 aa, Brassica incana
AQTNWSMEYSRLKAKIELLERNQRHYLGEDLESISIKELQNLEQQLDTSLKHIRSRKNQLMHESLNHLQRKEKEILEENSMLAKQIKERESILRTHQNQSEQQNRSHHVAPQPQPQLNPYMASSPFLNMG

SEQ ID NO: 7042 - protein, 468 aa, Medicago sativa
MNMMRRLKSIASGRTSISSDPGGDSNSKRVKLDQETEKVYEGINSLGRNDREQCVDASKEASVGTSNEVSTETKTEKKSGFDELPKELHEMKIRDEKSKNNNEKDIEATTVSGNGTETGQIITTTIAGRDGQPKQTISYMAERVVGTGSFGVVFQAKCLETNEAVAIKKVLQDKRYKNRELQVMRMVDHPNIVKLKHCFYSTTEKDELYLNLVLEFVPETVYKVSKNYIRIHQHMPIIHVQLYTYQILRGLNYLHEVIGVCHRDIKPQNLLVNPQTRQLKICDFGSAKMLVPGEPNISYICSRYYRAPELIFGATEYTTAIDMWSVGCVLAELLLGQAMFLGESGVDQLVEIIKVLGTPTREEIRCMNPNYNEFKFPQIKAHPWHKLFHKRMPSEAVDLVSRLLQYSPHLRCTALAACAHPFFNDLRDPNASLPNGQPLPPLFNFTPQELVNAPEDLRQRLIPEHARS

SEQ ID NO: 7043 - protein, 566 aa, Sulfolobus acidocaldarius
MKRYESLWFEDELKHVWMISAELEKVASLGGLGPVVYNLGKELVKQGIKVTVIMPSHGRHLNDYYRSLLKLNEISLVAEGDRIGIDGKSYHYKLGFEHGNLDGMNVVLIKGLDYNTGRIIDSWNIYDNAMEKSSLLARAVEKYAKFSIPNDIPSIIHVHDWHSVIAGVTAKFTFEARRVIVPLVFTVHLLNKVSAPWHYASEDWSGLMNYPHYIWRIIKHDLYTTREVWDFFSSGSIEKFGSYEADLITSVSKSYLTYDIFNFIGNWIENKSCIHYNGTDWEVEETKKYAYSKFGTEDRAEIRKRLFDELEVLRVTPEDYTTGNILWNNRFNIGIKDDWTYSRLENGPLILFAGRMVYQKGIDSLLIAFDEVLKTINNARLIILGLPSSDYGLLQNVVSNISRHGGNIRIILGKMSKELYRLFYYSASVFVIPSRWEPFGLVAVESMAVGTPVVAYSVGGLRESIVDIRVDQEQGTGLLVEPENVWELSKALISALSLSMASETNNGDFLKYTEVKTNDVKLWDKIRQNCVRRVNENFRWSASAKQLQECYSKAQTMAKYRLLASF

SEQ ID NO: 7044 - protein, 520 aa, Trametes versicolor
MSRFQSLLAFVVASLAAVAHAAIGPTADLTISNAEVSPDGFARQAVVVNNVTPGPLVAGNKGDRFQLNVIDNLTNHTMLKSTSIHWHGFFQKGTNWADGPAFVNQCPISSGHSFLYDFQVPDQAGTFWYHSHLSTQYCDGLRGPFVVYDPNDPHASLYDVDNDDTVITLADWYHTAAKLGPAFPLGADATLINGLGRSPSTTAADLAVINVTKGKRYRFRLVSLSCDPNHTFSIDGHDLTIIEVDSINSQPLVVDSIQIFAAQRYSFVLNADQDVGNYWIRANPNFGNVGFAGGINSAILRYDGADPVEPTTTQTTPTKPLNEVDLHPLATMAVPGSPVAGGVDTAINMAFNFNGTNFFINGASFVPPTVPVLLQIISGAQNAQDLLPSGSVYSLPSNADIEISFPATAAPPGAPHPFHLHGHAFAVVRSAGSTVYNYDNPIFRDVVSTGTPAAGDNVTIRFRTDNPGPWFLHCHIDFHLEAGFAVVFAEDIPDVASANPVPQAWSDLCPIYDALDVNDQ

SEQ ID NO: 7045 - protein, 170 aa, Sus scrofa
GCAPAEEYLCQAFSDVILAVNDVDAEDGGDPNLCSEYVKDIYDYLRQLEEEQAVRPKYLLGREVTGNMRAILIDWLVQVQMKFRLLQETMYMTVSIIDRFMQDNCVPKKMLQLVGVTAMFIASKYEEMYPPEIGDFAFVTDNTYTKYQIRQMEMKILRALNFCLGRPLPL

SEQ ID NO: 7046 - protein, 284 aa, Homo sapiens [sequence omitted]

SEQ ID NO: 7047 - protein, 127 aa, Homo sapiens
MWKSRSDPVLHIDLRRWADLLLVAPLDANTLGKVASGICDNLLTCVMRAWDRSKPLLFCPAMNTAMWEHPITAQQVDQLKAFGYVEIPCVAKKLVCGDEGLGAMAEVGTIVDKVKEVLFQHSGFQQS

SEQ ID NO: 7048 - protein, 360 aa, Escherichia coli
MSQNTLKVHDLNEDAEFDENGVEVFDEKALVEEEPSDNDLAEEELLSQGATQRVLDATQLYLGEIGYSPLLTAEEEVYFARRALRGDVASRRRMIESNLRLVVKIARRYGNRGLALLDLIEEGNLGLIRAVEKFDPERGFRFSTYATWWIRQTIERAIMNQTRTIRLPIHIVKELNVYLRTARELSHKLDHEPSAEEIAEQLDKPVDDVSRMLRLNERITSVDTPLGGDSEKALLDILADEKENGPEDTTQDDDMKQSIVKWLFELNAKQREVLARRFGLLGYEAATLEDVGREIGLTRERVRQIQVEGLRRLREILQTQGLNIEALFRESICQKGQSQARLAFFFWLGSRCVCGLDKPR

SEQ ID NO: 7049 - protein, 269 aa, Styphnolobium japonicum
PHHVKPPPVYQPPHHEKPPPAYPPPHHEIPPPVYPSPHEKPPPEYQPPPHEKPPPEYQPPPHVKPPPAYQPPPHVKPPPVYQPPHHEKPPPEYQPPPHEKPPPEYQPPHHVKPPPVYPPPHHEKPPPVHQPPPHEKPPPEYQPPPHVKPPPVYQPPPHVKPPPVYQPPPHHEIPPPEYQPPHHVKPPPVYQPPPHEKPPPVYQPPHHEIPPPVYPPPRENKPPPEYQPPPHVKPPPAYQPPPHEKPPPVYPPPHHEKPPPAYPPPHEKP

SEQ ID NO: 7050 - protein, 244 aa, Cladrastis kentukea
PVLANYKPPTYEPPATEKPPTYEPPPTEKPPPVYKPPIYPPPVHHPPHEKPPPVYPPPHEKPPPVYQPPPHEKPPPVYQPPPHVKPPPVYQPPPHVKPPPVYQPPPHEKPPSVYPPPHEKPPPVYQPPPHEKPPPVYPPPHEKPPPVYQPPPHEKPPPVYPPPHEKPPPVYQPPPHEKPPPVYPPPHEKPPPVYQPPPHEKPPVYKPPGYEPPPVEKPPVYKPPVEKPPSYKPPPYGHYPPSKN

SEQ ID NO: 7051 - protein, 308 aa, Maackia amurensis
PVLANYKPPIYEPPPTEKPPTYEPPEIEKPPPVYQPPPVHYPPPHVKPPPEYEPPPEYEPPPEYQPPHEKPPPEYQPPHEKPPPEYQPPHEKPPPEYPPPHEKPPPEFPPPYEKPPPEYQPPYEKPPPLYPPPHEKPPVEYPPPHEKPPPVYQPPYEKPPIEYPPPHEKPPPVYQPPYEKPPPVYPPPHEKPPIEYPPPHEKPPPVYQPPYEKPPPTYPPPHEKPPIEYPPPHEKPPYEKPPPLYPPPYEKPPPLYPPPHHHKPPHHEKPPFYKPPVYEPPPLEKPPPVEKPPSYKPPPYRHYPPSKN

SEQ ID NO: 7052 - protein, 514 aa, Leishmania donovani
MATNNANYRIKTIKDGCTAEELFRGDGLTYNDFIILPGFIDFGAADVNISGQFTKRIRLHIPIVSSPMDTITENEMAKTMALMGGVGVLHNNCTVERQVEMVKSVKAYRNGFISKPKSVPPNTPISNIIRIKEEKGISGILVTENGDPHGKLLGIVCTKDIDYVKNKDTPVSAVMTRREKMTVERAPIQLEEAMDVLNRSRYGYLPIVNENDEVVNLCSRRDAVRARDYPHSTLDKSGRLICAAATSTRPEDKRRVAALADVGVDVLVLDSSQGNTIYQIAFIKWVKSTYPHLEVVAGNVVTQDQAKNLIDAEADGIRIGMGSGSICITQEVLACGRPQGTAVYKVAQYCASRGVPCTADGGLRQVGDICKALAIGANCAMLGGMLSGTTETPGEYFFKGGVRLKVYRGMGSLEAMSQGKESGKRYLSENEAVQVAQGVSGNVVDKGSAAKLIAYVSKGLQQSAQDIGEISFDAIREKMYAGQVLFSRRSPTAQGEGGVHSLHSYEKKLFAAKM

SEQ ID NO: 7053 - protein, 284 aa, Leishmania major
MAGVDKAMVTLSNGVKMPQFGLGVWQSPAGEVTENAVKWALCAGYRHIDTAAIYKNEESVGAGLRASGVPREDVFITTKLWNTEQGYESTLAAFEESRQKLGVDYIDLYLIHWPRGKDILSKEGKKYLDSWRAFEQLYKEKKVRAIGVSNFHIHHLEDVLAMCTVTPMVNQVELHPLNNQADLRAFCDAKQIKVEAWSPLGQGKLLSNPILSAIGAKYNKTAAQVILRWNIQKNLITIPKSVHRERIEENADIFDFELGAEDVMSIDALNTNSRYGPDPDEAQF

SEQ ID NO: 7054 - protein, 135 aa, Trypanosoma cruzi
MATPRQAAKKASKKRSGGRSAKAGLIFPVGRVGSLLRRGQYARRIGASGAVYMAAVLEYLTAELLELSVKAASQQAKKPKRLTPRTVTLAVAHDDDLGMLLKDVTVSRGGVMPSLNKALAKKHKSSKKARATPSA

SEQ ID NO: 7055 - protein, 301 aa, Dictyostelium discoideum
MTEVEKIYEFKEELGRGAFSIVYLGENKQTKQRYAIKVINKSELGKDYEKNLKMEVDILKKVNHPNIIALKELFDTPEKLYLVMELVTGGELFDKIVEKGSYSEADAANLVKKIVSAVGYLHGLNIVHRDLKPENLLLKSKENHLEVAIADFGLSKIIGQTLVMQTACGTPSYVAPEVLNATGYDKEVDMWSIGVITYILLCGFPPFYGDTVPEIFEQIMEVNYEFPEEYWGGISKEAKDFIGKLLVVDVSKRLNATNALNHPWLKSNNSNNTIDTVKMKEYIVERRKNSNENWLTKRIFQ

SEQ ID NO: 7056 - protein, 103 aa, Physarum polycephalum
MSGRGKGGKGLGKGGAKRHRKVLRDNIQGITKPAIRRLARRGGVKRISKTIYEETRGVLKTFLENVIRDAVTYTEHARRKTVTAMDVVYALKRQGRTLYGFGG

SEQ ID NO: 7057 - protein, 145 aa, Stylonychia lemnae
MSENFKSSNRITNLRRFVNNSSLYKDPPSVNQQQFHKLINQMAGRGKVGKGYGKVGAKRHTKKSLKETIMGITKPAIRRLARRGGVKRISSLIYEETRNVLRSFLENVIRDSVTYTEHAKRKTVTALDVVYALKRQGRTLYGFGG

SEQ ID NO: 7058 - protein, 308 aa, Homo sapiens
EKATKVQDIKNNLKEAIETIVAAMSNLVPPVELANPENQFRVDYILSVMNVPDFDFPPEFYEHAKALWEDEGVRACYERSNEYQLIDCAQYFLDKIDVIKQADYVPSDQDLLRCRVLTSGIFETKFQVDKVNFHMFDVGGQRDERRKWIQCFNDVTAIIFVVASSSYNMVIREDNQTNRLQEALNLFKSIWNNRWLRTISVILFLNKQDLLAEKVLAGKSKIEDYFPEFARYTTPEDATPEPGEDPRVTRAKYFIRDEFLRISTASGDGRHYCYPHFTCAVDTENIRRVFNDCRDIIQRMHLRQYELL

SEQ ID NO: 7059 - protein, 285 aa, Homo sapiens
MSDKLPYKVADIGLAAWGRKALDIAENEMPGLMRMRERYSASKPLKGARIAGCLHMTVETAVLIETLVTLGAEVQWSSCNIFSTQDHAAAAIAKAGIPVYAWKGETDEEYLWCIEQTLYFKDGPLNMILDDGGDLTNLIHTKYPQLLPGIRGISEETTTGVHNLYKMMANGILKVPAINVNDSVTKSKFDNLYGCRESLIDGIKRATDVMIAGKVAVVAGYGDVGKGCAQALRGFGARVIITEIDPINALQAAMEGYEVTTMDEACQEGNIFVTTTGCIDIILGR

SEQ ID NO: 7060 - protein, 195 aa, Fagus sylvatica
YSGVPTRYSYDDLQAITENFSKELGAGGFGTVFGGTSIDGIKVAVKRLDGLSQIKKSFLAEVETIGSIHHFNLVRLIGFCAEKSHRLLVYEYMSNGSLDRWVFHKNPEMLLDWHHRKKIILDIARGLTYLHEDCRQKIVHLDIKPQNILVGENFNAKVSDFGLSKLVDRDQSQVVTTIRGTPEYLRPRRNSRVLC

SEQ ID NO: 7061 - protein, 247 aa, Fagus sylvatica
SQRPSLAKMSRYHIQRLGISVEVVSDLNQGWSKISSGNKVVDMVLVEQEVWDRDTHISASFIINLKKIDHGIPPKLFLLANSISSSRTNAATSGGFSPYTTMKPLRASMLAASLQRAMGVGSKGNLRNRELPSLSLRSLPRGRKILIIDDNNVNLKVAAGALKKYGADVVCAESRIKAIEFLKPPHRFDACFMDIQMPEMDGFEATRKIRDMEHCFNNRIRRGEASVEAYDNISNGMFPFWPVTVFG

SEQ ID NO: 7062 - protein, 267 aa, Fagus sylvatica
NQRPSLVTGHSHFVEDVALLTDGQFVLSGSWNGEPRLWNLQAGSRLSFVGHTKDVLSVVFSIDNRQIVSASRDRTIKFWNTLGECKFTIQEQDAHTDWVSCVRFSPNTTQPTIVSASWDKTIKVWHLTNCKIKNTLAGHSGYVNTVAVSPDGSLCASGGKDGVILLWDLAEGKRLYSLDAGAIIHALCFSPNRYWLCAATEQSIKIWDLESKSIVEDLKVDLKTEAADKDDATTINSTKKKVIYCTSLNWSADGSTLFSGYTDGVGQ

SEQ ID NO: 7063 - protein, 262 aa, Oryza sativa (indica cultivar-group); identical to SEQ ID NO: 3656

SEQ ID NO: 7064 - protein, 352 aa, Aplysia californica
MGNAATAKKGDPAENVKEFLARAKEEFQNKWDHPPASTSCLDDFDRIKTLGTGSFGRVMLVQHKGESRNFYAMKILDKQKVVKLKQVEHTLNEKKILQSINFPFLVKLEYSFKDNSNLYMVLEFVTGGEMFSHLRRIGRFSEPHSRFYAAQIVLVLEYLHHLDIMYRDLKPENLLIDSYGYLKVTDFGFAKRVKGRTWTLCGTPEYLAPEIILSKGYNKAVDWWALGVLIYEMAAGYPPFFADQPIQIYEKIVSGKVRFPSHFSSDLKDLLRNLLQVDLTKRFGNLKNGVNDIKNHKWFSTTDWIAIYQRKVEAPFVPKTKGAGDTANFDDYEEEPLRISSTEKCAKEFADF

SEQ ID NO: 7065 - protein, 352 aa, Aplysia californica
MGNAATAKKGDPAENVKEFLARAKEEFQNKWDHPPASTSCLDDFDRIKTLGTGSFGRVMLVQHKGESRNFYAMKILDKQKVVKLKQVEHTLNEKKILQSINFPFLVKLEYSFKDNSNLYMVLEFVTGGEMFSHLRRIGRFSESHSRFYAAQIILSFEYLHYLDLVYRDLKPENLLIDPQGYCKVTDFGFAKRVKGRTWTLCGTPEYLAPEIILSKGYNKAVDWWALGVLIYEMAAGYPPFFADQPIQIYEKIVSGKVRFPSHFSSDLKDLLRNLLQVDLTKRFGNLKNGVNDIKNHKWFSTTDWIAIYQRKVEAPFVPKTKGAGDTANFDDYEEEPLRISSTEKCAKEFADF

SEQ ID NO: 7066 - protein, 605 aa, Aspergillus terreus
MPSLKDWVAAGLVPMTIASSTGRLPSNCTNGPSSRRCWQDGFDIWSDYTDPKVAPPGKLVEYDLTVTQVTISPDGYERLGTVFNGQYPGPLIEADWGDTLRITVHNNLTNGNGTAVHWHGIRLFETNWIDGVPGVTQCPIPPGESQVYEFRATQYGTSWYHSHFSLQYSNGLYGPLVIHGPSSSDWDVDLGPWTLTDWYHEDAFTLNWISLAGQLAPIPVSTLLNGKGTYDCDPGLDPACTGKQEYFETTFQQGTKYKMAIVNTATLLTYTFWIDGHNFTVIEVDFVPVEPYSTNVLNVGMGQRYEIVVEANADRTQGSSFWIHAHYCDIPDVIPNNKVGIIRYDESDTSEPATPPLSEQHRDFGCSDPSLGDLVPVVKKTVGPRVNQIGPHDYLTIGEQGKIPTPWEKDPRVHLWTIKNTAMYVDWQTPSLGKLTADHDEEFPPETVPVTLDFDTGEWVYFLLTSNYSLEDVVTPRNLTPSVHPIHLHGHDFAILAQGKGPFTPDIAPQLDNPPRRDVVDVDIGGYAWIAFEVDNPGAWLLHCHLQYHASEGMALQYIEQPSKIKPLIENAGVLNDFENRCASWKRYYNAVDIPNDRPQDDSGI

SEQ ID NO: 7067 - protein, 441 aa, Aedes aegypti
MVKFHLLVLIAFTCYTCSDATLWNPYKKLMRGSASPRRPGESGEPLFLTPLLQDGKIEEARNKARVNHPMLSSVESYSGFMTVDAKHNSNLFFWYVPAKNNREQAPILVWLQGGPGASSLFGMFEENGPFHIHRNNSVKQREYSWHQNHHMIYIDNPVGTGFSFTDSDEGYSTNEEHVGENLMKFIQQFFVLFPNLLKHPFYISGESYGGKFVPAFGYAIHNSQSQPKINLQGLAIGDGYTDPLNQLNYGEYLYELGLIDLNGRKKFDEDTAAAIACAERKDMKCANRLIQGLFDGLDGQESYFKKVTGFSSYYNFIKGDEESKQDSVLMEFLSNPEVRKGIHVGELPFHDSDGHNKVAEMLSEDTLDTVAPWVSKLLSHYRVLFYNGQLDIICAYPMTVDFLMKMPFDGDSEYKRANREIYRVDRKSPGTRSGLVVCKRC

SEQ ID NO: 7068 - protein, 354 aa, Blumeria graminis
MGCGLSTEEKEKKARNEEIENQLKRDKILQRNEIKMLLLGAGESGKSTILKQMKLIHEGGYSRDERESFKEIIFSNTEQSMRVILEAMESLELPLDDQKAEYHVQTIFMQPAQIEGDNLPPEVGTAISALWTDAGVQDCFKRSREYQLNDSARYYFDNIDRIAQPDYMPNDQDVLRSRVKTTGITETTFIIGDLTYRMFDVGGQRSERKKWIHCFENVTTILFLVAISEYDQLLFEDETVNRMQEALTLFDSICNSRWFIKTSIILFLNKIDRFKEKLPISPMKNYFPDFEGGDDYALACDYILNRFVSLNHHETKQIYTHFTCATDTTQIRFVMAAVNLDIIIQENLRLCGLI

SEQ ID NO: 7069 - protein, 360 aa, Drosophila melanogaster
MECCLSEEAKEQKRINQEIEKQLRRDKRDARRELKLLLLGTGESGKSTFIKQMRIIHGSGYSDEDKRGYIKLVFQNIFMAMQSMIKAMDMLKISYGQGEHSELADLVMSIDYETVTTFEDPYLNAIKTLWDDAGIQECYDRRREYQLTDSAKYYLSDLARIEQADYLPTEQDILRARVPTTGILEYPFDLDGIVFRMVDVGGQRSERRKWIHCFENVTSIIFLVALSEYDQILFESDNENRMEESKALFRTIITYPWFQNSSVILFLNKKDLLEEKIDLLEEKIMYSHLVDYFPEYDGPKQDHAAAKQFVLKKYLACNPDPERQCYSHFTTATDTENIKLVFCAVKDTIMQNALKEFNLG

SEQ ID NO: 7070 - protein, 1305 aa, Drosophila melanogaster
MMSAGGTYISTASVEVPQALQDGEKFIRWDDDSGTGTPVTMRVDAKGFFLYWVDQNNELDILDIATIRDVRTGQYAKRPKDNKLRQIVTLGPQDTLEEKTVTVCHGSDFVNMTFVNFCCTRRDIAQLWTDGLIKLAYSLAQLNGSAIMFLQKAHTKLCLQVDKSGRIPVKNIIKLFAQNKEDRKRVEKALDVTGLPSGKVDSISVSKFQFEDFYNLYKYLTQRSEVERLFDSIVGNSKRKCMSIAQLVEFLNKTQRDPRLNEILYPYANPARAKELIQQYEPNKFNAQKGQLSLDGFLRYLMGDDNPIMAPSKLDLCDDMDQPMSHYFINSSHNTYLTGHQLTGKSSVEIYRQCLLAGCRCVELDFWNGRTEEPVIVHGYTFVPEIFAKDVLEAIAESAFKTSEYPVILSFENHCNPRQQAKIANYCREIFGDMLLDKPLDSHPLEPNMDLPPPAMLRRKIIIKNKKKHHHHHHHHHHKKPAQVGTPAANNKLTTANSVDAKAAQQVALSASHEDGGVTRSTANGDVATGTGTGSAAGTAGHAPPLQQIRQSSKDSTGSSDSDSSSEDESLPNTTPNLPSGNEPPPEKAQKETEAGAEISALVNYVQPIHFSSFENAEKKNRCYEMSSFDEKQATTLLKERPIEFVNYNKHQLSRVYPAGTRFDSSNFMPQLFWNAGCQLVALNFQTLDLAMQLNLGIFEYNARSGYLLKPEFMRRSDRRLDPFAESTVDGIIAGTVSITVLSGQFLTDKRANTFVEVDMYGLPADTVRKKFRTKTVRDNGMNPLYDEEPFVFKKVVLPELASIRIAAYEEGGKLIGHRVLPVIGLCPGYRHVNLRSEVGQPIALASLFLCVVVKDYVPDDLSNFAEALANPIKYQSELEKRDIQLSVLTDEAEALGSADEDLSKSCGQKKELRPVESLATSPKHRPSISAAAAMSVDVTVDRTDGGRGEDSISIVAPSIQHQHSLDQSVSTSIRQVESSQFDVDLVLAEPLEKILDHKSVKEKRLEMEKKLESLRKKHDKEKIKIAGQKSSPLEGKKPKFAITNKLVKRLSNKSLEPGVEIPACPLDLGDSSEESAAADAGEDLAGGSSSLDGRTQESRLRSACREYTSQYRELQEKYHEAIYSAAEKVLKTSQTGQTKQLKASLDKVTGEVMHQLQEARRNEVKNLATVHRDRDELIRMKREVASSVVERGVAERVRLKQTFDRRTDELQKQHDSVRNALAEHRSKARQILDKEAESRSCVSSNGFLVLFHGPHHHGCTGSGSSALSGNNLTLNLDAGAAGSHSAISPAKSHNSIAAAAEMKT

SEQ ID NO: 7071 - protein, 1312 aa, Drosophila melanogaster
MMSAGGTYISTASVEVPQALQDGEKFIRWDDDSGTGTPVTMRVDAKGFFLYWVDQNNELDILDIATIRDVRTGQYAKRPKDNKLRQIVTLGPQDTLEEKTVTVCHGSDFVNMTFVNFCCTRRDIAQLWTDGLIKLAYSLAQLNGSAIMFLQKAHTKLCLQVDKSGRIPVKNIIKLFAQNKEDRKRVEKALDVTGLPSGKVDSISVSKFQFEDFYNLYKYLTQRSEVERLFDSIVGNSKRKCMSIAQLVEFLNKTQRDPRLNEILYPYANPARAKELIQQYEPNKFNAQKGQLSLDGFLRYLMGDDNPIMAPSKLDLCDDMDQPMSHYFINSSHNTYLTGHQLTGKSSVEIYRQCLLAGCRCVELDFWNGRTEEPVIVHGYTFVPEIFAKDVLEAIAESAFKTSEYPVILSFENHCNPRQQAKIANYCREIFGDMLLDKPLDSHPLEPNMDLPPPAMLRRKIIIKNKKKHHHHHHHHHHKKPAQVGTPAANNKLTTANSVDAKAAQQVALSASHEDGGVTRSTANGDVATGTGTGSAAGTAGHAPPLQQIRQSSKDSTGSSDSDSSSEDESLPNTTPNLPSGNEPPPEKAQKETEAGAEISALVNYVQPIHFSSFENAEKKNRCYEMSSFDEKQATTLLKERPIEFVNYNKHQLSRVYPAGTRFDSSNFMPQLFWNAGCQLVALNFQTLDLAMQLNLGIFEYNARSGYLLKPEFMRRSDRRLDPFAESTVDGIIAGTVSITVLSGQFLTDKRANTFVEVDMYGLPADTVRKKFRTKTVRDNGMNPLYDEEPFVFKKVVLPELASIRIAAYEEGGKLIGHRVLPVIGLCPGYRHVNLRSEVGQPIALASLFLCVVVKDYVPDDLSNFAEALANPIKYQSELEKRDIQLSVLTDEAEALGSADEDLSKSCGQKKELRPVESLATSPKHRPSISAAAAMSVDVTVDRTDGGRGEDSISIVAPSIQHQHSLDQSVSTSIRQVESSQFDVDLVLAEPLEKILDHKSVKEKRLEMEKKLESLRKKHDKEKIKIAGQKSSPLEGKKPKFAITNKLVKRLSNKSLNCLSPHSEPGVEIPACPLDLGDSSEESAAADAGEDLAGGSSSLDGRTQESRLRSACREYTSQYRELQEKYHEAIYSAAEKVLKTSQTGQTKQLKASLDKVTGEVMHQLQEARRNEVKNLATVHRDRDELIRMKREVASSVVERGVAERVRLKQTFDRRTDELQKQHDSVRNALAEHRSKARQILDKEAESRSCVSSNGFLVLFHGPHHHGCTGSGSSALSGNNLTLNLDAGAAGSHSAISPAKSHNSIAAAAEMKT

SEQ ID NO: 7072 - protein, 369 aa, Cicer arietinum
DFNLAIDLAGENLWYDCDTHYNSSSYIPIECGSKKCPDVACIGCNGPFKPGCTNNTCAANTINTLANFIFGGGLGQDFIFISQQKVSGLLSSCIDTDGFPSFTGNDSPLNGLPKITKGIIGLARSNLSLPTQLALKNELPPKFSLCLPSSNKQGFTNLLVGSIGKDPFQELYKFVQTTPLIVNPVSTGAVSVQGVPSIEYFIDVKAIKIDGKVVNLKPSLWSIDNKGNGGTKISTMSPFTELQRSVYKPFIRDFLKKASDRKLKKVESVAPFEACFESTNIENSLPRIDLVLQGGVQWSIYGNNLMVNVKKNVACLGFVDGGTEPRMSFAKASIVIGGHQLEDNLLVFDLNSSKLSFSSSLLVHNASCS

SEQ ID NO: 7073 - protein, 310 aa, Orobanche ramosa
MVITLNNGFKMPIIGLGVWRTEGKDLKNLIINAIKIGYRHFDCAADYKNEAEVGEALEEALQTGLVKREDLFITTKLWNSDHGHVVEACTDSLKKLRLEYLDLYLVHFPVATKHTGVGTTDSALGDDGILDIDTTISLETTWHAMEDLVSLGLARSIGISNYDIFLTRDCLAYSKIKPAVNQIETHPYFQRESLVKFCQKHGICVTAHTPLGGALANTEWFGTVSCLDDPVIKGLTEKYKKKTVAQIALRWGIQRNTVVIPKTSKQDRLIENFQVFDFELSNEDMELLKTMERKYRTNQPAKFWGIDLFA

SEQ ID NO: 7074 - protein, 1112 aa, Watasenia scintillans
MAGVETAVRQIELKWPNVPEQLVKGDKFLMWEEDSSKTTEVLVRVDPKGYFIFWKIEGKEDTECLDLAYLRDIRTGKYSKCPKGKVKDMGTSYGSSNIPLQDKCVTICHGNNYIDLEWIHFIAENSGVAQKWCDEVFKYAYNLLSLNKNQLGEWEKLYFRLTVVEMENKKVPVKVLQKCLSKDKDDRTRISKALETMSWPSGKNDGIDIKTFDFDSFFKFYLTLLDRSEIEGIFKELSKNKGSITTPDFKEFLNEMQRHPSLHKTLFPLYTDSQCDGLINDYESAVNKKGKKKGQLTKEGLLYFLMCEENNLTPMHRLDLGANMKLSLAAYYINSSHNTYLTGHQLTGKSSVEIYRQVLLTGCRCLELDCWDGKDGEPIITHGFTMCTEVSFEDVVHAIGECAFKVSEYPVILSFENHCSVPQQKLLAKYCHEAFGEMLLSEPIDGHPLKPGVTLPTPYDLKKKILIKNKKMHKGAGDDEDMAGLTDEEKKKIEKEKKDAGTAAKEAEAAEEMSDLVNYIQPVHFTTFEQAQKKDRHYEMSSMVETQALNKLKDNPEDFVDYNKKQLTRIYPKGTRVDSSNYVPQIYWNAGCQLVALNFQCFDVAMCVNLGVFEYNGSSGYLVKPEFMRKLDKRFDPFTESTVDGIVAGTIEIKIISAQFLSDKKISSYVEVEMYGLPTDTVRKKFKTKTVANNGIDPYYNEKAFTFKKVVLPDLAVVRIIVSEDGGKFIGHRVMPLDGIKPGYRHIPLRNESNRPLGLASVFAHIVAKDYVSDAFADFADALLNPIAYQCAQDARAAALCAFEDDPEAALDAAKPTGKPGKGKGKGKGGVKSPKGGKKAWAGAQKKVSTGNIAKTALMGAKKPAATPGSPPPPPKGDESEFVQNSKMKDEANCAPPKLEDLKKNKAYTKIASKRDKEVDSLKKKNEKAQSSMKKKLKDEEKKAKKKESEDKFNQIHKENMDKYVALCTEHYNAEADIAKKYIESLNDCLKTLIGSCTDDIKKKLQTIHDKEVEAMNKEMNKKSKVEQKELGKETKDKEELARKKRESSKKLIDGIVQERNKLKALKERQEKGLDKKVEELTKEFEAEKASAETTLKQQIDEKLKKAKEDWS

SEQ ID NO: 7075 - protein, 250 aa, Schistosoma japonicum
MVSDRECSVECAKLCEQAERYDDMVKAVIEIVKISEGELTIEERNLLSVAYKNAVGARRSSWRILNSLETKRDRYRTLQCTNIHAVSKQCEKKLDEICTNILDLLHDYLVPKAASDESKVFLHKMRGDYHRYRAEFAVHDKRKEAAESSLLAYKEAMKYAENLTVTHPIRLGLGLNFSVLYYEILNNPAKACDVAKTAFDLAIAELDTLSEESYKDSTLIMQLLRDNLNLWNPFNDGEKDTAASPKGEEK

SEQ ID NO: 7076 - protein, 172 aa, Drosophila melanogaster
MSSSQNNNSSWIDWFLGIKGNEFLCRVPTDYVQDTFNQMGLEYFSEILDVILKPVIGNSSGLLYGDEKKWYGMIHARYIKAERGVIAMHRKYMRGDFESCPNISCDRQNTLPVGVSDVWGKSTVKIYCPRCKKNFHPKSDTQLDGAMFGPSFPDIFFSMLPNLRSPLDDPRT

SEQ ID NO: 7077 - protein, 1037 aa, Saccharomyces cerevisiae
MTVANTETHSAAKPSSTIGPWKLGETLGFGSTGKVQLAQHERTGHRTAVKVISKSIFNNNGNHSNDDSVLPYNIEREIVIMKLLSHPNVLSLYDVWETNNNLYLILEYAEKGELFNLLVDHGPLPEREAINCFRQIIIGISYCHALGIVHRDLKPENLLLDSFYNIKIADFGMAALQTDADLLETSCGSPHYAAPEIVSGLPYEGFASDVWSCGVILFALLTGRLPFDEENGNVRDLLLKVQKGQFEMPNDTEISRDAQDLIGKILVVDPRQRIKIRDILSHPLLKKYQTIKDSKSIKDLPRENTYLYPLADSNNHTSASIDDSILQNLVVLWHGRHADDIVSKLKENGTNKEKILYALLYRFKLDSVRGSNKKNRNKIKKTKKNKRSSTLSSSSSLLLNNRSIQSTPRRRTSKRHSREFSSSRKRSSFLLSSNPTDSSPIPLRSSKRITHINVASANTQATPSGVPNPHKRNSKKRSSKRLSYMPNTKRSSLTSKSLSNFTNLIDDDDWEYIEKDAKRTSSNFATLIDEIFEPEKFELAKREKAELQRKVQEAKRQSVNAQKINEDEFGSEVSDGMKELKKINDKVSSPLINYEFSQQELLQDIDTLLTNRYQLSSYTRPISRLDPGLTPVTETLPNNLKEKTALLQDTEKKIIETIRRSKFLGSLLNVRGGLSPGKSELAPIEESPIVSTTPLIYNDRMEPRRISDVEVPHFTRKSKHFTTANNRRSVLSLYAKDSIKDLNEFLIKEDPDLPPQGSTDNESRSEDPEIAESITDSRNIQYDEDDSKDGDNVNNDNILSDFPQGVGISQEYDMKDKNPNQSPISKSAEPTLVVKLPSLSSFQGKNASGLGLYQREPSKVTLPSLTSNNSSVGENIEDGAEKGTESEKIAASLSDDDLKEDNDKKDNDTVNAPTTVKKPPNSVLLKKFSKGKILELEIHAKIPEKRLYEGLHKLLEGWKQYGLKNLVFNITNMIITGKLVNDSILFLRSTLFEIMVLPNGDGRSLIKFNKKTGSTKTLTKLATEIQIILQKEGVLDK

SEQ ID NO: 7078 - protein, 350 aa, Xenopus laevis
MSGPVPSRARVYTDVNTHRPRDYWDYESHVVEWGNQDDYQLVRKLGRGKYSEVFEAINITNNEKVVVKILKPVKKKKIKREIKILENLRGGPNIITLADIVKDPVSRTPALVFEHVNNTDFKQLYQTLTDYDIRFYMYEILKALDYCHSMGIMHRDVKPHNVMIDHEHRKLRLIDWGLAEFYHPGQEYNVRVASRYFKGPELLVDYQMYDYSLDMWSLGCMLASMIFRKEPFFHGHDNYDQLVRIAKVLGTEDLYDYIDKYNIELDPRFNDILGRHSRKRWERFVHSENQHLVSPEALDFLDKLLRYDHQTRLTAREAMDHPYFYPIVKDQSRMAALICPVAAHPSVAPV

SEQ ID NO: 7079 - protein, 297 aa, Xenopus laevis
MENFQKVEKIGEGTYGVVYKARNRETGEIVALKKIRLDTETEGVPSTAIREISLLKELNHPNIVKLLDVIHTENKLYLVFEFLNQDLKKFMDGSNISGISLALVKSYLFQLLQGLAFCHSHRVLHRDLKPQNLLINSDGAIKLADFGLARAFGVPVRTFTHEVVTLWYRAPEILLGCKFYSTAVDIWSLGCIFAEMITRRALFPGDSEIDQLFRIFRTLGTPDEVSWPGVTTMPDYKSTFPKWIRQDFSKVVPPLDEDGRDLLAQMLQYDSNKRISAKVALTHPFFRDVSRPTPHLI

SEQ ID NO: 7080 - protein, 361 aa, Xenopus laevis
MAAAAASSNPGGGPEMVRGQAFDVGPRYTNLSYIGEGAYGMVCSAHCNINKVRVAIKKISPFEHQTYCQRTLREIKILLRFKHENIIGINDIIRAPTIEQMKDVYIVQDLMETDLYKLLKTQHLSNDHICYFLYQILRGLKYIHSANVLHRDLKPSNLLLNTTCDLKICDFGLARVADPDHDHTGFLTEYVATRWYRAPEIMLNSKGYTKSIDIWSVGCILAEMLSNRPIFPGKHYLDQLNHILGILGSPSQEDLNCIINLKARNYLLSLPHKNKVPWNRLFPNADPKALDLLDKMLTFNPHKRIEVEAALAHPYLEQYYDPSDEPVAEAPLKFEMELDDLPKETLKELIFEETARFQPGY

SEQ ID NO: 7081 - protein, 77 aa, Rubus hispidus
THRRCPNPEVFIGLIVGAMLPYWFSAMTMKSVGSAALKMVEEVRRQFNTIPGLMEGLLSLLCYLCQDSTDLHLIDQR

SEQ ID NO: 7082 - protein, 391 aa, Homo sapiens [sequence omitted]

SEQ ID NO: 7083 - protein, 374 aa, Homo sapiens
MEADSPAGPGAPEPLAEGAAAEFSSLLRRIKGKLFTWNILKTIALGQTLSLCICGTAITSQYLAERYKVNTPMLQSFINYCLLFLIYTVMLAFRSGSDNLLVILKRKWWKYILLGLADVEANYVIVRAYQYTTLTSVQLLDCFGIPVLMALSWFILHARYRVIHFIAVAVCLLGVGTMVGADILAGREDNSGSDVLIGDILVLLGASLYAISNVCEEYIVKKLSRQEFLGMVGLFGTIISGIQLLIVEYKDIASIHWDWKIALLFVAFALCMFCLYSFMPLVIKVTSATSVNLGILTADLYSLFVGLFLFGYKFSGLYILSFTVIMVGFILYCSTPTRTAEPAESSVPPVTSIGIDNLGLKLEENLQETHSAVL

SEQ ID NO: 7084 - protein, 677 aa, Homo sapiens
MSPDCYIFDPEHKKVCQDMKQPLSHYFINSSHNTYLIEDQFRGPSDITGYIRALKMGCRSVELDVWDGPDNEPVIYTGHTMTSQIVFRSVIDIINKYAFFASEYPLILCLENHCSIKQQKVMVQHMKKLLGDKLYTTSPNVEESYLPSPDVLKGKILIKAKKLSSNCSGVEGDVTDEDEGAEMSQRMGKENMEQPNNVPVKRFQLCKELSELVSICKSVQFKEFQVSFQVQKYWEVCSFNEVLASKYANENPGDFVNYNKRFLARVFPSPMRIDSSNMNPQDFWKCGCQIVAMNFQTPGLMMDLNIGWFRQNGNCGYVLRPAIMREEVSFFSANTKDSVPGVSPQLLHIKIISGQNFPKPKGSGAKGDVVDPYVYVEIHGIPADCAEQRTKTVHQNGDAPIFDESFEFQINLPELAMVRFVVLDDDYIGDEFIGQYTIPFECLQTGYRHVPLQSLTGEVLAHASLFVHVAITNRRGGGKPHKRGLSVRKGKKSREYASLRTLWIKTVDEVFKNAQPPIRDATDLRENMQNAVVSFKELCGLSSVANLMQCMLAVSPRFLGPDNTPLVVLNLSEQYPTMELQGIVPEVLKKIVTTYDMMIQSLKALIENADAVYEKIVHCQKAAMEFHEHLHSIGTKEGLKERKLQKAVESFTWNITILKIRKTGRRSIFVPQTPIMV

SEQ ID NO: 7085 - protein, 235 aa, Homo sapiens
MPNLKDELHHSGWNTCSSCFGDSTKSRTKLVLPSLISSRIYVVDVGSEPRAPKLHKVIEPKDIHAKCELAFLHTSHCLASGEVMISSLGDVKGNGKGGFVLLDGETFEVKGTWERPGGAAPLGYDFWYQPRHNVMISTEWAAPNVLRDGFNPADVEAGLYGSHLYVWDWQRHEIVQTLSLKDGLIPLEIRFLHNPDAAQGFVGCALSSTIQRFYKNEVTYALWPSPPSSLVSSST

SEQ ID NO: 7086 - protein, 332 aa, Homo sapiens
MVDIHDQLHQGTVPVSYTVTTVAPHGIPLCTGQHIPACSTQQVPGCSVVFSGQHLPVCSVPPPMLQACSVQHLPVPYAAFPPLISSDPFLIHPPHLSPHHPPHLPPPGQFVPFQTQQSRSPLQRIENEVELLGEHLPVGGFTYPPSAHPPTLPPSAPLQFLTHDPLHQEVSFGVPYPPFMPRRLTGRSRYRSQQPIPPPPYHPSLLPYVLSMLPVPPAVGPTFSFELDVEDGEVENYEALLNLAERLGEAKPRGLTKADIEQLPSYRFNPNNHQSEQTLCVVCMCDFESRQLLRVLPCNHEFHAKCVDKWLKANRTCPICRADASEVHRDSE

SEQ ID NO: 7087 - protein, 210 aa, Homo sapiens
MLIAQNSSLEFKLHRLYFISLLMGGTTNQREALQYAKNFQPFALNHQKDIQVLMGSLVYLRQGIENSPYVHLLDANQWADICDIFTRDACALLGLSVESPLSVSFSAGCVALPALINIKAVIEQRQCTGVWNQKDELPIEVDLGKKCWYHSIFACPILRQQTTDNNPPMKLVCGHIISRDALNKMFNGSKLKCPYCPMEQSPGDAKQIFF

SEQ ID NO: 7088 - protein, 506 aa, Homo sapiens
MEFLKVARRNKREQLEQIQKELSVLEEDIKRVEEMSGLYSPVSEDSTVPQFEAPSPSHSSIIDSTEYSQPPGFSGSSQAGVQWRYLGSLQPPPPRYKRFSCLTLPSSWDYRRLPPHLTKKQPWYNSTLASRRKRLTAHFEDLEQCYFSTRMSRISDDSRTASQLDEFQECLSKFTRYNSVRPLATLSYASDLYNGSSIVSSIEFDRDCDYFAIAGVTKKIKVYEYDTVIQDAVDIHYPENEMTCNSKISCISWSSYHKNLLASSDYEGTVILWDGFTGQRSKVYQEHEKRCWSVDFNLMDPKLLASGSDDAKVKLWSTNLDNSVASIEAKANVCCVKFSPSSRYHLAFGCADHCVHYYDLRNTKQPIMVFKGHRKAVSYAKFVSGEEIVSASTDSQLKLWNVGKPYCLRSFKGHINEKNFVGLASNGDYIACGSENNSLYLYYKGLSKTLLTFKFDTVKSVLDKDRKEDDTNEFVSAVCWRALPDGESNVLIAANSQGTIKVLELV

SEQ ID NO: 7089 - protein, 272 aa, Homo sapiens
MAIVEHLYQQGMLSVAEELCQESTLNVDLDFKQPFLELNRILEALHEQDLGPALEWAVSHRQRLLELNSSLEFKLHRLHFIRLLAGGPAKQLEALSYARHFQPFARLHQREIQVMMGSLVYLRLGLEKSPYCHLLDSSHWAEICETFTRDACSLLGLSVESPLSVSFASGCVALPVLMNIKAVIEQRQCTGVWNHKDELPIEIELGMKCWYHSVFACPILRQQTSDSNPPIKLICGHVISRDALNKLINGGKLKCPYCPMEQNPADGKRIIF

SEQ ID NO: 7090 - protein, 167 aa, Homo sapiens
MESILGSASCTEPSSALEVNSPPSQPPQPVVPAKPVQCVHHVSTQPSCPGRGKMSKLLNPEEMTSRDYYFDSYAHFGIHEEMLKDEVRTLTYRNSMYHNKHVFKDKVVLDVGSGTGILSMFAAKAGAKKVFGVPSPFLKAWPEASETPSVPLCEYFSREWSLPEAWG

SEQ ID NO: 7091 - protein, 238 aa, Homo sapiens
  unsure (1)..(238): unsure at all Xaa locations
MADPDPRYPRSSIEDDFNYGSSVASATVHIRMAFLRKVYSILSLQVLLTTVTSTVFLYFESVRTFVHESPALILLFALGSLGLIFALXLNRHKYPLNLYLLFGFTLLEALTVAVVVTFYDVYIILQAFILTTTVFFGLTVYTLQSKKDFSKFGAGLFALLWILCLSGFLKFFFYSEIMELVLAAAGALLFCGFIIYDTHSLMHKLSPEEYVLAAISLYLDIINLFLHLLRFLEAVNKK

SEQ ID NO: 7092 - protein, 63 aa, Pleurochrysis carterae
MRGILVDWLVEVHLKFKLMIETLYLTVNLIDRYLEKEKITRNKLQLVGVTAMFLASKYEEIYP

SEQ ID NO: 7093 - protein, 486 aa, Comamonas sp. JS765
MLAKQILNFINGEFVATGKWFDNRTPISNAVIGQVAEAGQAEVDAAVAAARAALKGPWGSMTLAQRVELLEALVAEITRRFDEFLEAECADTGKPRSLASHIDIPRGAANFKVFADVVKNVPTEFFEMATPDGRGAINYGYRKPVGVVGVICPWNLPLLLMTWKVGPALACGNTVVVKPSEETPRTAALLGEVMNHVGIPKGVYNVVHGFGPGSAGEFVTSHPGIDAITFTGETRTGEVIMKAAAKGARPVSLEMGGKNAAIVFADCDFDAAIEGTLRSAFVNCGQVCLGTERVYVERPIFDKFVAALKQQVEGWKIGVPEGADTQLGPLISKEHQAKVLSYYQLAVQEGATVVTGGGVPDMPGELKDGCWVQPTIWTGLPETARVIKEEIFGPCCHIAPFDTEDEVLAKANDNEYGLATAIWTRDLSRAHRVAQRMEVGISWVNSWFLRDLRTPFGGSKQSGIGREGGVHSLEFYTELKNVCIKL

SEQ ID NO: 7094 - protein, 231 aa, Homo sapiens
MQQHEQALADCRRALELDGQSVKAHFFLGQCQLEMESYDEAIANLQRAYSLAKEQRLNFGDDIPSALRIAKKKRWNSIEERRIHQESELHSYLSRLIAAERERELEECQRNHEGDEDDSHVRAQQACIEAKHDKYMADMDELFSQVDEKRKKRDIPDYLCGKISFELMREPCITPSGITYDRKDIEEHLQRVGHFDPVTRSPLTQEQLIPNLAMKEVIDAFISENGWVEDY

SEQ ID NO: 7095 - protein, 500 aa, Pseudonocardia sp. K1
MTVIAKPDHLLRDDVQKFIDRPKKLFINGQWHDSIKGETLEVYDPAVGTKICTVAAGDAEDVDRAVAAARHAFDEGPWSKLNPSERGRLVWRLADLLEEHADEFAQIDALDNGKPVTDARAVDVAFSIELLRYMAGWSNKIYGETIPLTNPADFHAYTLREPVGVVGQIVPWNFPLMMAVWKVAPALAAGCTVILKPAEQTPLSALRLAELTEEAGFPPGVFNVITGFGETAGAAIAAHDNIDKVAFTGSTEVGRLIAQAASGNLKKVSLELGGKSPVIVFGDSDIEQAVAGASSAIFYNNGQTCTAGSRLYVHRKVYDKVVEGIASEASALPIGHGLDPATRIGPLISAEQRDRVTGYIAQGREAGAEVIVGGDTVGDGGYFIQPTILTKTDPSMSVVREEIFGPVLCAMAFDEDTIDSVVREANNSVYGLAASIYTRDISVAHRVAKRLKAGTIGINTHHVVDVALPFGGFKQSGYGRDMGRDAIDQYTEVKSIGIAL

SEQ ID NO: 7096 - protein, 475 aa, Xenopus laevis
MASTTCTRFTDEYQLFEELGKGAFSVVRRCIKINIGQEYAAKIINTKKLSARDHQKLEREAKICRLLKHPNIVRLHDSISEEGFHYLVFDLVTGGELFEDIVAREYYSEADASHCIQQILESVNHCHLNGIVHRDLKPENLLLASKLKGAAVKLADFGLAIEVQGDQQAWFGFAGTPGYLSPEVLRKDPYGKPVDMWACGVILYILLVGYPPFWDEDQHRLYQQIKAGAYDFPSPEWDTVTPEAKDLINKMLTINPAKRINATEALRHPWICQRSTVASMMHRQETVDCLKKFNARRKLKGAILTTMLATRNFSAKSLLKKPDGVKESTESSNTTIEDEDVKARKQEIIKVTEQLIEAINNGDFEAYTKICDPGLTSFEPEALGNLVEGMDFHRFYFENALSKSNKPVHTIILNPHVHLIGEDAACIAYIRLTQYLDSAGMPKTMQSEETRVWHRRDGKWQNVHFHRSGSPTIPN

SEQ ID NO: 7097 - protein, 541 aa, Xenopus laevis
MATPQTCTRFTDEYQLYEELGKGAFSVVRRCVKKSSSQEYAAKIINTKKLSARDHQKLEREARICRLLKHPNIVRLHDSISEEGFHYLLFDLVTGGELFEDIVAREYYSEADASHCIHQILESVNHIHQHDIVHRDLKPENLLLASKCKGAAVKLADFGLAIEVQGDQQAWFGFAGTPGYLSPEVLRKDPYGKPVDIWACGVILYILLVGYPPFWDEDQHKLYQQIKAGAYDFPSPEWDTVTPEAKNLINQMLTINPAKRITADQALKHPWVCQRSTVASMMHRQETVECLRKFNARRKLKGAILTTMLVSRNFSGIAFGCRKAASTVPCTSSTGDTTITGVGRQTSAPVVAATSAANLVEQAAKSLLNKKTDGVKEPQTTVVHNATDGIKGSTESCNTTTEDEDLKVRKQEIIKITEQLIEAINNGDFEAYTKICDPGLTSFEPEALGNLVEGMDFHKFYFDNLLSKHTKPIHTTILNPHVHVIGEDAACIAYIRLTQYIDAQGRPRTTQSEETRVWYRRDGKWLNVHYHCSGAPAAPLQ

SEQ ID NO: 7098 - protein, 564 aa, Xenopus laevis
MATPQTCTRFTDEYQLYEELGKGAFSVVRRCVKKSSSQEYAAKIINTKKLSARDHQKLEREARICRLLKHPNIVRLHDSISEEGFHYLLFDLVTGGELFEDIVAREYYSEADASHCIHQILESVNHIHQHDIVHRDLKPENLLLASKCKGAAVKLADFGLAIEVQGDQQAWFGFAGTPGYLSPEVPRKDPYGKPVDIWACGVILYILLVGYPPFWDEDQHKLYQQIKAGAYDFPSPEWDTVTPEAKNLINQMLTINPAKRITADQALKHPWVCQQSTVASMMHRQETVECLRKFNARRKLKGAILTTMLVSRNFSGIAFGCRKAASTVPCTSSTGDTTITGVGRQTSAPVVAATSAANLVEQAAKSLLNKKTDGVKPQTNNKNSIVSPAKENPPLQASMEPQTTVVHNATDGIKGSTESCNTTTEDEDLKVRKQEIIKITEQLIEAINNGDFEAYTKICDPGLTSFEPEALGNLVEGMDFHKFYFDNLLSKHTKPIHTTILNPHVHVIGEDAACIAYIRLTQYIDAQGRPRTTQSEETRVWYRRDGKWLNVHYHCSGAPAAPLQ

SEQ ID NO: 7099 - protein, 620 aa, Xenopus laevis
MATTQTCTRFTDEYQLYEELGKGAFSVVRRCVKKSSNQEYAAKIINTKKLSARDHQKLEREARICRLLKHPNIVRLHESISEEGFHYLVFDLVTGGELFEDIVAREYYSEADASHCIHQILESVNHIHQHDIVHRDLKPENLLLASKCKGAAVKLADFGLAIEVQGDQQAWFGFAGTPGYLSPEVLRKDPYGKPVDIWACGVILYILLVGYPPFWDEDQHKLYQQIKAGAYDFPSPEWDTVTPEAKNLINQMLTINPAKRITADQALKHPWVCQRSTVASMMHRQETVECLGKFNARRKLKGAILTTMLVSRNFSGIAFGCRKAASTVPCTSSTGETITGVGRQTSAPVVAATSAANLVEQAAKSLLNKKTDGVKEPQTTVVHNATDGIKGSTESCNTTTEDEDLKANPVCPGDGPLLLQGWSQSESKIQTESLQSQIGLWGSSTAQSCEKTLLAWDSPGQTLELEPAQSEPMLTPVVPFSLSNSLLRKQEIIKITEQLIEAINNGDFEAYTKICDPGLTSFEPEALGNLVEGMDFHKFYFDNLLSKHTKPIHTTILNPHVHVIGEDAACIAYIRLTQYIDAQGRPRTTQSEETRVWYRRDGKWLNVHYHCSGAPAAPLQ

SEQ ID NO: 7100 - protein, 643 aa, Xenopus laevis
MATTQTCTRFTDEYQLYEELGKGAFSVVRRCVKKSSNQEYAAKIINTKKLSARDHQKLEREARICRLLKHPNIVRLHESISEEGFHYLVFDLVTGGELFEDIVAREYYSEADASHCIHQILESVNHIHQHDIVHRDLKPENLLLASKCKGAAVKLADFGLAIEVQGDQQAWFGFAGTPGYLSPEVLRKDPYGKPVDIWACGVILYILLVGYPPFWDEDQHKLYQQIKAGAYDFPSPEWDTVTPEAKNLINQMLTINPAKRITADQALKHPWVCQRSTVASMMHRQETVECLRKFNARRKLKGAILTTMLVSRNFSGIAFGCRKAASTVPCTSSTGETITGVGRQTSAPVVAATSAANLVEQAAKSLLNKKTDGVKPQTNNKNSIISPAKENPPLQASMEPQTTVVHNATDGIKGSTESCNTTTEDEDLKANPVCPGDGPLLLQGWSQSESKIQTESLQSQIGLWGSSTAQSCEKTLLAWDSPGQTLELEPAQSEPMLTPVVPFSLSNSLLRKQEIIKITEQLIEAINNGDFEAYTKICDPGLTSFEPEALGNLVEGMDFHKFYFDNLLSKHTKPIHTTILNPHVHVIGEDAACIAYIRLTQYIDAQGRPRTTQSEETRVWYRRDGKWLNVHYHCSGAPAAPLQ

SEQ ID NO: 7101 - protein, 345 aa, Zea mays; identical to SEQ ID NO: 1130

SEQ ID NO: 7102 - protein, 764 aa, Cricetulus griseus
MNGEADCPTDLEMAAPKGQDRWSQEDMLTLLECMKNNLPSNDSSKFKTTESHMDWEKVAFKDFLGDMCKLKWVEISNEVRKFRTLTELILDAQEHVKNPYKGKKLKKHPDFPKKPLTPYLRFFMEKRAKYAKLHPEMSNLDLTKILSKKYKELPEKKKMKYIQDFQREKQEFERNLARFREDHPDLIQNAKKSDIPEKPKTPQQLWYTHEKKVYLKVRPDATTKEVKDSLGKQWSQLSDKKRLKWIHKALEQRKEYEEIMRDYIQKHPELNISEEGITKSTLTKAERQLKDKFDGRPTKPPPNSYSLYCAELMANMKDVPSTERMVLCSQQWKLLSQKEKDAYHKKCDQKKKDYEVELLRFLESLPEEEQQRVLGEEKMLNINKKQTTSPASKKPSQEGGKGGSEKPKRPVSAMFIFSEEKRRQLQEQRPELSESELTRLLARMWNDLSEKKKAKYKAREAALKAQSERMPGGEREERGKLPESPKRAEEIWQQSVIGDYLARFKNDRVKALKAMEMTWNNMEKKEKLMWIKKAAEDQKRYERELSEMRAPPAATNSSKKMKFQGMPKKPPMNGYQKFSQELLSNGELNHLPLKERMVEIGSRWQRISQSQKEHYKKLAEEQQKQYKVHLDLWVKSLSPQDRAAYKEYISNKRKNMTKLRGPNPKSSRTTLQSKSESEEEEDEEDEDDDEEEEEEDDENGDSSEDGGDSSESSSEDESEDGDENEDDDDDDDDDEDDDEDEDNESEGSSSSSSSSGDSSDSDSN

SEQ ID NO: 7103 - protein, 727 aa, Cricetulus griseus
MNGEADCPTDLEMAAPKGQDRWSQEDMLTLLECMKNNLPSNDSSKFKTTESHMDWEKVAFKDFLGDMCKLKWVEISNEVRKFRTLTELILDAQEHVKNPYKGKKLKKHPDFPKKPLTPYLRFFMEKRAKYAKLHPEMSNLDLTKILSKKYKELPEKKKMKYIQDFQREKQEFERNLARFREDHPDLIQNAKKSDIPEKPKTPQQLWYTHEKKVYLKVRPDEIMRDYIQKHPELNISEEGITKSTLTKAERQLKDKFDGRPTKPPPNSYSLYCAELMANMKDVPSTERMVLCSQQWKLLSQKEKDAYHKKCDQKKKDYEVELLRFLESLPEEEQQRVLGEEKMLNINKKQTTSPASKKPSQEGGKGGSEKPKRPVSAMFIFSEEKRRQLQEQRPELSESELTRLLARMWNDLSEKKKAKYKAREAALKAQSERMPGGEREERGKLPESPKRAEEIWQQSVIGDYLARFKNDRVKALKAMEMTWNNMEKKEKLMWIKKAAEDQKRYERELSEMRAPPAATNSSKKMKFQGMPKKPPMNGYQKFSQELLSNGELNHLPLKERMVEIGSRWQRISQSQKEHYKKLAEEQQKQYKVHLDLWVKSLSPQDRAAYKEYISNKRKNMTKLRGPNPKSSRTTLQSKSESEEEEDEEDEDDDEEEEEEDDENGDSSEDGGDSSESSSEDESEDGDENEDDDDDDDDDEDDDEDEDNESEGSSSSSSSSGDSSDSDSN

SEQ ID NO: 7104 - protein, 180 aa, Gallus gallus
MDGDSSTTDASQLGIAGDYIGGSHYVIQPHDDTEDSMNDHEDTNGSKESFREQDIYLPIANVARIMKNAIPQTGKIAKDAKECVQECVSEFISFITSEASERCHQEKRKTINGEDILFAMSTLGFDSYVEPLKLYLQKFREAMKGEKGIGGTRCWRLLSSSHDCCSVLVDPIIPDFTDYK

SEQ ID NO: 7105 - protein, 496 aa, Gallus gallus
MADKKKITASLIYAVSVAAIGSLQFGYNTGVINAPEKIIQAFYNRTLSQRSGETISPELLTSLWSLSVAIFSVGGMIGSFSVSLFVNRFGRRNSMLLVNVLAFAGGALMALSKIAKAVEMLIIGRFIIGLFCGLCTGFVPMYISEVSPTSLRGAFGTLNQLGIVVGILVAQIFGLEGIMGTEALWPLLLGFTIVPAVLQCVALLFCPESPRFLLINKMEEEKAQTVLQKLRGTQDVSQDISEMKEESAKMSQEKKATVLELFRSPNYRQPIIISITLQLSQQLSGINAVFYYSTGIFERAGITQPVYATIGAGVVNTVFTVVSLFLVERAGRRTLHLVGLGGMAVCAAVMTIALALKEKWIRYISIVATFGFVALFEIGPGPIPWFIVAELFSQGPRPAAMAVAGCSNWTSNFLVGMLFPYAEKLCGPYVFLIFLVFLLIFFIFTYFKVPETKGRTFEDISRGFEEQVETSSPSSPPIEKNPMVEMNSIEPDKEVA

SEQ ID NO: 7106 - protein, 359 aa, Mus musculus
MTLESMMACCLSDEVKESKRINAEIEKQLRRDKRDARRELKLLLLGTGESGKSTFIKQMRIIHGAGYSEEDKRGFTLLVYQNIFTAMQAMVRAMETLKILYKYEQNKANALLIREVDVEKVTTFEHQYVNAIKTLWSDPGVQECYDRRREFQLSDSAKYYLTDVDRIATVGYLPTQQDVLRVRVPTTGIIEYPFDLENIIFRMVDVGGQRSERRKWIHCFENVTSIMFLVALSEYDQVLVESDNENRMEESKALFRTIITYPWFQNSSVILFLNKKDLLEDKILHSHLVDYFPEFDGPQRDAQAAREFILKMFVDLNPDSDKIIYSHFTCATDTENIRFVFAAVKDTILQLNLKEYNLV

SEQ ID NO: 7107 - protein, 358 aa, Homo sapiens [sequence omitted]

SEQ ID NO: 7108 - protein, 510 aa, Taenia solium
MKGISGPLVLAIFTTCFGSSFLLGYNLGVANLPGDNIKKFLVNYYKPDNSSALNANFLYGQVTSVLVICAAIAAFTCGWVADGLGRKRSLMVNNGIGIVGSVISSVCVVANQPALLYVGRAISGLNSGLSIGIAAMFLTEIAPRHLRGMIGACNQLAITIGIVISYVLTLSHLLNTPTLWPVAMGVGAIPAVIALIISPFTVESPRWLYLKKKDEKAAREAFARINGSENVDMFIAEMREELEVAQNQPEFKFTELFRRRDLRMPVIIAVLIQVMQQLSGINAVVANSSEMLKSAKVSPDMLEYFVVGLGLLNVICTIVALPLLEKAGRRTLLLWPSLVVAIILLLLVIFVNIANYGGVVNKTPFVLVSAVLVFIYVAAFAMGLGPMPALIVAEIFRQGPRAAAYSLSQSIQWACNLIVVASFPSLNELLKGYVYLPYLVVVAVCWVVFFLFMPETKNRTFDEVARDLAFGSIVVGKRTAALQAPVFTKEDEEAATALRRSDEEDAKVDA

SEQ ID NO: 7109 - protein, 205 aa, Homo sapiens
MDGDSSTTDASQLGISADYIGGSHYVIQPHDDTEDSMNDHEDTNGSKESFREQDIYLPIANVARIMKNAIPQTGKIAKDAKECVQECVSEFISFITSEASERCHQEKRKTINGEDILFAMSTLGFDSYVEPLKLYLQKFREAMKGEKGIGGAVTATDGLSEELTEEAFTNQLPAGLITTDGQQQNVMVYTTSYQQISGVQQIQFS

SEQ ID NO: 7110 - protein, 354 aa, Homo sapiens
MGCTLSAEERAALERSKAIEKNLKEDGISAAKDVKLLLLGAGESGKSTIVKQMKIIHEDGFSGEDVKQYKPVVYSNTIQSLAAIVRAMDTLGIEYGDKERKADAKMVCDVVSRMEDTEPFSAELLSAMMRLWGDSGIQECFNRSREYQLNDSAKYYLDSLDRIGAADYQPTEQDILRTRVKTTGIVETHFTFKNLHFRLFDVGGQRSERKKWIHCFEDVTAIIFCVALSGYDQVLHEDETTNRMHESLMLFDSICNNKFFIDTSIILFLNKKDLFGEKIKKSPLTICFPEYTGPNTYEDAAAYIQAQFESKNRSPNKEIYCHMTCATDTNNIQVVFDAVTDIIIANNLRGCGLY

SEQ ID NO: 7111 - protein, 345 aa, Homo sapiens
MPRIDADLKLDFKDVLLRPKRSSLKSRAEVDLERTFTFRNSKQTYSGIPIIVANMDTVGTFEMAAVMSQHSMFTAIHKHYSLDDWKLFATNHPECLQNVAVSSGSGQNDLEKMTSILEAVPQVKFICLDVANGYSEHFVEFVKLVRAKFPEHTIMAGNVVTGEMVEELILSGADIIKVGVGPGSVCTTRTKTGVGYPQLSAVIECADSAHGLKGHIISDGGCTCPGDVAKAFGTGADFVMLGGMFSGHTECAGEVIERNGRKLKLFYGMSSDTAMNKHAGGVAEYRASEGKTVEVPYKGDVENTILDILGGLRSTCTYVGAAKLKELSRRATFIRVTQQHNTVFS

SEQ ID NO: 7112 - protein, 341 aa, Arabidopsis thaliana
MDNSAPDSLSRSETAVTYDSPYPLYAMAFSSLRSSSGHRIAVGSFLEDYNNRIDILSFDSDSMTVKPLPNLSFEHPYPPTKLMFSPPSLRRPSSGDLLASFGDFLRLWEINEDSSTVEPISVLNNSKTSEFCAPLTSFDWNDVEPKRLGTCSIDTTCTIWDIEKSVVETQLIAHDKEVHDIAWGEARVFASVSADGSVRIFDLRDKEHSTIIYESPQPDTPLLRLAWNKQDLRYMATILMDSNKVVILDIRSPTMPVAELERHQASVNAIAWAPQSCKHICSGGDDTQALIWELPTVAGPNGIDPMSVYSAGSEINQLQWSSSQPDWIGIAFANKMQLLRV

SEQ ID NO: 7113 - protein, 436 aa, Thermoplasma acidophilum
MCVLMPHFLYLRSLISGRRYINKDHRYPCRRLGFMGIYDIFDDESARSISGMSIDEMAKKYGTPVIIYSRARIVSNIRRIREAYENRVRMLYSVKANDNPRIIEIMHQESIGSDSASPMEIMMSIFSGIPPEDILYSPNNASEYDLNFALDRGIAINFNTFTQYRKMREKPERISFRINPGFGMGEFAGTTTGGARTKFGIDPDAAILAYRKAREDGIREFGIHMMIGSNNRDHVKIAEAYSNFFRIADRIGREAGVSFQFADVGGGLGIPYVQGENELDIAALGSAVLKEFDRYHFGDLVLEPGRYLVGDAGIIVGTVNDVHNGFAGTDIGMNLNIRPALYGARHTIIPVGERVEGEKITVTGQICENTDRIGDTAWRLSEGDRIMVLDAGAYVYSMSSRYNGRPRPPEIMIMEDGKDVMIRRREDFSDFIATVV

SEQ ID NO: 7114 - protein, 163 aa, Thermoplasma acidophilum
MISMVFKRKEAGITDYSKRLKLLKSREKRFIVRITGKGVIAQVAEYSDIGDRILFTVTDKTLAKYGVDLRGNNIQVCYLVGYIAGIESEKNGVESAVLDTGRRKFRKGGRIAACLKGFTDAGIEVPHGEDVFPDKKRIDGKHLKSPVKISEIVKNFKKMEEKA

SEQ ID NO: 7115 - protein, 133 aa, Nicotiana benthamiana
LIYVSREKRPGFQHHKKAGAMSALVRVSAVLTNGPFMLNLDCDHYINNSKALREAMCFLTDPNLGKYVCYVQFPQRFDGIDRNDRYANRNTVFFDINLRGLDGIQGPVYVGTGCVFNRTALYGYEPPIKPKHK

SEQ ID NO: 7116 - protein, 223 aa, Nicotiana tabacum
LDGIQGPVYVGTGCVFNRTALYGYEPPIKPKHKKAGLFSSCFGGSRKKSSKSSKKGSDKKKSSKNVDPTVPIFNLEDIEEGVEGAGFDYEKSLLMSQMSLEKKFGQSAVFVASTLMENGGVPQSATPETLLKEAIHVISCGYEDKSEWGSEIGWIYGSVTEDILTGFKMHARGWRSIYCMPKRPAFKGSAPINLSDRLNQVLRWALGSVEILFSRHCPIWYGY

SEQ ID NO: 7117 - protein, 161 aa, Nicotiana tabacum
  unsure (1)..(161): unsure at all Xaa locations
SDKHADGSVPVFNLEDIEEGIEGSGFDDEKXLLMSQMSLEERFGQSSVFVASTLMEYVGVPQSATPESLLKEAIHVISCGYEDRSDWGREIAWIYGSVTEDILTGFKMHARGWRSIYCMPKRPLSSSAPINLSDRLNQVLRWALGSVEILFSRHCPIWYGY

SEQ ID NO: 7118 - protein, 436 aa, Saccharomyces cerevisiae
AVSKVYARSVYDSRGNPTVEVELTTEKGVFRSIVPSGASTGVHEALEMRDGDKSKWMGKGVLHAVKNVNDVIAPAFVKANIDVKDQKAVDDFLISLDGTANKSKLGANAILGVSLAASRAAAAEKNVPLYKHLADLSKSKTSPYVLPVPFLNVLNGGSHAGGALALQEFMIAPTGAKTFAEALRIGSEVYHNLKSLTKKRYGASAGNVGDEGGVAPNIQTAEEALDLIVDAIKAAGHDGKVKIGLDCASSEFFKDGKYDLDFKNPNSDKSKWLTGPQLADLYHSLMKRYPIVSIEDPFAEDDWEAWSHFFKTAGIQIVADDLTVTNPKRIATAIEKKAADALLLKVNQIGTLSESIKAAQDSFAAGWGVMVSHRSGETEDTFIADLVVGLRTGQIKTGAPARSERLAKLNQLLRIEEELGDNAVFAGENFHHGDKL

SEQ ID NO: 7119 - protein, 817 aa, Pyrococcus furiosus
MAYRFIKWFEELSKNDVPLVGGKGANLGEMTNAGIPVPPGFCVTAEAYKYFVENVKVSKEDVKRILGEKVNKGTISEVLAQAPDEPRPLQDWIMDIISKTDVDDSKMLQENTEAIRTLIKSLDMPSEIAEEIKQAYKELSQRFGQEEVYVAVRSSATAEDLPEASFAGQQETYLDVLGADDVIDKVKRCWASLWTARATFYRAKQGFDHSKVYLSAVVQKMVNSEKSGVMFTANPVTNNRNEIMINASWGLGEAVVSGAVTPDEYIVEKGTWKIKEKVIAKKEVMVIRNPETGRGTVMVKVAEYLGPEWVEKQVLTDEQIIEVAKMGQKIEDHYGWPQDIEWAYDKDDGKLYIVQSRPITTLKEEATAEEAEEVEEAEVILKGLGASPGIGAGRVVVIFDASEIDKVKEGDILVTTMTNPDMVPAMKRAAAIVTDEGGRTSHAAIVSRELGIPCVVGTKEATKKLKTGMYVTVDGTRGLVYKGIVKSLVKKKEEAKAEGGQVVVAGAPLVTGTMVKVNVSMPEVAERAAATGADGVGLLRAEHMILSIGQHPIKFIKEGKEEELVEKLAEGIEKVAAAFYPRPVWYRTLDAPTNEFREMPGGEDEPEERNPMLGWRGIRRGLDQPELLRAEFKAIKKVVEKGYNNIGVMLPLVSHPEQIREAKRIAREVGLEPHKDVAWGVMIEVPAAAIIIEDLIKEGIDFVSFGTNDLTQYTLAIDRDNERVAKLYDETHPAVLKLIKHVIKVCQRYGVETSICGQAGSDPKMARILVRLGIDSISANPDAVQLIRQVVAQEERKLMLEAARKQLFEEEEEEELF

SEQ ID NO: 7120 - protein, 514 aa, Homo sapiens
MADYLISGGTGYVPEDGLTAQQLFASADDLTYNDFLILPGFIDFIADEVDLTSALTRKITLKTPLISSPMDTVTEADMAIAMALMGGIGFIHHNCTPEFQANEVRKVKNFEQGFITDPVVLSPSHTVGDVLEAKMRHGFSGIPITETGTMGSKLVGIVTSRDIDFLAEKDHTTLLSEVMTPRIELVVAPAGVTLKEANEILQRSKKGKLPIVNDCDELVAIIARTDLKKNRDYPLASKDSQKQLLCGAAVGTREDDKYRLDLLTQAGVDVIVLDSSQGNSVYQIAMVHYIKQKYPHLQVIGGNVVTAAQAKNLIDAGVDGLRVGMGCGSICITQEVMACGRPQGTAVYKVAEYARRFGVPIIADGGIQTVGHVVKALALGASTVMMGSLLAATTEAPGEYFFSDGVRLKKYRGMGSLDAMEKSSSSQKRYFSEGDKVKIAQGVSGSIQDKGSIQKFVPYLIAGIQHGCQDIGARSLSVLRSMMYSGELKFEKRTMSAQIEGGVHGLHSYEKRLY

SEQ ID NO: 7121 - protein, 375 aa, Homo sapiens
PNRLFFGNLGTILLYAVVGTVWNAATTGLSLYGVFLSGLMGDLQIGLLDFLLFGSLMAAVDPVAVPAVFEQVHVNEVLFIIVFGESLLNDAVTVVLYNVFESFVALGGDNVTGVDCVKGIVSFFVVSLGGTLVGVVFAFLLSLVTRFTKHVRIIEPGFVFIISYLSYLTSEMLSLSAILAITFCGICCQKYVKANISEQSATTVRYTMKMLASSAETIIFMFLGISAVNPFIWTWNTAFVLLTLVFISVYRAIGVVLQTWLLNRYRMVQLEPIDQVVLSYGGLRGAVAFALVVLLDGDKVKEKNLFVSTTIIVVFFTVIFQGLTIKPLVQWLKVKRSEHREPRLNEKLHGRAFDHILSAIEDISGQIGHNYLRDK

SEQ ID NO: 7122 - protein, 542 aa, Ipomoea nil
MAFGLSSLLQNSDLFTSDHASVVSMNLFVALLCACIVLGHLLEENRWVNESITALIIGLCTGVVILLLSGGKSSHLLVFSEDLFFIYLLPPIIFNAGFQVKKKQFFVNFMTIMLFGAIGTLISCSIISFGAVKIFKHLDIDFLDFGDYLAIGAIFAATDSVCTLQVLSQDETPLLYSLVFGEGVVNDATSVVLFNAIQSFDMTSFDPKIGLHFIGNFLYLFLSSTFLGVGIGLLCAYIIKKLYFGRHSTDREVALMMLMSYLSYIMAELFYLSGILTVFFCGIVMSHYTWHNVTESSRVTTRHSFATLSFVAETFIFLYVGMDALDIEKWKFVKNSQGLSVAVSSILVGLILVGRAAFVFPLSFLSNLAKKNSSDKISFRQQIIIWWAGLMRGAVSIALAYNKFTTSGHTSLHENAIMITSTVTVVLFSTVVFGLMTKPLINLLLPPHKQMPSGHSSMTTSEPSSPKHFTVPLLDNQPDSESDMITGPEVARPTALRMLLRTPTHTVHRYWRKFDDSFMRPVFGGRGFVPFVAGSPVEQSPR

SEQ ID NO: 7123 - protein, 607 aa, Oryza sativa (japonica cultivar-group)
MENGAGAGDDEYTRDGSVDLRGNPVLRSKRGGWKACSFIVVYELFERMAYYGIASNLVIYLTEKLHQGTVEAANNVTNWSGTVFITPLIGAVVADAWLGRYWTFVAGSAVYLMGMLLLTLAVSVPALKPPPCDGGGGAACPRASALQLGVYFGGLYTIALGHGGTKPNISTIGADQFDDFHPPEKLHKLSFFNWWMFTIFLGILFSTTVLVYLQDNVSWTVGYGIPTLGLMVSVAVFLSGTPLYRHKVPQGSPLATMGRVVAAAVWKWRVPLPADSKELHELELEHYTTRRGFRMDATVSMAFLNKAAVKPGEGGGGSVARLPGWTLCTVTQVEETKQIVKLVPLLATMVVPCTLVAQAGTLFVKQGVTLDRRIGKFHVPPASLGAFVTATMLICIVLYDRFLVPAVRRRTKNPRGITLLQRISLGMLLQIVTMVVTSVVESQRLGYARRHGLVATGGQLPVTIFILLPQFVLLGVADAFLVVGQIEFFYDQAPESMKSLGTAMSLTAYGAGNLLSSAILAAVERVTGGGKGRTPWVTNNLNASRLDYYYAFLATLAAANLLAFVVLSCKYSYRVESTETIDVDVAMDNVAQGGGVVTVKSEAAPMA

SEQ ID NO: 7124 - protein, 316 aa, Arabidopsis thaliana
MAMKCVSRRWRDFVCSDEMCDYRNEFNLAESWIYALCRDISGGVFLHMLNPFSSRRSWKRINDYPYIPMREGMGFAVLGKRLFVLGGCGWLEDATDEIYCYDAAMNTWFDVVPPLSTKRCYFACETLDGKIIAIGGLGLNPNAKRTWDIYDPLTRTCKSCSDVNIVPEMEDSFVMDGRIYIRGGVGGSSTAVYSASSGIWERMDDDMASGWRGPAVVVAGDLYVLDQTFGAKLTMWCKDTRMWIHIGKLSQLVMKQPCRLVSIGNSIFVIGKDCSTVVIDVENVRKNKMNGVMVCSSIPKTWDDDIDVISCKSVAI

SEQ ID NO: 7125 - protein, 252 aa, Arabidopsis thaliana
MKKRMKPYSLTSLNNLDDGCLMHILSFLSPIPDRYNTALVCHRWRYLACHPRLWLRVDRFVKDLSQPGVFLNIESAVSAARPGDTILIVAGGNYRVSNIQIKKPLCLVGGGEIPDETTLVCARGSDSALELLSTCKLANLTVKAELGCCLLHRSGRLTIDGCVLQCETNPLDHLSCPIVSTAGDEDIENILSHVEVKETVTGKIKANSVTVLQTRIEGGAKAVSTRGDLVLQRVRVMYSKAYLYFWFDVDYE

SEQ ID NO: 7126 - protein, 247 aa, Fundulus heteroclitus
MSESSQKELVQKAKLAEQAERYDDMAAAMKSVTEEGEELTNEERNLLSVAYKNVVGARRSSWRVVSSIEQKAEGVEGRQAKVKEYREKIEKELKDICNDVLVLLDKFLIPKAEAAESKVFYLKMKGDYYRYLAEVAVGDEKTGIIGDSQEAYKQAFEISKAEMQPTHPIRLGLALNFSVFYYEILNSPEQACKLAKQAFDDAIAELDTLSEESYKDSTLIMQLLRDNLTLWTSDNAVEGEEPEEPKE

SEQ ID NO: 7127 - protein, 528 aa, Mycobacterium bovis
MAATKASTATDEPVKRTATKSPAASASGAKTGPKRTAAKSASGSPPAKRATKPAARSVKPASAPQDTTTSTIPKRKTRAAAKSAAAKAPSARGHATKPRAPKDAQHEAATDPEDALDSVEELDAEPDLDVEPGEDLDLDAADLNLDDLEDDVAPDADDDLDSGDDEDHEDLEAEAAVAPGQTADDDEEIAEPTEKDKASGDFVWDEDESEALRQARKDAELTASADSVRAYLKQIGKVALLNAEEEVELAKRIEAGLYATQLMTELSERGEKLPAAQRRDMMWICRDGDRAKNHLLEANLRLVVSLAKRYTGRGMAFLDLIQEGNLGLIRAVEKFDYTKGYKFSTYATWWIRQAITRAMADQARTIRIPVHMVEVINKLGRIQRELLQDLGREPTPEELAKEMDITPEKVLEIQQYAREPISLDQTIGDEGDSQLGDFIEDSEAVVAVDAVSFTLLQDQLQSVLDTLSEREAGVVRLRFGLTDGQPRTLDEIGQVYGVTRERIRQIESKTMSKLRHPSRSQVLRDYLD

SEQ ID NO: 7128 - protein, 528 aa, Mycobacterium bovis
MAATKASTATDEPVKRTATKSPAASASGAKTGAKRTAAKSASGSPPAKRATKPAARSVKPASAPQDTTTSTIPKRKTRAAAKSAAAKAPSARGHATKPRAPKDAQHEAATDPEDALDSVEELDAEPDLDVEPGEDLDLDAADLNLDDLEDDVAPDADDDLDSGDDEDHEDLEAEAAVAPGQTADDDEEIAEPTEKDKASGDFVWDEDESEALRQARKDAELTASADSVRAYLKQIGKVALLNAEEEVELAKRIEAGLYATQLMTELSERGEKLPAAQRRDMMWICRDGDRAKNHLLEANLRLVVSLAKRYTGRGMAFLDLIQEGNLGLIRAVEKFDYTKGYKFSTYATWWIRQAITRAMADQARTIRIPVHMVEVINKLGRIQRELLQDLGREPTPEELAKEMDITPEKVLEIQQYAREPISLDQTIGDEGDSQLGDFIEDSEAVVAVDAVSFTLLQDQLQSVLDTLSEREAGVVRLRFGLTDGQPRTLDEIGQVYGVTRERIRQIESKTMSKLHHPSRSQVLRDYLD

SEQ ID NO: 7129 - protein, 603 aa, Escherichia coli
MEQNPQSQLKLLVTRGKEQGYLTYAEVNDHLPEDIVDSDQIEDIIQMINDMGIQVMEEAPDADDLMLAENTADEDAAEAAAQVLSSVESQIGRTTDPVRMYMREMGTVELLTREGEIDIAKRIEDGINQVQCSVAEYPEAITYLLEQYDRVEAEEARLSDLITGFVDPNAEEDLAPTATHVGSELSQEDLGDDDSADDDNSIDPELAREKFAELRAQYVVTRDTIKAKGRSHATAQEEILKLSEVFKQFRLVPKQFDYLVNSMRVMMDRVRTQERLIMKLCVEQCKMPKKNFITLFTGNETSDTWFNAAIAMNKPWSEKLHDVSEEVHRALQKLQQIEEETGLTIEQVKDINRRMSIGEAKARRAKKEMVEANLRLVISIAKKYTNRGLQFLDLIQEGNIGLMKAVDKFEYRRGYKFSTYATWWIRQAITRSIADQARTIRIPVHMIETINKLNRISRQMLQEMGREPTPEELAERMLMPEDKIRKVLKIAKEPISMETPIGDDEDSHLGDFIEDTTLELPLDSATTESLRAATHDVLAGLTAREAKVLRMRFGIDMNTDHTLEEVGKQFDVTRERIRQIEAKALRKLRHPSRSEVLRSFLDD

SEQ ID NO: 7130 - protein, 3828 aa, Drosophila virilis
MGRSKFPGNPSKSINRKRISVLQLEDEAASAAAAAAAATAATTEQHQQSEQSAGSSASREKGNNCDNDDDDNAPSGAATSGNRGASSGASDAAPEGGNSYGNGSSTGSKTTNGGNVNGGSHHKSATAPAELKECKNQGNQIEPNNCIAAEPDGTEDTNNDDDDDSSNDKKPTAAAAAAAAAAFVPGPSALQRARKGGNKKFKNLNLARPEVMLPSTSKLKQQQQQQLQLNCPSASASSLSSSAAAAAAAAAPTTTTTTASASATLTATATSTSTSSLPGTPLSVIAGGGGGAAAAALLLANPFASVETKVVEVNAAATAAATAAATAAAGAGEDVGMLKASIEMANEAGLEAPAVAVKSSGSSPNPNHNPNAVAGSTSAAAPGAPTATKQKKTVTFKNILETSDDKSVVKRFYNPDNRVPLVSIMKKDSLNRPLNYCRGSEFIVRPSILSKILNKNSNIDKLNSLKFRSVHASSNSIQESSSSTTNLFGSGLSRAFGAPIDDEDAVSGGVTFRKQEPQHKTPEDNDDDGSASSDAIEDDEDIDDDDAEENEEAASEKSAETTASVDEKEADDRQLVMDKHFVLPKRSTRSSRIIKPNKRLLEVGGICSKRSPSDANGKPKPKNYFGLATLPAKCTPRRRRSAATALSQKLGKETFASFATAKVNSSFVLRQPRLQFQTDKSRSFVSAKPTLPTTTVLPASSSAITSANVLSFGALNNANSAVAAASTCAVCSAPVNNKDAPLARKYGVIACEVCRKFNSRMTKISKLSTPMHSNPSTSTAQSGQQLKCTDGGNCSILSLKSQLKNFKKLYKERCKACWLKKCLATLQLPAGHRSRLSAILPASMREEVAPKDDKCPELLSPTASLRFTAPTSSASSGTTIKWKSSAETAVNSIKSNPLAENNVTFGGTPLLRPAILEKPLFLKIGSDNKKAKESKEALGLSPVPSTSEAAVAPGKTTRKAKQDKEKARELEAEKPLSPNAKKTTEANTPETQKDEQPASTTTTVSAASSSTSHTSSAATNSSQLETTEAANASAVPDNLKRQRIDLKGPRVKHVCRSASIVLGQPLATFGDEEEELAAAEAGPAPTTTTTTTSPEVIIKKPKSPQPMQMIIDENDNCASCILTPTEATAEAQPAVKSVLESRSSKSNTQTEAKKTPATSGSSKGKVTTRNATATVTSVASSLVATKKQRNIEVSSSISSSQAAATQSRRALAKEVNRLKALISIDFWENYDPAEVCQTGFGLIVTETVAQRALCFLCGSTGLDPLIFCACCCEPYHQYCVLDEYNLKHSSFEDTLMTSLLETSNNACAISAATNTALNQLTQRLNWLCPRCTVCYTCNMSSGSKVKCQKCQKNYHSTCLGTSKRLLGADRPLICVNCLKCKSCATTKVSKFVGNLPMCTACFKLRKKGNFCPICQKCYDDNDFDLKMMECGDCNQWVHSKCEGLSDEQYNLLSTLPESIEFICKKCARRCDVSRNKADEWRQAVMEEFKSSLYSVLKLLSKSRQACALLKLSPRKNWRCCSAGAQPAKAHSQGKLQPKALQFTYNGLGSDGESQNSDDIYEFKEQHSTNRKPSTPVPCSCLQPLSQSPSFSLVDIKQKIASNAYVSLAEFNYDMSQVIQQSNCDELDIAYKELLSEQFPWFQNETKACTDALEEDMFESCGYEELKESPTTYAEHHTASQAPRTGLLDIPLDDVDDLGGCAVKTRLDTRVCLFCRKSGEGLSGEEARLLYCGHDCWVHINCAMWSAEVFEEIDGSLQNVHSAVARGRMIKCTVCGNRGATVGCNVKSCGEHYHYPCARTIDCAFLTDKSMYCPAHARNALKANGSPSVTYESNFEVSRPVYVELERKRKKLIVPAKVQFHIGSVAVRQLGSIVPRFSDSFEAIVPINFLCSRLYWSSKEPWKIVEYTVRTTIQNSYSSTLTLDAGRNFTVDHTNPNCSLVQLGLAQIARWHSSLARSDLLDTDWAEFPNSYVPADENTEEEPQQNADLLPPEIKDAIFEDLPHELLDGISMLDIFMYEDLGDKTELFAMSEQSKDGTTATSQAGGASVIICDEDTRNSNSLNKHLVLSNCCTASNPVDDAMLCAARSSSQEKECGDVLKKTDTAPTRSWPKLDGGSVAAFKRRKLSKNIAEGVLLSLNQRSKKEMATVAGITRRQSVCGSSELPAEGSATMRTKSFTWSAAKCLFEKNESREEPAKLTIMQMDGVDDSITEYRIIGSDGNLSTAQFTGQVKCERCQCTYRNYDSFQRHLGSCEPMSTSESESETATGTAQLSAESLNELQKQALAAATLSNTGGLNYLQTSFPQVQNLATLGQFGVQGLQGLQTLQLQPQSLGNGFFLSQPNAAQATSNGNDVLQLYANSLQNLAANLGGGFTLTQPTMSTQAQPQLIALSTNPDGTQQFIQLPQSNGATTQLLQTAAPLRCNATYQTLQATNSDKKIVLLFLEAGDPLQEVVTQAAQQATAAAHQKQLKSGHGVKPIQAKLQGQQQQQRHQQHQQHQQHQQQQQQQQQQQQQQQTPITVAQHGGTTQLLGQNLLQPQLLFQSNAQPQTQQLLLPQTQAQNIISFVTGDGSQNQPLQYISIPTTNDFKPQQTTSTPTFLTAPGGGATFLQTDASGNLMLTTAPANSGLQMLTGQLQTQPQVIGTLIQPQTLQLTTGADGTQTATAQQPLILGGATGGGTTGLEFATAPQVILATQPMYYGLETIVQNTVMSSQQFVSTAMPGVLSQNSSFSATTTQVFQASKIEPIVDLPAGYVVLNNAVDASGNTSWLQQSQTQATDDATAQLLQNAGFQFQTTPTTSTQQTMSTDYAPPLVVTAKVPPVAQMKRNTNANKSPISVLSKVQPQPQQSQVVNKVLPTNVIQQQQQQQQQQQQQQQQMQPKQQLAGNANLKLTSQFQRQQQANELKNKQAAGQQTGSTCGAPPSIASKPLQKKTNLIRPIHKVEVKPKIMKQAPKLATSAASMQHHQQQQSPAAINQVAKVALLQQRLAPAPQPQQQEPQEEQQHLHQQQQQQQQQQQHMQQHQQQQQQLSMPQLLRAQQPIISIVNTAEPQAATQFVIRPALQAQAQPIQLQEQQSQQQQQQPAEQLINGKAARLQRYASNSLPTNVVNPLQQQRCASANNSSNSNVTQQNSTITINSRPTNRVLPMQQRQEPTPLSNDVVVQSPTPPKPIEEPVPAGASTQKPIVKCYAQLEQKSPGYETELKTNITLDNLEQTNSITTMQLQQPQQGPIYGEQIFEKQSEAQVQLEKPKHNDLMLLEATSCQQQQQQQQHMEMVVDNGFQLTSNESCLLEKHGFNVEAVPMDTEDHYASMKNGSGGGAAEGIGQVDDAEEDEDDDDDFSLKMATSACNDHEMSDSEEPAVKEKISKILDNLTNDDCSDSIATATTVEASAGYQQMVEDVLATTAAGSVSTDDETFTATAEAVEAAASYINEMAEAHELQLKQLQAGVELDLKKPKLDVPQQQPDTVPPNVVPTAAAPQQPPPMRDPKKISGPHLLYEIQSEDGFTYKSSSIAEIWEKVFEAVQVARRAHGLTPLPEGPLADMSGVQMIGLKTNALKYLIEQLPGVEKCVKYTPKYHKRNGNVSTAAGGGHARTAGSNPAALAAGAESLIDYGSDQEELQENAYECARCEPYVSRSEYDMFSWLASRHRKQPIQVFVQPSDNELVPRRGTGSNLPMAMKYRTLKETYKDYVGVFRSHIHGRGLYCTKDIEAGEMVIEYAGELIRSTLTDKRERYYDSRGIGCYMFKIDDNLVVDATMRGNAARFINHSCEPNCYSKVVDILGHKHIIIFALRRIVQGEELTYDYKFPFEDEKIPCSCGSKRCRKYLN

SEQ ID NO: 7131 - protein, 874 aa, Clostridium symbiosum
MAKWVYKFEEGNASMRNLLGGKGCNLAEMTILGMPIPQGFTVTTEACTEYYNSGKQITQEIQDQIFEAITWLEELNGKKFGDTEDPLLVSVRSGARASMPGMMDTILNLGLNDVAVEGFAKKTGNPRFAYDSYRRFIQMYSDVVMEVPKSHFEKIIDAMKEEKGVHFDTDLTADDLKELAEKFKAVYKEAMNGEEFPQEPKDQLMGAVKAVFRSWDNPRAIVYRRMNDIPGDWGTAVNVQTMVFGNKGETSGTGVAFTRNPSTGEKGIYGEYLINAQGEDVVAGVRTPQPITQLENDMPDCYKQFMDLAMKLEKHFRDMQDMEFTIEEGKLYFLQTRNGKRTAPAALQIACDLVDEGMITEEEAVVRIEAKSLDQLLHPTFNPAALKAGEVIGSALPASPGAAAGKVYFTADEAKAAHEKGERVILVRLETSPEDIEGMHAAEGILTVRGGMTSHAAVVARGMGTCCVSGCGEIKINEEAKTFELGGHTFAEGDYISLDGSTGKIYKGDIETQEASVSGSFERIMVWADKFRTLKVRTNADTPEDTLNAVKLGAEGIGLCRTEHMFFEADRIMKIRKMILSDSVEAREEALNELIPFQKGDFKAMYKALEGRPMTVRYLDPPLHEFVPHTEEEQAELAKNMGLTLAEVKAKVDELHEFNPMMGHRGCRLAVTYPEIAKMQTRAVMEAAIEVKEETGIDIVPEIMIPLVGEKKELKFVKDVVVEVAEQVKKEKGSDMQYHIGTMIEIPRAALTADAIAEEAEFFSFGTNDLTQMTFGFSRDDAGKFLDSYYKAKIYESDPFARLDQTGVGQLVEMAVKKGRQTRPGLKCGICGEHGGDPSSVEFCHKVGLNYVSCSPFRVPIARLAAAQAALNNK

SEQ ID NO: 7132 - protein, 299 aa, Escherichia coli
MSRKDGVLALLVVVVWGLNFVVIKVGLHNMPPLMLAGLRFMLVAFPAIFFVARPKVPLNLLLGYGLTISFAQFAFLFCAINFGMPAGLASLVLQAQAFFTIMLGAFTFGERLHGKQLAGIALAIFGVLVLIEDSLNGQHVAMLGFMLTLAAAFSWACGNIFNKKIMSHSTRPAVMSLVIWSALIPIIPFFVASLILDGSATMIHSLVTIDMTTILSLMYLAFVATIVGYGIWGTLLGRYETWRVAPLSLLVPVVGLASAALLLDERLTGLQFLGAVLIMTGLYINVFGLRWRKAVKVGS

SEQ ID NO: 7133 - protein, 352 aa, Azospirillum brasilense
MLTFTQREPIGVVGAIIPWNVPLYLMALKIAPALVAGNAVIVKSAEEAPLAALRVIQVMNQVLPAGVLNILSGDGPGCGAPLVTHPGVGKVTFTGSVETGKIISHLAADKLIPVTLELGGKSPMIVMGDADLDKAIDGAVAGMRFTRQGQSCTASSRIFVHESLHDAFIDKLKAKVDAMTMGDPLDEATDIGTIISPQQFERVQSYIALGEATAGAVAHRCSALPTDERLARGLFVQPVLFTGLANDHRLAREEIFGPVTCVIAFRDYEDALAMANDSDFGLAATIWTRDLRTALDATRRLQAGFVQVNQNLVVQPGLSYGGFKQSGLGKEASLEAMLDHFTHKKTVIINMD

SEQ ID NO: 7134 - protein, 635 aa, Xanthomonas campestris
MSFDSSDSRNGGPRHVSRRHFVQGLASGGAVATLGLWPQLSWALKGSGQSNVLSGTEFDLAIGETPVNFTGRARPAITVNGSIPAPLLRWREGTTVNLRVSNVLPAESIHGHETSIHWHGILLPANMDGVPGLSFAGIGRGDTYHYRFTVQQGGTYWYHSHSAFQEQAGLYGPLVIDPIEPEPFSFDRDYVVMLSDWTDLDPAALFARLKKMAGHDNYYRRTVGDFVRDAREDGLKATLADRKMWGQMRMTPTDLSDVNANTYTYLMNGTTSLGNWTGLFRSGEKVRLRFINGSAMTYFDVRIPGLKMTVVAADGQYVHPVSVDEFRIAVAETFDVIVEPSGQDAFTIFAQDSGRTGYISGTLAVREGLRAPVPSVDPRPILTMADMGMDHGGMSGMSMSASDSSDSSDSSNKPAMAMNMAGMAHEPGQRSPAGADADPHAGHDMSGMQSGSMPGMDHGAGMQAHPPSEDRNPLVDNQAMTPTSRMDDPGNGLRGNGRTVLTYAMLKSTFEDPDGRAPGREIELHLTGHMEKFAWGFNGQKFSDVTPLRLNYGERLRIVLVNDTMMSHPIHLHGMWSDLEDDGGNFQVRKHTVDMPPGSKRTYRVRADALGTWAYHCHLLYHMEAGMMRAVKVEE

SEQ ID NO: 7135 - protein, 837 aa, Xanthomonas campestris
MSSPSIAPVTPDLVRLRATARDKDDAIAQAAQLLVAAGCVAPGYDASMRRREGLANTFLGHGLAIPHGVGEDRHLVRRDGIAVLQLPEGVEWNPGQTTRLVVGIAAQSDTHITLVRRLTRLIQDPAQLEALFTTDDPAVIVAALTGDRAPDTSAAPATDLAERFEWTIAYPSGLHARPATRWAETARGFSARAQVRAGDQAADAKSLVGLLQLGLRAGDSITVSAKGSDAPALLKRLRAVMDSLTAQEKADAERAAQRRAAPVIGWTPPQAQPAIVGIGASPGVAIGIVHRLRAAQTEVADQPIGLGDGGVLLHDALTRTRQQLAAIQDDTQRRLGASDAAIFKAQAELLNDTDLITRTCQLMVEGHGVAWSWHQAVEQIASGLAALGNPVLAGRAADLRDVGRRVLAQLDAAAAGAGLTDLPEQPCILLAGDLSPSDTANLDTDCVLGLATAQGGPTSHTAILSRTLGLPALVAAGGQLLDIEDGVTAIIDGSSGRLYINPSEQDLDAARTHIAEQQAIREREAAQRALPAETTDGHHIDIGANVNLPEQVAMALTQGANVGLMRTEFLFLERGSTPTEDEQYHTYLAMAQALNGRPLIVRALDIGGDKQVAHLESPHEENPFLGVRGARLSSRRPDLLEPQSRALYRAAKDGARLSIMFPMITSVPELISLREICAAIRAELHAPELPIGIMIEVPAAAAQADVLARHADFFSIGTNDLTQYVLAIDRQNPELAAEASSLHPAVLRMIRSTIDGARKHDRWVGVCGGLAGDPFGASLLAGLGVQELSMTPNDIPAVKARLRGRALSALQQLAEQALHCETAEQVRALEAQREGQA

SEQ ID NO: 7136 - protein, 323 aa, Zea mays; identical to SEQ ID NO: 845

SEQ ID NO: 7137 - protein, 339 aa, Zea mays; identical to SEQ ID NO: 6738

SEQ ID NO: 7138 - protein, 338 aa, Zea mays; identical to SEQ ID NO: 846

SEQ ID NO: 7139 - protein, 342 aa, Zea mays; identical to SEQ ID NO: 6060

SEQ ID NO: 7140 - protein, 462 aa, Listeria monocytogenes
MFKTNVEQNNVPVFGSFESGQDLPEKRMNKESVDPRIAYQLVKDQLIDEGSARQNLATFCQTYMEPEAEQIMAETMEKNAIDKSEYPQTAKLESSCVNMLADLWNVDESEHYMGTSTVGSSEACMLGGMAMKFRWRSAALKNGLDIHAKKPNLVISSGYQVCWEKFCVYWDIELREVPMSEEHLSINTDIIMDYVDEYTIGIVGILGITYTGKFDDIMTLNDLVEDYNNTHDNEVVIHVDGASGAMFTPFVEPGLEWDFRLPNVVSINTSGHKYGLVYPGVGWILWRDKEYLPEELVFDVSYLGGHMPTMAINFSRSASQIIGQYYNFLRFGYEGYRQIHMRTRDGALQLSQAVAETGLFEIYNDGANLPIVCYKLKDDANVAWTLYDLADRLQMKGWQVPAYPLPKEMGNTIIQRYVCRGDLGQNMVTAFKNDLSESIEELNNAHILYHDVNTSKTHGFTH

SEQ ID NO: 7141 - protein, 464 aa, Listeria monocytogenes
MLYSKENKESYLEPVFGSSAEDRDIPKYTLGKEPLEPRIAYRLVKDELLDEGSARQNLATFCQTYMEDEATKLMSETLEKNAIDKSEYPRTPELENRCVNIIADLWHAPKDQKFMGTSTIGSSDACMLGGMAMKFAWRKRAEKLGLDIYAKKPNLVISSGYQVCWEKFCVYWDIDMRVVPMDKEHMQLNTDQVLDYVDEYTIGVVGILGITYTGRYDDIYALNEKLEEYNSKTDYKVYIHVDAASGGFFTPFVEPDIIWDFRLKNVISINTSGHKYGLVYPGIGWVLWKDESYLPEELIFKVSYLGGEMPTMQINFSRSASHIIGQYYNFLRYGFEGYRTIHQKTSDVAQYLAHAVEQTGYFDIFNDGSHLPIVCYKLKTTANVNWTLYDLADRLQMRGWQVPAYPLPKSLENIIIQRYVCRADLGFNMAEEFIQDFQASIQELNNAHILFHDTQQSGVHGFTH

SEQ ID NO: 7142 - protein, 330 aa, Salmonella typhimurium
MSQNTLKVHDLNEDAEFDENGVEAFDEKALSEEEPSDNDLAEEELLSQGATQRVLDATQLYLGEIGYSPLLTAEEEVYFARRDLRGDVASRRRMIESNLRLVVKIARRYGNRGLALLDLIEEGNLGLIRAVEKFDPERGFRFSTYATWWIRQTIERAIMNQTRTIRLPIHIVKELNVYLRTARELSHKLDHEPSAEEIAEQLDKPVDDVSRMLRLNERITSVDTPLGGDSEKALLDILADEKENGPEDTTQDDDMKQSIVKWLFELNAKQREVLARRFGLLGYEAATLEDVGREIGLTRERVRQIQVEGLRRLREILQTQGLNIEALFRE

SEQ ID NO: 7143 - protein, 344 aa, Yersinia enterocolitica
MYEAGHNVMIISLTGETLVRPNDGIQLNELKLDKAPFSLFKGLFEVKKIIKKFKPDIVHSHMFHANLFARILRVFTKIPALICTAHNTNEGSSLRMLAYKYTDKLASLSTNVSQDAVDSFIHKGASSTGRMIAVSNGIDASQFDFSMDERKVKRSELGIFNDTPIILSVGRLTEAKDYPNLLTAFSLLIKDNSLQSFPQLFIVGTGHLDGYLKNMSKEFGIDKYVTLFGQRDDILQLMCAADIFVLSSEWEGFPLVITEAMACKKIIVATDAGGITEALGDCGSIVPIKDPNSLSQAINKMIKLSDNEKEILGNKARERIIQTNSIEKIIELGCLFILNLKNNC

SEQ ID NO: 7144 - protein, 386 aa, Haemophilus influenzae
MIKYARQIYSTKQEVIMATYFSDNLTADQQNQVQQIIQQFQHPTLQKDLIVLNTLKKVEKGGDTLRIELQLPFAWNSGAEQLKQAVSDALLKATDCKLIKWAVAYQIATLKRANNQPAVKGVKNIIAVSSGKGGVGKSSVSVNLALALQAQGARVGILDADIYGPSIPHMLGAADQRPTSPDNQHITPIKAHGLSANSIGFLMNEDSATIWRGPMASSALSQLLNETLWDSLDYLVIDMPPGTGDIQLTLSQQIPVTGAVVVTTPQDIALLDAVKGISMFERVSVPVLGIVENMSMHICSECGHHEAIFGTGGAEKMAEKYNVKVLAQLPLHIRIREDLDAGNPTVVRVPENEISQAFLQLAEKVSTELYWQGSVIPSEILFKEVK

SEQ ID NO: 7145 - protein, 103 aa, Anabaena sp.
MSVYVGNLSYDVTEDSLNAVFAEYGSVKRVQLPTDRETGRMRGFGFVEMGSDAEETAAIEALDGAEWMGRDLKVNKAKPKEDRGSFGGGNRGGYGGGGGPNRY

SEQ ID NO: 7146 - protein, 368 aa, Enterococcus faecalis
MEKETSKKYEAAVGTFIKENKPKGTVVYDDLANQLATPYTLDAEAMEKLIQKVEDAGISVVDENGDPSEHSLKKDEKEAEKAQAEDLSAPTGVKINDPVRMYLKEIGRVQLLTAAEEVELALKIEEGDQEAKQRLAEANLRLVVSIAKRYVGRGMQFLDLIQEGNMGLMKAVEKFDYRKGFKFSTYATWWIRQAITRAIADQARTIRIPVHMVETINKLIRMQRNLLQDLGREPTPEEIGAEMDLPTEKVREILKIAQEPVSLETPIGEEDDSHLGDFIEDQDATSPAEHAAYELLKEQLEDVLDTLTDREENVLRLRFGLDDGRTRTLEEVGKVFGVTRERIRQIEAKALRKLRHPSRSKQLKDFLE

SEQ ID NO: 7147 - protein, 261 aa, Streptomyces fradiae
MTQQNPKVAIVTGATSGIGLAVTRLLGRQGHRVFLCARTEDSVTSTVKQLLDEGLEVDGAPCDVRSADDVERFVQRAVHRFGTIDVLVNNAGRSGGGVTADIADELWHDVIDTNLNSVFRMTREVLNTGGMRHKDRGRIINIASTAGKQGVVLGAPYSASKHGVVGFTKALGNELAPTGITVNAVCPGYVETPMAQRVRAGYAAAYDTSEDAILEKFQAKIPLGRYSTPEEVAGLVGYLASDTAASITSQALNVCGGLGNF

SEQ ID NO: 7148 - protein, 261 aa, Streptomyces griseus
MSDQDKRVAVVTGATSGIGLSVARLLASQGHRVFIGARSAENVAATVKELVAEGLDVDGAVVDVRSDADVEAWIQAAVDRFGTVDVVVNNAGRSGGGVTADIDPELWHDVIDTNLNSVFRVTRSALNTGGLRSKSRGRIINIASTAGKQGVVLGAPYSASKHGVVGFTKALGNELAPTGITVNAVCPGYVETPMAQRVRQGYAAAYDATEDAILEKFQAKIPLGRYSTPDEVAGLVGYLASDTAASITSQALNVCGGLGNF

SEQ ID NO: 7149 - protein, 591 aa, Chlamydomonas eugametos
MAAKFVEGTLDVTLKSASDLREDMSVKLDAYCVVSCASTAHRSNTVTDAGKTMNWEQTFHFDKVASTSVLKLESSMRRTPSDRSSCACKIPLTRACTSGSDEVCVPVLDKKGKPIGETHVSMTFKATSMADGPTKGNWILPTYANKDCWKDYEQGKVVGKGSFGTTYLVTKKDTQEQYAVKVISKRKLTTMEEVEDIQREVRIMHHLAGHPNVVQLKNVYEDKSYVYLVMDACMGGELFDAIVERGTYSEKDARALMRTIVSVVAHCHDMGVIHRDLKPENFLLLDKSANPVLKSIDFGLSSFYQEGQVFHDIVGSPFYVAPEVVRRSYGKEADIWSCGVILYILLCGYPPFHGDNETKIFEAIMNKSLDFQSDPWPKVSEPAKECIRRMLDRNPKTRASAQQTLEHEWMRENGVATEKRLEMEVLTSMKKFSAGNRLKKEAAKIIAANLPTDEICGLREMFIAIDVDHSGSITAEEFANALRMKGNSLPEDEVQRLVSNADVDGDGTCDYEEFLAATINQSKLEREDRLKIAFEHFDLDHDGSITHDELMQSLANLGINDAGIKEIIADVDRDGNGQIDYNEFCLMMRNL

SEQ ID NO: 7150 - protein, 547 aa, Chlamydomonas reinhardtii
MAEKPATVNAELVKEMDAAPKKYPYSLDSEGKANYCPVWRFTQPHMMAFHLSWICFFMSFVATFAPASLAPIIRDDLFLTKSQLGNAGVAAVCGAIAARIFMGIVVDSIGPRYGAAATMLMTAPAVFCMALVTDFSTFACVRFFIGLSLCMFVCCQFWCGTMFNVKIVGTANAIAAGWGNMGGGACHFIMPLIYQGIKDGGVPGYQAWRWAFFVPGGIYILTATLTLLLGIDHPSGKDYRDLKKEGTLKAKGAMWPVVKCGLGNYRSWILALTYGYSFGVELTVDNVIVEYLFDQFGLNLAVAGALGAIFGLMNLFTRATGGMISDLVAKPFGMRGRIWALWIIQTLGGIFCIVLGKVSNSLSSTIVIMIVFSIFCQQACGLHFGITPFVSRRAYGVVSGLVGAGGNTGAAITQAIWFAGTAPWQLTLSKADGFVYMGIMTIGLTLPLFFIWFPMWGSMLTGPREGAEEEDYYMREWSAEEVASGLHQGSMRFAMESKSQRGTRDKRAAGPARVPQQLRLGARCCQARGGLIRCVLAQSLGATGCSD

SEQ ID NO: 7151 - protein, 239 aa, Chlamydomonas reinhardtii
AYLFDQFGLNLAVAGALGAIFGLMNIFSRATGGMISDLIAKPFGMRGRLWVLWITQTLGGIFCIIMGKVSNSLTATIVIMIIFSIFCQQACGMHFGITPFVSRRAYGVVSGLVGAGGNVGAAITQAIWFSGTATWQINLSRPDSFVWMGVQAVALTVAVMFIWFPMWGSMFTGPREGVEEEDYYLREWSAEEVAQGLHQGSMRFAMESKSQRGYKDKRMLDAVGETASADVAAVKATVA

SEQ ID NO: 7152 - protein, 289 aa, Mesembryanthemum crystallinum
MSNTCFTSSLHSPSILIPKSLFFSIPSKPTKIPLSLSLSSPQLSSFSLQKQTLSSTVVTYVAQTSEWDQEGTNAVLEEGSDQEPSWGNTEAQVSDFGSDEGEGFQEPPEDAKLFVGNLPFDVDSEKLAQIFEGAGVVEIAEVIYNRETDRSRGFGFVTMSTVEEAEKAVELYHKFEVNGRFLTVNKAAPRGSRPERAPREYEPSFRVYVGNLPWDVDDARLEQVFSEHGKVLSARVVSDRETGRSRGFAFVTMASESEMNEAIGALDGQTLEGRAIRVNVAEERPRRSF

SEQ ID NO: 7153 - protein, 523 aa, Beta vulgaris
MEGRNVKNGDTNNNKIVGSSLSIEKNPISPPEASSLKKLALVASIAAGVQFGWALQLSLLTPYVQLLGIPHTWAPYIWLCGPISGMIVQPTVGYYSDRCTSKFGRRSPFIAVGATLVGFAVSLIGFAADIGHATGDPNGNVPKPRAIAVFVVGFWILDVANNTLQGPCRALLADMAAGSQAKTRYANAFFSFFMALGNIGGYAGSYGRLYTVFPFTHTKACDTYCANLKSCFFISITLLIVLTILALSVVRERPFTLDEIQEEENLKNNTGGCARLPFFGQLFGALKDLPKPMLILLLVTCLNWIAWFPFLLFDTDWMGKEVYGGTVGEGKAYDMGVHAGALGLMINSVVLGIMSLGIEKLARLVGGVKRLWGIVNLILAVCLAMTILVTKSAEHYRATHHVPGAIGPPLPPPGVKGGALAIFAVLGIPLAITFSIPFALASIFSASSGSGQGLSLGVLNLAIVVPQMFVSVTSGPWDALFGGGNLPAFVVGAVAATASAILSFTLLPPPPPEAKIGGSMGGH

SEQ ID NO: 7154 - protein, 383 aa, Arabidopsis thaliana
MAENLACGETASHGSLTTTMMISTMAADFTNEIDYNHQLFAKDDNFGGNGSIPMMGSSSSSLSEDRIKEMLVREIEFCPGTDYVKRLLSGDLDLSVRNQALDWILKVCAHYHFGHLCICLSMNYLDRFLTSYELPKDKDWAAQLLAVSCLSLASKMEETDVPHIVDLQVEDPKFVFEAKTIKRMELLVVTTLNWRLQALTPFSFIDYFVDKISGHVSENLIYRSSRFILNTTKAIEFLDFRPSEIAAAAAVSVSISGETECIDEEKALSSLIYVKQERVKRCLNLMRSLTGEENVRGTSLSQEQARVAVRAVPASPVGVLEATCLSYRSEERTVESCTNSSQSSPDNNNNNNNSKQEEEKTMRENKRVIHCLLQPKTTSTHDI

SEQ ID NO: 7155 - protein, 586 aa, Arabidopsis thaliana
MGSIEEEARPLIEEGLILQEVKLYAEDGSVDFNGNPPLKEKTGNWKACPFILGNECCERLAYYGIAGNLITYLTTKLHQGNVSAATNVTTWQGTCYLTPLIGAVLADAYWGRYWTIACFSGIYFIGMSALTLSASVPALKPAECIGDFCPSATPAQYAMFFGGLYLIALGTGGIKPCVSSFGADQFDDTDSRERVRKASFFNWFYFSINIGALVSSSLLVWIQENRGWGLGFGIPTVFMGLAIASFFFGTPLYRFQKPGGSPITRISQVVVASFRKSSVKVPEDATLLYETQDKNSAIAGSRKIEHTDDCQYLDKAAVISEEESKSGDYSNSWEDLCTVTQVEELKILIRMFPIWASGIIFSAVYAQMSTMFVQQGRAMNCKIGSFQLPPAALGTFDTASVIIWVPLYDRFIVPLARKFTGVDKGFTEIQRMGIGLFVSVLCMAAAAIVEIIRLHMANDLGLVESGAPVPISVLWQIPQYFILGAAEVFYFIGQLEFFYDQSPDAMRSLCSALALLTNALGNYLSSLILTLVTYFTTRNGQEGWISDNLNSGHLDYFFWLLAGLSLVNMAVYFFSAARYKQKKASS

SEQ ID NO: 7156 - protein, 251 aa, Arabidopsis thaliana
MAATLGRDQYVYMAKLAEQAERYEEMVQFMEQLVTGATPAEELTVEERNLLSVAYKNVIGSLRAAWRIVSSIEQKEESRKNDEHVSLVKDYRSKVESELSSVCSGILKLLDSHLIPSAGASESKVFYLKMKGDYHRYMAEFKSGDERKTAAEDTMLAYKAAQDIAAADMAPTHPIRLGLALNFSVFYYEILNSSDKACNMAKQAFEEAIAELDTLGEESYKDSTLIMQLLRDNLTLWTSDYAGADGRGLRI

SEQ ID NO: 7157 - protein, 858 aa, Brassica rapa
MQGVRYIYHHFYTSLLVFVVMILFRSALSIYINTLSSTESLTISNNRTLVSPGDVFELGFFTPGSSSRWYLGIWYKKLPYITYVWVANRDNPLSNSTGTLKISGNNLFLLGDSNKSIWSTNLTRGNERSPVVAELLANGNFVMRDSNNNDASGFLWQSFDYPTDTLLPEMKLGYDLKTGLNRFLTSSRNFDDPSSGDYSYKLEPRRLPEFYLLLGDVREHRSGPWNGIQFSGIPEDQKLSYMVYNFTKNSEEVAYTFRMTNNSFYSRLTINSEGYLERLTWAPSSVVWNVFWSSPNHQCDMYRMCGPYSYCDVNTSPSCNCIQGFNPGNVQQWALRNQISGCKRRTRLSCNGDGFTRMKNIKLPDTRMAIVDRSIGLKECEKRCLSDCNCTAFANADIRNRVTGCVIWTGELEDMRNYAEGGQDLYVRLAAADLVKKRNGNWKIISLIVGVSVVLLLLLLLLIMFCLWKRKQNRAKAMATSIVNQQRNQNVLMNTMTQSNKRQLSRENKADEFELPLIELEAVVKATENFSNCNELGRGGFGIVYKGMLDGQEVAVKRLSKTSLQGIDEFMNEVRLIARLQHINLVRILGCCIEAGEKILIYEYLENSSLDYFLFGKKRSSNLNWKDRFAITNGVARGLLYLHQDSRFRIIHRDLKPGNILLDKYMIPKISDFGMARIFARDETQVRTDNAVGTYGYMSPEYAMYGVISEKTDVFSFGVIVLEIVIGKRNRGFYQVNPENNLPSYAWTHWAEGRALEIVDPVILDSLSSLPSTFKPKEVLKCIQIGLLCIQERAEHRPTMSSVVWMLGSEATEIPQPKPPVYCLIASYYANNPSSSRQFDDDEPWTVNKYTCSVIDAR

SEQ ID NO: 7158 - protein, 434 aa, Brassica napus
MGKENVVSRPLTRAFASALRASTTENQQRANTKRPASEDVNVTAPPNKKKKRAVLGDISNASFSAAKLEARDIKQVKKSQGLASASCVTSEVTDLQSGTEAKAEVVSVTAGNTNDTADNCIEKHKLPPRPLGRSSASIVEKSGVIRSSTALDLPKFTDIDSDDKDPLLCCLYAPEIYYNLRVSELKRRPVPNFMERIQKDVTQSMRGILVDWLVEVSEEYTLVPDTLYQTVYLIDWFLHGNYLERQRLQLLGITCMLIASKYEEINAPRIEEFCFITDNTYTRDQVLEMENQVLAHFSFQIYTPTPKTFLRRFLRAAQASYLIPRRELECLASYLTEVTLIDYHFLKFLPSVIAASAVFLAKWTLDQSNHPWNPTLEHYTTYKASDLKASVHALQDLQLNTKGCPLSAIRMKYKQEKFKSVAVLMSPKLLDTLF

SEQ ID NO: 7159 - protein, 425 aa, Brassica napus
MSKTTNQNRRPSFTSSTESSMRKRHGPSSSSSAVKPISNTAVMVAKKRAPLGNITNQRKDSRIFPNSSSADSAHCPNKSAKLKLAAPTQPVCVNACETKSTCEEEVVPIERKAFSNLCITPSSDTTTNVMSETENKEEKFMNIDNKDDADPQLYATFACDIYNHLRAAEAKKQPAVDYMETVQKDVNSTMRGILVDWLVEVSEEYRLVPETLYLTVNYIDRYLSGNVISRQKLQLLGVACMMIAAKYEEVCAPQVEEFCYITDNTYLKDEVLDMESAVLNYLKFEMSAPTVKCFLRRLFSGCPRVHEAPCMQLECMASYIAELSLLEYTMLSHPPSLVAASAIFLAKYTLDPTRRPWNSTLRHYTQYEAMELRGCVMDLQRLCSNAHVSTLPAVRDKYSQHKYKFVAKKFCPSIIPPDFFKNSLY

SEQ ID NO: 7160 - protein, 63 aa, Brassica rapa
MRGILVDWLVEVAEEYTLVPDTLYLTVYLIDWFLNGNYVERNRLQLLGVTCMLIASKYEEIYP

SEQ ID NO: 7161 - protein, 177 aa, Ceratodon purpureus
MAPPTVGTQAQAAPAMVPARVYSKDDEVLVKKSWDILKKDAQRNGINFFRKVFEIAPGAKSMYSFLRDSTIPFEENPKVKNHARYVFMMTGDAAVQLGEKGAYQVLDSKLQKLAATHINAGVTDDQFEIVKEAILYAIEMGVPELWSPELKSAWGDAYDMLAAAVKAEMHAQRAAAQ

SEQ ID NO: 7162 - protein, 277 aa, Glycine max; identical to SEQ ID NO: 2838

SEQ ID NO: 7163 - protein, 323 aa, Homo sapiens
MDSKQQCVKLNDGHFMPVLGFGTYAPPEVPRSKALEVSKLAIEAGFRHIDSAHLYNNEEQVGLAIRSKIADGSVKREDIFYTSKLWSTSHRPELVRPALENSLKKAQLDYVDLYLIHSPMSLKPGEELSPTDENGKVIFDIVDLCTTWEAMEKCKDAGLAKSIGVSNFNRRQLEMILNKPGLKYKPVCNQVECHPYFNRSKLLDFCKSKDIVLVAYSALGSQRDKRWVDPNSPVLLEDPVLCALAKKHKRTPALIALRYQLQRGVVVLARSYNEQRIRQNVQVFEFQLTAEDMKAIDGLDRNLHYFNSDSFASHPNYPYSDEY

SEQ ID NO: 7164 - protein, 258 aa, Pisum sativum
MAAILLLTIASLTSLFAPTTARIPGVYTGGPWTSAHATFYGGSDASGTMGGACGYGNLYSQGYGVNTAALSTALFNNGLSCGACFELKCDQDPRWCNPGNPSILITATNFCPPNFAEPSDNGGWCNPPRPHFDLAMPMFLKIAQYRAGIVPVAYRRVPCRKAGGIRFTINGFRYFNLVLITNVAGAGDIVRVSVKGTNTAWMTMSRNWGQNWQSNAVFVGQALSFRVTGSDRRTSTSWNVAPPHWQFGQTFTGKNFRV

SEQ ID NO: 7165 - protein, 117 aa, Vicia faba
VVELARALGSMPGVYRVDLLTRQVSSPDVDWSYGEPTEMLAPRNTDEFGDDMGESSGAYIIRIPFGPRNKYIPKEELWPYIPEFVDGAMGHIIQMSKALGEQIGSGHAVWPVAIHGH

SEQ ID NO: 7166 - protein, 386 aa, Lycopersicon esculentum
MASTKQYFSAAGKPIRCKAAVARKAGEPLVIEEVIVAPPKAHEVRRKIICTSLCHTDITLWKLKGCFPRILGHEAFGVVESVGEDVDELKEGDSVVPIFLPDCMDCVDCKSKKSNLCSKFPIQVSPLLHRNDTSRFSNAAGETLHHFLYISSFSEYTVVDVVNVTKIDPEIPPNRACLLSCGVSTGVGAAWKTANVEPGSTVVIFGLGSIGLAVAEGARLCGATRIIGVDINSNKFEIGKQFGITEFVNSKSCVDKPISQVIIEMTDGGADYCFECVGLATLVQEAFTCCRKGWGKTVVLGVDKPDAHLNLNSFEVLQSQKTLTGALFGGLKPKSDVPILVKRYLDKELQLNKFVTHEVNFEDINKAFDLLIQGKSLRCVIWMDKL

SEQ ID NO: 7167 - protein, 390 aa, Lycopersicon esculentum
MASTVQSGISKTAGKPIRCRAAVARKAGEPLVIEEVIVAPPKAHEVRLKIICTSLCHTDITLWKLKEFPGCFPRILGHEAFGVVESVGEDVDHLKEGDSVVPIFLPDCMDCVDCKSKKSNLCSKFPIQSSLLLHRDDTSRFTNADGETLHHYLYISSFSEYTVVDVVNVTKIDPEIPPNRACLLSCGVSTGVGAAWKTANVEPGSTVVIFGLGSVGLAVAEGARLCGATRIIGVGRNSDKFEIGKQFGVTEFVNSKSCGDKPVSQVIIEMTNGGADYCNECVGLGRVVQEAFACCRKGWGKTIVLGVDKPDARLNLNSFEVLQSNKTLMGSFFGGLKPKSDVHTSLKRYLDKELELDKFVTHEVNLEDINKGFDLLIQLKSLRCVIWMEK

SEQ ID NO: 7168 - protein, 428 aa, Lycopersicon esculentum
MENGTKGKLTVSSSLQIEQPLPPSKLWKIIVVASIAAGVQFGWALQLSLLTPYVQLLGIPHRFASFIWLCGPISGMIVQPVVGYYSDNCSSRFGRRRPFIAAGAALVTIAVFLIGFAADLGHASGDPLGKGSKPRAIAVFVVGFWILDVANNMLQGPCRALLADLSGGKSGKMRTANAFFSFFKAVGNILGYAAGSYSRLFKVFPFSKTKACDMYRANLKSCFFIAIFLLLSLTTLALTLVRENELPEKEELEIDEKLSGAGKSKVPFFGEIFGALKDLPRPMWILLLVTCLNWIAWFPFFLYDTDWMAKEVFGGQVGDAKLYDLGVRAGALGLLLQSVVLGFMSLGVEFLGKKIGGAKRLWGILNFVLAICLAMTILVTKMAEKSRGHDAAGTLMGPTPGVKIGALLLFAALGIPLAVTFSIPFALA

SEQ ID NO: 7169 - protein, 435 aa, Lycopersicon esculentum
MSSQNFGVGAVSHVRSLSQSSIFSNSCLPPLSPFPPSEPGMVSGRSSLKDISMEEADVNSQGVGVVSSFTRDGLPPRKGHRRSNSDVPLGFSAMIQSSPQLMPISGQKVLGRAVSLGDSNGKIDERKPKGEVTDELLFSYMNLENIETLNGSGTKDRDKDSIVSGTKVTGSESSNNEAESVMKGNNVSIQPTNLREGTKRSADANIAPAARHFRSLSMDSAIGNFHYGDESPNLPTSLMMRSGQLSPSNSGNESSSKHNLDFGNSEFSEAEMKKIMADERLAEIAVLDPKRAKRILANRLSAARSKERKTRYISELEHKVQKLQTETTTLSTQVTILQKNFVEISSLNSELKFRIQAMEQQAQLRDALHEALTAEVQRLKLAAGEHREEGRLPNNMTQQTPVKHNIFQMQRQQPSQMQQLSVGKASAASATPASA

SEQ ID NO: 7170 - protein, 415 aa, Nicotiana tabacum
MGNSEDGKPSKPEKSSSPTPDQSNLHVYPDWAAMQAYYGPRVAVPTYFNSAVAPGHTPHPYMWGPQPMIPPYGAPYAAIYAHGGVYAHPGVPIGSHPPGHGMATSPAVSQAMDGASLSLDASAKSSENSDRGLLAMSLGNGSADNIEGGTDHGNSQSGDTEGSTDGSDTNGAGVSERSKKRSRGTTPDNSGDSKSHLRRCQPTGEVNNDSEKTIVVVRPGKVEEKVMGTVLSPSMTTTLEMRNPASTHLKASPTNVSQLSPALPNEAWLQNERELKREKRKQSNRESARRSRLRKQAEAEELAIRVQSLTGENMTLKSEINKLMENSEKLKLENAALMEKLNNEQLSPTEEVSLGKIDDKRVQPVGTANLLARVNNSGSLNRANEESEVYENNSSGAKLHQLLDSSPRTDAVAAG

SEQ ID NO: 7171 - protein, 427 aa, Nicotiana tabacum
MGNSEDGKSCKPEKSSSTAPDQSNIHVYPDWAAMQAYYGPRVAVPPYVNSPVAPGQAPHPCMWGPLQPMMPPYGIPYAGIYAHGGVYAHPGVPIVSRPQAHVMTSSPAVSQTMDAASLSMDPSAKTSGDTNQGLMSKLKGSDGLGMSIGNCSVDNGDGTDHGPSQSDSGQTEGSSDGSNIHTAEVGEKSKKRSRETTPNTSGDGKSRTRSSPQPREVNGATKKETSIAFNPGNIAEKVVGTVFSPTMTTTLELRNPVGTLVKASPTNVSRISPAVPGEAWLQNEREMKREKRKQSNRESARRSRLRKQGEAEELAIRVQSLTSENLGLKSEINNFTENSAKLKLENSALMERLQNKQRGQAEEVTLGKIGDKRLQPVSTADLLARVNNSGPLDRTNKDDEIHENNTSGAKLHQLLDASHRTDAVAAR

SEQ ID NO: 7172 - protein, 765 aa, Nicotiana tabacum
MGAALLPDLGAEIVIPVCAVIGIVFSLVQWYLVSNVKLTPESSSPSNNGKNGYGDYLIEEEEGINEQNVVVKCAEIQNAISEGATSFLFTEYQYVGIFMIAFAILIFLFLGSVEGFSTKSQPCTYNKEKLCKPALATAIFSTVSFLLGAVTSVVSGFLGMKIATYANARTTLEARKGVGKAFIVAFRSGAVMGFLLAANGLLVLYIAINLFKLYYGDDWEGLFEAITGYGLGGSSMALFGRVGGGIYTKAADVGADLVGKVERNIPEDDPRNPAVIADNVGDNVGDIAGMGSDLFGSYAEASCAALVVASISSFGINHEFTAMLYPLLISSMGILICLITTLFATDFFEIKAVKEIEPALKNQLIISTALMTVGIAIVTWTCLPSSFTIFNFGAQKVVKNWQLFLCVAVGLWAGLIIGFVTEYYTSNAYSPVQDVADSCRTGAATNVIFGLALGYKSVIIPIFAIAIAIFVSFSFAAMYGIAVAALGMLSTIATGLAIDAYGPISDNAGGIAEMAGMSHRIRERTDALDAAGNTTAAIGKGFAIGSAALVSLALFGAFVSRAAITTVDVLTPQVFIGLIVGAMLPYWFSAMTMKSVGSAALKMVEEVRRQFNTIPGLMEGTAKPDYATCVKISTDASIKEMIPPGALVMLTPLIVGIFFGVETLSGVLAGALVSGVQIAISASNTGGAWDNAKKYIEAGASEHARTLGPKGSDPHKAAVIGDTIGDPLKDTSGPSLNILIKLMAVESLVFAPFFATHGGLLFKIF

SEQ ID NO: 7173 - protein, 526 aa, Nicotiana tabacum
MDSARGWFQKLSSTKKDPMASGREDGKPVSAEEASNITKQRVAAAKQYIEKHYREQMKNLQERRERRILLEKKLADADVSEEDQNNLLKFLEKKETEYMRLQRHKMGADDFELLTMIGKGAFGEPICMIGFSVITGQNCREKTTGQVYAMKKLKKSEMLRRGQVEHVKAERNLLAEVDSDCIVKLYYSFQDDDYLYLVMEYLPGGDMMTLLMRKDILTEDEARFYVAETVLAIESIHKHNYIHRDIKPDNLLLDRYGHLKLSDFGLCKPLDCSTLEEKDFSVGDNANGGSRSDSPPAPKRTQQEQLEHWQKNRRMLAYSTVGTPDYIAPEVLLKKGYGMECDWWSLGAIMYEMLVGYPPFYSDDPMSTCRKIVNWKNHLKFPEEAKLSPEAKDIISRLLCNVTERLGSNGADEIKVHSWFKGIDWDRIYQMEAAFIPEVNDELDTQNFEKFEESESHSQSGSRSGPWRKMLSSKDINFVGYTYKNFKVVNDYQVPGMVELKKTNTKPKKPTIKSLFGDESEASEDN

SEQ ID NO: 7174 - protein, 507 aa, Nicotiana tabacum
MENGTKKLNVSSLAVEQPLPKSKLWKIIMVASIAAGVQFGWALQLSLLTPYVQLLGIPHKFASFIWLCGPISGMIVQPVVGYYSDNCSSRFGRRRGFIAAGAALVTIAVFLIGFAADLGHATGDPLGKGSKPRAIAVFVVGFWILDVANNMLQGPCRALLADLSGGKARMRTSNAFFSFFMAVGNVLGYAAGSYSRLCKIFPFSKTPACDIYCANLKSCFFIAVFLLLSLTILALTVVRENELPEKDEHEIDEKAGARKSKVPFFGEIFGALKDLPRPMWILLLVTSLNWIARFPFFLYDTDWMAKEVYGGKVGDGRLYDLGVHAGALGLLLNSVVLGFMSLSVEFLGKKIGGVKRLWGILNFVLAVCMALTVLVTKMAEKSRQYDAHGTLMAPTSGVKIGALTLFAVLGIPLAVTFSVPFALASIFSSNAGSGQGLSLGVLNLAIVVPQMLVSIAGGPWDDLFGGGNLPGFIVGAVAAAASGILALTMLPSPPADAKPATTMGGFH

SEQ ID NO: 7175 - protein, 219 aa, Nicotiana tabacum
MVRGKTQMRRIENATSRQVTFSKRRNGLLKKAFELSVLCDAEVGLVIFSPRGKLYEFASSSMQEIIERYKRHTKDKVQPENQVGEQNLQHMQHAAASLMKKIELLEESKRKLLGEGLQSCSLVELQQIEKQLERSVSTIRARKIQVFKEQIERLKEKEKILASENAILREKFGGLQQRQGSSGEKEGEALCTESSEKSDVETELFIGPPECRIRRPLQN

SEQ ID NO: 7176 - protein, 281 aa, Petunia x hybrida
MSSTVGQVIRCKAAVAWQPGKPLVIEEVEVAPPQKMEVRLKILYTSLCHTDVYFWEAKGQNPVFPRILGHEAAGIVESVGEGVTELVPGDHVLPVFTGECKDCAHCKSEESNMCSLLRINTDRGVMIHDGQSRFSINGKPIFHFVGTSTFSEYTVVHVGCLAKINPLAPLDKVCVLSCGISTGLGATLVAKPTKGSSVAIFGLGAVGLAAAEGARIAGASRIIDVDLNASRFEEAKKFGVTEFVNPKDYSKPVQRVIAEMTDGGVDRSVECTGHIDAMISA

SEQ ID NO: 7177 - protein, 431 aa, Petunia x hybrida
MASTSKDTTTASTSTMDTRPENSEVDELPKELHEMKIKDERTDSHEDNLKDMEPAVVSGNGAETGQIIVTTVSGRNGQQKQTLSYMAERVVGTGSFGVVFQAKCLETGESVAIKKVLQDRRYKNRELQIMRTLDHPNVVKLRHCFYSTTEKNEVYLNLVLEYVSETVYRVSRHYSRMNQHMPIIYVQLYTYQICRALNYMHSVLHVCHRDIKPQNLLVNPHTHQLKLCDFGSAKMLVPGEPNISYICSRYYRAPELIFGATEYTTAIDMWSAGCVMAELLLGQPLFPGESGVDQLVEIIKILGTPTREEIRCMNPNYTEFKFPEIKAHPWHKIFQKKMPPEAVDLVSRLLQYSPTLRCTALEACAHPFFDALREPNACLPNGRPLPHLFNFTAQELSGAPADLRKALCLSTCASEFCEDSSLGFVNGFREV

SEQ ID NO: 7178 - protein, 263 aa, Solanum chacoense
KHHFGGLFHHHKNEEEDTPVEKTTYEETTYGESEKTSTYGEKTSYGDDTYGEKTTTFGDDNKYGEKTSYGDDTYGEKPTSYGGDNTYGEKTSYGKGDDNKYGEKTSYGEGDDNKYGEKTSYGDSGYGEKPSYGGGDDNKYGEKTSYGNEEGGYGGGVGETTNYEENESETKTSEDYKEEKKHHKHLEEIGGLGAVAAGAFALHEKHKAEKDPENAHKHKIEEGIAAAAAIGAGGFAFHEHHEKKEAKEEEEEAEGKKKHHFFN

SEQ ID NO: 7179 - protein, 341 aa, Solanum melongena
MADLLSNYSSKLEAVPPSHCLPLHERPVDPVEIVNTIPVIDLGKAKGDERPAVVQQLMKAFEEYGFFQIINHGVPEKLMEEAMKVYKEFFSLPAEEKERYAKDAANNTATGAAKMYSSSAKHYDSEEHRYWRDVLEHSANLDGKDRETWPDKPSRYREVIGEYSDELRRVSKVILGMVAEGLGLEPGFFDKGLGQRMLVNHYPACPDPSLTLGVGGHCDPNLITIIQQEVYGLQILKDDKWIGVEPKPNAFVVNSGLPITVISNGKLASVAHRVVTNTTHSRTSIGTFICPENIVEPAKALVGPGNPPQFKSFNWGIDFMPHYLSKKSVYHAALEPFKIDA

SEQ ID NO: 7180 - protein, 175 aa, Solanum tuberosum
MADVEYRCFVGGLAWATTDQTLSDAFSQYAEVVESKIINDRETGRSRGFGFVTFKDEQAMRDAIEGMNRQDLDGRNITVNEAQSRGGVEAGGGRGGGGYGGGRREGGGGGYGGYGGGRREGGGGGGYSGGGGGYGGGRREGGYGGGGGGYGGGDRYSDRSSRGGGGGSSDGNWRN

SEQ ID NO: 7181 - protein, 549 aa, Ipomoea batatas
MAASSGTIDAPTASSSFSFSTASSFMSSFTDLLASDAYSGGSVSRGLGDRIAERTGSGVPKFKSLPPPSLPLSSPAVSPSSYFAFPPGLSPSELLDSPVLLSSSNILPSPTTGTFPAQTFNWKNDSNASQEDVKQEEKGYPDFSFQTNSASMTLNYEDSKRKDELNSLQSLPPVTTSTQMSSQNNGGSYSEYNNQCCPPSQTLREQRRSDDGYNWRKYGQKQVKGSENPRSYYKCTHPNCPTKKKVERALDGQITEIVYKGAHNHPKPQSTRRSSSSTASSASTLAAQSYNAPASDVPDQSYWSNGNGQMDSVATPENSSISVGDDEFEQSSQKRESGGDEFDEDEPDAKRWKVENESEGVSAQGSRTVREPRVVVQTTSDIDILDDGYRWRKYGQKVVKGNPNPRSYYKCTSQGCPVRKHVERASHDIRSVITTYEGKHNHDVPAARGSGSHGLNRGANPNNNAAMAMAIRPSTMSLQSNYPIPIPSTRPMQQGEGQAPYEMLQGSGGFGYSGFGNPMNAYANQIQDNAFSRAKEEPRDDLFLDTLLA

SEQ ID NO: 7182 - protein, 338 aa, Hordeum vulgare
MAKVMNLTPVHASSIPDSFLLPADRLHPATTDVSLPIIDMSRGRDEVRQAILDSGKEYGFIQVVNHGISEPMLHEMYAVCHEFFDMPAEDKAEFFSEDRSERNKLFCGSAFETLGEKYWIDVLELLYPLPSGDTKDWPHKPQMLREVVGNYTSLARGVAMEILRLLCEGLGLRPDFFVGDISGGRVVVDINYYPPSPNPSRTLGLPPHCDRDLMTVLLPGAVPGLEIAYKGGWIKVQPVPNSLVINFGLQLEVVTNGYLKAVEHRAATNFAEPRLSVASFIVPADDCVVGPAEEFVSEDNPPRYRTLTVGEFKRKHNVVNLDSSINQIININNNQKGI

SEQ ID NO: 7183 - protein, 899 aa, Schizosaccharomyces pombe
MNCEMVTSPESVNLGDSNRAVSPFCLPDCSENAVAQTRSKTLDNAALDLPYVGNRKKSEQDFFKMLSSRDRDAHSTLRKRSNSLSSFLSTKSTSASENKFHGGLNWLSLKLNLLLRLQGRMNSARTNTSMNPYSCDSNENLSTLSSVNQNFNSRQLLATIVPESIQNGCSLLRITKKKVRQRKVSLDPISGYLMLDKNTGKAYKKLCVDDIKEIRQGRDARNYREQYKISSENEKRWFTIIYCADNKLKAMHMISPTLDAHNQWIMALEGLKTYRLNEFIIGLNLVCHQGEKMIDYSENLNPWEKLEKEQSAQLDLGDVHRMCQMLHLNASMEFLEETFQKADADHSGKLSFEEFQHFVSLLKTRSEIVDIFKEYTSGSDKMSLEQFRHFLSTSQKARLDSDSIRTLYVSFCSNDDSKMGLIEFTSFLLSPHNSPVVPVIQDMSRPLNEYLISSSHNTYLLGKQFGGESSIEGYIRSLQAGCKCIEIDCWDGPNGPVVCHGHTFTSMIKFNDVIDAIRKYAFVVSPYPLFISLEIHCCPDQQRQMVSYMKQAFGDTLVMKPVTANESVLPSPEDLLNKILLKVKCSATPLHQFSTDILKVGITDSSTDTTESSELENSELTGLRKGKRRMKNIIVQELQQLAPYARSLKFRNFSLPESKTYSHIFSFSERTIKKHGKAMVPRLSKHNLRYLCRVYPGPLRVGSTNFNPQVYWRLGVQMVALNWQTYDTGLQINDALFIADPPTGYLLKPPCQRIIGTTVGEEGLPRKIKLTIDVISGQQLRRARELSNSETLSPYVEIQVHSMEESPFRWCSKVVHENGFRPFWGETMVYESIISDDFYSMIRFLVHHRGSNGNDSIFANFTCPIDRLQQGYRHIRLLDMQGENLLFSSLFLKIKKEDI

SEQ ID NO: 7184 - protein, 439 aa, Schizosaccharomyces pombe
MAIQKVFARQIYALGGNPTVEVDLTTETGIHRAIVPSGASTGIWEALEMRDGDKTKWGGKGVLKAVGNVNNIIAPAVVKANLDVTDQKAADEFLLKLDGTENKSKLGANAILGVSMAICRAGAAQKKLPLWKYIAENFGTKGPYVLPVPSFNVLNGGSHAGGDLAFQEFMILPTGAPSFSEAMRWGAETYQTLKSIAKKRYGSSAGNVGDEGGIAPDLQTPQEALDLIVEAINKAGYEGKIKIGLDVTSSEFYVDGKYDLDIKAAKPKPENKLTYQQLTDLYVELSKKYPIVSIEDPFDQDDWSAWTHMKAETDFQIVGDDLTVTNVKRLRTAIDKKCANALLLKVNQIGSVTESLNVVRMSYEAGWGVMVSHRSGGTADTFISHLTVGIGAGQLKSGAPCRSERLAKYNELLRIEEELGSRGVYAGAHAGKYIKAAKF

SEQ ID NO: 7185 - protein, 698 aa, Candida albicans
MTSLQQQQQQQRVKYGPPHHIKRRPYHPILESLEFQTNQHLIQEYSLDIVNTLSQLESLTLVNPAMIDLQPEIQWFMRPFLLDFLIELHSSFKLQPTTLFLCLNIIDRYCAKRIVFKRHYQLVGCTALWIASKYEDKKLRVPTLKELTIMCRNAYDEEMFVQMEMHILSTLDWSIGHPTLEDCLQLAIDLNNLSNNTTNDIENKSVRPNRKSSISSAVTAVARFLCELSLYDKYFLSVPPSLIAITANLLSCSMLQIPHASITLKNLIEQEIINPQQKKQKKAFSSNSSRTTTASYTHQNQLDVRHSSFDEDIDLDSGDEGDDDEDYIDEFYETNNYDDTNATTFDESINKSTTINDENQPPQIHTPFLSGLDEDSILSIKKICLMLIIQLSKVTEVLSKKYENLGVIQVINNFHSNYKFIIQSIYENQELLLNTINDSTNNNEIDYKLIQSSEILLQFPKFDEYLTEDEDENVSTDDEANSQPQGYDGSGSDGNNQLFTPKSPNAFSSNSSLTLNNHPQSMVPVTPPSATSQYSLFSNKNNRTHESTSGLNSTCNTPTHISISSFAPPQPPPGSILKPKLTSINSTNSLKIKKLTSNSNSSNINIHHGHHNTKQEKRYSHISIGSNSSSKYDGFSPIKSISTNGSLITNNGSFTNIVNNTNSSSPLMNQQQQYYHQQQHQQQVTQSSLYQHHHQYHQ

SEQ ID NO: 7186 - protein, 301 aa, Plasmodium falciparum
MSSDIKTNFAADFLMGGISAAISKTVVTPIERVKMLIQTQDSIPEIKSGQVERYSGLINCFKRVSKEQGVLSLWRGNVANVIRYFPTQAFNFAFKDYFKNIFPRYDQNTDFSKFFCVNILSGATAGAISLLIVYPLDFARTRLASDIGKGKDRQFTGLFDCLAKIYKQTGLLSLYSGFGVSVTGIIVYRGSYFGLYDSAKALLFTNDKNTNIVLKWAVAQSVTILAGLISYPFDTVRRRMMMMSGRKGKEEIQYKNTIDCWIKILRNEGFKGFFKGAWANVIRGAGGALVLVFYDELQKLI

SEQ ID NO: 7187 - protein, 521 aa, Schistosoma mansoni
MGVASNNGITGKLVLTVLITCVGSSFLIGYNLGVLNLPRRNIEIYFNETVVPNTPELDSSFFYTHVSTIFVVAAAIGAFSCGWVADGLGRRNGLILNNVIGIIGGVIVGPCVLVKQPALLYVGRFVIGINSGITIGIASLYLTEVAPRDLRGGIGACHQLAVTVGIAFSYFITFTFLLNTLNLWPLAVALGAVPAAISLVTLPFCPESPRFLYMKKHKEAEARKAFLQLNVKENVDTFIGELREEIEVAKNQPVFKFTQLFTQRDLRMPVLIACLIQVLQQLSGINAVITYSSLMLELAGIPDVYLQYCVFAIGVLNVIVTVVSLPLIERAGRRTLLLWPTVSLALSLLLLTIFVNLADSGPQSTKNAMGIISIILILIYICSFALGLGPVPALIVSEIFRQGPRAAAYSLSQSIQWLSNLIVLCSYPVIQKNIGGYSFLPFLVVVVICWIFFFLFMPETKNRTFDEVARDLAFGNIVVGKRTTALEDRNLTVFTKQGNNEGPASESLLYPRSDNDKGMYA

SEQ ID NO: 7188 - protein, 489 aa, Schistosoma mansoni
MRQLKFFLPYCIITLGSSFPFGYHTGVINAPADLIKSFINTTLAARSVTCDERFIDLLWSLCVTSFLLGGFFGGLIGGVLANKLGRKNSLFLLSIPTVIGSLLMMFSKMAQSFEMIIIGRFTIGIACGAHTVVGPMFLSEIAPVNFRGAAGTFNQFVIVSAILLSQVLSLPEVMGTTELWPYLLALCTVSSVIHILLLFTCPESPTYLYIIKGDRRRSENALVYLRGQDCDVHAELELLKLETEQSSTHKSNVCDLLRIPYLRWGLIVALVPHIGQQFSGINGILYYFVSLFISNGLTKQVASYANLGTGVTILIGAFASIFVIDRKGRRPLLMFGTSVCLFSLLLFTLTLIIKQVTEINKLTILSIVLTYTFLFGFSVSIPWFLVSELFTQENRDAAVSIAAATNWLCNAIVALIFPQLVIYIGIYAFIPFICALLVVLIFVGLYLPETKGKTPASIEDYFMRVCGFRGTEAHENPTFTDIIDDTTQY

SEQ ID NO: 7189 - protein, 505 aa, Schistosoma mansoni
MGSGKKFTKSLSLSVLLACLGSSFTIGYNLGVLNLPGENIKEFLSRTMLGKNASEAENTANLVTPSFLYAQVSTAFVVAGAIGAFSCGAIADCLGRRNGLIVNSLLAIIGGILVGPCVAYSQPALLFVGRVFNGFNFGISMGIAPMYLTEIAPLSLRGGIGSLHQLALTIGILVSYLMTLTYTLNTPTLWPISVAVGSVPALIALILLPYCPESPRFLFIKKGKEAKARKAFQRLNCIDDINETFNEMKREMHEAEKRPKFKFFRLFTQRDLRMPVLIACIIQVFQQLSGINAVITYSSTMLKTAGIPLVYIQFCVVAVPAINVLMTVLSVYLIERAGRRTLLLWPTVLLAFSLLCLTISVNIASSTKDPTTARTAGIISAVLIILYICGFALGLGPIPGVIVAEIFRQEPRAAAYSLSQGVNLLCNLLVLFSYPSINDAIGGYSFLPFLVIVIICWIFFFLYMIETKNRTCDSNARDLATAKVVACQRPSRLTYKNEEPFYSDE

SEQ ID NO: 7190 - protein, 451 aa, Aplysia californica
IKLLGRKVRGKHDGPKINDYDKFYEDIWKKYVPQPVEVKQGSCYDYYDILEELGSGAFGVVHRCVEKATGRVFEAKFINTPYPLDKYTVKNEISIMNQLHHPKLINLHDAFEDKYDMVLILEFLSGGELFDRIAAEDYKMSEAEVINYMRQACEGLKHMHEHSIVHLDIKPENIMCETKKASSVKIIDFGLATKLNPDEIVKVTTATAEFAAPEIVDREPVGFYTDMWAIGVLGYVLLSGLSPFAGEDDLETLQNVKRCDWEFDEDAFSSVSPEAKDFIKNLLQKEPRKRLTVHDALEHPWLKGDHSNLTSRIPSSRYNKIRQKIKEKYADWPAPQPAIGRIANFSSLRKHRPQEYQIYDSYFDRKEAVPRFVRRPRNQITADESAKFDCKIIAASPPIVTWYKDDGLLGQSYKHMHKYHGSEYELKISRIKMDDKGAAREKSIRTKSKVD

SEQ ID NO: 7191 - protein, 1236 aa, Drosophila melanogaster
MSCFSAMSAPLLGEMEQTIGMLERGTIVTKLYGKQRRPDRRHLMLIRETRQLLWATVATQTPRTDYEGAIQLREIREIRVGKHSKEFRLFADDCQRFESSKCFVILHGNHFKLKSFSVVALSEIEADNWVRGLRYMVKDTLGAPYPLQIDRWLRREYYQIENVNTHSAKATEQSPAQVTIKDFKLFLAGVSCKMTTGKFMEHFTEDVRRKHDLKFDDFSRLYQKLLLPNGFASVLSGSGVANFPYSEDQQVVRPAELKQFLETEQRDVSASEISSAAIASFIRDFVQDVERDVQEPYLTFPEFVDFLFSKQNDLWNSKYDQVFMDMNLPLSSYWIASSHNTYLTGDQFSSESSCEAYARALRMGCRCIELDCWNGPDNLPYIFHGHTITSKIKFMDVIKTIKDHAFTSSEYPVILSIEQNCSLEQQRNMAQALIEVFGDMLLTQPCDRNEQHLPSPYQLRRKIILKHKKLPQFDDIANGISSTGSLGHRSSLGGAGGGAHGENDGENVRKVFKEGLLYFKDPVDKSWNLYQFVLTHQELIYSSEINESRNGNSEDDDFGLSSSCSLNSNMQQKQKDTSANDELHFGENWFHGKLEGGRKEADDLLKKYKHFGDGTFLVRESATFVGDYSLSFWRRNRPNHCRIKLKHENGSIKYYLVENFVFDSLYSLIVYYRKNMLRSSEFSIILKEPVPQPKKHEDQEWFHPNTTKEQAEQGLYRLEIGSFLVRPSVQSINAFVISFTINRKIKHCRIMQEGCLYGIDTMNFESLVSLINYYTRNPLYRNVKLSHPVSQELLRQALAEAAQGDHSGGHDDNGASNYMGSNLEENVTCKALYSYKANKPDELSFPKHAIITNVQRDNSMWWIGDYGGMIKKHLPANYVKVIDSTTEDYNSLNEEGTDGRTDSIEIFGAVASLFESNDPGIIFKLQIQTPTMQNPFVIGFDNQETAYEWIKAIQEAALIASQLASERRKKERTARVAKEMSDLIIYFRSVPFREHSWIFQEMSSFPETKAEKQFFQQNTQLFLSYHRNQISRVYPKGQRLDSSNFNPMPFWNVGSQMIALNYQTGDKAMQLNQAKFRNNGQCGYILKPSFMKSDSFNPNNPLCDGLSEVKVSIRLIAARHLFRGGKSNNPQIVVELIGASFDTGVKYRTKVIENGFNPVWNESCEFNVRNPQFAILRFEVQDEDMFAETHFIAQACYPLTCIRQGYRSVILRNKFSEELELSSLLINIKIANVTAP

SEQ ID NO: 7192 - protein, 651 aa, Xenopus laevis
MAVDDYEELLKYYELHETVGTGGFAKVKLASHLITGEKVAIKIMDKESLGDDLPRVKTEIDAMKNLSHQHVCRLYHVIETPKKIFMVLEYCPGGELFDYIIAKDRLTEEEARVFFRQIVSAVAYIHSQGYAHRDLKPENLLIDEDQNLKLIDFGLCAKPKGGLDYHLMTCCGSPAYAAPELIQGKAYIGSEADIWSMGVLMYALMCGYLPFDDDNVMVLYKKIMRGKYEIPKWLSPGSVLLLSQMMQVDPKKRITVKHLLNHPWLMHGYSCPVEWQSKYPLGYIDEDCVTELSVFYKYSRTSTTRLISEWSYDHITASYLLLHSKKSHGKAVRLKHPLAVGDQAVTSFKELRPKSKLDFEEPNGEIAYVFGSMDFSDEELFSEDFTYSSFEPHTPKEYVKGRLEFNSVDSAPATPVFNAMLGTKMKIKRTVIQQWPGMKMSFCTQHRGLLLPGGNRMKRRVYSPLLIKTLKQKRKISQKKRQLKSLLVPGEEFANVISPERRCRSVELDLNQAHIDSAQKKKGAKVFGSLERGLDKMITMLTPSKRKGYTREGPRKLRAHYNVTTTNIVNPEQLLNQIVRVLPSKNVDYVQKGYTLKCKTQSDFGKVTMQFELEVCQLSKSEVVGIRRQRLKGDAWVYKRLVEDILSSCKV

SEQ ID NO: 7193 - protein, 1210 aa, Xenopus laevis
MAGARPGVHSLQLEPVKVPETLIKGSKFIKWDEESSSKSLVTLRVDTMGFYLYWTCPNMEVDILDISVIRDTRTGKYAKIPKDIKMREILGFTGPEQRPEDKLVTVVYGNDIVNISFLNFMAVQEDTAKIWTEELFKLAHNILAQNSSRNTFLQKAYTKLKLQVNQDGRIPVKNILKMFAADKKRVETALESCGLNFNRGDSIKPEEFTLDIFERFLNKLCLRPDIDKILLELGAKGKPYLTLEQLMDFLNQKQRDPRLNEILFPPLKRDQVRQLIEKYEPNRQFLDRDQMSMEGFSRFLGGHENSIVPPEILDLSDDMNQPLSSYFINSSHNTYLTAGQLTGNSSVEMYRQVLLTGCRCIELDCWKGRPQDEEPFITHGFTMTTEIPFKEVIEAIAESAFKTSPFPVILSFENHVDSSKQQAKMAEYCRNIFGDALLIDPLEKYPLQPGVALPSPQELMGKILVKNKKRHKVAVKGPEGSVKRRVSEQTSNTYSDSSSVCESSATGLPPSESADVSLTLSNGDEKIEEKPPKYTKPRKSIDHDAYSEEEEEEEPSDPKKSDEGTASSEVNATEEMSTLVNYVEPVKFKSFDAAKKRNKYYEMSSFVETKALEQLTKSPMEFVEYNKKQLSRIYPKGTRVDSSNYMPQLFWNAGCQMVALNFQTLDLPMQLNVGIFEYNRRSGYLLKPEFMCRTDKHFDPFTENIVDGIVANTVKIKIISGQFLSEKRVGIFVEVDMFGLPVDTKRKFRTKTSQGNSFNPVWDEEPFILPKVVLPTLATLRIAVFEEGGKFVGHRILPVSAIRPGYHYICLRNELNQPVCLPALLVYTEVNDYIPDDHQGYANALTNPIKHISLMDQRAKQLAALMGENEQPFNKDKIDWDPISKPPIRSRDDTPEKIKIPIIPVPSPPAQRDDHIASVLTDIQAPSMEELKSQKSFEKLICRQYRELRQLRRKHLRKVSSLCKEQSTWVTPLQSLRRRKPFGRSHRGVSGADQDAEQKLMDMQRDQQKRLLELREIQHEQERKLKHSHLLQAVQKLQEVAISYHSTQLKKLKEINEKEKKELQKILDRKRHNSITEAKSRERQKKDVELTEINRRHINESVSSIRRLEEAQKRRQEKLQTAHQETLQRIKDEEPKLQAQLDEACQAEFCQLPQEVRRYLQEDGWVGSGSGPPSSSHSSPPSITRSWGSESGEKDSLHSPGDSSDEATRL

SEQ ID NO: 7194 - protein, 226 aa, Nicotiana tabacum
ISDFWSSSSSSSSIAGKSDSVQSLTHSYNKPQKSDSGKLNQLEKGTISVKVEKESSGPRARKNKYRGIRQRPWGKWAAEIRDPQKGVRVWLGTFNTAEEAARAYDEAAKRIRGDKAKLNFPEPPSPPAKRHCTSTIPDQPTRSDLMSQKPASIMLNYGYENQTPYYPMEMPAAEDPQHHDYELKEQISNLESFLDLEPDSGIVDSDPLNIFLMDDFAATQQQQLFY

SEQ ID NO: 7195 - protein, 580 aa, Oryza sativa (japonica cultivar-group); identical to SEQ ID NO: 1214

SEQ ID NO: 7196 - protein, 355 aa, Botryotinia fuckeliana
MTARAPNPASGSRKISFNVSEQYDIQDVVGEGAYGVVCSALHKPSGQKVAIKKITPFDHSMFCLRTLREMKLLRYFNHENIISILDIQKPRNYESFTEVYLIQELMETDMHRVIRTQDLSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFKTMFPKTSDLALDLLEKLLAFNPVKRITVEEALKHPYLEPYHDPEDEPTANPIPEEFFDFDKNKDNLTKEQLKKLIYDEIMR

SEQ ID NO: 7197 - protein, 170 aa, Sorghum bicolor
MAAADVEYRCFVGGLAWATNNETLEHAFANFGQVLDSKVITDRETGRSRGFGFVTFSSEQSMLDAIENMNGKELDGRNITVNQAQSRGGGGGGGGYGGGGGGYGGRREGGGYGGGGGGYGGRREGGGGYGGGGYGGGGGGYGGRREGGGGYGGGGGYGGNRGDSGGNWRN

SEQ ID NO: 7198 - protein, 176 aa, Oryza sativa (japonica cultivar-group); identical to SEQ ID NO: 3948

SEQ ID NO: 7199 - protein, 592 aa, Homo sapiens
MSVSLVVIRLELAEHSPVPAGFGFSAAAGEMSDEEIKKTTLASAVACLEGKSPGEKVAIIHQHLGRREMTDVIIETMKSNPDELKTTVEERKSSEASPTAQRSKDHSKECINAAPDSPSKQLPDQISFFSGNPSVEIVHGIMHLYKTNKMTSLKEDVRRSAMLCILTVPAAMTSHDLMKFVAPFNDVIEQMKIIRDSTPNQYMVLIKFRAQADADSFYMTCNGRQFNSIEDDVCQLVYVERAEVLKSEDGASLPVMDLTELPKCTVCLERMDESVNGILTTLCNHSFHSQCLQRWDDTTCPVCRYCQTPEPVEENKCFECGVQENLWICLICGHIGCGRYVSRHAYKHFEETQHTYAMQLTNHRVWDYAGDNYVHRLVASKTDGKIVQYECEGDTCQEEKIDALQLEYSYLLTSQLESQRIYWENKIVRIEKDTAEEINNMKTKFKETIEKCDNLEHKLNDLLKEKQSVERKCTQLNTKVAKLTNELKEEQEMNKCLRANQVLLQNKLKEEERVLKETCDQKDLQITEIQEQLRDVMFYLETQQKINHLPAETRQEIQEGQINIAMASASSPASSGGSGKLPSRKGRSKRGK

SEQ ID NO: 7200 - protein, 378 aa, Solanum tuberosum
MAIDCMITNAKSPMIDETKQFIFDASHMKRESNIPTQFIWPDHEKPCAVVQELHVPLIDLRGFLSGDSDAAQQASKLVGEACRSHGFFLVVNHGVDANLISNAHRYMDTFFDLPLLEKQKAQRKIGEHCGYASSFTGRFSSKLPWKETLSFRYSAEEESSHIVEDIFKGHWVKILTILGNVYQEYCNSKNTLSLGIMELLGMSLGVEKSHFKEFFEENDSIMRLNYYPPCQKPELTLGTGPHCDPTSLTILHQDCVGGLQVFVDDEWRSISPNFNAFVVNIGDTFMALSNGRYKSCLHRAVVNNKTPRKSLAFFLCPNKDKVVSPPNELVDSNNPRIYPDFTWPTLLEFTQKHYRADMNTLQTFSNWVHDQHNTKTQV

SEQ ID NO: 7201 - protein, 375 aa, Solanum tuberosum
MAIDCMVMPMIQTSSDEKNPLIFDSSVLKHESNIPRQFIWPDHEKPSGGVPELDVPLIDLGAFLSGDPIAAKRESRLVDEACKNHGFFLVGNHGVDTNLISLAHRYMNMFFELPLSNKQMIQRKRGDHCGYASSFTERFSSKLPWKETLSFSYSALQGSSHMVDQYFLKTMGEDFSHIGKFYQEYCNAMSTLSSGIMELLGESLGVSKNHFKQFFEENESIMRLNYYPTCQKPDLALGTGPHCDPTSLTILHQDSVSGLQVFMDNQWRSISPNLSAFVVNIGDTFMALSNGRYKSCLHRAVVNNKTPRKSLAFFLCPKKDKVVRPPAELVDSNNPRIYPDFTWPTLLEFTQKHYRADTNTLQFFSNWLQQRTTEV

SEQ ID NO: 7202 - protein, 271 aa, Solanum tuberosum
AQVYIDKFFELPLCEKQKAQRRVGEHCGYASSFIGGFSSKLPWKETLSFQYSDEEGSSHIVEQYFQRTLGEQFSYIGKIYQEYCNAMSTLSLGIMELLGLSLGVSKNHFKEFFQENESIMRLNYYPTCQKPELTLGTGPHCDPTSLTILHQDSVGGLQVFVDNEWHSITPNFNAFVVNIGDTFMALSNGRYKSCLHRALVNNKVPRKSLTFFLCPKKDKVVTPPIELVDSNNPRIYPDFTWPTLLEFTQKQYRADMNTLQTFSNWLKKTHP

SEQ ID NO: 7203 - protein, 517 aa, Funalia trogii
MARFQSLLTFITLSLVASVYAAIGPVADLTISNGAVSPDGFSRQAILVNDVFPSPLITGNKGDRFQLNVIDNMTNHTMLKSTSIHWHGFFQHGTNWADGPAFVNQCPISTGHAFLYDFQVPDQAGTFWYHSHLSTQYCDGLRGPIVVYDPQDPHKSLYDVDDDSTVITLADWYHLAAKVGSPVPTADATLINGLGRSIDTLNADLAVITVTKGKRYRFRLVSLSCDPNHVFSIDGHSLTVIEADSVNLKPQTVDSIQIFAAQRYSFVLNADQDVGNYWIRALPNSGTRNFDGGVNSAILRYDGAAPVEPTTSQTPSTNPLVESALTTLEGTAAPGSPAPGGVDLALNMAFGFAGGKFTINGASFTPPTVPVLLQILSGAQSAQDLLPSGSVYSLPANADIEISLPATAAAPGFPHPFHLHGHTFAVVRSAGSSTYNYENPVYRDVVSTGSPGDNVTIRFRTDNPGPWFLHCHIDFHLEAGFAVVMAEDIPEVAATNPVPQAWSDLCPTYDALSPDDQ

SEQ ID NO: 7204 - protein, 645 aa, Xenopus laevis
MGLEEELLKIGRRLERRFSEGNTDRILELLKELQAIEVNVTLLRSTRVGVTVNKIKKKSDERKVIELATAIIKDWKKIFESSYKDKGTKATSDVVKPTQSGPARISSPTSKNLHVERPSQCPASYKPSHTQQDIPKEPKLKRSYSEDVQPSIQTEKKKERSHSPTIQPSLQVVKKPERRHSTNDKSFLHATKKPERVHSTDVQSSDHTTKKPERSHSTDVQSSLHTAKKTERGHSTDVQSSLHTAKKPERSHSTDVQSSLLTAKKPERSHSTDGQSTLHTAKKPERNHPTNAQTTVEITKKPERRHSLSSPLQSSASCKSPTNTKEERKFSAGSPVQPTRNGSTKLFSDAEKQGRHSLSSPLQSSASCKSPTNTKEERKFSVGSPVQPTRNGSTKPFSDAEKQRRHSLSSPLQSSASCKSPTNTKEERKFSAGSPLQPTRNGSTKPFSDAEKQGASGGQMGSPVDIHSPSSCLLGPCYLTGDSVRDKCVEMVASALKTDDDYKQFGTNCERLAWEIEECIYSEVKVTDMKYRNRIRSRISNLKDPKNPNLRKNVLCGVVTPQSIATMTAEEMASDELRELRNTMTQEAIREHQMAKTGGTQTDLLQCEKCKKKNCSYNQVQTRSADEPMTTFVLCNECGNRWKFC

SEQ ID NO: 7205 - protein, 130 aa, Carboxydothermus hydrogenoformans
MPVMLGSLFGWNRGNAPGKLKSWQERCYKVYRGMGSLGAMKEGSKDRYFQENEQKLVPEGVEGRVPFKGPVSETIFQLIGGLRAGMGYCGVRNIYELKTKTKFIKITQAGLRESHPHDVTITKEAPNYSL

SEQ ID NO: 7206 - protein, 130 aa, Carboxydothermus hydrogenoformans
  unsure (1)..(130): unsure at all Xaa locations
IDYEKKLFTVDNITVKEGDYLSIDGSTGRVILGTVPMKDPELSPEFIKLLEWADELKRLEVRANADTPEDAQKAREFGAKGIGLCRTEHMFMGPERLPHVQRMILAETKEERXEALSHLLPMKEEDFYGF

SEQ ID NO: 7207 - protein, 89 aa, Carboxydothermus hydrogenoformans
  unsure (1)..(89): unsure at all Xaa locations
DHXEGTNLVAKGLNGAXXVLDAAPKGCLLDAPDMYMEKIAVGPAAAGKIHLDAPVKDNLRIVAESLKKSVTDITVVILDRPRHEXXCPD

SEQ ID NO: 7208 - protein, 242 aa, Gerbera hybrid cultivar
MGKGRLELKRIENKINRQVTFAKRRNGLLKKAYELSVLCDAEVALIVFSTRGKLYEFSSTSSMLKTLERYEKCSFGPPEQRRPAAKEDLQEQSSYQEYMRLKERYDALKRLERNYYGEEIDSLTTSELESLERQLHCSLKQIRTIRTQSLLDKLYEQQKMEHQLYESNKTLRLRLDEEGQAEALQWDAHAHANGMVYAHQHQVSQPMRDTFYHPTGCETTLQIGYQSEQMSAVNHQMQGWPA

SEQ ID NO: 7209 - protein, 453 aa, Rattus norvegicus
  unsure (1)..(453): unsure at all Xaa locations
XEFCERFSYYGMRALLVLYFRNFLGWDDDLSTAIYHTSVALRYLTPILGALIADSWLGKFKTIVSLSIVYTIGQAVISVSSINDLTDHDHDGSPNNLPLHVALSMIGLGLIGLGTGGIKPCVSAFGGDQFGEGQEKQGNPVFSIFYLAINAGSLLSTIITPILRVQQCGIHSQQACYPLAFGVPAALMAVALIVFVLGSGMYKKFQPQGNIMGKVAKCIGFAIKNRFRHRSKAFPKREHWLDWAKEKYDERLISQIKMVTKVMFLYIPLPMSWALFDQQGSRWTLQATTMTGKIGTIEIQPDQMQTVNAILIVIMVPIVDAVVYPLIAKCGFNYTSLKKMTVGMFLASMAFVVAAIVQVEIDKTLPVFPSGNQVQIKVLNIGNNDMAVYFPGKNVTVAQMSQTDTFMTFDVDQLTSINVSSPGSPGVTTVAHEFEPGHRHTLLVWGPNNYRVV

SEQ ID NO: 7210 - protein, 424 aa, Homo sapiens
MSDSKCDSQFYSVQVADSTFTVLKRYQQLKPIGSGAQGIVCAAFDTVLGINVAVKKLSRPFQNQTHAKRAYRELVLLKCVNHKNIISLLNVFTPQKTLEEFQDVYLVMELMDANLCQVIHMELDHERMSYLLYQMLCGIKHLHSAGIIHRDLKPSNIVVKSDCTLKILDFGLARTACTNFMMTPYVVTRYYRAPEVILGMGYKENVDIWSVGCIMGELVKGCVIFQGTDHIDQWNKVIEQLGTPSAEFMKKLQPTVRNYVENRPKYPGIKFEELFPDWIFPSESERDKIKTSQARDLLSKMLVIDPDKRISVDEALRHPYITVWYDPAEAEAPPPQIYDAQLEEREHAIEEWKELIYKEVMDWEERSKNGVVKDQPPDAAVSSNATPSQSSSINDISSMSTEQTLASDTDSSLDASTGPLEGCR

SEQ ID NO: 7211 - protein, 196 aa, Sus scrofa domestica
EFFCEVDEDYIQDKFNLTGLNEQVPHYRQALDMILDLEPDEELEDNPNQSDLIEQAAEMLYGLIHARYILTNRGIAQMLEKYQQGDFGYCPRVYCENQPMLPIGLSDIPGEAMVKLYCPKCMDVYTPKSSRHHHTDGAYFGTGFPHMLFMVHPEYRPKRPANQFVPRLYGFKIHPMAYQLQLQAASNFKSPVKTIR

SEQ ID NO: 7212 - protein, 1234 aa, Homo sapiens [sequence omitted]

SEQ ID NO: 7213 - protein, 679 aa, Mus musculus
METPDYNTPQGGTPSAGSQRTVVEDDSSLIKAVQKGDVVRVQQLLEKGADANACEDTWGWTPLHNAVQAGRVDIVNLLLSHGADPHRRKKNGATPFIIAGIQGDVKLLEILLSCGADVNECDENGFTAFMEAAERGNAEALRFLFAKGANVNLRRQTTKDKRRLKQGGATALMSAAEKGHLEVLRILLNDMKAEVDARDNMGRNALIRTLLNWDCENVEEITSILIQHGADVNVRGERGKTPLIAAVERKHTGLVQMLLSREGINIDARDNEGKTALLIAVDKQLKEIVQLLLEKGADKCDDLVWIARRNHDYHLVKLLLPYVANPDTDPPAGDWSPHSSRWGTALKSLHSMTRPMIGKLKIFIHDDYKIAGTSEGAVYLGIYDNREVAVKVFRENSPRGCKEVSCLRDCGDHSNLVAFYGREDDKGCLYVCVSLCEWTLEEFLRLPREEPVENGEDKFAHSILLSIFEGVQKLHLHGYSHQDLQPQNILIDSKKAVRLADFDQSIRWMGESQMVRRDLEDLGRLVLYVVMKGEIPFETLKTQNDEVLLTMSPDEETKDLIHCLFSPGENVKNCLVDLLGHPFFWTWENRYRTLRNVGNESDIKVRKCKSDLLRLLQHQTLEPPRSFDQWTSKIDKNVMDEMNHFYEKRKKNPYQDTVGDLLKFIRNIGEHINEEKKRG

SEQ ID NO: 7214 - protein, 2033 aa, Gallid herpesvirus 3
MENPPDFYSLLEMLADNGGFSPQPPATPGDPYQDVCLNTPSVAVPPTPGRQPVPPRSKSPARAAPVAGSLAGARAPFGIEGAVSEGSDTGLRSAEPPDGAHQGSPGEVVSSTADIVDVCGNETAAAAPRSCSWQKTVGDLVPAGSERGEPSPMDPRKSNDPVRCVSDAPCKPTGACTPLAVCVETLPPPSGVPPPPPPEPIVNFPWTFSPLTPGPFAQHHSPTPPTPPPLSPPPPTPPPLSPPPPTPPPLSPPPPTPPPHTPPPHGSPPPTPLPSTSPPSTQTSSPSASLPLDSPPASTPPPPTPLHDRPLSPDPPALSASCQRPSPPLSPSAPRLAPAPLRSDRVPARRKSSVSEGGGPRTRGAGFQYVCRLSASARIPSPPREELELVARQPGSHAMLWRAGARDGATEPSSGDDPKVFLLALSDARRCPSYWDRLAREAVLREILPTPRGSPLRTSPGSIELPREAPLLDSDYRPFEWRCAKGRPLPQEPVFPCPPNELGNDWAACKMWLFSRCARLVLSTLDDMSPSEDGESVLESQGCGWGPQNECPLPLPAPIVLPTRIWEAVTRLPRPAPRTPTYAYILSALLRFLGLQVTPDFVSKVPRLSYRWLDRLRCVRRVQYMAHVLTRDFSYQLQAARGLPCFPACAPPPGAGTPLDEDWNGTPPSESPRGLDCSRRRGGFYASNFCPLLEEIRWVEGREGSPNPWTGLTWNDFKMLHYRCLFFKVRRGLLLAPDDYIVGPDVRPGFEVPFEMPPPPATALPPALSAAVRESKLALRNGNPEPGGTPHGSRPARAYGFMVQQLAVAMVELGFPACGPAIEKRVRPLYKAILDWRAAVTAAALRRFRHLRQPSGARDDGAPMFPPLPVPDWNGPSPRPGLVSSPTGTQERYRRVQPGSGSDGSHTTAPPAVLKQALQQEVGTPATRASHPLPRPPPASYPSLGCRSRSSSSSSASSSSSSSSSAPSSSEQSSAAPSSRTSSRSPTREAGAPQCAARGRGRGRGGRRGRGRRAPSPSSETAAPPPPDDLDQEVWWQIPSPPAGRCWFGPLGGHRQALRGIPEVEQAAVRFLSTPGPLPVYVEEMGNCAKQYEALVSAMLNKDVKANPLNWAHHGKLSPTDAALNHIYVTKFRSSHSSPGAAVTGTVNKCIPHIASAMKKRNLLWALPHIAASVSMTRRYCKDQKEFMFRSLRKAYAPMASAASAEMRRPSASPISNRAPVTAQSTAAGLIPVIDVSTIHDRVRRGVAAFNSALEEGLLDVPEYRLVAPARPDIPAGDGFASTRPLNELVDACALECEGVVAALLRGPDGPGAVAEMLSSCEDGPFPRPAGHEQWEKCRALLGSWLRDLLDLRSAVYAAYANGSAPRGRQERTLAANAAALITEAIGPLLSKDPARPWRCPGSRDITSVLLRECGSRGEPVRSREKARRLQRVARLLADADAASSGTSEGRSRSAEPCYDPGPASSPEPVRALCAQTSAESRKRKSAPAAVLDGADNAVENPRPRLGRSRTGAGPPPVASCTRPPTPPEACRDAGPFPPKRPRCFPWRDPARIMDGSLSLGDRRHRGAAFRKPPIGTPIAGYAGPPHLDAYCPGEGVDELTSFAQIPTLWRQPLARSPEAMAEIARVASTPSHVSRSPDTAASEGVLCRTAVVSLRARTAWMRHQQASPEDVALVILYTANPGEHLFCVPAPGSPPGGPRFDPNRGGLSFLLAALANRLCLPESAAWAGRWRAAPDVSALTAAGVMFLSPQDLGFAGVLEHLQRLCLKREKRLVVLDTLEDRDRPENGPRLVEEAVRYVRCTVSPRSQCSVRWPGHPDLATTVITSRDVLGPVVLRELETHFRRENPAAGDISLCCGSNVRYKVATRLDRVATVPMTALSYLAASSALVAGRQRPPGPDFLAGESHSHRAALKWGLYAPLRPVYVLEPKKNAIVSPDFLNRTVCDVCRSVVLPPDPHAQPVVVHVPEATCSLLAREMLAHLRSSSVVWLEGDGGPPETTVQEEQGARQRIIHPPTLPGPPSPLALSDSEVFGE

SEQ ID NO: 7215 - protein, 2033 aa, Gallid herpesvirus 3
MENPPDFYSLLEMLADNGGFSPQPPATPGDPYQDVCLNTPSVAVPPTPGRQPVPPRSKSPARAAPVAGSLAGARAPFGIEGAVSEGSDTGLRSAEPPDGAHQGSPGEVVSSTADIVDVCGNETAAAAPRSCSWQKTVGDLVPAGSERGEPSPMDPRKSNDPVRCVSDAPCKPTGACTPLAVCVETLPPPSGVPPPPPPEPIVNFPWTFSPLTPGPFAQHHSPTPPTPPPLSPPPPTPPPLSPPPPTPPPLSPPPPTPPPHTPPPHGSPPPTPLPSTSPPSTQTSSPSASLPLDSPPASTPPPPTPLHDRPLSPDPPALSASCQRPSPPLSPSAPRLAPAPLRSDRVPARRKSSVSEGGGPRTRGAGFQYVCRLSASARIPSPPREELELVARQPGSHAMLWRAGARDGATEPSSGDDPKVFLLALSDARRCPSYWDRLAREAVLREILPTPRGSPLRTSPGSIELPREAPLLDSDYRPFEWRCAKGRPLPQEPVFPCPPNELGNDWAACKMWLFSRCARLVLSTLDDMSPSEDGESVLESQGCGWGPQNECPLPLPAPIVLPTRIWEAVTRLPRPAPRTPTYAYILSALLRFLGLQVTPDFVSKVPRLSYRWLDRLRCVRRVQYMAHVLTRDFSYQLQAARGLPCFPACAPPPGAGTPLDEDWNGTPPSESPRGLDCSRRRGGFYASNFCPLLEEIRWVEGREGSPNPWTGLTWNDFKMLHYRCLFFKVRRGLLLAPDDYIVGPDVRPGFEVPFEMPPPPATALPPALSAAVRESKLALRNGNPEPGGTPHGSRPARAYGFMVQQLAVAMVELGFPACGPAIEKRVRPLYKAILDWRAAVTAAALRRFRHLRQPSGARDDGAPMFPPLPVPDWNGPSPRPGLVSSPTGTQERYRRVQPGSGSDGSHTTAPPAVLKQALQQEVGTPATRASHPLPRPPPASYPSLGCRSRSSSSSSASSSSSSSSSAPSSSEQSSAAPSSRTSSRSPTREAGAPQCAARGRGRGRGGRRGRGRRAPSPSSETAAPPPPDDLDQEVWWQIPSPPAGRCWFGPLGGHRQALRGIPEVEQAAVRFLSTPGPLPVYVEEMGNCAKQYEALVSAMLNKDVKANPLNWAHHGKLSPTDAALNHIYVTKFRSSHSSPGAAVTGTVNKCIPHIASAMKKRNLLWALPHIAASVSMTRRYCKDQKEFMFRSLRKAYAPMASAASAEMRRPSASPISNRAPVTAQSTAAGLIPVIDVSTIHDRVRRGVAAFNSALEEGLLDVPEYRLVAPARPDIPAGDGFASTRPLNELVDACALECEGVVAALLRGPDGPGAVAEMLSSCEDGPFPRPAGHEQWEKCRALLGSWLRDLLDLRSAVYAAYANGSAPRGRRERTLAANAVALITEAIGPLLSKDPARPWRCPGSRDITSVLLRECGSRGEPVRSREKARRLQRVARLLADADAASSGTSEGRSRSAEPCYDPGPASSPEPVRALCAQTSAESRKRKSAPAAVLDGADNAVENPRPRLGRSRTGAGPPPVASCTRPPTPPEACRDAGPFPPKRPRCFPWRDPARIMDGSLSLGDRRHRGAAFRKPPIGTPIAGYAGPPHLDAYCPGEGVDELTSFAQIPTLWRQPLARSPEAMAEIARVASTPSHVSRSPDTAASEGVLCRTAVVSLRARTAWMRHQQASPEDVALVILYTANPGEHLFCVPAPGSPPGGPRFDPNRGGLSFLLAALANRLCLPESAAWAGRWRAAPDVSALTAAGVMFLSPQDLGFAGVLEHLQRLCLKREKRLVVLDTLEDRDRPENGPRLVEEAVRYVRCTVSPRSQCSVRWPGRPDLATTVITSRDVLGPVVLRELETHFRRENPAAGDISLCCGSNVRYKVATRLDRVATVPMTALSYLAASSALVAGRQRPPGPDFLAGESHSHRAALKWGLYAPLRPVYVLEPKKNAIVSPDFLNRTVCDVCRSVVLPPDPHAQPVVVHVPEATCSLLAREMLAHLRSSSVVWLEGDGGPPETTVQEEQGARQRIIHPPTLPGPPSPLALSDSEVFGE

SEQ ID NO: 7216 - protein, 227 aa, Populus balsamifera subsp. trichocarpa
MGRGKIEIKKIENPTNRQVTYSKRRNGIFKKAQELTVLCDAKVSLIMFSNTNKLNEYISPSTSTKKIYDQYQNALGIDLWGTQYEKMQEHLRKLNDINHKLRQEIRQRRGEGLNDLSIDHLRGLEQHMTEALNGVRGRKYHVIKTQNETYRKKVKNLEERHGNLLMEYEAKLEDRQYGLVDNEAAVALANGASNLYAFRLHHGHNHHHHLPNLHLGDGFGAHELRLP

SEQ ID NO: 7217 - protein, 1173 aa, Rattus norvegicus
MAGAQPGVHALQLKPVCVSDSLKKGTKFVKWDDDSTIVTPIILRTDPQGFFFYWTDQNKETELLDLSLVKDARCGKHAKAPKDPKLRELLDVGNIGHLEQRMITVVYGPDLVNISHLNLVAFQEEVAKEWTNEVFSLATNLLAQNMSRDAFLEKAYTKLKLQVTPEGRIPLKNIVRLFSADRKRVETALEACSLPSSRNDSIPQEDFTPDVYRVFLNNLCPRPEIDNIFSEFGAKASPYLTVDQMMDFINLKQRDPRLNEILYPPLKQEQVQVLILKYEPNSSLAKKGQMSVDGFMRYLSGEENGVVSPEKLDLNEDMSQPLSHYFINSSHNTYLTAGQAAGNSSVEMYRQVLLSGCRCVELDCWKGRTAEEEPVITHGFTMTTEISFKEVIEAIAECAFKTSPFPILLSFENHVDSPKQQAKMAEYCRLIFGDALLMEPLEKYPLESGVPLPSPMDLMYKILVKNKKKSHKSSEGSGKKKLSEQASNTYSDSSSVFEPSSPGAGEADTESDDDDDDDDCKKSSMDEGTAGSEAMATEEMSNLVNYIQPVKFESFETSKKRNKSFEMSSFVETKGLEQLTKSPVEFVEYNKMQLSRIYPKGTRVDSSNYMPQLFWNICGQMVALNFQTVDLAMQINMGMYEYNGKSGYRLKPEFMRRPDKHFDPFTEGIVDGIVANTLSVKIISGQFLSDKKVGTYVEVDMFGLPVDTRRKAFKTKTSQGNAVNPVWEEEPIVFKKVVLPSLACLRIAAYEEGGKFIGHRILPVQAIRPGYHYICARNERNQPLMLPAVFVYIEVKDYVPDTYADVIEALSNPIRYVNLMEQRAKQLAALTLEDEEEVKKEADPGETSSEAPSETRTTPAENGVNHTATLAPKPPSQAPHSQPAPGSVKAPAKTEDLIQSVLTEVEAQTIEELKQQKSFVKLQKKHYKEMKDLVKLHHKKTTELIKEHTTKYNEIQNDYLRRRAALEKSAKKDSKKKSEPSSPDHGSSAIEQDLAALDAEMTQKLIDLKDKQQQQLLNLRQEQYYSEKYQKREHIKLLIQKLTDVAEECQNNQLKKLKEICEKEKKELKKKMDKKLQEKITEAKSKDKSQMEEEKTEMIRSYIQEVVQYIKRLEEAQSKRKEKLVEKHKEIRQQILDEKPKGEGSSSVLSESCHEDPSVPPNFTPPNPQALKW

SEQ ID NO: 7218 - protein, 376 aa, Mus musculus
GTQGKVIKCKAAIAWKTGSPLCIEEIEVSPPKACEVRIQVIATCVCPTDINATDPKKKALFPVVLGHECAGIVESVGPGVTNFKPGDKVIPFFAPQCKRCKLCLSPLTNLCGKLRNFKYPTIDQELMEDRTSRFTCKGRSIYHFMGVSSFSQYTVVSEANLARVDDEANLERVCLIGCGFSSGYGAAINTAKVTPGSTCAVFGLGCVGLSAIIGCKIAGASRIIAIDINGEKFPKAKALGATDCLNPRELDKPVQDVITELTAGGVDYSLDCAGTAQTLKAAVDCTVLGWGSCTVVGAKVDEMTIPTVDVILGRSINGTFFGGWKSVDSVPNLVSDYKNKKFDLDLLVTHALPFESINDAIDLMKEGKSIRTILTF

SEQ ID NO: 7219 - protein, 376 aa, Mus musculus
GTQGKVIKCKAAIAWKTGSPLCIEEIEVSPPKACEVRIQVIATCVCHTDINATDPKKKALFPVVLGHECAGIVESVGPGVTNFKPGDKVIPFFAPQCKRCKLCLSPLTNLCGKLRNFKYPTIDQELMEDRTSRFTCKGRSIYHFMGVSSFSQYTVVSEANLARVDDEANLERVCLIGCGFSSGYGAAINTAKVTPGSTCAVFGLGCVGLSAIIGCKIAGASRIIAIDINGEKFPKAKALGATDCLNPRELDKPVQDVITELTAGGVDYSLDCAGTAQTLKAAVDCTVLGWGSCTVVGAKVDEMTIPTVDVILGRSINGTFFGGWKSVDSVPNLVSDYKNKKFDLDLLVTHALPFESINDAIDLMKEGKSIRTILTF

SEQ ID NO: 7220 - protein, 259 aa, Nicotiana sylvestris
MAFVNKIGNMLKQIVSRHANLELCASRTSLYQAIRSMSSSKLFVGGLSWGTDETSLKEAFSQHGEVIEARVIMDRDTGRSRGFGFVSFTSTEEAASALTALDGQDLHGRQIRVNYATEKLRGSFGGGYGSGGGYGGGDGSFAGAGGYASSNYGGGGNYGSNNSYPTGGGNYGGGVRYGNGEGGNDAGGVRQGSFGGGYGGGNSGNYNADFTQGMVNNGVEEQLSADQGTESVNSDFTPGAEGSYRDDDDEPNGYANSRG

SEQ ID NO: 7221 - protein, 366 aa, Sorghum bicolor
RPLEYAWNKAANILFAESPAGVGFSYSNTSSDLSMGDDKMAQDTYTFLVKWFERFPHYKYREFYIAGESGHFIPQLSQVVYRNRNNSPFINFQGLLVSSGLTNDHEDMIGMFESWWHHGLISDETRDSGLKVCPGTSFMHPTPECTEVWNKALAEQGNINPYTIYTPTCDREPSPYQRRFWAPHGRAAPPPLMLPPYDPCAVFNSINYLNLPEVQTALHANVSGIVEYPWTVCSNTIFDQWGQAADDLLPVYRELIQAGLRVWVYSGDTDSVVPVSSTRRSLAALELPVKTSWYPWYMAPTEREVGGWSVQYEGLTYVSPSGAGHLVPVHRPAQAFLLFKQFLKGEPMPAEEKNDILLPSQKAPFY

SEQ ID NO: 7222 - protein, 245 aa, Bos taurus
  unsure (1)..(245): unsure at all Xaa locations
XMDKSELVQKAKLAEQAERYDDMAAAMKAVTEQGHELSNEERNLLSVAYKNVVGARRSSWRVISSIEQKTERNEKKQQMGKEYREKIEAELQDICNDVLQLLDKYLIPNATQPESKVFYLKMKGDYFRYLSEVASGDNKQTTVSNSQQAYQEAFEISKKEMQPTHPIRLGLALNFSVFYYEILNSPEKACSLAKTAFDEAIAELDTLNEESYKDSTLIMQLLRDNLTLWTSENQGDEGDAGEGEN

SEQ ID NO: 7223 - protein, 246 aa, Bos taurus
  unsure (1)..(246): unsure at all Xaa locations
XVDREQLVQKARLAEQAERYDDMAAAMKNVTELNEPLSNEERNLLSVAYKNVVGARRSSWRVISSIEQKTSADGNEKKIEMVRAYREKIEKELEAVCQDVLSLLDNYLIKNCSETQIESKVFYLKMKGDYYRYLAEVATGEKRATVVESSEKAYSEAHEISKEHMQPTHPIRLGLALNYSVFYYEIQNAPEQACHLAKTAFDDAIAELDTLNEDSYKDSTLIMQLLRDNLTLWTSDQQDDDGGEGN

SEQ ID NO: 7224 - protein, 315 aa, Bos taurus [sequence omitted]

SEQ ID NO: 7225 - protein, 380 aa, Phaseolus acutifolius
MSSTAGQVIKCKAAVAWEAGKPLVMEEVEVAPPKAGEVRLKILYTSLCHTDVYFWEAKGQTPLFPRIFGHEAGGIVESVGEGVTHLKPGDHALPVFTGECGECAHCKSEESNMCDLLRINTDRGVMIHDSQTRFSIKGQPIYHFVGTSTFSEYTVVHAGCVAKVNPAAPLDKICVLSCGICTGLGATVNVAKPKPGSSVAIFGLGAVGLAAAEGARISGASRIIGVDLVSSRFEEAKKFGVNEFVNPKDHDKPVQEVIAEMTNGGVDRAVECTGSIQAMISAFECVHDGWGVAVLVGVPNKDDAFKTHPVNFLNERTLKGTFYGNYKPRTDLPLVVEQYMNGELELDKFITHTVPFSEINKAFDYMLKGESIRCIIRMGE

SEQ ID NO: 7226 - protein, 170 aa, Bos taurus
EFYHPAQEYNVRVASRYFKGPELLVDYQMYDYSLDMWSLGCMLASMIFRKEPFFHGQDNYDQLVRIAKVLGTDELYGYLKKYHIDLDPHFNDILGQHSRKRWENFIHSENRHLVSPEALDLLDKLLRYDHQQRLTAKEAMEHPYFYPVVKEQSQPCADNAVLSSGLTAAR

SEQ ID NO: 7227 - protein, 440 aa, Cladosporium herbarum
MPISKIHSRYVYDSRGNPTVEVDIVTETGLHRAIVPSVASTGSHEACELRDGDKSKWAGKGVTKAVANVNEIIAPALIKENLDVKDQAAVDAFLNKLDGTTNKTKIGANAILGVSMAVAKAAAAEKRVPLYAHISDLSGTKKPFVLPVPFMNVVNGGSHAGGRLAFQEFMIVPSGAPSFTEAMRQGAEVYQKLKSLTKKRYGQSAGNVGDEGGVAPDIQTAEEALDLITDAIEEAGYTGQIKIAMDVASSEFYKADEKKYDLDFKNPDSDKSKWITYEQLADQYNELAAKYPIVSIEDPFAEDDWEAWSYFYKTSGSDFQIVGDDLTVTNPEFIKKAIETKACNALLLKVNQIGTITEAINAAKDSFAAGWGVMVSHRSGETEDVTIADIVVGLRAGQIKTGAPARSERLAKLNQILRIEEELGDKRLYAGDNFRTAINL

SEQ ID NO: 7228 - protein, 99 aa, Chlorogloeopsis sp.
MSVYVGNLSYEVTEDSLNAVFAEYGSVKRVQLPTDRETGRVRGFGFVEMGTDAEEAAAIEALDGAEWMGRDLKVNKAKPKEDRGSFGGGRGSYGGRNRY

SEQ ID NO: 7229 - protein, 259 aa, Streptomyces setonii
MDARRLSRLFFDRLQVLEEGTHEYQYARNTLIEMNLSLVRFAANRFRNRGSGDMEDIVQVGTIGLIKAIDRFDLSREVEFTSFAVPYIVGEIKRFFRDTSWAVHVPRRLQELRVDLAKAKESLAGDLDRDPTVRELAQDLGIEESEVTEGIVASNGYTAGSLDMPTDTAEAGPGQHSGRTFADVLGEPDPAMETVENLHALAPLLGELDERERRIIDMRFGQEMTQAQIGAELGISQMHVSRLLSRMLGKLRNGMLTQE

SEQ ID NO: 7230 - protein, 503 aa, Plantago major
MGELSGIENGNKAIGEEAIPVWKFVLVASLAAGIQFGWALQLSLLTPYIQMLGLPHGAASFIWLCGPVSGLLVQPLAGYFSDRCKSRFGRRRPFIMSGACLVAAAVILIGFAADIGHSAGDDMTKKTKPRAVVVFVVGFWILDVANNMLQGPCRAFLADLSAGDEKKMTHAMSFFAFFMGIGNVLGYAAGSYNNLHRLLPFTRTDACEIFCANLKTCFLIHICLLMCLTITALSVVKEPLVNVVDDERKGGSLMVFVELFGALKNLSKPMWILMLVTCLNWIAWFPFLLYDTDWMGREVYGGKVNQSVYDMGVRAGAIGLMLNSVVLGITSILLYFFSKGAKAAKTWWLGVNIVLAVGLAGTVWVSYHAKSVRQLGASGEALPPSFEVKASALAIFAILGIPLAVTFSVPFALAAIYCSRNTNTGGAGQGLSLGVMNLSIVIPQIIVSLSSGPLDKAFGGGNLPAFIMGAVGAVFSGVLAFILLPAPKVDNGVNPFAVGGGGH

SEQ ID NO: 7231 - protein, 510 aa, Plantago major
MENSNRGVGAKTIITTTPPPEEAAPIRNIFLVAAIAAGVQFGWALQLSLLTPYVQLLGIPHKWASYIWLCGPISGMIVQPVVGYFSDNCTSRFGRRRPFIAAGAGLVGVAVVLIGFAADLGHAGGDSLGDGLKPRAIGVFVFGFWILDVANNMLQGPCRALLADLSGGNTKKMANANSFFSFFMAVGNVLGYAAGSYSRMYKVFPFSKTKACDIYCANLKSCFIISITLLITLTTLALSIVREKRHVAEEQVTAAKKGFKIPVFPELFGALKDLPRPMWVLLLVTALNWIAWFGFLLFDTDWMGREVYGETQQHKAPELAVIYNKGVSAGALGLMLNSIVLGFASLGVQYMARALGGVKRLWGVVNFILAICLCMTIVITKVASHHRPYSNGVLQTPESSVKIGALVVFSALGIPLAITFSVPFALASIYSTTTGSGQGLSLGVLNLAIVIPQMIVSVASGPWDAMFGGGNLPAFVVGAVAAAASGIFAFTMLPSPPAESIKNLSVAGGH

SEQ ID NO: 7232 - protein, 369 aa, Oryza sativa
MDGAPVAEFRPTMTHGGRYLLYDIFGNKFEVTNKYQPPIMPIGRGGYGIVCSVMNFETREMVAIKKIANAFNNDMDAKRTLREIKLLRLLDHENIIGIRDVIPPPIPQAFNDVYIATELMDTDLHHIIRSNQELSEEHCQYFLYQILRGLKYIHSANVIHRDLKPSNLLLNANCDLKICDFGLARPSSESDMMTEYVVTRWYRAPELLLNSTDYSAAIDVWSVGCIFMELINRQPLFPGRDHMHQMRLITEVIGTPTDDELGFIRNEDARKYMRHLPQYPRRTFASMFPRVQPAALDLIERMLTFNPLQRITVEEALDHPYLERLHDIADEPICLEPFSFDFEQKALNEDQMKQLIFNEAIEMNPNIRY

SEQ ID NO: 7233 - protein, 377 aa, Saccharomyces kluyveri
RNSSDYLIPDSKKFPRGMKHVADSLHDKGLLFGMYSSAGEYTCAGYPGSLGHEEADAASFASWDVDYLKYDNCYNQGNYGTAQLSYERYKAMSDALNKTGRPIYYTLCNWGEDSPWHWASAIANSWRISGDIYADFDRPDSRCPCNGDEYYCHLAGFHCSIMNILNKAAPLGQKAGPGGWNDLDALEVGVGNMTDEEEKTHFSMWAAVKSPLVIGANLNTLDAKSFSIYVNPAIIAVNQDAAGAPVMRVWRYYVSDTDEHGQGEIQLWSGPLDNGDQIVALLNAGSKDRSMNATLEDIFIDSGADSEKLSSSWAIYDLWANRLDEDTAKDIINGNSTAEGKLYNATELPYTEGIAKNDTRLFGTKVGTVKPFGSIET

SEQ ID NO: 7234 - protein, 377 aa, Saccharomyces kluyveri
RNSSGHLVSDSKKFPRGMKHVADSLHDEGLLFGMYSSAGEYTCAGYPGSLGHEEADAASFASWDIDYLKYDNCFSKGNFGTPQLSYDRYKAMSDALNKTGRPIFYSICNWGQDSPWYWGSAIANSWRISGDIYADFDRPDSRCPCSGDEYYCQLAGFHCSIMNILNKAAPLGQTAGPGGWNDLDALEVGVGGLTDEEEKTHFSMWAAVKSPLVIGANLKTLDAKSFSIYANPAVIAVNQDAAGVPASRIWRYYVSETDEYGQGEIQLWSGPLKNGDQIVALVNGGNKPRPMNATLEDIFVDSGVDSDKVSSSWAIYDLWANRLSEETAKDIIGGDSAAAGKLYNATKLSYSNGLARNDTRLFGTKVGSVSPSGTIEA

SEQ ID NO: 7235 - protein, 377 aa, Saccharomyces kluyveri
RNSSDYLIPDSKKFPRGMKHVADSLHDEGLLFGMYSSAGEYTCAGYPGSLGHEEADAASFASWDVDYLKYDNCYNQGNYGTAQLSYERYKAMSDALNKTGRPIYYTLCNWGEDSPWHWASAIANSWRISGDIYADFDRPDSRCPCNGDEYYCHLAGFHCSIMNILNKAAPLGQKAGPGGWNDLDALEVGVGNMTDEEEKTHFSMWAAVKSPLVIGANLNTLDAKSFSIYVNPAIIAVNQDAAGAPVMRVWRYYVSDTDEHGQGEIQLWSGPLDNGDQIVALLNAGSKDRPMNATLEDIFIDSGADSEKLSSSWAIYDLWANRLDEDTAKDIINGNSTAEGKLYNATELPYTEGIAKNDTRLFGTKVGTVKPFGSIET

SEQ ID NO: 7236 - protein, 846 aa, Rattus norvegicus
MEITRPLLEIGRASTGVDDDTAVNMDSPPIASDGPPIEVSGAPVKSEHAKRPPLERQAAETGNSPISSTTAEEAKVPSLERGEGSPTQPETVHIKPAPVAESGTDSSKADPDSATHAVLQIGPEEVGGVPTMPTDLPPASEDAGPDVRAEPDGGTAPATPAESEDNREPAAAAAAEPAAEPAAEPAAEPAAEPAAEPAAEAVPDTEAESASGAVPDTQEEPAAAAASATPAEPAARAAPVTPTEPATRAVPSARAHPAAGAVPGASAMSAAARAAAARAAYAGPLVWGARSLSATPAARASLPARAAAAARAASAARAVAAGRSASAAPSRAHLRPPSPEIQVADPPTPRPAPRPSAWPDKYERGRSCCRYEAASGICEIESSSDESEEGATGCFQWLLRRNRRPGQPRSHTVGSNPVRNFFARAFGSCFGLSECTRSRSLSPGKAKDPMEERRKQMRKEAMEMREQKRADKKRSKLIDKQLEEEKMDYMCTHRLLLLGAGESGKSTIVKQMRILHVNGFNGEGGEEDPQAARSNSDGEKATKVQDIKNNLKEAIETIVAAMSNLVPPVELANPENQFRVDYILSVMNVPNFDFPPEFYEHAKALWEDEGVRACYERSNEYQLIDCAQYFLDKIDVIKQADYVPSDQDLPRCRVLTSGIFETKFQVDKVNFHMFDVGGQRDERRKWIQCFNDVTAIIFVVASSSYNMVIREDNQTNRLQEALNLFKSIWNNRWLRTISVILFLNKQDLLAEKVLAGKSKIEDYFPEFARYTTPEDATPEPGEDPRVTRAKYFIRDEFLRISTASGDGRHYCYPHFTCAVDTENIRRVFNDCRDIIQRMHLRQYELL

SEQ ID NO: 7237 - protein, 487 aa, Sinorhizobium meliloti
MRAQPKASHFIDGEYVEDAAGTVIESIYPATGEIIARLHAATPGIVEKAIAAAKRAQPEWAAMSPTARGRILKRAAELMRQLNRELSELETLDTGKPIQETIVADPTSGADSFEFFGGVAPAALNGDYIPLGGDFAYTKRVPLGVCVGIGAWNYPQQIACWKGAPALVAGNAMVFKPSENTPLGALKIAEILIEAGLPKGLFNVIQGDRATGPLLVNHPDVAKVSLTGSVPTGKKVAGAAAAELKHVTMELGGKSPLIVFDDADLESAIGGAMLGNFYSTGQVCSNGTRVFVQRKIKEPFLARLKERTEAIVIGDPLDEATQLGPMVSAAQRDKVFSYIGKGKAEGARLVTGGGIPNNVSGEGTYIQPTVFADDTDGMTIAREEIFGPVMCVLDFDDEVEVIARANATEFGLSAGVFTADLTRAHRVADRLEAGTLWINTYNLCPVEIPFGGSKQSGFGRENSVAALNHYTELKTVYVGMGPVEAPY

SEQ ID NO: 7238 - protein, 764 aa, Bos taurus
MAYLLQGRLPINQDLLLMQKGTMMRKVRSKSWKKLRFFRLQDDGMTVWHARQAGGRAKPSFSISDVDTVREGHESELLRNLAEEFPLEQGFTIVFHGRRSNLDLVANSVQEAQTWMQGLQLLVGFVTNMDQQERLDQWLSDWFQRGDKNQDGRMSFGEVQRLLHLMNVEMDQEYAFQLFQTADTSQSGTLEGEEFVEFYKSLTQRPEVQELFEKFSSDGQKLTLLEFVDFLQEEQKEGERASDLALELIDRYEPSESGKLRHVLSMDGFLGYLCSKDGDIFNPTCHPLYQDMTQPLNHYYINSSHNTYLVGDQLCGQSSVEGYIRALKRGCRCVEVDIWDGPSGEPIVYHGHTLTSRIPFKDVVAAIGQYAFQTSDYPVILSLENHCSWEQQEIIVRHLTEILGDQLLTTALDGQPPTQLPSPEDLRGKILVKGKKLMLEEEEEEPEAELEAEQEARLDLEAQLESEPQDLSPRSEDKKKKPKAILCPALSALVVYLKAVTFYSFTHSREHYHFYETSSFSETKAKSLIKEAGDEFVQHNAWQLSRVYPSGLRTDSSNYNPQEFWNAGCQMVAMNMQTAGLEMDLCDGLFRQNAGCGYVLKPDFLRDAQSSFHPERPISPFKAQTLIIQEPWLQVISGQQLPKVDNTKEQSIVDPLVRVEIFGVRPDTTRQETSYVENNGFNPYWGQTLCFRILVPELALLRFVVKDYDWKSRNDFIGQYTLPWSCMQQGYRHIHLLSKDGLSLHPASIFVHICTQEVSEEAES

SEQ ID NO: 7239 - protein, 302 aa, Oryctolagus cuniculus
ILGLGTWKSPPGQVTEAVKTAIDLGYRHIDCAHVYQNENEVGVALQEKLKEQVVKREELFIVSKLWCTSHDKSLVKGACQKTLNDLKLDYLDLYLIHWPTGFKHGSEYFPLDAAGNVIPSDTDFLDTWEAMEGLVDEGLVKSIGVSNFNHLQIERILNKPGLKYKPAVNQIECHPYLTQEKLIQYCHSKGIVVTAYSPLGSPDRPWAKPEDPSLLEDPRIKAIADKHKKTTAQVLIRFPMQRNLVVIPKSVTPARIAENFQVFDFELSSEDMTTLLSYNRNWRVCALVSCASHKDYPFHAEF

SEQ ID NO: 7240 - protein, 846 aa, Rattus norvegicus
MEITRPLLEIGRASTGVDDDTAVNMDSPPIASDGPPIEVSGAPVKSEHAKRPPLERQAAETGNSPISSTTAEEAKVPSLERGEGSPTQPETVHIKPAPVAESGTDSSKADPDSATHAVLQIGPEEVGGVPTMPTDLPPASEDAGPDVRAEPDGGTAPATPAESEDNREPAAAAAAEPAAEPAAEPAAEPAAEPAAEPAAEAVPDTEAESASGAVPDTQEEPAAAAASATPAEPAARAAPVTPTEPATRAVPSARAHPAAGAVPGASAMSAAARAAAARAAYAGPLVWGARSLSATPAARASLPARAAAAARAASAARAVAAGRSASAAPSRAHLRPPSPEIQVADPPTPRPAPRPSAWPDKYERGRSCCRYEAASGICEIESSSDESEEGATGCFQWLLRRNRRPGQPRSHTVGSNPVRNFFARAFGSCFGLSECTRSRSLSPGKAKDPMEERRKQMRKEAMEMREQKRADKKRSKLIDKQLEEEKMDYMCTHRLLLLGAGESGKSTIVKQMRILHVNGFNGEGGEEDPQAARSNSDGEKATKVQDIKNNLKEAIETIVAAMSNLVPPVELANPENQFRVDYILSVMNVPNFDFPPEFYEHAKALWEDEGVRACYERSNEYQLIDCAWYFLDKIDVIKQADYVPSDQDLPRCRVLTSGIFETKFQVDKVNFHMFDVGGQRDERRKWIQCFNDVTAIIFVVASSSYNMVIREDNQTNRLQEALNLFKSIWNNRWLRTISVILFLNKQDLLAEKVLAGKSKIEDYFPEFARYTTPEDATPEPGEDPRVTRAKYFIRDEFLRISTASGDGRHYCYPHFTCAVDTENIRRVFNDCRDIIQRMHLRQYELL

SEQ ID NO: 7241 - protein, 529 aa, Homo sapiens [sequence omitted]

SEQ ID NO: 7242 - protein, 530 aa, Aspergillus niger
MLFRSLLSTAVLAVSLCTDNASAAKHGRFGQKARDAMNIANGSANAVKHSLKIPVEDYQFLNNKTKRYRVESLPDVHFDLGEMYSGLVPIEKGNVSRSLFFVFQPTIGEPVDETTIWLNGGPGCSSLEALSPGECRFVWQPGTYQPVENPYSWVNLTNVLWVDQPVGTGFSLGVPTATSEEEIAEDFVKFFKNWQQIFGIKNFKIYVTGESYAGRYVPYISAAFLDQNDTEHFNLKGALAYDPCIGQFDYVQEEAPVVPFVQKNNALFNFNASFLAELESIHEQCGYKDFIDQYLVFPASGVQPPKAMNWSDPTCDVYDIVNNAVLDPNPCFNPYEINEMCPILWDVLGFPTEVDYLPAAPASTLTALIKRAMHAPNITWSECSVESVFVGGDGGPEQEGDYSANPIEHVLPQVIEGTNRVLIGNGDYDMVILTNGTLLSIQNMTWNGKLGFDTAPSTPINIDIPDLMYNEVFIENGYDPQGGQGVMGIQHYERGLMWAETFQSGHMQPQFQPRVSYRHLEWLLGRRDTL

SEQ ID NO: 7243 - protein, 794 aa, Pyrococcus furiosus
MAYRFIKWFEELSKNDVPLVGGKGANLGEMTNAGILGEKVNKGTISEVLAQAPDEPRPLQDWIMDIISKTDVDDSKMLQENTEAIRTLIKSLDMPSEIAEEIKQAYKELSQRFGQEEVYVAVRSSATAEDLPEASFAGQQETYLDVLGADDVIDKVKRCWASLWTPRATFYRAKQGFDHSKVYLSAVVQKMVNSEKSGVMFTANPVTNNRNEIMINASWGLGEAVVSGAVTPDEYIVEKGTWKIKEKVIAKKEVMVIRNPETGRGTVMVKVAEYLGPEWVEKQVLTDEQIIEVAKMGQKIEDHYGWPQDIEWAYDKDDGKLYIVQSRPITTLKEEATAEEAEEVEEAEVILKGLGASPGIGAGRVVVIFDASEIDKVKEGDILVTTMTNPDMVPAMKRAAAIVTDEGGRTSHAAIVSRELGIPCVLETKEATKKLKTGMYVTVDGTRGLVYKGIVKSLVKKKEEAKAEGGQVVVAGAPLVTGTMVKVNVSMPEVAERAAATGADGVGLLRAEHMILSIGQHPIKFIKEGKEEELVEKLAEGIEKVAAAFYPRPVWYRTLDAPTNEFREMPGGEDEPEERNPMLGWRGIRRGLDQPELLRAEFKAIKKVVEKGYNNIGVMLPLVSHPEQIREAKRIAREVGLEPHKDVAWGVMIEVPAAAIIIEDLIKEGIDFVSFGTNDLTQYTLAIDRDNERVAKLYDETHPAVLKLIKHVIKVCQRYGVETSICGQAGSDPKMARILVRLGIDSISANPDAVQLIRQVVAQEERKLMLEAARKQLFEKRKKRSSSEVFPPFL

SEQ ID NO: 7244 - protein, 391 aa, Mus musculus
MSGPVPSRARVYTDVNTHRPREYWDYESHVVEWGNQDDYQLVRKLGRGKYSEVPEAINITNNEKVVVKILKPVKKKKIKREIKILENLRGGPNIITLADIVKDPVSRTPALVFEHVNNTDFKQLYQTLTDYDIRFYMYEILKALDYCHSMGIMHRDVKPHNVMEDHEHRKLRLIDWGLAEFYHPGQEYNVRVASRYFKGPELLVDYQMYDYSLDMWSLGCMLASMIFRKEPFFHGHDNYDQLVRIAKVLGTEDLYDYIDKYNIELDPRFNDILGRHSRKRWERFVHSENQHLVSPEALDFLDKLLRYDHQSRLTAREAMEHPYFYTVVKDQARMSSTSMAGGSTPVSSANMMSGISSVPTPSPLGPLAGSPVIAAANSLGIPVPAAAGAQQ

SEQ ID NO: 7245 - protein, 856 aa, Brassica rapa
QRCVRNIYYQSYTFSFVLAFVVLILFHPAISMHFNTLLSTESLTISGNRTLVSPGHVFELGFFKNTLNSRWYLGIWYKNLSDRTYVWVANRDSSLSNAIGTLKLCRSNVVLRGRSNKFVWSTNLTRGNERSPVVAELLANGNFVIRYSYNNDASGFLWQSFDFPTDTLLPEMKLGYYLKTGLNRFLTSWRNFNDPSSGEFSYKLETRRLPEFYLLKNGSPGQRSGPWNGGQFSGIPEDQTLSYMVYNFTENSEEVAYTFRMTDNSIYSRIQLSPEGLLERLTWTPTSGTWNLFWSAPVDIQCDVYMTCGPYAYCDVNTSPVCNCIQGFMPFDMQQWALRDGTGGCIRRTRLSCSSDGFTRMKNMKLPDTKMAIVDRSIDVKECEKRCLSDCNCTAFANADIRNGGTGCVTWTGELEDIRNYIGNGQDLYVRLAAADLVKKRKANGKIISLIVGVSVLLLLIMFCLWKRKKNRAKASATSIDNQQRNQNVLMNGMTQSNKRQLSRENKTEEFELPLIELEAVVKATENFSNCNELGQGGFGIVYKGMLDGQEVAVKRLSKTSLQGIDEFMNEVRLIARLQHINLVRILGCCIEADEKILIYEYLENSSLDYFLFGKKRSSNLNWKDRFAITNGVARGLLYLHQDSRFRIIHRDLKPGNILLDKYMIPKISDFGMARIFARDEIQARTDNAVGTYGYMSPEYAMDGVISEKTDVFSFGVIVLEIVSGKRNRGFYQVNPENNLPSYVWTHWAEGRALEIVDPVILDSLSSLPSTFKPKEVLKCIQIGLLCIQERAEHRPTMSSVVWMLGSEATEIPQPKPPVYCLIASYYANNPSSSRQFDDDESWTVDKYTWSVIDAR

SEQ ID NO: 7246 - protein, 551 aa, Oryza sativa (japonica cultivar-group)
MGNACGGSLRSKYLSFKQTASQRHDTDDNNNAAAADSPKKPSRPPAAAKTDDHPVSASAPAAAMRRGQAPADLGSVLGHPTPNLRDLYAMGRKLGQGQFGTTYLCTELSTGVDYACKSISKRKLITKEDIEDVRREIQIMHHLSGHKNVVAIKGAYEDQLYVHIVMELCAGGELFDRIIQRGHYSERKAAELTRIIVGVVEACHSLGVMHRDLKPENFLLANKDDDLSLKAIDFGLSVFFKPGQTFTDVVGSPYYVAPEVLLKHYGPEADVWTAGVILYILLSGVPPFWAETQQGIFDAVLKGFIDFDSDPWPVISESAKDLITKMLNPRPKERLTAHEVLCHPWIRDHGVAPDRPLDPAVLSRIKQFSAMNKLKKMALRVIAESLSEEEIAGLKEMFQTMDADNSGAITYDELKEGLRKYGSTLKDTEIRDLMDAADIDNSGTIDYIEFIAATLHLNKLEREEHLVAAFSYFDKDGSGYITVDELQQACKEHNMPDAFLDDVINEADQDNDGRIDYGEFVAMMTKGNMGVGRRTMRNSLNISMRDAPGAL

SEQ ID NO: 7247 - protein, 438 aa, Phanerochaete chrysosporium
MLPLASLVLLSSLHWTAVLAADNGLAITPQMGWNTWNHFGCDISEDTILSAAQAILASNLTDFGYEYVIMDDCWHAPSRDNQTGAPVADPSKFPNGIKDLSDKIHAMGLKFGIYSDAGTYTCGGRFGSLGYEEIDAKTYAEWGVDYLKYDNCYNEGLSGTPHISHERYANMSRALNATGRPILYSMCNWGEDGPWNFAQNIANSWRISGDIMDNFDRYDDRCPCTSVIDCKLPGFHCAMTRIIDFAAPVGQKAGPGHWNDLDMLEIGNGGMTFDEYVTHFSMWSILKSPLILGNDVTDMTNETLTIITNKAIIDINQDAAGSPANRMWKRSVDEGGDLSLWAGSLVNNTFVFTLLNTSPAEQTVQVDFADVFFDQGKTYQTQPYEVFDLWQKDDEGTWGKSIGIIQGSMNVTIGVHQTKVWKAVPAPQTSTRRDYAEL

SEQ ID NO: 7248 - protein, 438 aa, Phanerochaete chrysosporium
MLPLASLVLLSSLHWTAVLAADNGLAITPQMGWNTWNHFGCDISEDTILSAAQAIIANNLTDLGYEYVIMDDCWHAPSRDNQTGAPVADPAKFPNGIKDLSDKIHAMGLKFGIYSDAGTYTCGGRFGSLGYEDIDAKTYAEWGVDYLKYDNCYNEGLSGTPHISHERYANMSRALNATGRPILYSMCNWGEDGPWNFAQNIANSWRISGDIMDNFDRYDDRCPCTSVIDCKLPGFHCAMTRIIDFAAPVGQKAGPGHWNDLDMLEIGNGGMTFDEYVTHFSMWSILKSPLILGNDVTNMTNETLTIITNKAIIDINQDAAGSPTNRMWKRSVDEGGDLSLWAGSLVNNTYVFALLNTSPAEQTVQVDFVDVFFDQGKVYQTQPYEVFDLWQKDDEGTWGKSFGIIQGSMNVTIGVHQTKVWKAVPAPQTSTRRDYAEL

SEQ ID NO: 7249 - protein, 377 aa, Oryza sativa (japonica cultivar-group)
MGAEAEHRMSPSPAPAPAPPTPVGRTDGDAPPMVLGLQLSALIDHVARVDWSLLNRIPGDRGGSQQVCIEELNHILAEVNAQILPCRDDLSSIRTIAGGSVANTIRGLSAGFGISTGIIGACGDDSQGVLFVSNMSFSGVDLTRLRTKKGHTAQCLVDASGNRTMRPCLSSAVKLQANEFKKEDFKGSKWLVVRYARQNMEQILEAIRIAKQEGLSVSLDLASFEMVRDYRTQLIDLLETGNIDLCFANEDEARELLGGELTFDPEEALAFLAKYCKWAVVTLASKGCIAKHGKQVVQVAATGESNAVDATGAGDLFASGFLYGLVKGLALEECCKVGACSGGSVVRALGGEVRPENWQWMYKQMNASGLLLPDLKN

SEQ ID NO: 7250 - protein, 97 aa, Oryza sativa (japonica cultivar-group)
METDINAPPPPAPAPAGAGEGSSSAAGPSSRKPNKRFEIKKWNAVALWAWDIVVDNCAICRNHIMDLCIECQANQASATSEECTVAWGQSRYDPVTG

SEQ ID NO: 7251 - protein, 473 aa, Oryza sativa (japonica cultivar-group)
MALKVVSFPGDLAAVSFLDSNRGGAFNQLKVDLPFQTRDRRAVSLRRTCCSMQQAPPPAWPGRAVVEPGRRSWDGPKPISIVGSTGSIGTQTLDIVAENPDKFRVVALAAGSNVTLLADQVKTFKPKLVAVRNESLVDELKEALADCDWKPEIIPGEQGVIEVARHPDAVTVVTGIVGCAGLKPTVAAIEAGKDIALANKETLIAGGPFVLPLAQKHKVKILPADSEHSAIFQCIQGLPEGALRRIILTASGGAFRDWPVDKLKEVKVADALKHPNWNMGKKITVDSATLFNKGLEVIEAHYLFGAEYDDIEIVIHPQSIIHSMIETQDSSVLAQLGWPDMRIPILYTMSWPDRIYCSEVTWPRLDLCKLGSLTFKAPDNVKYPSMDLAYAAGRAGGTMTGVLSAANEKAVELFIDEKIGYLDIFKVVELTCDAHRNELVTRPSLEEIIHYDLWAREYAASLQPSTGLSPVPV

SEQ ID NO: 7252 - protein, 159 aa, Daucus carota
MASHQDTSYKAGEAKGHAQEKTGQMADTIKDKAQAAKDKASELAGTARDRTAESKDQTGSYVSDKASAARDKSCETGQAAKEKTGGVVEATKEKASQMGESAKETAQAGKEKTGGVISSAAEQVKGMAQGATEAVKNTFGMGGGNEEKSTTTTRTTRSD

SEQ ID NO: 7253 - protein, 417 aa, Ipomoea nil
MLKEESCEVLDLDVTIGSSSGSRSGNKQNWARVCDICRSAACSVYCRADLAYLCGGCDARVHGANTVAGRHERVLVCEACESAPATVICKADAASLCAACDSDIHSANPLARRHHRVPILPISGTLYGPPTSNPCRESSMMVGLTGDAAEEDNGFLTQDAEETTMDEDEDEAASWLLLNPNPNPNPNPVKSNNSTNMCKGGNNNNNEMSCAVEAVDAYLDLAEFSSCHNNLFEDKYSINQQQNYSVPQRNMSYRGDSIVPNHGKNQFHYTQGLQQHNHHAIFNCKEWNMRILTRDMVSISSMDVGVVPESTLSDTSISHSRASKGTIDLFSGPPIQMPPQLQLSQMDREARVLRYREKKKTRKFEKTIRYASRKAYAETRPRIKGRFAKRTDVDTEVDQIFYAPLMAESGYGIVPSF

SEQ ID NO: 7254 - protein, 244 aa, Eucalyptus globulus
MGRGRLQLKRIENKINRQITFSKRRAGLLKKAHEISVLCDAEVALIVFSAKGKLFEYSTDSCMERILERYERYSYAEHQVLASETESIGSWTLEHAKLKARLEVLHRNYRHFMGEDLDSLSLKDLQNLEQQLESALKHIRSRKNQLMHESISVLQKKDRALQEQNNLLTKKIKEKERALAQQAQWEQQDHALDSPVVLPHYLPSLDINGSYQARHNGHDDGENLTQPRAGTLLPPWISASQLRL

SEQ ID NO: 7255 - protein, 740 aa, Mus musculus
MLEERESKEPAMNPFQKNESKETLFSPVSTEEMLPGPPSPPKKSTPKLFGSSYPLSIAFIVVNEFCERFSYYGMKAVLTLYFLYFLHWNEDTSTSVYHAFSSLCYFTPILGAAIADSWLGKFKTIIYLSLVYVLGHVFKSLGAIPILGGKMLHTILSLVGLSLIALGTGGIKPCVAAFGGDQFEEEHAEARTRYFSVFYLSINAGSLISTFITPMLRGDVKCFGEDCYALAFGIPGLLMVLALVVFAMGSKMYRKPPPEGNIVAQVTKCIWFAICNRFRNRSEDIPKRQHWLDWAAEKYPKHLIMDVKALTRILFLYIPLPMFWALLDQQGSRWTLQANKMDGDLGFFVLQPDQMQVLNPFLVLVFIPLFDLVIYRLISKCGVNFSSLRKMAVGMILACLAFAVAALVEIKINGMIHPQPASQEIFLQVLNLADGEIEVTVQGNRNNPLLVESISSFQNTTHYSKLRLETKSQDLHFHLKYNNLSVHNEYSVEEKNCYQLVVHENGESLSSMLVKDTGIKPANGMTAIRFINTLHKDMNISLDANAPLSVGKDYGVSEYRTVQRGKYPAVHCETEDNVFSLNLGQLDFGTTYLFVITNITNRGLQAWKAEDIPANKLSIAWQLPQYVLVTAAEVMFSVTGLEFSYSQAPSSMKSVLQAAWLLTVAVGNIIVLIVAQFSGLVQWAEFVLFSCLLLVVCLIFSVMGYYYVPLKSEGIHEATEKQIPHIQGNMINLETKNTRL

SEQ ID NO: 7256 - protein, 325 aa, Mus musculus
MTASSVLLHTGQKMPLIGLGTWKSEPGQVKAAIKHALSAGYRHIDCASVYGNETEIGEALKESVGSGKAVPREELFVTSKLWNTKHHPEDVEPALRKTLADLQLEYLDLYLMHWPYAFERGDNPFPKNADGTVRYDSTHYKETWKALEVLVAKGLVKALGLSNFNSRQIDDVLSVASVRPAVLQVECHPYLAQNELIAHCHARGLEVTAYSPLGSSDRAWRHPDEPVLLEEPVVLALAEKHGRSPAQILLRWQVQRKVICIPKSINPSRILQNIQVFDFTFSPEEMKQLDALNKNWRYIVPMITVDGKRVPRDAGHPLYPFNDPY

SEQ ID NO: 7257 - protein, 608 aa, Mus musculus
MAAAAATAVGPGAGSAGVAGPGGAGPCATVSVFPGARLLTIGDANGEIQRHAEQQALRLEVRAGPDAAGIALYSHEDVCVFKCSVSRETECSRVGRQSFIITLGCNSVLIQFATPHDFCSFYNILKTCRGHTLERSVFSERTEESSAVQYFQFYGYLSQQQNMMQDYVRTGTYQRAILQNHTDFKDKIVLDVGCGSGILSFFAAQAGARKIYAVEASTMAQHAEVLVKSNNLTDRIVVIPGKVEEVSLPEQVDIIISEPMGYMLFNERMLESYLHAKKYLKPSGNMFPTIGDVHLAPFTDEQLYMEQFTKANFRYQPSFHGVDLSALRGAAVDEYFRQPVVDTFDIRILMAKSVKYTVNFLEAKEGDLHRIEIPFKFHMLHSGLVHGLAFWFDVAFIGSIMTVWLSTAPTEPLTHWYQVRCLFQSPLFAKAGDTLSGTCLLIANKRQSYDISIVAQVDQTGSKSSNLLDLKNPFFRYTGTTPSPPPGSHYTSPSENMWNTGSTYNLSSGVAVAGMPTAYDLSSVIAGGSSVGHNNLIPLANTGIVNHTHSRMGSIMSTGIVQGSSGAQGGGGSSSAHYAVNNQFTMGGPAISMASPMSIPTNTMHYGS

SEQ ID NO: 7258 - protein, 404 aa, Strongylocentrotus purpuratus
MGEEIGKIFVGGVDRNTHADTFRAYFEKFGKLSDIILMMDKDKPGQNKGFGFVTFADPACVDDVTNEKNHNLEGKGLDCKRCKARGSEKRMGPGDQRTKKVFVGGISQQATKEDLYELFRSHGNVEDVHIMNDTDTGKHRGFGFVTLDSEEAVEKLVRMHHLELKGKSMEIKKAQPKMNRGFGGPGGQGGPGGPGGFPQGGNWNQGGGQGGYGGGGSNGYGGGNQWGQQMGQYGGGQQGGGYQQQRGGGQQPGYNRQQQQPQSGYGQQGQQSYGGAQSYGSYGGYGQAQQDPTANNNKQHLSSSMQAKDRWVATLKKHPAMDLREETTTKVIVKQLPRHRPPHRSHHSSRAMHRWTVVKTCMAPTTTARLTWGETSSIRTVDNQLTRSLWEQPSVSHICSLCLV

SEQ ID NO: 7259 - protein, 301 aa, Sinorhizobium meliloti
MARNTLPTIAAGEGGLNRYLDEIRKFPMLEPQEEYMLAKRYQEHDDRKAAHKLVTSHLRLVAKIAMGYRGYGLPIGEVISEGNVGLMQAVKKFEPDRGFRLATYAMWWIKAAIQEYILRSWSLVKMGTTANQKRLFFNLRRLKGRIQALDEGDLKPEQVKEIATTLKVSEEEVVSMNRRLSGDASLNAPIKASEGDSGQWQDWLVDDHDNQEQILIEQDELESRRALLANAMKVLNDRERRIFEARRLTEEPITLEDLSTEFDISRERVRQIEVRAFEKVQEAVRKAALERASSLRVVEGA

SEQ ID NO: 7260 - protein, 98 aa, Schistosoma mansoni
GRGKGGKGLGKGGAKRHRKVLRDNIQGITKPAIRRLARRGGVKRISGLIYEETRGVLKVFLENVIRDAVTYTEHAKRKTVTAMDVVYALKRQGRTLYG

SEQ ID NO: 7261 - protein, 335 aa, Agrobacterium rhizogenes
MTITPDIELGAYLLQRKIDPALASLIESIAASATVVADHLKEAAFQNHIGSAGTTNVQGEDQKLLDVLADRVFRETCGEAVSLAAYVSEEAEDVTWLKAPAAGDLILYVDPLDGSSNLEVNLSVGSIFAVSQVQADGDTNVLRKGRDYLCAGYAIYGPSTLFVITFGLGVVGFTLDPSDGQFKLTNARMRVPTETTEFAVNSSRQRFWDEPIRRYVDECLAGSAGPRGQDFNMRWTASMVADVHRILTRGGVFLYPADDSNRRAGGKLRLMYEANPMAFLIEAAGGAASTGTEDILRIQPQAHHQRVSVLLGSSNEIQRLVQFHQIHHSQEEIGS

SEQ ID NO: 7262 - protein, 306 aa, Agrobacterium tumefaciens
MATVSARPMSARNWGQLLLLGALWGGSFFFAHIAVAEIPPLALVLYRVSIAALVLHIWLRLRGLSFAPVLAKPMSFLFLALLNNVIPFSLIFTGQTAIGAGLASVFYATTPLWTILVANVLTADEKLSAVKLAGVALGIVGTAVTIGPGLLSDLSGPAWAKFAVIGAAISYAFAVVYAKGFKDISPTVVAAGQLTGATVLMVPVVLALYSPASIVTSSGPIWLSVLALAIFTTAFAFILYFNLIASAGATNASLVTLLVPASAIMLSSAFLDERLEVFELVGMTLIMVSLIIMDGRIFSRLLSRKS

SEQ ID NO: 7263 - protein, 294 aa, Agrobacterium tumefaciens
MTERRKTGSVGWAFAAIALSVLSWSAAFLVIAFSLREMRPIPLATARFEMAGLIALGWLIWKRPKLPSWPHMLRFAICGLLGFTLYSVFINTGQTTVSVGAASFISNIIPIMTALLAWVMLGERFKLVGWLGCAVSFTGVTIIAINQPGGLAFGAGATFILLAALCSAAYFVLQKPLVAIYGALPCTAYTLVCGALFLLPWAPEATLQFTQASPSTMAAVTGLALLPTLLAYFAWNYALGELPAGLAANFLYLVAPLATLFAFVFFGDHPSVNTILGGAMAMFGTIIVARWGKE

SEQ ID NO: 7264 - protein, 258 aa, Agrobacterium tumefaciens
MKYGSLLNKFRLDGKVALITGGTRGIGLATAYAFGEAGAKLYLSARREEYEDAGAILTAGYDVTFYPADLKTREAACALVKRVADDAGRLDILINNAGIANGGDTPLFTEQQWRDVIATNVETVFWCSQAAIPVMREGGRGAIVNVGSMSGIVSNIPQNQVAYNSSKAAVHMMTKSLASELALDNIRVNAVAPGYIDTDMSRGGMVHPVRGPIWLEMTPMKRFGRPDEIATAILFLASEASSYVTGDILVVDGGYTTR

SEQ ID NO: 7265 - protein, 197 aa, Escherichia coli
MLIKNPISYFHIGTFLFSERKGHLLEYWKAEIIMRDNFTVHRLIRNGMQRQRGFLLWWRLANEMYISGNKKQRKCAIKIKNALMAKYGCDIGLGARIGKGFVLPRHSGIVIHGNVKIGENVIIRQNATIGEKESDSRENYIVIGDNVDVGAHTCIIGLNVKIGSNIKIGAMSFIMEDVPDNCTYVTRKESRVIMRQL

SEQ ID NO: 7266 - protein, 161 aa, Escherichia coli
MKNKSGNSYYREAVDIHSSLELSFILHKYHLRVDEKKSRNVFSAIRDELILDGDSRQNLATFCQTWIDDEIRELLNLSIDRNMIYKDEYPQMAEPEGRCVRMLSDSWSFPDSRHTLGCSTIGSSEAAMLGRLALKWQWCKKREVQGKSTEPDLRSCANMLA

SEQ ID NO: 7267 - protein, 291 aa, Yersinia enterocolitica
MLMKNFLVILLFIMVSVTWGTTWLAMKLTVETIPPIFATGIRFMLAAPVLILISVLTKTRLLFPDGQKFFQLFVCIFYFSIPFSLMIYGETYVSPALASIIFSSMPVCVLFFSWLLLNERVGIIAILGLVTSTVSLLAILFIETNIGSNNQWVGIISLVIAVIMHALVYVQCKKRSCSVSVLTFNAIPSLVAGILLCIVGWIAEQPVISKFSQQSLLSVIYLGIIAGVFGILCYFQLQNKASAFQRSTVFLVFPIIALLLDGYVYGRYFSLYSILLIIPLLTGVLLISLRK

SEQ ID NO: 7268 - protein, 888 aa, Novosphingobium aromaticivorans
MSSVFSFGSGVLVAGQIGLDKRVLGGKGANLAEMARIGLPVPPGFTISAGECLAYLDHGRASLDRIRDEVSAALGLVERATGKTFGNPRDPLLVSVRSGARVSMPGMMDTILNLGINDATVTGLGQSSGDERFALDSYRRFIQMYSSVVLEIEHGVFEAALDRIKEDRGVDEDIDLRVEDLRGVIATFKDLVLAHHGAAFPQDVQEQLWTAIEAVFRSWDSPRAKVYRRLNDIPGDWGTAVNVQAMVFGNLGETSATGVAFTRNPATGEKAYYGEWLANAQGEDVVAGIRTPQYLTRAAREAAGARLPSMQEAMPKAYAQLAEVFELLERHYRDMQDIEFTVERGRLYLLQTRSGKRTAKAALKIAVDMVEESLVDEVTALLRLDPASLDQLLHPSLDPNAPRVLLGKGLPASPGAASGGVVFDAETAARWAELGEKVILVRHETSPDDIHGMHVATGILTARGGMTSHAAVVARGMGRPCVAGTASLKIDPVARVAEIGGQRLEEGAFITIDGSTGEVFLGELPTILPKLSGDFATVMAWADKHRRLKIRTNAETPLDCEMARRFGAEGVGLCRTEHMFFDESRILAMRQMILADSEKERRSALDQLLPEQRTDFRRIFEIMEGLPVTIRLLDPPLHEFLPHTDSEFTELSRAMGIDVEQVRHRAIELAETNPMLGHRGCRLGVVYPEIYEMQARAIFEAALEVAGEAGMAVCPEIMIPLVGLPRELESLKDTLYRVAEVVFAEKGERIAFSVGTMIELPRAALVADEIAASGEFFSFGTNDLTQTTLGISRDDAARFLGAYVEKGIIAKDPFVTLDIEGVGKLIEMASRKGRETRPDLKLGICGEHGGDPATIAFCEEIGLDYVSASPFRVPIARLAAAQAALAPS

SEQ ID NO: 7269 - protein, 365 aa, Novosphingobium aromaticivorans
MDAYAAIIERQGGEFVLDNVSIEDPRDGEVLVKVAAAGMCHTDLTVRDQYYPTPLPAVLGHEGSGVVEKVGRGVTTVKPGDKVVLSFSYCGTCPSCLKGHQAYCPSLFPLNFMGRRLDGSTPITRNGQEVNACFFGQSSFATYSIASENNCVKVADDAQIELLGPLGCGIQTGAGSIHNALCPEPGSSIAIFGVGSVGLSAVMAAKASGCLKIIAVDRNAGRLELARELGATDVIDANTVNAQEAIVAMTGGGADYAMDTTAIPAVLRSAVDSTHNMGETAVVGGAKLGTEFSLDMNNMLFGRKLRGVVEGSSTPQVFIPQLIAMQKAGLFPFEKLCTFYDLDQINQAVEDTEKTGKAIKAILKM

SEQ ID NO: 7270 - protein, 262 aa, Novosphingobium aromaticivorans
MTDANGRFADKIAVVTGAAQGIGFATAQRLGREGATVVVADRAEQATLDAVARLMAESVDAHPAIHDLEQQTGAAALYNAVSDKFGRIDVAVHNVGGTIWAKPYWEYTTEEIVAEINRSLWPTLWCCHAVLPHMRAAGRGAIVNIGSVATRGVNRVPYAAAKGGVAALTAALSLELEDCGIRVNCVAPGGVNVTRVTPRNTAPHSDADRKGFGEVMEQTLRDTPLGRFGEPEELAAAICFLAADEASYITGQTLYVAGGGIG

SEQ ID NO: 7271 - protein, 501 aa, Novosphingobium aromaticivorans
MATQLRSAENEYGIKSEYGHYIGGEWIAGDSGKTIDLLNPSTGKVLTKIQAGNAKDIERAIAAAKAAFPKWSQSLPGERQEILIEVARRLKARHSHYATLETLNNGKPMRESMYFDMPQTIGQFELFAGAAYGLHGQTLDYPDAIGIVHREPLGVCAQIIPWNVPMLMMACKIAPALASGNTVVLKPAETVCLSVIEFFVEMADLLPPGVINVVTGYGADVGEALVTSPDVAKVAFTGSIATARRIIQYASANIIPQTLELGGKSAHIVCGDADIDAAVESATMSTVLNKGEVCLAGSRLFLHQSIQDEFLAKFKTALEGIRQGDPLDMATQLGAQASKMQFDKVQSYLRLATEEGAEVLTGGSRSDAADLADGNFIKPTVFTNVNNSMRIAQEEIFGPVTSVITWSDEDDMMKQANNTTYGLAGGVWTKDIARAHRIARKLETGTVWINRYYNLKANMPLGGYKQSGFGREFSHEVLNHYTQTKSVVVNLQEGRTGMFDQ

SEQ ID NO: 7272 - protein, 505 aa, Novosphingobium aromaticivorans
MASGQLRYYAPMTSTSSSPVTETILNFIDGSYRKGSEGKSFPNVNPATGTAIGVVHEASQADVADAVAAAKAALTGPWGKMTTAERVKLIAAVATEIERRADDFLAAEVADTGKPRHVASHIDIPRGAANFRMFADVVSTMPGESFNTSTPDGGQALNYTVRKPKGVVAVVCPWNFPLLLMTWKVGPALACGNTVVVKPSEETPRTAALLGEVMNAVGMPKGVYNVVHGFGPGSAGEFLTSNPDVDAITFTGETGTGQAIMQKAAIGVRDISFELGGKNPAIVFADADLDKAVEGLSRSVFLNTGQVCLGTERVYVERPIFDAFVARMAAAAQGFKPGVTGDRAYLGPLISAEHREKVLGYYRRAVEDGATVVTGGGVPEISGAEAGGFFVEPTLWIDVAHGDTVMREEIFGPCCGIVPFDSEDEVIALANDTVYGLCASIWTENMSRGHRVAAAMDVGVCWVNSWFLRDLRTAFGGSGHSGIGREGGVHSLEFYTEITNICVKL

SEQ ID NO: 7273 - protein, 490 aa, Novosphingobium aromaticivorans
MGVTIPPLERSDFLTGQPLVDGTEICAGSTYAVTNPATGKTLANVVKLGAAQTRRAIESNSRALIDWRKRPAQERARLLHDWLALVRLHRHDLGLLMTAEQGKPLAEALGEVDYAASFIQWFAEEARRVYGEVIPASADRRIVVIRQPVGVAGAITPWNFPAAMITRKVAPALAAGCTVTLKPSELTPMTAFALAKLAREAGVPPGVFNVVCGDAPEIGSVLTSHPDVTKFTFTGSTAIGKLLTAQCAATLKRVSMELGGNAPLLVFDDADLDQAVEGAIASKFRNTGQTCVCANRILVQSGIHDRFVEALAARVSAFRVGNGLEGATDQGPLITASALAKVQGHVADAVAQGAQLVTGGKRHEAGELFFQPTVLTGARPAMRLADEETFGPVAPVFRFETEAEALALANATHSGLAAYAFTRDIDRAWRVSEGLETGMVGLNSGIVSTETAPFGGIKESGLGREGSRHGIEEFLEMKTISVGVRPESPV

SEQ ID NO: 7274 - protein, 479 aa, Novosphingobium aromaticivorans
MTQIEHWIGGTAVAATGGAYFDDLNPVDDSVYSRVPAGTAEDVNRAVENAHQAYLQHRDLPAAVREGWIAKAAEIMERDTAKFADVLVDEIGSPIAKAGFETRFAVSFLRAAIGVPRRIRGETIPSDTPGRFSMSLRQPVGVVAGITPFNVPLIKGIKQSAMALATGNAFVLLPSEAAPMIADLLAKLWKEAGVPDGLFNVVYGNGAEIGDVLTGHPKVASITFTGSSRVGKHIAEIAARNLKKYTLELGGKSPLVICADADLDKAVNAALFSIFMYQGQVCMGASRIYVERSIFDQFTKAFAAATGRANSGDLRDPTTMLGPIISERQRDRVRRHIDDARSKGAAVLAGGEWSGNSCAATILSGVTAEMTVFEEETFGPVTSLFPFDTLEEALELANNTEYGLSASIFTRDLDKALAFAQRAEAGMVHINAPTLHDEPHVPFGGTKASGFGREGTEADLEIMTEWKWVTIQSATEGGH

SEQ ID NO: 7275 - protein, 422 aa, Deinococcus radiodurans
MHLLDLSALLVCVTAALAFLNVRVLHLPAAIGVTVGGLLISLLLVVLTALKVPFAQEAVELVRKIQFDEFVFQGVLSFLLFAGALSVDTHALWRLRGPVTVFALLSTALSTALVGGGTYLLLELVGLPTPLAYCLLFGALISPTDPVAVLGMLKEAHVPSRIETLVAGESLFNDGVGVVAFSVLAGVAASSAAGHGPELSAGGVLRFFLQEAGGGLLLGGFLGWLGFLALKRVDDFVTEVLLTLGVVMACTAIATHLHVSGPLAAVAAGLLMGSLTDWRPGALSSREKFDSFWHLTDELLNISLFSLLALEIVAVKFSASALLAGLIALPLVLLARSVSVVLPAAALSRAHEFEPYTRRLMIWGGLRGAISVALAFTVPAGPQRELFLVMTYVVVVFSIIVQGLTVSRLAAQAASAADPEAS

SEQ ID NO: 7276 - protein, 577 aa, Deinococcus radiodurans
MNLLALPLRSEVELADARTRARHIAELLGLGNQDQVRVATVVSELARNVLLYAGSGQVTFSVRDEAGRSTLLIEVRDQGPGLGHLDEVLGGQYRSKTGMGVGLTGTRRLMDEFDIQTAPGKGTVVRVGKHLPAVVGDAEQRRVAEVLGSSGPRDLLTALSVQNRDLLETLAALNEREERLQVLNQELQDTNRGVVALYAELEEKAERLREANGLKTTFLSYMSHELRTPLHSMLGLARILSGQLDGPLNPEQLKQVQLLQGAAGDLLEMVNGLLDLAKMEAGKTDVDVTTFEVRELFGTLRALFLPLLDNPAVNLIFEDAAGFPPLTTDQRKVEQVLRNFIANALKFTAAGEVRVTAQLLPSGDRVRFTVQDTGIGLSDEEQAQLFQDFSQVGRPGRPAGTGLGLSIARKFTELLGGRVGVQSAPGAGAEFSAELPVVYPGVGAAKRPRALLIDDSEADRYVLTTLLTRAGYEVDEVAYAEPGLEQARSGAYDAVVLDLNLPDRSGLDVLRALRENAGTRSLPVLVVIAAALDAAERAALETLGASVHLKEALYQDEQVLFASLPSGSVHYGEAPDA

SEQ ID NO: 7277 - protein, 492 aa, Mus musculus
MDPSSKKVTGRLMLAVGGAVLGSLQFGYNTGVINAPQKVIEEFYNQTWNHRYGEPIPSTTLTTLWSLSVAIFSVGGMIGSFSVGLFVNRFGRRNSMLMMNLLAFVAAVLMGFSKLGKSFEMLILGRFIIGVYCGLTTGFVPMYVGEVSPTALRGALGTLHQLGIVVGILIAQVFGLDSIMGNADLWPLLLSVIFIPALLQCILLPFCPESPRFLLINRNEENRAKSVLKKLRGTADVTRDLQEMKEEGRQMMREKKVTILELFRSPAYRQPILIAVVLQLSQQLSGINAVFYYSTSIFEKAGVQQPVYATIGSGIVNTAFTVVSLFVVERAGRRTLHLIGLAGMAGCAVLMTIALALLERLPWMSYLSIVAIFGFVAFFEVGPGPIPWFIVAELFSQGPRPAAIAVAGFSNWTSNFIVGMCFQYVEQLCGPYVFIIFTVLLVLFFIFTYFKVPETKGRTFDEIASGFRQGGASQSDKTPEELFHPLGADSQV

SEQ ID NO: 7278 - protein, 508 aa, Mus musculus
MPSGFQQIGSDDGEPPRQRVTGTLVLAVFSAVLGSLQFGYNIGVINAPQKVIEQSYNATWLGRQGPGGPDSIPQGTLTTLWALSVAIFSVGGMISSFLIGIISQWLGRKRAMLANNVLAVLGGALMGLANAVASYEILILGRFLIGAYSGLTSGLVPMYVGEIAPTHLRGALGTLNRLAIVIGILVAQVLGLESMLGTATLWPLLLALTVLPALLQLILLPFCPESPRYLYIIRNLEGPARKSLKPLTGWADVSDALAELKDEKRKLERERPMSLLQLLGSRTHRQPLIIAVVLQLSQQLSGINAVFYYSTSIFESAGVGQPAYATIGAGVVNTVFTLVSVLLVERAGRRTLHLLGLAGMCGCAILMTVALLLLERVPAMSYVSIVAIFGFVAFFEIGPGPIPWFVAELFSQGPRPAAMAVAGFSNWTCNFIVGMGFQYVADRMGPYVFLLFAVLLLGFFIFTFLKVPETRGRTFDQISAAFRRTPSLLEQEVKPSTELEYLGPDEND

SEQ ID NO: 7279 - protein, 517 aa, Mus musculus
MKQSSNVPAFLSKLWTLVEETHTNEFITWSQNGQSFLVLDEQRFAKEILPKYFKHNNMASFVRQLNMYGFRKVVHIESGIIKQERDGPVEFQHPYFKQGQDDLLENIKRKVSSSKPEENKIRQEDLTKIISSAQKVQIKQETIESRLSELKSENESLWKEVSELRAKHAQQQQVIRKIVQFIVTLVQNNQLVSLKRKRPLLLNTNGAPKKNLYQHIVKEPTDNHHHKVPHSRTEGLKSRERISDDIIIYDVTDDNVDEENIPVIPETNEDVVVDSSNQYPDIVIVEDDNEDEYAPVIQSGEQSEPAREPLRVGSAGSSSPLMSSAVQLNGSSSLTSEDPVTMMDSILNDNINLLGKVELLDYLDSIDCSLEDFQAMLSGRQFSIDPDLLVDSENKGLEATKSSVVQHVSEEGRKSKSKPDKQLIQYTAFPLLAFLDGNSASAIEQGSTTASSEVVPSVDKPIEVDELLDSSLDPEPTQSKLVRLEPLTEAEASEATLFYLCELAPAPLDSDMPLLDS

SEQ ID NO: 7280 - protein, 488 aa, Solanum tuberosum
RTRHNRPAIREPVKPRVPLRLLFRVASVAGGIQFGWALQLSLLTPYVQELGIPHAWASIIWLCGPLSGLLVQPLVGHMSDKCTSRFGRRRPFIVAGAVSIMIAVLIIGFSADIGWLLGDRGEIKVRAIAAFVVGFWLLDVANNMTQGPCRALLADLTQKDHRRTRVANAYFSLFMAIGNILGFATGSYSGWFKIFPFTLNTACTINCANLKAAFIIDIIFIATTTCISISAANEQPLDPSRGSSHTREEIGESSHGQEEAFLWELFGIFKYFPGVVWVILLVTALTWIGWFPFLLFDTDWFGREIYGGEPNDGKNYSAGVRMGSLGLMLNSVLLGLTSLFMEKLCRKWGAGFTWGVSNVVMSLCFIAMLIITAVRSNIDIGQGLPPDGIVIAALVVFSILGIPLAITYSVPYALVSSRIDALGLGQGLSMGVLNLAIVFPQIVVSLGSGPWDELFGGGNSPAFVVAALSAFAGGLIAILAIPRTRVEK

SEQ ID NO: 7281 - protein, 729 aa, Mus musculus
MNPFQKNESKETLFSPVSTEEMLPGPPSPPKKSTPKLFGSSYPLSIAFIVVNEFCERFSYYGMKAVLTLYFLYFLHWNEDTSTSVYHAFSSLCYFTPILGAAIADSWLGKFKTIIYLSLVYVLGHVFKSLGAIPILGGKMLHTILSLVGLSLIALGTGGIKPCVAAFGGDQFEEEHAEARTRYFSVFYLSINAGSLISTFITPMLRGDVKCFGEDCYALAFGIPGLLMVLALVVFAMGSKMYRKPPPEGNIVAQVTKCIWFAICNRFRNRSEDIPKRQHWLDWAAEKYPKHLIMDVKALTRILFLYIPLPMFWALLDQQGSRWTLQANKMDGDLGFFVLQPDQMQVLNPFLVLVFIPLFDLVIYRLISKCGVNFSSLRKMAVGMILACLAFAVAALVEIKINGMIHPQPASQEIFLQVLNLADGEIEVTVQGNRNNPLLVESISSFQNTTHYSKLRLETKSQDLHFHLKYNNLSVHNEYSVEEKNCYQLVVHENGESLSSMLVKDTGIKPANGMTAIRFINTLHKDMNISLDANAPLSVGKDYGVSEYRTVQRGKYPAVHCETEDNVFSLNLGQLDFGTTYLFVITNITNRGLQAWKAEDIPANKLSIAWQLPQYVLVTAAEVMFSVTGLEFSYSQAPSSMKSVLQAAWLLTVAVGNIIVLIVAQFSGLVQWAEFVLFSCLLLVVCLIFSVMGYYYVPLKSEGIHEATEKQIPHIQGNMINLETKNTRL

SEQ ID NO: 7282 - protein, 112 aa, Clostridium longisporum
MKKIEAVIRPEKLEELKDALKKGNINGITVDQVMGCGQQHGWTEHYRGSEIMVNFLPKVEVKVIVDDSKVQEVINLIIDTVKTGEVGDGKIFVSDVSECIRIRTGEKGLDAL

SEQ ID NO: 7283 - protein, 249 aa, Synechocystis sp.
MLNSLIADFRIIFERDPAARNWLEVLFCYPGLQALLIHRFSHRLYTLGLPFFPRLMSHLARFFTGIEIHPGAQIGQGVFSDHGMGVVIGETAIVGDYSLIYQGVTLGGTGKESGKRHPTLGENVVVGAGAKVLGNIAIGDNVRIGAGSVVLRDVPADFTVVGVPGRMVHPSGERVNPLEHGKLPDSEGKVIRLLLERIELLEQQVATLQQQQSEQAWESDYRSCSETDREPVLCRLGDREIEEFLGGTL

SEQ ID NO: 7284 - protein, 219 aa, Drosophila melanogaster
MSCPRSIEIPDGSWIDWFLGIKGHEFSCRVPNEYIQDKFNLTGLEFDSQTLEVVLDPEFDNEDWDCAEEKKLYGMIHARYIVSPRGIEDMRLKYERGDFGSCPRVFCKRQKVLPVGLHDVWDKAQVKIYCPSCNNVYIPLPHIGMLDGAMFGTSFPHMFFMQLPSLIPSPPVEKYIPRIYGFQLHKKALMPPESAESPPIKVESSVSKSPSWLRNVPNF

SEQ ID NO: 7285 - protein, 388 aa, Picea mariana
MGRAPCCAKVGLNKGAWSAEEDSLLGKYIQTHGEGNWRSLPKKAGLRRCGKSCRLRWLNYLRPCIKRGNITADEEELIIRMHALLGNRWSIIAGRVPGRTDNEIKNYWNTNLSKKLAVRGIDPKTHKKVTTDSINRASDRFNQRKGGKLYDCSQRSQRLERNVARAGQSTGLVIPNVHNLKADLKGQYIAGPRAIQSSNSIRSSSPINTLIQPKSNELTDDPDFMQPQPVVSSEAGKQTDDSTVYCSSDSAASCALIDHLSSADDDQYLSLEGNSNECYSHTVAEESGTLKSSNPQTHSEAICDSRERDNGGPVQKHDQFPEYDVLSFFDVRNAENEICCNDDQWVHEQEMPQLHSWDNQIDDQGKEHFGSHVNNDVTAMSWEASFWF

SEQ ID NO: 7286 - protein, 100 aa, Leishmania major
MAKGKRSTDAKGSQRRQKKVLRDNIRGITRGCVRRMARRGGVKRISSEVYEEVRRVLKAYVEDIVRCSTAYTEYARKKTVTACDVVTALRKQGHILYGYA

SEQ ID NO: 7287 - protein, 297 aa, Drosophila melanogaster
MGKDFDAVGFVKDFAAGQVSAAVSKTAVAPIERVKLLLQVQHISKQISPDKQYKGMVDCFIRIPKEQGFSSFWRGNLANVIRYFPTQALNFAFKDKYKQVFLGGVDKNTQFWRYFAGNLASGGAAGATSLCFVYPLDFARTRLAADTGKGGQREFTGLGNCLTKIFKSDGIVGLYRGFGVSVQGIIIYRAAYFGFYDTARMLPDPKNTPIYISWAIAQVVTTVAGIVSYPFDTVRRRMMMQSGRKATEVIYKNTLHCWATIAKQEAPCFFKGAFSNILRGTGGAFVLVLYDEIKKVL

SEQ ID NO: 7288 - protein, 303 aa, Oryzias javanicus
MEDYVKIEKIGEGTYGVVYKGRHKSTGQVVAMKKIRLESEEEGVPSTAIREVSLLQELKHPNVVRLLDVLMQESRLYLIFEFLSMDLKKYLDSIPSGQYMDPMLVKSYLYQILEGIYFCHRRRVLHRDLKPQNLLIDNKGVIKLADFGLARAFGVPVRVYTHEVVTLWYRAPEVLLGSPRYSTPVDVWSTGTIFAELATKKPLFHGDSEIDQLFRIFRTLGTPNNDVWPDVESLPDYKNTFPKWKEGSLSSMVKNLDKNGLDLLAKMLTYNPPKRVSAREAMTHPYFDDLDKSTLPAASINGV

SEQ ID NO: 7289 - protein, 342 aa, Escherichia coli
MFRQGITGRSHLMSQNTLKVHDLNEDAEFDENGVEVFDEKALVEEEPSDNDLAEEELLSQGATQRVLDATQLYLGEIGYSPLLTAEEEVYFARRALRGDVASRRRMIESNLRLVVKIARRYGNRGLALLDLIEEGNLGLIRAVEKFDPERGFRFSTYATWWIRQTIERAIMNQTRTIRLPIHIVKELNVYLRTARELSHKLDHEPSAEEIAEQLDKPVDDVSRMLRLNERITSVDTPLGGDSEKALLDILADEKENGPEDTTQDDDMKQSIVKWLFELNAKQREVLARRFGLLGYEAATLEDVGREIGLTRERVRQIQVEGLRRLREILQTQGLNIEALFRE

SEQ ID NO: 7290 - protein, 205 aa, Eucalyptus globulus
MGRGRVQLKRIENKINRQVTFSKRRCGLLKKAHEISVLCDADVALIVFSTKGKLFEYATDCCMERILERYERYSYAESQVLTNNAETNGNWTLEHAKLKARMEILQKNQKNLMGEELDSLSLKELQNLEHQLDTALKNIRSRKIQLMCESISELQRKDKALQEQNNMLAKKVKEKEKALAQQTQWDNPQDDGLTSSSGSLPSEWN

SEQ ID NO: 7291 - protein, 766 aa, Nicotiana tabacum
MGAPILSDLGTEILIPVCAVVGIAFSLFQWFLVSKVTLSADKSSGAADDKNGYAAESLIEEEEGINDHNVVQKCAEIQNAISEGATSFLFTEYQYVGVFMVAFAILIFLFLGSVEGFSTKNQPCTYDSTKTCKPALATAVFSTVSFLLGAVTSVVSGFLGMKIATYANARTTLEARKGVGKAFIVAFRSGAVMGFLLAANGLLVLYITILLFKLYYGDDWEGLFEAITGYGLGGSSMALFGRVAGGIYTKAADVGADLVGKVERNIPEDDPRNPAVIADNVGDNVGDIAGMGSDLFGSYAESSCAALVVASISSFGVNHEFTAMLYPLLVSSVGILVCLLTTLFATDFFEVKAVKEIEPALKQQLVISTALMTVGIAVVTWIALPSIFTIFNFGAQKEVKSWQLFLCVGVGLWAGLIIGFVTEYYTSNAYSPVQDVADSCRTGAATNVIFGLALGYKSVIIPIFAIAVSIFVSFSFAAMYGIAVAALGMLSTIATGLAIDAYGPISDNAGGIAEMAGMSHRIRERTDALDAAGNTTAAIGKGFAIGSAALVSLALFGAFVSRAAISTVDVLTPKVFIGLLVGAMLPYWFSAMTMKSVGSAALKMVEEVRRQFNTIPGLMEGTAKPDYATCVKISTDASIKEMIAPGALVMLTPLIVGILFGVETLSGVLAGSLVSGVQIAISASNTGGAWDNAKKYIEAGVSEHARTLGPKGSDAHKAAVIGDTVGDPLKDTSGPSLNILIKLMAVESLVFAPFFATHGGLLFKLF

SEQ ID NO: 7292 - protein, 380 aa, Brassica nigra
MLKQESNYNISNRENNRGARACDTCRSTICTVYCHADSAYLCNSCDAEVHSANRVASRHKRVPVCESCERAPAAFMCEADDVSLCTACDSEVHSANPLARRHQRVPVVPITGNSCSSLATTHHTAVTEPEKRAVLVQDDEEGKEDAKETASWMFPYSDKGSPNHNNNNNNNNQNNELLFSDDYLDLADYNSSMDYKFTGQYNQPQHKQDCTVPQTNYGGDRVVPLQLEETRGNVRHKKEKITYGSSGSQYNYNDSINHNAYNPSMETDFVPEPTARETTVSHQKTPKIHQLPEPLVQILSPMDREARVLRYREKKKRRKFEKTIRYASRKAYAERRPRINGRFAKMSETEVEDQEYNTMLMYYDTGYGIVPSFYGQNKEY

SEQ ID NO: 7293 - protein, 348 aa, Brassica nigra
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHHSSETTEPENIVVVGQEEEDEAEAASWLLPSSVKNCGDNNNNNNNNNISENNRFSVGEEYLDLVDYSSSIDKRFTGQTNQYQQDYNVPQRSYVADGVVPLQVGVANGHMHHEKHNFQFGFTNVSSEASPIHMVSLVPESVTSDATVSHPRSPKAGTEELPEAPVQMLSPMERKARVLRYREKKKTRKFEKRIRYASRKEYAEKRPRIKGRFAKRNEVDADHALSTMVMFDTGYGIVPSFS

SEQ ID NO: 7294 - protein, 224 aa, Brassica nigra
MLKEESNESVFLVGKEEDDDGREVASWLMLNLGKDNDSHNNGFLFGVEYLDPVDYSSSIDNQFEDQYSQYQRSFGGEDGVVPLQVEEITSHLQQSHHNYGHYNYNGSLKDLNHTVSVSSMDISVVPESRAIDTSVQHPKETIDQQSGPPTQKLTPADREARVLRYREKKKRRKFEKTIRYASRKAYAEIRPRIKGRFAKTIETEADAQQLLSTALVSYGIVPSF

SEQ ID NO: 7295 - protein, 347 aa, Pneumocystis carinii
MTIKDLQDKISAACKEAEYLKEKIKKKKDELADTNLRSMAQTLDVIERLSIRVRYTLKGHLAKIYAMHWSTDQKHLVSASQDGKLIVWDAYTTRKTHAIPLRSSWVMTCAYAPSGNFVSCGGLDNVCTIYDISSKDGHAKIARELMAHTGYLSCCRFLSDEQILTSSGDMSCILWDINTGSKIQEFLDHLGDVMSLSIHPTNPNLFVSGACDAFAKIWDIRIGKSVQTFAGHESDINAVQYFPNGNAFATGSDDASCRLFDVRADRELNQYSAANIMCGITSISFSNSGRLLFAGYDDFNCNVWDVLRGNRVGILQGHDNRVSCVGVSKDGRSLATGSWDSLLKIWA

SEQ ID NO: 7296 - protein, 352 aa, Schizophyllum commune
MGACVSSSSQPVADVQAKERSDEIDSQIKADSERLKKECKILLLGSGESGKSTIVKQMKIIHKNGFSPQELASFRPTVYRNVIDSAQAVAQIIKKANPESPNLALLDKIIDYDANGIVTPDLADAIRRITSDPATPKIIDEHANEFYLMDNAAYFFENVVRIGAEKYLPTETDILRARVKTTSIKETRFACGPLTIHMFDVGGQRSERKKWIHCFESVTSIIFCTALSEYDQVLLEEKNQNRMAESLTLFESVINSRWFLRTSIILFLNKTDVFKIKLPKVPLDRYFPEYTGGNDINKAAKFILWKFMQANRARLSVYPHLTQATDTKNVRHVFAAVKETILHNALKDSGIL

SEQ ID NO: 7297 - protein, 283 aa, Homo sapiens
MAGNFWQSSHYLQWILDKQDLLKERQKDLKFLSEEEYWKLQIFFTNVIQALGEHLKLRQQVIATATVYFKRFYARYSLKSIDPVLMAPTCVFLASKVEEFGVVSNTRLIAAATSVLKTRFSYAFPKEFPYRMNHILECEFYLLELMDCCLIVYHPYRPLLQYVQDMGQEDMLLPLAWRIVNDTYRTDLCLLYPPFMIALACLHVACVVQQKDARQWFAELSVDMEKILEIIRVILKLYEQWKNFDERKEMATILSKMPKPKPPPNSEGEQGPNGSQNSSYSQS

SEQ ID NO: 7298 - protein, 589 aa, Arabidopsis thaliana
MEAKIVKVLDSSRCEDGFGKKRKRAASYAAYVTGVSCAKLQNVPPPNGQCQIPDKRRRLEGENKLSAYENRSGKALVRYYTYFKKTGIAKRVMMYENGEWNDLPEHVICAIQNELEEKSAAIEFKLCGHSFILDFLHMQRLDMETGAKTPLAWIDNAGKCFFPEIYESDERTNYCHHKCVEDPKQNAPHDIKLRLEIDVNGGETPRLNLEECSDESGDNMMDDVPLAQRSSNEHYDEATEDSCSRKLEAAVSKWDETDAIVVSGAKLTGSEVLDKDAVKKMFAVGTASLGHVPVLDVGRFSSEIAEARLALFQKQVEITKKHRGDANVRYAWLPAKREVLSAVMMQGLGVGGAFIRKSIYGVGIHLTAADCPYFSARYCDVDENGVRYMVLCRVIMGNMELLRGDKAQFFSGGEEYDNGVDDIESPKNYIVWNINMNTHIFPEFVVRFKLSNLPNAEGNLIAKRDNSGVTLEGPKDLPPQLESNQGARGSGSANSVGSSTTRPKSPWMPFPTLFAAISHKVVENDMLLINADYQQLRDKKMTRAEFVRKLRVIVGDDLLRSTITTLQNQPKSKEIPGSIRDHEEGAGGL

SEQ ID NO: 7299 - protein, 262 aa, Brassica napus
MKALGLSFFQDCPLEEKLQYACDSTSAASEGYGSRMLLGAEGDVVLDWRDYFDHHTFPLSRRDPSHWPLRPPHYRQVVEEYGNEMKKLAQKLLGIISESLSLPCSSIEEAVGEIYQNITMSYYPPCPQPELTLGLQSHSDMGAITLLIQDDVGGLQLYKDDQWLTVPPISHAILVLIADQTEIITNGVYKSAQHRAVTNANRARLSVATFHDPSKTARIAPASHLIGQHTKPAYKEVVYGQYVSSWYSKGPVGKRNLDALLC

SEQ ID NO: 7300 - protein, 327 aa, Leishmania major
MATAQNANPECVGPESPQAGIAPSCQGCPNAAICASAPKGPDPDIPLIRERLAGVKHKVMVVSGKGGVGKSTMTKELAFALGARGLSVGLMDMDICGPSLPRLTGVRGEDAHQSAGGIEPVLVDENVTMMSMHYLLSDKNEAVLFRGPRKNGVIKMFLKDVIWGNLDVLLIDTPPGTSDEHITVNSLLQQTTNGVDGAVLITTPQRVAEADVRREVNFCQKAKLPILGLVENMSGFVCPGCHKESQIFPKEEGGEGRKEGAGVRLSREFDVPLWGEVPLDPQLMKACEEGISFSEYVEKSGMTSSTTLDALFTVADQLIASLGIQVE

SEQ ID NO: 7301 - protein, 559 aa, Mus musculus
NPHNDRFVLSKGHAAPILYAVWAEAGFLPEAELLNLRKISSDLDGHPVPKQAFTDVATGSLGQGLGAACGMAYTGKYFDKASYRVYCMLGDGEVSEGSVWEAMAFAGIYKLDNLVAIFDINRLGQSDPAPLQHQVDIYQKRCEAFGWHTIIVDGHSVEELCKAFGQAKHQPTAIIAKTFKGRGITGIEDKEAWHGKPLPKNMAEQIIQEIYSQVQSKKKILATPPQEDAPSVDIANIRMPTPPSYKVGDKIATRKAYGLALAKLGHASDRIIALDGDTKNSTFSELFKKEHPDRFIECYIAEQNMVSIAVGCATRDRTVPFCSTFAAFFTRAFDQIRMAAISESNINLCGSHCGVSIGEDGPSQMALEDLAMFRSVPMSTVFYPSDGVATEKAVELAANTKGICFIRTSRPENAIIYSNNEDFQVGQAKVVLKSKDDQVTVIGAGVTLHEALAAAESLKKDKISIRVLDPFTIKPLDRKLILDSARATKGRILTVEDHYYEGGIGEAVSAAVVGEPGVTVTRLAVSQVPRSGKPAELLKMFGIDKDAIVQAVKGLVTKG

SEQ ID NO: 7302 - protein, 347 aa, Emericella nidulans
MAEFIRSDILGTTFETTSRYANLQPVGLGTAGVVCSAYDLISEQVVAIKKMMKPFHSTSVAKRTYREVKLLRHLRHDNLINMSDIFISPLEDVYLVTELLGTDLHRLLNGKPLESKFAQYFTYQILRGLKYIHSAGVIHRDLKPGNLLINENCDLKICDFGLARVQEPQMTGYVSTRYYRAPEIMLTWQRYGSKVDLWSVGCILAEMLLGRPLFPGTDHINQFWLITDLLGNPPDEVIDRITTNNVRNPAPDLQPSNHLEPANGNRRIDSSGALNLLDNLLVFDPDRRISAEQGLMHPWMAPYHDPTDEPVATEQFDWSFNDADLPLDTWKIMMYVHHCSDVVSFTL

SEQ ID NO: 7303 - protein, 619 aa, Emericella nidulans
MRSIDQPLLTRLPSSGRAQTSQLPLTMYNAHRGMVPAPNSRLNELLDQLRQEFENQSRSTGEFEHQLTGQLQEMEMIRQKVYQLEQAQLKMKQDYEAEIRMLRHELESRGVQPVASHVAVPAQHGGPSQAPPPALGHGPSNLFGGIMANQGGSGPGLAPPPPQDQQPSQHTLQQPAAAAQPGAPQPPQSSFGGYQPWRCCYGPPPPPTASPGPGKRPRAPPGPATPQQAHQLAYPESRVSPQLARPTPPNQPVVRDRPGNMLANWNPEDLPPSQKKEGVDWYAVFNPEVQRVLDVELVHHLVHDSVVCCVRFSRDGKYLATGCNRSAQIFDVTLGQNVAVLQDESVDKSGDLYIRSVCFSPDGKYLATGAEDKQIRVWDIATRTIKHIFSGHEQDIYSLDFAGNGRYIASGSGDKTVRLWDIAEGKLVYTLSIEDGVTTVAMSPDGLYVAAGSLDKTVRVWDTTTGYLVERLENPDGHKDSVYSVAFAPNGKELVSGSLDKTIKLWELNLPRQQYNSAGKGGKCHRTFEGHKDFVLSVCLTPDGHWVMSGSKDRGVQFWDPITGNAQMMLQGHKNSVISVAPSPTGNLFATGSGDMRARIWRYASFPNPISLPKIWMLG

SEQ ID NO: 7304 - protein, 350 aa, Gallus gallus
MGAGASAEEKHSRELEKKLKEDAEKDARTVKLLLLGAGESGKSTIVKQMKIIHQDGYSLEECLEFIAIIYSNTLQSMLAIVRAMTTLNIQYGDSARQDDARKLLHLSDTIEEGTMPKEMSDIIGRLWKDAGIQACFDRASEYQLNDSAGYYLSDLERLVTPGYVPTEQDVLRSRVKTTGIIETQFSFKDLNFRMFDVGGQRSERKKWIHCFEGVTCIIFIAALSAYDMVLVEDDEVNRMHESLHLFNSICNHRYFATTSIVLFLNKKDVFLEKIKKAHLSICFPDYDGPNTYDDAGNYIKLQFLELNMRRDVKEIYSHMTCATDTENVKFVFDAVTDIIIKENLKDCGLF

SEQ ID NO: 7305 - protein, 354 aa, Gallus gallus
MGSGASAEDKEMAKRSKELEKKLQEDADKEAKTVKLLLLGAGESGKSTIVKQMKIIHQDGYTPEECMEFKAVIYGNILQSILAIIRAMSTLGIDYAESGRADDGRQLFNLADSIEEGTMPPELVDCIKKLWKDGGVAGVFDRAAEYQLNDSAAYYLNQLDRITAPGYLPNEQDVLRSRVKTTGIIETKFSVKDLNFRMFDVGGQRSERKKWIHCFEGVTCIIFCGALSAYDMVLVEDDEVNRMHESLHLFNSICNHKFFAATSIILFLNKKDLFEEKIKKVHLSICFPDYDGPNTFEDAGNYIKTQFLDLNMRKDVKEIYSHMTCATDTQNVKFVFDAVTDVIIKENLKDCGLF

SEQ ID NO: 7306 - protein, 776 aa, Rattus norvegicus
MVIMSEFSAVPTGTGQGQQKPLRVGFYDVERTLGKGNFAVVKLARHRVTKTQVAIKIIDKTRLDSSNLEKIYREVQLMKLLNHPNIIKLYQVMETKDMLYIVTEFAKNGEMFDYLTSNGHLSENEARKKFWQILSAVEYCHNHHIVHRDLKTENLLLDGNMDIKLADFGFGNFYKPGEPLSTWCGSPPYAAPEVFEGKEYEGPQLDIWSLGVVLYVLVCGSLPFDGPNLPTLRQRVLEGRFRIPFFMSQDCETLIRRMLVVDPAKRITIAQIRQHRWMQADPTLLQQDDPAFSMQGYTSNLGDYNEQVLGIMQALGIDRQRTVESLQNSSYNHFAAIYYLLLERLREHRSTQPSSRATPAPARQPQLRNSDLSSLEVPQEILPCDPFRPSLLCPQPQALAQSVLQAEIDCDLHSSLQPLFFPLDTNCSGVFRHRSISPSSLLDTAISEEARQGPSLEEEQEVQEPLPGSTGRKHTLAEVSTHFSPLNPPCIIVSSSAAVSPSEGTSSDSCLPFSASEGPAGLGGGLATPGLLGTSSPVRLASPFLGSQSATPVLQSQAGLGATVLPPVSFQEGRRASDTSLTQGLKAFRQQLRKNARTKGFLGLNKIKGLARQVCQSSIRGSRGGMSTFHTPAPSSGLQGCTASSREGRSLLEEVLHQQRLLQLQHHSAVSSDYQQAPQLSPVPYVLTPCDGLLVSGIPLLPTPLLQPGMSPVASAAQLLDAHLHISAGPVALPTGPLPQCLTRLSPSCDPAGLPQGDCEMEDLTSGQRGTFVLVQ

SEQ ID NO: 7307 - protein, 722 aa, Rattus norvegicus
MSSARTPLPTLNERDTEQPTLGHLDSKPSSKSNMLRGRNSATSADEQPHIGNYRLLKTIGKGNFAKVKLARHILTGKEVAVKIIDKTQLNSSSLQKLFREVRIMKVLNHPNIVKLFEVIETEKTLYLVMEYASGGEVFDYLVAHGRMKEKEARAKFRQIVSAVQYCHQKFIVHRDLKAENLLLDADMNIKIADFGFSNEFTFGNKLDTFCGSPPYAAPELFQGKKYDGPEVDVWSLGVILYTLVSGSLPFDGQNLKELRERVLRGKYRIPFYMSTDCENLLKKFLILNPSKRGTLEQIMKDRWMNVGHEDDELKPYVEPLPDYKDPRRTELMVSMGYTREEIQDSLVGQRYNEVMATYLLLGYKSSELEGDTITLKPRPSADLTNSSAPSPSHKVQRSVSANPKQRRSSDQAVPAIPTSNSYSKKTQSNNAENKRPEEETGRKASSTAKVPASPLPGLDRKKTTPTPSTNSVLSTSTNRSRNSPLLDRASLGQASIQNGKDSTAPQRVPVASPSAHNISSSSGAPDRTNFPRGVSSRSTFHAGQLRQVRDQQNLPFGVTPASPSGHSQGRRGASGSIFSKFTSKFVRRNLNEPESKDRVETLRPHVVGGGGTDKEKEEFREAKPRSLRFTWSMKTTSSMEPNEMMREIRKVLDANSCQSELHERYMLLCVHGTPGHENFVQWEMEVCKLPRLSLNGVRFKRISGTSMAFKNIASKIANELKL

SEQ ID NO: 7308 - protein, 690 aa, Bifidobacterium longum
MAVFELILCIIAAVVVSSFASRFVPKVSTPLVQIVLGVLVTYLPFFPDAKLDPELFMVLFIAPLLYLEAHEIDKSALLKTLDLSLSLAIGLAIVTMAAVGFTLHAVWPSITLASALALGAALGPTDAVAVSSLGKEASLTQRQRSVLKGESLFNDASGIVGFQFALAAAFTGEFAVGQAAGEFVISFFGGTLFGLMIAAAANWLFETVRSLGWETTTTRILMELFLPFLLYLGAEEFNVSGILSVVAAGLFIRFDRTGVGPNVARTNIVSTSVWGVLSFSLNGAVFILLGMQLPRAMRASWSDPYISNTVLIGIILLVTLVVIALRFFWIAAMLRVARDTISGQRRKMTPERWRSAAVMTFGGPKGTITLSLMFTIPYYIAGGAPFPMRDELIFIASGVIIVTLLLANFLLPLLAPNRGKDPSAEIIPVTIDVLRATVEELTGRITPENRRAILMVIDQYTKRIGRLQQRIGDTDPQGFEQLQIEALHWEKEFVRDRLADTKAHPAADTATQELNVEACERMLDQIMNTLRHTSTDPTSGHAVSQIRGRVRMFQRQMSNYAKRTVSKIRHTTPLVSEDQIFARTRELQVEAIHHVIGRLIDEMGQDTYNTEHCSALLLDYRRAEASLQARPTMSGTTETITQVEDVKRESYGIELGMIQDMYEAGDINRAQARSLRRNIYVMQVDADSGI

SEQ ID NO: 7309 - protein, 143 aa, Bifidobacterium longum
MRCALELAGQAAAAGDVPVGAVVLDAAGQIVGRGYNTREADGDPLAHAEIIAMRQAAQALGAWNLADCTLAVTLEPCPMCAGACIQTHIGTIAFGAWDPKLGACGSIWDIPRDPHIGHSPEVHGGVLEGECQSILTDFFAQRR

SEQ ID NO: 7310 - protein, 158 aa, Plutella xylostella granulovirus
MYFFIIIIAVLLLFNYFCFILKPKTIHTPSPPLPPPPTPPPTPPTSPATPPPTFPPTPPPTPPPTPPPTPPPTPPPTPPPPPIIPAPSPPTAPPQPPPPPPPPPPPPPPPPPPTPPPTPPPTPPPTPPPTPPPTPNPDAVIPPITRPPLRPPSLPNRI

SEQ ID NO: 7311 - protein, 420 aa, Homo sapiens
QEADSLASVQLGATRPTAPASAKRTKAAATAGGQGGAARKEKKGKHKGTSGPAALAEDKSEAQGPVQILTVGQSDHAQDAGETAAGGGERPSGQDLRATMQRKGISSSMSFDEDEEDEEENSSSSSQLNSNTRPSSATSRKSVEAASAPSPTAPEQPVDVEVQDLEEFALRPAPQGITIKCRITRDKKGMDRGMYPTYFLHLDREDGKKVFLLAGRKRKKSKTSNYLISVDPTDLSRGGDSYIGKLRSNLMGTKFTVYDNGVNPQKASSSTLESGTLRQELAAVCYETNVLGFKGPRKMSVIVPGMNMVHERVSIRPRNEHETLLARWQNKNTESIIELQNKTPVWNDDTQSYVLNFHGRVTQASVKNFQIIHGNDPDYIVMQFGRVAEDVFTMDYNYPLCALQAFAIALSSFDSKLACE

SEQ ID NO: 7312 - protein, 555 aa, Populus balsamifera subsp. trichocarpa
MEYYQARTMLLVIFIFPALVECKVRLYNFRVVLTNTTKLCSSKSIPTINGKFPGPTIYAREGDNVNIRLTNQVQYNVTVHWHGVSSCFTGWADGPAYITQCPIQPGQSYLYNFTLTGQRGTLLWHAHISWLRATIHGAIVIFPKKGVPYPFPKPDKEKIIILSEWWKADVEAVVNQATMTGLPPNISDAHTVNGHTGAVPGCTSPGFTLHVESGKTYLLRIINAALNDELFFKIAGHNITVVEVDATFTKPFSADTIFIGPGQTTNALLTADKSIGKYLIAVSPFMDTVVAVDNVTAIAFLRYNEPLHSPHLSLTTTPAINATPATSTFMDKLRSLNSKKYPANVPLTVDHDLYFTIGVGIDPCATCTNGSKAVADINNVSFIMPTTALLQAHYYNISGVFTDDFPAKPPISFNYTGNNTAMNLKTTNGTRAYRLAFNSAVQVVLQGTTIIAPESHPFHLHGFNFFVVGKGIGNFDPDNDPKKFNLADPVERNTVSVPTAGWIAIRFKADNPGVWFLHCHLEVHTTWGLKMAFVVDNGKGPNESILPPPSDLPTC

SEQ ID NO: 7313 - protein, 374 aa, Oryza sativa (japonica cultivar-group); identical to SEQ ID NO: 3221

SEQ ID NO: 7314 - protein, 336 aa, Arabidopsis thaliana
MAACIDTCRTGKPQISPRDSSKHHDDESGFRYMNYFRYPDRSSFNGTQTKTLHTRPLLEDLDRDAEVDDVWAKIREEAKSDIAKEPIVSAYYHASIVSQRSLEAALANTLSVKLSNLNLPSNTLFDLFSGVLQGNPDIVESVKLDLLAVKERDPACISYVHCFLHFKGFLACQAHRIAHELWTQDRKILALLIQNRVSEAFAVDFHPGAKIGTGILLDHATAIVIGETAVVGNNVSILHNVTLGGTGKQCGDRHPKIGDGVLIGAGTCILGNITIGEGAKIGAGSVVLKDVPPRTTAVGNPARLLGGKDNPKTHDKIPGLTMDQTSHISEWSDYVI

SEQ ID NO: 7315 - protein, 701 aa, Mus musculus
MSKSRGCFGYPLSIFFIVVNEFCERFSYYGMRALLVLYFRNFLGWDDNLSTAIYHTFVALCYLTPILGALIADSWLGKFKTIVSLSIVYTIGQAVISVSSINDLTDHDHNGSPDSLPVHVALSMVGLALIALGTGGIKPCVSAFGGDQFEEGQEKQRNRFFSIFYLAINGGSLLSTIITPILRVQQCGIHSQQACYPLAFGVPAALMAVALIVFVLGSGMYKKFQPQGNIMGKVAKCIGFAIKNRFRHRSKAYPKREHWLDWAKEKYDERLISQIKMVTKVMFLYIPLPMFWGSRWTLQATTMNGKIGAIEIQPDQMQTVNAILIVIMVPIVDAVVYPLIAKCGFNFTSLKKMTVGMFLASMAFVVAAPVQVEIGKTLPVFPGGNQVQIKVLNIGNNNMTVHFPGNSVTLAQMSQTDTFMTFDIDKLTSINISSSGSPGVTTVAHDFEQGHRHTLLVWNPSQYRVVKDGPNQKPEKGENGIRFVNTLNEMVTIKMSGKVYENVTSHNASGYQFFPSGEKQYTINTTAVAPTCLTDFKSSNLDFGSAYTYVIRRASDGCLEVKEFEDIPPNTVNMALQIPQYFLLTCGEVVFSVTGLEFSYSQAPSNMKSVLQAGWLLTVAVGNIIVLIVAGAGHFPKQWAEYILFASLLLVVCVIFAIMARFYTYINPAEIEAQFDEDEKKKGIGKENPYSSLEPVSQTNM

SEQ ID NO: 7316 - protein, 395 aa, Oryza sativa (japonica cultivar-group); identical to SEQ ID NO: 3303

SEQ ID NO: 7317 - protein, 342 aa, Oryza sativa (indica cultivar-group); identical to SEQ ID NO: 3301

SEQ ID NO: 7318 - protein, 407 aa, Oryza sativa; identical to SEQ ID NO: 3302

SEQ ID NO: 7319 - protein, 259 aa, Oryza sativa
MNYNFGGNVFDQEVGVGGEGGGGGEGSGCPWARPCDGCRAAPSVVYCRADAAYLCASCDARVHAANRVASRHERVRVCEACERAPAALACRADAAALCVACDVQVYSANPLARRHQRVPVAPLPAITIPATSVLAEAVVATATVLGDKDEEVDSWLLLSKDSDNNNNNNNNNDNDNNDNNNSNSSNNGMYFGEVDEYFDLVGYNSYYDNRIENNQDRQYGMHEQQEQQQQQQEMQKEFAEKEGSECVVMELWEQTRPPP

SEQ ID NO: 7320 - protein, 258 aa, Streptomyces rishiriensis
MTGPAASAVACEPVAMVTGAGRGIGAATAERLAAEGMAVIVVDRVEQDTTATVSAIRAAGGRASGLGCDVSVAQAVTATVASAVEEFGHLDVLVNCAGITQDRLLLTMSDQEWDRVLDVNLGGSMRCSFAVGRHMRRQGHGRIINFSSVAARGNAGQTNYATAKGAIAGFTRTLAAEFGPHGVTVNSIAPGFVATPMVAELTERLGVDRDTVLLEAAMSSAVGRIGTPEEIAAVVAFVTRPESGYLTGETIHVEGGRR

SEQ ID NO: 7321 - protein, 515 aa, Cryptococcus neoformans var. grubii
MFQKVSDKFHRKQQSSTSPGKTQQVPNSPSSVLAKANSQAQQAYSSQDHSPMEGIQSDSTHIQQPMATQKAPIVGPSTSTSLSTVPVQDGTLPLTPGAQGMLAGTTDGHRQVQSPVSRSSSAGEDKMREKARDAQEQAAQAQANLHRVTQQARVAAINAAATQAALETATQLPATARVPTSGTGAEPGQARRKTAGRYALSDFLIERTLGTGSFGRVHLVRSRHNGRFYAVKVLNKEKVIKMKQVEHTNSEREMLVRVRHPFLVNLWGTFQDVNNLYMVMDFVAGGELFSLLRKSQRFPNSVAKFYAAEVALALDYLHSLDIIYRDLKPENLLLGADGHVKVTDFGFAKYVPDITWTLCGTPDYLAPEVVQSKGYNKSVDWYALGVLIFEMLAGYPPFFTEDGNPMKLYEKIIAGKVRYPTYFDVLAKELLKNLLIGDLTKRYGNLRAGSSDIFAHGWFAEVDWDKLYRREIPAPYVPKIDGEGDASQFDRYQEADVSAYGKVGNGPYDHFFVEF

SEQ ID NO: 7322 - protein, 1230 aa, Cryptococcus neoformans var. neoformans
MSSFTPAFRLHHTHSSSVSPTASNDVAPSSPTPNQPHQLAARSPLYANSPNCASKITKGSSLSSSTAHHGLKYVRPSTSPLLRSPKGESFSAYLGNWGSQELITFLNIHKCGQYLAIFQKNDINGKILLDLDMTALKSMGIGKISERVRLIGGIKDLRRCVADESIRAPFTQRSYPSERTLLPSLPSHSNVLLDKWDCSSSASRLGKRQITLRPPPLDLQGHMPPRLLSHASLGIATIDTHDIHTTNSKIEVYIQQNPPGQPQSMPTKRSDSLTLCAAPSRNVGRRSPSSRHFEGCKSQTDGLTTLNLTLDRQVPSSTMNNVTLREDCHLQREERLPLSHQVPHSRNAFASPHKTSLSGRCPLARGDTTSHQPSGPAIAEQDSPVNYRISNTVTNTKEISQGDLKQPFVMKSLESQSHLLAGVSDMSHDPVTDGFKPKGKASVPLTVMSSSDISAVNANPAALSLADLRRQLVKFINTEDDTIRTVNVMHVTSGVEILERALKKFGKFGTGIHGSPDVYGDEDGDGTLEIGGWEVYTESTPDESSKPLSEFNLLKTCTFHREGTAIQDKGLFLRKKQRMQKRKNIQDFFGETPPPSMSPTSPTLITGPHLSLVQGKSQPTSGSAFSSSSRLSTLTHKGRNRASMISVMSGLGVPIINTLPSPQGNGLRLTGSVHSHEKKSMYNFFGHRPPSELISNHLTDYFPSAKKSDVEKARHSLLRLSGGTVAYKKSGIYEGDSTPDHWSKPGDNQPPSLPPFEPSQDTLSDSLQAFASSTPVHLSRPKHTVALRRRRDSDSSSRSHTSMLMQTRRNRDHSDTTSLLTVDEITAEVENRRVSTIQRGDYIEETEDSSSIEGDTLPQDDESKGVLRAICSDSNKLVDSGKSYQGDSDIDQQHELEDEEEDKLDDDEEEEEEEEEEDNEQGKAFTSTGSKRIIKWIKGALIGAGSFGSVYLGMDAQSGLLMAVKQVELSAGSAKNEDRKRSMLSALEREIELLKELQHENIVQYLDSSVDANHLNIFLEYVPGGSVAALLNNYGAFEEALVRNFVRQILTGLNYLHMRGIVHRDIKGANILVDNKGGIKISDFGISKKVENSLITGLRTNRPSLQGSVFWMAPEVVKQTSYSPKADIWSVGCLVVEMLTGTHPWADLTQMQAIFRIGSLARPAPPSDISVQADEFLRKTFEIEHAKRPTAAQLLKHPFIGSPRVRTAASNFINGAIASETMEVQVVEES

SEQ ID NO: 7323 - protein, 1230 aa, Drosophila melanogaster
MSAPLLGEMEQTIGMLERGTIVTKLYGKQRRPDRRHLMLIRETRQLLWATVATQTPRTDYEGAIQLREIREIRVGKHSKEFRLFADDCQRFESSKCFVILHGNHFKLKSFSVVALSEIEADNWVRGLRYMVKDTLGAPYPLQIDRWLRREYYQIENVNTHSAKATEQSPAQVTIKDFKLFLAGVSCKMTTGKFMEHFTEDVRRKHDLKFDDFSRLYQKLLLPNGFASVLSGSGVANFPYSEDQQVVRPAELKQFLETEQRDVSASEISSAAIASFIRDFVQDVERDVQEPYLTFPEFVDFLFSKQNDLWNSKYDQVFMDMNLPLSSYWIASSHNTYLTGDQFSSESSCEAYARALRMGCRCIELDCWNGPDNLPYIFHGHTITSKIKFMDVIKTIKDHAFTSSEYPVILSIEQNCSLEQQRNMAQALIEVFGDMLLTQPCDRNEQHLPSPYQLRRKIILKHKKLPQFDDIANGISSTGSLGHRSSLGGAGGGAHGENDGENVRKVFKEGLLYFKDPVDKSWNLYQFVLTHQELIYSSEINESRNGNSEDDDFGLSSSCSLNSNMQQKQKDTSANDELHFGENWFHGKLEGGRKEADDLLKKYKHFGDGTFLVRESATFVGDYSLSFWRRNRPNHCRIKLKHENGSIKYYLVENFVFDSLYSLIVYYRKNMLRSSEFSIILKEPVPQPKKHEDQEWFHPNTTKEQAEQGLYRLEIGSFLVRPSVQSINAFVISFTINRKIKHCRIMQEGCLYGIDTMNFESLVSLINYYTRNPLYRNVKLSHPVSQELLRQALAEAAQGDHSGGHDDNGASNYMGSNLEENVTCKALYSYKANKPDELSFPKHAIITNVQRDNSMWWIGDYGGMIKKHLPANYVKVIDSTTEDYNSLNEEGTDGRTDSIEIFGAVASLFESNDPGIIFKLQIQTPTMQNPFVIGFDNQETAYEWIKAIQEAALIASQLASERRKKERTARVAKEMSDLIIYFRSVPFREHSWIFQEMSSFPETKAEKQFFQQNTQLFLSYHRNQISRVYPKGQRLDSSNFNPMPFWNVGSQMIALNYQTGDKAMQLNQAKFRNNGQCGYILKPSFMKSDSFNPNNPLCDGLSEVKVSIRLIAARHLFRGGKSNNPQIVVELIGASFDTGVKYRTKVIENGFNPVWNESCEFNVRNPQFAILRFEVQDEDMFAETHFIAQACYPLTCIRQGYRSVILRNKFSEELELSSLLINIKIANVTAP

SEQ ID NO: 7324 - protein, 351 aa, Aplysia californica
EIVRGQTFEVAPRYTNLTYIGEGAYGMVVSATDNQTKQKVAIKKISPFEHQTYCQRTLREIKILTRFKHENIIDIRDILRAPTVEDMKDVYIVQCLMETDMYKLLKTQQLSNDHVCYFLYQILRGLKYIHSANVLHRDLKPSNLLLNTTCDLKICDFGLARVADPDHDHTGFLTEYVATRWYRAPEIMLNSKGYTKSIDVWSVGCILAEMLANRPLFPGKHYLDQLNHILGVLGSPSQEDLQCIINDKARGYIQSLPFKPKVPWNKLYPNADVKALDLLEKMLTFNPNKRITVEQALAHPYLEQYYDPADEPVAEEPFTFEMELDDLPKERLKELIFQETLQIQDKNLEHS

SEQ ID NO: 7325 - protein, 823 aa, Pneumocystis carinii
MDYLKKVRLWSEEEVGEWLESNNFGDYMDIFKENNINGDILLECNAAVLKELGVKKLGDRIRLSVCIKGLREKCIESARKSKMSFLMIDNQIQGFSFTLQSPTDPLIPVKSSELASPTSNFQLDNSYSDACCFDSLNNFHSVLSNISCSTKSISRNSSISTQKVFEKSPIFLETNVMQSDSIKKNCLKFIGEKGQTRIVNISLCYTADAILSKALKKFNITENPSEWRVFITNEDGSFECISNDTLLTISRQLSRPERERLILKRKSDPLTQEEFKKSQTIAREQRDAIYHTAVMAKTSGNLRKLETFFGEKLAPTLTSSFTTPLPSPLPKDNKYGNITHIRNFFGQRPPSELINSNLAEYFPGHEKKVLEQTIKNSIKSNHLNSFKGSNFDTPSSTLTYDLSSIPAVGEERIQYEGRRLSGVSHTLSLSRFISTRFPTLLESSILRENSSHHTLSSSSKLNSEGNTQDSKPSFRKKLEEKASSDETFKSESPNMLMEPSILSDFYDASLETDRDLLDDNIFENNEAKDFNTEKEIENNNSGPTRWIKGALIGSGSFGSVFLGMNALSGELMAVKQVEIPSIDIQGCKRKRAMLDALQREISLLKELHHENIVQYLGSSMDETHLTFFLEYVPGGSVTALLNNYGAFEEPLIRNFVRQILKGLNYLHNKKIIHRDIKGANILVDNKGGIKISDFGISKKVEANLLSMTRNQRPSLQGSVYWMAPEVVKQTLYTRKADIWSLGCLIVEMFTGKHPFPKMNQLQAIFKIGQYVSPDIPEHCTSEARHFLEKIFEPDYHARPTAADLLKYSFLGPMVSSPLTDAKK

SEQ ID NO: 7326 - protein, 63 aa, Strombidinopsis acuminata
MRGILADWLIKVHTKLKLLPETLFLTINLVDRYLERVQVDRDRLQLVGIAAILTATKYEEIYP

SEQ ID NO: 7327 - protein, 63 aa, Strombidinopsis acuminata
MRGILADWLVEVHYKFKMVPETLYLTVNLIDRYLSLKTVRKDRLQLLGVTSMLIACKYEEIYP

SEQ ID NO: 7328 - protein, 245 aa, Eucalyptus globulus
MGRGRVQLKRIENKINRQVTFSKRRCGLLKKAHEISVLCDADVALIVFSTKGKLFEYATDCCMERILERYERYSYAESQVLTNNAETNGNWTLEHAKLKARMEILQKNQKNLMGEELDSLSLKELQNLEHQLDTALKNIRSRKIQLMCESISELQRKDKALQEQNNMLAKKVKEKEKALAQQTQWDNPQDDGLTSSSVILSQSLQPLNIGGPYHPSGIEEGAALGPPQHRNATLFPSWMLSHLQE

SEQ ID NO: 7329 - protein, 261 aa, Bacillus subtilis
MYPDLKGKVVVITGSSTGLGKAMAIRFATAKAKVVVNYRSKEDEANSVLEEIKKVGGEAIAVKGDVTVESDVINLVQSAIKEFGKLDVMINNAGLENPVSSHEMSLSDWIKVIDTNLTGAFLGSREAIKYFVENDIKGTVINMSSVHEKIPWPLFVHYAASKGGMKLMTETLALEYAPKGIRVNNIGPGAINTPINAEKFADPEQSADVESMIPMGYIGEPEETAAVAAWLASSEASYVTGITLFADGGMTQYPSFQAGRG

SEQ ID NO: 7330 - protein, 542 aa, Rattus norvegicus
MATTVTCTRFTDEYQLYEDIGKGAFSVVRRCVKLCTGHEYAAKIINTKKLSARDHQKLEREARICRLLKHSNIVRLHDSISEEGFHYLVFDLVTGGELFEDIVAREYYSEADASHCIQQILEAVLHCHQMGVVHRDLKPENLLLASKCKGAAVKLADFGLAIEVQGDQQAWFGFAGTPGYLSPEVLRKEAYGKPVDIWACGVILYILLVGYPPFWDEDQHKLYQQIKAGAYDFPSPEWDTVTPEAKNLINQMLTINPAKRITAHEALKHPWVCQRSTVASMMHRQETVECLKKFNARRKLKGAILTTMLATRNFSVGRQTTAPATMSTAASGTTMGLVEQAKSLLNKKADGVKPQTNSTKNSSAITSPKGSLPPAALEPQTTVIHNPVDGIKESSDSTNTTIEDEDAKARKQEIIKTTEQLIEAVNNGDFEAYAKICDPGLTSFEPEALGNLVEGMDFHRFYFENLLAKNSKPIHTTILNPHVHVIGEDAACIAYIRLTQYIDGQGRPRTSQSEETRVWHRPDGKWQNVHFHCSGAPVAPLQ

SEQ ID NO: 7331 - protein, 367 aa, Rattus norvegicus
MSSPPPARKGFYRQEVTKTAWEVRAVYQDLQPVGSGAYGAVCSAVDSRTGNKVAIKKLYRPFQSELFAKRAYRELRLLKHMRHENVIGLLDVFTPDETLDDFTDFYLVMPFMGTDLGKLMKHETLSEDRIQFLVYQMLKGLKYIHAAGVIHRDLKPGNLAVNEDCELKILDFGLARQADSEMTGYVVTRWYRAPEVILNWMRYTQTVDIWSVGCIMAEMITGKILFKGNDHLDQLKEIMKVTGTPPPEFVQKLQSAEAKNYMEGLPELEKKDFASVLTNASPQAVNLLEKMLVLDAEQRVTAAEALAHPYFESLRDTEDEPKAQKYDDSFDDVDRTLEEWKRVTYKEVLSFKPPRQLGARVPKETAL

SEQ ID NO: 7332 - protein, 103 aa, Mortierella alpina
MSGRGKGGKGLGKGGAKRHRKILRDNIQGITKPAIRRLARRGGVKRISGLIYEETRSVLKVFLENVIRDAVTYTEHAKRKTVTSLDVVYALKRQGRTLYGFGG

SEQ ID NO: 7333 - protein, 303 aa, Lycopersicon esculentum
MEKYEKLEKVGEGTYGKVYKAKDKATGQLVALKKTRLEMDEEGIPPTALREISLLQMLSHSLYIVRLLCVEHIDKNGKPILYLVFEYLDTDLKKFIDSHRKGPNARALPTALIQSFLFQLCKGVAHCHSHGVLHRDLKPQNLLVDKEKGILKIADLGLGRAFTVPMKSYTHEIVTLWYRAPEVLLGSTHYSTAVDMWSVGCIFAEMVRRQALFPGDSEFQQLLHIFRLLGTPTDKQWPGVSSLRDWHVYPQWEPQNLASAVPALGPDGVDLLTKMLKFDPSDRISAKAALDHPYFDSLDKSQF

SEQ ID NO: 7334 - protein, 315 aa, Lycopersicon esculentum
MEAAKNAGKSVSAMEAFEKLEKVGEGTYGKVYRARDRITGKIVALKKTRLHEDEEGVPPTTLREISLLRMLSRDPHIVRLMDVKQGQNKEGKTVLYLVFEYMDTDVKKFIRTFRAKGETMPLKIVKSLMYQLCKGVAFCHGHGVLHRDLKPHNLLMDRKTNVLKLADFGLGRAYTLPIKKYTHEILTLWYRAPEVLLGATHYSTAVDMWSVGCIFAELVTNQALFPGDSELQQLLHIFRLLGTPNEELWPGVSKLVNWHEYPQWKPQPLSTVVPGLDEDGIHLLSEMLHYEPSRRISAKKAMEHPYFDDLDKTPL

SEQ ID NO: 7335 - protein, 276 aa, Trypanosoma brucei
MALTQSLKLSNGVMMPVLGFGMWKLQDGNEAETATMWAIKSGYRHIDTAAIYKNEESAGRAIASCGVPREELFVTTKLWNSDQGYESTLSAFEKSIKKLGLEYVDLYLIHWPGKDKFIDTWKAFEKLYADKKVRAIGVSNFHEHHIEELLKHCKVAPMVNQIELHPLLNQKALCEYCKSKNIAVTAWSPLGQGHLVEDARLKAIGGKYGKTAAQVMLRWEIQAGVITIPKSGNEARIKENGNIFDFELTAEDIQVIDGMNAGHRYGPDPEVFMNDF

SEQ ID NO: 7336 - protein, 676 aa, Erwinia amylovora
MPATEIPEKPQKDRINPVVFYTSAVLILLFSLTTILFTEFSDRWINRTLNWVSNTFGWYYLLAATLYIVFVIFMACSRFGSIKLGPEQSKPEFSLMSWAAMLFAAGIGIDLMFFSVAEPVTQYMMPPEGQGQTLEAARQAMVWTLFHYGLTGWSMYALMGIALGYFSYRYGLPLTIRSALYPIFGKRVNGPIGHTVDIAAVLGTIFGIATTLGIGVVQLNYGLKVLFDVPEGLTAQAGLIVLSVIMATISVTSGVNKGIRLLSELNVLLAFGLILFVLFVGDTSFLLNALVLNVGDYINRFMGMTLDSFAFDRPAEWMNNWTLFFWAWWVAWSPFVGLFLARISRGRTIRQFVLGTLTIPFIFTLLWLSIFGNSALNEIIHGNLALAQETLAHPERGFYSLLAQYPGFTFSASVATITGLLFYVTSADSGSLVLGNFTSRLADINNDAPNWLRIFWSVTIGVLTMGMLMVNGVTALQKTTVIMGLPFSFVIFFVMAGLYKSLRVEDHRRASATVNTPPVTVDRLNWKQRISRVMNYPGTTHTRKMLDNVCRPAMEEVGRELEHRGAKVQVNELPAVDDERLNHLELLVDLADEQSFLYQIWPQRYSVPAFTYRARSGKSDYFRLETFLLEGTQGNDLMDYTKEQIINDILDQYERHLTFLHIHREAPGNSMPFPEV

SEQ ID NO: 7337 - protein, 340 aa, Ambystoma tigrinum
MSELEQLRQEAEQLKNQIRDARKVCADATLAQITANIDPVGRIQMRTRRTLRGHLAKIYAMHWGTDSRLLVSASQDGKLIIWDSYTTNKVHAIPLRSSWVMTCAYAPSGNYVACGGLDNICSIYNLKTREGNVRVSRELAGHTGYLSCCRFIDDNQIITSSGDTTCALWDIETGQQTTTFAGHTGDVMSLSLAPDSRCFVSGACDASAKLWDVREGMCRQTFTGHESDINAICFFPNGNAFATGSDDATCRLFDLRADQELMVYSHDNIICGITSVAFSKSGRLLLAGYDDFNCNVWDTLKADRAGVLAGHDNRVSCLGVTDDGMAVATGSWDSFLKIWN

SEQ ID NO: 7338 - protein, 340 aa, Ambystoma tigrinum
MGGMEQLRQEAEQLKKQIAEARKVCADTTLAQITAGMEVVGRIQMRTRRTLRGHLAKIYAMHWSNDSRLLVSASQDGKLIVWDTYSTNKVHAIPLRSSWVMTCSYAPSGNFVACGGLDNMCSIYNLKTREGNVKVSRELAAHTGYLSCCRFLDDNQIVTSSGDTTCALWDIETGTQKTVFMGHTGDCMSLAVSPDFRIFVSGACDATAKLWDIREGTCRQTFTGHESDINAICFFPNGEAVCTGSDDATCRLFDLRADQELTVYSHESIICGITSVAFSRSGRLLLAGYDDFNCNMWDSMKGERVGVLSGHDNRVSCLGVTTDGMAAATGSWDSFLKIWN

SEQ ID NO: 7339 - protein, 423 aa, Zea mays; identical to SEQ ID NO: 657

SEQ ID NO: 7340 - protein, 420 aa, Arabidopsis thaliana
RLTSPPRLMIVSDLDHTMVDHHDPENLSLLRFNSLWEHAYRHDSLLVFSTGRSPTLYKELRKEKPLLTPDITIMSVGTEITYGNSMVPDHGWVEALNNKWDLGIVKQEASNFPELKLQAETEQRPHKVSFYVEKSKAQEVTKELSQRFLKRGLDVKIIYSGGMDLDILPQGAGKGQALAYLLKKLKTEGKLPVNTLACGDSGNDAELFSIPDVYGVMVSNAQEELLKWHAENAKDNPKVIHAKERCAGGIIQAIGHFKLGPNLSPRDVSDFLEIKVENVNPGHEVVKFFLFYERWRRGEVENSEAYTASLKASVHPGGVFVHPSGTEKSLRDTIDELRKYHGDKQGKKFRVWADQVLATDTTPGTWIVKLDKWEQDGDERRCCTTTVKFTSKEGEGLVWEHVQQTWSKETMVKDDSSWII

SEQ ID NO: 7341 - protein, 419 aa, Medicago truncatula
MDRLKSSARLMIVSDLDHTMVDHHDAENSSLLRFNALWEASYRHDSLLVFSTGRSPLLYKQLRKEKPMITPDITIMSVGTEITYGKSMVPDDGWVQVLNQKWDKDIVIEEASKFPELKPQAETEQRAHKVSFYVEKDNAKQVTEALSKILEQRGLDVKIIYSGGVDLDILPQGAGKGQALAYLLKKFETEGKLPGNTLVCGDSGNDAELFSIPGVYGVMVSNAQEELLQWHAENAKDNPKILHASERCASGIIQAIGHFNLGPNLSPRDVSDIGQEQSVENVSAVQEIVNFSLLIEKWRRAEVENSELFIAAIKASTDPSGVYIHPSGADHNLNEYINILRKEYGKKQGKQFRIWLDNVLATQISSDIWLVKFDKWELHDEERHGCVVTTILRKDSDWFTWMHVHQSWLEQSGQNEWII

SEQ ID NO: 7342 - protein, 335 aa, Rattus norvegicus
MALLARAFFAGVSRLPCDPGPQRFFSFGTKTLYQSIDAPQSKFFPPILKPMLPPNAFQGKVAFITGGGTGLGKAMTTFLSSLGAQCVIASRNIDVLKATAEEITSKTGNKVYAIRCDVRDPDMVHNTVLELIKVAGHPDVVINNAAGNFISPSERLSPNGWKTITDIVLNGTAYVTIEIGKQLIKAQKGAAFLAITTIYAESGSGFVMPSSSAKSGVEAMNKSLAAEWGRYGMRFNIIQPGPIKTKGAFSRLDPTGKFEKDMIERIPCGRLGTVEELANLATFLCSDYASWINGAVIRFDGGEEVFLSGEFNSLKKVTKEEWDVIEGLIRKTKGS

SEQ ID NO: 7343 - protein, 186 aa, Rattus norvegicus
PVDLSKWSGPLSLQEVDERPQHPLQVKYGGAEVDELGKVLTPTQVKNRPTSITWDGLDPGKLYTLVLTDPDAPSRKDPKYREWHHFLVVNMKGNNISSGTVLSDYVGSGPPKGTGLHRYVWLVYEQEGPLKCDEPILSNRSGDHRGKFKVASFRKKYELGAPVAGTCYQAEWDDYDPKLYEQLSGK

SEQ ID NO: 7344 - protein, 188 aa, Vigna radiata var. radiata
MEKEDLGLEITELRLGLPGAGGENNTDKDKNKNKKRVFSDIEGENSSSEEDGKKETKNQVVGWPPVCSYRKKNTVNEPKLYVKVSMDGAPFLRKIDLAMHKGYSDLAFALDKFFGCYGICEALKDAENAEHVPIYEDKDGDWMLVGDVPWEMFRESCKRLRIMKRSDAKGFDLQPKGSLKGFIEGVRK

SEQ ID NO: 7345 - protein, 193 aa, Vigna radiata var. radiata
MENSLGSYEKELNLKATELRLGLPGSDEPEKRATARSNKRSSPEASDEESISNGSDVTKEDNVVPPAKAQVVGWPPIRSYRKNNVQQKKEEESEGNGMYVKVSMAGAPYLRKIDLKVYKSYPELLKALENMFKCIFGEYSEREGYNGSEYAPTYEDKDGDWMLVGDVPWNMFVSSCKRLRIMKGSEAKGLGCF

SEQ ID NO: 7346 - protein, 203 aa, Vigna radiata var. radiata
MGSYETELNLRATELRLGLPGSDEPQEKRPCSGSVVRSSNKRSSPELEESRCKSNINSDSSDSTTTSDHNEDSVQPAKVQVVGWPPIRSFRKNSLQQKKVEQGDGTGMYLKVSMAGAPYLRKIDLKVYKSYPELLKALQNLFKCTFGEYSEREGYNGSEYAPTYEDKDGDWMLVGDVPWNMFVSSCKRLRIIKGSEAKGLGCL

SEQ ID NO: 7347 - protein, 514 aa, Streptomyces griseus
MSASTSRTLPPEIAESESVMALIERGKADGQIAGDDVRRAFEADQIPPTQWKNVLRSLNQILEEEGVTLMVSAAESPKRARKSVAAKSPVKRTATKTVAAKTTVTRTVAATAAPAVESADAADDAVAAAPAKKTAAKKATAKKAAAKKTTAKKTAAKKSGKQDDEILDGDEAAEEVKAGKGEEEEGEGENKGFVLSDDDEDDAPAQQVAVAGATADPVKDYLKQIGKVPLLNAEQEVELAKRIEAGLFAEDKLANADKLAPKLKRELEIIAEDGRRAKNHLLEANLRLVVSLAKRYTGRGMLFLDLIQEGNLGLIRAVEKFDYTKGYKFSTYATWWIRQAITRAMADQARTIRIPVHMVEVINKLARVQRQMLQDLGREPTPEELAKELDMTPEKVIEVQKYGREPISLHTPLGEDGDSEFGDLIEDSEAVVPADAVSFTLLQEQLHSVLDTLSEREAGVVSMRFGLTDGQPKTLDEIGKVYGVTRERIRQIESKTMSKLRHPSRSQVLRDYLD

SEQ ID NO: 7348 - protein, 332 aa, Streptomyces viridifaciens
MATRAVARRQSATGETADSASSVRAHGGEIADRDLVGMYLDEIARTPLLDAAKEVELSQTIEAGVFAQQVLDGEEESRTDATREELQALVDAGERAKDVFIRSNLRLVVAVARRYPRSGLPLLDLIQEGNAGLVRAVEKFDYRKGFKFSTYATWWIRQAITRSIADQSRTIRLPVHLVEELGRIRRVQREFNREHGRDPEPAEVAAELGSTPERVIDVLDWARDPVSLNMAVDDAGETQFGDLLEDTSAVSPEQSVLTLLRSEELDDLIGRLDQRTASIIKMRYGIDDGRERTLTEVGKEHGLTRERIRQIEKHALLELKKLARDTGFDAAA

SEQ ID NO: 7349 - protein, 1188 aa, Homo sapiens
EFMEHSDKGPLPLRDDNGIVLLGERAAKCRAYAKALHYKELEFQKGPTPAILESLISINNKLQQPEAAAGVLEYAMKHFGELEIQATWYEKLHEWEDALVAYDKKMDTNKDDPELMLGRMRCLEALGEWGQLHQQCCEKWTLVNDETQAKMARMAAAAAWGLGQWDSMEEYTCMIPRDTHDGAFYRAVLALHQDLFSLAQQCIDKARDLLDAELTAMAGESYSRAYGAMVSCHMLSELEEVIQYKLVPERREIIRQIWWERLQGCQRIVEDWQKILMVRSLVVSPHEDMRTWLKYASLCGKSGRLALAHKTLVLLLGVDPSRQLDHPLPTVHPQVTYAYMKNMWKSARKIDAFQHMQHFVQTMQQQAQHAIATEDQQHKQELHKLMARCFLKLGEWQLNLQGINESTIPKVLQYYSAATEHDRSWYKAWHAWAVMNFEAVLHYKHQNQARDEKKKLRHASGANITNATTAATTAATATTTASTEGSNSESEAESTENSPTPSPLQKKVTEDLSKTLLMYTVPAVQGFFRSISLSRGNNLQDTLRVLTLWFDYGHWPDVNEALVEGVKAIQIDTWLQVIPQLIARIDTPRPLVGRLIHQLLTDIGRYHPQALIYPLTVASKSTTTARHNAANKILKNMCEHSNTLVQQAMMVSEELIRVAILWHEMWHEGLEEASRLYFGERNVKGMFEVLEPLHAMMERGPQTLKETSFNQAYGRDLMEAQEWCRKYMKSGNVKDLTQAWDLYYHVFRRISKQLPQLTSLELQYVSPKLLMCRDLELAVPGTYDPNQPIIRIQSIAPSLQVITSKQRPRKLTLMGSNGHEFVFLLKGHEDLRQDERVMQLFGLVNTLLANDPTSLRKNLSIQRYAVIPLSTNSGLIGWVPHCDTLHALIRDYREKKKILLNIEHRIMLRMAPDYDHLTLMQKVEVFEHAVNNTAGDDLAKLLWLKSPSSEVWFDRRTNYTRSLAVMSMVGYILGLGDRHPSNLMLDRLSGKILHIDFGDCFEVAMTREKFPEKIPFRLTRMLTNAMEVTGLDGNYRITCHTVMEVLREHKDSVMAVLEAFVYDPLLNWRLMDTNTKGNKRSRTRTDSYSAGQSVEILDGVELGEPAHKKTGTTVPESIHSFIGDGLVKPEALNKKAIQIINRVRDKLTGRDFSHDDTLDVPTQVELLIKQATSHENLCQCYIGWCPFW

SEQ ID NO: 7350 - protein, 263 aa, Vicia faba
MGITVPENLTKLGVAVPENLNREQYVYLAKLAEQAERYEEMVSFMQKLVLVSTPSSELSVEERNLISVAYKNVIGSLRAAWRIVSSIEQKEEGRKNDDHVVLVKDYRSKVEAELSNVCASILELLDKNLIPSGSSSESKVFYYKMKGDYHRYLAEFKIGEERKSAAEDTMLSYKAAQDIAAADLPSTHPIRLGLALNFSVFYYEILNQSDKACAMAKQAFEEAIAELDTLGEESYKDSTLIMQLLRDNLTLWTSDVQDQLDEP

SEQ ID NO: 7351 - protein, 257 aa, Vicia faba
MASSKETFVYTAKLAEQAERYEEMVEAMKNVAKLDVELTVEERNLLSVAYKNVVGGRRASWRILSSIEQREETKGNEVNVNRIKEYRKKVESELSDICTDIMAVIDEHLIPNSSGESNVFYYKMKGDYYRYLAEFKSGDDRKEAADQSLKAYQEASTAAETELPPTHPVRLGLALNFSVFYYEILNSPERACHLAKQAFDVAIAELDSLNEESYKDSTLIMQLLRDNLTLWTSDIPEEGVEEQKAESARAPVGDNAE

SEQ ID NO: 7352 - protein, 325 aa, Vitis vinifera
GGGNFGVARLVSDKRTRELFAVKFIERGQKIDEHVQREIMNHRSLMHPNIVRFKEVLLTPTHLAIVMEYAAGGELFGRICNAGRFSEDEARFFFQQLISGVSYCHSMRICHRDLKLENTLLDGSTAPRVKICDFGYSKSSVLHSQPKSTVGTPAYIAPEVLSRKEYDGKLSDVWSCGVTLYVMLVGAYPFEDPDDPRNFRKTIGRILSVHYSIPDYVRVSIECRHLLSRVFVANPDKRITIPEIKTHPWFLKNLPIEMMDGGSWQKNDVNNPSQSVEEILSIIQEARKTTGVRKAGGPFMEGSMDLDDIDADEDIETSGDFVCPL

SEQ ID NO: 7353 - protein, 192 aa, Wuchereria bancrofti
WYGTGENIFFQALQIPTKISRGTIEILNEVHLIKTGEKVGASESALLNMLNIMPFSYGLVVRQVYENGTVFAPEVLDMTPDDIRAKFLKGVQNVAAVSLAIGHPTLASVPHSIANAFKNLLAIAVEASIEMKEAEKIKEYLADPAKFAAPVAATAPAASSAQPVKSEESSKKEEAKKEESSEDEDMGFGLFD

SEQ ID NO: 7354 - protein, 375 aa, Sinorhizobium meliloti
MDARAAVAIQAGKPLEVMTVQLEGPRAGEVLVEVKATGICHTDDFTLSGADPEGLFPAILGHEGAGIVVDVGPGVTSVKKGDHVIPLYTPECRSCPSCLSRKTNLCTAIRATQGQGLMPDGSSRFSINGDKIHHYMGCSTFSNFTVLPEIALAKVNPDAPFDKICYIGCGVTTGIGAVINTAKVEIGATAIVFGLGGIGLNVIQGLRLAGADMIIGVDLNNDKKPWGEKFGMTHFVNPKEVGDDIGPYLVNLTKRGADHIGGADYTFDCTGNTNVMRQALEASHRGWGKSVIIGVAGAGQKIATRPFQLVTGRTWMGTALGGARGRTDVPKIVDWYMEGKIAIDPMITHTMPLDDINKGFELMHSGESIRSVVLF

SEQ ID NO: 7355 - protein, 312 aa, Leishmania panamensis
MNYEGHLKGHRGWVTSLACPQQAGSYIKVVSTSRDGTAISWKSNPDRHSVDSDYGLPNHRLEGHTGFVSCVSLAHATDYALTASWDRSIRMWDLRNGQSQRKFLKHTKDVLAVAFSPDDRLIVSAGRDNVIRVWNVAGECMHEFLRDGHEDWVSSICFSPSLEHPIVVSGSWDNTIKVWNVNEGKCERTLKGHSNYVSTVTVSPDGSLCASGGKDGAALLWDLSTGEQLFRINVESAINQIAFSPNRFWMCVAAEKSLSVYDLESKAVIAELTPDGTKPSECISIAWSADGNRLYSGHKDNLIRVWSISDAE

SEQ ID NO: 7356 - protein, 63 aa, Atriplex garrettii
PRPNIGIHRFAFILFKQNRRDSVNPPCNRDRFCTRKFAEENQLGLPVAAVYFNCQRETTARRR

SEQ ID NO: 7357 - protein, 173 aa, Lolium perenne
MSRSVEPLIVGRVIGEVLDPFNPCVKMVATYNSNKLVFNGHELYPSAVVSKPRVEVQGGDLRSLFTLVMTDPDVPGPSDPYLREHLHWIVSNIPGTTDASFGGEVMSYESPKPNIGIHRFIFVLFKQKRRQTVSVPSFRDHFNTRQFAVDNDLGLPVAAVYFNCQRETAARRR

SEQ ID NO: 7358 - protein, 341 aa, Beta vulgaris
MDHAADATRTDLMTITRFVLNEQSKRPESRGDFTILMSHIVLGCKFVCSAVNKAGLAKLIGLAGETNIQGEEQKKLDVLSNEVFIKALISSGRTCILVSEEDEEATFVEPSLRGKYCVVFDPLDGCSNIDCGVSIGTIFGIYMVKDLNNATLDDVLQPGKNMVAAGYCMYGSSCTLVMSTGSGVNGFTHDPSLGEFILTHPDIKIPKKGKIYSVNEGNAKNWDGPTTKYVEKCKFPKDGSSPKSLRYIGSMVADVHRTLLYGGIFMYPGDKKSPNGKLRVLYEVFPMSFLMEQAGGQAFTGEQRALDLVPKNIHDRSPVFLGSYDDVEDIKALYAAEQKNA

SEQ ID NO: 7359 - protein, 343 aa, Oryza sativa (indica cultivar-group)
MTVEVEAVTMAKEEQPEEEEVIEKLVEKITGLAAAIGKLPSLSPSPEVNALFTELVMTCIPPSSVDVEQLGAEAQDMRGRLIRLCADAEGHLEAHYSDVLAAHDNPLDHLALFPYFNNYIQLAQLEYALLARHLPAAPPPSRLAFLGSGPLPLSSLVLAARHLPAASFHNYDICADANRRASRLVRADRDLSARMAFHTSDVAHVTTDLAAYDVVFLAALVGMAAEEKARMVEHLGKHMAPGAALVVRTAHGARGFLYPVVDPEEIRRGGFDVLAVHHPEGEVINSVIIARNRPWPGPALEGGDAHAHGHGAVVSRPCQRCEMEARAHQKMEDMSAMEKLPSS

SEQ ID NO: 7360 - protein, 222 aa, Oryza sativa (japonica cultivar-group)
MKVYGWVVSPWMARVLVALEEAGAEYEVVPMSRSGGDHRRPEHLARNPFGEIPVLEDGDLTLYQSRAIARYIFRKYKPEFLGLGEGGSLEESAMVDVWLDVEAHQHEAAVRPILWHCIINKFEGRDRDQGVVDESVRKLEKVLGVYEARLSGSRYLAGDRISLADLSHFSNMRYFMATEYAGVVDAYPHVKAWWEALLARPTVQKVMAGMPPDFGFGSGNIP

SEQ ID NO: 7361 - protein, 94 aa, Gallus gallus
LQWILDKQDLLKERQKDLKFLSEEEYWKLQIFFTNVIQALGEHLKLRQQVIATATVYFKRFYARYSLKSIDPVLMAPTCVFLASKVEDKTSAPY

SEQ ID NO: 7362 - protein, 272 aa, Gallus gallus
LQWILDKQDLLKERQKDLKFLSEEEYWKLQIFFTNVIQALGEHLKLRQQVIATATVYFKRFYARYSLKSIDPVLMAPTCVFLASKVEEFGVVSNTRLISAATSVLKTRFSYAFPKEFPYRMNHILECEFYLLELMDCCLIVYHPYRPLLQYVQDMGQEDMLLPLAWRIVNDTYRTDLCLLYPPFMIALACLHVACVVQQKDARQWFAELSVDMEKILEIIRVILKLYEQWKNFDERKEMATILSKMPKPKPPPNSEGEQGPNGSQNSSYSQS

SEQ ID NO: 7363 - protein, 105 aa, Gallus gallus
MAGNFWQSSHYLQWILDKQDLLKERQKDLKFLSEEEYWKLQIFFTNVIQALGEHLKLRQQVIATATVYFKRFYARYSLKSIDPVLMAPTCVFLASKVEDKTSAPY

SEQ ID NO: 7364 - protein, 531 aa, Picea abies
MWDLNHIPEATKEPQVVVPMEAACSAEGNLSVGNANFRDENVSGSSSSSSVAIANTAMSVDCEEHSMSRACPSEQAEMNARSSQENGNGLGSEAQVQTGKLFGFSFSNIVKGNCTEASSGVSNGRSGCTNRVTRQFFPHGREFESQVMIPGRPQLPRAHWVGLTFRQAESFRSPTPKEATQPIKKSRRGPRSRSSQYRGVTFYRRTGRWESHIWDCGKQVYLGGFDTAHAAARAYDRAAIKFRGVDADINFNIDDYEDDVKQMSKLTKEEFVHVLRRQSTGFPRGSSKFRGVTLHKCGRWEARMGQFLGKKYVYLGLFDNEVEAARAYDKAAIRCNGKEAVTNFSPELYESELALTEDKGHDPDLDLSLGNSVPKDGSLVSKDNNDGPMRSESDLCTLSEPDWKTSCLIKPTVPNLLDGLNQSAQSLSCEVPSLQRYQQSPGWVWQLPTNRPAAPHPPPMIESAASSGFSPQIYSSTTSPSPEWLQKRGFHFLFQPALMQTKNILHSPTAPALINTYGKKPSDHSLNLSLG

SEQ ID NO: 7365 - protein, 633 aa, Picea abies
MMTVDTSSIEPVGKIAPRSSEETESVCVEAAAATVTHIQSNNETRRRAPFRSEMTESGTSISSVVNSIACNENINSLEHEASSKAVELDGDVLSSNSTQVPRSNEGNHKIFGFSLKIETQNLTSRGNLLNVKANDEQQKDPACVTRHFFPLHNGQPSEVLMPTECTGGNPFTESHWTTVTSRLPESTEPRKKQAENNKPIKKSRRGPRSRSSQYRGVTFYRRTGRWESHIWDCGKQVYLGGFDTAHAAARAYDRAAIKFRGVDADINFTLTDYQEDLDQTSKLSKEEFVHILRRQSTGFSRGSSKYRGVTLHKCGRWEARMGQFLGKKYIYLGLFDSEEDAARAYDKAAIRCNGKDAVTNFDPSSYENEILEEGRESQTSTGFDQNLDLSLGIGHVTTQLKISPSYKSRVEEDSQLNRIEAVTYSNLSQDSKILSCLTSKGAENAVPEFQSLPRGHAVYWNSQTLQVPDAMKHKQSHTREDNAYEQTAISGSQLYPDHLSNCKRLNMEGLKEQSLGVPSSTVSFWPMKQQSGWTWQLHASGPTTPVFTTNRSPASGFSPQIHTAFVPSTHGCHKMGVHWAAQSTDPCMVQTPSPHLATRLTSGPDSGDHPVGLTLDLPGKKIKRSSVQRDKVD

SEQ ID NO: 7366 - protein, 452 aa, Lupinus albus
MAKNMAPILHILVISLSYSFLFVTSSSQNSQSLYHNSQPTSSSKPNLLVLPIQQDASTKLHWGNILKRTPLMQVPVLLDLNGKHLWVTCSQHYSSSTYQAPFCHSTQCSRANTHQCFTCTDSTTSRPGCHNNTCGLISSNPVTQESGLGELAQDVLALHSTHGSKLGSLVKIPQFLFSCAPTFLTQKGLPNNVQGALGLGHAPISLPNQLFSHFGLKRQFTMCLSSYPTSNGAILFGDINDPNNNNYIHNSLDVLHDMVYTPLTISKQGEYFIQVSAIRVNKHMVIPTKNPSMFPSSSSSSYHESSEIGGAMITTTNPYTVLRHSIFEVFTQVFANNVPKQAQVKAVGPFGLCYDTKKISGGVPSVDLIMDKSDVVWRISGENLMVQAQDGVSCLGFVDGGVHTRAGIALGTHQLEENLVVFDLARSRVGFNTNSLKSHGKSCSNLFDLNNP

SEQ ID NO: 7367 - protein, 820 aa, Rattus norvegicus
MMLRWSGIWGLYPPRIFPSLLVVVALVGLLPVLRSHGLQLNPTASTIRGSEPPRERSIGDVTTAPSEPLHHPDDRNLTNLYIEHGAKPVRKAFPVLDIDYLHVRTPFEISLWILPGLVMKIGFHVIPTISSIVPESCLLIVVGLLVGGLIKGVGETPPFLQSDVFFLFLLPPIILDAGYFLPLRQFTENLGTILIFAVVGTLWNAFFLGGLLYAVCLVGGEQINNIGLLDTLLFGSIISAVDPVAVLAVFEEIHINELLHILVFGESLLNDAVTVVLYHLFEEFASYEYVGISDIFLGFLSFFVVSLGGVFVGVVYGVIAAFTSRFTSHIRVIEPLFVFLYSYMAYLSAELFHLSGIMALIASGVVMRPYVEANISHKSHTTIKYFLKMWSSVSETLIFIFLGVSTVAGSHQWNWTFVISTLLFCLIARVLGVLVLTWFINKFRIVKLTPKDQFIIAYGGLRGAIAFSLGYLLDKKHFPMCDLFLTAIITVIFFTVFVQGMTIRPLVDLLAVKKKQETKRSINEEIHTQFLDHLLTGIEDICGHYGHHHWKDKLNRFNKKYVKKCLIAGERSKEPQLIAFYHKMEMKQAIELVESGGMGKIPSAVSTVSMQNIHPKSAASERILPALSKDKEEEIRKILRSNLQKTRQRLRSYNRHTLVADPYEEAWNQMLLRRQKARQLEQKITNYLTVPAHKLDSPTMSRARIGSDPLAYEPKADLPVITIDPASPQSPESVDLVNEELKGKVLGLKRGPRTTPEEEEEDEDGVIMIRSKEPSSPGTDDVFTPGPSDSPGSQRIQRCLSDPGPHPEPGEGEPFIPKGQ

SEQ ID NO: 7368 - protein, 904 aa, Escherichia coli
MGFALMALLTLTSTLVGWYNLRFISQVEKDNTQALIPTMNMARQLSEASAWELFAAQNLTSADNEKMWQAQGRMLTAQSLKINALLQALREQGFDTTAIEQQEQEISRSLRQQGELVGQRLQLRQQQQQLSQQIVAAADEIARLAQGQANNATTSAGATQAGIYDLIEQDQRQAAESALDRLIDIDLEYVNQMNELRLSALRVQQMVMNLGLEQIQKNAPTLEKQLNNAVKILQRRQIRIEDPGVRAQVATTLTTVSQYSDLLALYQQDSEISNHLQTLAQNNIAQFAQFSSEVSQLVDTIELRNQHGLAHLEKASARGQYSLLLLGMVSLCALILILWRVVYRSVTRPLAEQTQALQRLLDGDIDSPFPETAGVRELDTIGRLMDAFRSNVHALNRHREQLAAQVKARTAELQELVIEHRQARAEAEKASQAKSAFLAAMSHEIRTPLYGILGTAQLLADNPALNAQRDDLRAITDSGESLLTILNDILDYSAIEAGGKNVSVSDEPFEPRPLLESTLQLMSGRVKGRPIRLATAIADDMPCALMGDPRRIRQVITNLLSNALRFTDEGYIILRSRTDGEQWLVEVEDSGCGIDPAKLAEIFQPFVQVSGKRGGTGLGLTISSRLAQAMGGELSATSTPEVGSCFCLRLPLRVATAPVPKTVNQAVRLDGLRLLLIEDNPLTQRITIEMLKTSGAQIVAVGNAAQALETLQNSEPFAAALVDFDLPDIDGITLARQLAQQYPSLVLIGFSAHVIDETLRHGTSSLFRGIIPKPVPREVLGQLLAHYLQLQVNNDQSLDVSQLNEDAQLMGTEKIHEWLVLFTQHALPLLDEIDIARASQDSEKIKRAAHQLKSSCSSLGMHIASQLCAQLEQQPLSAPLPHEEITRSVAALEAWLHKKDLNAI

SEQ ID NO: 7369 - protein, 381 aa, Leishmania major
MLVSVKPKPEVAGTAHVPLGPTGTNVRGAFPITAASRSAHAMFPSTWYSALKPKVACNFAKPDTSSWKLSDFELKNTLGTGSFGRVRIAHRKGTEEYYAIKCLRKREIIKMKQQQHVAQEKGILMELCHPFIVNMMCSFQDEKKVYFLLEFVMGGEMFTHLRTAGRFPNDVAKFYHAELVLAFEYLHSLDVIYRDLKPENLLLDNKGHVKMTDFGFAKKVPDRTFTLCGTPEYLAPEVIQSKGHGKAVDWWTMGVLLYEFIAGYPPFYDDTPFRIYEKILAGRLKFPNWFDGRARDLVKGLLQTDHTKRLGTLKGGPADVKNHPYFHGANWDKLYARYYPAPIPVRVKSPGDTSNFEKYPDSPVDRTPALTSAQQAELKGF

SEQ ID NO: 7370 - protein, 258 aa, Leishmania major
MLVSVKPKPEVAGTAHVPLGPTGTNVRGAFPITAASRSAHAMFPSTWYSALKPKAAYYFAKPDTSSWKLSDFELKNTLGTGSFGRVRIAHRKGTEEYYAIKCLRKREIIKMKQQQHVAQEKGILMELCHPFIVNMMCSFQDEKKVYFLLEFVMGGEMFTHLRTAGRFPNDVAKFYHAKLVLAFEYLHSLDVIYRDLKPENLLLDNKGHVKMTDFGFAKKVPDRTFTLCGTPEYLAPEVIQSKGHGKAVDWWTMGVLLY

SEQ ID NO: 7371 - protein, 505 aa, Mus musculus
MTSKPHSDWIPYSVLDDEGSNLRQQKLDRQRALLEQKQKKKRQEPLMVQANADGRPRSRRARQSEEQAPLVESYLSSSGSTSYQVQEADSIASVQLGATRPPAPASAKKSKGAAASGGQGGAPRKEKKGKHKGTSGPATLAEDKSEAQGPVQILTVGQSDHDKDAGETAAGGGAQPSGQDLRATMQRKGISSSMSFDEDEDEDENSSSSSQLNSNTRPSSATSRKSIREAASAPSPAAPEPPVDIEVQDLEEFALRPAPQGITIKCRITRDKKGMDRGMYPTYFLHLDREDGKKVFLLAGRKRKKSKTSNYLISVDPTDLSRGGDSYIGKLRSNLMGTKFTVYDNGVNPQKASSSTLESGTLRQELAAVCYETNVLGFKGPRKMSVIVPGMNMVHERVCIRPRNEHETLLARWQNKNTESIIELQNKTPVWNDDTQSYVLNFHGRVTQASVKNFQIIHGNDPDYIVMQFGRVAEDVFTMDYNYPLCALQAFAIALSSFDSKLACE

SEQ ID NO: 7372 - protein, 123 aa, Lotus japonicus
GNSVLFYTLILEKAPAAKDMFSFLKASGPTHSPQLQAHAEKVFGLTRDAAAQLLAKGEVTLADAGLGAVHVQKAVADPHFAVVKEALLKTVQAAVGDKWSEDLSTAWGVAYDGLAAAIKKAMS

SEQ ID NO: 7373 - protein, 123 aa, Lotus japonicus
GNSVLFYTLILEKAPAAKDMFSFLKASGPTHSPQLQAHAEKVFGLTRDAAAQLLAKGEVTLADASLGAVHVQKAVADPHFAVVKEALLKTVQAAVGDKWSEELSTAWGVAYDGLAAAIKKAMS

SEQ ID NO: 7374 - protein, 95 aa, Zinnia elegans
WFQNRRTRWKTKQLEKDYDVLQESYNQLKANYENLLQEKEKLKSQVLELSEKLSMQENEKGTSDSSSTKSPSDPLQQEHVTDCVNDEDVTKVSND

SEQ ID NO: 7375 - protein, 151 aa, Zinnia elegans
WFQNRRTRWKTKQLERDYGVLKSNFDSLKHKYESLKQDNESMVKQIKELKSKLYEEDEPDNIPMPEQSDDKPKSPENMVETAYFPDFKDGSSDSDSSAIMGDAQKAYQPQFVKLEEHNFFGGDESCNFFSDDQAPTLQWYCQDQWNLSEEN

SEQ ID NO: 7376 - protein, 139 aa, Zinnia elegans
WFQNRRTRWKTKQLERDYNVLKTQVDSIKADNDKLMNHNNKLHAQLMALKGEGSNSIRAMVNLNKETEGSWSNGSDNSREDNNAIFYTPISNNLPNSSAMIGGSAPSYNEGFCNLLNVIDDQPAFWSWPEAEQQNQHLP

SEQ ID NO: 7377 - protein, 170 aa, Zinnia elegans
KIWFQNRRARWKTKQLEKDYDVLKRQYESVKADNDALKTLNKKLHAELMAVKSGETNGIRPINLNKETEGSWSNGSENSCDLNTVTGTMTPSEESPIFYTQISTNINYPNMSSMGPNSSLTQLLQSPSTTDLLGQRLNQTVGNEGFLNMFNGIEDQPAYWSWPEQHTQHL

SEQ ID NO: 7378 - protein, 174 aa, Zinnia elegans
KIWFQNRRARWKTKSLERDYNRLKSCYDVLTSDYESIVKENEKLKAEVLSLTEKLQSKEVSETSAVGQGSGSALEEAGDVPAPSDNDNVKVEDHFSTGSGGSAVVDDQDGPQLVDSGDSYNFPNDDDYPHEYVVPAVDQSEEDDGSDDGQNRFQYTFETADHEEQDGLGWWVWS

SEQ ID NO: 7379 - protein, 110 aa, Zinnia elegans
KIWFQNRRARTKLKQTEVDCEFLKRCCENLTEENRRLQKELQELKALKLSPQFYMQMAPPTTLTMCPSCERVGAPPSQKSIDHQHRKLPFYPWPTSASQVVQRQMGALHH

SEQ ID NO: 7380 - protein, 142 aa, Zinnia elegans
KIWFQNRRARWKTKQLERDYNLLKDNYDVLKRNYHKLQQEKESITKELVELKAKVYKDTKEDNNAMFLGSDPTNTTLNNDKTHKLLDGLSDSDSSGVLNDENMNISDHNISWSLNMTTFGVSSICSSSSKELIIDQGAYQQL

SEQ ID NO: 7381 - protein, 247 aa, Zinnia elegans
MKRHGSSDSVGLMPMCHTLDETREFHSMLMEGLDDDCGGVDGGECDRGLISEKKRRLTAVQVKALEKNFEMENKLEPERKVKLAKELALQPRQVAIWFQNRRARWKTKQLERDYGVLKSNFDSLKHKYESLKQDNESMVKQIKELKSKLYEEDEPDNIPMPEQSDDKPKSPENMVETAYFPDFKDGSSDSDSSAIMGDAQKAYQPQFVKLEEHNFFGGDESCNFFSDDQAPTLQWYCQDQWNLSEEN

SEQ ID NO: 7382 - protein, 1053 aa, Lycopersicon esculentum
MAGNDWINSYLEAILDVGPGLDDKKSSLLLRERGRFSPTRYFVEEVITGFDETDLHRSWIRAQATRSPQRRNTRLENMCWRIWNLARQKKQLEGEQARWMAKRRQERERGRRGAVADMSEDLSEGEKGDIVADMSSHGESTRGRLPRISSVETMEAWVSQQRGKKLYIVLISLHGLIRGENMELGRDSDTGGQVKYVVELARALGSMPGVYRVDLLTRQVSSPEVDWSYGEPTEMLTPISTDGLMSEMGESSGAYIIRIPFGPREKYIPKDQLCPYNPEFVDGALNHIIQMSKVLGEQIGNGHPVWPVAIHGHYADAGDSAALLSGALNVPMLFTGHSLGRDKLEQLLRQGRLSKDEINSTYKIMRRIEAEELTLDASPIVITSTRQEIDEQWRLYDGFDPILERKLRARIKRNVSCYGRFMPRMAVIPPGMEFHHIVPHEGDMDGDTEGSEDGKIPDPPIWAEIMRFFSNPRKPMILALARPDPKKNLTTLVKAFGECRPLRELANLTLIMGIRDNIDEMSSTNSALLQIILKMIDKYDLYGQVAYPKHHKQSDVPDIYRLAAKTKGVFINPAFIEPFGLTLIEAAAYGLPMVATKNGGPVDIHRVLDNGLLVDPHDQQAIADALLKLVADKQLWAKCRANGLKNIHLFSWPEHCKTYLSRIASCKPRQPRWLRPDDDDDENSETDSPSDSESIHDISPDSGFSLVGEKDDNKENAGSTLDPEVGKSKLENAVLSLSKGARKSTSKSWSSDKADQNPGAGKFPAIRRRRHIFVIAVDCDASSGLSGSVKKIFEAVEKERSEGSIGFILASSFNISEVQSFLVSGGRSPTDFDATICNSGGDLYYSSFHSEQNPFVVDLYYHSHIEYRWGGEGLRKTLVRWAASITDKNGENGEHIVVEDEDNSADYCYTFKVCKPGKVPPAKELRKVMRIQALRCHAVYCQNGSRINMIPVLASRSQALRYLYLRWGMDLSKLVVFVGESGDTDYEGLIGGLRKAVIMKGLCTNASSLIHGNRNYPLSDVLPFDSPNVIQADEECSSTEIRSLLEKLAVLKG

SEQ ID NO: 7383 - protein, 383 aa, Hordeum vulgare subsp. vulgare
MGSSCSRPHSVNEAEAAGNTRSADIDRRILHETKADQHIHKLLLLGAGESGKSTIFKQIKLLFRTGFDEAELKGYTPVIHANVYQTIKILYDGAKELAQVELESSKYVISSDNQEIGEKLSEIGGRLDYPLLNKELVQDVRKLWEDPAIQETYSCGSVLQVPDCAHYFMENLDRLAEADYVPTKEDVLHARVRTNGVVEIQFSPLGESKRGGEVYRLYDVGGQRNERRKWIHLFEGVDAVIFCAAISEYDQLLFEDETQNRMMETKELFDWVLKQRCFEKTSFMLFLNKFDIFERKIQKVPLTVCEWFKDYEPIAPGKVQDVEHAYEFVKKKFEEVYFQSSKPDRVDRVFKIYRTTALDQKLVKKTFKLIDESMRRSREGTGT

SEQ ID NO: 7384 - protein, 727 aa, Rattus norvegicus
MNGEADCPTDLEMAAPKGQDRWSQEDMLTLLECMKNNLPSNDSSKFKTTESHMDWEKVAFKDFSGDMCKLKWVEISNEVRKFRTLTELILDAQEHVKNPYKGKKLKKHPDFPKKPLTPYFRFFMEKRAKYAKLHPEMSNLDLTKILSKKYKELPEKKKMKYIQDFQREKQEFERNLARFREDHPDLIQNAKKSDIPEKPKTPQQLWYTHEKKVYLKVRPDEIMRDYIQKHPELNISEEGITKSTLTKAERQLKDKFDGRPTKPPPNSYSLYCAELMANMKDVPSTERMVLCSQQWKLLSQKEKDAYHKKCDQKKKDYEVELLRFLESLPEEEQQRVLGEEKMLNINKKQTTSPASKKPSQEGGKGGSEKPKRPVSAMFIFSEEKRRQLQEERPELSESELTRLLARMWNDLSEKKKAKYKAREAALKAQSERKPGGEREDRGKLPESPKRAEEIWQQSVIGDYLARFKNDRVKALKAMEMTWNNMEKKEKLMWIKKAAEDQKRYERELSEMRAPPAATNSSKKMKFQGEPKKPPMNGYQKFSQELLSNGELNHLPLKERMVEIGSRWQRISQSQKEHYKKLAEEQQRQYKVHLDLWVKSLSPQDRAAYKEYISNKRKNMTKLRGPNPKSSRTTLQSKSESEEDDDEEDDDDDDEEEEEDDENGDSSEDGGDSSESSSEDESEDGDENEDDDDDEDDDEDDDEDEDNESEGSSSSSSSSGDSSDSDSN

SEQ ID NO: 7385 - protein, 378 aa, Arabidopsis thaliana
MEKTSMFSIHEGKPIRCKAAVSRKPGEALVIEEIHVDPPQAYEVRIKIICTSLCHTDVSFSKIDRHEAVGVIESIGEHVNGFQQGDVVLPVFHPHCEECRDCKSSKSNWCARFADDFLSNTRRYGMTSRFKDSFGEDIYHFLFVSSFSEYTVVDIAHLVKISPDIPVDKAALLSCGVSTGIGAAWKVANVEKGSTVAVFGLGAVGLAVGEGARLRGAGKIIGVDLNPEKFELGKKFGFTDFINSTLCGENKISEVIKEMTGGGVDYSFECVGLPSLLTEAFSSTRTGSGKTVVLGIDKHLTPVSLGSFDLLRGRHVCGSLFGGLKPKLDIPILVDHYLKKELNLDSFITHELKFEEINKAFDLLVQGKSLRCILWMNK

SEQ ID NO: 7386 - protein, 245 aa, Alcaligenes latus
MAQKLAYVTGGMGGIGTSMCQRLHKDGFKVIAGCGPSRDHQKWIDEQAALGYTFYASVGNVADWDSTVAAFEKVKAEHGTVDVLVNNAGITRDGQFRKMSKADWQAVMSTNLDSMFNVTKQVIEGMLDKGWGRIINISSVNGEKGQFGQTNYSAAKAGMHGFSMALAQEVAAKGVTVNTVSPGYIATDMVKAIRQDVLDKIIATIPIRRLGTPEEIASIVAWLAGEESGFTTGADFSCNGGLHMG

SEQ ID NO: 7387 - protein, 248 aa, Pseudomonas sp.
MESRSRIAVVTGGMGGIGTSISQRLYKEGFKVIVGCSANSSRKDDWMATQLAAGYQFECVETDITDWESTRKAFEMVREHFGPIDVLVNNAGITRDASFRKLTPEDWNTVIGTNLNSLFNTSKQVIEGMLSKGWGRIINISSINGQRGQFGQTNYSAAKAGIHGFTMALAREVSGKGVTVNTVSPGYIQTDMTAAIRKDILDGMIAGIPVGRLGQPEEIASIVAWLASDESAYSTGADFSVNGGMNMQ

SEQ ID NO: 7388 - protein, 244 aa, Moritella marina
MSFSSKTVLVTGASRGIGRAIAEHFAKLGATVIGTATSAQGAERIGAYLGDAGFGLELNVTSQDSVDALYAEIKTQVGHIDILVNNAGITADNIFLRMKEDEWCNVIDTNLTSLYRLCKPCLRGMMKQRHGRIINIGSVVGTTGNGGQANYAAAKSGLLGFTKSLASEVASRGITVNAVAPGFIETDMTAELTEEQKQTILAQVPTSRLGSTTEIAETVGFLASDGASYITGETIHVNGGMYMA

SEQ ID NO: 7389 - protein, 172 aa, Butyrivibrio fibrisolvens
MESLTTRIKLNNGTAIPMFGYGTYKIKDQNEAYNSVRLALKNGYRHIDTAAFYENEKFVANAIKDFMEESQTKREDIFVTSKAWKTELGYDKTLAAFEKTMNEMQMDYLDLYLVHWPASYAFDDDWENTNRQTWKAMTEIYKSGRVKAIGVSNFLTHHLDTIIDMEVTPAVD

SEQ ID NO: 7390 - protein, 509 aa, Bacillus cereus
MWESKFVKEGLTFDDVLLVPARSDILPREVSVKTVLSESLQLNIPLISAGMDTVTEADMAIAMARQGGLGIIHKNMSIEQQAEQVDKVKRSESGVISDPFFLTPEHQVYDAEHLMGKYRISGVPVVNNLDERKLVGIITNRDMRFIQDYSIKISDVMTKEQLITAPVGTTLEEAEKILQKYKIEKLPLVDNNGVLQGLITIKDIEKVIEFPNSAKDKQGRLLVGAAVGVTADAYLRIDALVKASVDAIVLDTAHGHSKGVIDKVKEVRAKYPSLNIIAGNVATAEATKALIEAGENVVKVGIGPGSICTTRVVAGVGVPQLTAVYDCATEARKHGIPVIADGGIKYSGDMVKALAAGAHVVMLGSMFAGVAESPGETEIYQGRQFKVYRGMGSVGAMEKGSKDRYFQEGNKKLVPEGIEGRVPYKGPLADTVHQLVGGLRAGMGYCGAQDLEFLRENAQFIRMSGAGLRESHPHHVQITKEAPTTHYNVLYTNRQRFDISVYFFLIMLE

SEQ ID NO: 7391 - protein, 497 aa, Spinacia oleracea
MAFPIPARQLFIDGEWREPIKKNRIPVINPSTEEIIGDIPAATAEDVEVAVVAARRAFRRNNWSATSGAHRATYLRAIAAKITEKKDHFVKLETIDSGKPFDEAVLDIDDVASCFEYFAGQAEALDGKQKAPVTLPMERFKSHVLRQPLGVVGLISPWNYPLLMATWKIAPALAAGCTAVLKPSELASVTCLEFGEVCNEVGLPPGVLNILTGLGPDAGAPLVSHPDVDKIAFTGSSATGSKVMASAAQLVKPVTLELGGKSPIVVFEDVDIDKVVEWTIFGCFWTNGQICSATSRLLVHESIAAEFVDKLVKWTKNIKISDPFEEGCRLGPVISKGQYDKIMKFISTAKSEGATILYGGSRPEHLKKGYYIEPTIVTDISTSMQIWKEEVFGPVLCVKTFSSEDEAIALANDTEYGLAAAVFFNDLERCERITKALEVGAVWVNCSQPCFVQAPWGGIKRSGFGRELGEWGIQNYLNIKQVTQDISDEPWGWYKSP

SEQ ID NO: 7392 - protein, 500 aa, Amaranthus hypochondriacus
MAIRVPSRQLFIDGEWREPIKKNRIPIINPSTEEIIGVIPAATAEDVELAVAAARRALKRNKGEDWASASGAHRAKYLRAIAAKITEKKDYFAKLEAMDCGKPLDEAAWDIDDVAGCFEYYADQAEALDAKQKAPIALPMDTFKCHVLKQPIGVVGLISPWNYPLLMATWKVAPALAAGCSAVLKPSELASVTCLELAEVCREVGLPPGVLNILTGLGPEAGGPLACHPDVDKVAFTGSTATGSKVMSSAAQLVKPVTLELGGKSPIVIFEDVDLDKAAEWTAFGCFWTNGQICSATSRLLVHESIAAEFLDRLVKWCKNIKISDPFEEGCRLGPVVSKSQYEKVLKFISTAKSEGATILCGGSRPEHLKKGYYVEPTIISDVSTSMQIWREEVFGPVLCVKTFGSEDEAIELANDTQYGLGAAVLSKDLDRCERITKALQAGIVWVNCSQPCFCQAPWGGTKRSGFGRELGEWGIENYLNIKQVTEYISDEPWGWYKSP

SEQ ID NO: 7393 - protein, 496 aa, Haloferax volcanii
MVDDIATDADWNALYIDGEWTESESGESIAVEDPSTRETVAHVPRGTEADVDAAYEAAAEAQESWAEAPPARRQEVVEQFLQALNEYEDEIIDLLAHEVGGSRIMGETSIQIASDHASEAATLPRRMRGEHVASNIPGKENIVQKNPKGVVTVISPWNFPLNLSMRAVAPAVAAGNAVVLKPSTNSPITGGLLFAKLFEETDLPEGVVNVVTGRGSEIGDRVAGHPESDVVAFTGSTEVGKRVSGIAGENLAVPAMELGGNNAHVVTEGADVDRAADAAVFGSFVHQGQVCISINRHIVHESVYDEYVEKLTERAAELPVGSAHEDDTVVGPIIDESQRDEMLGYVEETVAAGATLETGGSTADLDGVDDSLVVQPTVLSGVTNDMAAARNEHFGPIAPVIPFSDVDEAVELANATEYGLSGSVHAGDLATGKEIALRMETGNVHVNDQPINDEAHVPFSGTGASGVGTYNSDAFLDEITEDKWISLQHEPRDYPL

SEQ ID NO: 7394 - protein, 352 aa, Arabidopsis thaliana
MAALLGRSCRKLSFPSLTHGARRVSTETGKPLNLYSAINQALHIALDTDPRSYVFGEDVGFGGVFRCTTGLAERFGKNRVFNTPLCEQGIVGFGIGLAAMGNRAIVEIQFADYIYPAFDQIVNEAAKFRYRSGNQFNCGGLTIRAPYGAVGHGGHYHSQSPEAFFCHVPGIKVVIPRSPREAKGLLLSCIRDPNPVVFFEPKWLYRQAVEEVPEHDYMIPLSEAEVIREGNDITLVGWGAQLTVMEQACLDAEKEGISCELIDLKTLLPWDKETVEASVKKTGRLLISHEAPVTGGFGAEISATILERCFLKLEAPVSRVCGLDTPFPLVFEPFYMPTKNKILDAIKSTVNY

SEQ ID NO: 7395 - protein, 407 aa, Neurospora crassa
MRGSTIRPKAQCLRSLSKGLTKRPSAGLRSVPVAATLAPSLPSQRAYSTHPPHAKLNLPTDYSTTPLLAQTSQSALNNPELSPEVRNGPTKRMNMFQAVNDALSVALAQDESVLIFGEDVAFGGVFRCTGKLADTYGADRVFNTPLCEQGIMGFAIGVAAEGMRPVAEIQFADYVYPAFDQLVNEAAKFRYRDGSCGRSAGGLTVRMPCGGVGHGGLYHTQSPESLFTHIPGLRVIMPRSPIQAKGLLLSAIRSNDPCVFMEPKILYRAAVEQVPTGSYTLPLSKAEVLKEGKDVTIISYGQPLYKCMDALQKAEKDFGVSVELIDLRTVYPWDKETVFQSVRKTGRCIVVHESMVNAGIGAEVAAAIQEDSETFVRLEAPVARVAGWSIHTPLMFEALNIPDVASE

SEQ ID NO: 7396 - protein, 334 aa, Streptomyces avermitilis
MTTVALKPATMAQALTRALRDAMAADPAVHVMGEDVGTLGGVFRVTDGLAKEFGEDRCTDTPLAEAGILGTAVGMAMYGLRPVVEMQFDAFAYPAFEQLISHVARDAQRTRGAMPLPITIRVPYGGGIGGVEHHSDSSEAYYMATPGLHVVTPATVADAYGLLRAAIASDDPVVFLEPKRLYWSKDSWNPDEPGTVEPIGRAVVRRSGRSATLITYGPSLPVCLEAAEAARAEGWDLEVVDLRSLVPFDDETVVRVGARTGRAVVVHESGGYGGPGGEIAAGITERCFHHLEAPVLRVAGFDIPYPPPMLERHHLPGVDRILDAVGRLQWEAGS

SEQ ID NO: 7397 - protein, 327 aa, Haloferax volcanii
MSSQNLTIVQAVRDGLYTEMNLDDEVLVMGEDVGKNGGVFRATEGLWDEFGDDRVIDTPLAESGIVGTAIGMAAMGLKPVPEIQFSGFMYPGFDQIVSHMGRFRNRTRGRYTLPMVLRAPYGGGIRAPESHSESKEMFYAHEAGLKVVIPSTPYDTKGLLISAIRDPDPVIFMEPKLIYRAFRGEVPEDDYTVPIGEAAVRREGTDVSVFTFGAMTRPTLEAVENLEEEGIDAEVVDIRTISPLDRETIVESFKKTGRAVVVHEAPKNGGLGAEITATVQEEALLYQEAPVKRVAGYDVPYPLYALEDYYLPSVARVEEGIREAVNF

SEQ ID NO: 7398 - protein, 567 aa, Arabidopsis thaliana
IVLVVAVLTHTASAAVREYHWEVEYKYWSPDCKEGAVMTVNGEFPGPTIKAFAGDTIVVNLTNKLTTEGLVIHWHGIRQFGSPWADGAAGVTQCAINPGETFTYNFTVEKPGTHFYHGHYGMQRSAGLYGSLIVDVAKGKSERLRYDGEFNLLLSDWWHEAIPSQELGLSSKPMRWIGEAQSILINGRGQFNCSLAAQFSNNTSLPMCTFKEGDQCAPQILHVEPNKTYRIRLSSTTALASLNLAVQGHKLVVVEADGNYITPFTTDDIDIYSGESYSVLLTTDQDPSHNYYISVGVRGRKPNTTQALTILNYVTAPASKLPSSPPPVTPRWDDFERSKNFSKKIFSAMGSPSPPKKYRKRLILLNTQNLIDGYTKWAINNVSLVTPATPYLGSVKYNLKLGFNRKSPPRSYRMDYDIMNPPPFPNTTTGNGIYVFPFNVTVDVIIQNANVLKGIVSEIHPWHLHGHDFWVLGYGDGKFKPGIDEKTYNLKNPPLRNTAILYPYGWTAIRFVTDNPGVWFFHCHIEPHLHMGMGVVFAEGLNRIGKVPDEALGCGLTKQFLMNRNRN

SEQ ID NO: 7399 - protein, 555 aa, Arabidopsis thaliana
MGFLFLFCYLLAFLGYSPVDAAVKKYQFDVQVKNISRICNAKPIVTVNGMFPGPTVYAREGDRVIINVTNHVQYNMSIHWHGLKQYRNGWADGPAYITQCPIQTGQSYLYDFNVTGQRGTLWWHAHILWLRATVYGAIVILPAPGKPYPFPQPYQESNIILGEWWNKDVETAVNQANQLGAPPPMSDAHTINGKPGPLFPCSEKHTFVIEAEAGKTYLLRIINAALNDELFFGIAGHNMTVVEIDAVYTKPFTTKAILLGPGQTTNVLVKTDRSPNRYFMAASPFMDAPVSVDNKTVTAILQYKGVPNTVLPILPKLPLPNDTSFALDYNGKLKSLNTPNFPALVPLKVDRRLFYTIGLGINACPTCVNGTNLAASINNITFIMPKTALLKAHYSNISGVFRTDFPDRPPKAFNYTGVPLTANLGTSTGTRLSRVKFNTTIELVLQDTNLLTVESHPFHLHGYNFFVVGTGVGNFDPKKDPAKFNLVDPPERNTVGVPTGGWAAIRFRADNPGVWFMHCHLEVHTMWGLKMAFVVENGETPELSVLPPPKDYPSC

SEQ ID NO: 7400 - protein, 251 aa, Azotobacter vinelandii
MFERMREDIRSVFQRDPAARNALEVLICYPGLHALWLHRLAHGLWCSDWKLLARLVSHVGRWLTGIEIHPGARIGRRLFIDHGMGVVIGETAEIGDDVTLYHGVTLGGTSWNKGKRHPTLEDGVIVGAGAKILGPFTVGAGAKIGSNAVVTRAVPAGATAVGIPGRIVARPDDEQEARRRAIAEKYGFDAIALGQNTPDPVAQAIGQLLDHLQAVDERLEGMCQALRALGSDYHAKELPALREEDFAGRQG

SEQ ID NO: 7401 - protein, 1047 aa, Arabidopsis thaliana
MVGNDWVNSYLEAILAAEPGIANSKPPGTGDSKSSLLLRERGHFSPTRYFVEEVITGFDETDLHRSWVQAAATRSPQERNTRLENLCWRIWNLARQKKQVEGKNAKREAKREREREKARREVTAEMSEDFSEGEKADLPGEIPTPSDNNTKGRMSRISSVDVFENWFAQHKEKKLYIVLISLHGLIRGENMELGRDSDTGGQVKYVVELARALGSMPGVYRVDLLTRQVTAPDVDSSYSEPSEMLNPIDTDIEQENGESSGAYIIRIPFGPKDKYVPKELLWPHIPEFVDRALSHIMQISKVLGEQIGGGQQVWPVSIHGHYADAGDSTALLSGALNVPMVFTGHSLGRDKLEQLLKQGRPKEEINSNYKIWRRIEAEELCLDASEIVITSTRQEVDEQWRLYDGFDPVLERKLRARMKRGVSCLGRFMPRMVVIPPGMEFHHIVPHDVDADGDDENPQTADPPIWSEIMRFFSNPRKPMILALARPDPKKNLVTLVKAFGECRPLRELANLTLIMGNRNDIDELSSTNSSVLLSILKLIDKYDLYGQVAMPKHHQQSDVPEIYRLAAKTKGVFINPAFIEPFGLTLIEAGAHGLPTVATINGGPVDIHRVLDNGLLVDPHDQQAIADALLKLVSDRQLWGRCRQNGLNNIHLFSWPEHCKTYLARIASCKQRHPKWQRVEFENSDSDSPSDSLRDINDISLNLKLSLDGEKSGSNNGVDTNLDAEDRAAERKAEVEKAVSTLAQKSKPTEKFDSKMPTLKRRKNIFVISVDCSATSDLLAVVKTVIDAAGRGSSTGFILSTSMTISETHTALLSGGLKPQDFDAVICSSGSELYFTSSGSEDKTALPYTLDADYHSHIEFRWGGESLRKTLIRWISSVEEKKKTKKGEILVEDESSSTNYCLSFKVKDPALMPPMKELRKLMRNQALRCNAVYCQNGARLNVIPVLASRSQALRYLLVRWGIDLSNMVVFVGDSGDTDYEGLLGGIHKTVILKGLASDLREQPGNRSYPMEDVTPLNSPNITEAKECGRDAIKVALEKLGISLLKP

SEQ ID NO: 7402 - protein, 354 aa, Neisseria meningitidis
MEKEFRILNIVSAKIWGGGEQYVYDVSKALGLRGCTMFTAVNKNNELMHRRFSEVSSVFTTRLHTLNGLFSLCALTRFIRENRISHLMIHTGKIAALSILLKKLTGVRLIFVKHNVVANKTDFYHRLIQKNTDRFICVSRLVYDVQTADNPFKEKYRIIHNGIDTDRFPPSQEKPDSRFFTVAYAGRISPEKGLENLIEACVILHRKYPQIRLKLAGHGHPDYMCRLKRDVSASGAEPFVSFEGFTENIASFYRQSDVVVLPSLVPEAFGLSLCEAMYCRTAVISNTLGAQKEIVEHHQSGILLDRLTPESLADEIERLVLNPEAKNALATAAHQCVAARFTINHTADKLLDAI

SEQ ID NO: 7403 - protein, 390 aa, Bordetella parapertussis
MLSNVPSRQSPDFAQRTPARVALLGPARSIHTIRWANGLALRGLQVHLLSLETPDLSLYDERIVQYRLPWRAPLGYFLAAPRLRALLKRIDPDLLNVHYATGYGLLARRARFSPVLLSAWGSDIYEFPNSSTWHKALLQRNLDHATALAATSHAMQREMRGLTRRPIFVTPFGIDEALSQPAQSVQAPAADGPIVIGTVKALETHYGIDTLIQAFALLRQALAASQPGMAERLVLRIYGAGSQLQRLRAQAQAAHIANQVEFKGRIPHAEVPEALRALDVYVALSRMDSFGVAILEACSCALPVVVSNADGPAEVVVDGKTGYIVAREDAHAAADRLQELVLNPELRQRLGAAGRARVLSEYTWSKSLDMMLDAYTETARLYRATQPASV

SEQ ID NO: 7404 - protein, 294 aa, Arabidopsis thaliana
MDQYEKVEKIGEGTYGVVYKARDKVTNETIALKKIRLEQEDEGVPSTAIREISLLKEMQHSNIVKYDDVVHSEKRLYLVFEYLDLDLKKHMDSTPDFSKDLHMIKTYLYQILRGIAYCHSHRVLHRDLKPQNLLIDRRTNSLKLADFGLARAFGIPVRTFTHEVVTLWYRAPEILLGSHHYSTPVDIWSVGCIFAEMISQKPLFPGDSEIDQLFKIFRIMGTPYEDTWRGVTSLPDYKSAFPKWKPTDLETFVPNLDPDGVDLLSKMLLMDPTKRINARAALEHEYFKDLGGMP

SEQ ID NO: 7405 - protein, 322 aa, Rubrivivax gelatinosus
MVTRRDAHDGPAEGSDTFEPGASPEVPEAAEAPAQVPADGEGEHGNTLQSYLRDIRRAPLMSAEEEHATAVRARAGDFAARQAMIERNLRLVVSIAKHYVGRGMPMIDLIEEGNLGLMHATGKFEPERGFRFSTYASWWIRQSIERAIMHQARLIRLPVHVVRELNQVLKARRALESARRGEAERPVSVDEVAAALQRPVEEVAELLKLAEQPTSLDMPLERESGESMLDTVADEDAIDPLGLTLSREAVHLLDNGLAELNEREREVLAGRFGLRDREPETLEELAARLGLTRERIRQIQQEALLKLKRRMVRRGVDRDALF

SEQ ID NO: 7406 - protein, 284 aa, Pseudomonas putida
MTTSLQPAYALVPGANLEAYVHTVNSIPLLTVEQERDLGERLYYEQDVEAARQMVMAHLRFVVHIARSYAGYGLAQADLIQEGNVGLMKAVKRFNPEMGVRLVSFAVHWIKAEIPEFILRNWRIVKVATTKAQRKLFFNLRSQKKRLAWLNNDEVHRVAESLGVEPREVREMESRLSGQDMAFDPAAEADDDSAFQSPAHYLEDHRYDPAVQLEDADWSDNSTSNLHEALQGWNERSRDILYQRWLAEEKATLHELADKYSVSAERIRQLEKNAMNKVKALIAV

SEQ ID NO: 7407 - protein, 304 aa, Schizosaccharomyces pombe
LLPVPHTADSAIDEWYPPGHGDVFEALTNSGIIDTLIAQGKEYLFVSNIDNLGAVVDLNILNHMVETNAEYLMELTNKTKADVKGGTLIDYDGNVRLLEIAQVPPQHVEEFKSIKKFKYFNTNNLWFHLPSVKRVVNNHELSMEIIPNKKTIKHKGENINIIQLETAAGAAIRHFKNAHGVNVPRRRFLPVKTCSDLLLVKSDLYSINHGQVEMNPRRFGGTAPLVKLGAHFKKVADFSAHIPSIPKILELDHLTITGDVNIGRNVTLKGTVIIVASDANRIDIPNGSVLENCVITGNLNILEH

SEQ ID NO: 7408 - protein, 273 aa, Arabidopsis thaliana
MAATLGRDQYVYMAKLAEQAERYEEMVQFMEQLVTGATPAEELTVEERNLLSVAYKNVIGSLRAAWRIVSSIEQKEESRKNDEHVSLVKDYRSKVESELSSVCSGILKLLDSHLIPSAGASESKVFYLKMKGDYHRYMAEFKSGDERKTAAEDTMLAYKAAQDIAAADMAPTHPIRLGLALNFSVFYYEILNSSDKACNMAKQAFEEAIAELDTLGEESYKDSTLIMQLLRDNLTLWTSDMQTNQMHHIRDIKEHVKTEITAKPCVLSYYYSM

SEQ ID NO: 7409 - protein, 271 aa, Schizosaccharomyces pombe
MSTTSREDAVYLAKLAEQAERYEGMVENMKSVASTDQELTVEERNLLSVAYKNVIGARRASWRIVSSIEQKEESKGNTAQVELIKEYRQKIEQELDTICQDILTVLEKHLIPNAASAESKVFYYKMKGDYYRYLAEFAVGEKRQHSADQSLEGYKAASEIATAELAPTHPIRLGLALNFSVFYYEILNSPDRACYLAKQAFDEAISELDSLSEESYKDSTLIMQLLRDNLTLWTSDAEYSAAAAGGNTEGAQENAPSNAPEGEREPKATHR

SEQ ID NO: 7410 - protein, 270 aa, Schizosaccharomyces pombe
MSTTSREDAVYLAKLAEQAERYEGMVENMKSVASTDQELTVEERNLLSVAYKNVIGARRASWRIVSSIEQKEESKGNTAQVELIKEYRQKIEQELDTICQDILTVLEKHLIPNAASAESKVFYYKMKGDYYRYLAEFAVGEKRQHSADQSLEGYKAASEIATAELAPTHPIRLGLALNFSVFYYEILNSPDRACYLAKQAFDEAISELDSLSEESYKDFTLIMQLLRDNLTLWTSDAEYSAAAAGGNTEGAQENAPSNAPEGEAEPKADA

SEQ ID NO: 7411 - protein, 256 aa, Lentinula edodes
MPETREDSVYLAKLAEQAERYEEMVENMKRVASSDQELTVEERNLLSVAYKNVIGARRASWRIVSSIEQKEESKGNEAQVSMIKGYREKIETELAEICEDILDVLDKHLIPSAASGESKVFYHKMMGDYHRYLAEFATGDKRKESADKSLEAYKAASDVAVTELPPTHPIRLGLALNFSVFYYEILNSPDRACHLAKQAFDDAIAELDTLSEESYKDSTLIMQLLRDNLTLWTSDMQDSADKPAEKDEAADAPADE

SEQ ID NO: 7412 - protein, 581 aa, Brassica napus
MSKQTYKVCFCFNRRFRYTASEAPRDVKTLFDKYSENGVMTVDHLQRFLIDVQKQDKATKEDAQSIINAASSLLHSNGLHLDAFFKYLFGDSNPPLALHEVHQDMDAPISHYFIFTGHNSYLTGNQLSSDCSEVPIIDALKKGVRVIELDIWPNSNKNDIDVLHGRTLTSPVELIKCLRAIKTHAFEVSDYPVVVTLEDHLTPELQSKVAEMVTEIFGEILFTPPVGESLKEFPSPNSLKRRIIISTKPPKEYKEGKDEDVVQKGKALGDEEVWGREVPSFIERNKSGDKDDLDDEEDNDEDDDVEKFKKNAPPQYKHLIAIHAGKPKGSITACLKVDPDKVRRLSLSEEQLEKAAEKYAKQIVRFTQQNLLRIYPKGTRVTSSNYNPLVGWSHGAQMVAFNMQGYGRSLWLMQGMFRANGGCGYIKKPDILLKGGSDSDIFDPKTTLPVKTTLRVTIYMGEGWYFDFRHTHFDQYSPPDFYTRVGIAGVPADTVMKKTKTLEDNWVPSWDEVFEFPLTVPELALLRLEVHEYDMSEKDDFGGQTCLPVWELQEGIRSFPLHNRKEEKYKSVKLLVKVEFV

SEQ ID NO: 7413 - protein, 605 aa, Nicotiana tabacum
MSRQTYRVCFCFRRRFRVVAAEAPADVKNLFNKYSDNGVMNAENLQRFLIEVQKEENSSIEDAQGIMNNLHDLKILNIFHRRGLHLDAFFKYLFADINPPINPKRGIHHDMNEPLSHYFIYTGHNSYLTGNQLSSDCSDVPIIQALHRGVRVIELDIWPNSAKDDVEVLHGGTLTTPVALIKCLRSIKEHAFSVSEYPVVITLEDHLTPDLQAKVAEMITQTFGDMLFSPDSCLKNFPSPGSLKRRVLISTKPPKEYLQAKEVKEKDSKKGTDAPDTEAWGREVSDLKARYNDKDDSDDGAGVEDDESDEGDPNSQQNVAPEYKCLIAIHAGKGKGGLSDWLRVDPDKVRRLSLSEQELGKAIVTHGKEIIRFTQRNLLSIYPKGIRFDSSNYNPFVAWTHGAQMVAFNMQGYGRSLWLMHGMFRSNGGCGYVKKPDILLKAGPNNQIFDPEANLPVKTTLKVTVFMGEGWYYDFNHTHFDAYAPPDFYAKIGIAGVPADNVMKKTRTLENNWIPTWDEKFEFPLTVPELALLRVEVHVYDMSEKDDFAGQTCLPVSELRQGIRAVSLHDRKGERYNSVKLLMRFDMSNSESSSFEFGTSFRYHG

SEQ ID NO: 7414 - protein, 586 aa, Nicotiana tabacum
MSRQTYRVCFCFRRRFRVVAAEAPADVKNLFNRYSDNGVMNAENLQRFLIEVQKEENASLEDAQGIMNNLHDLKILNIFHRRGLHLDAFFKYLFADINPPINPKRGIHHDMNEPLSHYFIYTGHNSYLTGNQLSSDCSDVPIIQALGRGVRVIELDIWPNSAKDDVEVLHGGTLTTPVALIKCLRSIKEHAFTVSEYPVVITLEDHLTPDLQAKVAEITQTFGDMLFSPDSCLKNFPSPESLKRRVLISTKPPKEYLQAKEVKEKDSKKGTESPDTEARGREVSDLKARYNDKDDSDDGAGVEDDESDEGDPNSQQNVAPEYKCLIAIHAGKGKGGLSDWLRVDPDKVRRLSLSEQELGKAVVTHGKEIIRFTQRNLLRIYPKGIRFDSSNYNPFVAWTHGAQMVHHMQGYGRSLWLMHGMFRSNGGCGYVKKPDILLKAGPNNQIFDPEANLPVKTTLKVTVFMGEGWYIDFKHTHFDAYTPPDFYAKIGIAGVPADNVMKKTKTLEDMDTPTWDEKFEFPLTVPELALLRVEVHEYDMSEKDDFAGQTCLPVSELRQGIRAVSLHDRKGEKYNSVKLLMRFEFV

SEQ ID NO: 7415 - protein, 913 aa, Homo sapiens
ILYPPLKQEQVQVLIEKYEPNNSLARKGQISVDGFMRYLSGEENGVVSPEKLDLNEDMSQPLSHYFINSSHNTYLTAGQLAGNSSVEMYRQVLLSGCRCVELDCWKGRTAEEEPVITHGFTMTTEISFKEVIEAIAECAFKTSPFPILLSFENHVDSPKQQAKMAEYCRLIFGDALLMEPLEKYPLESGVPLPSPMDLMYKILVKNKKKSHKSSEGSGKKKLSEQASNTYSDSSSMFEPSSPGAGEADTESDDDDDDDDCKKSSMDEGTAGSEAMATEEMSNLVNYIQPVKFESFEISKKRNKSFEMSSFVETKGLEQLTKSPVEFVEYNKMQLSRIYPKGTRVDSSNYMPQLFWNAGCQMVALNFQTMDLAMQINMGMYEYNGKSGYRLKPEFMRRPDKHFDPFTEGIVDGIVANTLSVKIISGQFLSDKKVGTYVEVDMFGLPVDTRRKAFKTKTSQGNAVNPVWEEEPIVFKKVVLPTLACLRIAVYEEGGKFIGHRILPVQAIRPGYHYICLRNERNQPLTLPAVFVYIEVKDYVPDTYADVIEALSNPIRYVNLMEQRAKQLAALTLEDEEEVKKEADPGETPSEAPSEARTTPAENGVNHTTTLTPKPPSQALHSQPAPGSVKAPAKTEDLIQSVLTEVEAQTIEELKQQKSFVKLQKKHYKEMKDLVKRHHKKTTDLIKEHTTKYNEIQNDYLRRRAALEKSAKKDSKKKSEPSSPDHGSSTIEQDLAALDAEMTQKLIDLKDKQQQQLLNLRQEQYYSEKYQKREHIKLLIQKLTDVAEECQNNQLKKLKEICEKEKKELKKKMDKKRQEKITEAKSKDKSQMEEEKTEMIRSYIQEVVQYIKRLEEAQSKRQEKLVEKHKEIRQQILDEKPKGEGSSSFLSETCHEDPSVSPNFTPPNPQALKW

SEQ ID NO: 7416 - protein, 434 aa, Arabidopsis thaliana
MKKMKDSVLFLVVGLFSLSVLVSQSIAGRVKAPLLQSNTGGLVFSKSFNSIYDTSMYGRLQLNNGLARTPQMGWNSWNFFACNINETVIKETADALVSSGLADLGYIHVNIDDCWSNLLRDSEGQLVPHPETFPSGIKLLADYVHSKGLKLGIYSDAGVFTCEVHPGSLFHEVDDADIFASWGVDYLKYDNCFNLGIKPIERYPPMRDALNATGRSIFYSLCEWGVDDPALWAKEVGNSWRTTDDINDTWASMTTIADLNNKWAAYAGPGGWNDPDMLEIGNGGMTYEEYRGHFSIWALMKAPLLIGCDVRNMTAETLEILSNKEIIAVNQDPLGVQGRKIQANGENDCQQVWSGPLSGDRMVVALWNRCSEPATITASWDMIGLESTISVSVRDLWQHKDVTENTSGSFEAQVDAHDCHMYVLTPQTVSHSDV

SEQ ID NO: 7417 - protein, 262 aa, Hordeum vulgare
MSTAEATREENVYMAKLAEQAERYEEMVEFMEKVAKTADVGELTVEERNLLSVAYKNVIGARRASWRIISSIEQKEESRGNEAYVASIKEYRTRIETELSKICDGILKLLDSHLVPSATAAESKVFYLKMKGDYHRYLAEFKAGAERKEAAENTLVAYKSAQDIALADLPTTHPIRLGLALNFSVFYYEILNSPDRACNLAKQAFDEAIAELDSLGEESYKDSTLIMQLLRDNLTLWTSDNAEEGGDEIKEAASKPEGEGHS

SEQ ID NO: 7418 - protein, 220 aa, Spinacia oleracea
RNLLSVAYKNVVGARRASWRIISSIEQKEESRGNEDHVSVIRDYRSRIEKELSDNCDGILKLLDTKLVPAASSGDSKVFYLKMKGDYHRYLAEFKTGAQRKEAAESTLTAYKAAQDIANAELAPTHPIRLGLALNFSVFYYEILNSPDRACNLAKQAFVEAIAELDTLGEDSYKDSTLIMQLLRDNLTLWTSDMQDEAADEITEEAAKQQKAVNNNKIAY

SEQ ID NO: 7419 - protein, 235 aa, Xenopus laevis
AKLSEQAERYDDMAASMKAVTELGAELSNEERNLLSVAYKNVVGARRSSWRVISSIEQKTEGNDKRQQMAREYREKVETELQDICKDVLDLLDRFLVPNATPPESKVFYLKMKGDYYRYLSEVASGDSKQETVASSQQAYQEAFEISKSEMQPTHPIRLGLALNFSVFYYEILNSPEKACSLAKSAFDEAIRELDTLNEESYKDSTLIMQLLRDNLTLWTSENQGEEADNVEGDN

SEQ ID NO: 7420 - protein, 245 aa, Ovis aries
MDKNELVQKAKLAEQAERYDDMAACMKSVTEQGAELSNEERNLLSVAYKNVVGARRSSWRVVSSIEQKTEGAEKKQQMAREYREKIETELRDICNDVLSLLEKFLIPNRSQPESKVFYLKMKGDYYRYLAEVAAGDDKKGIVDQSQQAYQEAFEISKKEMQPTHPIRLGLALNFSVFYYEILNSPEKACSLAKTAFDEAIAELDTLSEESYKDSTLIMQLLRDNLTLWTSDTQGDEAEAGEGGEN

SEQ ID NO: 7421 - protein, 300 aa, Asterina pectinifera
MEDYSKIEKIGEGTYGVVYKGRCKKDGSIVALKKIRLESEEEGVPSTAIREISLLKELQHPNVVNLSNVLMQESRLYLVFEFLTMDLKKYMETLRGTTMDPALVKSYLHQIVQGILFCHCRRVLHRDLKPQNLLIDEKGIIKLADFGLARAFGIPVRVYTHEVVTLWYRAPEVLLGSPRYSTPVDVWSIGCIFAEMVTKRPLFHGDSEIDQLFRIFRTPGTPTDKTWPGVTELPDHKSTFPKWTTNNLAKSVKTLTLRNDLLQKMLIYDPAKRISCKAALSHPYLKDFEGGTVLPTRLGQ

SEQ ID NO: 7422 - protein, 193 aa, Daucus carota
MKLSKSTLVFSALLVILAAASAAPANQFIKTSCTLTTYPAVCEQSLSAYAKTIQNNPQELASTALQVSLTRTQQAQTFMKRLNKFKGLKARQYAAIHDCLEEVEDSLDRVSRSCDEMKNLSHAKGNDFTFRMSNVETWVSAALTDETTCMDGFAGKGMDGKIKESVRAQVVAVARVTSNALALVNNFAAKHKH

SEQ ID NO: 7423 - protein, 255 aa, Streptomyces exfoliatus
MNDLSGKTVIITGGARGLGAEAARQAVAAGARVVLADVLDEEGAATARELGDAARYQHLDVTIEEDWQRVVAYAREEFGSVDGLVNNAGISTGMFLETESVERFRKVVDINLTGVFIGMKTVIPAMKDAGGGSIVNISSAAGLMGLALTSSYGASKWGVRGLSKLAAVELGTDRIRVNSVHPGMTYTPMTAETGIRQGEGNYPNTPMGRVGNEPGEIAGAVVKLLSDTSSYVTGAELAVDGGWTTGPTVKYVMGQ

SEQ ID NO: 7424 - protein, 389 aa, Chlamydomonas reinhardtii
MADPGAQPVPAPQSAEEPVTGGLQESVEVTASGKLDSYNREYNQFLVCGSLFECPAKYLPIKPIGKGAYGVVCSAKNLDNQEKVAIKKIANAFDNVIDAKRTLREIKLLRHLQHENIVQIKDIIPPTNRDAFKDLYVVYELMDTDLHQIIRSPQALSNDHSQYFLYQLLRGLKYIHSANILHRDLKPSNLLVNANCDLKICDFGLARTSTSNEREFMTEYVVTRWYRAPELLLSCSGYTTAIDVWSVGCIFAELLGRKPLFPGKDYVHQLSLITKVIGSPSEEELGFITSEKAKRYIRSLPRSERVDFGQLWPHVTKTALDLIDKMLVFDPTKRITVEQALEHPYLASLHDVSDEPVCPTPFTFDFDSEHLTPDVVREVILQDMAELHT

SEQ ID NO: 7425 - protein, 416 aa, Saccharomyces kluyveri
FACDVSEDLLLGTSEKIVKWGLKDLGYKYVVLDDCWSSGRNSSGYLVPDSKKFPRGMKHVGDSLHDEGLLFGMYSSAGEYTCAGYSGSLGHEEADAAAFASWGVDYLKYDNCYNQGNYGTAQLSYERYKAMSDALNKTGKNIYYTLCNWGEDSPWHWASAIANSWRISGDVYAHFDRPDSRCPCDGDEYYCHLAGFDCSIMNILNKAAPLGQKAGPGGWNDLDSLEVGVGNMTDEEEKTHFSMWAAVKSPLVIGANLNSLDAKSFSIYVNPAIIAVNQDPAGVPATRVWRYYVSDTDEYGQGEIQLWSGPLDNGDQIVALVNAGSNPRPMNATLADVFFDSGADSKKLSSSWGIYDLWANRLSEEAAESIISGNSTASGKLYNATDLSYGEGIAKNDTRLFGTKVGRVEAFGAIET

SEQ ID NO: 7426 - protein, 416 aa, Saccharomyces kluyveri
FACDVSEDLLIGTSEKIVKWGLKDLGYNYVILDDCWSEGRNSSNYLIPDSKKFPRGMKHVADSLHSEGLLFGMYSSAGEYTCAGYSGSLGREEADAAAFASWDVDYLKYDNCYNQGNYGTAQLSYERYKAMSDALNKTGRPIYYSLCNWGEDSPWHWASAIANSWRISGDIYADFDRPDSRCPCNGDEYYCHLAGFHCSIMNILNKAAPLGQKAGPGGWNDLDALEVGVGNMTDEEEKTHFSMWAAVKSPLVIGANLNTLDAKSFSIYVNPAIIAVNQDAAGTPVMRVWRYYVSDTDEHGQGEIQLWSGPLDNGDQIVALLNAGSKDRPMNATLEDIFIDSGADSEKLSSSWAIYDLWANRLDEDTAKDIINGNSTAEGKLYNATELPYTEGIAKNDTRLFGTKVGTVKPFGSIET

SEQ ID NO: 7427 - protein, 410 aa, Sus scrofa
MVLSQRQRDELNRAIADYLRSNGYEEAYSVFKKEAELDMNEELDKKYAGLLEKKWTSVIRLQKKVMELESKLNEAKEEFTSGGPLGQKRDPKEWIPRPPEKYALSGHRSPVTRVIFHPVFSVMVSASEDATIKVWDYETGDFERTLKGHTDSVQDISFDHSGKLLASCSADMTIKLWDFQGFECIRTMHGHDHNVSSVAIMPNGDHIVSAARDKTIKMWEVQTGYCVKTFTGHREWVRMVRPNQDGTLIASCSNDQTVRVWVVATKECKAELREHEHVVECISWAPESSYSSISEATGSETKKSGKPGPFLLSGSRDKTIKMWDVSTGMCLMTLVGHDNWVRGVLFHSGGKFILSCADDKTLRVWDYKNKRCMKTLNAHEHFVTSLDFHKTAPYVVTGSVDQTVKVWECR

SEQ ID NO: 7428 - protein, 248 aa, Schizosaccharomyces pombe
PKYRLVVRFSNRFVTCQIVSSRVNGDYVLAHAHSSELPRYGIKWGLANWTAAYATGLLVARRALAKVGLADKYEGVTEPEGEFELTEAIEDGPRPFKVFLDVGLKRTSTGSRVFGAMKGASDGGLFIPHSPNRFPGFDIETEELDDETLRKYIYGGHVAEYMEMLIDDDEERYQKQFSGLIADGIESDQLEDIYAEAYAKIREDPSFQKSGKDAAAFKAESLKYTQRKLTAEERKERFNAKVIEAGRA

SEQ ID NO: 7429 - protein, 376 aa, Schizosaccharomyces pombe
IMAASRNVAMMVVGRFIVGYGIGLTSLIVPMYITELAPARLRGRLVIIYVVFITGGQLIAYSLNAAFEHVHQGWRIMFGIGAAPALGQLISLFWTPESPRYLLRHHHVEKVYKILSRIHPEAKPAEIAYKVSLIQEGVKVDFPEGNKFQHFFHSLKVLFTVPSNRRSLFIGCFLQWFQQFSGTNAIQYFSAIIFQSVGFKNSISVSMVVGATNFVFTIVAFMFIDRIGRRRILLCTSAVMIAGLALCAIAYHFLPADTTQNTHSGWQYVVIASIIIFLASYASGIGNIPWQQAELFPMEVRALGAGFSTAINWVGNLIISASFLTMMESITPTGTFALFAGFCFVGLVTSYFTYPELAGMFIENIHKLLEKGFWQA

SEQ ID NO: 7430 - protein, 518 aa, Pichia angusta
MLRTSLRSLAKPASRVSLRYYSSYPLSTTVTLPNGKSYEQPTGLFINNEFVPSKQHKTFEVINPATEEEICHVYEARKEDVDVAVDAAEKAFKGSWSTADPAIRGKALWNLAELLEAHKDTLAAIESLDNGKALQLAQGDVALVINYIRSCAGWADKLTGQYIDTGDTHHTYTKREPIGVCGQIIPWNFPLLMWSWKVGPALAAGNTVVLKTAESTPLSALYASQLVKEAGIPAGVVNIVSGFGKITGDAIASHPKIKKLAFTGSTATGRHIMKVAADSNLKKVTLELGGKSANIVFDDADVKTAISALVAGIFYNSGEVCSAGSRVFVQEGIYEEILREFKAAAETLKVGDPFDLSTFQGAQTSQMQLNKILGYVDIAHQEGGRLITGGERLGNKGFFVKPTIFADVTPDMRAYKEEIFGPFAVITPFKTADEVIELANDSEYGLAAGVHTKSLDTATYVSNKLEAGSVWINTYNDFHQMVPFGGYKQSGIGREMGAQALDNYTQWKAVRIGLQKPT

SEQ ID NO: 7431 - protein, 262 aa, Arabidopsis thaliana
MGRGRVELKRIENKINRQVTFAKRRNGLLKKAYELSVLCDAEVALIIFSNRGKLYEFCSSSNMLKTLDRYQKCSYGSIEVNNKPAKELENSYREYLKLKGRYENLQRQQRNLLGEDLGPLNSKELEQLERQLDGSLKQVRSIKTQYMLDQLSDLQNKEQMLLETNRALAMKLDDMIGVRSHHMGGGGGWEGGEQNVTYAHHQAQSQGLYQPLECNPTLQMGCCFGDDDDDDRYDNPVCSEQITATTQAQAQQGNGYIPGWML

SEQ ID NO: 7432 - protein, 435 aa, Mycobacterium leprae
MCSWLAPGTSQPVAPLPCCHTDLHRPIELGARSGQLTTRRAERTSSHLHSAVMSRTDRNAADLKSAVSTALAKVIDPELQRPITELGMVKNIDIEPGGNVQVGIYLTIASCPKKSEISKRVTKAIADVPGTAAVEVSLDVMSDEQRTKLRKKLRGDAREPMIPFAQPNSLTRVYTVASGKGGVGKSTVTVNLATAIAARGLAVGVLDADIHGHSIPRMMGSNQRPIQLESMILPPIVHEVKVISIGQFTEGNTPVIWRGPMLHRALQQFLSDVYWGDLDVLMLDLPPGTGDIAISVAQLIPNAEILVVTTPQLAAAEVAERAGSIALQTRQRIVGVVENMSGLMMPDGSRLQVFGEGGGQQVAERLSRAVGTDVPLLGQIPLDPALVAAGDSGIPIVLNASDSPVGKELLRIADGLSSRQRRLAGVSLGLDPSRR

SEQ ID NO: 7433 - protein, 105 aa, Rhodobacter sphaeroides
MTNPTPRPETPLLDRVCCPADMKALSDAELERLADEVRSEVISVVAETGGHLGSSLGVVELTVALHAVFNTPTDKLVWDVGHQVLPPQDPHRPARADAHPAPEGR

SEQ ID NO: 7434 - protein, 508 aa, Pichia angusta
MQLSTLWEPPIVNPRNLKATSIPIFNLWNVYGRNFFFGWFGFFVCFLSWFAFPPLLHGMLKKDLRLTAVDISNNNICGLTGTLLGRFILGPLNDKYGPRITLTGVLVAGAIPTAFVPLVTNVAGLHAIRFFISFLGSSFICCSQFCAVFFDNNIIGTANAISAGWGNAGGGVAFFVMPAISNALENRGYSLHHSWSYSFVIGPFLILMITAILIFVFGSDCPRGRWSLRGDILGINMDNMLVKSVSVTRHFSKEGELTSVFVEPVNAIDKVVVEPNQDQEILEVADIINGDEIIEDPSLNDVVKICLSPRTMLVGLCYMCSFGTELAVESIISNLFGQKMTNWSTSKAGAWGSMLGLLNVVARPAGGIISDFLYQRFKTTKAKKFWMIFTGLMQGIFLIWIGLVPELSIAGLIVSVSFLCLWFEMGNGANYACVPVVNRHHSGIVSGVTGAMGNLGGILFSLVFRYTISNGVNNYFKAFWIIGIVCTAVNLVCVLIPIREERPRKAEN

SEQ ID NO: 7435 - protein, 351 aa, Schizosaccharomyces pombe
TFSLPLLQSFIMSSYILFGLENPLLDYYVGGETATLEKYGLKSNDAVLASESQMGIYKEPCVSYSAGGAAQNSCRAAQYVLPPNSTVFAGCVGQDKFADMLLESNEKAGLRSEFSVDPTTPTGVCAVVLSNNNKNRSLCTNLGAANNYKLKDLQQPNVWKFVEEAKVIYVGGFHLTVSPESMLCLAQHANENNKPYIMNLSAPFLSQFFKEQMDSVIPYCDYVIGNEAEILSYGENHGIKSTDVQEIALALSSVEKVNKKRTRVVVITQGADATIVAKDGKVTTYKPNRVPSEEIVDTNGAGDAFAGGFIAALSQGQGIDYAVTLGHWLGQECIKVSGTTLPLPKKQFPLP

SEQ ID NO: 7436 - protein, 619 aa, Arabidopsis thaliana
MAMEVGEMSQPEATASLLSLASATQQPYVSELLSFTLDRLHKEPELLRVDAERIQRQMQEVAVGNYRAFITAADALLAIRQEVSSIDKHLESLILKLVEVGGVRGIVFGAFNSFGIGEVPKLTSGCTEFIDSAENILEKRKMNQALLANHSTLLDLLEIPQLMDTQSLADLLPGVSNFWMCTYLFKMICVFVRCVRNGNFDEALDLEAFVSKLATLHPKLPVIQALAAEVRQTTQSLLSQLLQKLRSNIQLPECLRIIGYLRRIGVFGEYEMRLQFLRCREAWLTGILEDLDQKNAYEYLKGMINCHRMHLFDVVNQYRAIFSDDTSGSEENYDGGLLFSWAMHQITSHLKTLKIMLPKITEGGSLSNILDQCMYCAMGLGGVGLDFRGLLPPLFEEAVLNLFSKNMSTAVENFQLVLDSHRWVPLPSVGFPSSGINEDSKDDVTPPSYLMEHPPLAVFINGVSSALNELRPCAPLSLKNVVAHELIKGLQAVSDSLLRYNTTRMLRLSESNLFLSLCRAFVEVVFPHCATCFGRCYPGGATIVMDAKSAYEGLGRILAASSSQEPSNKSPKVISTDTKDASENGVASQPEEKQAENPNAKEEDNSPIPLQTPEITPES

SEQ ID NO: 7437 - protein, 168 aa, Arabidopsis thaliana
MATATYPPPPPYYRLYKDFSENTDSAPEPPPPIEGTYVCFGGNYTTEDVLPSLEEQGVPQLYPKDSNLDYKKELRSLNRELQLHILELADVLVDRPSQYAKRIGEISSIFKNLHHLLNSLRPHQARATLIHIMELQIQQRKQAVEDIKRRREEAQGLLKDAFVTLDGQ

SEQ ID NO: 7438 - protein, 412 aa, Arabidopsis thaliana
MERLISHPPLMIVSDLDHTMVDHQDHENLSLLRFNSLWEYAYRRDSLLVFSTARSPVLYKELRKEKPLLTPDIIITSIGTEIAFGNSMVPDHAWVESLNSCKWNREIVLEETSKFPELTLQPKTEQRLHKVSFYIDEGKGEALTKELSQLLEKRGLDVKIIYSWGKNVDVIPRGAGKGEALEYLLKKLQAEGIFPVNTLACGDSEHDAELFSIPDVHGVMVSNSQEELLKWRSENALNNLKVIHSTERCADGIIQAIGHFNLGPDLSPRDVSEFLDRKMDNVNPGHEVVRFYLFYERLRRGEIKNYETYIASFKDSCAEKSLRDTIDELKKCYGDKRGKKFWVWVDQVLVTDTIPGKWIVKFDKWEQCEDESQCCKTTVEFTSKGGDLVWEKVKQIWSEESKVKDDNSSWIL

SEQ ID NO: 7439 - protein, 410 aa, Arabidopsis thaliana
MDRLEGPPRLILVADLDCTLVDHDDPENNDLLRFNALWEAHYRHDSLLVYCTGRSFSSYSSLRKKRPLLTPDIAVTSVGSEIVYGGGESTVSDVVWTARLDYKWNRDIVVEETLKFPKLEPQPDKSQEEHKVSFFVGREDAVEIMKVLPGILEERGVDVKLVYSNGYAFDVLPRGAGKQGALTYLLDKLDIEGKQPSNTLVCGDSGNDAELFNISDVYGVMVSNSHEELLQWYEENAKDNPKIFHASERCGAGMIEAIQRFNLGPNVSPRDVMDTENFHGESLNPAHEVVQFYLFYERWRCGEVEKSDKYLQNLKSLSSPLGIFVHPSGVEKPIHEWIDEMENLYGDGKEKKFRIWLDNVTSSHISSDTWLAKFVKHELSGYTVEVCFHVLMSSSCLQREKYGLVQQKSY

SEQ ID NO: 7440 - protein, 413 aa, Arabidopsis thaliana
METPGASHDSFRGSPRRNSILSASNIIQAPISTLLEYSGLFRARPSPSHEAETLVSDDSSGLSNGEVAIRIIGNTEQDAETDTNALREPGHSELLGSSATQVDPMGGASEGASQAAPGDPAAGDAASRDSPYQRYDIQQAARWIEQILPFSLLLLVVFIRQHLQGFFVAIWIAAVMFKSNDILKKQTALKGERHISALIGISVAFTAHVVGVYWWFRKDDLLYPLIMLPPKSIPPFWHAIFIIVYPVGSFGAYSLVPIFLRYTCPAGLNDFQGQLLTLVEYFMLLYRSLLPTPVWYRFFLNKDYGSLFSSLMTGLYLTFKLTSVVEKLREIGNEIQVQSFFTALKALSRKEVHYGSYATTEQATCVPSARRRCTPQFFFAANTCFAKIAFQSGEVFLHIAIIFVYEYLDVERM

SEQ ID NO: 7441 - protein, 262 aa, Arabidopsis thaliana
MELHEISKLDNKKHPERIVESKMKKRMKPYSLTSLNNLDDGCLMHILSFLSPIPVCFNAVLCISCEFADRYNTALVCHRWRYLACHPRLWLRVDRFVKDLSQPGVFLNIESAVSAARPGDTILIVAGGNYRVSNIQIKKPLCLVGGGEIPDETTLVCARGSDRSGRLTIDGCVLQCETNPLDHLSCPIVSTAGDEDIENILSHVEVKETVTGKIKANSVTVLQTRIEGGAKAVSTRGDLVLQRVRVMYSKAYLYFWFDVDYE

SEQ ID NO: 7442 - protein, 417 aa, Pisum sativum
MEFDTIPQEAMWQMNLRSSETMESGPYPEHPGEPDCSYYIRTGLCRFGATCRFNHPPNRKLAIATARMKGEFPERLGQPECQYYLKTGTCKFGATCRFHHPKDKAGVAGRVALNILGYPLRPNESERAYYLRTGQCKFGNTCKFHHPQPSNMVLSMRGSTVYPTVQSPTTPGQQSYAAGITNWSSSSYVPSPRWQGPSSYAPLILPQGVVSVPGWSTYGGQMGSESPQQTMRNDQTYGTSHQGELENAGLQGAYSQYRSGSVPVGFYALQRDNIFPERPDQPECQFYMKTGDCKFGAVCRFHHPRERQIPAPDCVLSPIGLPLRPGEPLCVFYSRYGICKFGPSCKFDHPMGIFTYNVASPLADTPGRRLLGSSSGTAALSLSSEGLVESGTAKPRRLSLSETRPIPPGDDNIDDEG

SEQ ID NO: 7443 - protein, 424 aa, Arabidopsis thaliana
MDFNAGVPMSSLSPLMNQDAMWQMNLSSDETMETGSYPERPGEPDCSYYIRTGLCRFGSTCRVNHPRDRELVIATARMRGEYPERIGHPECEYYLKTGTCKFGVTCKFHHPRNKAGIAGRVSLNMLGYPLRSNEVDCAYFLRTGHCKFGGTCKFNHPQPQPTNMMVPTSGQQSYPWSRASFIASPRWQDPSSYASLIMPQGVVPVQGWNPYSGQLGSVSPSGTGNDQNYRNLQQNETIESGSQSQGSFSGYNPGSSVPLGGYYALPRENVFPERPGQPECQFYMKTGDCKFGTVCKFHHPRDRQAPPPDCLLSSIGLPLRPGEPLCVFYTRYGICKFGPSCKFDHPMRVFTYDNTASETDEVVETSTGKSRRLSVSETRQAATTSSGKDTTIDIHSSEGNKGRRRRAFKQEKNKSFLIFQKRNL

SEQ ID NO: 7444 - protein, 315 aa, Arabidopsis thaliana
MDVTDDEEIHQDRHSYASVSKHHHTNNNTTNVNAAASGLLPTTTSVHELLECPVCTNSMYPPIHQCHNGHTLCSTCKARVHNRCPTCRQELGDIRCLALEKVAESLELPCKHMSLGCPEIFPYYSKLKHETVCNFRPYSCPYAGSECSVTGDIPFLVAHLRDDHKVDMHSGCTFNHRYVKSNPREVENATWMLTVFHCFGQYFCLHFEAFQLGMAPVYMAFLRFMGDETEARNYNYSLEVGGYGRKLIWEGTPRSVRDSHRKVRDSHDGLIIQRNMALFFSGGDRKELKLRVTGRIWKEQQQSGEGGGACIPNLS

SEQ ID NO: 7445 - protein, 336 aa, Gossypium hirsutum
MESDTIECVSSIDEIVEDHEIPHHNLLHHPHPRHAPHHQFSSSKPHHNGTNNVNSISNIVGPTAIAPAASVHELLECPVCTNSMYPPIHQCHNGHTLCSTCKIRVHDRCPTCRQELGDIRCLALEKVAESLELPCKYYKLGCPETFPYYSKLKHEGICIYRPYNCPYAGSECSVVGDIPFLVAHLRDDHKVDMHTGCTFNHRYVKSNPREVENATWMLTVFHCFGQYFCLHFEAFQLGMAPVYMAFIRFVGDETEARNYSYSLEFGANGRKLIRKSAPRSIRDSHRKVRDSHDGLIIQRNMALFFSGGDRKELKLRVTGRIWKEQQNPDANMCIPN

SEQ ID NO: 7446 - protein, 315 aa, Vitis vinifera
MEIDSIECVSSTDGIYEEEIHHHHHQFSSSSKPHSNVVSPAISPATSVHELLECPVCTNSMYPPIHQCHNGHTLCSTCKSRVHNRCPTCRQELGDIRCLALEKVAESLELPCKYCSLGCPEIFPYYSKLKHEAQCNFRPYNCPYAGSECAVVGDIPFLVSHLRDDHKVDMHTGCTFNHRYVKSNPREVENATWMLTVFNCFGQYFCLHFEAFQLGMAPVYMAFLRFMGDEIEARNFSYSLEVGANGRKLIWEGTPRSIRDSHKKVRDSHDGLIIQRNMALFFLWWGQEGAEASGHRTNMEGTTKSRCRGVHTQSL

SEQ ID NO: 7447 - protein, 315 aa, Vitis vinifera
MAPGGSTYKEVLESHSTVTDYDIAMTKADTNLTPAKTTAGLSGKKGISSPNGVHELLECPVCTSLMYPPIYQCPSGHTLCSNCKSRVHNCCPTCRHELGDIRCLALEKVAESLELPCRYQSLGCHDIFPYYSKLKHEQQCRFHPYNCPYAGFECSVTGDIPTLVEHLKGDHKVDMHDGCTFNHRYVKSNPQEVENATWMLTVFNCFGKQFCLHFEAFQLGTAPVYMAFLRFMGDDNEAKKFSYSLEVGGNSRKLIWQGVPRSIRDSHRKVRDSQDGLIIQRNLALYFSGGDRQELKLRVTGRIWKESELWKDNGC

SEQ ID NO: 7448 - protein, 446 aa, Arabidopsis thaliana
MSQRWSRKKSRLPLAGLLFILVVTFMILFNERSIQQIHHHAASHTQNLREPSTFDFVKPNVPRINYLGAHEVLDRFSKCNSTKEYSGKKIGWVDPFEDHPGQVTKEEQKCDVFSGKWVFDNSSSYPLHKESQCPYMSDQLACQKHGRKDLEYQHWRWQPHACNLKRWNAIEMWEKLRGKRLMFVGDSLNRGQWISMVCLLQSVIPRDKQSMSPNAHLTIFRAEDYNATVEFLWAPLLVESNSDDPVNHRLSERIIRPDSVLKHASKWQHADILIFNTYLWWRQDSVKLREEKGSCEEVKSAEGMEMAMDSWGDWVANNVDPNKKRVFFVTMSPTHQWSREWNPGSEGNCYGEKKPIEEESYWGSGSDIPTMRMVKRVLERLGPKVSVINITQLSEYRKDGHPSVYRKFWEPLNEDRLKNPASYSDCTHWCVPGVPDVWNQLLFHFL

SEQ ID NO: 7449 - protein, 215 aa, Neurospora crassa
MDDFVPTLDLKVKWSHGIKASLGNTLKPKDLQDPPSIRLKDLVASTACLRHSSTSLVIVITDPDAPSRDDPKWSEFCHWIAVGPLVTADCPISDEQTQIHGCCSSDSLGTLEDIVSYTPPAPPEKTGKHRYVILALAPVNGTSEKLHLSKPKERKRWGYDKAVHGKTHGVREWAVENGLVPFGKSWTQTERSMDFLGLTLSYTAANFIYAQNKKQ

SEQ ID NO: 7450 - protein, 338 aa, Ralstonia eutropha
MARKLSIKLAINEAIDQEMTRDPSVIMLGEDIVGGAGADGEKDAWGGVLGVTKGLYAKHGDRLLDTPLSESAYVGAAIGAAACGMRPIAELMFIDFMGVCFDQIFNQAAKFRYMFGGKAETPVVIRAMVGAGFRAAAQHSQMLTPLFTHIPGLKVVCPSTPYDTKGLLIQAIRDNDPVIFCEHKNLYGLEGEVPEGAYAIPFGEANIVRDGKDVSIVTYGLMVHRALEAAATLAKEGIEAEIVDLRTLSPLDMDTVLESVENTGRLVVVDEASPRCNIATDISAQVAQQAFGALKAGIEMVCPPHTPVPFSPTLEDLYIPSAAQIAAAARKTMKGGKH

SEQ ID NO: 7451 - protein, 273 aa, Streptomyces antibioticus
MNQPWPATRADRPNICREGARMSLGADTVAIVTGAGRGIGAATAQRLAAEGATVAVVDRTEADTADTVASIRAAGGRALGIGCDVTVTDLVEAAVDRTVAEFGRLDVLVNNAGVTRDSLVFMMGDEDWDTVIDVHLNGAARTVRAARRQMVRQGSGRIVNLSSIAALGNQGQANYATAKAAIQGYTRTLAVELGPHGITVNAIAPGFIATTMTDDTARRMGSDPVALRKAVASRVPMRRVGRPEDIAGLVAFLAGPDASYLTGQTIYVDGGPQ

SEQ ID NO: 7452 - protein, 508 aa, Equus caballus
MWELLAFLLLAIAYFFRPKVKCPGAKYPKSLPYLPLVGSLPFLPRHGHPHVNFFKLQKKYGPIYSLRMGTKTTVMVGHYQLAKEVLIKKGKEFSGRPQVATLNILSDNQKGVAFADHGAPWQLHRKLVRAAFALFKDGNQKLEKIICHETSLLCDLLATQNGQTIDLSSPLFLAVTNVICWICFNSSYMKGDPALETMQNYHKGILETLEKDNVVDIFPALKIFPNKSLEKMRHCVNIRNELLSKIFEKHKENFNSDSITSMLDLLIQAKKNSDNNNTGPDQDSKLLSDKHILATIGDIFGAGVETTTSVVKWIVAFLLHDPQLKKKIQEEIDQNVGFSRTPTLSDRNRLLLLEATIREVLRIRPVAPMLIPHKALVDSSIGEFAVDEGTNVIINLWALHHNEKEWHQPDRFMPERFLDPTGSQLISPSLSYLPFGAGPRSCIGELLARQELFLFTAWLLQRFNLEVPDDGQLPSLEGHPTAVFLIDSFKVKINVRQAWREAQAEGST

SEQ ID NO: 7453 - protein, 376 aa, Gallus gallus
MSTVGKVIKCKAAVLWEANKPFSLEEVEVAPPKAHEVRIKIVATGICRSDDHVVTGALAMPFPIILGHEAAGVIESVGEKVTSLKPGDAVIPLFVPQCGECRSCLSTKGNLCIKNDLSSSPTGLMADGTTRFTCKGKAIHHFVGTSTFTEYTVVHETAAAKIDSAAPLEKVCLIGCGFSTGYGAVLQTAKVEAGSTCAVFGLGGVGLSVVMGCKAAGASRIIAVDINKDKFAKAKELGATECINPKDFKKPIHEVLTEMTGQGVDYSFEVIGRIETMTAALASCHNNYGVSVIVGVPPAAQKISFDPMLIFSGRTWKGSVFGGWKSKDAVPKLVADYMKKKFVLDPLITHTLPFTKINEGFDLLRTGKSIRSVLVL

SEQ ID NO: 7454 - protein, 379 aa, Hordeum vulgare
MATAGKVIKCKAAVAWEAGKPLTMEEVEVAPPQAMEVRVKILFTSLCHTDVYFWEAKGQIPMFPRIFGHEAGGIVESVGEGVTDVAPGDHVLPVFTGECKECPHCKSAESNMCDLLRINTDRGVMIGDGKSRFSIGGKPIYHFVGTSTFSEYTVMHVGCVAKINPEAPLDKVCVLSCGISTGLGASINVAKPPKGSTVAIFGLGAVGLAAAEGARIAGASRIIGVDLNAVRFEEARKFGCTEFVNPKDHTKPVQQVLADMTNGGVDRSVECTGNVNAMIQAFECVHDGWGVAVLVGVPHKDAEFKTHPMNFLNERTLKGTFFGNFKPRTDLPNVVEMYMKKELEVEKFITHSVPFSEINTAFDLMAKGEGIRCIIRMDN

SEQ ID NO: 7455 - protein, 379 aa, Zea mays
MATAGKVIKCKAAVAWEAGKPLSIEEVEVAPPQAMEVRVKILFTSLCHTDVYFWEAKGQTPVFPRIFGHEAGGIIESVGEGVTDVAPGDHVLPVFTGECKECAHCKSAESNMCDLLRINTDRGVMIADGKSRFSINGKPIYHFVGTSTFSEYTVMHVGCVAKINPQAPLDKVCVLSCGYSTGLGASINVAKPPKGSTVAVFGLGAVGLAAAEGARIAGASRIIGVDLNPSRFEEARKFGCTEFVNPKDHNKPVQEVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFAEINKAFDLMAKGEGIRCIIRMEN

SEQ ID NO: 7456 - protein, 376 aa, Oryza sativa
MATAGKVIKCKAAVAWEAGKPLSIEEVEVAKEMEVRVKILFTSLCHTDVYFWEAKGQTPVFPRIFGHEAGGIVESVGEGVTDLAPGDHVLPVFTGECKECAHCKSAESNMCDLLRINTDRGVMIGDGKSRFSINGKPIYHFIGTSTFSEYTVMHVGCVAKINPAAPLDKVCVLSCGISTGLGATINVAKPKGSTVAIFGLGAVGLAAAEGARIRGASRIIGIDLNANRFEEARKFGCTEFVNPKDHDKPVQQVLAEMTNGGVDRSVECTGNINAMIQAFECVHDGWGIAVLVGVPHKDAEFKTHPMNFLNERTLKGTFFGNYKPRTDLPNVVELYMKKELEVEKFITHSVPFSEINTAFDLMHKGEAIRCIIRMEN

SEQ ID NO: 7457 - protein, 380 aa, Pisum sativum
MSNTVGQIIKCRAAVAWEAGKPLVIEEVEVAPPQAGEVRLKILFTSLCHTDVYFWEAKGQTPLFPRIFGHEAGGIVESVGEGVTHLKPGDHALPVFTGECGECPHCKSEESNMCDLLRINTDRGVMLNDNKSRFSIKGQPVHHFVGTSTFSEYTVVHAGCVAKINPDAPLDKVCILSCGICTGLGATINVAKPKPGSSVAIFGLGAVGLAAAEGARISGASRIIGVDLVSSRFELAKKFGVNEFVNPKEHDKPVQQVIAEMTNGGVDRAVECTGSIQAMISAFECVHDGWGVAVLVGVPSKDDAFKTHPMNFLNERTLKGTFYGNYKPRTDLPNVVEKYMKGELELEKFITHTVPFSEINKAFDYMLKGESIRCIIKMEE

SEQ ID NO: 7458 - protein, 379 aa, Pennisetum glaucum
MATAGKVIKCKAAVAWEAGKPLSIEEVEVAPPQAMEVRVKILYTSLCHTDVYFWEAKGQTPVFPRIFGHEAGGIIESVGEGVTDVAPGDHVLPVFTGECKECPHCKSAESNMCDLLRINTVRGVMIGDGKSRFSINGKPIYHFVGTSTFSEYTVMHVGCVAKINPEAPLDKVCVLSCGISTGLGASINVAKPPKGSTVAIFGLGAVGLAAAEGARIAGASRIIGVDLNPSRFEEAKKFGCTEFVNPKDHNKPVQEVLADMTNGGVDRSVECTGNINAMIQAFECVHDGWGVAVLVGVPHKDAEFKTHPMNFLNERTLKGTFFGNFKPRTDLPNVVELYMKKELEVEKFITHSVPFSEINKAFDLMAKGEGIRCIIRMEN

SEQ ID NO: 7459 - protein, 382 aa, Petunia x hybrida
MSSNTAGQVIRCKAAVAWEAGKPLVIEEVEVAPPQKMEVRLKILFTSLCHTDVYFWEAKGQTPLFPRIFGHEAGGIVESVGEGVTDLKPGDHVLPVFTGECQQCRHCKSEESNMCDLLRINTDRGVMIHDGQTRFSKDGKPIYHFVGTSTFSEYTVCHSGCVTKIDPQAPLDKVCVLSCGISTGLGATLNVAKPTKGSTVAIFGLGAVGLAAAEGARIAGASRIIGVDLNPSRFNDAKKFGVTEFVNPKDHGDKPVQQVIAEMTDGGVDRSVECTGNVNAMISAFECVHDGWGVAVLVGVPNKDDAFKTHPMNLLNERTLKGTFFGNYKPKSDIPSVVDKYMKKELELEKFITHQVPFSEINKAFDYMLKGESIRCMITMEH

SEQ ID NO: 7460 - protein, 375 aa, Rana perezi
ATAGKVIKCKAAVCWGPKQPLSIEEIEVAPPKRHEVRVKIVATGICRSDDHVISGALSDMKFPVILGHEAAGVVESVGEGVTKFKPGDKVIPLFVPQCGECRCCKNPESNLCYKNDIGKYDGVLLDKTSRFTCKGKSIHNFISTSTFTEYTVLDEIAVAKIHEDAPLEKVCLIGCGFSTGYGSAVNTGKVKPGSTCAVFGLGGVGLSVIIGCKVAGASRIIGVDLNSDKFTTAKECGATECINPKDYNIPIHEVLAKMTDDGVDYAFEVIGNTTVMTSALSSSHFGCGKTVIVGLAPSSAVMSFDPLLILTGRILTGAVFGGWKSKDDVPKLVRDYLNKKFDFDPLITHYMPFEKINEGFELLRNGKSIRTILTF

SEQ ID NO: 7461 - protein, 380 aa, Solanum tuberosum
MSTTVGQVIRCKAAVAWEAGKPLVMEEVDVAPPQKMEVRLKILYTSLCHTDVYFWEAKGQNPVFPRILGHEAAGIVESVGEGVTELGPGDHVLPVFTGECKDCAHCKSEESNMCSLLRINTDRGVMINDGQSRFSINGKPIYHFVGTSTFSEYTVVHVGCVAKINPLAPLDKVCVLSCGISTGLGATLNVAKPTKGSSVAIFGLGAVGLAAAEGARIAGASRIIGVDLNASRFEQAKKFGVTEFVNPKDYSKPVQEVIAEMTDGGVDRSVECTGHIDAMISAFECVHDGWGVAVLVGVPHKEAVFKTHPMNLLNERTLKGTFFGNYKPRSDIPSVVEKYMNKELELEKFITHTLPFAEINKAFDLMLKGEGLRCIITMED

SEQ ID NO: 7462 - protein, 380 aa, Trifolium repens
MSNTAGQVIKCRAAVAWEAGKPLVIEEVEVAPPQAGEVRLKILFTSLCHTDVYFWEAKGQTPLFPRIFGHEAGGIVESVGEGVTHLKPGDHALPVFTGECGECPHCKSEESNMCNLLRINTDRGVMINDNKSRFSIKGQPVHHFVGTSTFSEYTVVHAGCVAKINPDAPLDKVCILSCGICTGLGATVNVAKPKPGSSVAIFGLGAVGLAAAEGARMSGASRIIGVDLVSSRFELAKKFGVNEFVNPKDHDKPVQQVIAEMTDGGVDRAVECTGSIQAMISAFECVHDGWGVAVLVGVPKKDDAFKTHPMNFLNERTLKGTFYGNYKPRTDLPNVVEQYMKGELELEKFITHSIPFSEINKAFDYMLKGESIRCIIRMEE

SEQ ID NO: 7463 - protein, 373 aa, Hordeum vulgare
MATAGKVIKCKAAVAWEAGKPLSMEEVEDAPPQAMEVRDKILYTALCHTDVYFWEANGQTPVFPRILGHEAGGIVESVGEGVTELVPGDHVLPVFTGECKECAHCMSEESNLCDLLRINVDRGVMIDDGQSRFTIDGKPIFHFLGTSTFSEYTVIHVGCVAKIDPEAPLDKVCLLSCGISTGLGATLNVTKPKKGMTVAIFGLGAVGLAAMEGARMSGASRIIGVDLNPAKHEQAKKFGCTDFVNPKDHTKPVQEVIVEMTDGGVNRAVECTGNADAMISAFECVHDGWGVAHKEAVFKTHPMNFLNERTLRGTFFGNYKPRTGLPGVVDMYMRKELELDKFITHSLPFSQINTAFDLMLRGEGLRCVIRSEE

SEQ ID NO: 7464 - protein, 379 aa, Zea mays; identical to SEQ ID NO: 5433

SEQ ID NO: 7465 - protein, 375 aa, Oryza sativa; identical to SEQ ID NO: 3890

SEQ ID NO: 7466 - protein, 380 aa, Solanum tuberosum
MSTTTGQVIRCKAAVAWEAGKPLVMEEVDVAPPQKMEVRLKILYTSLCHTDVYFWEAKGQNPVFPRILGHEAAGIVESVGEGVTELAPGDHVLPVFTGECKDCAHCKSEESNMCSLLRINTDRGVMINDGQSRFSINGKPIYHFVGTSTFSEYTVVHVGCVAKINPLAPLDKVCVLSCGISTGLGATLNVAKPTKGSSVAIFGLGAVGLAAAEGARIAGASRIIGVDLNASRFEQAKKFGVTEFVNPKDYSKPVQEVIAEMTDGGVDRSVECTGHIDAMISAFECVHDGWGVAVLVGVPHKEAVFKTHPMNFLNERTLKGTFFGNYKPRSDIPSVVEKYMNKELELEKFITHTLPFAEINKAFDLMLKGEGLRCIITMED

SEQ ID NO: 7467 - protein, 375 aa, Coturnix japonica
STAGKVIKCKAAVLWEANKPFSLEEVEVAPPKAHEVRIKIVATGICRSDDHVVTGALAMPFPVILGHEAAGVVESVGEKVTLLKPGDAVIPLFVPQCGECRSCLSTKGNLCIKNDLSSSPTGLMADGTTRFTCKGKAIHHFIGTSTFTEYTVVHETAAAKIDSAAPLEKVCLIGCGFSTGYGAVLQTAKVEPGSTCAVFGLGGVGLSVVMGCKAAGASRIIAIDINKDKFAKAKELGATECVNPKDFKKPIHEVLTEMTGKGVDYSFEVIGRIETMTEALASCHYNYGVSVIVGVPPAAQKISFDPMLIFSGRTWKGSVFGGWKSKDAVPKLVADYMKKKFVLDPLITHTLPFTKINEGFDLLRTGKSIRTVLVL

SEQ ID NO: 7468 - protein, 379 aa, Hordeum vulgare
MATAGKVIKCKAAVAWEAGKPLSIEEVEVAPPQAMEVRVKILYTALCHTDVYFWEAKGQTPVFPRILGHEAGGIVESVGEGVTELVPGDHVLPVFTGECKDCAHCKSEESNLCDLLRINVDRGVMIGDGQSRFTINGKPIFHFVGTSTFSEYTVIHVGCLAKINPEAPLDKVCVLSCGLSTGLGATLNVAKPKKGSTVAIFGLGAVGLAAMEGARMAGASRIIGVDLNPAKYEQAKKFGCTDFVNPKDHTKPVQEVLVEMTNGGVDRAVECTGHIDAMIATFECVHDGWGVAVLVGVPHKEAVFKTHPMNFLNEKTLKGTFFGNYKPRTDLPEVVEMYMRKELDLEKFITHSVPFSQINTAFDLMLKGEGLRCITRTDQ

SEQ ID NO: 7469 - protein, 380 aa, Solanum tuberosum
MSTTVGQVIRCKAAVAWEAGKPLVMEEVDVAPPQKMEVRLKILYTSLCHTDVYFWEAKGQNPVFPRILGHEAAGIVESVGEGVTELAPGDHVLPVFTGECKDCAHCKSEESNMCSLLRINTDRGVMINDGQSRFSINGKPIYHFVGTSTFSEYTVVHVGCVAKINPLAPLDKVCVLSCGISTGLGATLNVAKPTKGSSVAIFGLGAVGLAAAEGARIAGASRIIGVDLNASRFEQAKKFGVTEFVNPKDYSKPVQEVIAEMTDGGVDRSVECTGHIDAMISAFECVHDGWGVAVLVGVPHKEAVFKTHPMNFLNERTLKGTFFGNYKPRSDIPSVVEKYMNKELELEKFITHTLPFAEINKAFDLMLKGEGLRCIITMED

SEQ ID NO: 7470 - protein, 376 aa, Rattus norvegicus
MSTAGKVIKCKAAVLWEPHKPFTIEDIEVAPPKAHEVRIKMVATGVCRSDDHAVSGSLFTPLPAVLGHEGAGIVESIGEGVTCVKPGDKVIPLFSPQCGKCRICKHPESNLCCQTKNLTQPKGALLDGTSRFSCRGKPIHHFISTSTFSQYTVVDDIAVAKIDAAAPLDKVCLIGCGFSTGYGSAVQVAKVTPGSTCAVFGLGGVGLSVVIGCKTAGAAKIIAVDINKDKFAKAKELGATDCINPQDYTKPIQEVLQEMTDGGVDFSFEVIGRLDTMTSALLSCHSACGVSVIVGVPPSAQSLSVNPMSLLLGRTWKGAIFGGFKSKDAVPKLVADFMAKKFPLEPLITHVLPFEKINEAFDLLRAGKSIRTVLTF

SEQ ID NO: 7471 - protein, 375 aa, Homo sapiens [sequence omitted]

SEQ ID NO: 7472 - protein, 375 aa, Equus caballus
MSTAGKVIKCKAAVLWEEKKPFSIEEVEVAPPKAHEVRIKMVATGICRSDDHVVSGTLVTPLPVIAGHEAAGIVESIGEGVTTVRPGDKVIPLFTPQCGKCRVCKHPEGNFCLKNDLSMPRGTMQDGTSRFTCRGKPIHHFLGTSTFSQYTVVDEISVAKIDAASPLEKVCLIGCGFSTGYGSAVKVAKVTQGSTCAVFGLGGVGLSVIMGCKAAGAARIIGVDINKDKFAKAKEVGATECVNPQDYKKPIQEVLTEMSNGGVDFSFEVIGRLDTMVTALSCCQEAYGVSVIVGVPPDSQNLSMNPMLLLSGRTWKGAIFGGFKSKDSVPKLVADFMAKKFALDPLITHVLPFEKINEGFDLLRSGESIRTILTF

SEQ ID NO: 7473 - protein, 374 aa, Equus caballus
MSTAGKVIKCKAAVLWEQKKPFSIEEVEVAPPKAHEVRIKMVAAGICRSDDHVVSGTLVAPLPVIAGHEAAGIVESIGEGVTTVRPGDKVIPLFIPQCGKCSVCKHPEGNLCLKNLSMPRGTMQDGTSRFTCRGKPIHHFLGTSTFSQYTVVDEISVAKIDAASPLEKVCLVGCGFSTGYGSAVKVAKVTQGSTCAVFGLGGVGLSVIMGCKAAGAARIIGVDINKDKFAKAKEVGATECVNPQDYKKPIQEVLTEMSNGGVDFSFEVIGRLDTMVAALSCCQEAYGVSVIVGVPPDSQNLSMNPMLLLSGRTWKGAIFGGFKSKDSVPKLVADFMAKKFALDPLITHVLPFEKINEGFDLLRSGKSIRTILTF

SEQ ID NO: 7474 - protein, 373 aa, Equus caballus
SAEVIKCKAAVAWEAGKPVSIEEVEVAPPKAHEVRIKIIATAVCHTDAYTLSGADPEGSFPVILGHEGAGIVESVGEGVTKLKAGDTVIPLYIPQCGECKFCLNPQTNLCQKIRTTQGKGLMPDGTSRFTCKGKTILHYMGTSTFSEYTVVADISVAKIDPLAPLDKVCLLGCGVSTGYGAAVNTAKVEPGSTCAIFGLGGVGLAVIMGCKVAGASRIIGVDINKDKFAKAKEFGASECINPQDFSKPIQEVLIEMTDGGVDYSFECIGNVKVMRAALEACHKGWGVSVVVGVAASGEEIATRPFQLVTGRTWKGTAFGGWKSVESIPKLVSEYMSKKIKVDEFVTHSLSFDQINEAFELMHAGKSIRTVVKL

SEQ ID NO: 7475 - protein, 374 aa, Homo sapiens
MANEVIKCKAAVAWEAGKPLSIEEIEVAPPKAHEVRIKIIATAVCHTDAYTLSGADPEGCFPVILGHEGAGIVESVGEGVTKLKAGDTVIPLYIPQCGECKFCLNPKTNLCQKIRVTQGKGLMPDGTSRFTCKGKTILHYMGTSTFSEYTVVADISVAKIDPLAPLDKVCLLGCGISTGYGAAVNTAKLEPGSVCAVFGLGGVGLAVIMGCKVAGASRIIGVDINKDKFARAKEFGATECINPQDFSKPIQEVLIEMTDGGVDYSFECIGNVKVMRAALEACHKGWGVSVVVGVAASGEEIATRPFQLVTGRTWKGTAFGGWKSVESVPKLVSEYMSKKIKVDEFVTHNLSFDEINKAFELMHSGKSIRTVVKI

SEQ ID NO: 7476 - protein, 374 aa, Mus musculus
MANQVIRCKAAVAWEAGKPLSIEEIEVAPPKAHEVRIKILATAVCHTDAYTLSGRDPEGCFPVILGHEGAGIVESVGEGVTKLKAGDTVIPLYIPQCGECKFCLNPKTNLCQKIRVTQGKGLMPDGTSRFTCKGKSVFHFMGTSTFSEYTVVADISVAKIDPSAPLDKVCLLGCGISTGYGAAVNTAKVEPGSTCAVFGLGGVGLAVIMGCKVAGASRIIGIDINKDKFAKAKEFGASECISPQDFSKSIQEVLVEMTDGGVDYSFECIGNVKVMRSALEAAHKGWGVSVVVGVAASGEEISTRPFQLVTGRTWKGTAFGGWKSVESVPKLVSEYMSKKIKVDEFVTGNLSFDQINQAFDLMHSGDSIRTVLKM

SEQ ID NO: 7477 - protein, 373 aa, Rattus norvegicus
ANQVIRCKAAVAWEAGKPLSIEEIEVAPPQAHEVRIKIIATAVCHTDAYTLSGADPEGCFPVILGHEGAGIVESVGEGVTKLKAGDTVIPLYIPQCGECKFCLNPKTNLCQKIRVTQGKGLMPDGTSRFTCKGKPILHFMGTSTFSEYTVVADISVAKIDPSAPLDKVCLLGCGISTGYGAAVNTAKVEPGSTCAVFGLGGVGLAVIMGCKVAGASRIIGIDINKDKFAKAKEFGATECINPQDFSKSIQEVLIEMTDGGVDFSFECIGNVKVMRSALEAAHKGWGVSVVVGVAASGEEISTRPFQLVTGRTWKGTAFGGWKSVESVPKLVSEYMSKKIKVDEFVTGNLSFDQINKAFDLMHSGNSIRTVLKL

SEQ ID NO: 7478 - protein, 379 aa, Arabidopsis thaliana
MSTTGQIIRCKAAVAWEAGKPLVIEEVEVAPPQKHEVRIKILFTSLCHTDVYFWEAKGQTPLFPRIFGHEAGGIVESVGEGVTDLQPGDHVLPIFTGECGDCRHCQSEESNMCDLLRINTERGGMIHDGESRFSINGKPIYHFLGTSTFSEYTVVHSGQVAKINPDAPLDKVCIVSCGLSTGLGATLNVAKPKKGQSVAIFGLGAVGLGAAEGARIAGASRIIGVDFNSKRFDQAKEFGVTECVNPKDHDKPIQQVIAEMTDGGVDRSVECTGSVQAMIQAFECVHDGWGVAVLVGVPSKDDAFKTHPMNFLNERTLKGTFFGNYKPKTDIPGVVEKYMNKELELEKFITHTVPFSEINKAFDYMLKGESIRCIITMGA

SEQ ID NO: 7479 - protein, 380 aa, Fragaria x ananassa
MSSTEGKVICCRAAVAWEAGKPLVIEEVEVAPPQANVVRVKILYTSLCHTDVYFWEAKGQNPLFPRIYGHEAGGIVESVGEGVTDLKAGDHVLPVFTGECKECDHCKSEESNMCDLLRINTDRGVMLNDGKSRFSIKGKPIYHFVGTSTFSVYTVTHVGCLAKINPQSPLDKVCILSCGISTGLGATLNVRKPKKGSTVAVFGLGAVGLAAAEGARMAGASRIIGVDLNSNRFEEAKKFGITEFVNPKDHKKPVQEVIAELTNGGVDRSIECTGNIQAMIPAFECVHDGWGVAVLVGVPHKDAVFTTHPMNFLNERTLKGTFFGNYKPRTDIPSVVEKYMNKELEVDKFITHQLPFSQINKAFDYMLKGEGIRCIITMEE

SEQ ID NO: 7480 - protein, 375 aa, Gadus callarias
ATVGKVIKCKAAVAWEANKPLVIEEIEVDVPHANEIRIKIIATGVCHTDLYHLFEGKHKDGFPVVLGHEGAGIVESVGPGVTEFQPGEKVIPLFISQCGECRFCQSPKTNQCVKGWANESPDVMSPKETRFTCKGRKVLQFLGTSTFSQYTVVNQIAVAKIDPSAPLDTVCLLGCGVSTGFGAAVNTAKVEPGSTCAVFGLGAVGLAAVMGCHSAGAKRIIAVDLNPDKFEKAKVFGATDFVNPNDHSEPISQVLSKMTNGGVDFSLECVGNVGVMRNALESCLKGWGVSVLVGWTDLHDVATRPIQLIAGRTWKGSMFGGFKGKDGVPKMVKAYLDKKVKLDEFITHRMPLESVNDAIDLMKHGKCIRTVLSLE

SEQ ID NO: 7481 - protein, 375 aa, Macaca mulatta
MSTAGKVIKCKAAVLWEVMKPFSIEDVEVAPPKAYEVRIKMVTVGICGTDDHVVSGTMVTPLPVILGHEAAGIVESVGEGVTTVEPGDKVIPLALPQCGKCRICKTPERNYCLKNDVSNPRGTLQDGTSRFTCRGKPIHHFLGVSTFSQYTVVDENAVAKIDAASPMEKVCLIGCGFSTGYGSAVKVAKVTPGSTCAVFGLGGVGLSAVMGCKAAGAARIIAVDINKDKFAKAKELGATECINPQDYKKPIQEVLKEMTDGGVDFSFEVIGRLDTMMASLLCCHEACGTSVIVGVPPDSQNLSINPMLLLTGRTWKGAVYGGFKSKEDIPKLVADFMAKKFSLDALITHVLPFEKINEGFDLLRSGKSIRTILTF

SEQ ID NO: 7482 - protein, 375 aa, Papio hamadryas
MSTAGKVIKCKAAVLWEVKKPFSIEDVEVAPPKAYEVRIKMVAVGICRTDDHVVSGNLVSPLPAILGHEAAGIVESVGEGVTTVKPGDKVIPLFTPQCGKCRVCKSPEGNYCVKNDLSNPRGTLQDGTRRFTCRGKPIHHFVGTSTFSQYTVVDENAVAKIDAASPLEKVCLIGCGFSTGYGSAVNVAKVTPGSVCAVFGLGGVGLSAVMGCKAAGAARIIAVDINKDKFAKAKELGATECINPQDYKKPIQEVLKEMTDGGVDFSFEVIGRLDTMMASLLCCHEACGTSVIVGVPPDSQNLSINPMLLLTGRTWKGAVYGGFKSREGIPKLVADFMAKKFSLDALITHVLPFEKINEGFDLLRSGKSIRTVLTF

SEQ ID NO: 7483 - protein, 421 aa, Pseudomonas fluorescens
MRAQVQQGLVLGMSTLAFTVCFMVWMMFAVLGVPIKELLALNETQFGLLAATPVLTGSLVRLPLGLLTDRFGGRIVFFLLMLACVLPLYLITLATAYWQFLVLGLFVGLAGGSFSVGIAYVAKWFDKQNQGFAMGVFGAGNAGAAVTKFLAPALIAFGTWHLVPKVFSAILFITALLFWFLTAEKKEHRNAGGATLREQLKSLKDPAVWRYCQYYSIVFGGYVALALWMTKYYVQEYGFSLQSAALLAACFSLPGGVLRAVGGWMSDRWGAQSVTWWVLWVSWICLFLLSYPQTQLQVQTVNGIVDFHIGLNATLFPVILFVMGIAFAFGKASVFKYIANNYPQNMGAVSGIVGLAGGLGGFVLPIMFGALVDLTGVRSSCFMLLYGVVWVSLIWMYLSKVHKRPLLGKQPPASQSPFSSI

SEQ ID NO: 7484 - protein, 504 aa, Matthiola incana
MLAAYAIPILTAILSIFWYLLKRVQRRPPLPPGPRGLPIVGNLPFLDPDLHTYFTSLAQTHGSIFKLNLGSKLTVVISSPSLAREILKDQDINFANHDVPLTGRAATYGGLDILWSPYGAEWRMLRKVCLLKLLSRKTLDSFYELRRKEIRERTRFLYKQSRGEAPVNVGDQLFLTMMNLTMNMLWGGSVKAEEMASVGTEFKGVISEITRLIGEPNVSDFFPWLARFDIQGLVKSMRVSARQLDAVFDRAIKQMQQITSSDGECKDFLQYLMKLKDQESDSEVPITLNHVKAVLTDMVVGGTDTSMNTVEFAMAELINKPELMKKAQQELDQVVGKDNIVEESHITKLPYIVAIMKETLRLHPTLPLLVPRRPAEAAVVGGYTIPKDTKIFINVWCIQRDPNVWEKPTEFRPERFLDNNKPRDFTGTDYSYFPFGSGRRICAGVALAERMVLYTLATLLHSFDWKIPQGHVLDLEEKIGIVLKLKTPLVALPVPRLSDSNLYI

SEQ ID NO: 7485 - protein, 265 aa, Petunia x hybrida
MAQLRADDLSFIFGLLGNIVSFMVFLAPVPTFYKIYKRKSSEGYQAIPYMVALFSAGLLLYYAYLRKNAYLIVSINGFGCAIELTYISLFLFYAPRKSKIFTGWLMLLELGALGMVMPITYLLAEGSHRVMIVGWICAAINVAVFAAPLSIMRQVIKTKSVEFMPFTLSLFLTLCATMWFFYGFFKKDFYIAFPNILGFLFGIVQMLLYFVYKDSKRIDDEKSDPVREATKSKEGVEIIINIEDDNSDNALQSMEKDFSRLRTSK

SEQ ID NO: 7486 - protein, 298 aa, Homo sapiens
MGDHAWSFLKDFLAGGVAAAVSKTAVAPIERVKLLLQVQHASKQISAEKQYKGIIDCVVRIPKEQGFLSFWRGNLANVIRYFPTQALNFAFKDKYKQLFLGGVDRHKQFWRYFAGNLASGGAAGATSLCFVYPLDFARTRLAADVGKGAAQREFHGLGDCIIKIFKSDGLRGLYQGFNVSVQGIIIYRAAYFGVYDTAKGMLPDPKNVHIFVSWMIAQSVTAVAGLVSYPFDTVRRRMMMQSGRKGADIMYTGTVDCWRKIAKDEGAKAFFKGAWSNVLRGMGGAFVLVLYDEIKKYV

SEQ ID NO: 7487 - protein, 387 aa, Zea mays
MADQANQPTVLHKLGGQFHLRSIISEGVRARNICPSVSSYERRFATRNYMTQSLWGPSMSVSGGINVPVMQTPLCANAPAEKGGKNFMIDFMMGGVSAAVSKTAAAPIERVKLLIQNQDEMIKSGRLSEPYKGIVDCFKRTIKDEGFSSLWRGNTANVIRYFPTQALNFAFKDYFKRLFNFKKDRDGYWKWFAGNLASGGAAGASSLFFVYSLDYARTRLANDAKAAKGGGERQFNGLVDVYRKTLKSDGIAGLYRGFNISCVGIIVYRGLYFGLYDSIKPVVLTGNLQDNFFASFALGWLITNGAGLASYPIDTVRRRMMMTSGEAVKYKSSLDAFQQILKKEGPKSLFKGAGANILRAIAGAGVLSGYDQLQILFFGKKYGSGGA

SEQ ID NO: 7488 - protein, 386 aa, Solanum tuberosum
MADMNQHPTVFQKAANQLDLRSSLSQDVHARYGGVQPAIYQRHFAYGNYSNAGLQRGQATQDLSLITSNASPVFVQAPQEKGFAAFATDFLMGGVSAAVSKTAAAPIERVKLLIQNQDEMLKAGRLSEPYKGIGECFGRTIKEEGFGSLWRGNTANVIRYFPTQALNFAFKDYFKRLFNFKKDRDGYWKWFAGNLASGGAAGASSLFFVYSLDYARTRLANDRKASKKGGERQFNGLVDVYKKTLKSDGIAGLYRGFNISCVGIIVYRGLYFGMYDSLKPVLLTGNLQDSFFASFGLGWLITNGAGLASYPIDTVRRRMMMTSGEAVKYKSSLDAFSQIVKNEGPKSLFKGAGANILRAVAGAGVLAGYDKLQVLVLGKKFGSGGA

SEQ ID NO: 7489 - protein, 387 aa, Zea mays
MADQANQPTVLHKLGGQFHLSSSFSEGVRARNICPSFSPYERRFATRNYMTQSLWGPSMSVSGGINVPVMPTPLFANAPAEKGGKNFMIDFMMGGVSAAVSKTAAAPIERVKLLIQNQDEMIKSGRLSEPYKGIADCFKRTIKDEGFSSLWRGNTANVIRYFPTQALNFAFKDYFKRLFNFKKDRDGYWKWFAGNLASGGAAGASSLFFVYSLDYARTRLANDAKAAKGGGDRQFNGLVDVYRKTLKSDGIAGLYRGFNISCVGIIVYRGLYFGLYDSIKPVVLTGSLQDNFFASFALGWLITNGAGLASYPIDTVRRRMMMTSGEAVKYKSSLDAFQQILKKEGPKSLFKGAGANILRAIAGAGVLSGYDQLQILFFGKKYGSGGA

SEQ ID NO: 7490 - protein, 386 aa, Solanum tuberosum
ADNQHPTVYQKVASQMHLSSSLSQDVHARYGGIQRPALSQRRFPYGNYSNAGLQTCQATQDLSLIAANASPVFVQAPQEKGLAAFATDFLMGGVSAAVSKTAAAPIERVKLLIQNQDEMIKAGRLSEPYKGIGDCFSRTIKDEGFAALWRGNTANVIRYFPTQALNFAFKDYFKRLFNFKKDRDGYWKWFAGNLASGGGAGASSLLFVYSLDYARTRLANDAKAAKKGGGGRQFDGLVDVYRKTLKSDGVAGLYRGFNISCVGIIVYRGLYFGMYDSLKPVLLTGKMEDSFFASFALGWLITNGAGLASYPIDTVRRRMMMTSGEAVKYKSSFDAFNQILKNEGPKSLFKGAGANVLRAVAGAGVLAGYDKLQVIVFGKKYGSGGG

SEQ ID NO: 7491 - protein, 298 aa, Homo sapiens
MTEQAISFAKDFLAGGIAAAISKTAVAPIERVKLLLQVQHASKQIAADKQYKGIVDCIVRIPKEQGVLSFWRGNLANVIRYFPTQALNFAFKDKYKQIFLGGVDKHTQFWRYFAGNLASGGAAGATSLCFVYPLDFARTRLAADVGKSGTEREFRGLGDCLVKITKSDGIRGLYQGFSVSVQGIIIYRAAYFGVYDTAKGMLPDPKNTHIVVSWMIAQTVTAVAGVVSYPFDTVRRRMMMQSGRKGADIMYTGTVDCWRKIFRDEGGKAFFKGAWSNVLRGMGGAFVLVLYDELKKVI

SEQ ID NO: 7492 - protein, 310 aa, Schizosaccharomyces pombe
IVVRATLEGHSGWVTSLSTAPENPDILLSGSRDKSIILWNLVRDDVNYGVAQRRLTGHSHFVSDCALSFDSHYALSASWDKTIRWWDLEKGECTHQFVGHTSDVLSVSISPDNRQVVSGSRDKTIKIWNIIGYCKYTITDGGHSDWVSCVRFSPNPDNLTFVSVGWEKPVKAWDLETFSLRTSHYGHTGYVSAVTISPDGSLCASGGRDGTLMLWDLNESTHLYSLEAKANINALVFSPDRYWLCAATGSSIRIFDLETQEKVDELTVDFVGVGKKSSEPECISLTWSPDGQTLFSGWTDNLIRVWQVTK

SEQ ID NO: 7493 - protein, 308 aa, Chlamydomonas reinhardtii
MAKEEKNFMVDFLAGGLSAAVSKTAAAPIERVKLLIQNQDEMIKQGRLASPYKGIGECFVRTVREEGFGSLWRGNTANVIRYFPTQALNFAFKDKFKRMFGFNKDKEYWKWFAGNMASGGAAGAVSLSFVYSLDYARTRLANDAKSAKKGGGDRQFNGLVDVYRKTIASDGIAGLYRGFNISCVGIVVYRGLYFGMYDSLKPVVLVGPLANNFLAAFLLGWGITIGAGLASYPIDTIRRRMMMTSGSAVKYNSSFHCFQEIVKNEGMKSLFKGAGANILRAVAGAGVLAGYDQLQVILLGKKYGSGEA

SEQ ID NO: 7494 - protein, 545 aa, Aspergillus niger
MIQGLESIMNQGTKRILLAATLAATPWQVYGSIEQPSLLPTPPMGFNNWARFMCDLNETLFTETADTMAANGLRDAGYNRINLDDCWMAYQRSDNGSLQWNTTKFPHGLPWLAKYVKAKGFHFGIYEDSGNMTCGGYPGSYNHEEQDANTFASWGIDYLKLDGCNVYATQGRTLEEEYKQRYGHWHQVLSKMQHPLIFSESAPAYFAGTDNNTDWYTVMDWVPIYGELARHSTDILVYSGAGSAWDSIMNNYNYNTLLARYQRPGYFNDPDFLIPDHPGLTADEKRSHFALWASFSAPLIISAYIPALSKDEIAFLTNEALIAVNQDPLAQQATLASRDDTLDILTRSLANGDRLLTVLNKGNTTVTRDIPVQWLGLTETDCTYTAEDLWDGKTQKISDHIKIELASHATAVFRLSLPQGCSSVVPTGLVFNTASGNCLTAASNSSVAFQSCNGETSQIWQVTPSGVIRPVSQTTQCLAADGNLVKLQACDSTDSDGQKWTYPVTGNLKNAKTDGCLTEGSVQMKSCLYERDGQVFGLPSGVQLA

SEQ ID NO: 7495 - protein, 471 aa, Saccharomyces cerevisiae
MFAFYFLTACISLKGVFGVSPSYNGLGLTPQMGWDNWNTFACDVSEQLLLDTADRISDLGLKDMGYKYIILDDCWSSGRDSDGFLVADEQKFPNGMGHVADHLHNNSFLFGMYSSAGEYTCAGYPGSLGREEEDAQFFANNRVDYLKYDNCYNKGQFGTPEISYHRYKAMSDALNKTGRPIFYSLCNWGQDLTFYWGSGIANSWRMSGDVTAEFTRPDSRCPCDGDEYDCKYAGFHCSIMNILNKAAPMGQNAGVGGWNDLDNLEVGVGNLTDDEEKAHFSMWAMVKSPLIIGANVNNLKASSYSIYSQASVIAINQDSNGIPATRVWRYYVSDTDEYGQGEIQMWSGPLDNGDQVVALLNGGSVSRPMNTTLEEIFFDSNLGSKKLTSTWDIYDLWANRVDNSTASAILGRNKTATGILYNATEQSYKDGLSKNDTRLFGQKIGSLSPNAILNTTVPAHGIAFYRLRPSS

SEQ ID NO: 7496 - protein, 803 aa, Yersinia pestis
MMTANYLSAQNFSPNIKTVAVAGEEPLMMAFAIRPDLPELKTIIDKVIESIPPEEFDNLTSEWSTFKPKPISFDESSLDNELLMIALKISSGLLLVFGLYLCYLVFNKRRQAKLLHARLLQQESIINALPFAVFIRTASGELAVYNSHFADVHSDKLYDMLNQTHEPAHWPMTSPLDREIDKYCRSVLLNRKPQLVDLSVEIKGDIRDIFLWIIPLNNAEQGVLGGWLDISQRKTVERQLEAARVEAESANRTKSTFLATISHELRTPMYAIMGLLELEIRSNRPVEKDTLVTVSKSAQSLMLLLDDIIDSAKIEAGQLSIHPTAVDFHQEMERMFTLYQPIANERGLRFSGWLDDHIPPLLMADMLRVRQVMGNLLGNALKFTEQGSVSVDITWEPSDEQHGVMNIDITDTGIGISPAAQATLFQPFSQANEGKSPRFGGSGLGLWICHQLIHKMGGKIALESQLGKGTSLLITLPLNIATADDLAQDAAITHVDDERLNQLRNLRILVVDDLPANRQLLQQQLAFIGIEQVVTAENGAKACQILQHNNFDVVITDCSMPVMDGYELAAHIRQDPALKDLIVIGCTADAREESAARCIDAGMNACMIKPVAIDTLQATLLRKDIVSQISNTNHSQSTEDNDRGGNQSNLSEKNTAQQENAPAIHSTTITSSVNRLAAAQNKLRTLSGGNPAVELQLLQSLLESNLQDAVTLTQLYRQLCVEDEDVVETVDTAETVDTADTVEDGETRGPGSTVGRHSTAGSDHIPHADIYKQMASLVHRIKGSVQLIDAQELVASCVKFESQ

SEQ ID NO: 7497 - protein, 327 aa, Arabidopsis thaliana
MALIGKSERFSADFVMGGAAAIVAKSAAAPIERVKLLLQNQGEMIKTGHLIRPYTEETKPMSYDISLHRYYIPRTLTLDQRAEASNFAFKGYFKNLLGCSKEKDGYLKWFAGNVASGSAAGATTSLFLYHLDYARTRLGTDAKECSVNGKRQFKGMIDVYRKTLSSDGIKGLYRGFGVSIVGITLYRGMYFGMYDTIKPIVLVGSLEGNFLASFLLGWSITTSAGVIAYPFDTLRRRMMLTSGQPVKYRNTIHALREILKSEGFYALYRGVTANMLLGVAGAGVLAGYDQLHQIAYKHWNLGIINRLNQQKIGKIVHSSCAVTLLYQ

SEQ ID NO: 7498 - protein, 317 aa, Arabidopsis thaliana
MAEFMEPNLVSNFDDEKSNSVDTRSIFQMGFPLESEEIVREMIEKERQHSPRDDYLKRLRNGDLDFNVRIQALGWIWKACEELQFGPLCICLAMNYLDRFLSVHDLPSGKAWTVQLLAVACLSLAAKIEETNVPELMQLQVGAPMFVFEAKSVQRMELLVLNVLRWRLRAVTPCSYVRYFLSKINGYDQEPHSRLVTRSLQVIASTTKGDRLGLFFFKGVLIVDVWAGIDFLEFRASEIAAAVALSVSGEHFDKFSFSSSFSSLEKERVKKIGEMIERDGSSSSSQTPNNTVLQFKSRRYSHSLSTASVSSSLTSLS

SEQ ID NO: 7499 - protein, 496 aa, Arabidopsis thaliana
MAAVTQFLSQPSSIRGTLNQYQLNQTSLSRIPFLSLKSTLKPLKRLSVKAAVSQNSTKTLTKESASSFDHCFKKSSDGFLYCEGTKVQDIMETVEKRPFYLYSKPQITRNLEAYKEALEGVRSVIGYAIKANNNLKILEHLRSLGCGAVLVSGNELRLALLAVFDHVFGVDEMNRCIFNGNGKSLEDLVLAAQEGVFVNVDSEFDLNNIVEASRISGKQVNVLLRINPDVDPQVHPYVATGNKNSKFGIRNEKLQWFLDEVKAHPKELKLVGAHCHLGSTITKVDIFRDAAVLMIEYIDEIRRQGFEVSYLNIGGGLGIDYYHAGAVLPTPMDLINTVRELVLSRDLNLIIEPGRSLIANTCCFVNHVTGVKTNGTKNFIVIDGSMAELIRPSLYDAYQHIELVSPTPPEAEVTKFDVVGPVCESADFLGKDRELPTPPQGAGLVVHDAGAYCMSMASTYNLKMRPPEYWVEEDGSITKIRHAETFDDHLRFFEGL

SEQ ID NO: 7500 - protein, 112 aa, Arabidopsis thaliana
MSGVWVFNNGVIRLVENPNQSGGVSTQSHGRRNVLVYLPTGEAVSSYSSLEQILRSLGWERYFSGDSDLIQYHKRSSIDLISLPRDFSKFNSVYMYDIVVKNPNSFHVRDFN

SEQ ID NO: 7501 - protein, 339 aa, Arabidopsis thaliana
MGFDLKEIRTKKTLIGLGLGQLLSLLATSNGFTSSELARKGINVPTSQCFLNYVLLAIVYGSIMLYRRSDIKAKWYYYFLLAFVDVEANFLVVKAYQYTSLTSVMLLDCWAIPCVLVLTWFYLKTKYRLMKISGVFICIVGVFMVVFSDVHAGDRAGGSNPVKGDFLVLAGATLYAVSNTSEEFLVKNADTVELMTFLGFFGAIISAIQALTSLVHRSILERDELKAIHWSTGAVFPFLRFTLTMFLFYPLVPVLLKTNGATMFNLSLLTSDMWAVLIRTFGYHEKVDWLYFLAFATTATGLIIYSMKEKDQEEHRFEEVGDEAAMQRKLLGEDDEPGT

SEQ ID NO: 7502 - protein, 315 aa, Arabidopsis thaliana
MVCFNFNEMKTKKTLIGLGLGQIISLLSTLIASIASEIARKGISAPTSQTFLGYVSLAIVYGVISIASIVVKAFQNTSMTSIMLLDCWAIPCVLVLTWVFLKTRYRLMKISGVVICIVGVVMVVFSDVHAGDRAGGSNPVKGDFLVIAGATLYAVSNVTEEFLVKNADVTELMAFLGLFGAIIAAIQIIFERGAVRAIQWSTEAILLYIGGALGLFLFYTLITILIKNNGSTMFNLSLLTSDMWAILIRTFGYHEKVDWLYFLAFATTATGLIIYSMKEKDEEEQRSGEVVSERRKLFDEEDGDSLHSNLIDAST

SEQ ID NO: 7503 - protein, 330 aa, Arabidopsis thaliana
MAMGFDFNEMNKTKKTLIGLGLGQILSLLCTSNAFTSSELARKGINAPTSQTFLSYTLLAVVYGGIMLYRRPTIKGKWYHYFLLALVDVEGNFLVVKANQYTSITSIMLLDCWAIPCVLVLTWMFLKTKYRLMKISGVFICIAGVVMVLFSDVHAGSRAGGSNPVKGDFLVLAGATLYAVSNTTEEFLVKNADTVELMTFMGLFGAIISAIQPYSNKFKVSTLSRFQVFPFLRFAITMFLFYSLLPILLRTNGSTMFTLSLLTSDMWAVLIRIFAYHEKVDWLYYLAFATTAIGLIIYSMKEKDEEEEREEQRKKLLDEEEGQSLPDTSL

SEQ ID NO: 7504 - protein, 1280 aa, Arabidopsis thaliana
MGQRGFSKVESGTCNVCSAPCSSCMHRNVGFTGSKLDESSDENCHGVVGSQCSVNEDDLLPSSMVNAHKSLNNTASEASNLVNSSHDALSENAESKETIRCSGISDDSGAAAMTSKPSLSGSRMKHKVSASANMLDQSSNCIEDQEDGILSADRAKQLKSGCSNNEIGNKDLADGSALNSDPIPGGSRKDEVKLESLQNPSSNHDDRVSSEKGNFKEKSRPGGNKERQEPSVEGSTRSGENRKDGKSSKSSSSNSSAVSESESDDSEMVEHDVKVCDICGDAGREDLLAICSGCSDGAEHTYCMREMLDEVPEGDWLCEECAEEAEKQKQEAKRKRETEVTFNTYSSGKRHADKIEAAPDAKRQVVEASTGSPKKSILPRVGALSRETSFKGLDRLRGKLNHQTSFSDDTESARSAGSQLQPPKGAFLKSSSFNCSSSKPKVQLMDDAIHPRQKTGKEDTALDLKVGGFRNVGKSMPSRTTDAGNSGGSDSQAKMLGSKVYHSQEGKSLKQVKDRNREANASASSIDQKLKSRGNSSVSHANNNRDLKGLQSDGKRGGDISTNEKCSASEQSSSQADCKDELPSTSCTGEGMPNHGTVALQDGLPRSRVPREVGKKSKEAFSKRQRSSLLAGAKGLPSSQKGGQTAESSDTSGVSDSDLSTTKNVKEDLNKGNRLRAAVDAALRKKPSFGKNRVLEQSDASLVANVDSSSEKTLRNQLPSKMHKNHVSHEGLQGGHPILWPTSDPYKQTIVTNEKQLIFPGADTIPSRLVEPEVSFPAVKPVMRDLPLVPSPVMLRSSAIPDHEFIWQGDLEVRKIINQSAMHSGIQAHLSTLASPRVAEVVNKFPETFSLNEVPRKSTWPTQFEKLGTKEAHIALFFFAKDTESYERNYKPLVDNMIKNDLALKGNLDNVDLLIFASNQLPSNCQRWNMLYFLWGVFQGRKETNPQKNTSLPTSNVLPRDRDPKELCQTSSPSKHLEKGSSLRESSSNGIETRNGTDARSHENPNNRESSIERSPSKKEDIALKVEEAGVNHIPPQVTGSNSGDSLVRKVQKVEEQELGGRKDLPLTVMGSGIQSHGQDNPLEKDLNSSQASHRKRPLWELSNPANENSSAINQKVELNNDGLCEGSPNKKLKTENGSSSLCRDTSGHDSGIMKKSPKVVFPLDLNDDSEMVDNLSPLGNDENNNNRRLISGTVPNLELALGAEETTEATMGLLPFLSRSSNSGEQSNNSMNKEKQKADEEEEDDAEVAASLSLSLSFPGTEERKNVNTPLFLFRDLPR

SEQ ID NO: 7505 - protein, 720 aa, Arabidopsis thaliana
MNANEEGEGSRYPITDRKTGETKFDRVESRTEKHSEEEKTNGITMDVRNGSSGGLQIPLSQQTAATVCWERFLHVRTIRVLLVENDDCTRYIVTALLRNCSYEVVEASNGIQAWKVLEDLNNHIDIVLTEVIMPYLSGIGLLCKILNHKSRRNIPVIMMSSHDSMGLVFKCLSKGAVDFLVKPIRKNELKILWQHSSGSGSESGTHQTQKSVKSKSIKKSDQDSGSSDENENGSIGLNASDGSSDGSGAQSSWTKKAVDVDDSPRAVSLWDRVDSTCAQVVHSNPEFPSNQLVAPPAEKETQEHDDKFEDVTMGRDLEISIRRNCDLALEPKDEPLSKTTGIMRQDNSFEKSSSKWKMKVGKGPLDLSSESPSSKQMHEDGGSSFKAMSSHLQDNREPEAPNTHLKTLDTNEASVKISEELMHVEHSSKRHRGTKDDGTLVRDDRNVLRRSEGSAFSRYNPASNANKISGGNLGSTSLQDNNSQDLIKKTEAAYDCHSNMNESLPHNHRSHVGSNNFDMSSTTENNAFTKPGAPKVSSAGSSSVKHSSFQPLPCDHHNNHASYNLVHVAERKKLPPQCGSSNVYNETIEGNNNTVNYSVNGSVSGSGHGSNGPYGSSNGMNAGGMNMGSDNGAGKNGNGDGSGSGSGSGSGNLADENKISQREAALTKFRQKRKERCFRKKVRYQSRKKLAEQRPRVRGQFVRKTAAATDDNDIKNIEDS

SEQ ID NO: 7506 - protein, 428 aa, Arabidopsis thaliana
MNLDLNLGPGPESDLQPAPNETVNLADWTNDPPERSSEAVTRIRTRHRTRFRQLNLPIPVLSETHTMAIELNQLMGNSVNRAAMQTGEGSERGNEDLKMCENGDGALGDGVLDKKADVEKSSGSDGNFFDCNICLDLSKEPVLTCCGHLYCWPCLYQWLQISDAKECPVCKGEVTSKTVTPIYGRGNHKREIEESLDTKVPMRPHARRIESLRNTIQRSPFTIPMEEMIRRIQNRFDRDSTPVPDFSNREASERVNDRANSILNRLMTSRGVRSEQNQASAAAAAIVAASEDIDLNPNIAPDLEGESNTRFHPLLIRRQLQSHRVARISTFTSALSSAERLVDAYFRTHPLGRNHQEQNHHAPVVVDDRDSFSSIAAVINSESQVDTAVEIDSMALSTSSSRRRNENGSRVSDVDSADSRPPRRRRFT

SEQ ID NO: 7507 - protein, 274 aa, Arabidopsis thaliana
MGGSASLQSDSMEAAAAADSSIPRDKDFGKFQFGCEHYKRRCKIRAPCCNLIFSCRHCHNDSANSLPDPKERHDLVRQNVKQVVCSICQTEQEVAKVCSNCGVNMGEYFCDICKFFDDDISKEQFHCDDCGICRVGGRDKFFHCQNCGACYGMGLRDKHSCIENSTKNSCPVCYEYLFDSVKAAHVMKCGHTMHMDCFEQMINENQYRCPICAKSMVDMSPSWHLLDFEVSILCNDCNKGSKAMFHILGHKCSDCGSYNTRRISTPQDPVSETE

SEQ ID NO: 7508 - protein, 346 aa, Arabidopsis thaliana
MASRREVRCRCGRRMWVQPDARTVQCSTCHTVTQLYSLVDIARGANRIIHGFQQLLRQHQPQHHEQQQQQMMAQPPPRLLEPLPSPFGKKRAVLCGVNYKGKSYSLKGCISDAKSMRSLLVQQMGFPIDSILMLTEDEASPQRIPTKRNIRKAMRWLVEGNRARDSLVFHFSGHGSQQNDYNGDEIDGQDEALCPLDHETEGKIIDDEINRILVRPLVHGAKLHAVIDACNSGTVLDLPFICRMERNGSYEWEDHRSVRAYKGTDGGAAFCFSACDDDESSGYTPVFTGKNTGAMTYSFIKAVKTAGPAPTYGHLLNLMCSAIREAQSRLAFNGTTQALMHPRSHC

SEQ ID NO: 7509 - protein, 446 aa, Arabidopsis thaliana
MELKKERLILILSKSALSSLHHHHLVFFLPESSLHVTHRHGTCSRLNNGKATSPDHVEILRLDQARVNSIHSKLSKKLATDHVSESKSTDLPAKDGSTLGSGNYIVTVGLGTPKNDLSLIFDTGSDLTWTQCQPCVRTCYDQKEPIFNPSKSTSYYNVSCSSAACGSLSSATGNAGSCSASNCIYGIQYGDQSFSVGFLAKEKFTLTNSDVFDGVYFGCGENNQGLFTGVAGLLGLGRDKLSFPSQTATAYNKIFSYCLPSSASYTGHLTFGSAGISRSVKFTPISTITDGTSFYGLNIVAITVGGQKLPIPSTVFSTPGALIDSGTVITRLPPKAYAALRSSFKAKMSKYPTTSGVSILDTCFDLSGFKTVTIPKVAFSFSGGAVVELGSKGIFYVFKISQVCLAFAGNSDDSNAAIFGNVQQQTLEVVYDGAGGRVGFAPNGCS

SEQ ID NO: 7510 - protein, 159 aa, Arabidopsis thaliana
MGLPEDFITELQIPGYILKILYVIGFFRDMVDALCPYIGLPSFLDHNETSGPDPTRHALSTSASLANELIPVVRFSDLPTDPEDCCTVCLSDFESDDKVRQLPKCGHVFHHHCLDRWIVDYNKMKCPVCRHRFLPKEKYTQCDWGSGSDWFSDEVESTN

SEQ ID NO: 7511 - protein, 190 aa, Arabidopsis thaliana
MGGCCSSSRKSHLVGTPVYYYCPESFEELVPSGTRAGVGSAFTTGLLVDIGLETSIPDTFCAPAPLPYDLLLGRPQCTDSESIKGRMSGSSFETLATCEDLGESDCKTLASSVILSPRKSDFSKHQGLKILVDEEEECCPICFEDYDVENPRLTTKCEHEFHLSCLLEWIERSDRCPICDKEVVFDDRLN

SEQ ID NO: 7512 - protein, 329 aa, Arabidopsis thaliana
DDACSICLEPFTLQDPSTVTSCKHEYHLQCIIEWSQRSKECPICWQLFVLRDPASQELLAAVEKERLLKTRNISSSSPISIHHSHDDFHSEEEESQFSSFDEQFLRHLTEAAHRRCLLRRRDGQISSSLVSSSDPTTIHPTDLVNLYRLSAISHVEHQNSNPCPSPGSMTPSPVSGHSSIPADSNNGSRISPGPSPSRSSQSPKSPEASSLPEAIKSKLAAASAKYKESISKSKQGLKEKLLARNNSVKELSKGVQREMNAGIAGVARMIERMDFSSKRFGGSAHVSTSTATASGFNFSFKGKRVEANSKSNNNGDKTEPQKLQGGETC

SEQ ID NO: 7513 - protein, 306 aa, Arabidopsis thaliana
GTSPTGPELLTYMHILYEACPYFKFGYESANGAIAEAVKNESFVHIIDFQISQGGQWVSLIRALGARPGGPPNVRITGIDDPRSSFARQGGLELVGQRLGKLAEMCGVPFEFHGAALCCTEVEIEKLGVRNGEALAVNFPLVLHHMPDESVTVENHRDRLLRLVKHLSPNVVTLVEQEANTNTAPFLPRFVETMNHYLAVFESIDVKLARDHKERINVEQHCLAREVVNLIACEGVEREERHEPLGKWRSRFHMAGFKPYPLSSYVNATIKGLLESYSEKYTLEERDGALYLGWKNQPLITSCAWR

SEQ ID NO: 7514 - protein, 315 aa, Bos taurus
AHNIVLYTGAKMPILGLGTWKSPPGKVTEAVKVAIDLGYRHIDCAHVYQNENEVGLALQAKLQEQVVKREDLFIVSKLWCTYHDKDLVKGACQKTLSDLKLDYLDLYLIHWPTGFKPGKDFFPLDEDGNVIPSEKDFVDTWTAMEELVDEGLVKAIGVSNFNHLQVEKILNKPGLKYKPAVNQIECHPYLTQEKLIQYCNSKGIVVTAYSPLGSPDRPWAKPEDPSILEDPRIKAIADKYNKTTAQVLIRFPIQRNLIVIPKSVTPERIAENFQVFDFELDKEDMNTLLSYNRDWRACALVSCASHRDYPFHEEF

SEQ ID NO: 7515 - protein, 1281 aa, Neurospora crassa
MTDGPTLAAIAALVKSLAVDPATTQTSGLRPSTHVRLPGPYTREKGDLERELSALVVRIEQLETAAIAASPPAMPDTPNAPTDALFSNGTLSPSSETPDARYPAPLPRNGFIDEALEGLREHVDDQSKLLDSQRQELAGVNAQLIEQKQLQEKALAIIEQERVATLERELWKHQKANEAFQKALREIGEIVTAVARGDLSKKVRMNSVEMDPEITTFKRTINTMMDQLQVFSSEVSRVAREVGTEGILGGQAQIEGVDGTWKELTDNVNVMAQNLTDQVREIASVTTAVAHGDLTKKIERPAKGEILQLQQTINTMVDQLRTFASEVTRVARDVGTEGILGGQADVEGVQGMWNELTVNVNAMANNLTTQVRDIIKVTTAVAKGDLTQKVQAECRGEIFELKKTINSMVDQLQQFAREVTKIAREVGTEGRLGGQATVHDVQGTWRDLTENVNGMAMNLTTQVREIAKVTTAVAKGDLTKKIGVEVQGEILDLKNTINTMVDRLGTFAFEVSKVAREVGTDGTLGGQAQVDNVEGKWKDLTENVNTMASNLTSQVRGISTVTQAIANGDMSRKIEVEAKGEILILKETINNMVDRLSIFCNEVQRVAKDVGVDGIMGGQADVAGLKGRWKEITTDVNTMANNLTAQVRAFGDITNAATDGDFTKLVEVEASGEMDELKKKINQMVYNLRDSIQRNTQAREAAELANKTKSEFLANMSHEIRTPMNGIIGMTQLTLDTDLTQYQREMLNIVNSLANSLLTIIDDILDLSKIEARRMVIEEIPYTLRGTVFNALKTLAVKETEKFLDLTYRVDHSVPDHVVGDSFRLRQIILNLVGNAIKFTEHGEVSLTIQKASSVQCSTEEYAIEFVVSDTGIGIPADKLDLIFDTFQQADGSMTRKFGGTGLGLSISKRLVNLMGGDVWVKSEYGKGSKFFFTCVVRLANDDISLIAKQLNPYKSHQVLFIDKGRTGHGPEIAKMLHGLGLVPIVVDSERNPALEKARAAGQAPYDVIIVDSIEDARRLRSVDDFKYLPIVLLAPVVHVSLKSCLDLGITSYMTTPCQLIDLGNGMVPALENRATPSLADNTKSFEILLAEDNTVNQRLAVKILEKYHHVVTVVGNGEEAVEAVKRKKFDVILMDVQMPIMGGFEATAKIREYERSLGSQRTPIIALTAHAMMGDREKCIQAQMDEYLSKPLQQNHLIQTILKCATLGGQLLEKNRERELTRAADAVTGGRRDNGMYSASQAAQHAALRPPLATRGLTAADSLVSGLESPSIVTADKEDP

SEQ ID NO: 7516 - protein, 405 aa, Caenorhabditis elegans
MDFESSSAGPSTSYAEEPCTLSMLPQVSAVLSETSITESNVSCQLHPSRSAALNDNVRTLIYNRTDPHIQLDMRAFYNCMEYEEALQPNYHYFTGVQENITPFHREQAIDWIYDVAKEENCDGDVFLLAVSLIDRFMSVQNILKHDIQMIAGVALFIASKLKAPHPMTASKIAYYSDNSCPIDMILQWELLIVTTLQWETESPTAFSFFNFLASRIPQIHNTRGDFQTVVQKCQKMHKLATLFPSMQCAIGLYYVSNLPTQNKELAVKIKDLLANMFQLEVNLLDSYIPMVQRCMSTTPIYTSEDAEKTEPTPSAPASTQEPEAFQELKELKEEPLPTPPPEEPAFQKLVLLEPIPLSEQTPSTPLNDSGFSSDVSSPASSEKKRRRSTDWFEEDSTPPKIFKTL

SEQ ID NO: 7517 - protein, 791 aa, Homo sapiens
KRGYTPLHAAASNGQINVVKHLLNLGVEIDEINVYGNTALHIACYNGQDAVVNELIDYGANVNQPNNNGFTPLHFAAASTHGALCLELLVNNGADVNIQSKDGKSPLHMTAVHGRFTRSQTLIQNGGEIDCVDKDGNTPLHVAARYGHELLINTLITSGADTAKCGIHSMFPLHLAALNAHSDCCRKLLSSGQKYSIVSLFSNEHVLSAGFEIDTPDKFGRTCLHAAAAGGNVECIKLLQSSGADFHKKDKCGRTPLHYAAANCHFHCIETLVTTGANVNETDDWGRTALHYAAASDMDRNKTILGNAHDNSEELERARELKEKEATLCLEFLLQNDANPSIRDKEGYNSIHYAAAYGHRQCLELLLERTNSGFEESDSGATKSPLHLAAYNGHHQALEVLLQSLVDLDIRDEKGRTALDLAAFKGHTECVEALINQGASIFVKDNVTKRTPLHASVINGHTLCLRLLLEIADNPEAVDVKDAKGQTPLMLAVAYGHIDAVSLLLEKEANVDTVDILGCTALHRGIMTGHEECVQMLLEQEVSILCKDSRGRTPLHYAAARGHATWLSELLQMALSEEDCCFKDNQGYTPLHWACYNGNENCIEVLLEQKCFRKFIGNPFTPLHCAIINDHGNCASLLLGAIDSSIVSCRDDKGRTPLHAAAFADHVECLQLLLRHSAPVNAVDNSGKTALMMAAENGQAGAVDILVNSAQADLTVKDKDLNTPLHLACSKGHEKCALLILDKIQDESLINEKNNALQTPLHVAARNGLKVVVEELLAKGACVLAVDENGC

SEQ ID NO: 7518 - protein, 367 aa, Homo sapiens
PVEYLNNPIITQFFPTLLLWCFSALLPTIVYYSAFFEAHWTRSGENRTTMHKCYTFLIFMVLLLPSLGLSSLDLFFRWLFDKKFLAEAAIRFECVFLPDNGAFFVNYVIASAFIGNAMDLLRIPGLLMYMIRLCLARSAAERRNVKRHQAYEFQFGAAYAWMMCVFTVVMTYSITCPIIVPFGLMYMLLKHLVDRYNLYYAYLPAKLDKKIHSGAVNQVVAAPILCLFWLLFFSTMRTGFLAPTSMFTFVVLVITIVICLCHVCFGHFKYLSAHNYKIEHTETDTVDPRSNGRPPTAAAVPKSAKYIAQVLQDSEVDGDGDGAPGSSGDEPPSSSSQDEELLMPPDALTDTDFQSCEDSLIENEIHQ

SEQ ID NO: 7519 - protein, 297 aa, Vogesella indigofera
MGDKSVMPASRLWRDTLLTAVVPLIWGSTYLVTTQWLPAGLPFSAGVLRVLPAGLLLLLWTRHLPQRQEWPRLLLLSLLNIGAFQALLFVAAYRLPGGIAAVLGAIQPLLMMGLLWGLERQTPRPLVLLAACAGLAGMAVLLNAGNARWDSIGVLAAAGGAVVMALGMYLARRWGSSLPLLALTGWQLALGGLMLLPAALWLDPPLPALSAANVAGYAYLSLVGALLAYGLWFRGLRLLPPVAVSALGLLSPVAAVILGWVALGQRLHGWTLIGMVTVLASVLCVQLASSRRPARAG

SEQ ID NO: 7520 - protein, 2150 aa, Dictyostelium discoideum
MELKTFKDLNDDIIGDTSPVINTGDQPNPLRTQQQQLQQQQQQQQQQQQQQQQQQQQQQQQQQQQQHHIPQQLYQKQQQQQHSHSYGNHSFIHNVSPTSPSYDINNNNNNNNNNNNNNNNNNNNNNNSNNNNNNNNNNKNNYNNNYYYSPIENSNISKSLEESVLNQFPHNFNLNSSNNNYLNNSSSLHNINQSVNSLSNNNNNQTNQQPINNNNNNNNNNNNNNSNNSNNSNNNNNGNNNNNITDSPTKSKRHSTYETNIGSHQRRKSIQSLIANSAIHSFSKLKNKPLSSSTPSTVNTCGAVNNNSNNNNNNNNNSTGSLGAIPMDRSFDGNINTITEESTGGNNSPRSNCGSNCGSNGGIPLSPRNLSSLNSGVNVSPRNIHLNNLNNNSSNLPPLSPRHINFHINVSNLNNNNNNNINPNNNPNNSNNSNNNVSPRNNNHNISPRGSNISPRSNNGGSTTISPRNISNNNNIINNINNNNILTPPRNSPRLENVNPTNSPRLLATSLNSTLPIVSSLTSSNNNNQSNNNTNPSINNNNGRNGHCIQTISEEILGNKPVVYNNGNNNNNNNTNNSTTSNNNITTNNNNNNNNNINNNVLSTPRKRTKGNHSKTNSLQDFETSSMNGGDDSISGAGSGGSLRRRNKDDNDENDGNSNNTNSNNSNNNNNNNNNSSNNNNNNSNNNNNNNNNNNNNNNNNNNNNNNNNNNNNNNNNNNNNNNNNNNYHNGATMMMSHNHQSIGMSSSPKKNNFKPFSRNCSLMGMGRRAWAIILGLFIVGSSISILATLVLRYSEENSIADDFARVARDRFTMLRIEFNNRLYITQTLSLLLSVFPSTSEDQFVPFSKLWSDNAEGLEGIMWAPRVSNLDRYTWEIEHSVKIREIVTNPNNSSDMRDVPAAAASDYYPILFSEPQSSNDHFKGYNIYSDMWRRPSLNKTRDTGEKVSVASPYINKLANVPKNSRSNVLLYIYQAVYTYGKVLSTVEDRRHEVIGFASCRFFISRMVSASLQRLTEEDSLDLYVFDLDSTPIGELIYYRASNAGNDDGSSPTNIMNGKMLEDRSDMIYYNTMNVGGRNWMIALRPSRKFTNKHYTFYPYAIGGVCMLLSALVSFWFAVNTKHNIKLSATNEDLHKEIYNRKLAEKALAESQERLELAMEGSEDAVWDWKVNTGELHISSRWFQILKAHDTSYQSRTLYEELKSSSTNNLNFKGDSKNGGSNNGTFNLFKNGKVDSSSPQSITNVNTTNGGGGGELRKSNSGYLYNDELFSPIILEEMVSSPNTHQLAIWNMKFLAELIHPDDKQKFISEIKKTITRETAIMEIECRMRKKYGGYLYIIMRGKVVSNETSFKDNSLRMAGTLRDMTSRKDMQRLILEKEAAEEANKAKSAFVATVSHEVRTPLSGVIGVSDLLLETNLSEEQRDYVQTIQKSSQALLTIINDILDYSKLESRQLKMETLPFSIIETCQAVIHMLSVAANDDVDILLRVPPNVPRIIFGDAMRMRQVLLNRLSNAIKFTSRGHVLTDISVDDSIPPTNTEEEIIHLCITIEDTGIGIPQSLFDSIFEPFSQADNSTTRKYGGTGLGLSITKRLIEEVMGGTIQVSSIVGQGSKFKCIIPFLLPNTSPSDLNLISPSSLPKPFINRSPKSTYSFTDKKNSVPSTPIPSGDILINKVCLLICRDTVTELVFKEQLEWLGMIVKQVPRNVIDSIKNTILNNNNNNNNNNNNNNNNSNNSSSIISPSSLDYSDENEHLDLVLIDLEILTEHLKIPSNVPIIFITPTKFNISKHNGILNKWITKSPNQRVELIRRPAITDKLIPIISKCIKSQVQFTSGSSQLQSQQANLQQQLLHQQLCNNGQTLNNNYNSGGIGGGGGGGGSNTMNGSSGNLSNNNNFGQTPLSSGLVLLVHTGRTPPLFNNNGNSIIPPLELAVDHHGNQQQQLYQQQQQQQNNSSGNFQQFYQQQNNNSNNSFTPTLPNENSNNSIMNNSLNNNNTTPSNVTPTLFTSSPLDLQGRDTPVLQPPAYRKKALIVEDNELNRKVLAQLFKKIDWTISFAENGREALKEITGERCFDIVFMDCQMPVLDGFQTTKIIRSKERENNWKRMNIVALSAGSSSSFVQDCLDSGMDSFMGKPITLATLKDALAKWGGYNN

SEQ ID NO: 7521 - protein, 710 aa, Rattus norvegicus
MGMSKSRGCFGYPLSIFFIVVNEFCERFSYYGMRALLVLYFRNFLGWDDDLSTAIYHTFVALCYLTPILGALIADSWLGKFKTIVSLSIVYTIGQAVISVSSINDLTDHDHDGSPNNLPLHVALSMIGLALIALGTGGIKPCVSAFGGDQFEEGQEKQRNRFFSIFYLAINAGSLLSTIITPILRVQQCGIHSQQACYPLAFGVPAALMAVALIVFVLGSGMYKKFQPQGNIMGKVAKCIGFAIKNRFRHRSKAFPKREHWLDWAKEKYDERLISQIKMVTKVMFLYIPLPMFWALFDQQGSRWTLQATTMTGKIGTIEIQPDQMQTVNAILIVIMVPIVDAVVYPLIAKCGFNFTSLKKMTVGMFLASMAFVVAAIVQVEIDKTLPVFPSGNQVQIKVLNIGNNDMAVYFPGKNVTVAQMSQTDTFMTFDVDQLTSINVSSPGSPGVTTVAHEFEPGHRHTLLVWGPNLYRVVKDGLNQKPEKGENGIRFVSTLNEMITIKMSGKVYENVTSHSASNYQFFPSGQKDYTINTTEIAPNCSSDFKSSNLDFGSAYTYVIRSRASDGCLEVKEFEDIPPNTVNMALQIPQYFLLTCGEVVFSVTGLEFSYSQAPSNMKSVLQAGWLLTVAIGNIIVLIVAEAGHFDKQWAEYVLFASLLLVVCIIFAIMARFYTYINPAEIEAQFDEDEKKKGVGKENPYSSLEPVSQTNM

SEQ ID NO: 7522 - protein, 551 aa, Pseudomonas saccharophila
MSHILRAAVLAAVLLPFPALADQAGKSPAGVRYHGGDEIILQGFHWNVVREAPNDWYNILRQQASTIAADGFSAIWMPVPWRDFSSWTDGGKSGGGEGYFWHDFNKNGRYGSDAQLRQAAGALGGAGVKVLYDVVPNHMNRGYPDKEINLPAGQGFWRNDCADPGNYPNDCDDGDRFIGGESDLNTGHPQIYGMFRDELANLRSGYGAGGFRFDFVRGYAPERVDSWMSDSADSSFCVGELWKGPSEYPSWDWRNTASWQQIIKDWSDRAKCPVFDFALKERMQNGSVADWKHGLNGNPDPRWREVAVTFVDNHDTGYSPGQNGGQHHWALQDGLIRQAYAYILTSPGTPVVYWSHMYDWGYGDFIRQLIQVRRTAGVRADSAISFHSGYSGLVATVSGSQQTLVVALNSDLANPGQVASGSFSEAVNASNGQVRVWRSGSGDGGGNDGGEGGLVNVNFRCDNGVTQMGDSVYAVGNVSQLGNWSPASAVRLTDTSSYPTWKGSIALPDGQNVEWKCLIRNEADATLVRQWQSGGNNQVQAAAGASTSGSF

SEQ ID NO: 7523 - protein, 162 aa, Parasponia andersonii
MSSSEVNKVFTEEQEALVVKAWAVMKKNSAELGLQFFLKIFEIAPSAKNLFSYLKDSPVPLEQNPKLKPHATTVFVMTCESAVQLRKAGKVTVKESDLKRIGAIHFKTGVVNEHFEVTRFALLETIKEAVPEMWSPEMKNAWGVAYDQLVAAIKFEMKPSST

SEQ ID NO: 7524 - protein, 2654 aa, Xenopus laevis
MATDPGLEMASMIPALRELASAGAEEYNTTVQKPRQILCQFIDRILTDVDVVAVELSKNTDSQPSSVMLLDFIQHIMKSTPLMFLSANNGDQSAETNQNCVAFSNWIISRLLRIGATPSCKALHRKIAEVIRSLLFLFKNKSSFLFGVFTKDLLHLFEDLIYIHEQNMEKSVVWPVTISRFLSNASENQTCLRCTQFQLLNMQNIEPLESTLLMVLMDNEHDISPVFFQRQNLLLWGIGCSLLDYGSTSLKIQALHFLRQLIKLGGPPEQGAYFFFIVFFGILTCIKDMDLEEVSLYEMPLLKLVKVLFPFESKSYLNIEPVYLNMLLEKLAALFDGGILSNIQSAPLKEALCYMVHYFLSIVPPGYESAKEVREAHVRCICRAFVDVLGLQSKQEYLVCPLHEALRIENLVFMQQQRMQPLSTDSEGGGSSSSDEVQEKRPRLSLTAKPLRRNTPSVPAPVDMKTKSILWKAVSAKFSSILCKLEGDEVTDEEMVSLLEGLNTTVRVAALNTVHIFTNDSTDTDQLVSDLSNTSGIQSVEIVPHVFWLSPEDILKILKICRKVLDSAHQRANINDILMKIIKIFDAILYIHAGNRLNDQTLKDLCSMISLPWLQNHSNHASFKVASFDPTLMTISERIGQHYSPEIQSQLVFLLCLFPKMLCPEWRLAVYQWALDSPHEIVRARCIKGFPVLLCNVSQQGYGPIPKILIDCLNDASELVKKELANSVGMFASGLACGFELQYSPTAPTAAESEFLCSSLTVTALPSSKLSRMTASALKPFLALLNRNMPSSVKMAFIENMPMLFAHLSLEKDDLDSRTVIESLLNLMEDPDKDVRTAFSGNIKHLLACADCEDGYLKEIVVSRMKKAYTDAKMSRDNEMKDTLILTTGDIGRAAKGELVPFALLHLLHCLLSKSPCVAGASYTEIRSLAAAKSTSLHIFFSQYKKPICQFLIESLHSSQAALLTNTPGRSSEMQKQEATHHREAALDILSEIANVFDFPDLNRFLTRTLQLLLPYLAAKASPTASTLIRTIAKQLNVNRREILINNFKYIFSHLVCSCTKDELEKSLHYLKNETEIELGSLLRQDYQGLHNELLLRLGEHYQQVFSGLSILATYASNDDPYQGPRNFAKPEIMADYLQPKLLGILAFFNMHLLSSSIGIEDKKMALNSLVSLMKLMGPKHISSVRVKMMTTLRTGLRYKEEFPGLCCSAWDLFVRCLDQAYLGPLLSHVIVALLPLLHIQPKETVAVFRYLIVENRDAVQDFLHEIYFLPDHPELKEIQKVLQEYRKETTKSTDLQTAMQLSIRAIQHENVDVRMHALTSLKETLYKNQAKLLQYSTDSETVEPVISQLVTVLLIGCQDANPQARLFCGECLGQLGAIDPGRLDFSPSETQGKGFTFVSGVEDSDFAYELLTEQTRAFLAYADNVRAQDSAAYAIQELLSIFECKEGRTDCPGRRLWRRFPEHVQEILEPHLNTRYKSSRKAVNWSRVKKPIYLSKLGNNFADWSATWAGYLITKVRHELARRVFSCCSIMMKHDFKVTIYLLPHILVYVLLGCNKEDQQEVYAEIMAVLKHEDPLMRRLQDSASDLSQLSTQTVFSMLDHLTQWAREKFQALNAEKTNPKPGTRGEPKAVSNEDYGEYQNVTRFLDLIPQDTLAVASFRSKAYTRALMHFESFIMEKKQEIQEHLGFLQKLYAAMHEPDGVAGVSAIRKKEASLKEQILEHESIGLLRDATACYDRAIQLKPEEIIHYHGVVKSMLGLGQLSTVITQVNGILNSRSEWTAELNTYRVEAAWKLSQWDLVEEYLSADRKSTTWSIRLGQLLLSAKKGERDMFYETLKVVRAEQIVPLSAASFERGSYQRGYEYIVRLHMLCELEHSVKMFLQKPSVEPAVDSLNLPARLEMTQNSYRAREPILAVRRALQTINKRPNHADMIGECWLQSARVARKAGHHQTAYNALLNAGESRLSELNVERAKWLWSKGDVHQALIVLQKGAELFLSSTSAPPEQQLIHGRAMLLVGRLMEETANFESNAVMKKYKDVTALLPEWEDGHFYLAKYYDKLMPMVTDNKMEKQGDLIRYIVLPFGRSLQFGNQYIYQSMPRMLSLWLDFGAKVYEWEKAGRADRLQMKNELMKINKVISDHKNQLAPYQFLTAFSQLISRICHSHDEVFAVLMEIVAKVFVAYPQQAMWMMTAVSKSSYPMRVNRCKEILEKAIHMKPSLGKFIGDATRLTDKLLELCNKPVDGNTSTLSMNIHFKMLKKLVEETTFSEILIPLQSVMIPTLPSTAGKRDHADHDPFPGHWAYLSGFDDAVEILPSLQKPKKISLKGSDGKSYIMMCKPKDDLRKDCRLMEFNSLINKCLRKGAESRRRELHIRTYAVIPLNDECGIIEWVNNTAGFRNILIKLYKEKGIYMGGKELRQCMLPKSAPLQEKLKVFKEALLPRHPPLFHEWFLRTFPDPTSWYNSRSAYCRSTAVMSMVGYILGLGDRHGENILFDSLTGECVHVDFNCLFNKGETFEVPEIVPFRLTHNMVNGMGPMGTEGLFRRACEVIMRLMREQRESLMSVLKPFLHDPLVEWSKPARGSSKGQVNETGEVMNEKAKTHVLDIEQRLQGVIKTRNRVKGLPLSIEGHVHYLIQEATDENLLSQMYLGWAPYM

SEQ ID NO: 7525 - protein, 1234 aa, Homo sapiens
MAGAQPGVHALQLEPPTVVETLRRGSKFIKWDEETSSRNLVTLRVDPNGFFLYWTGPNMEVDTLDISSIRDTRTGRYARLPKDPKIREVLGFGGPDARLEEKLMTVVSGPDPVNTVFLNFMAVQDDTAKVWSEELFKLAMNILAQNASRNTFLRKAYTKLKLQVNQDGRIPVKNILKMFSADKKRVETALESCGLKFNRSESIRPDEFSLEIFERFLNKLCLRPDIDKILLEIGAKGKPYLTLEQLMDFINQKQRDPRLNEVLYPPLRPSQARLLIEKYEPNQQFLERDQMSMEGFSRYLGGEENGILPLEALDLSTDMTQPLSAYFINSSHNTYLTAGQLAGTSSVEMYRQALLWGCRCVELDVWKGRPPEEEPFITHGFTMTTEVPLRDVLEAIAETAFKTSPYPVILSFENHVDSAKQQAKMAEYCRSIFGDALLIEPLDKYPLAPGVPLPSPQDLMGRILVKNKKRHRPSAGGPDSAGRKRPLEQSNSALSESSAATEPSSPQLGSPSSDSCPGLSNGEEVGLEKPSLEPQKSLGDEGLNRGPYVLGPADREDEEEDEEEEEQTDPKKPTTDEGTASSEVNATEEMSTLVNYIEPVKFKSFEAARKRNKCFEMSSFVETKAMEQLTKSPMEFVEYNKQQLSRIYPKGTRVDSSNYMPQLFWNVGCQLVALNFQTLDVAMQLNAGVFEYNGRSGYLLKPEFMRRPDKSFDPFTEVIVDGIVANALRVKVISGQFLSDRKVGIYVEVDMFGLPVDTRRKYRTRTSQGNSFNPVWDEEPFDFPKVVLPTLASLRIAAFEEGGKFVGHRILPVSAIRSGYHYVCLRNEANQPLCLPALLIYTEASDYIPDDHQDYAEALINPIKHVSLMDQRARQLAALIGESEAQAGQETCQDTQSQQLGSQPSSNPTPSPLDASPRRPPGPTTSPASTSLSSPGQRDDLIASILSEVAPTPLDELRGHKALVKLRSRQERDLRELRKKHQRKAVTLTRRLLDGLAQAQAEGRCRLRPGALGGAADVEDTKEGEDEAKRYQEFQNRQVQSLLELREAQVDAEAQRRLEHLRQALQRLREVVLDANTTQFKRLKEMNEREKKELQKILDRKRHNSISEAKMRDKHKKEAELTEINRRHITESVNSIRRLEEAQKQRHDRLVAGQQQVLQQLAEEEPKLLAQLAQECQEQRARLPQEIRRSLLGEMPEGLGDGPLVACASNGHAPGSSGHLSGADSESQEENTQL

SEQ ID NO: 7526 - protein, 527 aa, Lycopersicon esculentum
MEPNSYGSGKAAVGDGVGAPMLQTAPAPAPIPSANAPPPFLVKTYDMVDDPSTDKIVSWSPTNNSFVVWDPPEFAKDLLPKYFKHNNFSSFVRQLNTYGFRKVDPDRWEFANEGFLRGQKHLLKSISRRKPAHGHAQQQQQPHGNAQQQMQPPGHSASVGACVEVGKFGLEEEVERLKRDKNVLMQELVRLRQQQQATDNQLQGMVQRLQGMELRQQQMMSFLAKAVNRPGFLAQFVQQQNESNKRIAEGSKKRRIKQDIESQDPSVTPADGQIVKYQPGINEAAKAMLRELSKLDSSPRLDNFSNSPESFLIGDGSPQSNASSGRVSGVTLQEVPPTSGKPLLNTASAIAGQSLLPATSEMQSSHLGTCSEIINNQLSNIIPLVGGEDLHPGSLSASDMIMPELSQLQGILPENNTDVIGCDSFMDTSAVEGKVGLDIIGSCLSPGADIDWQSGLLDEIEEFPSVGDPFWEKFLQSPCSPDAAMDDDISNTSETKPQINGWDKTQNMEHLTEQMGATNIKQQKHMI

SEQ ID NO: 7527 - protein, 182 aa, Ipomoea purpurea
MSGFSSSSCSVAVLLFFFLFISFTEARDHLVGGKPDAWKIPSSPSDSLNNWAQKTRFLPGDSLVWKYDGKADAVLEVSKRDYVTCNISLPIGAMVDGTRSIVLERSGPYYFISGAEGHCQKGQKVIVVVLSEKHTRKFLTAAAPSPADEVEAPAVAPTSGAVGLKGSLGVGFGLVVGLLFLM

SEQ ID NO: 7528 - protein, 503 aa, Avicennia marina
MSTMAIRMPTRQLFIDGEWREPVQRKRILIINPANEQTIGDIPAATAEDVDIAVEAARKAFFRNSGKDWSSTTGAHRAKYLRAIAAKIKDRKAELVKLEAIDSGKPLVEASLDMDDVIGCFEYFAGIAERLDSEQRTPVSLPMETFKCHLLKEPIGVVGLISPWNYPLLMAIWKVAPALASGCTAILKPSELASVTCLELAEVCMEVGLPPGVLNILTGLGPEAGAPLVTHPHVAKISFTGSDTTGVKIMTAAAQLVKPVTLELGGKSPIVVFEDVDLDTAAEWTLFGCFWTNGQICSATSRLLVHESIAATFLEKLVKWCEKIKISDPLEEGCRLGPIVSRRQYEKVMKYISTAKEEGATILCGGARPEHLEKGYFVQPTIITDVKTSMQIWIEEVFGPVLCVKTFATEDEAIDLANDTHYGLAAAVISKDLDRCERMAKAFQVGAVWVNCSQPCFYQAPWGGKKRSGFGRELGERGLDIYLNVKQVTQYVSSEPWDWYKSP

SEQ ID NO: 7529 - protein, 502 aa, Avicennia marina
  unsure (1)..(502): unsure at all Xaa locations
MAIRIPSRQLFIDGKWREPVNRKRLPIVNPATEETIGDIPAATAEDVNIAVEAARKAFFHNGGKDWATASGAHRAKYLRAIAAKVTEKKEELAKLEVLDCGKPLEEAAWDMDDVAGCFEYFADLAERLDSNQIPVSLPMDTFKCHVLKEPIGVVGLVXPWNYPLLMATWKVAPALAAGCTAILKPSEIASVTCLELAQVCKEVGLPAGVLNILTGLGPEAGAPLASHPHVDKITFTGSGATGSKIMTAAAQLVKPVTLELGGKSPIVVFEDVDLDTAAEWTLFGCFWTNGQICSATSRLLVHESIATTFLEKLVKWCEKIKISDPLEEGCRLGPIISRGQYEKVMKFISTAKEEGATILCGGARPEHLEKGYFVQPTIITDVKTSMQIWIEEVFGPVLGVKTFSKEDEPFELANDPHYGWAAAVLSQDLERCERMTKAFQAGIVWVNCSQPCFCQAPWGGKKRSGFGRDLGEWGLDNYLNVKQVTRYVSSEPWDWYKSPSKL

SEQ ID NO: 7530 - protein, 555 aa, Brassica napus
MRGVKLLAACLYLAAAATVVVHAEDPYFHHVWNVTYGTASPLGVPQQVILINGQFPGPNINSTSNNNVIINVFNNLDEPFLLTWNGIQHRKNCWQDGTPGTMCPIMPGTNYTYHFQPKDQIGSYFYYPTTGMHRAAGGYGGLRVNSRLLIPVPYADPEDDYTVLIGDWYTKSHTQLKKFLDGGRTIGRPDGIVINGKSGKGDGSDAPLFTLKPGKTYRVRICNVGVKTSINFRIQNHKMKLVEMEGSHVLQNDYDSLDVHVGQCFGTIVTANQEPKDYYMVASSRFLKTVITTTGLLRYEGGKGPASSQLPAGPVGWAWSLNQFRSFRWNLTASAARPNPQGSYHYGKINITRTIKLVNTQGKVDGKLRFALNGVSHTEPETPLKLAEYFGISDKVFKYDTITDDPTPEQIKNIKIEPNVLNITHRTFVEVVFENHEKSVQSWHLDGYSFFSVAVEPGTWTPEKRKNYNLLDAVSRHTVQVYPKCWAAILLTFDNCGMWNVRSENTERRYLGQQLYASVLSPEKSLRDEYNMPETSLQCGLVKNTPKPVNPYAGA

SEQ ID NO: 7531 - protein, 587 aa, Cucumis sativus
MAKVADKPFFPKPFLSFLVLSIIFGFGITLSEAGFPKIKHYKWDVEYMFWSPDCVENIVMGINGEFPGPTIRANAGDIVVVELTNKLHTEGVVIHWHGILQRGTPWADGTASISQCAINPGETFTYRFVVDKAGTYFYHGHLGMQRSAGLYGSLIVDPPEGRSEPFHYDEEINLLLSDWWHQSVHKQEVGLSSKPMRWIGEPQSILINGKGQFDCSIAAKYNQGLKQCELSGKEKCAPFILHVQPKKTYRIRIASTTALASLNFAIGNHELLVVEADGNYVQPFVTSDIDIYSGESYSVLITTDQNPLENYWVSIGVRARLPKTPPGLTLLNYLPNSASKLPISPPPETPHWEDFDRSKNFTFRIFAAMGSPKPPVRYNRRLFLLNTQNRINGFMKWAINNVSLALPPTPYLAAMKMRLNTAFNQNPPPETFPLNYDINNPPPNPETTTGNGVYKFNMGETVDVILQNANMLNPNMSEIHPWHLHGHDFWVLGYGEGKFYAPEDEKKLNLKNPPLRNTVVIFPYGWTAIRFVADNPGVWAFHCHIEPHLHMGMGVVFAEGVHMVGMIPPKALACGSTALVKNYPRLP

SEQ ID NO: 7532 - protein, 253 aa, Plasmodium falciparum (isolate fcm17 / Senegal)
MYLFIYIFFFFFFFFFFVIVQKDIEQLDIKCAHEQMNIQKQYDEKKKPLFEKRDEIIQKIPGFWANTLRKHPALSDIVPEDIDILNHLVKLDLKDNMDNNGSYKITFIFGEKAKEFMEPLTLVKHVTFDNNQEKVVECTRIKWKEGKNPIAAVTHNRSDLDNEIPKWSIFEWFTTDELQDKPDVGELIRREIWHNPLSYYLGLEEFDEFDDDFDEEFDDDDDDDDDDDDDDDDDDKDDDLDGDDDGNNDDNDD

SEQ ID NO: 7533 - protein, 293 aa, Stigmatella aurantiaca
MQASLTSTDSLSTYLSEINQYPLLTQQEEQALARSFRQGDLQAGHRLVTSNLRFVVKVAYEYRSYGLRMSDLIQEANIGLMKAVQKFDPDKGIRLISYAVWWILAYIQGYVLKNWSLVKLGTTQAQRRLFFALARTRRELEKQGNTDGNIVNAEEIARKLNVKASEVREMEQRMGGRDLSLDAPMGEDGDATHMDFVASDSVSQADEVADRQEADLARTRIQQALQRLDPRERFIIEKRVMSDSEMTLSELGEHFGFSRERARQLEIRAKDKLKAELATLMAEVGGDQASMLG

SEQ ID NO: 7534 - protein, 576 aa, Myxococcus xanthus
MVRRPGGVMMGAPSSQSPFMEARLPASLATVFAALPDPSYVLDDTGRVLVCSQAGARTVGRLPEELVGRHWGELGFPPEELARLETARARVMLIQDTCELEAPWTTQTGLRRHALMLSPLPSEDGGACCVLVTARPLTDAEGVFSRAMELELAARAEVEQDERRRSFLNQGMTTLFTHPPDPESIYTLLAHLAVPDVVDWCLVDTLEQRPWVTRVAAACLDPTEEERSGALPTRTELWDDATVGLLPVLRTGDPELVPAVTDSLLRAAAAETAHPALLRLLQARSYMIVPLRARGHTLGAVNFVSSGSGRGYGPDDLALAEELCLRARLAIDNARLVGESRRAARAREDLLAVVSHDLKNPLGVVQLGAALLLRGAGAKPGGSVAKQATRIQDATERMSRLISDLLDWGRLEAGGLPLEWAEHRVVGLLTEALDSIRPLAESKRLRLSVEFPTAGVRVLCDKVRLQVLANLLANAVKFTTAGGDLMLGARARGGEVSVHVRDTGSGITPDALPHIFDRYWQARDAGSRGTGLGLPSPRGSSKTHGGGIQAESTLPSAGASASHAVHPPLARRATDA

SEQ ID NO: 7535 - protein, 113 aa, Cyanidium caldarium
MFSKLEAIIRPFKLEEVKVRLMTFGVPGITVTNVMGCGKQIGGIERSKGVEYDSELIEKVKIEIVVMNEHIDELIEIIINAVWTGEIGDGKIFVSPVSSVIRIRTQDKDLDAI

SEQ ID NO: 7536 - protein, 112 aa, Porphyra purpurea
MKKIEAIIRPFKLNEVKLALVKGGIGGMTVVKVSGFGRQKGQTERYKGSEYSIDIIDKIKIEIIVSDDKVNSITEIIIKTAKTGEIGDGKIFISDVEQVIRIRTNDLNSAAL

SEQ ID NO: 7537 - protein, 743 aa, Leishmania major
MELMATMALDRDAINTVTLRLLPPSAAPGAAVSLWLLWHTIPITASLSRTLSRLVSIEASAMAQTPLDDTADTAAMYHAAHPSHDQKARSPSAASASSSSSSASTSSALSTRTRHTCSTAEAEKTSWIELVRVGYVVSEIHAYCVLLKCRRAAQAARLKAALEEGAALGLTAPVEYVSDARPVVVTHCAFAERRGKVEAVGPDDASTTDHHPPRASARWCTGDHMVSLWEAIATVYPVRGNGNSGDDGDGDSASDGDGEHHDTRGSLQRHHRYHHHPHHLQSSPHTASSAPVTPSPARQSPAASSVMRKGAAPPPSRHAPTVTAAAAASTPKHMPLSSATAVGRASPSRPPHKPPHFPLAGRGGGGLGSLRSGDFCTICLDPLYLSACVTTLCQHSFHLSCYAQLPSGSAECPLCRFSVYDLLNDARCKVCGTYEDLWVCLICGHVACGRARRDHQQKHYHASGHSCSWQSTTNRMRNLSSRMFLHQEVALLLDEGGADDAATADSPHSIGSTTQLRSAEAGTSSVEAATTAMGATLSPSGADRVRYRSWSDSLVDSDLQEALNESKEEAVAQYYTQFLRQLAEEQQRWYEARLAERRRRRHERQMAAVAMAGGRRAENASSPAAEWLSHVAPSAHTALQCIALDERRLRRRVFSEYVQATISLLQAAQREYAGMAHMLRAVRDDAQQQVLLRSHFNSGLMAQVERVRQRTRELQRKGATAAQQKAAEEAELQRLVDEALSSL

SEQ ID NO: 7538 - protein, 243 aa, Glycine max
MGFEETELRLGLPGNGGTEEVLIRKRGFSETETGHEDESATTVDLMLNLSSKEAATTAAAAADPTDKHKTLPKEKTLLPADPAKPPAKTQVVGWPPVRSFRKNMLAVQKSVGEESEKNSSPNASFVKVSMDGAPYLRKVDLKMYKSYRELSDSLGKMFSSFTFGNCESQGMKDFMNESKLNDLLNSSDYVPTYEDKDGDWMLVGDVPWEMFVESCKRLRIMKGKEAIGLGLAPRAMAKCKNRS

SEQ ID NO: 7539 - protein, 89 aa, Ascaris lumbricoides
YMSKQSDINAEMRHILIDWLADVVVEYDLQLETLHLTVSLIDRTLSVVDCPRLKLQLIGAAAVMVAAKYEEIYPPPLKEYVYITDDTYS

SEQ ID NO: 7540 - protein, 249 aa, Clostridium scindens
MKLVQDKITIITGGTRGIGFAAAKLFIENGAKVSIFGETQEEVDTALAQLKELYPEEEVLGFAPDLTSRDAVMAAVGTVAQKYGRLDVMINNAGITMNSVFSRVSEEDFKNIMDINVNGVFNGAWSAYQCMKDAKQGVIINTASVTGIYGSLSGIGYPTSKAGVIGLTHGLGREIIRKNIRVVGVAPGVVDTDMTKGLPPEILEDYLKTLPMKRMLKPEEIANVYLFLASDLASGITATTISVDGAYRP

SEQ ID NO: 7541 - protein, 249 aa, Clostridium scindens
MNLVQDKVTIITGGTRGIGFAAAKIFIDNGAKVSIFGETQEEVDTALAQLKELYPEEEVLGFAPDLTSRDAVMAAVGQVAQKYGRLDVMINNAGITSNNVFSRVSEEEFKHIMDINVTGVFNGAWCAYQCMKDAKKGVIINTASVTGIFGSLSGVGYPASKASVIGLTHGLGREIIRKNIRVVGVAPGVVNTDMTNGNPPEIMEGYLKALPMKRMLEPEEIANVYLFLASDLASGITATTVSVDGAYRP

SEQ ID NO: 7542 - protein, 146 aa, Vitreoscilla stercoraria
MLDQQTINIIKATVPVLKEHGVTITTTFYKNLFAKHPEVRPLFDMGRQESLEQPKALAMTVLAAAQNIENLPAILPAVKKIAVKHCQAGVAAAHYPIVGQELLGAIKEVLGDAATDDILDAWGKAYGVIADVFIQVEADLYAQAVE

SEQ ID NO: 7543 - protein, 674 aa, Halobacterium salinarum
MTSVQNTESETAAGATTIGVLFAGSDPETGPAACDLDEDGRFDVTQIRDFVAARDRVDDPDIDCVVAVHEPDGFDGVAFLEAVRQTHAEFPVVVVPTAVDEDVARRAVDADATGLVPAVSEDATAAIADRIEQSAPAHSEDTETRMPISDLTVESERRLKEQALDEAPIGITISDATDPEEPIIYINDSFEDITGYSPDEVVGANHRFLQGPKTNEEPRGGFWTAITEDHDTQVVLRNYRRDGSLFWNQVDISPIYDEDGTVSHYVGFQMDVSERMAAQQELQGERQSLDRLLDRVNGLMNDVTSALVRAADREEIETRITDRIGTGGEYAGAWFGRYDATEDTITVAEAAGDCEGCDGDVFDLASAGEAVALLQDVVEQREALVSTDADGVSGTADGDACVLVPVTYRSTTYGVLAVSTAEHRIDDREQVLLRSLGRTTGASINDALTRRTIATDTVLNIGVELSDTALFLVELAGATDTTFEQEATIADSQTQGVLMLVTTPHDDPQAVVDTALGYDAVQDAEVIVSTDDESVVQFDLSSSPLVDVLSECGSRVIRMHADRTTLELDVRVGTEGAARRVLSTLRDKYADVELVAYHEDDPEQTPHGFREELRNDLTDRQLTALQKAYVSGYFEWPRRAEGKQLAESMDIVPSTYHQHLQAAKQKLVGAFFEE

SEQ ID NO: 7544 - protein, 348 aa, Acinetobacter calcoaceticus
MSLYLNRIPAMSNHQVALQFEDGVTRFICIAQGETLSDAAYRQQINIPMDCREGECGTCRAFCESGNYDMPEDNYIEDALTPEEAQQGYVLACQCRPTSDAVFQIQASSEVCKTKIHHFEGTLARVENLSDSTITFDIQLDDGQPDIHFLAGQYVNVTLPGTTETRSYSFSSQPGNRLTGFVVRNVPQGKMSEYLSVQAKAGDKMSFTGPFGSFYLRDVKRPVLMLAGGTGIAPFLSMLQVLEQKGSEHPVRLVFGVTQDCDLVALEQLDALQQKLPWFEYRTVVAHAESQHERKGYVTGHIEYDWLNGGEVDVYLCGPVPMVEAVRSWLDTQGIQPANFLFEKFSAN

SEQ ID NO: 7545 - protein, 294 aa, Nicotiana tabacum
YTTYFAEALIAEAEADKDIVAIHAAMGGGTGMNLFHRRFPTRCFDVGIAEQHAVTFAAGLACEGLKPFCAIYSSFLQRAYDQVVHDVDLQKLPVRFAMDRAGLVGADGPTHCGAFDVTFMACLPNMVVMAPSDETELFHMVATAAAIDDRPSCFRYPRGNGIGVELPVGNKGTPLEVGKGRILVEGERVALLGYGSAVQNCLAAAAVLESRGLQVTVADAPFCKRLDHALIRSLAKSHEVLITVEEGSIGGFGSHVAQFMALDGLLDGKLKWRRIVLPDRYIDHGSPVDQLAEA

SEQ ID NO: 7546 - protein, 520 aa, Homo sapiens
GEHQLTGHKVAVKILNRQKIRSLDVVGKIKREIQNLKLFRHPHIIKLYQVISTPTDFFMVMEYVSGGELFDYICKHGRVEEMEARRLFQQILSAVDYCHRHMVVHRDLKPENVLLDAHMNAKIADFGLSNMMSDGEFLRTSCGSPNYAAPEVISGRLYAGPEVDIWSCGVILYALLCGTLPFDDEHVPTLFKKIRGGVFYIPEYLNRSVATLLMHMLQVDPLKRATIKDIREHEWFKQDLPSYLFPEDPSYDANVIDDEAVKEVCEKFECTESEVMNSLYSGDPQDQLAVAYHLIIDNRRIMNQASEFYLASSPPSGSFMDDSAMHIPPGLKPHPERMPPLIADSPKARCPLDALNTTKPKSLAVKKAKWHLGIRSQSKPYDIMAEVYRAMKQLDFEWKVVNAYHLRVRRKNPVTGNYVKMSLQLYLVDNRSYLLDFKSIDDEVVEQRSGSSTPQRSCSAAGLHRPRSSFDSTTAESHSLSGSLTGSLTGSTLSSVSPRLGSHTMDFFEMCASLITTLAR

SEQ ID NO: 7547 - protein, 333 aa, Petroselinum crispum
MEYSSSFVDTSLDLNAKPLQLFSETPIQQVQGSFIDFGMRTSVKEENNGALIEELNRVNTENKKLTEMLTVMCENYNTLRNNLMDYMSKNPEPNLETTTTKKRKSVERSSTTSCMIKNNASSAKNNDNSESCSTDEDHNSTKKPKEEHVKAKISRVYFRSEASDTTGLIVKDGYQWRKYGQKVTRDNPSPRAYFKCSYAPTCPVKKKVQRSIDDQSILVATYEGEHNHPHPAKLEPNDSSSNRCVTPASLRCSTSLNLSAPTLTLDMTKSKKSITEDANKKATTKKIDSPEFQQFLVDQMASSLTKDPSFKAALAAAISGKILQQNQQRNGEH

SEQ ID NO: 7548 - protein, 221 aa, Hemerocallis hybrid cultivar
MGRGKIEIKKIENSTNRQVTYSKRRSGIMKKAKELTVLCDADVSIIMFSSTGKFSEYCSPGTDTKTVFERYQQATQTNLWSTQYEKMQNTLNHLKEINHNLRKEIRQRIGEELDGMDFKELRGLEQNLDEALKSVRARKYHVITTQTDTYKKKVKNSQEAHKTLLHELDDAVYGYADEDPGNYDSSLALAHGGSNMYAYRVQPSQPNLHGMSYGPHDLRLA

SEQ ID NO: 7549 - protein, 497 aa, Corynebacterium glutamicum
MESSMVENNVAKKTVAKKTARKTARKAAPRVATPLESHPISATPARSIDGTSTPVEAADTIETTAPAAKAPAAKAPAKKVAKKTARKAPAKKTVAKKATTAKAAPATAKDENAPVDDDEENLAQDEQDFDGDDFVDGIEDEEDEDEDGVEALGEESEDDEEDGSSVWDEDESATLRQARKDAELTASADSVRAYLKQIGKVALLNAEQEVSLAKRIEAGLYATHRMEEMEEAFAAGDKDAKLTPAVKRDLRAIARDGRKAKNHLLEANLRLVVSLAKRYTGRGMAFLDLIQEGNLGLIRAVEKFDYSKGYKFSTYATWWIRQAITRAMADQARTIRIPVHMVEVINKLGRIQRELLQELGREPTPQELSKEMDISEEKVLEIQQYAREPISLDQTIGDEGDSQLGDFIEDSEAVVAVDAVSFTLLQDQLQDVLETLSEREAGVVKLRFGLTDGMPRTLDEIGQVYGVTRERIRQIESKTMSKRRHPSRSQVLRDYLD

SEQ ID NO: 7550 - protein, 140 aa, Clostridium perfringens
VGKSTVTGILATQLAKKGYKVGVLDADITGPSMPRFFGINEKRADIVAMDSEGKQVKFVPVKTELGIKVISMNLLMEVEDDPVIWRGPMVTGVLNQMFKDTDWEELDYLLIDMPPGTSDITLTVMQTFPIKELVIVSTPQ

SEQ ID NO: 7551 - protein, 374 aa, Homo sapiens
MANEVIKCKAAVAWEAGKPLSIEEIEVAPPKAHEVRIKIIATAVCHTDAYTLSGADPEGCFPVILGHEGAGIVESVGEGVTKLKAGDTVIPLYIPQCGECKFCLNPKTNLCQKIRVTQGKGLMPDGTSRFTCKGKTILHYMGTSTFSEYTVVADISVAKIDPLAPLYKVCLLGCGISTGYGAAVNTAKLEPGSVCAVFGLGGVGLAVIMGCKVAGASRIIGVDINKDKFARAKEFGATECINPQDLSKPIQEVLIEMTDGGVDYSFECIGNVKVMRAALEACHKGWGVSVVVGVAASGEEIATRPFQLVTGRTWKGTAFGGWKSVESVPKLVSEYMSKKIKVDEFVTHNLSFDEINKAFELMHSGKSIRTVVKI

SEQ ID NO: 7552 - protein, 404 aa, Borrelia burgdorferi B31
MPNKITKEALTFDDVSLIPRKSSVLPSEVSLKTQLTKNISLNIPFLSSAMDTVTESQMAIAIAKEGGIGIIHKNMSIEAQRKEIEKVKTYKFQKTINTNGDTNEQKPEIFTAKQHLEKSDAYKNAEHKEDFPNACKDLNNKLRVGAAVSIDIDTIERVEELVKAHVDILVIDSAHGHSTRIIELIKKIKTKYPNLDLIAGNIVTKEAALDLISVGADCLKVGIGPGSICTTRIVAGVGVPQITAICDVYEACNNTNICIIADGGIRFSGDVVKAIAAGADSVMIGNLFAGTKESPSEEIIYNGKKFKSYVGMGSISAMKRGSKSRYFQLENNEPKKLVPEGIEGMVPYSGKLKDILTQLKGGLMSGMGYLGAATISDLKINSKFVKISHSSLKESHPHDVFSIT

SEQ ID NO: 7553 - protein, 276 aa, Archaeoglobus fulgidus DSM 4304
MKKWIVLALTVTFWGLAFTAIKYSVRFLSPIAIASLRFAIANTLFAVIIILGKRIKWKDLPKVFALGIFGVSVYHVFLNLGEVYISSGVASVVISLAPIFVLILSAIFLRERITYSKVVGIIIAFLGVVVISEPSYANIYGIALVMVSTVAAAIYTTFGKSLLSKYNPITLTSNAMVLGSIPLYPFLPDSIRSLGGDLNLIGSIVFLGIFSTFFGYLGWYYFLEKEEASRASVFLLAIPVVSLLAGNILLAEPLTLRTVAGSGLVLLGIYIVVRKR

SEQ ID NO: 7554 - protein, 250 aa, Archaeoglobus fulgidus DSM 4304
MGLSRLGIETAYIGKVGSDEEGRILLADFEREGVSTDFVIRAEGRSGTAMIFVDEKGNRAILVDPGVNDTIAYDEIDVDSARKYDLIHLTSFICKNGLDSLNSQKRIVEEFDSVSFDPGMPYAERGLGDMEKILKNTTIFLPNRQEIEMLFSEDYRTAAERCIEMGIEIVAVKLGSEGCWIKKGDREVTVKPVSTKVVDTTGAGDAFNAGFLYGYLKGKDIEECGRLGNFVAAKCIEKYGAREGLPRSVD

SEQ ID NO: 7555 - protein, 289 aa, Archaeoglobus fulgidus DSM 4304
MNSKTHLLLALTMLIWAGSFIFIKIGLKELDPFNLAFYRFLLASPLLMAWVFWKRGLAKPSGSEWLHLSVLALSGVTLLYAFQFLALKYTTATNASILINTSAVFVALWGLVKGEANPRKLAGVFLSFAGVVLIVSKGTLEFFSSKTIFGDVLMIVDGFLWAVYTVLGSKMLLKYDHETLTAYAFALGTIFLIPFALMSGFANPVTFNPETVAALLYLSILCSVFAYVVWYYALTNADSTSVAVYVYLVPLFTAIFAFYALNEKPDFFTAIGGIITIAGVYLTTAKQHQ

SEQ ID NO: 7556 - protein, 753 aa, Archaeoglobus fulgidus DSM 4304
MPVLWLADVDKNDIPLVGGKGANLGELLRAEIPVPDGFVVDARTFREFIQKTGIAEKIYSLLRELDVEDTEKLDAVSREIREIIEKTEMPEDIEREIREAYRKLCEEEGKEVYVAVRSSATAEDLPDASFAGQQETYLNVVGEDEVVEKVKKCWGSLFTPRAIYYRVQKGFRHEDVSIAVVVQKMVNSEKSGVMFTSHPVSGEKKCIIEAVFGLGEAIVSGLVTPDTYVYDRVKRKIEEVKIGEKKFMLTRKDGKTVKVELPPEKANERVLSDEEIEKLVTLGELIEDHYGKPQDVEWAIEGGKIYIVQSRPITTIRKEKKEAEEEVSEEAEGKILLKGLGASPGIASGKVKVIFSEKEISKVEEGDILVTTMTTPDMVPAMKRAAAIVTDEGGMTCHAAIVSRELGVPAVVGTKVATKVLKDGMVVTVDGEKGIVYEGRIEKKEEPKPVVASAPIITATEVKVNISIPDVAERVARETNADGVGLFRIEHMVLGLEKHPMKFIRDGEIDRYIDLLYQEMKKVVKAFYPKPVWIRTIDAPTDEFRAMEGGEDEPIEANPMLGFRGIRRDLAEEEHFRAEMRAIKKLVDEGYTNVGVMLPLITSPEEVKRAKEIAISEGLPLDKIEFGVMVETPAAALILEDIIKEGIDFVSLGTNDLTQYTLAVDRNNENVAYLYNETHPAVLKLIERTIKVCKEHGVKSSICGQAGSYPHVVEKLVEFGIDSVSANPDAVQRIREVVARAEKRIILEKLRKI

SEQ ID NO: 7557 - protein, 308 aa, Archaeoglobus fulgidus DSM 4304
MGEDRRSLRVDYDDNFLRNNICSLKVSFIKQQGGAEGVKRLYADLGLALVALIWGSTFPVVKIALDSMSPFAFNTVRFFIACLFFLPFLKGWDFKDGFKIGIASFLGYTFQTVGLDYTTATNAGFITSTYVVLAPIISWLVYKDVFDKRDVSGVLLAFVGFYFLSGYSGFNIGDILMLFCALFFGAEIAMISHYSRLSNPTMLAFWQSFAIFILSAPFAVFTTTKFEINTTVILCLLITAFFATFVAKMLQNWLQSYTKSSDAAVILSLEGVFAHLFSVAVLAEILTPVQYFGAFLILLAVIIVSLRV

SEQ ID NO: 7558 - protein, 419 aa, Archaeoglobus fulgidus DSM 4304
MFSTSDGILTVEGVKVTEIVRETGTPVYVTSRALLERNLEAYKKAFSNEGLLYAVKANNNLALMRIIASHGFGADVFSDGELYLASLAGFRKDMVLFNGNSKSRKEIEMGVTAGVKFSVDSLDELRTISKIAKEVGKEVEIAFRVNPDVDPKTHPKIATGLRESKFGIPHEMVREAYEMALKLDGVVPVGIHCHIGSQILDLSPFVHALNKVMDIAVDIEKLGVELSFVDMGGGLGIDYEGKGAPTPKDLASAILPEFEGRKADLTSDPQLWLEPGRSIVGNTTVLITRVNAVKKGYKNFVAVDAGFNVLIRPAMYGSYHRVAVANKMDAEPEEVYTVVGPICESGDVLARDRKLPKVEVGDLIAVFDAGAYGFVMSSQYNGRPRCAEVLVSGDRWDVIREKESYGDLIEKQRLPEWLL

SEQ ID NO: 7559 - protein, 494 aa, Archaeoglobus fulgidus DSM 4304
MIEENLVEFIEILMLATAVAVTVKFIRLPYTIALVLAGLFVGLAGLLPEVPLSREIVFFIFLPPLLFEAAMNMDLKELRENFGPIALIAFLGVVVTTTVVGFSLNWILGIPLALALIFGAMVSATDPVSVLATFKSISAPKKLSILIEGESVLNDGAAIVVFAIALEMMLKGVFDPLNAALDFAVVCVGGAAVGLAVGYLAYRILAKIDDALVEIAVTIVAAYLGFVLAERFHFSGVIAVVAAGLILGNYGRDFSMSPTTRVIMLDFWSVIVFLVNSIIFILIGVNTHITIFSAWKEILVAIAAVILARAFVVYPVMTYYRFPNLWKHVVFWGGLRGVIPVALALSFGNQLLSAMAFGVVLFSLLLQGISLEIFVKRKFVSESERELEEIIARYIAARSAKFELMKAVEQGRIVEPVAREMLPNLDAEIEELRSKLEEKIRGGMGSKLRKAAVKYVIDAKKSAVVDAMAGGLVSQEVALEIMRELDSKTAELME

SEQ ID NO: 7560 - protein, 326 aa, Archaeoglobus fulgidus DSM 4304
MKLVRKFARDIEVDELAICIPLEYKSACLIYELSRYTNVYAAKLDDFSTKPEVVSWLKEKGVEVKMKRDVVNAEYFLDCAAVLSRVAVKSGKERLKVVELTKTGEEYLRKMDVRMKAISLDSSTLKGTGENTHGTAFGLLDALLRLNVFLPGKKALILGFGRVGRGCARLLKSVGCDVAVWDNDETRQIEALYEGFRVEKDFTAEVVVTCTGVKGVLGKEELEEISDGSIILNMGAEMEIEPAGELIKDYGLVKEYEIAGKRYFLVADGYAANLALGSGTPIEVMDRTFSAAILALNHLSRSDFDGIIPLPHHIESTILEAIMMYK

SEQ ID NO: 7561 - protein, 120 aa, Archaeoglobus fulgidus DSM 4304
MRRLPTREVVEMKMVVAVIRPEKLECVKKALEERGFVGMTVTEVKGRGEQKGIRLQFRGREVEVDLLQKTKVEVVVSDDAVDEVVEAIVSSARTGKFGDGRIFVIPVEKSVKIRTGEEEV

SEQ ID NO: 7562 - protein, 366 aa, Archaeoglobus fulgidus DSM 4304
MAPSGASTGSGEAVVVSPYRYEEIEEEVSKAIIGMSVFDQESVDEALRELDGTDNFSRIGGNFAITASLAVAKAAAEILGLPLYAYVGGVFAKELPYPLGNVIGGGRHAEGSTSIQEFLVIPVGAKTFFEAQRANAAVHKQLKKIFKERGIFAAKGDEGAWAAQISDEQAFEILSEAIQRVEDELGVKVRMGIDVAATELWDGERYVYSDRKLTTEEQIAYMAELADRYDLLYIEDPLHEKDFEGFAELTKQVKCMVCGDDIFVTNPEIIKKGIEVGAANTVLIKPNQNGTLSGTAKAVKIAKDNGYSVVVSHRSGETEDETLAHLAVAFNAKLIKTGVVGGERISKLNELIRIEELMDKPRMVMI

SEQ ID NO: 7563 - protein, 281 aa, Archaeoglobus fulgidus DSM 4304
MVKEVFESIEDYEKSLEERIQSGSMGYRKMFDLTGKVAIVTGATGGLGGPIALGLADFGCDVVVVGRRLEVLEKLKESIEKLGQRALAVKCDITSEEDVANLVNRTVEEFGRIDILVNCAGINIPKPAEEYPLEDWNKVMDANVTGVFLVCREVGKVMVKQNGGKIINVSSVRSSYGMPKNYIAYCSSKAAVNMITKQLACEWAKYNILVNAIAPTVIATPLTAHIMKDPELSKTMKSRILLGRWGYPDDLIGAVVFFASDASNFVTGQILYIDGGVTSWA

SEQ ID NO: 7564 - protein, 447 aa, Archaeoglobus fulgidus DSM 4304
MKNVEVLTGDPKKAILKLSAPMVVSNLIFTLYNLVDGIWVAGLGPDALSAVGLFFPIFFVFIAISFGLSVGANSAVSRRIGAKRYDAACVAATLAVAMGILVSIPMTLSVVFLNGVMVFLGADGEILRLAVDYGSIMVLGSVFLVFSNVSAGILNGEGNARMAMYANAAGSLLNMVLDPIFIYLLGYGIAGAAIASVISMALSSIVFSFWFLSGRSYVRFRVAGWNLPTVFDLLRVGMPASLSMLTMSVAFMLINRVVIETGGSEGLAAYTSAWRLIQFGFVPLFGVSAALTAVSGAAYGARNPRKIGESLNYTVKLLLAVDAAILALMVAFAPQIALIFTYTEVSAVMYEEIVRTIRIAAFVLLFAPLGVSSSAVFQGMGKGERSFAITVLRAIVFQVSLCYVLAVPFGFDGVLLGFVLGEALGCFTGFSWVRLTVRRLERCLLST

SEQ ID NO: 7565 - protein, 339 aa, Archaeoglobus fulgidus DSM 4304
MAAVRGSPPEYKVRAVEEIKRMISSKPVVAIVSFRNVPAGQMQKIRREFRGKAEIKVVKNTLLERALDALGGDYLKLKDYLGDQIAIITADENPFRLFRMIEDTKVPSPLKPNQVSPVDVVVNEGPTPIPPGPLMAELQMAGLPVAIEKGKVVVKATTTVVKAGEVVRPEVARALERLDIKPIKIGLDVKAMLDSGVILTPETLAIDTEKVLEDFQRAYQMALNLAVNSAYVTEETAEILIMKAVMDARNLAINAGIFEKGVMEDILMKAHAEMLSLASLLPDEALDEELKSMLSGIAEAAAQATPSVEEREEEEKPEEEEEEEEKEEEAIEGLGALFG

SEQ ID NO: 7566 - protein, 112 aa, Archaeoglobus fulgidus DSM 4304
MKKIEAIVRAEKFPEVKAALEERGFYGMTVTDVKGRGQQGGMQIQFRGRTMEVTLLPKVKLEIVVKDDAVEEVIGLIVNSAFTGSPGDGKIFIIPVEDVVRIRTGERGDDSL

SEQ ID NO: 7567 - protein, 120 aa, Archaeoglobus fulgidus DSM 4304
MRRLPTREVVDMKMVVAVIRPEKLECVKKALEERGFVGMTVTEVKGRGEQKGIRLQFRGREVEVDLLQKTKVEVVVSDDAVDEVVEAIVSSARTGKFGDGRIFVIPVEKSVKIRTGDEEV

SEQ ID NO: 7568 - protein, 189 aa, Archaeoglobus fulgidus DSM 4304
MKLARGPRYKVPLRRRREGKTNYRKRLKLLLSRKPRLVVRITNRRVIAQIVEYAPEGDRVVVGVDSAMLREFGWKGDLNNTPAAYLTGILIAKKALQKGIGEAVLDIGLHTPTRGSRVFAVLRGAVEGGLEVPHSDEVLPDDSRIRGEHIAAYYEMNPERFGEYEKRGLKPSDLPAHVDEIKEKLMVIS

SEQ ID NO: 7569 - protein, 405 aa, Archaeoglobus fulgidus DSM 4304
MEGFRKIEWAERYMKVLGKIREQFRKERPLEGFTVGMALHVEAKTAVLVRTLVDAGAEVAITGCNPMSTQDDVADALRESGIACYAKRGMDVEEYYEALRNVIRAEPDIVIDDGADLIFLLHGEMESYAEKVKGASEETTTGVIRLRAMEREGVLKFPVIAVNDAYTKYLFDNRYGTGQSAIDGVIRATNLLMAGKIVVVAGYGWCGRGIAMRARGMGASVVVTEVDEIRALEAVMDGFRVMRMEDAAKIGDIFITATGNRDIIREEHIRLMKDGAILANAGHFNVEIDIPALERMAKAKREARKYVTEYDLGDKRVYLLAEGRLVNLVAADGHPVEVMDMSFANQALAAKYIAENWQKLERKVYRLPEELDRMVARMKLESMGVEIDQLTEEQVRYLSDWRCGT

SEQ ID NO: 7570 - protein, 367 aa, Archaeoglobus fulgidus DSM 4304
MDIIEELRAYREKDIPYSRVLSSMCTVPHPVAVEAHRMFIETNLGDPGIFRGTVELEAKLMRLIGDILHCETPAGYICSGGTEANIQGIRAARNVQKKENPNIVIPKTAHFSFEKIGDILGVKIKRAGVDEEYKVDVGQVEDLMDENTVAIVGIAGTTELGQIDPIVELSKLAEERQVELHVDAAFGGLVIPFMDNPYPFDFQNRGVSSITIDPHKMGMATIPAGGIIFRNESYLRALEVETPYLTSKTQFTLTGTRPGTGVASAYAVLKSLGFEGMREVVKNCLKNTRILVEEMRDLGFEPVIEPVMNVVSFRTDEAERIKEELYRMRWVISTIREPKAIRFVVMPHVTEEVIKNFISDFRKVLRR

SEQ ID NO: 7571 - protein, 254 aa, Archaeoglobus fulgidus DSM 4304
MQKRVTDEDIKERLDKIGFRIAVMSGKGGVGKSTVTALLAVHYAKQGKKVGILDADFLGPSIPHLFGLEKGKVAVSDEGLEPVLTQRLGIKVMSIQFLLPKRETPVIWRGPLIAGMIREFLGRVAWGELDYLLIDLPPGTGDAPLTVMQDAKPNGAVIVSTPQELTAAVVEKAITMAEQTKTAVLGIVENMAYFECPNCGERTYLFGEGKASELARKYKIEFITEIPIDSDLLKLSDLGRVEEYEPDWFEFFPY

SEQ ID NO: 7572 - protein, 254 aa, Archaeoglobus fulgidus DSM 4304
MQKRVTDEEIKERLGKIKSRIAVMSGKGGVGKSTVTALLAVHYARQGKKVGILDADFLGPSIPILFGLRNARIAVSAEGLEPVLTQKYGIKVMSMQFLLPKENTPVIWRGPLIAGMIREFLGRVAWGELDHLLIDLPPGTGDAPLTVMQDAKPTGVVVVSTPQELTAVIVEKAINMAEETNTSVLGLVENMSYFVCPNCGHKSYIFGEGKGESLAKKYNIGFFTSIPIEEELIKLADSGRIEEYEKDWFESAPF

SEQ ID NO: 7573 - protein, 745 aa, Oryctolagus cuniculus
GLQGDRDLQVLLKGSQLLKVKSGSWRRERFLKLQEDCKTIWQESRKVMRSPESQLFSIEDIQEVRVGHRTEGLEKFARDVPEDRCFSIVFKDQRRPLDLIAPSPADAQHWVQGLRKVIHHSGSMDQRQKLQHWIHSCLRKADKNKDNKMSFKELQNFLKELNIQVDDGYARKIFRECDRSQTDSLEDEEIEAFYKMLTQREEIDRAFAEAAGSGQTLSVDQLVGFLQHQQREEAAGPALALSLIERYEPSETAKAQRQMTKDGFLMYLLSADGSAFSREHRRVYQDMGQPLSHYLVSSSHNTYLLEDQLTGPSSTEAYIRALCKGCRCLELDCWDGPSLEPVIYHGYTFTSKILFCDALRAIRDYAFKVSPYPVILSLENHCSLEQQRVMARHLRTLLGPMLLDRPLDGVTSSLPSPEQLKGKILLKGKKLGGLLPSAGEGGPEATVVSDEDEAAEMEDEAVRSRVQHQPKADKVRLVQELSDLVIYCKSVHFDGFSSPGTPRRAFYEMMSFSENRALRLLQESGNSFVRHNVGHLSRIYPPGWRTDSSNYSPVDMWNGGCQIVALNFQTPGPEMDVYQGRFLDNGACGYVLKPAFLRDPNTTFNARALAQGPWWARKRLSIRVISGQQLPKVNKSKNSIVDPKVTVEIHGVSRDVASRQTAVVTNNGFNPRWDTEFEFEVVVPELALVRFVVEDYDPSSKNDFIGQSTIPLGSLKQGYPHVHLLSKTGDQHPSATLFVKISLKD

SEQ ID NO: 7574 - protein, 363 aa, Toxoplasma gondii
MAVDSSNSATGPMRVFAIGNPILDLVAEVPSSFLDEFFLKRGDATLATPEQMRIYSTLDQFNPTSLPGGSALNSVRVVQKLLRKPGSAGYMGAIGDDPRGQVLKELCDKEGLATRFMVAPGQSTGVCAVLINEKERTLCTHLGACGSFRLPEDWTTFASGALIFYATAYTLTATPKNAFEVAGYAHGIPNAIFTLNLSAPFCVELYKDAMQSLLLHTNILFGNEEEFAHLAKVHNLVAAEKTALSTANKEHAVEVCTGALRLLTAGQNTGATKLVVMTRGHNPVIAAEQTADGTVVVHEVGVPVVAAEKIVDTNGAGDAFVGGFLYALSQGKTVKQCIMCGNACAQDVIQHVGFSLSFTSLPC

SEQ ID NO: 7575 - protein, 149 aa, Homo sapiens
MPSIKLQSSDGEIFEVDVEIAKQSVTIKTMLEDLGMDPVPLPNVNAAILKKVIQWCTHHKDDPGGSGTDDIPVWDQEFLKVDQGTLFELILAANYLDIKGLLDVTCKTVANMIKGKTPEEIRKTFNIKNDFTEEEEAQVRKENQWCEEK

SEQ ID NO: 7576 - protein, 373 aa, Equus caballus
  unsure (1)..(373): unsure at all Xaa locations
XTAGKVIKCKAAVLWEQKKPFSIEEVEVAPPKAHEVRIKMVAAGICRSDDHVVSGTLVAPLPVIAGHEAAGIVESIGEGVTTVRPGDKVIPLFIPQCGKCSVCKHPEGNLCLKNLSMPRGTMQDGTSRFTCRGKPIHHFLGTSTFSQYTVVDEISVAKIDAASPLEKVCLVGCGFSTGYGSAVKVAKVTQGSTCAVFGLGGVGLSVIMGCKAAGAARIIGVDINKDKFAKAKEVGATECVNPQDYKKPIQEVLTEMSNGGVDFSFEVIGRLDTMVAALSCCQEAYGVSVIVGVPPDSQNLSMNPMLLLSGRTWKGAIFGGFKSKDSVPKLVADFMAKKFALDPLITHVLPFEKINEGFDLLRSGKSIRTILTF

SEQ ID NO: 7577 - protein, 373 aa, Equus caballus
STAGKVIKCKAAVLWEQKKPFSIEEVEVAPPKAHEVRIKMVAAGICRSDDHVVSGTLVAPLPVIAGHEAAGIVESIGEGVTTVRPGDKVIPLFIPQCGKCSVCKHPEGNLCLKNLSMPRGTMQDGTSRFTCRGKPIHHFLGTSTFSQYTVVDEISVAKIDAASPLEKVCLVGCGFSTGYGSAVKVAKVTQGSTCAVFGLGGVGLSVIMGCKAAGAARIIGVDINKDKFAKAKEVGATECVNPQDYKKPIQEVLTEMSNGGVDFSFEVIGRLDTMVAALSCCQEAYGVSVIVGVPPDSQNLSMNPMLLLSGRTWKGAIFGGFKSKDSVPKLVADFMAKKFALDPLITHVLPFEKINEGFDLLRSGKSIRTILTF

SEQ ID NO: 7578 - protein, 421 aa, Homo sapiens
  unsure (1)..(421): unsure at all Xaa locations
EEFDCHFLDEGFTAKDILDQKINEVSSSDDKDAFYVADLGDILKKHLRWLKALPRVTPFYAVXCNDSKAIVKTLAATGTGFDCASKTEIQLVQSLGVPPERIIYANPCKQVSQIKYAANNGVQMMTFDSEVELMKVARAHPKAKLVLRIATDDSKAVCRLSVKFGATLRTSRLLLERAKELNIDVVGVSFHVGSGCTDPETFVQAISDARCVFDMGAEVGFSMYLLDIGGGFPGSEDVKLKFEEITGVINPALDKYFPSDSGVRIIAEPGRYYVASAFTLAVNIIAKKIVLKEQTGSDDEDESSEQTFMYYVNDGVYGSFNCILYDHAHVKPLLQKRPKPDERYYSSSIWGPTCDGLDRIVERCDLPEMHVGDWMLFENMGAYTVAAASTFNGFQRPTIYYVMSGPAWQLMQQFQNPDFPP

SEQ ID NO: 7579 - protein, 337 aa, Sus scrofa
TDQAAFDTNIVTLTRFVMEEGRKARGTGEMTQLLNSLCTAVKAISTAVRKAGIAHLWGIAGSTNVTGDQVKKLDVLSNDLVINVLKSSFATCVLVSEEDKNAIIVEPEKRGKYVVCFDPLDGSSNIDCLVSIGTIFGIYRKNSTDEPSEKDALQPGRNLVAAGYALYGSATMLVLAMVNGVNCFMLDPAIGEFILVDRDVKIKKKGSIYSINEGYAKEFDPAITEYIQRKKFPPDNSAPYGARYVGSMVADVHRTLVYGGIFMYPANKKSPKGKLRLLYECNPMAYVMEKAGGLATTGKEAVLDIVPTDIHQRAPIILGSPEDVTELLEIYQKHAAK

SEQ ID NO: 7580 - protein, 1238 aa, Bordetella bronchiseptica
MPAPHRLYPRSLICLAQALLAWALLAWAPAQASQELTLVGKAAVPDVEITLDGDDWRWLARKRVLTLGVYAPDIPPFDVTYDERYEGLTADYMAIIAHNLGVQAKVLRYPTREQAVGALESGQIDLIGTVNGIEGRLQSLRLSVPYAADHPVLVMPIGARRAPPADLAGQRLAVDANYLPRETLQQAYPQATLHYFPSSEQALAAVAYGQADVFIGDALTTSHLVSQSYFNDVRVVAPAQIVTGGESFGVRADNTRLLRVVNAVLEAIPASERRSLIYRWGLGSSISLDFARPAYSAREQQWMANHPVVKVAVLNLFAPFTLFRTDEQFGGISAAVLQLLQLRTGLDFQIIGVDTVEELIAKLRSGEADMAGALFVNAARESVLSFSRPYVRNGLVIVTRQDPAAPADADHLDGRTIAMVRNSAAIPLLQQRYPQAKVVTADNPTEAMLLVADGQADAVVQTQISASYYVNRYFAGKLRIASALDLPPAEIALATARGQTELISILNKALYSISNDELASIVSRWRGSDGDPRTWYAYRNEIYLLIGLGLLSALLFLSWIVYLRRQIRQRKRAERALNDQLEFMRVLIDGTPNPIYVRDKEGRMLLCNDAYLDTFGVTADAVLGKTIPEANVVGDPALAREMHEFLLTRMAAEREPRFEDRDVTLHGRTRHVYQWTVPYGDSLGELKGIIGGWIDITERAELLRELHDAKESADAANRAKTTFLATMSHEIRTPMNAIIGMLELALLRPADQEPDRQSIQVAYDSARSLLELIGDILDIAKIEAGKFDLAPVRTALRALPEGAIRVFDGLARQKGIELVLKTDIVGVDDVLIDPLRMKQVLSNLVGNAIKFTTEGQVVLTVTARPDGEAAHVQFSVSDTGCGISEADQRQLFKPFSQVGGSAEAGPAPGTGLGLSISRRLVELMGGTLVMRSAPGVGTTVSVDLRLTMVEKSAQATPPAAAAQATPSKPQVSLRVLVVDDHKPNLMLLRQQLDYLGQRVVAADSGEASLALWHEHAFDVVITDCNMPGINGYELARRIRAAEAAPGYGRTRCILFGFTASAQMDEAHACRAAGMDDCLFKPIGVDALRQRLNEAAARAALPTPPSPQAAAPATHDATPAAFSAESILALTQNDEALIRQLLEEVIRTNRADVDQLQKLHQQADWPKVSDMAHRLAGGARVVDAKAMIDTALALEKKAQGQAGPSPEIDGMVRTLAAQSAALETQLRAWLEQRPHQGQP

SEQ ID NO: 7581 - protein, 659 aa, Schizosaccharomyces pombe
MEYYTSKEVAEWLKSIGLEKYIEQFSQNNIEGRHLNHLTLPLLKDLGIENTAKGKQFLKQRDYLREFPRPCILRFIACNGQTRAVQSRGDYQKTLAIALKKFSLEDASKFIVCVSQSSRIKLITEEEFKQICFNSSSPERDRLIIVPKEKPCPSFEDLRRSWEIELAQPAALSSQSSLSPKLSSVLPTSTQKRSVRSNNAKPFESYQRPPSELINSRISDFFPDHQPKLLEKTISNSLRRNLSIRTSQGHNLGNFGQEILPRSSRRARPSELVCPLSSLRISVAEDVNRLPRIDRGFDPPLTVSSTQRISRPPSLQKSITMVGVEPLYQSNGNEKSSKYNVFSESAHGNHQVLSFSPGSSPSFIEQPSPISPTSTTSEDTNTLEEDTDDQSIKWIRGALIGSGSFGQVYLGMNASSGELMAVKQVILDSVSESKDRHAKLLDALAGEIALLQELSHEHIVQYLGSNLNSDHLNIFLEYVPGGSVAGLLTMYGSFEETLVKNFIKQTLKGLEYLHSRGIVHRDIKGANILVDNKGKIKISDFGISKKLELNSTSTKTGGARPSFQGSSFWMAPEVVKQTMHTEKTDIWSLGCLVIEMLTSKHPYPNCDQMQAIFRIGENILPEFPSNISSSAIDFLEKTFAIDCNLRPTASELLSHPFVS

SEQ ID NO: 7582 - protein, 330 aa, Zea mays subsp. parviglumis
MGRAPCCEKVGLKRGRWTAEEDQLLANYIAEHGEGSWRSLPKNAGLLRCGKSCRLRWINYLRADVKRGNISKEEEDIIIKLHATLGNRWSLIASHLPGRTDNEIKNYWNSHLSRQIHTYRRKYTAGPEDTAIAIDMSKLQSTDRRRGGRTPGRPPKTSASRTKQPDADQPGGEAKGAAASSPRHSDAVNPGPNQPNSSSGSTGTAEEEGPSSEDASGPWVLEPIELGDLVWGEADSEMDALMPIGPGGHDSAALEGLGAVGCEAQVDDLFDMDWDGFAAHLWGGPEQDDHSAQLRQAAEPLEASAAATAACTPDDRELEAFENWLLSDSF

SEQ ID NO: 7583 - protein, 340 aa, Zea mays subsp. parviglumis
MGRAPCCEKVGLKRGRWTKEEDQILANYIAEHGEGSWRSLPKNAGLLRCGKSCRLRWINYLRADVKRGNISKEEEDVIIKLHATLGNRWSLIASHLPGRTDNEIKNYWNSHLSRQIHTYRRKYTAGPDTAPIAIAIDMSKLRSAETRRGGRTPGRSPKSASSSSMTKSKQPDPEPEPESGGASSPRHSDGARSAVVDPDPDPNQPNSSSSGSTGEGEDATGPWLLDPVELGDLWEAESEMDALMSIGGNAHDSATAEGFDAAQAQAQVDDLFDDMDWDNFAAHLWGEPEQQTDHSAQPQPQQAAEPQAAAAAAAAAEAVACDPDEHELEALETWLLSDSF

SEQ ID NO: 7584 - protein, 260 aa, Zea mays; identical to SEQ ID NO: 5771

SEQ ID NO: 7585 - protein, 332 aa, Zea mays; identical to SEQ ID NO: 5772

SEQ ID NO: 7586 - protein, 279 aa, Ovis aries
NDGHFIPVLGFGTYAPEEVPKSEALEATKLAIEVGFRHVDSAHLYQNEEQVGQAIRSKIADGTVKREDVFYTSKLWCTFLRPELVQPALEKSLKNLQLDYVDLYIIHSPVSLKPGNRFVPKDESGKLIFDSVDLCHTWEALEKCKDAGLTKSIGVSNFNHKQLEKILNKPGLKYKPVCNQVECHPYLNQSKLLEFCKSHDIVLVAYAALGSQLSSEWENQNHPVLLEDPVLCAIAKKHKQTPALIALRYQVQRGVVVLAKSFNKKRIKEDMQVFDFELT

SEQ ID NO: 7587 - protein, 771 aa, Hordeum vulgare subsp. vulgare
MVAAAILPELATQLVVPVAAAVGIAFAVLQWVLVSKVKVAPEPRAEGGSASAVGAKDGATEYLIEEEEGLNDHNVVLKCAEIQTAISEGQTSFLFTEYKYAGGFMTIFAVLIFVFLGSIEGFSTKSQPCHYSVGKTCKPALANAAFSTIAFVLGAVTSLVSGFLGMKIATYANARTTLEARKGVGKAFITAFRSGAVMGFLLAASGLFVLYVAINLFGLYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGINHEFTPMMYPLLISSVGIIACLITTLFATDFFEVKEVDQIEPALKRQLIISTAVMTIGIALVSWLGLPYTFTIFNFGAQKTVHSWQLFLCVAVGLWAGLVIGFITEYYTSNAYSPVQDVADSCRTGAATNVIFGLALGYKSVIIPIFAIAFSIFLSFSLAAMYGVAVAALGMLSTIATGLAIDAYGPISDNAGGIAEMAGMSHRIRERTDALDAAGNTTAAIGKGFAIGSAALVSLALFGAFVSRAGITTVDVLTPNVFIGLLVGAMLPYWFSAMTMKSVGSAALKMVEEVRRQFNTIPGLMEGTAKPDYATCVKISTDASIKEMIPPGALVMLTPLIVGTLFGVETLSGVLAGALVSGVQIAISASNTGGAWDNAKKYIEAGASEHAKSLGPKGSDCHKAAVIGDTIGDPLKDTSGPSLNILIKLMAVESLVFAPFFATYGGILFKIL

SEQ ID NO: 7588 - protein, 235 aa, Leishmania mexicana amazonensis
GSGAYGVVWCALDRRTGKCVALKKVYDAFGNVQDAQRTYREVMLLQRLRHNPFIVGILDVIRAVNDIDLYLVFELIETDLTAIIRKNLLQCDHKRFLTYQLLRTVAQLHAQNIIHRDLKPANVFVSSDCSIKLGDFGLARTFRSGYDNEQEFLDLTDYIATRWYRSPEILVKSRAYSTAMDMWAIGCVIGEMLLGRPLFEGRNTLDQLRLIIEAIGVPSDADVRSLHSPELVKLI

SEQ ID NO: 7589 - protein, 235 aa, Leishmania infantum
GSGAYGVVWCALDRRTGKCVALKKVYDAFGNVQDAQRTYREVMLLQRLRHNPFIVGILDVIRAANDIDLYLVFELIETDLTAIIRKNLLQRDHKRFLTYQLLRTVAQLHAQNIIHRDLKPANIFVSSDCSIKLGDFGLARTFRSGFDNEQEILDLTDYIATRWYRSPEIFVKSRAYSTAMDMWAFGCVIGEMLLGHPLFEGRNTLDQLRLIVEAIGVPSDADVRSLHSPELETLI

SEQ ID NO: 7590 - protein, 235 aa, Leishmania donovani
GSGAYGVVWCALDRRTGKCVALKKVYDAFGNVQDAQRTYREVMLLQRLRHNPFIVGILDVIRAANDIDLYLVFELIETDLTAIIRKNLLQRDHKRFLTYQLLRTVAQLHAQNIIHRDLKPANIFVSSDCSIKLGDFGLARTFRSGFDNEQEFLDLTDYIATRWYRSPEILVKSRAYSTAMDMWAIGCVIGEMLLGHPLFEGRNTLDQLRLIVEAIGVPSDADVRSLHSPELETLI

SEQ ID NO: 7591 - protein, 235 aa, Leishmania aethiopica
GSGAYGVVWCALDRRTGKCVALKKVYDAFGNVQDAQRTYREVMLLQRLRHNPFIVGILDVIRAANDIDLYLVFELVETDLTAVIRKNLLQRDHKRFLTYQLLRTVAQLHAQNIIHRDLKPANVFVSSDCSIKLGDFGLARTFRSGFDNEQEFLDLTDYIATRWYRSPEILVKSRAYSTAMDMWAIGCVIGEMLLGHPLFEGRNTLDQLRLIVEAIGVPSDADVRSLHSPELETLI

SEQ ID NO: 7592 - protein, 235 aa, Leishmania tropica
GSGAYGVVWCALDRRTGKRVALKKVYDAFGNVQDAQRTYREVMLLQRLRHNPFIVGILDVIRAANDIDLYLVFELIETDLTAIIRKNLLQRDHKRFLTYQLLRTVAQLHAQNIIHRDLKPANVFVSSDCSIKLGDFGLARTFRSGFDNEQEFLDLTDYIATRWYRSPEILVKSRAYSTAMDMWAIGCVIGEMLLGHPLFEGRNTLDQLRLIVEAIGVPSDADVRSLHSPELETLI

SEQ ID NO: 7593 - protein, 235 aa, Leishmania major
GSGAYGIVWCALDRRTGKCVALKKVYDAFGNVQDAQRTYREVMLLQRLRHNPFIVGILDVIRAANDIDLYLVFELIEADLTAIIRKNLLQRDHKRFLTYQLLRTVAQLHAQNIIHRDLKPANVFVSSDCSIKLGDFGLARTFRSGFDNEQEFLDLTDYIATRWYRSPEILVKSRAYSTAMDMWAVGCVIGEMLLGHPLFEGRNTLDQLRLIVEAIGVPSDADVRSLHSPELETLI

SEQ ID NO: 7594 - protein, 235 aa, Leishmania braziliensis
GSGAYGVVWCALDHLTGKLVALKKVYDAFGNVQDAQRTYREVMLLQQLRHNPFVVDILNVIRAANDIDLYLVFELIETDLTAIIRKNLLQRDHKRFLTYQLLRTVAQLHAQNVIHRDLKPANVFVSSDCSIKLGDFGLARTFRSGFDNEQEFLDLTDYIATRWYRSPEILVKSRAYSTAMDMWAIGCVIGEMLLGHPLFEGRNTLDQLRLIVEAIGVPSDADVRSIHSPELETLI

SEQ ID NO: 7595 - protein, 509 aa, Pichia angusta
MVKLQSYYPLFRPGKPTQHILTVTCMFAFILYGFEQGALANVQNEVVFQSQFGHPQGNYLGIIVAIYNLGSFFGSMANIWIGDKLGRKRAIWLGFTLVTIGVILQCSSYSVVQLFIGRFISGLGTGFETSTTPMYQSEVCHENHRGGLVAAEPQGVAFGITVSYWIGYGCSKRTDQVSWRLPVGIQMLFAVLGIVMLFFCPESPRWLMKVGRTQDARYSLATINGVPEDHPRISAIIDDILYLQKIEGSGDKITWGDILMGRDAMHGRFRIMLTVFGQFWNQFGGINLVVYYVPMVLENNVGLSSNLATILGGCIMLTFFATGFIPTLFLDKMGRRFAMASGSAGQCISMLLVTILLRVGTKESSVAATAFFFTFIGFFGYAMNCVPWVYAAEVLPLQLRAKGNAISVATNWICNFVIAMITPIMTQNLAWKTYIVFTLTNAVATIHFFVFYPETSKRTLEDIENIFLDSHTIFYGLQEIKRTPTERLTEKLIDIEHVESVEEGSPESD

SEQ ID NO: 7596 - protein, 322 aa, Homo sapiens [sequence omitted]

SEQ ID NO: 7597 - protein, 222 aa, Oncorhynchus mykiss
LQNSPLLQLSQQLSGINAVFYYSTRIFEKAGVSQPVYATIGAGVVNTAFTVVSLFIVERAGRRSLHLTGLLGMAFSAVLMTVAMALLDQLPWMSYVSIVAIFSFVAFFEIGPGPIPWFIVAELFSZGPRPSAFAVAGFSNWSANFIVGMTFQYVEQLCGPYVFIIFTVLLLGFFVFTYFMVPETKGRSFDEIAAGFRHDAGEAGEKYAPDEMNSLGGADSQL

SEQ ID NO: 7598 - protein, 406 aa, Gallus gallus
MKATCWILAGFCLLFCCKAEEGLNFPTYDGKDRVIDLNEKNYKHALKKYDMLCLLFHEPVSSDRVSQKQFQMTEMVLELAAQVLEPRSIGFGMVDSKKDAKLAKKLGLVEEGSLYVFKEERLIEFDGELATDVLVEFLLDLLEDPVEVINSKLELQAFDQIDDEIKLIGYFKGEDSEHYKAFEEAAEHFQPYVKFFATFDKGVAKKLGLKMNEVDFYEPFMDEPVHIPDKPYTEEELVEFVKEHKRATLRKLRPEDMFETWEDDMEGIHIVAFAEEDDPDGFEFLEILKQVARDNTDNPDLSIVWIDPDDFPLLITYWEKTFKIDLFRPQIGIVNVTDADSVWMEIRDDDDLPTAEELEDWIEDVLSGKINTEDDDDDDDDDDDDDDDDDDDDDDDDDDDDDDDDD

SEQ ID NO: 7599 - protein, 319 aa, Lepidodactylus lugubris
MNTYVEMNTKGRMPILGLGTWQAPPGKVEEAIKHAIDLGYRHIDCAHLYRNENEIGNAIQQNIKEGAVKREDLFIVSKLWCTFHEKSQVKGACQRTLSALKLDYLDLYLIHFPMGFKAGDDLIPLDEHGKVIPSNTDIRDTWEGMEDLVDAGLVKAVGISNFNREQIEKILNKPGLRYIPANNQIECHPYLTQETLIKYCRSKGITVCAHSPFGSPGNPVSTLGKTRYTTLIEDPTVKKIADKYNKTSAQVLLRFHIERNTPVIPKSDKPHRLKENLQVFDFKLSDEDMKTLLSLNKNMRVYSMPPCAEHKEYPFHVDY

SEQ ID NO: 7600 - protein, 246 aa, Rhodococcus erythropolis
MSYALEGKVAVVTGGGSGIGAACVRQLCALGASVVVADIVFDNATLVAKEFGDRAVAVEVDVARVEDAERMVETAVAHFGGLDIAVNNAGVGVPVKASVGDTGFEEWRRVLDVNLDGAFFCMRAELRRMRKGGSVVNLASVMGAVAAEGSSSYVASKHALVGLTKTAALDYATAGIRVNAVGAGFVDTPLMAGRDPEWLAAVAASHPLGRLAQPDEIASVVAFLASSAASFVTGAFIPVDGGYLAR

SEQ ID NO: 7601 - protein, 354 aa, Schizophyllum commune
MGCVQSSGVDEEAKARNDEIESQLKKDRMMAKNEIKMLLLGAGESGKSTVLKQMKLIHHGGYNEQERDSYKEIIFSNTIQSMRAILEAMPQLDIPLTPQNDARRAVIMSMPMQIEADVLPPDVVDAIRSLWKDPGVRQAVQRSREFQLNDSAVYYFNSIDRMAAPNYMPTDQDILRSRVKTTGITETTFKVGELTYKLFDVGGQRSERKKWIHCFENVTALVFLVSLSEYDQMLYEDESVNRMQEALTLFDSICNSRWFVKTSIILFLNKIDLFAEKLPRSPLGDYFPDYTGGDNYDAACDYLLHRFVSLNQSAATKQIYAHYTCATDTQQIKFVLSAIQDILLQLHLRECGLL

SEQ ID NO: 7602 - protein, 351 aa, Schizophyllum commune
MGACVSSSSQPVADVQAKERSDEIDSQIKADSERLKKECKILLLGSGESGKSTIVKQMKIIHKNGFSPQELASFRPTVYRNVIDSAQAVAQIIKKANPESPNLALLDKIIDYDANGIVTPDLADAIRRITSDPATPKIIDEHANEFYLMDNAAFFENVVRIGAEKYVPTETDILRARVKTTSISETRFACGPLTIHMFDVGGQRSERKKWIHCFESVTSIIFCTALSEYDQVLLEEKNQNRMAESLTLFESVINSRWFLRTSIILFLNKTDVFKIKLPKVPLDRYFPEYTGGNDINKAAKFILWKFMQANRARLSVYPHLTQATDTKNVRHVFAAVKETILHNALKDSGIL

SEQ ID NO: 7603 - protein, 260 aa, Homo sapiens
MASSGMTRRDPLANKVALVTASTDGIGFAIARRLAQDGAHVVVSSRKQQNVDQAVATLQGEGLSVTGTVCHVGKAEDRERLVATAVKLHGGIDILVSNAAVNPFFGSIMDVTEEVWDKTLDINVKAPALMTKAVVPEMEKRGGGSVVIVSSIAAFSPSPGFSPYNVSKTALLGLTKTLAIELAPRNIRVNCLAPGLIKTSFSRMLWMDKEKEESMKETLRIRRLGEPEDCAGIVSFLCSEDASYITGETVVVGGGTPSRL

SEQ ID NO: 7604 - protein, 260 aa, Mus musculus
MASSGLTRRNPLSNKVALVTASTDGIGFAIARRLAEDGAHVVVSSRKQQNVDRAVATLQGEGLSVTGIVCHVGKAEDREKLITTALKRHQGIDILVSNAAVNPFFGNLMDVTEEVWDKVLSINVTATAMMIKAVVPEMEKRGGGSVVIVGSVAGFTRFPSLGPYNVSKTALLGLTKNFAAELAPKNIRVNCLAPGLIKTRFSSVLWEEKAREDFIKEAMQIRRLGKPEDCAGIVSFLCSEDASYINGETVVVGGGTPSRL

SEQ ID NO: 7605 - protein, 260 aa, Oryctolagus cuniculus
MASSGVTRRDPLANKVAIVTASTDGIGLAIARRLAQDGAHVVISSRKQQNVDRAVAALQAEGLSVTGTVCHVGKAEDRERLVATALNLHGGIDILVSNAAVNPFFGKLMDVTEEVWDKILDINVKAMALMTKAVVPEMEKRGGGSVVIVASIAAFNPFSGLGPYNVSKTALVGLTKNLALELAAQNIRVNCLAPGLIKTSFSKALWEDKAQEENIIQKLRIRRLGKPEECAGIVSFLCSEDASYITGETVVVAGGAPSRL

SEQ ID NO: 7606 - protein, 472 aa, Plasmodium falciparum
MTSIKESSSRDEEEEDANVNKNIKKFKEGNKKDNISKDCNIVEKKNNKSKEEKINIKEAIIKNVKVPDNYEIKHLIGRGSYGYVYLAYDKNANKNVAIKKVNRMFEDLIDCKRILREITILNRLKSDYIIRLHDLIIPEDLLKFDELYIVLEIADSDLKKLFKTPIFLTEQHVKTILYNLLLGEKFIHESGIIHRDLKPANCLLNQDCSVKICDFGLARTINSDKDIHIVNDLEEKEENEEPGPHNKNLKKQLTSHVVTRWYRAPELILLQENYTNSIDIWSTGCIFAELLNMMKSHINNPTNRFPLFPGSSCFPLSPDHNSKKVHEKSNRDQLNIIFNVIGTPPEEDLKCITKQEVIKYIKLFPTRDGIDLSKKYSSISKEGIDLLESMLRFNAQKRITIDKALSHPYLKDVRKENLENFSTEKIILPFDDWMVLSETQLRYIFLKEIQSFHADLIIPAKLNIHQKSFYNM

SEQ ID NO: 7607 - protein, 466 aa, Azorhizobium caulinodans
MPVDILMPALSPTMEKGNLTKWVKKEGDTVKAGDVIAEIETDKATMEVEAVDEGILGKILIPEGTQDVAVNTPIAVILGEGEDASAASTPAPQQKVAESAAPASPVAAAAPAPQASVPSAVANPPVVTSQPDPEVPAGTEMVTMTVREALRDAMAEEMRRDGDVFVMGEEVAEYQGAYKITQGLLQEFGAKRVVDTPITEHGFAGMGVGAAMAGLKPIIEFMTFNFAMQAIDQIINSAAKTLYMSGGQVQCSVVFRGPNGAAARVAAQHSQDYAAWYSHIPGLKVVAPYTAADAKGLLKAAIRDPNPVIFLENEILYGHSFEVPKLDDYVLPIGKARIARAGKDVTLVSWSIGMTYTLKAAEELAKQGIEAEVIDLRTIRPMDVPTIIESVKKTGRCVTVEEGWPQSGVGSEIAAQLMEKAFVYLDAPSAARTGKDVPMPYAANLEKLALPNVAEVIEAVRAVTYR

SEQ ID NO: 7608 - protein, 909 aa, Rattus norvegicus
MADDDVLFEDVYELCEVIGKGPFSVVRRCINRETGQQFAVKIVDVAKFTSSPGLSTEDLKREASICHMLKHPHIVELLETYSSDGMLYMVFEFMDGADLCFEIVKRADAGFVYSEAVASHYMRQILEALRYCHDNNIIHRDVKPHCVLLASKENSAPVKLGGFGVAIQLGESGLVAGGRVGTPHFMAPEVVKREPYGKPVDVWGCGVILFILLSGCLPFYGTKERLFEGIIKGKYKMNPRQWSHISESAKDLVRRMLMLDPAERITVYEALNHPWLKERDRYAYKIHLPETVEQLRKFNARRKLKGAVLAAVSSHKFNSFYGDPPEELPDFSEDPTSSGLLAAERAVSQVLDSLEEIHALTDCSEKDLDFLHSVFQDQHLHTLLDLYDKINTKSSPQIRNPPSDAVQRAKEVLEEISCYPENNDAKELKRILTQPHFMALLQTHHVVAHEVYSDEALRVTPPPTSPYLNGDSPESANGDMDMENVTRVRLVQFQKNTDEPMGITLKMNELNHCIVARIMHGGMIHRQGTLHVGDEIREINGISVANQTVEQLQKMLREMRGSITFKIVPSYRTQSSSCERDSPSTSRQSPANGHSSTNNSVSIYVRAQFEYDPAKDDLIPCKEAGIRFRVGDIIQIISKDDHNWWQGKLENSKNGTAGLIPSPELQEWRVACIAMEKTKQEQQASCTWFGKKKKQYKDKYLAKHNADLVTYEEVVKLPAFKRKTLVLLGAHGVGRRHIKNTLITKHPERFAYPIPHTTRPPKKDEENGKNYYFVSHDQMMQDISNNEYLEYGSHEDAMYGTKLETIRKIHEQGLIAILDVEPQALKVLRTAEFPPFVVFIAAPTITPGLNEDESLQRLQKESDVLQRTYAHYFDLTIINNEIDETIRHLEEAVELVCTAPQWVPVSWVY

SEQ ID NO: 7609 - protein, 151 aa, Gallus gallus
MDGDSSTTDASQLGIAGDYIGGSHYVIQPHDDTEDSMNDHEDTNGSKESFREQDIYLPIANVARIMKNAIPQTGKIAKDAKECVQECVSEFISFITSEASERCHQEKRKTINGEDILFAMSTLGFDSYVEPLKLYLQKFREAMKGEKGIGG

SEQ ID NO: 7610 - protein, 209 aa, Petromyzon marinus
MDADGSTTDASQLGITGDYIGGGHYVLQSSDGDAEGSLASGDHDESCGSKDPYREQDIYLPIANVARIMKTSIPSSGKIAKDAKECVQECVSEFISFITSEASERCHQEKRKTINGEDILFAMSTLGFDSYVEPLKQYLQKYRESMKGEKGINATVVTTTDAIPEELTEESFSGPLATSIITADGQQQNVMVYTTAYQQIPGVQPIQFT

SEQ ID NO: 7611 - protein, 122 aa, Xenopus laevis
VQECVSEFISFITSEASERCHQEKRKTINGEDILFAMSTLGFDSYVEPLKLYLQKFREAMKGEKGIGGTVTTGDGLGEDLAEEPFTSQIPAGLITTDGQQQNVMVYTTSYQQISGVQQIQFS

SEQ ID NO: 7612 - protein, 303 aa, Gallus gallus
MEDYTKIEKIGEGTYGVVYKGRHKTTGQVVAMKKIRLESEEEGVPSTAIREISLLKELHHPNIVCLQDVLMQDARLYLIFEFLSMDLKKYLDTIPSGQYLDRSRVKSYLYQILQGIVFCHSRRVLHRDLKPQNLLIDDKGVIKLADFGLARAFGIPVRVYTHEVVTLWYRSPEVLLGSALYSTPVDIWSIGTIFAELATKKPLFHGDSEIDQLFRIFRALGTPNNDVWPDVESLQDYKNTFPKWKPGSLGTHVQNLDEDGLDLLSKMLIYDPAKRISGKMALNHPYFDDLDKSTLPANLIKKF

SEQ ID NO: 7613 - protein, 297 aa, Drosophila melanogaster
MEDFEKIEKIGEGTYGVVYKGRNRLTGQIVAMKKIRLESDDEGVPSTAIREISLLKELKHENIVCLEDVLMEENRIYLIFEFLSMDLKKYMDSLPVDKHMESELVRSYLYQITSAILFCHRRRVLHRDLKPQNLLIDKSGLIKVADFGLGRSFGIPVRIYTHEIVTLWYRAPEVLLGSPRYSCPVDIWSIGCIFAEMATRKPLFQGDSEIDQLFRMFRILKTPTEDIWPGVTSLPDYKNTFPCWSTNQLTNQLKNLDANGIDLIQKMLIYDPVHRISAKDILEHPYFNGFQSGLVRN

SEQ ID NO: 7614 - protein, 291 aa, Medicago sativa
GENVEKIGEGTYGVVYKARDRVTNETIALKKIRLEQEDEGVPSTAIREISLLKEMQHRNIVRLQDVVHSDKRLYLVFEYLDLDLKKHMDSSPEFIKDPRQVKMFLYQMLCGIAYCHSHRVLHRDLKPQNLLIDRRTNSLKLADFGLARAFGIPVRTFTHEVVTLWYRAPEILLGSRHYSTPVDVWSVGCIFAEMANRRPLSPGDSEIDELFKIFRILGTPNEDTWPGVTSLPDFKSTFPRWPSKDLATVVPNLEPAGLDLLNSMLCLDPTKRITARSAVEHEYFKDIKFVP

SEQ ID NO: 7615 - protein, 302 aa, Xenopus laevis
MDEYTKIEKIGEGTYGVVYKGRHKATGQVVAMKKIRLENEEEGVPSTAIREISLLKELQHPNIVCLLDVLMQDSRLYLIFEFLSMDVKKYLDSIPSGQYIDTMLVKSYLYQILQGIVFCHSRGVLHRDLKPQNLLIDNKGVIKLADFGLARAFGIPVRVYTHEVVTLWYRAPEVLLGSVRYSTPVDVWSVGTIFAEIATKKPLFHGDSEIDQLFRIFRSLGTPNNEVWPEVESLQDYKNTFPKWKGGSLSSNVKNIDEDGLDLLSKMLVYDPAKRISARKAMLHPYFDDLDKSSLPANQIRN

SEQ ID NO: 7616 - protein, 560 aa, Pneumocystis carinii
MEHSFYERKGNEQLTSWGLLILMVLLIMALWVSYYLQDKRVRSMHETVISILLGMIVGVLIKEIKNTDIQKIVTFNYGYFFNLLLPPIILNSGYELHQELFFKNAGAIFTFAFVGTFVSAVITGLLIYLWALTGLEQIGISWIEALKFGATISATDPVTILSIFRTYNVDPTLYTIIFGESLLNDSVSIVMFETLQRFYNKEMSIIDVFIGIGRFFIIFIISLTIGIIAGISIALLLKYSHLRRFPYIESCIITLIAYSSYLFSNGCHMSGIVSLLFCAITLKHYAFYNMSIQTQFSTKFLFKILSQLSENFIFVYLGISLFTQENLVYKPLLILVTMLFVCIARYISIFSISKLINMIIESYNIVFYEKLPTSYQFMLFWSGLRGAVGVALIQALEGKEANTFKATILVVVVLTVIIFGGTTPQMLEITGIRMGITNYQDDYHMESFYNENPSLEETIYDRFQYRKSGQLDSFNVLYPFWIGSSETQGNEEDNTNRESFDSNLFFPTVTEPAKLEDISYTSYEMTNEDISTDKDKLSTSNNHIKWFKNFDSKVLMPFRC

SEQ ID NO: 7617 - protein, 566 aa, Pneumocystis carinii
MIGLYAHVNASKDHFDDVINASPPLEEPQEPPLRGTLYLLFLTLVLGGLQLTCKSRKIFILYYIREGTPYLLSLGLTKHYTSFVWIAAPLTGIIIQPLIGFFSDRSRSKFGRRRPFLVVGTLCVVISLIGLAYFKDIAFFFFSGHEKVAKNMTIIVSIIIVYLLDFSINIVQASSRALIIDMVPMVQQDLANAWASRMIGIFNVVGYLNGYLNLPKIAPALGNTEFKALSVIGSIVLIVCMAVTFFVAKEKRYFMESLFNFFKTIFSTIITLPSEILWICIIQFFAWIELISMVFKVSDSFLCKIFFGTTYVAEIYAEKYCNKYLKYPDHLYTKEKEYLLIEEATRYGSFAFCAFFYYFFIRNIFLSFIFFMDFWSFYFYFMHAFNHTSKINHFFFPLFVSGKKLFKYIFRLKFYNILQNINIQFLWTFGHFIFTLCMLSTILVKSITQATIIIALCGLSWAITLWAPFSLIAIQLSSNNQLHRSGTILGVHNIFITVPQVLSIIMVGIIFKLTGYKKFEDIIKCNDNMDYSFIWIFQISGISALIAMYLSFKIYTNDPSYERNKI

SEQ ID NO: 7618 - protein, 571 aa, Staphylococcus xylosus
MSNHINGIAASDGVAIAKAYLLVEPDLSLDNEKVTDTDAEIAKFNHAIETSKVELTKIRNNAEENLGADKAAIFDAHLLVLDDPELIQPIEDKIKNEQVNAPTALSDVTGQFITIFESMDNEYMKERAADIRDVSKRVLAHILGVELPNPSMIDESVVIIGNDLTPSDTAQLNKEFVRGFVTNIGGRTSHSAIMSRSLEIAAVVGTKSITKEVKQGDMIIVDGLTGEVIIDPTEDEVIAYQNKRERFFEDKQALQQLRDEPSTTADGTHVELAANIGTPDDLKGVIENGAEGIGLYRTEFLYMGRDEMPTEDKQFEAYKKVLETMEDKRVVVRTLDIGGDKELPYLNLPEEMNPFLGYRAIRLCLDQPDIFRPQLRALLRASTYGKLNIMFPMVATIKEFRDAKALLLEEKENLTNEGIEVSDDIELGIMVEIPSTAALADVFAKEVDFFSIGTNDLIQYTMAADRMSERVSYLYQPYNPSILRLVKQVIKASHNEGKWTGMCGEMAGDETAIPLLLGLGLDEFSMSATSILKARRQIKGLSQNEMEELADRAINCATSEEVQELVEQYAK

SEQ ID NO: 7619 - protein, 442 aa, Candida albicans
MVNLLKKLHITKSHQSNHSNSDSNSLNSNTSMDNHQQQQQLQQYQQQFQQPQQQLYPGEQIVHPAAAQTGQNTTNVTAVSSSNITQSATSSLHSQQLQHVDVSKSAAEEAIRRSLLPERSTVSKGKYSLTDFSIMRTLGTGSFGRVHLVRSVHNGRYYAIKVLKKHQVVKMKQVEHTNDERRMLKLVEHPFLIRMWGTFQDSKNLFMVMDYIEGGELFSLLRKSQRFPNPVAKFYAAEVTLALEYLHSHDIIYRDLKPENILLDRNGHIKITDFGFAKEVSTVTWTLCGTPDYIAPEVITTKPYNKSVDWWSLGVLIFEMLAGYTPFYDSTPMKTYEKILAGKIHYPSFFQPDVIDLLTKLITADLTRRLGNLINGPADIRNHPWFSEVVWEKLLAKDIETPYEPPITAGVGDSSLFDHYPEEQLDYGSQGEDPYASYFLDF

SEQ ID NO: 7620 - protein, 107 aa, Synechococcus sp.
MSIYVGNLSYEVTEADLTAVFTEYGAVKRVQLPIDRETGRMRGFGFVEMSADAEEDAAIAALDGAEWMGRGLRVNKAKPREERSGGGSFGGGGGRRGGGGGGGYRNY

SEQ ID NO: 7621 - protein, 267 aa, Drosophila melanogaster
MAGNFWQSSHSQQWILDKPDLLRERQHDLLALNEDEYQKVFIFFANVIQVLGEQLKLRQQVIATATVYFKRFYARNSLKNIDPLLLAPTCILLASKVEEFGVISNSRLISICQSAIKTKFSYAYAQEFPYRTNHILECEFYLLENLDCCLIVYQPYRPLLQLVQDMGQEDQLLTLSWRIVNDSLRTDVCLLYPPYQIAIACLQIACVILQKDATKQWFAELNVDLDKVQEIVRAIVNLYELWKDWKEKDEIQMLLSKIPKPKPPPQR

SEQ ID NO: 7622 - protein, 397 aa, Xenopus laevis
MSLRVTRNMLANAENNVKTTLAGKRVVATKPGLRPRTALGDIGNKAEVKVPTKKELKPAVKAAKKAKPVDKLLEPLKVIEENVCPKPAQVEPSSPSPMETSGCLPDELCQAFSDVLIHVKDVDADDDGNPMLCSEYVKDIYAYLRSLEDAQAVRQNYLHGQEVTGNMRAILIDWLVQVQMKFRLLQETMFMTVGIIDRFLQEHPVPKNQLQLVGVTAMFLAAKYEEMYPPEIGDFTFVTDHTYTKAQIRDMEMKILRVLKFAIGRPLPLHFLRRASKIGEVTAEQHSLAKYLMELVMVDYDMVHFTPSQIAAASSCLSLKILNAGDWTPTLHHYMAYSEEDLVPVMQHMAKNIIKVNKGLTKHLTVKNKYASSKQMKISTIPQLRSDVVVEMARPLM

SEQ ID NO: 7623 - protein, 399 aa, Gallus gallus
MALTRRAAVMRGVENAVTGHNTKAKVQVTGKRAVLEEIGNKVARGSNVPKKTDCIKPPVKATKGPGKMTNTVVPPKPPAAVNQAVKDTTTASKVLSPVPMDVSMQEEDLCQAFSDVLLHNIEDIDADDSGNPQLCSDYVKDIYLYLRQLELQQSVRPHYLDGKTINGRMRAILVDWLVQVHSRFQLLQETLYMCVAVMDRFLQSHPVPRKRLQLVGVTALLLASKYEEMYSPDIADFVYITDNAYNSAEVREMEITILKELNFDLGRPLPLHFLRRASKAGEADAEQHTLAKYLMELTLIDYDMVHYHPSEIAAAALCLSQKVLGHDKWGTKQQYYTGYAEDSLAMTMKHMAKNVVKVNENLTKYTAVRNKYASSKLLRISTISQLNSKTIKDLAASLL

SEQ ID NO: 7624 - protein, 392 aa, Xenopus laevis
MATRRAAIPREADNILGGAMRSKVQMNSRRAALGEIGNKVTVRGKPPAVKQSSNAVAKPSKMAATKVANVKTKHVPVKPVVAEAAPKVPSPVPMDVSLKEEELCQAFSDALTSVEDIDADDGGNPQLCSDYVMDIYNYLKQLEVQQSVHPCYLEGKEINERMRAILVDWLVQVHSRFQLLQETLYMGVAIMDRFLQVQPVSRSKLQLVGVTSLLIASKYEEMYTPEVADFVYITDNAYTASQIREMEMIILRLLNFDLGRPLPLHFLRRASKSCSADAEQHTLAKYLMELTLIDYEMVHIKPSEIAAAALCLSQKILGQGTWGTTQHYYTGYTEGDLQLIMKHMAKNITKVNQNLTKHVAVRNKYASSKLMKISTLPQLMAPLITELAASLS

SEQ ID NO: 7625 - protein, 341 aa, Daucus carota
APSMTTPEPASKRRVVLGEISNNSSAVSGNEDLLCREFEVPKCVAQKKRKRGVKEDVGVDFGEKFDDPQMCSAYVSDVYEYLKQMEMETKRRPMMNYIEQVQKDVTSNMRGVLVDWLVEVSLEYKLLPETLYLAISYVDRYLSVNVLNRQKLQLLGVSSFLIASKYEEIKPKNVADFVDITDNTYSQQEVVKMEADLLKTLKFEMGSPTVKTFLGFIRAVQENPDVPKLKFEFLANYLAELSLLDYGCLEFVPSLIAASVTFLARFTIRPNVNPWSIALQKCSGYKSKDLKECVLLLHDLQMGRRGGSLSAVRDKYKKHKFKCVSTLSPAPEIPESIFNDV

SEQ ID NO: 7626 - protein, 426 aa, Patella vulgata
MSMVHGSSFQIAQDGENENQGVQRVKKAGLTARGNVAVAKRSALGTITNQNIRVQPSRAAKSGNADCQDENVFAKQKSFGSSNNENKGFKIHVDEPTVQVLTTATLKTTRQSEDEDIKLNDQVTSLPSLQALEDIQVDNENGSPMVLDVTIEDAEKKPIDREAIILSVPEYAEDIYKHLREAESRHRSKPGYMKKQPDITNSMRSILVDWMVEVSEEYKLHRETLFLAINYIDRFLSQMSVLRGKLQLVGAASMFIASKYEEIYPPEVSEFVYITDDTYEQKQVLRMEHLILKVLSFDVAQPTINWFTDTYAKMADTDETTKSLSMYLSELTLVDADPYLKYLPSTIAAASLCLANITLGSEPWPSSLAKESKYEISEFSECLQEMYQTYLNAPNHPQQAIREKYKSSKYQQVSSISPPSSLSFTM

SEQ ID NO: 7627 - protein, 422 aa, Spisula solidissima
MSQPFALHHDGENQMQRRGKMNTRSNGLSGQKRAALGVITNQVNQQVRIQPSRAAKPKSSEFNIQDENAFTKKNAKTFGQQPSQFSVFVDPTPAAPVQKAPTSHVTDIPAALTTLQRVPLTEVPGSPDIISLEDSMESPMILDLPEEEKPLDREAVILTVPEYEEDIYNYLRQAEMKNRAKPGYMKRQTDITTSMRCILVDWLVEVSEEDKLHRETLFLGVNYIDRFLSKISVLRGKLQLVGAASMFLAAKYEEIYPPDVKEFAYITDDTYTSQQVLRMEHLILKVLTFDVAVPTTNWFCEDFLKSCDADDKLKSLTMFLTELTLIDMDAYLKYLPSITAAAALCLARYSLGIEPWPQNLVKKTGYEIGHFVDCLKDLHKTSLGAESHQQQAVQEKYKQDKYHQVSDFSKNPVPHNLALLAL

SEQ ID NO: 7628 - protein, 418 aa, Xenopus laevis
MRRSMASNGHILTASSVVGASSAFQNPCLAKVEVQPNLPQRTVLGVIGDNEQRRRSVSRGGVPAKSLPGIENVLAFPGKILSANPAPVAPKPSFTVYVDEPTETYSVEIDCPSLGDEDSNIVKQNIHLLLDISEASPMVVDTSPQTSPEDDSVTDPDAVAVSEYIHEIHQYLREAELKHRPKAYYMRKQPDITSAMRTILVDWLVEVGEEYKLHTETLYLAMNYLDRFLSCMSVLRGKLQLVGTAAILLASKYEEIYPPDVDEFVYITDDTYSKKQLLRMEHVLLKVLAFDLTVPTVNQFLLQYLQRHAVSVKMEHLAMYMAELTLLEVEPFLKYVPSLTAAAAYCLANYALNKVFWPDTLEAFTGYALSDIAPCLSDLHQFCLGAPYQAQQAIREKYKTTKYMQVSLLEMPSILPLN

SEQ ID NO: 7629 - protein, 409 aa, Arbacia punctulata
MALGTRNMNMNLHGESKHTFNNENVSARLGGKSIAVQKPAQRAALGNISNVVRTAQAGSKKVVKKDTRQKAMTKTKATSSLHAVVGLPVEDLPTEMRSTSPDVLDAMEVDQAIEAFSQQLIALQVEDIDKDDGDNPQLCSEYAKDIYLYLRRLEVEMMVPANYLDRQETQITGRMRLILVDWLVQVHLRFHLLQETLFLTVQLIDRFLAEHSVSKGKLQLVGVTAMFIASKYEEMYPPEINDFVYITDNAYTKAQIRQMEIAMLKGLKYKLGKPLCLHFLRRNSKAAGVDAQKHTLAKYLMEITLPEYSMVQYSPSEIAAAAIYLSMTLLDPETHSSWCPKMTHYSMYSEDHLRPIVQKIVQILLRDDSASQKYSAVKTKYGSSKFMKISGIAQLDSSLLKQIAQGSNE

SEQ ID NO: 7630 - protein, 530 aa, Drosophila melanogaster
MVGTTLKMRGDENASENFKQVQLKKLTVPSMEATTKRAALGDLQNRGISRPIAAKDAAQKDSKDLKLTDALRNAKARVDSHWKKQPLGSTNGNGNGAVPPKVNEGGVSAFLRSNSVRNRVPTKTTVEPTKVTVKSSSSENVNEPTLKREDSNLSKKSLTKLGAALAKPVMGVSGIRREPVAVSRKEAETKKELPETKKDSLEVKKDATRMPLIRGNSAVTTTTSTMPTTMSLSSKRLAGIEDIDANDKENLVLVSEYVNDIYDYLYQVELEQPIHKDHLAGQKEVSHKMRAVLIDWINEVHLQFHLAAETFQLAVAIIDRYLQVVKDTKRTYLQLVGVTALFIATKYEELFPPAIGDFVFITDDTYTARQIRQMELQIFKAIDCNLSRPLPIHFLRRYSKAAGAEDEHHTMSKYFIELASVDYEMATYRPSEIAAASLFLSLHLLNGNHRAGTGFNDRHWTPTLTFYSRYSAAHLRPITRLIAKLARDAPQAKLKAIYNKYQGSKFQKIALRTELTGALMDSIVGQSQRK

SEQ ID NO: 7631 - protein, 388 aa, Marthasterias glacialis
MLNGENVDSRIMGKVATRASSKGVKSTLGTRGALENISNVARNNLQAGAKKELVKAKRGMTKSKATSSLQSVMGLNVEPMEKAKPQSPEPMDMSEINSALEAFSQNLLEGVEDIDKNDFDNPQLCSEFVNDIYQYMRKLEREFKVRTDYMTIQEITERMRSILIDWLVQVHLRFHLLQETLFLTIQILDRYLEVQPVSKNKLQLVGVTSMLIAAKYEEMYPPEIGDFVYITDNAYTKAQIRSMECNILRRLDFSLGKPLCIHFLRRNSKAGGVDGQKHTMAKYLMELTLPEYAFVPYDPSEIAAAALCLSSKILEPDMEWGTTLVHYSAYSEDHLMPIVQKMALVLKNAPTAKFQAVRKKYSSAKFMNVSTISALTSSTVMDLADQMC

SEQ ID NO: 7632 - protein, 408 aa, Patella vulgata
MTTVTRSSSANLGASQKLAVKKGDAMMSSKGISNRSNRSALGDIGNKVSNMTIDPTKKALGLPVIKKEIIQKSKFTRSKTTVSESDILLQEKESACCSRAYTIFKDAIEPIVSTVDLMDISEDKPDAFSKVLLTVEDIDANDKDNPQLVSDYVNDIYHYMRHLEETFAVKANFLEGQEVTGKMRSILIDWLCQVHHRFHLLQETLYLTVSIIDRFLQVHPISRNKLQLVGVTSMLLASKYEEMYAPEVADFVYITDNAYTKADIRTMEQTILKTLDFSFGKPLCLHFLRRNSKAGQVDATKHTLAKYLMELTIIEYDMVHCNPSIIAAAALCLSMKVLDDSQWSETLAHYSNYSEKEIYPVMQKLAQLVVKAETSKLTAVKIKYSSSRFMKISSIPELKSNAITDLVL

SEQ ID NO: 7633 - protein, 428 aa, Spisula solidissima
MTTRAASANLANARMMHNMEEAGHMANLKGRPHTSHASQRNTLGDIGNQVSAITISDVPRKDPIIKKEIVHLSSHQHKILTKSKATTSLKSLAEESHIPKKQEAFTFLEPVAAMPKPTTVPTATVLPQPTVPVPMDISENVPESFSRVLLNVQNIDANDKENPQLVSEYVNDIYDYMRDLEGKYPIRHNYLENQEITGKMRAILIDWLCQVHHRFHLLQETLYLTVAIIDRLLQESPVPRNKLQLVGVTSMLIASKYEEMYAPEVADFVYITDNAYTKKEILEMEQHILKKLNFSFGRPLCLHFLRRDSKAGQVDANKHTLAKYLMELTITEYDMVQYLPSKIAAAALCLSMKLLDSTHWTETLTHYSSYCEKDLVSTMQKLASLVIKAENSKLTAVHTKYSSSKFMKISKLAALKSPLVKELAAASV

SEQ ID NO: 7634 - protein, 286 aa, Vibrio cholerae
MTNQAYPMALVSQDSLDSYIRSVNGYPMLSADEERELAERLHYKGDIDAAKGLILSHLRFVVHVARGYSGYGLPMADLVQEGNIGLMKAVKRFNPEMGVRLVSFAVHWIKAEIHEYVLRNWRIVKIATTKAQRKLFFNLRKSKKRLGWFNNGEVETVARELGVEPAEVREMESRLAAQDAAFEMSAEDDENGMAYTAPVLYLEDKHSDLADNLEAENWEAHTTQRLSMALASLDDGSQHIVRARWLDDDNKTTLQDLAAKYGVSAERIRQLEKNAMRKLKEAVGEF

SEQ ID NO: 7635 - protein, 251 aa, Streptomyces sp. C5
MENTQRSVIVTGGGSGIGRAVARAFAARGDRVLVVGRTAGPLAETVDGHKEAHTLAVDITDPAAPQAVVREVRERLGGVVDVLVNNAATAVFGHLGELDRTAVEAQVATNLVAPVLLTQALLDPLETASGLVVNIGSAGALGRRAWPGNAVYGAAKAGLDLLTRSWAVELGPRGIRVIGVAPGVIETGAGVRAGMSQEAYDGFLEAMGQRVPLGRVGRPEDVAWWVVRLADPEAAYASGAVLAVDGGLSVT

SEQ ID NO: 7636 - protein, 248 aa, Holcus lanatus
VFLGSAHGIAKVPPGPNITATYGDEWLDAKSTWYGKPTGAGPKDNGGACGYKDVDKPPFSGMTGCGNTPIFKDGRGCGSCFEIKCSKPESCSGEPVTVHITDDNEEPIAPYHFDLSGHAFGSMAKKGEEQKLRSAGELELKFRRVKCKYPDGTKPTFHVEKGSNPNYLALLVKYIDGDGDVVAVDIKEKGKDKWIELKESWGAVWRVDTPDKLTGPFTVRYTTEGGTKGEAEDVIPEGWKADTAYEAK

SEQ ID NO: 7637 - protein, 543 aa, Mus sp.
MSDSLDNEEKPPAPPLRMNSNNRDSSALNHSSKPLPMAPEEKNKKARLRSIFPGGGDKTNKKKEKERPEISLPSDFEHTIHVGFDAVTGEFTGIPEQWARLLQTSNITKLEQKKNPQAVLDVLKFYDSKETVNNQKYMSFTSGDKSAHGYIAAHQSNTKTGSEPPLAPPVSEEEDEEEEEEEDDNEPPPVIAPRPEHTKSIYTRSVVESIASPAAPNKEDIPPSAENANSTTLYRNTDRQRKKSKMTDEEILEKLRSIVSVGDPKKKYTRLEKIGQGESGTVYTALDIATGQEVAIKQMNLQQQPKKELIINEILVMRENKNPNIVNYLDSYLVGDELWVVMEYLAGGSLTDVVTETCMDEGQIAAVCRECLQALDFLHSNQVIHRDIKSDNILLGMDGSVKLTDFGFCAQITPEQSKRSTMVGTPYWMAPEVVTRKAYGPKVDIWSLGIMAIEMVEGEPPYLNENPLRALYLIATNGTPELQNPERLSAVFHDFLNRCLEMDVDRRGSAKELLQHPFLKLAKPLSSLTPLIIAAKEAIKNSS

SEQ ID NO: 7638 - protein, 239 aa, Entamoeba histolytica
MASREDCVYTAKLAEQSERYDEMVQCMKQVAEMEAELSIEERNLLSVAYKNVIGAKRASWRIISSLEQKEQAKGNDKHVEIIKGYRAKIEKELSTCCDDVLKVIQENLLPKASTSESKVFFKKMEGDYYRYFAEFTVDEKRKEVADKSLAAYTEATEISNAELAPTHPIRLGLALNFSVFYFEIMNDADKACQLAKQAFDDAIAKLDEVPENMYKDSTLIMQLLRDNLTLWTSDACDEE

SEQ ID NO: 7639 - protein, 261 aa, Vicia faba
MATAPTPREEFVYMAKLAEQAERYEEMVEFMEKVTAAVESEELTVEERNLLSVAYKNVIGARRASWRIISSIEQKEESRGNDEHVSVIRDYRSKIETELSNICNGILKLLDSRLIPSAALGDSKVFYLKMKGDYHRYLAEFKSGAERKDAAESTLTAYKSAQDIANTELPPTHPIRLGLALNFSVFYYEILNSPDRACGLAKQAFDEAIAELDTLGEESYKDSTLIMQLLRDNLTLWTSDMQDDGADEIKEAAPKGNDEPQ

SEQ ID NO: 7640 - protein, 238 aa, Entamoeba histolytica
MTSREDLVYLSKLAEQSERYEEMVQYMKQVAEMGTELSVEERNLISVAYKNVVGSRRASWRIISSLEQKEQAKGNTQRVELIKTYRAKIEQELSQKCDDVLKIITEFLLKNSTSIESKVFFKKMEGDYYRYYAEFTVDEKRKEVADKSLAAYQEATDTAASLVPTHPIRLGLALNFSVFYYQIMNDADKACQLAKEAFDEAIQKLDEVPEESYKESTLIMQLLRDNLTLWTSDMGDDE

SEQ ID NO: 7641 - protein, 260 aa, Lycopersicon esculentum
MADSSREENVYLAKLAEQAERYEEMIEFMEKVAKTADVEELTVEERNLLSVAYKNVIGARRASWRIISSIEQKEESRGNEDHVNTIKEYRSKIEADLSKICDGILSLLESNLIPSASTAESKVFHLKMKGDYHRYLAEFKTGTERKEAAENTLLAYKSAQDIALAELAPTHPIRLGLALNFSVFYYEILNSPDRACNLAKQAFDEAISELDTLGEESYKDSTLIMQLLRDNLTLWTSDNADDVGDDIKEASKPESGEGQQ

SEQ ID NO: 7642 - protein, 261 aa, Vicia faba
MASTKDRENFVYIAKLAEQAERYEEMVDSMKNVANLDVELTIEERNLLSVGYKNVIGARRASWRILSSIEQKEESKGNDVNAKRIKEYRHKVETELSNICIDVMRVIDEHLIPSAAAGESTVFYYKMKGDYYRYLAEFKTGNEKKEAGDQSMKAYESATTAAEAELPPTHPIRLGLALNFSVFYYEILNSPERACHLAKQAFDEAISELDTLNEESYKDSTLIMQLLRDNLTLWTSDIPEDGEDSQKANGTAKFGGGDDAE

SEQ ID NO: 7643 - protein, 248 aa, Caenorhabditis elegans
MSDTVEELVQRAKLAEQAERYDDMAAAMKKVTEQGQELSNEERNLLSVAYKNVVGARRSSWRVISSIEQKTEGSEKKQQLAKEYRVKVEQELNDICQDVLKLLDEFLIVKAGAAESKAFYLKMKGDYYRYLAEVASEDRAAVVEKSQKAYQEALDIAKDKMQPTHPIRLGLALNFSVFYYEILNTPEHACQLAKQAFDDAIAELDTLNEDSYKDSTLIMQLLRDNLTLWTSDVGAEDQEQEGNQEAGN

SEQ ID NO: 7644 - protein, 236 aa, Entamoeba histolytica
SEDCVFLSKLAEQSERYDEMVQYMKQVAALNTELSVEERNLLSVAYKNVIGSRRASWRIITSLEQKEQAKGNDKHVEIIKGYRAKIEDELAKYCDDVLKVIKENLLPNASTSESKVFYKKMEGDYYRYYAEFTVDEKRQEVADKSLAAYTEATEISNADLAPTHPIRLGLALNFSVFYYEIMNDADKACQLAKQAFDDSIAKLDEVPESSYKDSTLIMQLLRDNLTLWTSDTADEE

SEQ ID NO: 7645 - protein, 260 aa, Oenothera elata subsp. hookeri
MATAPSPREENVYLAKLAEQAERYEEMVEFMEKVCAAADSEELTVEERNLLSVAYKNVIGARRASWRIISSIEQKEESRGNDDHVSTIRDYRSKIETELSNICGGILKLLDSRLIPSAASGDSKVFYLKMKGDYHRYLAEFKTGAERKEAAESTLSAYKAAQDIANAELAPTHPIRLGLALNFSVFYYEILNSPDRACNLANEAFDEAIAELDTLEEESYKDSTLIMQLLRDNLTLWTSDMQDDGGDEIKEAAPKPDEQY

SEQ ID NO: 7646 - protein, 260 aa, Pisum sativum
MAAAHTPREENVYMAKLAEQAERYEEMVEFMEKVSANADSEELTVEERNLLSVAYKNVIGARRASWRIISSIEQKEESRGNEDHVAVIRDYRSKIESELSNICDGILKLLDTRLIPSASSGDSKVFYLKMKGDYHRYLAEFKTGAERKEAAESTLTGYKSAQDIANAELPPTHPIRLGLALNFSVFYYEILNSPDRACNLAKQAFDEAIAELDTLGEESYKDSTLIMQLLRDNLTLWTSDMQDDGADEIKEAAPKADEQQ

SEQ ID NO: 7647 - protein, 255 aa, Arabidopsis thaliana
MSTREENVYMAKLAEQAERYEEMVEFMEKVAKTVDVEELSVEERNLLSVAYKNVIGARRASWRIISSIEQKEESKGNEDHVAIIKDYRGEIESELSKICDGILNVLEAHLIPSASPAESKVFYLKMKGDYHRYLAEFKAGAERKEAAESTLVAYKSASDIATAELAPTHPIRLGLALNFSVFYYEILNSPDRACSLAKQAFDDAIAELDTLGEESYKDSTLIMQLLRDNLTLWTSDMTDEAGDEIKEASKPDGAE

SEQ ID NO: 7648 - protein, 506 aa, Ralstonia eutropha
MNMAEIAQLGVSNPYKQQYENYIGGAWVPPAGGEYFESTTPITGKPFTRVPRSGQQDVDAALDAAHAAKAAWARTSTTERANILNRIADRIEANLKLLAVAESIDNGKPVRETTAADLPLAVDHFRYFAGCIRAQEGGISEIDADTIAYHFHEPLGVVGQIIPWNFPLLMATWKLAPALAAGNCVVLKPAEQTPASILVLMEVIGDLLPPGVVNVINGFGLEAGKPLASSPRISKVAFTGETTTGRLIMQYASQNLIPVTLELGGKSPNIFFEDVLAADDAFFDKALEGFAMFALNQGEVCTCPSRALIQESIYDRFMERALKRVAAIRQGHPLDTGTMIGAQASAEQLEKILSYIDLGRKEGAQCLTGGERNVLDGDLAGGYYVKPTVFAGHNKMRIFQEEIFGPVVSVTTFKDEEEALAIANDTLYGLGAGVWTRDGARAFRMGRGIQAGRVWTNCYHAYPAHAAFGGYKQSGIGRENHRMMLDHYQQTKNLLVSYSPNALGFF

SEQ ID NO: 7649 - protein, 375 aa, Peromyscus maniculatus
MSTAGKVIKCKAAVLWEPHKPFSIEDIEVAPPKAHEVRIKMVATGVCRSDDHVVSRSLASPLPAVLGHEGAGIVESVGEGVTSVKPGDKVIPLFTPQCGKCRICKHPEYNLCMKNDLMQPRGTLLDGTSRFTCRGKAIHNFISTSTFSQYTVVDEMAVAKIDGASPLEKVCLIGCGFSTGYGSAVKVAKVTPGSTCAVFGLGGVGLSVIIGCKAAGAARIIAVDINKDKFAKAKELGATECINPLDYSKPIQEVLQEMTDGGVDFSFEVIGRLDTMTSSLLSCHASCGVSVIVGVPPNAQSLSVNPMSLLMGRSWKGAIFGGFKSKDSVPKLVTDFMAKKFPLEPLITHVLPFEKINEAFDLLRAGKSIRTVLTF

SEQ ID NO: 7650 - protein, 375 aa, Peromyscus maniculatus
MSTAGKVIRCKAAVLWKPGAPLTMEEIDVAPPKGKEVRVKMVAAGICGTDIKSLDNKKLAPFCPIIMGHEGTGIVESVGEGVSTVKTGDKVIILCLPQCGECNTCLNSKNNICKEVRLSGTHLTSEGNSRITCKGKTTYQYITTGTFSEYIVIKEISVAKVDEDALLEKACIIGCGFATGFGAAINSAKVSPGSTCAVFGLGGVGLSVIMGCKAAGAARIIAVDTNKDKFAKAKTVGATECIDPQDFEKPIQQVLFDMMNDGADFTFEVTGNPETVETALASCHKDHGVCVIVGSLASWIQLNINSHLFFSGRTLKGSVLGGWKTKEEIPKLVSDYTAKKFNLDPLITHTLTLDKVNEAIQLMKNGQCIRCVLLP

SEQ ID NO: 7651 - protein, 379 aa, Drosophila melanogaster
MSATEGKVITCKAAVAWEAKKPLVIEDIEVAPPKAHEVRIKITATGVCHTDAFTLSGADPEGLFPVVLGHEGAGIVESVGEGVTNFKAGDHVIALYIPQCNECKFCKSGKTNLCQKIRLTQGAGVMPEGTSRLSCKGQQLFHFMGTSTFAEYTVVADISLTKINEKAPLEKVCLLGCGISTGYGAALNTAKVEAGSTCAVWGLGAVGLAVGLGCKKAGAGKIYGIDINPDKFELAKKFGFTDFVNPKDVADKGSIQNYLIDLTDGGFDYTFECIGNVNTMRSALEATHKGWGTSVVIGVAGAGQEISTRPFQLVVGRVWKGSAFGGWRSVSDVPKLVEDYLKKDLLVDEFITHELPLSQINEAFDLMHKGESIRSIIKY

SEQ ID NO: 7652 - protein, 512 aa, Escherichia coli
MTNNPPSAQIKPGEYGFPLKLKARYDNFIGGEWVAPADGEYYQNLTPVTGQLLCEVASSGKRDIDLALDAAHKVKDKWAHTSVQDRAAILFKIADRMEQNLELLATAETWDNGKPIRETSAADVPLAIDHFRYFASCIRAQEGGISEVDSETVAYHFHEPLGVVGQIIPWNFPLLMASWKMAPALAAGNCVVLKPARLTPLSVLLLMEIVGDLLPPGVVNVVNGAGGVIGEYLATSKRIAKVAFTGSTEVGQQIMQYATQNIIPVTLELGGKSPNIFFADVMDEEDAFFDKALEGFALFAFNQGEVCTCPSRALVQESIYERFMERAIRRVESIRSGNPLDSVTQMGAQVSHGQLETILNYIDIGKKEGADVLTGGRRKLLEGELKDGYYLEPTILFGQNNMRVFQEEIFGPVLAVTTFKTMEEALELANDTQYGLGAGVWSRNGNLAYKMGRGIQAGRVWTNCYHAYPAHAAFGGYKQSGIGRETHKMMLEHYQQTKCLLVSYSDKPLGLF

SEQ ID NO: 7653 - protein, 472 aa, Klebsiella oxytoca
MTTLSHDSTTMPRTQRDTRRMNQFVSIAAAVAGLLFGLDIGVIAGALPFITDHFVLSSRLQEWVVSSMMLGAAIGALFNGWLSFRLGRKYSLMVGAVLFVAGSVGSAFATSVEMLLVARIVLGVAVGIASYTAPLYLSEMASENVRGKMISMYQLMVTLGIVMAFLSDTAFSYSGNWRAMLGVLALPAVVLIILVIFLPNSPRWLAEKGRHVEAEEVLRMLRDTSEKARDELNEIRESLKLKQGGWALFKVNRNVRRAVFLGMLLQAMQQFTGMNIIMYYAPRIFKMAGFTTTEQQMVATLVVGLTFMFATFIAVFTVDKAGRKPALKIGFSVMAIGTLVLGYCLMQFDNGTASSGLSWLSVGMTMMCIAGYAMSAAPVVWILCSEIQPLKCRDFGITCSTTTNWVSNMIIGATFLTLLDAIGAAGTFWLYTALNVAFIGVTFWLIPETKNVTLEHIERRLMSGEKLRNIGN

SEQ ID NO: 7654 - protein, 325 aa, Haemophilus influenzae
MKNFKYFAQSYVDWVIRLGRLRFSLLGVMILAVLALCTQILFSLFIVHQISWVDIFRSVTFGLLTAPFVIYFFTLLVEKLEHSRLDLSSSVNRLENEVAERIAAQKKLSQALEKLEKNSRDKSTLLATISHEFRTPLNGIVGLSQILLDDELDDLQRNYLKTINISAVSLGYIFSDIIDLEKIDASRIELNRQPTDFPALLNDIYNFASFLAKEKNLIFSLELEPNLPNWLNLDRVRLSQILWNLISNAVKFTDQGNIILKIMRNQDCYHFIVKDTGMGISPEEQKHIFEMYYQVKESRQQSAGSGIGLAISKNLAQLMGRGFNS

SEQ ID NO: 7655 - protein, 281 aa, Candida albicans
MDSAYWSYDNIVPSFRLDGKLVILTGGSGGLAAVVSRALLAKGADVALVDMNLERTQQAARDVLQWGEEQMKGKYESPIGQVSAWSCNIGDAEAVDLTFKAINEHHGKISSVLVNTAGYAENFPAEEYPAKNAENLMKVNGLGSFYVSQAFARPLIQNNMTGSIILIGSMSGTIVNDPQPQCMYNMSKAGVIHLARSLACEWAKYNIRVNTLSPGYILTPLTRNVISGHTEMKTEWESKIPMKRMAEPKEFVGSILYLASESASSYTTGHNLVVDGGYECW

SEQ ID NO: 7656 - protein, 542 aa, Candida albicans
MKLSKSTLIATLALTATSTNALVVQNPFSNIQQALKLDLSYDKLTSKLTDTFEQGKANIISTIAKVMNEPLDGLTPEIKNIWSEMLMKFPNSITELNFKAPPKKGKITTQQFDFHVTDAQVPNHKLRIKSTPKDLGIDTVKQYSGYLDVVDEDKHFFYYFFESRNDPKNDPVILWLNGGPGCSSLTGLFFELGPSSIDKNLKPVYNPHSWNANASVIFLDQPINVGYSYSSQSVSNTIAAGKDVYAFLQLFFKNFPEYANLDFHIAGESYAGHYIPAFASEILTHPERNFNLTSVLIGNGLTDPLVQYEYYEPMACGEGGEPSVLEPEECDGMLNSLPRCLSLIESCYESGSVWSCVPATIYCNNGQMGPYQKTGRNVYDIRTMCEGSSLCYSQLEYIDQYLNLPEVKKALGAEVDEYQSCNFDINRNFMFAGDWMKPYQKNVIDLLEKELPVLIYAGDKDFICNWLGNQAWTNRLEWSGSKGFTKAPVKSWKVGKNAAGEVKNYKHFTFLRVFGGGHMVPYDQPENALDMVNRWISGDYKY

SEQ ID NO: 7657 - protein, 317 aa, Candida albicans
MVELSDYQRQEKVGEGTYGVVYKALDTKHNNRVVALKKIRLESEDEGVPSTAIREISLLKEMKDDNIVRLYDIIHSDSHKLYLVFEFLDLDLKKYMESIPQGVGLGANMIKRFMNQLIRGIKHCHSHRVLHRDLKPQNLLIDKEGNLKLADFGLARAFGVPLRAYTHEVVTLWYRAPEILLGGKQYSTGVDMWSVGCIFAEMCNRKPLFPGDSEIDEIFRIFRILGTPNEEIWPDVNYLPDFKSSFPQWKKKPLSEAVPSLDANGIDLLDQMLVYDPSRRISAKRALIHPYFNDNDDRDHNNYNEDNIGIDKHQNMQ

SEQ ID NO: 7658 - protein, 298 aa, Carassius auratus
MESFQKVEKIGEGTYGVVYKAKNKVTGETVALKKIRLDTETEGVPSTAIREISLLKELNHPNIVKLHDVIHTENKLYLVFEFLHQDLKRFMDSSTVTGISLPLVKSYLFQLLQGLAFCHSHRVLHRDLKPQNLLINAQGEIKLADFGLARAFGVPVRTYTHEVVTLWYRAPEILLGCKYYSTAVDIWSLGCIFAEMITRKALFPGDSEIDQLFRIFRTLGTPDESIWPGVTSMPDYKPSFPKWARQDLSKVVPPLDEDGRDLLGQMLIYDPNKRISAKNALVHRFFRDVTMPVPPLRL

SEQ ID NO: 7659 - protein, 297 aa, Xenopus laevis
MENFQKVEKIGEGTYGVVYKARNRETGEIVALKKIRLDTETEGVPSTAIREISLLKELNHPNIVKLLDVIHTENKLYLVFEFLNQDLKKFMDRSNISGISLALVKSYLFQLLQGLAFCHSHRVLHRDLKPQNLLINSDGAIKLADFGLARAFGVPVRTFTHEVVTLWYRAPEILLGCKFYSTAVDIWSLGCIFAEMITRRALFPGDSEIDQLFRIFRTLGTPDEVSWPGVTTMPDYKSTFPKWIRQDFSKVVPPLDEDGRDLLAQMLQYDSNKRISAKVALTHPFFRDVSRPTPHLI

SEQ ID NO: 7660 - protein, 646 aa, Candida albicans
MTSLQQQQQQQRVKYGPPHHIKRRPYHPILESLEFQTNQHLIQEYSLDIVNTLSQLESLTLVNPAMIDLQPEIQWFMRPFLLDFLIELHSSFKLQPTTLFLCLNIIDRYCAKRIVFKRHYQLVGCTALWIASKYEDKKSRVPTLKELTIMCRNAYDEEMFVQMEMHILSTLDWSIGHPTLEDCLQLAIDSNNLSNNTTNDIENKSVRPNRKSSISSAVTAVARFLCELSLYDKYFLSVPPSLIAITANLLSCSMLQIPHASITLKNLIEQEIINPQQKKQKKAFSSNSSRTTTASYTHQNQSDVRHSSFDEDIDLDSGDEGDDDEDYIDEFYETNNYDDTNATTFDESINKSTTINDENQPPQIHTPFLSGLDEDSILSIKKICLMLIIQLSKVTEVLSKKYENLGVIQVINNFHSNYKFIIQSIYENQELLLNTINDSTNNNEIDYKLIQSSEILLQFPKFDEYLTEDEDENVSTDDEANSQPQGYDGSGSDGNNQLFTPKSPNAFSSNSSLTLNNHPQSMVPVTPPSATSQYSLFSNKNNRTHESTSGLNSTCNTPTHISISSFAPPQPPPGSILKPKLTSINSTNSLKIKKLTSNSNSSNINIHHGHHNTKQEKRYSHISIGSNSSSKYDGFSPIKSISTNGS

SEQ ID NO: 7661 - protein, 395 aa, Gallus gallus
MLAEQENQENVPPAAKAPPPAAGTRVALGLLRGGPARPGPAAQAARNGEGRGAAAGQQQQPFSVYVDEPDEERRRPQRKKERDEEAADAPGLRAALGTVGERRPLAPLGNAMELSLDSPSIMDISITSEAEERPNVNNVPDYVSDIHTYLREMEVKCKPKIGYMKKQPDITNNMRAILVDWLVEVGEEYKLQNETLHLAVNYIDRFLSSMSVLRGKLQLVGTAAMLLASKFEEIYPPEVAEFVYITDDTYNKKQVLRMEHLILKVLSFDLAAPTINQFLTQYFLHQQTNAKVESLSMYLGELTLIDADPYLKYLPSVIAAAAFHLASYTITGQTWPESLCKVTGYTLEHIKPCLMDLHRTYLKAAQHTQQSIREKYKSTKYHAVSLIDAPETLDL

SEQ ID NO: 7662 - protein, 436 aa, Dictyostelium discoideum
MSTINNPLNIKTRSHSSMGGGMIMDENKVPKSSIGMDKKIGGTTGLKSHRGALSDLTNNTHQTTGMATKTVQLSNNNIIMPQPTNTRNNIITRSKSIIDNGASLRNSALISGVLPNANGPVNKVQKRDIQSMEMMNNIPQQPVMIDDVDNDTNMIQEEQMVIDITEVPENIDIYDSHDPQCVGEYVNEIFAYYREKEQIDKIDKDYIKNQYHINERMRAILVDWMMAVHVRFKLLSETFFLSVNIVDRYLAKVMIPVTKLQLVGITAILLACKYEEIYSPQIKDFVHTSDDACTHAEVIDMERQILSTLQFHMSVATPLHFLRRFSKAAGSDSRTHSLSKYLSELSMVEYRMVQFVPSMIAAASIYVARRMTMKSGPYWNVTLEYYTCYKESEILQCAQELKEVRKRADTSNLKATRKKYLSSKLMEVAAIPVVEF

SEQ ID NO: 7663 - protein, 487 aa, Berberis stolonifera
MDYIVGFVSISLVALLYFLLFKPKHTNLPPSPPAWPIVGHLPDLISKNSPPFLDYMSNIAQKYGPLIHLKFGLHSSIFASTKEAAMEVLQTNDKVLSGRQPLPCFRIKPHIDYSILWSDSNSYWKKGRKILHTEIFSQKMLQAQEKNRERVAGNLVNFIMTKVGDVVELRSWLFGCALNVLGHVVFSKDVFEYSDQSDEVGMDKLIHGMLMTGGDFDVASYFPVLARFDLHGLKRKMDEQFKLLIKIWEGEVLARRANRNPEPKDMLDVLIANDFNEHQINAMFMETFGPGSDTNSNIIEWALAQLIKNPDKLAKLREELDRVVGRSSTVKESHFSELPYLQACVKETMRLYPPISIMIPHRCMETCQVMGYTIPKGMDVHVNAHAIGRDPKDWKDPLKFQPERFLDSDIEYNGKQFQFIPFGSGRRICPGRPLAVRIIPLVLASLVHAFGWELPDGVPNEKLDMEELFTLSLCMAKPLRVIPKVRI

SEQ ID NO: 7664 - protein, 411 aa, Petroselinum crispum
MGNTDDVKAVKPEKLSSPPPPAAPDQSNSHVYPDWAAMQAYYGPRVALPPYFNPAVASGQSPHPYMWGPPQPVMPPYGVPYAALYAHGGVYAHPGVPLAASPMSMDTHAKSSGTNEHGLIKKLKGHDDLAMSIGNGKADSSEGEMERTLSQSKETEGSSDGSNENSKRAAVNGRKRGRDEAPNMIGEVKIETQSSVIPSPRAKSEKLLGITVATPMVAGKVVGTVVSPSMTSSLELKDSPKEHAVNSPAGGQQPSTMMPNDSWLHNDRDLKRERRKQSNRESARRSRLRKQAEAEELAIKVDSLTAENMALKAEINRLTLTAEKLTNDNSRLLEVMKNAQAERAADVGLGNNNEKKASTLSTANLLSRVDNAGSGDRDEGESDVYEKTTKSGAKLHQLLDANPRTDAVAAG

SEQ ID NO: 7665 - protein, 716 aa, Catharanthus roseus
MAVSGAVIGLNPPISPAYWTVPRLNYTARKQFCLRASSVNSSNDAEEGKMISIKKEKDGWKIDFSGEKPPTPLLDTINYPVHMKNLSAHDLEQLAAELRAEIVYSVAKTGGHLSASLGVVDLTVALHHVFNTPEDRIIWDVGHQAYPHKILTGRRSKMHTIRQTSGLAGFPKRDESIYDAFGAGHSSTSISAGLGMAVARDILGKNNNVISVIGDGAMTAGQAYEAMNNAGFLDANLIVVLNDNKQVSLPTATLDGPATPVGALSSALSKLQASPKFRQLREAAKSITKQIGPQAHEVAAKVDEYARGMLSATGSTLFEELGLYYIGPVDGHSIEDLVTIFQKVKAMPAPGPVLIHIVTEKGKGYPPAEVAADKMHGVVKFDPKTGKQFKSKSPTLSYTQYFAESLIKEAEIDNKIIAIHAAMGGGTGLNYFQKRFPDRCFDVGIAEQHAVTFAAGLATEGLKPFCAIYSSFLQRGYDQVVHDVDLQKLPVRFAMDRAGLVGADGPTHCGAFDVAYMACLPNMIVMAPSDEAELMHMVATAAKIDDRPCCFRFPRGNGIGVALPPNNKGTPLEIGKGRILVEGSRVAILGYGSIVQQCLGAAEMLKSHNVSPTVADAKFCKPLDGDLIKTLAKEHEILITVEEGSIGGFGSHVTHFLSLTGILDGPIKVRSLFLPDRYIDHGAPVDQIEEAGLSSRHICATILSLLGKPKEALKLQ

SEQ ID NO: 7666 - protein, 113 aa, Xenopus laevis
MSVSVFSVVSRFLDEYVSSTPQRLKLLDAYLLYILLTGALQFLYCLLVGTFPFNSFLSGFISSVGSFILAVCLRIQINPQNKSDFQGISPERAFADFLFANTILHLVVVNFIG

SEQ ID NO: 7667 - protein, 609 aa, Pseudomonas syringae pv. tomato
MESRTSRRTFVKGLAAAGVLGGLGLWRSPSWAASGSPALSVLSGTEFDLSIGEMPVNITGRRRTAMAINGGLPGPLLRWKEGDTVTLRVRNRLDAATSIHWHGIILPPNMDGVPGLSFAGIEPGGVYVYQFKVQQNGTYWYHSHSGFQEQVGVYGPLVIEAKEPEPFKYDSEHVVMLTDWTDEDPVSLMRTLKKQSDYYNFHKRTVGDFVNDVADKGWAATVADRKMWAEMKMNPTDLADVSGATYTYLLNGQAPNMNWTGLFRPGEKLRLRFINGSAMTYFDIRIPGLKMTVVASDGQFVNPVEVDELRIAVAETFDVIVEPTAEAYTVFAQSMDRTGYARGTLAVREGLVAQVPPLDPRPLVTMDDMGMGGMDHGSMDGMSGMDSGADDGMQTMSSMGGDSMPAMDHSKMSTMQGMDHGAMSGMDHGAMGGMVMQSHPASENDNPLVDMQAMSPTAKLNDPGLGLRNNGRKVLTYADLKSTFEDPDGREPSRTIELHLTGHMEKFAWSFDGIKFADAQPLILKYGERVRIVLVNDTMMTHPIHLHGMWSDLEDEDGNFRVRKHTIDMPPGSKRSYRVTADALGRWAYHCHLLYHMEMGMFREVRVEE

SEQ ID NO: 7668 - protein, 500 aa, Petunia x hybrida
MVLSKTVSQSDVSIHSTFASRYVRTSLPRFKMPDNSIPKEAAYQIINDELMLDGNPRLNLASFVTTWMEPECDKLMMDSINKNYVDMDEYPVTTELQNRCVNMIAHLFNAPLEDGETAVGVGTVGSSEAIMLAGLAFKRKWQNKMKAQGKPCDKPNIVTGANVQVCWEKFARYFEVELKEVKLSEGYYVMDPEKAVEMVDENTICVAAILGSTLNGEFEDVKRLNDLLVEKNKETGWDTPIHVDAASGGFIAPFIYPELEWDFRLPLVKSINVSGHKYGLVYAGIGWVVWRNKDDLPDELIFHINYLGADQPTFTLNFSKGSSQVIAQYYQLIRLGYEGYKNVMENCQENASVLREGLEKTGRFNIISKEIGVPLVAFSLKDNRQHNEFEISETLRRFGWIVPAYTMPPNAQHITVLRVVIREDFSRTLAERLVRDIEKVLHELDTLPARVNAKLAVAEEQAAANGSEVHKKTDSEVQLEMITAWKKFVEEKKKKTNRVC

SEQ ID NO: 7669 - protein, 181 aa, Eriocheir sinensis
GIIWGFLTAFVTRLTSQVRVIEPIFVFVMAYLAYLNAEIFHLSGILSITFCGITMKNYVEQNISSKSHTTIKYAMKMLASSSETVIFMFLGVSTIQSTHDWNTWFVILTILFCSVYRILGVLIFSAVCNRFRVKKIAFVDKFVMSYGGLRGAVAFALVITIDPHHIPLQPMFLTATIAMVY

SEQ ID NO: 7670 - protein, 2654 aa, Xenopus laevis
MATDPGLEMASMIPALRELASAGAEEYNTTVQKPRQILCQFIDRILTDVDVVAVELSKNTDSQPSSVMLLDFIQHIMKSTPLMFLSANNGDQSAETNQNCVAFSNWIISRLLRIGATPSCKALHRKIAEVIRSLLFLFKNKSSFLFGVFTKDLLHLFEDLIYIHEQNMEKSVVWPVTISRFLSNASENQTYLRCTQFQLLNMQNIEPLESTLLMVLMDNEHDISPVFFQRQNLLLWGIGCSLLDYGSTPLKIQALHFLRQLIKLGGPPEQGAYFFFIVFFGILTCIKDMDLEEVSLYEMPLLKLVKVLFPFESKSYLNIEPVYLNMLLEKLAALFDGGILSNIQSAPLKEALCYMVHYFLSIVPPGYESAKEVREAHVRCICRAFVDVLGLQSKQEYLVCPLHEALRIENLVFMQQQRMQPLSTDSEGGGSSSSDEVQEKRPRLSLTAKPLRRNTPSVPAPVDMKTKSILWKAVSAKFSSILCKLEGDEVTDEEMVSLLEGLNTTVRVAALNTVHIFTNDSTDTDQLVSDLSNTSGIQSVEIVPHVFWLSPEDILKILKICRKVLDSAHQRANINDILMKIIKIFDAILYIHAGNRLNDQTLKDLCSMISLPWLQNHSNHASFKVASFDPTLMTISERIGQHYSPEIQSQLVFLLCLFPKMLCPEWRLAVYQWALDSPHEIVRARCIKGFPVLLCNVSQQGYGPIPKILIDCLNDASELVKKELANSVGMFASGLACGFELQYSPTAPTAAESEFLCSSLTVTALPSSKLSRMTASALKPFLALLNRNMPSSVKMAFIENMPMLFAHLSLEKDDLDSRTVIESLLNLMEDPDKDVRTAFSGNIKHLLACADCEDGYLKEIVVSRMKKAYTDAKMSRDNEMKDTLILTTGDIGRAAKGELVPFALLHLLHCLLSKSPCVAGASYTEIRSLAAAKSTSLHIFFSQYKKPICQFLIESLHSSQAALLTNTPGRSSEMQKQEATHHREAALDILSEIANVFDFPDLNRFLTRTLQLLLPYLAAKASPTASTLIRTIAKQLNVNRREILINNFKYIFSHLVCSCTKDELEKSLHYLKNETEIELGSLLRQDYQGLHNELLLRLGEHYQQVFSGLSILATYASNDDPYQGPRNFAKPEIMADYLQPKLLGILAFFNMHLLSSSIGIEDKKMALNSLVSLMKLMGPKHISSVRVKMMTTLRTGLRYKEEFPGLCCSAWDLFVRCLDQAYLGPLLSHVIVALLPLLHIQPKETVAVFRYLIVENRDAVQDFLHEIYFLPDHPELKEIQKVLQEYRKETTKSTDLQTAMQLSIRAIQHENVDVRMHALTSLKETLYKNQAKLLQYSTDSETVEPVISQLVTVLLIGCQDANPQARLFCGECLGQLGAIDPGRLDFSPSETQGKGFTFVSGVEDSDFAYELLTEQTRAFLAYADNVRAQDSAAYAIQELLSIFECKEGRTDCPGRRLWRRFPEHVQEILEPHLNTRYKSSRKAVNWSRVKKPIYLSKLGNNFADWSATWAGYLITKVRHELARRVFSCCSIMMKHDFKVTIYLLPHILVYVLLGCNKEDQQEVYAEIMAVLKHEDPLMRRLQDSASDLSQLSTQTVFSMLDHLTQWAREKFQALNAEKTNPKPGTRGEPKAVSNEDYGEYQNVTRFLDLIPQDTLAVASFRSKAYTRALMHFESFIMEKKQEIQEHLGFLQKLYAAMHEPDGVAGVSAIRKKEASLKEQILEHESIGLLRDATACYDRAIQLKPEEIIHYHGVVKSMLGLGQLSTVITQVNGILNSRSEWTAELSTYRVEAAWKLSQWDLVEEYLSADRKSTTWSIRLGQLLLSAKKGERDMFYETLKVVRAEQIVPLSAASFERGSYQRGYEYIVRLHMLCELEHSVKMFLQKPSVEPAVDSLNLPARLEMTQNSYRAREPILAVRRALQTINKRPNHADMIGECWLQSARVARKAGHHQTAYNALLNAGESRLSELNVERAKWLWSKGDVHQALIVLQKGAELFLSSTSAPPEQQLIHGRAMLLVGRLMEETANFESNAVMKKYKDVTALLPEWEDGHFYLAKYYDKLMPMVTDNKMEKQGDLIRYIVLHFGRSLQFGNQYIYQSMPRMLSLWLDFGAKVYEWEKAGRADRLQMKNELMKINKVISDHKNQLAPYQFLTAFSQLISRICHSHDEVFAVLMEIVAKVFVAYPQQAMWMMTAVSKSSYPMRVNRCKEILEKAIHMKPSLGKFIGDATRLTDKLLELCNKPVDGNTSTLSMNIHFKMLKKLVEETTFSEILIPLQSVMIPTLPSTAGKRDHADHDPFPGHWAYLSGFDDAVEILPSLQKPKKISLKGSDGKSYIMMCKPKDDLRKDCRLMEFNSLINKCLRKDAESRRRELHIRTYAVIPLNDECGIIEWVNNTAGFRNILIKLYKEKGIYMGGKELRQCMLPKNAPLQEKLKVFKEALLPRHPPLFHEWFLRTFPDPTSWYNSRSAYCRSTAVMSMVGYILGLGDRHGENILFDSLTGECVHVDFNCLFNKGETFEVPEIVPFRLTHNMVNGMGPMGTEGLFRRACEVIMRLMREQRESLMSVLKPFLHDPLVEWSKPARGSSKGQVNETGEVMNEKAKTHVLDIEQRLQGVIKTRNRVKGLPLSIEGHVHYLIQEATDENLLSQMYLGWAPYM

SEQ ID NO: 7671 - protein, 502 aa, Atriplex hortensis
MAFPIPARQLFIDGEWREPLLKNRIPIINPSTEEIIGDIPAATAEDVEVAVVAARKAFKRNKGRDWAALWSHRAKYLRAIAAKITEKKDHFVKLETLDSGKPRDEAVLDIDDVATCFEYFEYFAGQAEALDAKQKAPVTLPMERFKSHVLRQPIGVVGLISPWNYPLLMDTWKIAPALAAGCTTVLKPSELASVTCLEFGEVCNEVGLPPGVLNILTGLGPDAGAPIVSHPDIDKVAFTGSSATGSKIMASAAQLVKPVTLELGGKSPVIMFEDIDIETAVEWTLFGVFWTNGQICSATSRLLVHESIAAEFVDRMVKWTKNIKISDPFEEGCRLGPVISKGQYDKIMKFISTAKSEGATILCGGSRPEHLKKGYYIEPTIITDITTSMQIWKEEVFGPVICVKTFKTEDEAIELANDTEYGLAGAVFSKDLERCERVTKALEVGAVWVNCSQPCFVHAPWGGVKRSGFGRELGEWGIENYLNIKQVTSDISDEPWGWYKSP

SEQ ID NO: 7672 - protein, 495 aa, Alternaria alternata
MTSVKLSTPQTGEFEQPTGLFINNEFVKAVDGKTFDVINPSTEEVICSVQEATEKDVDIAVAAARKAFNGPWAKETPENRGKLLNKLADLFEKNADLIAAVEALDNGKAFSMAKNVDVPAAAGCLRYYGGWADKIEGKVVDTAPDSFNYIRKSLLVFAVRSSMELPILMWSWKIGPAIATGNTVVLKTAEQTPLSAYIACKLIQEAGFPPGVINVITGFGKIAGAAMSAHMDIDKIAFTGSTVVGRQIMKSAAGSNLKKVTLELGGKSPNIVFADADLDEAIHWVNFGIYFNHGQACCAGSRIYVQEEIYDKFIQRFKERAAQNAVGDPFAATLQGPQVSQLQFDRIMGYIEEGKKSGATIETGGNRKGDKGYFIEPTIFSNVTEDMKIQQEEIFGPVCTISKFKTKADVIKIGNNTTYGLSAAVHTSNLTTAIEVANALRAGTVWVNSYNTLHWQLPFGGYKESGIGRELGEAALDNYIQTKTVSIRLGDVLFG

SEQ ID NO: 7673 - protein, 317 aa, Rattus norvegicus
MPREDRATWKSNYFLKIIQLLDDYPKCFIVGADNVGSKQMQQIRMSLRGKAVVLMGKNTMMRKAIRGHLENNPALEKLLPHIRGNVGFVFTKEDLTEIRDMLLANKVPAAARAGAIAPCEVTVPAQNTGLGPEKTSFFQALGITTKISRGTIEILSDVQLIKTGDKVGASEATLLNMLNISPFSFGLIIQQVFDNGSIYSPEVLDITEQALHTRFLEGVRNVASVCLQIGYPTVASVPHSIINGYKRVLALSVETDYTFPLAEKVKAFLADPSAFAAAAPVAAATTAAPAAAAAPAKVEAKEESEESDEDMGFGLFD

SEQ ID NO: 7674 - protein, 271 aa, Flavobacterium sp. 141-8
MTTAGVSRRPGRLAGKAAIVTGAAGGIGRATVEAYLREGASVVAMDLAPRLAATRYEEPGAIPIACDLADRAAIDAAMADAVARLGGLDILVAGGALKGGTGNFLDLSDADWDRYVDVNMTGTFLTCRAGARAMVAAGAGKDGRSARIITIGSVNSFMAEPEAAAYVAAKGGVAMLTRAMAVDLARHGILVNMIAPGPVDVTGNNTGYSEPRLAEQVLDEVALGRPGLPEEVATAAVFLAEDGSSFITGSTITIDGGLSAMIFGGMREGRR

SEQ ID NO: 7675 - protein, 445 aa, Ricinus communis
MAITIVSVRARQIFDSRGNPTVEADIKLSDGHLARAAVPSGASTGIYEALELRDGGSDYLGKGVSKAVENVNSIIGPALIGKDPTEQTALDNFMVQELDGTVNEWGWCKQKLGANAILAVSLALCKAGAHVKGIPLYKHIANLAGNKNLVLPVPAFNVINGGSHAGNKLAMQEFMILPVGASSFKEAMKMGAEVYHHLKSVIKKKYGQDATNVGDEGGFAPNIQENKEGLELLKTAIAKAGYTGKVVIGMDVAASEFYGSDKTYDLNFKEENNDGSQKISGEALKDLYKSFASEYPIVSIEDPFDQDDWEHYSKLTSEIGEKVQIVGDDLLVTNPKRVEKAIQEKACNALLLKVNQIGSVTESIEAVRMSKRAGWGVMASHRSGETEDTFIADLSVGLATGQIKTGAPCRSERLAKYNQLLRIEEELGAEAVYAGAKFRTPVEPY

SEQ ID NO: 7676 - protein, 417 aa, Candida albicans
MMNIDQHHQLQQQHQQQMLQQQAQAQAQAQAQAQQQQQAAAAAAAANAAATTSSSSPRQVSFNVSDHYQILEIVGEGAYGIVCSAIHKPSQQKVAIKKIEPFERSMLCLRTLRELKLLKHFNHENIISILAIQRPINYESFNEIYLIQELMETDLHRVIRTQNLSDDHIQYFIYQTLRALKAMHSANVLHRDLKPSNLLLNSNCDLKICDFGLARSIASQEDNYGFMTEYVATRWYRAPEIMLTFQEYTTAIDVWSVGCILAEMLSGRPLFPGRDYHNQLWLIMEVLGTPNMEDYYNIKSKRAREYIRSLPFCKKIPFSELFANTNNNTSTSNTGGRTNINPLALDLLEKLLIFNPAKRITVEDALKHPYLQLYHDPNDEPISDKIPEDFFDFDKMKDQLTIEDLKKLLYEEIMKPL

SEQ ID NO: 7677 - protein, 415 aa, Dictyostelium discoideum
MPPPPTSDTSNFNDNISYFVYGSQFTVPRRYSIVKCIGHGAYGVVCSAKDNLTGEKVAIKKISKAFDNLKDTKRTLREIHLLRHFKHENLISIKDILKPNSKEQFEDVYIVSELMDTDLHQIITSPQPLSDDHCQYFVYQMLRGLKHIHSANVLHRDLKPSNLLINEDCLLKICDLGLARVEDATHQGFMTEYVATRWYRAPEVILSWNKYTKAIDIWSVGCIFAELLGRKPLFQGKDYIHQITLIIETIGSPSEEDICNIANEQARQFIRSLNMGNQPKVNFANMFPKANPDAIDLLERMLYFDPSKRLTVEEALAHPYFQSLHDPSDEPICLHKFSLNFEAWDLNRDLLKELIYNEMLAYHPEDPQAPYYTDLNNPNFNLSRIQSSSELFNLLQQQKQPIHQQVNQQSIKINN

SEQ ID NO: 7678 - protein, 339 aa, Brassica napus
MDHEADAFRDLMTITRFVLNEQSKYPESRGDFTILLSNIVLGCKFVCSAVNKAGLAKLIGLAGDTNIQGEEQKKLDVLSNDVFVKALVSSGRTSVLVSEEDEEATFVESSKCGKYCVVFDPLDGSSNIDCGVSIGTIFGIYTMEHSDEPTTKDVLKPGNEMVAAGYCMYGSSCMLVLSTGTGVHGFTLDPSLGEFILTHPDIKIPKKGNIYSVNEGNAQNWDGPTTKYVERCKYPKDGSPAKSLRYVGSMVADVHRTLLYGGIFLYPADKKSPNGKLRVLYEVFPMAFLMEQAGGQAFTGKKRALDLVPKKIHERSPIFLGSYDDVEEIKALYAEEEKN

SEQ ID NO: 7679 - protein, 340 aa, Solanum tuberosum
MDHAADRHRTDLMTITRFVLNEQTKHPESRGDFSILLSHIVLGCKFVCTAVNKAGLAKLLGLAGETNVQGEDQKKLDVLSNEVFIKALVSSNRTCILVSEEDEEATFVRPANRGKYCVVFDPLDGSSNIDCGVSIGTIFGIYMIKDGHEPTLDDVLQPGMNMLAAGYCMYGSSCTLVLSTGSGVNGFTLDPSLGEFILTHPDIKIPKKGKIYSVNEGNAKNWDSPTSKYVQSCKYPADGSSPKSLRYIGSMVADVHRTLLYGGIFLYPGDKKSPNGKLRVLYEVFPMSFLMEQAGGQAFTGKQRALDLVPEKIHERSPIFLGSYDDVEEIKKLYAAEEQN

SEQ ID NO: 7680 - protein, 375 aa, Paracoccus denitrificans
MRTRAAVALEAGKPLEVMEVNLEGPKAGEVMVEIKATGICHTDEFTLSGADPEGLFPSILGHEGAGVVVEVGPGVTSVKPGNHVIPLYTPECRQCASCLSGKTNLCTAIRATQGQGLMPDGTSRFSMLDGTPIFHYMGCSTFSNYTVLPEIAVAKVREDAPFDKICYIGCGVTTGIGAVINTAKVEIGAKAVVFGLGGIGLNVLQGLRLAGADMIIGVDLNDDKKPMAEHFGMTHFINPKNCENVVQEIVNLTKTPFDQIGGADYSFDCTGNVKVMRDALECTHRGWGQSIIIGVAPAGAEISTRPFQLVTGRVWKGTAFGGARGRTDVPQIVDWYMDGKIEIDPMITHTLSLDDINKGFDLMHAGESIRSVVLY

SEQ ID NO: 7681 - protein, 359 aa, Bos taurus
MTLESMMACCLSDEVKESKRINAEIEKQLRRDKRDARRELKLLLLGTGESGKSTFIKQMRIIHGAGYSEEDKRGFTKLVYQNIFTAMQAMIRAMETLKILYKYEQNKANALLIREVDVEKVTTFEHRYVSAIKTLWNDPGIQECYDRRREYQLSDSAKYYLTDVDRIATSGYLPTQQDVLRVRVPTTGIIEYPFDLENIIFRMVDVGGQRSERRKWIHCFENVTSIMFLVALSEYDQVLVESDNENRMEESKALFRTIVTYPWFQNSSVILFLNKKDLLEDKILHSHLVDYFPEFDGPQRDAQAAREFILKMFVDLNPDSDKIIYSHFTCATDTENIRFVFAAVKDTILQLNLKEYNLV

SEQ ID NO: 7682 - protein, 359 aa, Meleagris gallopavo
MTLESMMACCLSDEVKESKRINAEIEKQLRRDKRDARRELKLLLLGTGESGKSTFIKQMRIIHGSGYSEEDKKGFTKLVYQNIFTAMQSMIRAMETLKILYKYEQNKANAVLIREVDVEKVMTFEQPYVSAIKTLWNDPGIQECYDRRREYQLSDSAKYYLSDVDRIATPGYLPTQQDVLRVRVPTTGIIEYPFDLENIIFRMVDVGGQRSERRKWIHCFENVTSIMFLVALSEYDQVLVESDNENRMEESKALFRTIITYPWFQNSSVILFLNKKDLLEDKILYSHLVDYFPEFDGPQRDAQAAREFILKMFVDLNPDSDKIIYSHFTCATDTENIRFVFAAVKDTILQLNLKEYNLV

SEQ ID NO: 7683 - protein, 359 aa, Xenopus laevis
MTLDSTMACCLSEEVKESKRINAEIEKQLRRDKKDSRRELKLLLLGTGESGKSTFIKQMRIIHGSGYSEEDKKGFTKLVFQNIFTAMQSMIRAMETLKILYKYEQNKANAQVVREVDVEKVCTFEQPYVNAIKNLWSDPGIQECYDRRREYQLSDSTKYYLTDVDRISKPGYLPTQQDVLRVRVPTTGIIEYPFDLENIIFRMVDVGGQRSERRKWIHCFENVTSIMFLVALSEYDQVLVESDNENRMEESKALFRTIITYPWFQNSSVILFLNKKDLLEDKIMYSHLVDYFPEFDGPQRDAATAREFILKMFVDLNPDSDKIIYSHFTCATDTENIRFVFAAVKDTILQHNLKEYNLV

SEQ ID NO: 7684 - protein, 429 aa, Candida albicans
MGCGASVPVDDDEIDPFLQDKRINDAIEQSLQLRQQNSKKGVKLLLLGAGESGKSTVLKQLKLLHKGGFTQQERRQYSHVIWCDVIQSMKVLIIQARKLKIKLDCDQPNNSLIPYKQIILRSDPLKQIDASVAGGTDFLNDFVVKYSEENKNKRRLKSTGTTDIWGKDDDSNINSDAINQALESSLNKDSEQFTRLSIAEAIHKLWKLDSGIKKCFDRSNEFQLEGSADYYFDNVVNFADTNYLSTDLDILKGRIKTTGITETDFLIKSFQFKVLDAGGQRSVRKKWIHCFEDITAVLFVLAISEYDQNLFEDERVNRMHESIVLFDSLCNSKWFANTPFILFLNKIDIFENKIKKNPLKNYFPDYDGKPDDTNEAIKFFETNFLKINQTNKPIYVHRTCATDSKSMKFVLSAVTDMIVQQNLKKSGIM

SEQ ID NO: 7685 - protein, 390 aa, Dictyostelium discoideum
MSSTTTNTTTATPAIQVNGNQSSSPQSPSSSTSTLSPPMSPSLLTRYREQKAVNKQIEKQLKEEKKIMDSELKLLLLGTGDSGKSTVVKQMKILHLEGYSQEERINQRQFVYRNIIEIAYSIIRGCGVLNLTIPSQFDSICSSIEEIYETKNYTNLDKNVLKGVAELSKNESFINAANNSGSNFQLHSSSQYFLDDIARFSEEDYIPTDQDILYTRVASTSVSETRFSVRGIKFRMIDVAGQRGHRDKWIHHFSEVTAILFVISLCEYDQVLEEDGKTNRMIESIKVFGDIINQRLFKDIPIILFLNKRDLFAEKIKKTGISICFPDYTGPSDDYEQSLVFLKKKILSANKTSKAVYTNVTTATDTTNIGHVFEAVKDILTRQTMEEGGI

SEQ ID NO: 7686 - protein, 403 aa, Dictyostelium discoideum
MGCYQSRVQVEDKTNEQLDKYLVQAGKEGLLDFRILLLGAGESGKSTVVKQLKSIYKIQVDDDELHSYAVNIHKNTVLCMQVLLEAGETLGIELTDPETKKRAINVKSFQFEPEVKQMPVSIGLDIEELWRDEDIQKIWDRRSEYWFLDATPYYFENIQRFLDDDFVPTEEDCIMTRVRTTGISVTEFDEGPVHFRVVDVGGQRNERKKWIHCFDDVKALLFVVNLAGYDQVMFEDPSQNRMQESLTLFGQICNNPIFSETPTFLVLNKKDLFEQMIQKTDLSKCFPDYKGGSDVKTALEFIQMKYQQKIQESNKPLHTFHIAARYKKDIKYTWEEAKGILLEENKKVLMKATKDLKKSSKQSSKSSLGNSTQNNSNNNNNNNNSNNNNGQTTIDGATAKINS

SEQ ID NO: 7687 - protein, 355 aa, Homarus americanus
MGCAMSNAADKEAAERSKKIDKDLRLAGERAAREVKLLLLGAGESGKSTIVKQMKIIHETGYSREECEQYRPVVYSNTIQSLMAIIRAMGQLKIDFRDSSRADDARHFFTLASAADEGELTPELANIMKRLWNESGVQHCRNRSREYQLNDTAAYYLNALDRIARPGYIPTQQDVLRTRVKTTGIVETNFSFKNLNFKLFDVGGQRSERKKWIHCFEGVTAIIFVVALSGYDLVLAEDEEMNRMIESMKLFDSICNNKWFVETSIILFLNKKDLFEQKITKSPLTICFPEYQGSNVYEDSANYIRMKFENLNKRKDQKEIYTHFTCATDTNNIQFVFDAVTDVIIKNNLKDCGLF

SEQ ID NO: 7688 - protein, 332 aa, Dictyostelium discoideum
MEQQKAPQVTYLEVGSLVGHNGFVTSIAVSPENPDTIISSSRDKTVMVWQLTPTDATSPGKAHRSLKGHSHFVQDVVISHDGQFALSGSWDNTLRLWDITKGVSTRLFKGHTQDVMSVAFSSDNRQIISGSRDATIKVWNTLGECKFTLEGPEAHQAVLIGFHVSDSHQNTPTIVSGSWDNKVKIWDIKSFKCNHTLTDHTGYVNTVTISPDGSLCASGGKDTFACLWELSSGKPLYKLEARNTINALAFSPNKYWLSAATDDKIIIWDLLTKQVLAEIVPEVKEQAFDSKKKKESKPKAPACLSLAWSADGSVLYAGYNDGLIRVYKSSSQ

SEQ ID NO: 7689 - protein, 112 aa, Rhodobacter sphaeroides
MKKIEAIIKPFKLDEVKEALQAAGVQGLSVTEVKGFGRQKGHTELYRGAAYVVDFLPKVKIEVVLADDMVEAAVEAIVSASRTDKIGDGKIFISPVEQAIRIRTGETGEDAV

SEQ ID NO: 7690 - protein, 213 aa, Nicotiana tabacum
MAIKVHGSPMSTATMRVAACLIEKDLDFELVPVDMVSGEHKKHPYLSLNPFGQVPAFEDGDLKLFESRAITQYIAHVYADNGYQLILQDPKKMPIMSVWMEVEGQKFEPHASKLTWELGIKPIIGMTTDDDAVKESEVQLSKVLDIYETRLAESKYLGGDSFTLVDLHHIPNIYYLMSTKVKEVFDSRPRVSAWCADILARPAWVKGLEKLQK

SEQ ID NO: 7691 - protein, 212 aa, Hyoscyamus muticus
MGMKLHGPAMSPAVMRVIATLKEKDLDFELVPVNMQAGDHKKEPFITLNPFGQVPAFEDGDLKLFESRAITQYIAHTYADKGNQLLANDPKKMAIMSVWMEVESQKFDPVASKLTFEIVIKPMLGMVTDDAAVAENEEKLGKVLDVYESRLKDSKYLGGDSFTLADLHHAPAMNYLMGTKVKSLFDSRPHVSAWCADILARPAWSKAIEYKQ

SEQ ID NO: 7692 - protein, 490 aa, Gallus gallus
MESGSKMTARLMLAVGGAVLGSLQFGYNTGVINRPQKVIEDFYNHTWLYRYEEPISPATLTTLWSLSVAIFSVGGMIGSFSVGLFVNRFGRRNSMLMSNILAFLAAVLMGFSKMALSFEMLILGRFIIGLYSGLTTGFVPMYVGEVSPTALRGALGTFHQLGIVLGILIAQVFGLDLIMGNDSLWPLLLGFIFVPALLQCIILPFAPESPRFLLINRNEENKAKSVLKKLRGTTDVSSDLQEMKEESRQMMREKKVTIMELFRSPMYRQPILIAIVLQLSQQLSGINAVFYYSTSIFEKSGVEQPVYATIGSGVVNTAFTVVSLFVVERAGRRTLHLIGLAGMAGCAILMTIALTLLDQMPWMSYLSIVAIFGFVAFFEIGPGPIPWFIVAELFSQGPRPAAFAVAGLSNWTSNFIVGMGFQYIAQLCGSYVFIIFTVLLVLFFIFTYFKVPETKGRTFDEIAYRFRQGGASQSDKTPDEFHSLGADSQV

SEQ ID NO: 7693 - protein, 502 aa, Rattus norvegicus
MEKEDQEKTGKLTLVLALATFLAAFGSSFQYGYNVAAVNSPSEFMQQFYNDTYYDRNKENIESFTLTLLWSLTVSMFPFGGFIGSLMVGFLVNNLGRKGALLFNNIFSILPAILMGCSKIAKSFEIIIASRLLVGICAGISSNVVPMYLGELAPKNLRGALGVVPQLFITVGILVAQLFGLRSVLASEEGWPILLGLTGVPAGLQLLLLPFFPESPRYLLIQKKNESAAEKALQTLRGWKDVDMEMEEIRKEDEAEKAAGFISVWKLFRMQSLRWQLISTIVLMAGQQLSGVNAIYYYADQIYLSAGVKSNDVQYVTAGTGAVNVFMTMVTVFVVELWGRRNLLLIGFSTCLTACIVLTVALALQNTISWMPYVSIVCVIVYVIGHAVGPSPIPALFITEIFLQSSRPSAYMIGGSVHWLSNFIVGLIFPFIQVGLGPYSFIIFAIICLLTTIYIFMVVPETKGRTFVEINQIFAKKNKVSDVYPEKEEKELNDLPPATREQ

SEQ ID NO: 7694 - protein, 149 aa, Canavalia lineata
MGAFSEKQESLVKSSWEAFKQNVPHHSAVFYTLILEKAPAAQNMFSFLSNGVDPNNPKLKAHAEKVFKMTVDSAVQLRAKGEVVLADPTLGSVHVQKGVLDPHFLVVKEALLKTFKEAVGDKWNDELGNAWEVAYDELAAAIKKAMGSA

SEQ ID NO: 7695 - protein, 468 aa, Escherichia coli
MKKVNHWINGKNVAGNDYFLTTNPATGEVLADVASGGEAEINQAVATAKEAFPKWANLPMKERARLMRRLGDLIDQNVPEIAAMETADTGLPIHQTKNVLIPRASHNFEFFAEVCQQMNGKTYPVDDKMLNYTLVQPVGVCALVSPWNVPFMTATWKVAPCLALGITAVLKMSELSPLTADRLGELALEAGIPAGVLNVVQGYGATAGDALVRHHDVRAVSFTGGTATGRNIMKNAGLKKYSMELGGKSPVLIFEDADIERALDAALFTIFSINGERCTAGSRIFIQQSIYPEFVKFAERANRVRVGDPTDPNTQVGALISQQHWEKVSGYIRLGIEEGATLLAGGPDKPSDLPAHLKGGNFLRPTVLADVDNRMRVAQEEIFGPVACLLPFKDEAEALRLANDVEYGLASYIWTQDVSKVLRLARGIEAGMVFVNTQFVRDLRHAFGGVKPRTGREGGGYSSKCSRK

SEQ ID NO: 7696 - protein, 424 aa, Homo sapiens [sequence omitted]

SEQ ID NO: 7697 - protein, 415 aa, Malus x domestica
MIQETRRLADEYEISEILGRGGFSVVRKGISRKSSSSSDKTDVAIKTLKRPFAPSNPPPLPPHARRNDQNSFAAAAFQTRKQVSISNVLLTNEILVMRKIVENVSPHPNVIDLYDVYEDENGVHLVLELCSGGELFDRIVKQERYSEVGAAAVVRQIAQGLAALHRSNIVHRDLKPENCLFLDNTVDSPLKIMDFGLSSVEEFTDPVVGLFGSIDYVSPEALSQGQVTSKSDMWALGVILYILLSGYPPFIAQSNRQKQQMIMAGEFSFYEKTWKGFLCQPKQLISSLLKVDPDKRPSAQELLDHPWVVGLSAREDQMDAEIVSRLQSFNARRKLRAAAIASVWTSSIFLRTKKLKSLLGSYDLKPDEIKNLSSHFKKICVKGDNATLSEFRLSCKRLIQLRLVSMSLRAEPARL

SEQ ID NO: 7698 - protein, 735 aa, Homo sapiens
MAKERGLISPSDFAQLQKYMEYSTKKVSDVLKLFEDGEMAKYVQGDAIGYEGFQQFLKIYLEVDNVPRHLSLALFQSFETGHCLNETNVTKDVVCLNDVSCYFSLLEGGRPEDKLEFTFKLYDTDRNGILDSSEVDKIILQMMRVAEYLDWDVSELRPILQEMMKEIDYDGSGSVSQAEWVRAGATTVPLLVLLGLEMTLKDDGQHMWRPKRFPRPVYCNLCESSIGLGKQGLSCNLCKYTVHDQCAMKALPCEVSTYAKSRKDIGVQSHVWVRGGCESGRCDRCQKKIRIYHSLTGLHCVWCHLEIHDDCLQAVGHECDCGLLRDHILPPSSIYPSVLASGPDRKNSKTSQKTMDDLNLSTSEALRIDPVPNTHPLLVFVNPKSGGKQGQRVLWKFQYILNPRQVFNLLKDGPEIGLRLFKDVPDSRILVCGGDGTVGWILETIDKANLPVLPPVAVLPLGTGNDLARCLRWGGGYEGQNLAKILKDLEMSKVVHMDRWSVEVIPQQTEEKSDPVPFQIINNYFSIGVDASIAHRFHIMREKYPEKFNSRMKNKLWYFEFATSESIFSTCKKLEESLTVEICGKPLDLSNLSLEGIAVLNIPSMHGGSNLWGDTRRPHGDIYGINQALGATAKVITDPDILKTCVPDLSDKRLEVVGLEGAIEMGQIYTKLKNAGRRLAKCSEITFHTTKTLPMQIDVEPWMQTPCTIKITHKNQMPMLMGPPPRSTNFFGFLS

SEQ ID NO: 7699 - protein, 151 aa, Gossypium hirsutum
MSQLLEKAKDFVVDKVANIKKPEASVSDVDLKHVSRECVEYGAKVSVSNPYSHSIPICEISYNFRSAGRGIASGTIPDPGSLKASDTTMLDVPVKVPYNILVSLVKDIGADWDIDYELELGLTIDLPIVGNFTIPLSQKGEIKLPTLSDIF

SEQ ID NO: 7700 - protein, 471 aa, Saccharomyces cerevisiae
MFAFYFLTACISLKGVFGVSPSYNGLGLTPQMGWDNWNTFACDVSEQLLLDTADRISDLGLKDMGYKYIILDDCWSSGRDSDGFLVADEQKFPNGMGHVADHLHNNSFLFGMYSSAGEYTCAGYPGSLGREEEDAQFFANNRVDYLKYDNCYNKGQFGTPEISYHRYKAMSDALNKTGRPIFYSLCNWGQDLTFYWGSGIANSWRMSGDITAEFTRPDSRCPCDGDEYDCKYAGFHCSIMNILNKAAPMGQNAGVGGWNDLDNLEVRVGNLTDDEEKAHFPMWAMVKSPLIIGADVNTLKPSSYSIYSQASVIAINQDPKGIPATRVWRYYVSDTDEYGQGEIQMWSGPLDNGDQVVALLNGGSVPRPMNTTLEEIFFDSNLGSKELTSTWDIYDLWANRVDNSTASAILGQNKTATGILYNATEQSYKDGLSKNDTRLFGQKIGSLSPNAILNTTVPAHGIAFYRLRPSA

SEQ ID NO: 7701 - protein, 471 aa, Saccharomyces cerevisiae
MFAFYFLTACTTLKGVFGVSPSYNGLGLTPQMGWDSWNTFACDVSEQLLLDTADRISDLGLKDMGYKYVILDDCWSSGRDSDGFLVADKHKFPNGMGHVADHLHNNSFLFGMYSSAGEYTCAGYPGSLGREEEDAQFFANNRVDYLKYDNCYNKGQFGTPDVSYHRYKAMSDALNKTGRPIFYSLCNWGQDLTFYWGSGIANSWRMSGDITAEFTRPDSRCPCDGDEYDCKYAGFHCSIMNILNKAAPMGQNAGVGGWNDLDNLEVGVGNLTDDEEKAHFSMWAMVKSPLIIGADVNHLKASSYSIYSQASVIAINQDPKGIPATRVWRYYVSDTDEYGQGEIQMWSGPLDNGDQVVALLNGGSVARPMNTTLEEIFFDSNLGSKELTSTWDIYDLWANRVDNSTASAILEQNKAATGILYNATEQSYKDGLSKNDTRLFGQKIGSLSPNAILNTTVPAHGIAFYRLRPSA

SEQ ID NO: 7702 - protein, 471 aa, Saccharomyces cerevisiae
MFAFYFLTACISLKGVFGVSPSYNGLGLTPQMGWDNWNTFACDVSEQLLLDTADRISDLGLKDMGYKYVILDDCWSSGRDSDGFLVADKHKFPNGMGHVADHLHNNSFLFGMYSSAGEYTCAGYPGSLGREEEDAQFFANNRVDYLKYDNCYNKGQFGTPDVSYHRYKAMSDALNKTGRPIFYSLCNWGQDLTFYWGSGIANSWRMSGDITAEFTRPDSRCPCDGDEYDCKYAGFHCSIMNILNKAAPMGQNAGVGGWNDLDNLEVGVGNLTDDEEKAHFSMWAMVKSPLIIGADVNHLKASSYSIYSQASVIAINQDPKGIPATRVWRYYVSDTDEYGQGEIQMWSGPLDNGDQVVALLNGGSVARPMNTTLEEIFFDSNLGSKELTSTWDIYDLWANRVDNSTASAILEQNKAATGILYNATEQSYKDGLSKNDTRLFGQKIGSLSPNAILNTTVPAHGIAFYRLRPSA

SEQ ID NO: 7703 - protein, 501 aa, Candida albicans
MDQQEAPIYYGRSVNKVYNQEFIIDSRFKIVKELGHGAYGIVCSAKYDNGSKKVPDSNNGNASSSANASFVAIKKITNIFSKNILCKRALRELKLLQFFRGHKNITCLYDLDIIPNPMTGEFNEIYLYEELMECDMHQIIRSGQPLSDQHYQSFIYQVLCGLNFIHSADVLHRDLKPGNLLVNADCELKICDFGLARGFSENPDENAGFMTEYVATRWYRAPEIMLSFTNYTKAIDIWSVGCILAELLGGKPLFRGKDYVDQLNQILMILGTPPESTLQRIGSHRAQNYVRSLPITRKASYEELFPDANPLALDLLERMLTLDPRERITVRDALNHKYLELWHDPKEEIECQVKFDFKSFETVDGLDEMKQLIMDEVQKFREFVRKPIEEQQRIQMQLHMQKREEQRQEEEEKELLEQQRQFPAQESMDISQTPYNNLETNIGTPQVEDDYPRPQELDEFTFSNLESSSSMNLFQDMAKPSGEEYIKLEEELGFGLDWCYV

SEQ ID NO: 7704 - protein, 265 aa, Holcus lanatus
MASSSRSVLLLVAALFAVFLGSAHGIAKVPPGPNITATYGDEWLDAKSTWYGKPTGAGPKDNGGACGYKDVDKPPFSGMTGCGNTPIFKDGRGCGSCFEIKCTKPESCSGEPVTVHITDDNEEPIAPYHFDLSGHAFGSMAKKGEEQKLRSAGELELKFRRVKCKYPDGTKPTFHVEKGSNPNYLALLVKYIDGDGDVVAVDIKEKGKDKWIELKESWGAVWRVDTPDKLTGPFTVRYTTEGGTKGEAEDVIPEGWKADTAYEAK

SEQ ID NO: 7705 - protein, 518 aa, Oryctolagus cuniculus
MVSDFGLPTFISATELLLASAVFCLVFWVAGASKPRVPKGLKRLPGPWGWPLLGHVLTLGKNPHVALARLSRRYGDVFQIRLGSTPVVVLSGLDTIKQALVRQGDDFKGRPDLYSFSFVTKGQSMIFGSDSGPVWAARRRLAQNALNSFSVASDPASSSSCYLEEHVSQEAENLISKFQELMAAVGHFDPYRYVVMSVANVICAMCFGRRYDHDDQELLSLVNLNDEFGKVAASGSPADFFLILRYLPNPALDTFKDLNERFYSFTQERVKEHCRSFEKGHIRDITDSLIKHYRVDRLDENANVQVSDEKTVGIVLDLFGAGFDTVTTAISWSLMYLVTKPRIQRKIQEELDAVVGRARRPRFSDRPQLPYLEAVIMETFRHTSFLPFTIPHSTTRDTSLGGFYIPKGRCVFVNQWQNNHDPELWGDPEAFRPERFLTPSGAVDKALTEKVLLFGLGKRKCIGETIGRLEVFLFLATLLQQVEFSVSPGTTVDMTPIYGLTMKHARCEHFQAKLRFEA

SEQ ID NO: 7706 - protein, 555 aa, Arabidopsis thaliana
MKSFCDNDDNNHSNTTNLLGFSLSSNMMKMGGRGGREAIYSSSTCSAATSSSSVPPQLVVGDNTSNFGVCYGSNPNGGIYSHMSVMPLRSDGSLCLMEALNRSSHSNHHQDSSPKVEDFFGTHHNNTSHKEAMDLSLDSLFYNTTHEPNTTTNFQEFFSFPQTRNHEEETRNYGNDPSLTHGGSFNVGVYGEFQQSLSLSMSPGSQSSCITGSHHHQQNQNQNHQSQNHQQISEALVETSVGFETTTMAAAKKKRGQEDVVVVGQKQIVHRKSIDTFGQRTSQYRGVTRHRWTGRYEAHLWDNSFKKEGHSRKGRQVYLGGYDMEEKAARAYDLAALKYWGPSTHTNFSAENYQKEIEDMKNMTRQEYVAHLRRKSSGFSRGASIYRGVTRHHQHGRWQARIGRVAGNKDLYLGTFGTQEEAAEAYDVAAIKFRGTNAVTNFDITRYDVDRIMSSNTLLSGELARRNNNSIVVRNTEDQTALNAVVEGGSNKEVSTPERLLSFPAIFALPQVNQKMFGSNMGGNMSPWTSNPNAELKTVALTLPQMPVFAAWADS

SEQ ID NO: 7707 - protein, 68 aa, Lycopersicon esculentum
MDLIDKAKNFVSEKIANMEKPEATITDVDLKGIGFDGLAFHAKVSVKNPYSVPIPIMEIDYVLKSATR

SEQ ID NO: 7708 - protein, 482 aa, Naegleria fowleri
MMMRCVNGQTAQDHLVTQLPGLSGNIGVKSYTGYLLANATRGRYLFYWFFESMRNPSQDPLVMWTNGGPGCSSLGGEASEHGLFLVNADGATITRNPYSWNRVSNILYIEQPVGVGFSYSNSTDDYQNLNDVQAASDMNNALRDFLTRFPQFIGRETYLAGESYGGVYVPTTAYNIVEGNGKGQQPYVNLVGILVGNGVTDAEADSNSIPPMMKYHSLISIKYYEEGYKACQGDFYANQNLPACQKFLTDSSNAMGNINPYYIYDSCPWLGINLQQKLKTTQEMTFQVLDPKTQQPVKIHPLFQMYKHGGWSKRVANERNFAPRFETDAPCVPNQSIAKYFRRLDVQQALGVRRKTADPNGWNICTGIINYTQVYSTILPFYAKLLPHIRILVYSGDTDMVVNGLGTQAAIDKLQLQETSSWRTWEFDSALGTVVGGYIRKFEKSGKGLTFITVRGAGHMVPLVKPDSAFYMFKNFIDGTCC

SEQ ID NO: 7709 - protein, 130 aa, Saccharomyces cerevisiae [sequence omitted]

SEQ ID NO: 7710 - protein, 284 aa, Leishmania major
MAGVDKAMVTLSNGVKMPQFGLGVWQSPAGEVTENAVNWALCAGYRHIDTAAIYKNEESVGAGLRASGVPREDVFITTKLWNTEQGYESTLAAFEESRQKLGVDYIDLYLIHWPRGKDILSKEGKKYLDSWRAFEQLYKEKKVRAIGVSNFHIHHLEDVLAMCTVTPMVNQVELHPLNNQADLRAFCDAKQIKVEAWSPLGQGKLLSNPILSAIGAKYNKTAAQVILRWNIQKNLITIPKSVHRERIEENADIFDFELGAEDVMSIDALNTNSRYGPDPDEAQF

SEQ ID NO: 7711 - protein, 297 aa, Erwinia chrysanthemi
MKLKDFAFYAPCVWGTTYFVTTQFLPADKPLLAALIRALPAGIILILGKNLPPVGWLWRLFVLGALNIGVFFVMLFFAAYRLPGGVVALVGSLQPLIVILLSFLLLTQPVLKKQMVAAVAGGIGIVLLISLPKAPLNPAGLVASALATMSMASGLVLTKKWGRPAGMTMLTFTGWQLFCGGLVILPVQMLTEPLPDLVTLTNLAGYLYLAIPGSLLAYFMWFSGLEANSPVIMSLLGFLSPLVALLLGFLFLQQGLSGAQLVGVVFIFSALIIVQDISLFSRRKKVKPLEQSDCVIK

SEQ ID NO: 7712 - protein, 519 aa, Trametes versicolor
MGLQRFSFFVTLALVARSLAAIGPVASLVVANAPVSPDGFLRDAIVVNGVVPSPLITGKKGDRFQLNVVDTLTNHSMLKSTSIHWHGFFQAGTNWADGPAFVNQCPIASGHSFLYDFHVPDQAGTFWYHSHLSTQYCDGLRGPFVVYDPKDPHASRYDVDNESTVITLTDWYHTAARLGPRFPLGADATLINGLGRSASTPTAALAVINVQHGKRYRFRLVSISCDPNYTFSIDGHNLTVIEVDGINSQPLLVDSIQIFAAQRYSFVLNANQTVGNYWVRANPNFGTVGFAGGINSAILRYQGAPVAEPTTTQTTSVIPLIETNLHPLARMPVPGSPTPGGVDKALNLAFNFNGTNFFINNATFTPPTVPVLLQILSGAQTAQDLLPAGSVYPLPAHSTIEITLPATALAPGAPHPFHLHGHAFAVVRSAGSTTYNYNDPIFRDVVSTGTPAAGDNVTIRFQTDNPGPWFLHCHIDFHLDAGFAIVFAEDVADVKAANPVPKAWSDLCPIYDGLSEANQ

SEQ ID NO: 7713 - protein, 729 aa, Oryctolagus cuniculus
MNPFQQNESKETLFSPVSTEETPPRLSSPAKKTPPKICGSNYPLSIAFIVVNEFCERFSYYGMKAVLTLYFLYFLHWNEDTSTSVYHAFSSLCYFTPILGAAIADSWLGKFKTIIYLSLVNVLGHVIKSLSAFPILGGKVVHTVLSLVGLCLIALGTGGIKPCVAAFGGDQFEEKHAEERTRYFSGFYLAINAGSLISTFITPMLRGDVQCFGEDCYALAFGVPGLLMVIALVVFAMGSKMYKKPPPEGNIVAQVVKCIWFAISNRFKNRSEDIPKRQHWLDWAAEKYPKQLIMDVKTLTRVLFLYIPLPMFWALLDQQGSRWTLQATKMNGNLGFFVLQPDQMQVLNPLLVLIFIPLFDLVIYRLISKCGINFTSLRKMAVGMVLACLAFAAAATVEIKINEMAPPQPGSQEILLQVLNLADDEVKLTVLGNNNNSLLADSIKSFQKTPHYSKIHLNTKSQDFYFHLKYHNLSIYTEHSVEERNWYSLIIREDGKSISSIMVKDMENETTYGMTAIRFINTLQENVNISLGTDISLNVGENYGVSAYRTVQRGEYPAVHCKTEDKDFSLNLGLLDFGASYLFVITNSTKQGLQAWKMEDIPANKVSIAWQLPQYALVTAGEVMFSVTGLEFSYSQAPSSMKSVLQAAWLLTVAIGNIIVLVVAQFSGLVQWAEFVLFSCLLLVVCLIFSIMGYYYIPIKSEDIQGPEDKQIPHMQGNMINLETKKTKL

SEQ ID NO: 7714 - protein, 246 aa, Allochromatium vinosum
MARIALVTGGIGGIGTSICTRLAKDGCTVVANCHPSEAAAAEEWKQARAAEGFDIAVFTADVSSFDDSARMVREITEQVGPIDILVNCAGITRDKTFKKMEQAHWEAVINVNLNSVFNVTRQVWDGMLERGFGRIINISSVNGQRGQFGQANYSAAKAGMHGFTMALAQEGASKGVTVNTISPGYVETAMTLAMNDDVRNSIISGIPMRRMAQPNEIAAAIAFLAGDESGYMTGANLPVNGGLFMH

SEQ ID NO: 7715 - protein, 834 aa, Staphylothermus marinus
MSNVPKEKRFIVWLDEVTKDDVVLVGGKNANLGEMIRAGIPVPPGFAVTAYAYKYFIEKTGLKDKIYPLLNSIDVNDKKVLDETTAKIRQWIMDTPMPPEVEEEIRKYYRELAKKIGMEPEKLRVAVRSSATAEDMPEASFAGQQDTYLNVYGEDNVVYYVKRCWASLFTSRAVFYRVAQGIPHEKSLMSVTVQKMVNSRTAGVMFTLHPVTGDEKVVVIEASWGLGESVVGGKVTPDEWVVDKQTLQIVDQKIHHKTLAIVFDPKKGKNVEIRWDENKQAWVSEEGPVDIEMVKHFHPDKPALKEEEVKRLAELALLIEKHYGRHMDIEWAVDYDIPFPDNVFIVQARLETVWSVRKEKEKAEKKAEIKGKNIVKLSEAKVLVRGLPASPGIGAGVAKVIFDPHSKEAQEFKEGEVLVTKMTDPDWVPLMKKAVAIVTDEGGMTSHAAIVSRELGIPAIVGTGNATQVIKSGIEVTVDGSRGVVYEGIVEDLVKPKEEVKAEVAGVGISPEQLLPLYPVTATKIYMNLGEPDAIEKYKDLPFDGIGLMRIEFIITDWVQYHPLYLIEQGKESLFIDKLAEGIAKVAQAIYPRPVVVRFSDFKTNEYRGLKGGEKYEPEERNPMIGWRGVSRYIHPKYEPAFRLEVRAIKKVREEMGLTNVWVMFPFVRTTWELERALKIMEEEGLKRGKDFKVWAMAEVPSIVLLADKFAEYVDGFSIGSNDLTQLILGADRDSNILAEMGYFDERDPAVLAGIKMIIEKAHSKGATVSICGQAPSVYPEIVEFLVEAGIDSISVNPDAVIATRRLVASIERKIMLKRLNKIMDKLNKLELGF

SEQ ID NO: 7716 - protein, 578 aa, Geobacillus stearothermophilus
MGNAIREKTIHGIAASSGIAIAKAYRLETPDLAAEKRTVADVEAEIARLEAAVAKAKEELEAIKQHALEKLGEDKAAIFAAHLLVLDDPELLNPIKEKIQTERVNAEYALDETALFFISMFEAMDNEYMKERAADIRDVTKRVLAHLLGVTISNPSLISEEVVIIAEDLTPSDTAQLNRQYVKGFATDIGGRTSHSAIMARSLEIPAVVGTKTVTAEVKNGDIVIVDGLDGQVIINPSPELLAQYEQKRARYEAQKAEWAKLVHEATVTADGIHVELAANIGTPDDVKGALANGAEGIGLYRTEFLYMGRSELPTEDEQFVAYKTVLEQMNGKPVVVRTLDIGGDKELPYLQLPKEMNPFLGFRAIRLCLEMQDMFRTQLRALLRASVYGNLKIMFPMIATLDEFRQAKAILLEEKEALLRQGVAVADGIEVGMMVEIPAAAVMADQFAKEVDFFSIGTNDLIQYTMAADRMNERVAYLYQPYNPAILRLISHVIDAAHREGKWVGMCGEMAGDPIAIPILLALGLDEFSMSATSILPARAQLKKLAKEEAARIKETVLSLGTAEEVVSFVKRTFSLA

SEQ ID NO: 7717 - protein, 573 aa, Mycoplasma capricolum
MSKQIKGIAASEGISLARALVIKETKLDIQKQLISDVDQEIIKLEQAIEKSIADLKKIQQITLKKLGEEKAAIFDAHQDIANDPAIKEEVVELIKKEKVNAEYALFTVSNNYFEMFSQLEDPYFKERSADIKDVSLRIISHILGLEIHDLSTIDKEVIIISDDLTPSQTAQLDKKFVKGFLTNVGGRTSHAAIMARSLEIPAILGLKNITELVKTDDLIALDGSSGIVELDLNDDDIKNYQTKVQQYIELKEQLKKFKDEPSLTKDKIKKLIEANIGSTNDVQSVLDSGAEGIGLFRTEFLYMDNDHFPTEEEQFEAYKKVVSQIKHLVVFRTLDIGGDKKLSYFKFDEEMNPFLGYRAIRFTLDRKDIFKDQIRALLRASAFGKLGIMFPMIATIDEFKQAKTFVEECKIELDKEGIKYDNQVQIGMMVEIPSAAILADQFAKYADFFSIGTNDLIQYSFASDRMNQNVSYLYQPLNPSLLRLIQLTISGAHKHNKWVGMCGEMAGDSKALPILLGLDLDAFSMSATSVLKARSLMSKIEFSKAKILANKVLECETNEQVNKLVEDFLNNLD

SEQ ID NO: 7718 - protein, 623 aa, Candida albicans
MVSSDFENEKQPDVVQVLTDEKNISLDDKYDYEDPKNYSTNYVDDYNPKGLRRPTPQESKSLRRVIGNIRYSTFMLCICEFAERASYYSTTGILTNYIQRRIDPDSPHGWGAPPPGSPDASAGALGKGLQAASALTNLLTFLAYVFPLIGGYLGDSTIGRWKAIQWGVFFGFVAHLFFIFASIPQAIENANAGLGLCVIAIITLSAGSGLMKPNLLPLVLDQYPEERDMVKVLPTGESIILDREKSLSRITNVFYLAINIGAFLQIATSYCERRVGFWLAFFVPMILYIIVPIFLFIVKPKLKIKPPQGQVMTNVVKILAVLFSGNFIKRLWNGTFWDHARPSHMEARGTIYYNSKKKSAITWSDQWILDIKQTFDSCKIFLYYIIFNLADSGLGSVETSLIGAMKLDGVPNDLFNNFNPLTIIILIPILEYGLYPLLNKFKIDFKPIWRICFGFVVCSFSQIAGFVLQKQVYEQSPCGYYATNCDSPAPITAWKASSLFILAAAGECWAYTTAYELAYTRSPPALKSLVYALFLVMSAFSAALSLAITPALKDPNLHWVFLAIGLAGFLCAIVMLAQFWNLDKWMENETNERERLDREEEEEANRGIHDVDHPIEAIVSIKS

SEQ ID NO: 7719 - protein, 404 aa, Spinacia oleracea
MESRVLSRTTAIAALPKLFRPSREAASFGFATGVKTPVGLVKDGGSLTWGRQLRPVLLLEPVQTGPVCSRREKTAVQPCRAASGSSGEAKTGFLEKYPALVTGSFFFMWYFLNVIFNILNKKIYNYFPYPYFVSVIHLFVGVVYCLASWSVGLPKRAPMDSKLLKLLIPVAVCHAIGHVTSNVSFAAVAVSFTHTIKALEPFFNAAASQFVLGQSIPITLWLSLAPVVIGVSMASLTELSFNWLGFISAMISNVSFTYRSLYSKKAMTDMDSTNIYAYISIIALFVCLPPAIIVEGPQLMKHGFNDAIAKVGLTKFISDLFWVGMFYHLYNQLATNTLERVAPLTHAVGNVLKRVFVIGFSIIAFGNKISTQTAIGTSIAIAGVALYSLIKAKMEEEKRQMKST

SEQ ID NO: 7720 - protein, 297 aa, Homo sapiens [sequence omitted]

SEQ ID NO: 7721 - protein, 88 aa, Dictyostelium discoideum
MRLLAKHKTSEFHSEIELIEFNNLDNSFIKFPLLVEKSITEGSYNKIIQSRSGVPSEYYQVFLDILADSIKQDIANCSEKSFKTLSLK

SEQ ID NO: 7722 - protein, 674 aa, Rhodobacter capsulatus
MAAKDIDDTKPDTAADEDASFDMSQAAVKRMIGEAKERGYITIDQLNAVMPPETVSGEQIEDVMSMLSEMGINVVEGEEVEESEGGEVVETGSGSREIAVAGAAGETLDRTDDPVRMYLREMGSVELLSREGEIAIAKRIEAGRNTMIAGLCESPLTFQAITIWRDELLSEEILLRDVIDLEATFGRSLDGDEGMEGMEGIEGPVVEGLDLETAEGAAPAARRPASDEPEYDADGNPISRIDEEEDDDDSSNMSLAAMEAALKPKVLETLELIARDYAKLAEMQDLRMSATLNEDGTFSVAEEAAYQKLRSEIVLLVNELHLHNNRIEALIDQLYGINRKIMSIDSGMVKLADAARINRREFIDEYRGYELDPTWMDRMSAKPARAWVTLFEKSRDKVEDLRHEMAQVGQYVGVDISEFRRIVNQVQKGEKEARQAKKEMVEANLRLVISIAKKYTNRGLQFLDLIQEGNIGLMKAVDKFEYRRGYKFSTYATWWIRQAITRSIADQARTIRIPVHMIETINKLVRTGRQMLHEIGREPTPEELAEKLQMPLEKVRKVMKIAKEPISLETPIGDEEDSQLGDFIEDKNAILPLDSAIQENLKETTTRVLASLTPREERVLRMRFGIGMNTDHTLEEVGQQFSVTRERIRQIEAKALRKLKHPSRSRKLRSFLDQ

SEQ ID NO: 7723 - protein, 215 aa, Serratia marcescens
  unsure (1)..(215): unsure at all Xaa locations
LQFLDLIQEGNIGLMKAVDKFEYRRGYKFSTYATWWIRQAITRSIADQARTIRIPVHMIETINKLNRISRQMLQEMGREPTPEELAERMLMPEDKIRKVLKIAKEPISMETPIGDDEDSHLGDFIEDTTLELPLDSATSESLRSATHDVLAGLTAREXKVLRMRFGIDMNTDHTLEEVGKQFDVTRERIRQIEAKALRKLRHPSRSEVLRSFLDD

SEQ ID NO: 7724 - protein, 389 aa, Chlamydomonas reinhardtii
MAAMMMRQKVAGAIAGERRSAVAPKMGRAATAPVVVASANASAFKGAAVTARVKASTRAARVQSRRTAVLTQAKIGDSLAEFLVEATPDPKLRHVMMSMAEATRTIAHKVRTASCAGTACVNSFGDEQLAVDMVADKLLFEALKYSHVCKLACSEEVPEPVDMGGEGFCVAFDPLDGSSSSDTNFAVGTIFGVWPGDKLTNITGREQVAAGMGIYGPRTVFCIALKDAPGCHEFLLMDDGKWMHVKETTHIGEGKMFAPGNLRATFDNPAYERLINFYLGEKYTLRYTGGIVPDLFQIIVKEKGVFTNLTSPTTKAKLRILFEVAPLALLIEKAGGASSCDGKAVSALDIPILVCDQRTQICYGSIGEVRRFEEYMYGTSPRFSEKVVA

SEQ ID NO: 7725 - protein, 393 aa, Triticum aestivum
METVAAAGYAHGAATRSPACCAAMSFSQSYRPKAARPATSFYGESLRANTARTSFPAGRQSKAASRAALTTRCAIGDSLEEFLTKATPDKNLIRLLICMGEAMRTIAFKVRTASCGGTACVNSFGDEQLAVDMLADKLLFEALEYSHVCKYACSEEVPELQDMGGPVEGGFSVAFDPLDGSSIVDTNFTVGTIFGVWPGDKLTGVTGGDQVAAAMGIYGPRTTFVVALKDCPGTHEFLLLDEGKWQHVKDTTSIGEGKMFSPGNLRATFDNPDYDKLVNYYVKEKYTLRYTGGMVPDVNQIIVKEKGIFTNVTSPTAKAKLRLLFEVAPLGFLIEKAGGHSSDGKQSVLDKVISVLDERTQVAYGSKNEIIRFEETLYGSSRLAASATVGATA

SEQ ID NO: 7726 - protein, 426 aa, Phalaenopsis sp. SM9108
MAFSVGLTRFIVSSHPKTAKEILSSPAFADRPIKESAYELLFNRAMGFAPFGDYWRNLRRISSTYLFSPRRVSSFEKQRSEIGEGMVRDMKRMMERNGVVEVRRMLHYGSLNNIMLTVFGKKFDFAKDEGLELELILKEGYELLGIFNWGDHLPLLGWLDLQGVRRRCRTLVAKVNVFVKKIIDEHKRRANGVGIDEGEGEDFVDVLLGLEEKDRLSESDMVAVLWEMIFRGTDTVAILLEWTLARMVLHPDIQSKAQVEIDSVVDSSRPVLDSDIQRLPYLQSIVKETLRMHPPGPLLSWARLAIHDVPVDGHMIPAGTTAMVNMWAITHDECNWAEPNKFNPDRFIDEDVNILGSDLRLAPFGSGKRVCPGKTMALAAVHLWLAQLLKSFKLLPSRNGVDLSECLKMSLEMKNPLVCVAVPRFE

SEQ ID NO: 7727 - protein, 108 aa, Phalaenopsis sp. SM9108
MESRMIRYMIWDGLAGDVIELPGVKGKFLSMILDFCKKRVAWAAGGDGTLEGLKSDFVNVDLGTLIHLGAASFYLKTNDLVDLTSQTLANRIQGKTIEEVCRALNPEE

SEQ ID NO: 7728 - protein, 265 aa, Nicotiana tabacum
AHGGVYAHPGVPIGSHPPGHGMATSPAVSQAMDGASLSLDASAKSSENSDRGLLAMSLGNGSADNIEGGADHGNSQSGDTEDSTDGSDTNGAGVSERSKKRSRETTPDNSGDSKSHLRRCQPTGEINDDSEKAIVAVRPGKVGEKVMGTVLSPSMTTTLEMRNPASTHLKASPTNVSQLSPALPNEAWLQNERELKREKRKQSNRESARRSRLRKQAEAEELAIRVQSLTAENMTLKSEINKLMENSEKLKLENAALMERLKMNS

SEQ ID NO: 7729 - protein, 506 aa, Rhodococcus erythropolis
MTKYARPGTADAIMSFQSRYDNWIGNEWVAPVKGQYFENPTPVTGQNFCDVARSTAEDIELALDAAHAAAPAWGKTSVAERAIILNKIADRMEENLESIALAESWDNGKPIRETLNADIPLAIDHFRYFAGAIRAQEGSLSEINSDTVAYHFHEPLGVVGQIIPWNFPILMAVWKLAPALAAGNAIVLKPAEQTPVSILHLIGIIGDLLPAGVLNIVNGFGVEAGKPLASSPRIKKIAFTGETTTGRLIMQYASQNLIPVTLELGGKSPNVFFSDVLASNDDYQDKALEGFTMFALNQGEVCTAPSRALIQEDIFDEFLAMAAIRTKAVRQGDPLDTDTMIGAQASNDQLEKILSYIEIGKAEGAKVITGGERAELGGDLSGGYYVQPTVFTGNNKMRIFQEIFGPVVSVTSFKDYDEAIEIANDTLYGLGAGVWSRDGGVAYRAGRDIQAGRVWTNTYHQYPAHAAFGGYKQSGIGRENHLMMLSHYQQTKNLLVSYAQKAQGFF

SEQ ID NO: 7730 - protein, 180 aa, Oryza sativa (japonica cultivar-group); identical to SEQ ID NO: 1071

SEQ ID NO: 7731 - protein, 368 aa, Oryza sativa (japonica cultivar-group)
MRGPLLLRAVVVVAMEHFNDWDLQAVVRSCSFPQSEPPRVGVGVPAAPGAGGAPVVVAPPARAPDGPDQMARASASALYDLEYLDLDHKPFLLPGSSSSSSSSRAVARARGEDDGKGRHEVMISFPAAAAASTSGAQPRSPSGRKPGIRTPRPKRRKFSAYFEVIDYCDFHGVRSSKKSQLKKVVYEVPVADGGVSSDLWAWRKYGQKPIKGSPYPRGYYKCSSMKGCMARKMVERSPAKPGMLVVTYMAEHCHPVPTQLNALAGTTRHKSAPTGDDDKPTSPGPAAGRAAAGEGVVKCEDVDGNELSAMAADGGAEDTAAAADDDGELWPEGMGLELDEFLGPMDDDVFEFDHVLEDDGVLGRRLSL

SEQ ID NO: 7732 - protein, 348 aa, Oryza sativa (japonica cultivar-group)
MDGLHTELALGLIGCCGGDGQQQTAPFVAKTYQMVCDPRTDALVRWGRDNNSFVVVDPAAFSQLLLPCFFKHGNFSSFVRQLNTYVSIIQSPAPGFRKVHPDRWEFAHESFLRGQTHLLPRIVRRKKRGEGGGGGGGASCSFGGGAGEHQVAAAAASVGMSGEEEDAAEDVLAKEAALFEEVQRLRHEQTAIGEELARMSQRLQATERRPDQLMSFLAKLADDPNAVTGHLLEQAAERKRRRQHLPSHEPTVCPLPPAPPPQPPQPLLALAGAAAMDGTYWWTTEHHHHHHHQMKPMTVLPSLEPPTASCGVHQVPELGGGGVMGLTTDGEAKVEPPFPFCLLGQAFF

SEQ ID NO: 7733 - protein, 4133 aa, Gallus gallus
MAGGVQECLQELHGCLQPGDAMRGYGLLRGLGEACLTCLAGGALALHVSLVFAPERGLLAFVCRSLGVEEFRECREEALKFLCVFLERIGERAHPYACSLKQTCISVYTKERAAKCKIPALELLIKLLQSLRRSCLMEEMKVGEIFNKFYGELAVRSKISDTVLEKIYELLGVLGEVHPADMINNSEKLFRAYLGELKTQMTSATRVPKLPIVAGCLRGLTALMYNFTKSVDEDAQTSKEIFDFAVKAIRPQVDQKRYAVHLAGLQLFSWHAAQFGTLLLDSYVMLFETMCRWCGHTNQELKKAGHNALDSFLKQMSLMVAKDAELHKSKLKFFMEQFYGIIRRMDSSNKELSIAIRGYGLFAAPCKAMHPADVDAMYIELLQRCKQMYLTEAETIDDHLYQLPSFLQSIASVIFHLDTIPEVYTPVLEHLVVLQINSFPRYSEKMQLVCCRSIIKVFLALSIKGPVLWNFISTVVHQGLIRVFSKPMKFSKDVFGKETSGSEEFPESGEVDTARWKVPTYKDYLYLFRSLLSCDTMKESIFEEENFLTGNSPLQSLNRLLYDELIKSILKIIEKLDLTVQKLNVHEQDENETDSAFIGPTSDPASNLQPKKPTDFIAFINLVEFCRDILPDKHVEYFQPWVYSFGYELIIHSTRLPLISGFYKLLSVTMKIAKKIKYFEGVGPKSLRKATEDPEKSSCFALFAKFGKEVTAKMKQYKDELLASCLNFLLSLPHDIVMLDIKAYIPALQNAFKLGLSCTPMADLGLDALEDWSAHIPRHIMQPYYKDVLPLLDGYLKNSATTVEPQNNWEVRKLSRAAQKGFNKIVIQRLRKAKTSSLDDNPSLEAVRTRVARLLGSLGGQINHNLITATSAEEMMKKCVSWDTKNHLSFAVPFADMKPVIYLDVFLPRVTDLALSASDRQTKIAACELLHSIVAYMLGKASQMPERQQGPPPMHQLYKRIFPVLLRLACDVDQVTRQLYEPLVMQLIHWFTNNKKFESQDTVTFLEAILSGIVDPVDSTLRDFCGQCVREFLKWSIKQTTPKQQEKSPANTKSLFKRLYSLALHPSAFKRLGAALAFNSIYREFREENSLVEQFVFEALVVFLESLALTHTDEKSLGTTQQCCDAINHLKRIIKHKAPALNKEGKRRVPRGFPATKSVCLQDVVMWLLVQCGRPQTECRHKAMELFYEFVPLLPGNILHLLGADVLKKRDVSFLINKFEGGGSDAKSPSGILSQPTLRDMQEPFSLLTVMRWMDMFLAALDCYNTFFELRMIKPHEILGVNERSSFLEAVDFFLETIALHDIHAAEQCFDCRSRGNIFSPQEREVYNYSKCTIIVRIMEFVTMILEICQQDFWKLLEKELLNANFIELLVMTVCDPSHIGFNTADVQVMKNLPDISVRLLKALMKSPYKEYLQLCLKKRITPQSFEDLCSVDLFNSDARFDQVRFSAVLSACKQLQKSGLLHSVLHSQDERPHPSIGSKLLSVVYKSIAPGSERSSLPAVDISSKRLADRLLQLAFAIDDQCEELVSLLLNTVVLSVPLSKASERNFVDFSHGQYFYSLFSDTINQQLLKNLDVIVIHLMESSVSNPQMVGSILNGMLDQSFRERTIRKQQGVKLVTAVLRNWKRLDSWWAKDSSPESKMAVLTLLAKVLQIDSSVSFNTSHEAFTAVFDTYTSLLTDQNLGLNLKGHAVIILPFFTNLSGEKLHDLKNALDQLVAFNFPMSSDEFPKGTLKHNNYVDCTKKFLDALELSQSPMLLQLMTEVLCRDHRHSMEDLFQASFKRISRRSSTDKQVVLLDTVHKMFQNEDLLSNIVRQAFVDRSLLTLMSHCSLDALREFFCKIIVQAMDTLNSRFTKSNECVFDTQITKKMGYYKMLEVMYIRLSKDDVHSKDSKINQAYRGSVSVEGNELTKALIKLCYDAFTENMAGENQLLEKRRQYHCAAYNCAIAVISCVFTESKFYQGFLFTEKSEKNLLIFENLIDLKRQYVFPVEIEVPLERKKRYIAIRKEAREAWNDGQDEPKYLASASYMMDSSLSEEMSQFDFSTGVQGFSYSSQDVTASSAHFRRKETSEYMVLNDEMELEMDELNQHECMAPLTTLIKHMQRNQITPKVEEGVIPVDLPLWMKFLHSKLGNPSVPLNIRLFIAKLIVNTEDVFRPYAKQWLGPMLQLVVSGDNGGEGIHYMVVEIAVTVLSWTSVTTPKGNIKDEILANRLLEFLMKNAFHQKRAVFRHNLEIIKTVIECWKNCLSIPYSLIFEKFSSGDPDTKDNSVGIQLLGIVLANNLPPFDLKCEIDRVRYFQALVSNMGLLRYKEVYAAAAEVLGLALQYIAERQNILEDPVYDCVIKQLKRHQNTQQDKFIICLNKVVKNFPPLADRFMNAVFFLIPKLHGVMKNYCLEVIMCRAEEIPDLYLQLKSKDFIQIMKHRDDERQRVCLDIIYKMLSTLKPPELKELLPGVTGFISHPSVICRQRMYDILMWIYDNYSDPESQADGDSQEVLSLAKEILLQGLIDENAELQLIVRNFWSDETRLPANILDRMLMLLNSLYSAKIETQYLSLITNFLLEMTSKSPDYSRKIFEHPLSECKFHDFVIDSSWRYRSTMLTPMFVETQASQSTNRNSSQERSLSISGSVGGRVRATQRQYEFTPTQNVSGRSSFNWLTGNSIDTLAEYTVPSSSESLSSSMLLVNKRSEKFKQAAFKPVGPDFGKKRLSLPGDKVDSKTKGIDERAEILRLRRRFLKDQEKVSLIYARKGVAEQKREKEMKSELKMKFDGQVTLYRSYRVGDLPDIQIEHCSLIAPLQGLAQKDPTFAKQLFSSLFGGIFCEVKKSKIPSEKKAIIQKLLKDFNHFLSTSVSYFPPFIACIQEISYKHRELLELDSANVSTSCLASLQQPVGILLLEHALMALSPAEEPPSKRMRGRTELPPDVVKWLELAKLYRSLGDYDVLRGIFSGKIGTKDITQQALLAEARSDYAEAAKCYDEALSKEDWEDGEPTEAEKDFWELASLECYDHLTEWKSLEYCATVNIDSGKPPDLNKTWSDPFYQETYLPYIIRSKLKLLLNGENDQTLLTFIDEAMKTEQKKALIEMHYSQELSLLYILQDDFDRAKYYIGNGIQIFMQSYSSIDTLLYQSRMSKLQSVQALTEIQDFINFMTKTSNIASQAKSLKRLLRTWTSRYPDAKMDPMNIWDDIITNRCFFLDKLQEKFLCDKANDSMEVDEESSVGDQMEVDQQDEDIHSMIRSCKFNMKLKMIESARKQNSFSIAKKLLKGLRREAKTREDWLVRWNYAYCRFVHSCSQSQSCPERVLSVLKTISLLEDTKSDYLNKNIMAFRNQNLLLGTTYHIMANALSQDPKCCEQIEEEKTGKILELSGESSESPEKILAGLNKRAFQCFSSAARKSEEEVQSLSMEHVDVKGVIDAYMTLVGFCDQHLRKEEEGSLEINAADLQLFPAIVVEKMIKALKLNSREARLRFPRLLQIIERYPAETLGLVTRELPSVPCWQFIGWISQMMALLDKDEAVAVQHTVEEIVDTYPQAIIYPFTISSESYCFKDTAAGCRNKEFVASIKNKLDRGGVVQDFIHALEQLSNPVMLFKDWVADVRNELVKTQRNKIILKEMYEGMYKNLGDVKAPGLGWLRKRFVQAFGKDFDSHFGKGGSKLLDMKISDFNEITTALLTKMNKTHKEPGNLKECSPWMSEFRAEFLRNELEVPGQYDGKGKPLPEYHVKISGFDERIMVLESLRKPKRITIRGSDEQEHPFLVKGGEDLRQDQRIEQLFDVMNIVLSRDAACSQRNMQLKTYQVIPMTTRLGLIKWLENTCTLKEFLRNSMTEEEDANYNSLKGPRAAYSDWLSKMGGKAQGLSRYNAMYKNASRTETVIAFKSRESSVPEDLLRRAFVKMSTSPEAFLALRSHFVSSHALMCVSHWILGIGDRHLSNFMINKETGGMVGIDFGHAFGSATQFLPVPELMPFRLTRQFVNLMMPVKEWGLIYSVMVHALRAYRADPDLLISTMDVFVKEPSLDWKNFEQRQLKKGGTWIKEINTAEVNWYPLQKVSYVKRKLTGANPARITCDELRLGYEKLPFYNDFAAVARGSADHNIRAKEPEDRLSEETQVRCLIDQATDPNLLGRVWEGWEPWM

SEQ ID NO: 7734 - protein, 166 aa, Xenopus laevis
MSDEGKLFIGGLNFDTNEESLEQVFSKYGQISEVVVVKDRETKRSRGFGFVTFENPDDAKDAMMAMNGKAVDGRQIRVDQAGKSSGDRRGGYRGGSSGGRGFFRGGRGRGGGDRGYGSSRFDNRSGGYGGSSGSRDYYSSGRSQGSYGDRAGGSYRDSYDSYATHE

SEQ ID NO: 7735 - protein, 669 aa, Haemophilus influenzae
MTKRTSFNPLVIGVTLFFILLLMAMIFIAPEQTQALLNQAKSGIFANFSWFYVLTFSVFLGFLLILSVSSLGNIKLGQDEEEPEFSFLSWLAMLFAAGMGVGLMFFGVAEPLTHYLSDITAGSAEHKQQEALLHTLFHWGIHAWAVYGTIALALAYFGFRYKLPLALRSCFYPLLKDRINGKIGDAIDVMALLATLFGIITTLGFGSSQLGAGLEQIGWISQNSFALQVGVIVVVMCLAVFSAISGVGKGVKILSEINLTLAFCLLLFVLISGPTLYLLSAFSDNIGNYFSNLVQLSFKTYAYEQEHTSWFSGWTVLYWAWWCSWAPFVGLFIARISKGRTIREFIFGVLVIPSLFGILWFTVFGNTAVWLNDGIAAGGLGEFISSPEILLFKFLNYLPLPTITGFVSLLVILLFFITSADSGIYVLNNIASRDKSLASPAWQAIMWGTLMSVVAIVLMQSGGLANLQTMTLIVALPFALLMLVMCFSLWKGLIADKKYFSTKVNPTSIFWSGDKWKSHLEQMMNQTQEKDILRFLKNTALPAMRELRQELTGKYNLSVEINTLFEQEEPALELVIHKESMRDFMYGIKSVGREVSEQLINDENLPHIQHSATYEPYTYFFDGRVGYDVQYMDQDELIADMLKQYERYLSLLDDVGQELMAHEQTELAE

SEQ ID NO: 7736 - protein, 112 aa, Azoarcus sp. BH72
MKLITAIIRPFKLDEVREALAHVGVTGLTVTEIKGFGRQKGHAELYRGAEYVVDFVPKVKLETVVADERLEATLEAIQAAAHTGKIGDGKMFVTTVDQTIRIRTGESGADAL

SEQ ID NO: 7737 - protein, 112 aa, Azoarcus sp. BH72
MKFITAIIKPFKLDEVREALSAIGVQGITVTEVKGFGRQKGHTELYRGAEYVVDFLPKVKIEAAIRDELLDQAIEAIEKSASTGKIGDGKIFVFDLEQAIRIRTGETGADAL

SEQ ID NO: 7738 - protein, 112 aa, Azoarcus sp. BH72
MKKIEAIIKPFKLDEVREALSEVGIAGLTVTEVKGFGRQKGHTELYRGAEYVVDFLPKIKVEVVVADDMVEQTMDAVIKAAQTGKIGDGKIFVTPVEQVVRIRTGETNEAAI

SEQ ID NO: 7739 - protein, 502 aa, Arabidopsis thaliana
MATAAVIGLNTGKRLLSSSFYHSDVTEKFLSVNDHCSSQYHIASTKSGITAKKASNYSPSFPSSNRHTQSAKALKESVDVASTEKPWLPNGTDKELEEECYDDDDLISHSVEAILLLQKSMLEKSWNLSFEKAVSSEYPGKGTIRKKKIPVITCSGISARQRRIGAKKKTNMTHVKAVSDVSSGKQVRGYVKGVISEDVLSHVEVVRLSKKIKSGLRLDDHKSRLKDRLGCEPSDEQLAVSLKISRAELQAWLMECHLAREKLAMSNVRLVMSIAQRYNNLGAEMSDLVQGGLIGLLRGIEKFDSSKGFRISTYVYWWIRQGVSRALVDNSRTLRLPTHLHERLGLIRNAKLRLQEKGITPSIDRIAESLNMSQKKVRNATEAVSKVFSLDRDAFPSLNGLPGETHHSYIADTRLENNPWHGYDDLALKEEVSKLISATLGEREKEIIRLYYGLDKECLTWEDISKRIGLSRERVRQVGLVALEKLKHAARKRKMEAMILKN

SEQ ID NO: 7740 - protein, 313 aa, Pyrus communis
MATFPVVDLSLVNGEERVATLEKINDACENWGFFELVNHGMSTELLDTVEKMTKDHYKKTMEQRFKEMVAAKGLDAVQSDIHDLDWESTFFLRHLPSNISEVPDLEEDYRKTMKEFAVELEKLAEKLLDLLCENLGLEKGYLKKVFYGSKGPNFGTKVSNYPPCPKPDLIKGLRAHSDAGGIILLFQDDKVSGLQLLKDGDWVDVPPMHHSIVINLGDQIEVITNGKYKSVMHRVIAQSDRDRMSIASFYNPGDDAFISPAPAVLEKKTEDAPTYPKFVFDDYMKLYSGLKFQAKEPRFEAMKAKESTLVATT

SEQ ID NO: 7741 - protein, 1169 aa, Homo sapiens [sequence omitted]

SEQ ID NO: 7742 - protein, 359 aa, Homo sapiens [sequence omitted]

SEQ ID NO: 7743 - protein, 378 aa, Enterobacter aerogenes
MSLSIADQNKLDAFWSYCVKNRYFNIGYPESADFDYTMLERFLRFSINNCGDWGEYCNYLLNSFDFEKEVMEYFSGIFKIPFAESWGYVTNGGTESNMFGCYLGRELFPEGTLYYSKDTHYSVAKIVKLLRIKSQLVESQPDGEMDYDDLINKIRTSGERHPIIFANIGTTVRGAVDNIAEIQKRIAALGIPREDYYLHADAALSGMILPFVEDPQPFTFADGIDSIGVSGHKMIGSPIPCGIVVAKKANVDRISVEIDYISAHDKTISGSRNGHTPLMMWAAVRSHTDAEWHRRIGHSLNMAKYAVDRFKAAGIDALCHKNSITVVFPKPSEWVWKKHCLATSGNVAHLITTAHHLDSSRIDALIDDVIADLAQRAA

SEQ ID NO: 7744 - protein, 378 aa, Morganella morganii
MTLSINDQNKLDAFWAYCVKNQYFNIGYPESADFDYTNLERFLRFSINNCGDWGEYCNYLLNSFDFEKEVMEYFADLFKIPFEQSWGYVTNGGTEGNMFGCYLGREIFPDGTLYYSKDTHYSVAKIVKLLRIKSQVVESQPNGEIDYDDLMKKIADDKEAHPIIFANIGTTVRGAIDDIAEIQKRLKAAGIKREDYYLHADAALSGMILPFVDDAQPFTFADGIDSIGVSGHKMIGSPIPCGIVVAKKENVDRISVEIDYISAHDKTITGSRNGHTPLMLWEAIRSHSTEEWKRRITRSLDMAQYAVDRMQKAGINAWRNKNSITVVFPCPSERVWREHCLATSGDVAHLITTAHHLDTVQIDKLIDDVIADFNLHAA

SEQ ID NO: 7745 - protein, 450 aa, Gallus gallus
FTFLDEGFTAKDILDQKINEVSSSDDKDAFYVADLGDIVKKHMRWHKALPRVTPFYAVKCNDSEAVVKTLAVLGAGFDCASKTEIQLVQSIGVPPERIIYANPCKQLSQIKHAANSGVRMMTFDSEVELMKIARPHPKAKLLLRITTDDSKAVCRLSVKFGATLKTSRLLLERAKELDLAIVGVSFHVGSGCTDPETFVQAISDARCVFDMGAELGFNMYLLDIGGGFPGSEDVKLKFEEITSVINPALDKYFPLDSEVTIIAEPGRYYVASAFTLAVNIIAKKIVSKEQTGSDDEDDVNDKTLMYYVNDGVYGSFNCILYDHAHVKPVLQKRPKPDDGCYSCSIWGPTCDGLDRIVERCNMPELQVGDWILFENMGAYTVAAASTFNGFQRPTIHYVMSRPAWQLMQQIKEQEFLAEVEEQDVASLPLSCACESGIEYPATCASASINV

SEQ ID NO: 7746 - protein, 707 aa, Leishmania donovani
MGDHDVALCHVSRYNHANYWAFVPLPTVSDDTGCDSLHHDSASERIRMAPPASASKAGAAEERLHPYERRLLDQYQIHLQPANRNPLSRADSAAGREETAQTPAQVQMVPVVAVADSTSDQHASVASSQDLVDLFFLEGSQAVDGLCFSPYPIYGWRTAEERRAAVCEVFKTYNVVTRLPASPAALAAAQRRYSRHRHSAIAPINKSAIETREQYWRRLSNLYTQKGVKDAASAADAAATTATNGAVPAAPAYEPEDPFYIIDLGRVVEQMARWRHELPMVRPYFAVKSNPQPAVLEVLSALGAGFDCASKEEIHMVLGRQLVASPDDIIFANPCKQLGDLREAQACGVTYVTVDNPLEMEKISRLMPSAHAIIRIKTNDSKAQCSFSTKFGAPLEDVEGLLEAARQFNVTVCGVSFHVGSGNDDQSAYVSAVRDAYQVFQQAVQYGFKCTILDIGGGFPGTEVVEGSGNTSFEAIARTIRPVLAELFGGGDVTIISEPGRYFTAASHALLMNVFASRTLRLSDVEVSRQAFQSVVSMDEPEEYQYYVNDGLYHSFNCILFDHAHPTLLLLNDGDGADGVESGTEAAAVCSEEEGETSLSGPLANDPLFMSAWDRRRSFARRPLRITTIFGPTCDSMDCILKKQPFPEMKLGDWLLVPDMGSYTTAAAGFFNGFATRRLEWVSSVDLCARPRPVYTREGNTLRCVSE

SEQ ID NO: 7747 - protein, 461 aa, Mus pahari
MSSFTKEEFDCHILDEGFTAKDILDQKINEVSSSDDKDAFYVADLGDILKKHLRWLKALPRVTPFYAVKCNDSRAIVSTLAATGTGFDCASKTEIQLVQGLGVPPERIIYANPCKQVSQIKYAASSGVQMMTFDSEIELMKVARAHPKAKLVLRIATDDSKAVCRLSVKFGATLKTSRLLLERAKELNIDVIGVSFHVGSGCTDPETFVQAVSDARCVFDMGTEVGFSMYLLDIGGGFPGSEDTKLKFEEITSVINPALDKYFPSDSGVRIIAEPGRYYVASAFTLAVNIIAKKTVWKEQPGSDDEDESNEQTFMYYVNDGVYGSFNCILYDHAHVKALLQKRPKPDEKYYSSSIWGPTCDGLDRIVERCNLPEMHVGDWMLFENMGAYTVAAASTFNGFQRPNIYYVMSRPMWQLMKRIQSHGFPPEVEEQDDGTLPMSCAQESGMDHHSAACASARINV

SEQ ID NO: 7748 - protein, 460 aa, Xenopus laevis
MNSFSNDDFDFSFLEEGFSARDIVEQKINEVSLSDDKDAFYVADFGDIVKKHVRWFKALPRVTPFYAVKCNDGKAIVKTLSILGAGFDCASKTEIQLVQSIGVSPERIIYANPCKQVSQIKYAASCGVEKMTFDSEVELMKVARNHPNAKLVLRIATDDSKAVCRLSVKFGATLKTSRLLLERAKELNVDIIGVSFHVGSGCTDPQTYVQAVSDARCVFDMGAELGFNMHLLDIGGGFPGSEDVKLKFEEITSVINPALDKYFPADSGVKIIAEPGRYYVASSFTLAVNIIAKKVMVNEQSGSDDEEDAANDKTLMYYVNDGVYGSFNCILFDHAHVKPVLTKKPKPDEKFYSSSIWGPTCDGLDRIVERFELPELQVGDWMLFENMGAYTVAAASTFNGFQRPTLYYVMSRPHWQLMHDIKEHGILPEVPDLSALHVSCAQESGMELAPAVCTAASINV

SEQ ID NO: 7749 - protein, 430 aa, Nicotiana alata
MAVIISVKVLLIQLFVLVLGSFSKLSHGYYQAQPFLTLPLPFDLPPAKIPLLPIRGVPSISLVPPPPPPPSPRSPPPPSPSPPPPSPSPPPPTPSPPPPSTLIPFIPPFTGGLLPPLPGSMLPGLLPLIPNLPDVPPIGGGPPVNRPKPSAPSPPVKPPPPPPSPCKPSPPDQSAKQPPPAKQPPPPPPPPPVKAPSPSPAKQSPPPPRAPSPSPATQPPTKQPPPPPRAKKSPPPPPPPPVAYPPVMAPSPSPAAEPPIVAPFPSPTANPPHVPRRPAPPVVKPLPPLGKPPIVNGLVYCKSCNSYGVPTLLNASLLQGAVVKLICYGKKAMVQWATTDNKGEFRIMPKSLTTTDVGKCKVYLVKSPNPNCNVPTNFNGGKSGGLLKPLLPPKQPITPAVVPVQPPMSDLYGVGPFIFEASSKMPCAKN

SEQ ID NO: 7750 - protein, 227 aa, Antirrhinum majus
MARGKIQIKRIENQTNRQVTYSKRRNGLFKKAHELSVLCDAKVSIIMISSTQKLHEYISPTTATKQLFDQYQKAVGVDLWSSHYEKMQEHLKKLNEVNRNLRREIRQRMGESLNDLGYEQIVNLIEDMDNSLKLIRERKYKVISNQIDTSKKKVRNVEEIHRNLVLEFDARREDPHFGLVDNEGDYNSVLGFPNGGPRIIALRLPTNHHPTLHSGGGSDLTTFALLE

SEQ ID NO: 7751 - protein, 295 aa, Caulobacter vibrioides
MAVNSLSVMSPDGGLSRYLTEIRKFPMLSKDEEFMLAQRWKEHQDPQAAHKMVTSHLRLVAKIAMGYRGYGLPIGEVISEGNVGLMQAVKKFEPEKGFRLATYAMWWIRASIQEYILRSWSLVKMGTTAAQKKLFFNLRKAKSQIAAFQEGDLHPDQVSQIATKLGVLDSEVISMNRRLSGPDASLNAPLRRDGESEWQDWLADEEQVSQETRVAEDEEKSLRMSLLEEAMVELTDRERHILTERRLKDDPTTLEELAAQYGVSRERVRQIEVRAFEKLQKTMREAAIAKNMVDA

SEQ ID NO: 7752 - protein, 500 aa, Beta vulgaris
MSMPIPSRQLFIDGEWREPIKKNRIPIINPSNEEIIGDIPAGSSEDIEVAVAAARRALKRNKGREWAATSGAHRARYLRAIAAKVTERKDHFVKLETIDSGKPFDEAVLDIDDVATCFEYFAGQAEAMDAKQKAPVTLPMERFKSHVLRQPIGVVGLITPWNYPLLMATWKIAPALAAGCTAVLKPSELASITCLEFGEVCNEVGLPPGVLNIVTGLGPDAGAPLAAHPDVDKVAFTGSSATGSKVMASAAQLVKPVTLELGGKSPIIVFEDVDIDQVVEWTMFGCFWTNGQICSATSRLLVHESIAAEFIDRLVKWTKNIKISDPFEEGCRLGPVISKGQYDKIMKFISTAKSEGATILCGGSRPEHLKKGYFIEPTIISDISTSMQIWREEVFGPVLCVKTFSSEDEALELANDTEYGLASAVFSKDLERCERVSKLLESGAVWVNCSQPCFVHAPWGGIKRSGFGRELGEWGIENYLNIKQVTSDISNEPWGWYKSP

SEQ ID NO: 7753 - protein, 497 aa, Spinacia oleracea
MAFPIPARQLFIDGEWREPIKKNRIPVINPSTEEIIGDIPAATAEDVEVAVVAARRAFRRNNWSATSGAHRATYLRAIAAKITEKKDHFVKLETIDSGKPFDEAVLDIDDVASCFEYFAGQAEALDGKQKAPVTLPMERFKSHVLRQPLGVVGLISPWNYPLLMATWKIAPALAAGCTAVLKPSELASVTCLEFGEVCNEVGLPPGVLNILTGLGPDAGAPLVSHPDVDKIAFTGSSATGSKVMASAAQLVKPVTLELGGKSPIVVFEDVDIDKVVEWTIFGCFWTNGQICSATSRLLVHESIAAEFVDKLVKWTKNIKISDPFEEGCRLGPVISKGQYDKIMKFISTAKSEGATILYGGSRPEHLKKGYYIEPTIVTDISTSMQIWKEEVFGPVLCVKTFSSEDEAIALANDTEYGLAAAVFSNDLERCERITKALEVGAVWVNCSQPCFVQAPWGGIKRSGFGRELGEWGIQNYLNIKQVTQDISDEPWGWYKSP

SEQ ID NO: 7754 - protein, 506 aa, Vibrio cholerae
MIYPIPNSETSTVHFKDVYDNYIGGQWMKPHSGEYFSNTSPVNGLVFCRVARSSSQDVELALDAAHNALESWSTTSAVERSNILLRIADRIESNLETLAIVESWDNGKPIRETLAADLPLTIDHFRYFAACIRSQEGAASELDSRTLTYHLPEPIGVVGQIIPWNFPLLMAAWKLAPALAAGCTVVLKPAEQTPVSILFLMEIIGDLIPAGVINVVNGFGSEAGNALATSQRIDKLAFTGSTEIGNHILKCAADNLIPSTIELGGKSPNIYFPDIFSHEDQYLDKCIEGALLAFFNQGEVCTCPSRILVHESIYEKFIAKIIERVALIKQGNPLDTETQIGAQVSKEQYDKILGYIQIGKDEGAELIFGGHPNNQENYLSGGYYIKPTLFFGHNQMHIFQEEIFGPVIAITKFKDEIEALHLANDTVYGLGAGVWTRDINIAHRMAKNIKAGRVWVNCYHAYPAHAAFGGYKKSGIGRETHKLTLSHYQNIKNVLISHEIHPLGLF

SEQ ID NO: 7755 - protein, 261 aa, Bacillus megaterium
MYTDLKDKVVVITGGSTGLGRAMAVRFGQEEAKVVINYYNNEEEALDAKKEVEEAGGQAIIVQGDVTKEEDVVNLVQTAIKEFGTLDVMINNAGVENPVPSHELSLDNWNKVIDTNLTGAFLGSREAIKYFVENDIKGNVINMSSVHEMIPWPLFVHYAASKGGMKLMTETLALEYAPKGIRVNNIGPGAMNTPINAEKFADPEQRADVESMIPMGYIGKPEEVAAVAAFLASSQASYVTGITLFADGGMTKYPSFQAGRG

SEQ ID NO: 7756 - protein, 262 aa, Bacillus megaterium
MYKDLEGKVVVITGSSTGLGKSMAIRFATEKAKVVVNYRSKEDEANSVLEEEIKKVGGEAIAVKGDVTVESDVINLVQSAIKEFGKLDVMINNAGMENPVSSHEMSLSDWNKVIDTNLTGAFLGSREAIKYFVENDIKGTVINMSSVHEWKIPWPLFVHYAASKGGMKLMTETLALEYAPKGIRVNNIGPGAINTPINAEKFADPEQRADVESMIPMGYIGEPEEIAAVAWLASSEASYVTGITLFADGGMTQYPSFQAGRG

SEQ ID NO: 7757 - protein, 272 aa, Streptomyces violaceoruber
MTTATATATATPGTAAKPVALVTGATSGIGLAIARRLAALGARTFLCARDEERLAQTVKELRGEGFDVDGTVCDVADPAQIRAYVAAAVQRYGTVDILVNNAGRSGGGATAEIADELWLDVITTNLTSVFLMTKEVLNAGGMLAKKRGRIINIASTGGKQGVVHAVPYSASKHGVVGLTKALGLELARTGITVNAVCPGFVETPMAERVREHYAGIWQVSEEETFDRITNRVPLGRYVETREVAAMVEYLVADDAAAVTAQALNVCGGLGNY

SEQ ID NO: 7758 - protein, 249 aa, Streptomyces violaceoruber
MATDAPEAPVALVTGSSSGIGQTVAQRLAAEGYRVVVNSARSVEDGEKTAAALPDALYVRADVSEEADARRLVDTAVEHYGRLDVLVNNAGRTRAIPHADLAAATPEVWREILGLNVIGTWQTTVAAMPHLARSGNGSVVNVSSIAGSRPAGSSIPYAVSNGGHRAQTRLLANTVGPAVRVNAVAPGLIETPWTQNSDFFAPIAEHVRQTTPLRRTGRPEDVAEAVLGLVRATYTTGQVLLVDGGAHLL

SEQ ID NO: 7759 - protein, 717 aa, Oryza sativa (japonica cultivar-group); identical to SEQ ID NO: 3898

SEQ ID NO: 7760 - protein, 569 aa, Oryza sativa (japonica cultivar-group)
MADGLSIDRPPVMVREGARLPPSLRSLDMDWRRSKVLAADAGLKLLHVQLASPCQGLPLTNTAIEASSSSLTNADLKLHLYRLRLSDGGHTMGKRERGDTKQKEDVGLWIRPLRGKEKPSSSWFLDARSEKEMNEKDATDLEERSEASEHGQALSFHGGAMFLQEAQIASPAAANNALTSMANPFPIPPGLWNPPSHNMGLGETSFSSLLGMLSAGAPPPFVATPGFVDSTAGFPCYNGGNLGAMINHPFPGIHQPLGDFQNGVEPCREIEDIEIEGSKNVSQTGEKQQGDGETTHAVDSSSKELSMPGRNGGAGHDEGTRVSCSKKRKRSGQDGGVKHAEGGEQLATVGSAQKNEDDEKGEPKRSSVASGKSSGKQIKDNAGSPKEDYIHVRARRGQATNSHSLAERVRREKISERMKYLQDLVPGCSKVTGKAVMLDEIINYVQSLQRQVEFLSMKLASVNPTLDFNIERILSKDIFQCRGTTASSAFGFFPDIVHPRLHPPKYTQVGMPSIVNPTDAFGRVIHAPLGTNSAFKEPKHQMPNNLNGEFQDVIEMPFTHDHHGSNDQP

SEQ ID NO: 7761 - protein, 548 aa, Rattus norvegicus
MAEKQKHDGRVKIGHYILGDTLGVGTFGKVKVGKHELTGHKVAVKILNRQKIRSLDVVGKIRREIQNLKLFRHPHIIKLYQVISTPSDIFMVMEYVSGGELFDYICKNGRLDEKESRRLFQQILSGVDYCHRHMVVHRDLKPENVLLDAHMNAKIADFGLSNMMSDGEFLRTSCGSPNYAAPEVISGRLYAGPEVDIWSSGVILYALLCGTLPFDDDHVPTLFKKICDGIFYTPQYLNPSVISLLKHMLQVDPMKRATIKDIREHEWFKQDLPKYLFPEDPSYSSTMIDDEALKEVCEKFECSEEEVLSCLYNRNHQDPLAVAYHLIIDNRRIMNEAKDFYLATSPPDSFLDDHHLTRPHPERVPFLVAETPRARHTLDELNPQKSKHQGVRKAKWHLGIRSQSRPNDIMAEVCRAIKQLDYEWKVVNPYYLRVRRKNPVTSTFSKMSLQLYQVDSRTYLLDFRSIDDEITEAKSGTATPQRSGSISNYRSCQRSDSDAEAQGKPSEVSLTSSVTSLDSSPVDVAPRPGSHTIEFFEMCANLIKILAQ

SEQ ID NO: 7762 - protein, 486 aa, Pseudomonas sp. CF600
MKEIKHFINGAFVGSASGRTFEDVNPANGQVIARVHEAGRAEVDAAVQAARAALKGPWGKMSVSERAEILHRVADGITARFDEFLEAECLDTGKPKSLASHIDIPRGAANFKVFADLLKNVATEAFEMATPDGSGAINYAVRRPKGVIGVISPWNLPLLLMTWKVGPALACGNTVVVKPSEETPLTTALLGEVMQAAGVPAGVYNVVHGFGPDSAGAFLTEHPDVNAITFTGETRTGEAIMRAAAKGVRPVSFELGGKNAGIVFADCDLDKAIEGSMRSVFANGGQVCLGTERLYVERPIFDEFVARLKAGAESLVIGTPDDPQANFGPLISLQHREKVLSYYQKAVDEGATVVTGGGVPEMPAELAGGAWVQPTIWTGLADGAAVVTEEIFGPCCHIRPFDREEEAVELANSLPYGLAATIWTENTSRAHRVAGQLEAGIVWVNSWFLRDLRTAFGGSKQSGIGREGGVHSLEFYTELKNICVKL

SEQ ID NO: 7763 - protein, 369 aa, Oryza sativa; identical to SEQ ID NO: 3326

SEQ ID NO: 7764 - protein, 369 aa, Oryza sativa; identical to SEQ ID NO: 3856

SEQ ID NO: 7765 - protein, 721 aa, Myxococcus xanthus
MLGVGSATGSCAGRRGLCRGHAPGDESGMRLRSWWWVLVLLTVSCAGRRSSSEDLGGRDARSELFRARGDAAIETKQWALAAGYFASARHTEDSPTARWGQVWAEKRASSLEWAKQFEGSVLALAFSPDGRLLASGGYDAVVRVWDVAAGAQVAELKGHEAELHAVAFSPDGRWLAAAGRPGALWLWDWKQGRRVALLSGHTDVVRGLAFSPDGEWLASGGLDRTVRVWRIRDGAEVLRFTHDDIVIAVAFSPDGGRLVSSSMDRTARVWELTARRELHRLTGHGDKVESCAFSADGERVMTASADRAIRFWDARTGALLDVQRNTGALSAVAIDAGFQQLVQAGWEGRVQRVDVRGGGEVLERLDAHRTFVMAVALSPDGRTFASGGMDGVLKVWSRPEVPPDVLLRELPAWPEVLTSVGPDAFVSGGEDGLRSWSVSAGGELHSRLEAPDAVGAVAVSADRRLLAVGTLKGEVRVRDVRSGNQLMVIPAARESIRALAFSPDGALLAAGVAQDVVLWAVPSATQVARLTGHTGKAWALAFDATGQRLASGAADHTVRIWDVARGTVIRVLEAGDRVRAVTFLASGELLTAGMRQPIRLWSPDDGRVLTSMDSLTVGVLSLAMAPQGAFVASGGVGGEMKVWRLPDGALMGEVPGLQGFVSAVTFSSDGAWLAAAASDRTFHLLGFDAFALPPPVEPDLTRILRRHGLAWDDLRGAFTLH

SEQ ID NO: 7766 - protein, 627 aa, Leishmania major
MALPPATLQSPAVPDGQQHLGCSGGSGHLSVAALDQSRTPLYSAERRASLCDESGALAAVSLSADASRPTAANFVKGELIGKGSYGAVYRGMQRSNNRIIAMKEIRLPGVVEQQLRQSEKLAATAASPAGVSSPVLPASNSVKGESALAKEVAAIKRELTLLKQLNHPNIVRYLNDEVVDGTLRIYMDYVSGGSVTAALKSYGSFEEPQAAALCFQLLQGLVYMHRRGIIHRDLKGDNLLLETSSQLKIADLGTAKSIFSSATMTTSIVGTAYFMAPEVLQPSGAAVGTAADIWSVGCCLIEMMTGKPPLSDLPNQFTVMMAIGGSATVPLDKYIPADNTWSDEVLDFISQCLRANPAQRPTAVDLLQHSWFAKFLNVMHAPSMSTPATLDSMLTPTAPPIERPFTLSPQRQMVSPICSPNLTAALTPGYAGPQYSSGQPESSASSHTSRERKGKRDKRVSARRHARYSTSGATSATSRRSQESSQASTPQYSSGTRTRDGSAQSASLPRSHSHPGRQQGPSSKRRAHAHIVGHGLPRDDSRQSFSSEQAMPQHTCTPGSGGAGDGSGENKTKTAFLPAITHNGSVAPSPCGYSLDVSRCSRSLKNSGSSREPTKACLYTTDTENKS

SEQ ID NO: 7767 - protein, 345 aa, Leishmania major
MAQSVLPMDPRERIYYRPRHRLLQCYLERRKRKGLGIASLLPGRHQSFQFFLEHTGDFVLAAVPRSFKTRTMVEDTSSGVGGQFYPVSQGGANIVFTINQQQLDSDTRAFVGKLSRRGKGMEMVLFSEGSKDARKEILAVLLHNLADTNRSSFTVLLPAIDPESGYIKPLEGGEVEFLRDGRGSSHAGIDEAMVNSSDDDVDAAYSTMSRATPNFAAVCDSPGASGAPAPSRSETAGRQKKWFLHGVLAREYRRNPGSPNIIVLKSKEPQWDGVLRGYKLDFHGRSTKASEKNFQLVAVSDPGKVVMLFGKQDDDRFALDFRYPLCGLQAAAIATTILTARKAIL

SEQ ID NO: 7768 - protein, 151 aa, Craterostigma plantagineum
MAQLMNKAKNFVAEKVANVEKPKASVEDVDLKDVGRHGITYLTRICVENPYSASIPVGEIKYTLKSAGRVIVSGNIPDPGSLKGNDKTMLEPAIKVPHSALVSLIKDIGADMDIDYVLELGLVVDLPVIGNFTIPLSHKGEMKLPGLSDIF

SEQ ID NO: 7769 - protein, 201 aa, Craterostigma plantagineum
MEAMSFAARSTVLSISKSFPKNNSPTYLTLRPKFSRVRFTTVASQSQGRQQVSENAEDAKKKFSETTDSLKHKTSEATDSASHKANGAARETNDKAKETYNAASGKAGELKDKTQEGAENVREKAMDAGNDAMEKTRNAGERVADGVSNVGQNVKENVMGAGEKVKEFAEDVKDTVMGKSEEVKNQAEHETKKRSTSTNYF

SEQ ID NO: 7770 - protein, 91 aa, Oryctolagus cuniculus
LQPGRNLVAAGYALYGSATMLVLATDSGVNCFMLDPAIGEFILVDKNVKIKKKGNIYSLNEGYAKDFDPAVTEYIQKKKFPPDNSSPYGAR

SEQ ID NO: 7771 - protein, 574 aa, Glycine max; identical to SEQ ID NO: 1687

SEQ ID NO: 7772 - protein, 437 aa, Saccharomyces cerevisiae
MAVSKVYARSVYDSRGNPTVEVELTTEKGVFRSIVPSGASTGVHEALEMRDGDKSKWMGKGVLHAVKNVNDVIAPAFVKANIDVKDQKAVDDFLISLDGTANKSKLGANAILGVSLAASRAAAAEKNVPLYKHLADLSKSKTSPYVLPVPFLNVLNGGSHAGGALALQEFMIAPTGAKTFAEALRIGSEVYHNLKSLTKKRYGASAGNVGDEGGVAPNIQTAEEALDLIVDAIKAAGHDGKVKIGLDCASSEFFKDGKYDLDFKNPNSDKSKWLTGPQLADLYHSLMKRYPIVSIEDPFAEDDWEAWSHFFKTAGIQIVADDLTVTNPKRIATAIEKKAADALLLKVNQIGTLSESIKAAQDSFAAGWGVMVSHRSGETEDTFIADLVVGLRTGQIKTGAPARSERLAKLNQLLRIEEELGDNAVFAGENFHHGDKL

SEQ ID NO: 7773 - protein, 517 aa, Cucurbita maxima
MAVATDPLGCMQKLVQMLQAPPYVAAAVQSSALLLTFFIGDWRKRRRSPLPLLPAIPGIPVLGNLLQLKEKKPHKTFAQWSETYGPIYSIKAGASTVIVLNSSDLAKEAMVTRYSSISSRKLSKALTILTADKCMVAMSDYNDFHKLVKRYILANVLGANAQKRLRQRRDTMIDNISRELFACVKDSSSESVNFRKIFESELFGLALKETFGRDMESLYVDGLGTTLLREDLFRTLVIDPMEGAIEVDWRDFFPYLRWIPNKGVEDRIRKMDFRRRVTMKSLMEEKKKQIAAGEDLNCYSEFLLSEAKSLTEEQISMLLWEIIIETSDTTLVVTEWAMYELAQNPKRQERLYQHIQSVCGSAKITEENLSQLPYLTAVFHETLRKYSPVSIVPLRYAHEDTQLGGYFIPAGSEVAVNIYACNMDKKQWESPEEWKPERFLDESYDPMDLYKTMAFGGGKRVCAGAPKAMLIACTTLGRLVQGFTWKLREGEEDKVDTLGLTARKLQPLHIVAKPRIN

SEQ ID NO: 7774 - protein, 173 aa, Canis familiaris
ACLMKIGFHVIPTISSIVPESCLLIVVGLLVGGLIKGVGETPPFLQSDVFFLFLLPPIILDAGYFLPLRQFTENLGTILIFAVVGTLWNAFFLGGLMYAVCLVGGEQINNIGLLDNLLFGSIISAVDPVAVLAVFEEIHINELLHILVFGESLLNDAVTVVLYHLFEEFANYD

SEQ ID NO: 7775 - protein, 634 aa, Carica papaya
MESCDCIDTPCPGEELLVKYQYISDVLIALAYFSIPLELIYFVQKSAFFPYRWVLMQFGAFIVLCGATHFINLWTFSMHSKAVAVVMTIAKVACAAVSCVTALMLVHIIPDLLSVKTRELFLKNKAEELDREMGLILTQEETGRHVRMLTHEIRSTIDRHTILKTTLVELGRTLGLEECALWMPSRSGLNMQLSHTLNYHIQVGSTLPTNLPIVNEVFNNARAMRIPYTCPLARIRPLVGRYVPPEVVAVRVPLLHLSNFQINDWPDHSAKSYAIMVLILPTDSARKWRDHELELVEVVADQVAVALSHAAILEESMRARDQLMEQNVALNLARQEAEMAIHARNDFLAVMNHEMRTPMHAIIALSSLLLETELTPEQRVMIETVLKSSNLLATLINDVLDLSRLEDGSLKLDSETFNLQGIFREVINLIKPITSVKKLSMTLIMAPDLPACAVGDEKRLMQAILNVVGNAVKFTKEGYVTIVASVAKPDASRDWPECYPVSSEGHFHLCVQVKDSGCGIHPQDIPHLFTKFAQPRSGSSRKNGSAGLGLAICKRFVNLMGGHIWIESEGADKGCTATFIVKLGICNSPTDPSERKVGTKGQTTHGSGDLTRHKPLYRDNNGSTSSNPRYQRSF

SEQ ID NO: 7776 - protein, 400 aa, Lolium temulentum
MDPHDAFLAAHPFRWDLGPPAPAAVPPPPPLPMPQTPALPPANSPRELEDLVAGYGVRGATVARISELGFTASTLLVMTDRELDDMTAALAGLFRWDLLIGERFGLRAALRAERGRLMALHGGRHHGHQSGSTIDGASQEVLSNERDGAASGEDDAGRMMLSGKKLKNGSVARKAKKARRKKVDGLRLDHMQEDEREDGGGRSESTESSAGGGGGVGGERQREHPFVVTEPGEVARAKKNGLDYLFHLYEQCRLFLLQVQSMAKLHGHKSPTKVTNQVFRYASKVGASYINKPKMRHYVHCYALHCLDQEASDALRRAYKARGENVGAWRQACYAPLVDIAAGHGFDVDAVFAAHPRLAIWYVPTRLRQLCHQARSAHEAAAANANANGAMPPPPPPPMF

SEQ ID NO: 7777 - protein, 400 aa, Haloarcula marismortui [sequence omitted]

SEQ ID NO: 7778 - protein, 502 aa, catfish
KLIDKYEPDLTAKQNKHMTKDGFLAYLTHLEGFIFNPAHINVYQDMRQPINHYFISSSHNNYLMQEQLKGASSTEGYIRALLKSCRCVELDCWDGPNGEPVIYHGHTLTSKVLFKDVIKAINEYAFKTSEYPVILSLENHCSVEQQKLMAHHMTSILGSALLTRPLGKEIPSSLPSPEELKGRILIKGKRLNKLEAAFNNNAEDADSVSEEDEAAEAKQGEQETKPKKKKMKLAKELSDLVIYCKSVHFNSFEHSREKQACYEMSSFKESKAKNLAEHSATEFIQHNMDKLSRIYPAGTRTDSSNYSPVTMWNAGCQIVALNFQTYGKEMDVNQGRFLPNGKCGYILKPEFMRNPDSRFDPNAPTEGRWFRKSILHVMVISAQQLPKLNKDKPKSIVDPFVKWEIFGVPGDQARAQTSYINNNGFNPAWNKTFKFPIHVPDLAIVRFVVEDYDAASHNDFIGQYTLPFTSIKNGYRHIPLLTKGGDVIPSAKLFVHIMFMDP

SEQ ID NO: 7779 - protein, 85 aa, Escherichia coli
DVREALSSIGIQGLTVTEVKGFGRQKGHAELYRGAEYSVNFLPKVKIDVAIADDQLDEVIDIVSKAAYTGKIGDGKIFVAELQRV

SEQ ID NO: 7780 - protein, 115 aa, Klebsiella pneumoniae
MKQLTVLGSTGSIGCSTLDVVRHNPGRFSVAALVAGKNVDRMVEQCLEFTPRYAVMDDAQSAERLRTRLHEHGSRTEVLSGQQAAAEVAALDEVDQVMAAIVGAAGLVPTLAAIR

SEQ ID NO: 7781 - protein, 494 aa, Pisum sativum
ETSLLLSFLIILSHFVVEIHGKNKQVEALDNLHKAEYIENSEIDKSEFEVQEIVYDIDAIADSQKGVKENDRIKKLPGQPFVKFSQFGGYVTLDKLSGSAFYYYFVEAHQSKETPPLLLWLNGGPGCSSLAYGAMQELGPFRVNSDGKTLHQNRYSWNYAANVLFLESPVGVGFSYSNKSTEYSSNGDKKTAIDNYLFLVNWLERFPEYKNRDFYISGESYAGHYVPQLAHTILYHNKKANKTIINLKGILIGNAVIHDTTDSTGMYDFLATHAIISDKAAYDVNKVCDFSSSDNLTAECNSAADEVNEDIAFIDLYNIYAPLCKNENLTSKPKKNTIVTDPCSKNYVYAYLNRQDVQEAIHANVTKLKYEWSPCSGVIRKWVDSSPTVLPLLHEFLNNGLRVWIFSGDTDGRVPVTSTKYSIKKMNLPVKTVWHPWFAYGEVGGYTEVYKGDLTFVTVREAGHQVPSYQPARALTLIKHFLDGTPLPSPKIKA

SEQ ID NO: 7782 - protein, 294 aa, Petroselinum crispum
MDQYEKVEKIGEGTYGVVYKARDRVTNETIALKKIRLEQEDEGVPSTAIREISLLKEMQHGNIVRLQDVVHSEKRLYLVFEYLDLDLKKHMDSCPEFAKDPRLIKMFLYQILRGIAYCHSHRVLHRDLKPQNLLIDRRTNALKLADFGLARAFGIPVRTFTHEVVTLWYRAPEILLGSRHYSTPVDVWSVGCIFAEMVNQRPLFPGDSEIDELFKIFRITGTPNEDTWPGVTSLPDFKSAFPKWPSKELETVVPNLDSAGLNLLKKMLCLDPSRRITARIALEHEYFKDIGIVP

SEQ ID NO: 7783 - protein, 448 aa, Rattus norvegicus
MSTFRQEDVEDHYEMGEELGSGQFAIVRKCQQKGTGMEYAAKFIKKRRLPSSRRGVSREEIEREVSILREIRHPNIITLHDVFENKTDVVLILELVSGGELFDFLAEKESLTEDEATQFLKQILDGVHYLHSKRIAHFDLKPENIMLLDKHAASPRIKLIDFGIAHRIEAGSEFKNIFGTPEFVAPEIVNYEPLGLEADMWSIGVITYILLSGASPFLGETKQETLTNISAVNYDFDEEYFSSTSELAKDFIRRLLVKDPKRRMTIAQSLEHSWIKVRRREDGARKPERRRLRAARLREYSLKSHSSMPRNTSYASFERFSRVLEDVAAAEQGLRELQRGRRQCRERVCALRVAAEQREARCRDGSAGLGRDLRRLRTELGRTEALRTRAQEEARAALLGAGGLKRRLCRLENRYDALAAQVAAEVQFVRDLVRALEQERLQAECGVR

SEQ ID NO: 7784 - protein, 620 aa, Nicotiana tabacum
MKLSTLFALVLLLQSTAILSLVAAEATTQYGGYLPPPVTSQPPPSSIGLSPPSAPTTTPPSRGHVPSPRHAPPRHAYPPPSHGHLPPSVGGPPPHRGHLPPSRGFNPPPSPVISPSHPPPSYGAPPPSHGPGHLPSHGQRPPSPSHGHAPPSGGHTPPRGQHPPSHRRPSPPSRHGHPPPPTYAQPPPTPIYSPSPQVQPPPTYSPPPPTHVQPTPSPPSRGHQPQPPTHRHAPPTHRHAPPTHQPSPLRHLPPSPRRQPQPPTYSPPPPAYAQSPQPSPTYSPPPPTYSPPPPSPIYSPPPPAYSPSPPPTPTPTFSPPPPAYSPPPTYSPPPPTYLPLPSSPIYSPPPPVYSPPPPPSYSPPPPTYLPPPPPSSPPPPSFSPPPPTYEQSPPPPPAYSPPLPAPPTYSPPPPTYSPPPPTYAQPPPLPPTYSPPPPAYSPPPPPTYSPPPPTYSPPPPAYAQPPPPPPTYSPPPPAYSPPPPSPIYSPPPPQVQPLPPTFSPPPPRRIHLPPPPHRQPRPPTPTYGQPPSPPTFSPPPPRQIHSPPPPHWQPRTPTPTYGQPPSPPTFSAPPPRQIHSPPPPHRQPRPPTPTYGQPPSPPTTYSPPSPPPYGLLLSTP

SEQ ID NO: 7785 - protein, 304 aa, Halocynthia roretzi
MPWSAVDFAKDLAIGGTAAAISKTIVAPIERVKLLLQVQAVSTQMKAGTEYKGIIDAFVRIPKEQGFFSLWRGNLANVIRYFPTQALNFAFKDTYKKIFLAGVDKRKQFWRYFHGNLASGGAAGATGLCFVYPLDFARTRLAADIGSGGSRQFTGLGNCLATIVKKDGPRGLYQGFVVSIQGIIVYRAAYFGTYDTVKGMLPDPQNTPIIVSWAIAQVVTTGAGIISYPFDTVRRRMMMQSGRNKEDRMYKGTVDCWGKIYKNEGGKAFFKGALSNVIRGTGGALVLVLYDELKKLVFGTSVHN

SEQ ID NO: 7786 - protein, 363 aa, Rattus norvegicus
MVDHAPFETDISTLTRFVLEEGRKAGGTGEMTQLLNSLCTAIKAISSAVRQAGIAQLYGIAGSTNVTGDQVKKLDILSNDLVINMLKSSYATCVLVSEEDTHAIIIEPEKRGKYVVCFDPLDGSSNIDCLASIGTIFGIYRKTSANEPSEKDALQPGRNLVAAGYALYGSATMLVLAMNCGVNCFMLDPSIGEFILVDRDVKIKKKGNIYSINEGYAKDFDPAINEYIQRKKFPPDNSAPYGARYVGSMVADVHRTLVYGGIFLYPANKKNPSGKLRLLYECNPIAYVMEKAGGLATTGNEDILDIVPTEIHQKAPVIMGSTEDVQEFLEIYNKDKAKSRPSLPLPQSRARESPVHSICDELF

SEQ ID NO: 7787 - protein, 333 aa, Rhodobacter sphaeroides
MKPFPTHPDAIPAELQDVMDRLGSVAIEVANRIARGGIDEDLAGLCGTNTDGDGQKALDVIADDAFRVALEGSAVRFYASEEQDTAVTLNEAGTLALAIDPLDGSSNIDTNLSVGTTFAIWPAAPRPNPSFLRLGSELIAAGYVIYGPQVCMMVSFGKGTQKYVLDPGSRSFVLVDRAVKVPPSSTEFAINASNYRHWPKPIRAYIDDCVAGTEGPRGRNFNMRWLASLVAETHRILARGGVFLYPRDSRKGYEQGRLRYLYECAPIAFVITQAGGGATDGENPILGQTPSRLHARTPFVFGSAEKVARITAYHDLPEQETSALFGNRGLFRS

SEQ ID NO: 7788 - protein, 347 aa, Schizosaccharomyces pombe
MKKDLDEIDTDIVTLSSFILQEQRRYNQKHKNEEGKPCIIQEASGELSLLLNSLQFSFKFIANTIRKAELVNLIGLSGIVNSTGDEQKKLDKICNDIFITAMKSNGCCKLIVSEEEEDLIVVDSNGSYAVTCDPIDGSSNIDAGVSVGTIFGIYKLRPGSQGDISDVLRPGKEMVAAGYTMYGASAHLLLTTGHRVNGFTLDTDIGEFILTHRNMKMPLQHSIYSINEGYTAFWDEKIARFIAHLKESTPDKKPYSARYIGSMVADMHRTILYGGLFAYPCSKGNNGKLRLLYECFPMAFLVEQAGGIAVNDKGDRILDLVPKTLHGKSSIWLGSKHEVEEYINFIK

SEQ ID NO: 7789 - protein, 409 aa, Triticum aestivum; identical to SEQ ID NO: 5079

SEQ ID NO: 7790 - protein, 364 aa, Xanthobacter flavus
MLEPNADHRAAVAQAAGVAASRITLTVMLDEWAGADARRRAVADTVCALATGCASLAAAIAEGPLAGDLARTLSSGEAGEGQKALDVISNDIVIGALKAAPVAAVASEENDAPVLLDPTAPLLVAIDPLDGSSNIDTDISVGTIFAVFPRPEGADASEPSAFLQNGRDMLAAGYVIYGPHTAMMLTLGAGTWHFALDRAGLFRLVDAEVKVKEGAAEFAINMSNYHHWDVPVRDYVDDCLAGKKGPRERDFNMRWVASMVADAHRIFQRGGIYLYPGDGRKGYTHGRLRLLYEAFPVAFLMEQASGSATDGRGAILDLSATGLHQRVPFIFGSRDEVARVSRYHLEPNGHGERSPLFARRGLFI

SEQ ID NO: 7791 - protein, 341 aa, Spinacia oleracea
MDHAGDAMRTDLMTITRYVLNEQSKRPESRGDFTILLSHIVLGCKFVCSAVNKAGLAKLIGLAGETNIQGEEQKKLDVLSNEVFVKALTSSGRTCILVSEEDEEATFIEPSLRGKYCVVFDPLDGSSNIDCGVSIGTIFGIYMVKDFETATLEDVLQPGKNMVAAGYCMYGSSCTLVLSTGSGVNGFTLDPSLGEYILTHPDIKIPNKGKIYSVNEGNAKNWDGPTTKYVEKCKFPTDGSSPKSLRYIGSMVADVHRTLLYGGIFLYPGDKKSPNGKLRVLYEVFPMSFLMEQAGGQAFTGKQRALDLIPTKIHERSPVFLGSYDDVEDIKALYAAQEKTA

SEQ ID NO: 7792 - protein, 320 aa, Cuphea lanceolata
MATATAAGCSGAVALKSLGGRRLCIPQQLSPVLAGFGSHAAKSFPILSTRSIATSGIRAQVATAEKVSAGAGQSVESPVVIVTGASRGIGKAIALSLGKAGCKVLVNYARSSKEAEEVSKEIEAFGGQALTFGGDVSKEEDVEAMIKTAVDAWGTVDILVNNAGITRDGLLMRMKKSQWQEVIDLNLTGVFLCTQAAAKIMMKKKKGRIINIASVVGLVGNAGQANYSAAKAGVIGFTKTVAREYASRNINVNAVAPGFISSDMTSKLGDDINKKILETIPLGRYGQPEEVAGLVEFLAINPASSYVTGQVFTIDGGMTM

SEQ ID NO: 7793 - protein, 762 aa, Zymomonas mobilis
  unsure (1)..(762): unsure at all Xaa locations
MPPSQQIATIAAREILTRLHDVMASRSNAQSKLDQVVQIISTALLSDVCSIYLLRDGVLELFATYGLKQEAVHVTRLSLGQGLVGTIARDMAILNLSEATSHPDFVHNPETGEEFFHSFAGVPIVRREQAVGVLAVQSAESRRFADIEVEALQTVAMVLAELIFSAGLIDENSLASSGSKDQGSLRYNGLKLVEGMGRGYAVFHQPRVTIEFTVAEDVEVERQRLNAAFARMREQIEHMAQEAEFFGNSNDHREVLATYRMFAYDEGWRRRIDEAIDSGLTAEAAIERVQQHNRMRMREIGDPIXADRLHDLEDLSNRLLRLVSGQLGTAARLGLHDDAILIARNMGPAELLEYERGRLXGIVLEEGSLTSHVTIVAKAIGIPVLGRVKEIHQGVREGDLLLVDSNQGAVFIRPTPEIEEAFATRFALSRKRRAEFAAMRDLPAITRDNHRIELMINAGLRDDVAALEATGADGIGLFRTQFEFLVYSTLPRRERQLRLYSDILEAAGDRPVILRTVDIGNDKTLPYINNSDETVEENPALGWRAIRLALEKKALLKVQARALIEGAAGKTLYVMFPMIAEPWEYEQARAVFEKQNAWLAKHDKPRAKRIYYGSMLEVPSLAETLDILLPKLDFLSIGTNDLIQFFFAADRAYPKLAERYDWLSPALLRFLSRIIDQANAAGCKVGICGEMGGRTLTAMALIGLGLKRLSITPVAIGPIKAMIRSLDRDAFAPFIRELVASGASNIGDQLELWAKKHGVVIN

SEQ ID NO: 7794 - protein, 306 aa, Hordeum vulgare subsp. spontaneum
MATAGKVIKCKAAVAWEAGKPLSMEEVEVAPPQAMEVRDKILYTALCHTDVYFWEANGQTPVFPRILGHEAGGIVESVGEGVTELVPGDHVLPVFTGECKECAHCMSEESNLCDLLRINVDRGVMIDDGQSRFTIDGKPIFHFLGTSTFSEYTVIHVGCVAKIDPEAPLDKVCLLSCGISTGLGATLNVTKPKKGMTVAIFGLGAVGLAAMEGARMSGASRIIGVDLNPAKHEQAKKFGCTDFVNPKDHTKPVQEVIVEMTDGGVNRAVECTGNADAMISAFECVHDGWGVAHKEAVFKTHPMNFL

SEQ ID NO: 7795 - protein, 308 aa, Hordeum vulgare subsp. spontaneum
MATAGKVIKCKAAVAWEAGKPLSMEEEEVEVAPPQAMEVRDKILYTALCHTDVYFWEANGQTPVFPRILGHEAGGIVESVGEGVTELVPGDHVLPVFTGECKECAHCMSEESNLCDLLRINVDRGVMIDDGQSRFTIDGKPIFHFLGTSTFSEYTVIHVGCVAKIDPEAPLDKVCLLSCSISTGLGATLNVTKPKKGMTVAIFGLGAVGLAAMEGARMSGASRIIGVDLNPAKHEQAKKFGCTDFVNPKDHTKPVQEVIVEMTDGGVNRAVECTGNADAMISAFECVHDGWGVAHKEAVFKTHPMNFL

SEQ ID NO: 7796 - protein, 306 aa, Hordeum vulgare subsp. spontaneum
MATAGKVIKCKAAVAWEAGKPLSMEEVEVAPPQAMEVRDKILYTALCHTDVYFWEAKGQTPVFPRILGHEAGGIVESVGEGVTELVPGDHVLPVFTGECKECAHCMSEESNLCDLLRINVDRGVMIDDGQSRFTIDGKPIFHFLGTSTFSEYTVIHVGCVAKIDPEAPLDKVCLLSCGISTGLGATLNVTKPKKGMTVAIFGLGAVGLAAMEGARMSGASRIIGVDLNPAKHEQAKKFGCTDFVNPKDHTKPVQEVIVEMTDGGVNRAVECTGNADAMISAFECVHDGWGVAHKEAVFKTHPMNFL

SEQ ID NO: 7797 - protein, 306 aa, Hordeum vulgare subsp. spontaneum
MATAGKVIKCKAAVAWEAGKPLSMEEVEVAPPQAMEVRDKILYTALCHTDVYFWEANGQTPVFPRILGHEAGGIVESVGEDVTELVPGDHVLPVFTGECKECAHCMSEESNLCDLLRINVDRGVMIDDGQSRFTIDGKPIFHFLGTSTFSEYTVIHVGCVAKIDPEAPLDKVCLLSCGISTGLGATLNVTKPKKGMTLAIFGLGAVGLAAMEGARMSGASRIIGVDLNPAKHEQAKKFGCTDFVNPKDHTKPVQEVIVEMTDGGVNRAVECTGNADAMISAFECVHDGWGVAHKEAVFKTHPMNFL

SEQ ID NO: 7798 - protein, 306 aa, Hordeum vulgare subsp. spontaneum
MATAGEVIKCKAAVAWEAGKPLSMEEVEVAPPQAMEVRDKILYTALCHTDVYFWEANGQTPVFPRILGHEAGGIVESVGKGVTELVPGDHVLPVFTGECKECAHCMSEESNLCDLLRINVDRGVMIDDGQSRFTIDGKPIFHFLGTSTFSEYTVIHVGCVAKIDPEAPLDKVCLLSCGISTGLGATLNVTKPKKGMTVAIFGLGAVGLAAMEGARMSGASRIIGVDLNPAKHEQAKKFGCTDFVNPKDHTKPVQEVIVEMTDGGVNRAVECTSNADAMISAFECVHDGWGVAHKEAVFKTHPMNFL

SEQ ID NO: 7799 - protein, 306 aa, Hordeum vulgare subsp. spontaneum
MATAGKVIKCKAAVAWEAGKPLSMEEVEVAPPQAMEVRDKILYTALCHTDVYFWEANGQTPVFPRILGHEAGGIVESVGEGVTELVPGDHVLPVFTGECKECAHCMSEESNLYDLLRINVDRGVMIDDGQSRFTIDGKPIFHFLGTSTFSEYTVIHVGCVAKIDPEAPLDKVCLLSCGISTGLGATLNVTKPKKGMTVAIFGLGAVGLAAMEGARMSGASRIIGVDLNPAKHEQAKKFGCTDFVNPKDHTKPVQEVIVEMTDGGVNRAVECTGNADAMISAFECVHDGWGVAHKEAVFKTHPMNFL

SEQ ID NO: 7800 - protein, 306 aa, Hordeum vulgare subsp. spontaneum
MATAGKVIKCKAAVAWEAGKPLSMEEVEVAPPQAMEVRDKILYTALCHTDVYFWEANGQTPVFPRILGHEAGGIVESVGEGVTELVPGDHVLPVFTGECKECAHCMSEESNLCDLLRINVDRGVMIDDGQSRFTIDGKPIFHFLGTSTFSEYTVIHVGCVTKIDPEAPLDKVCLLSCGISTGLGATLNVTKPKKGMTVAIFGLGAVGLAAMEGARMSGASRIIGVDLNPAKHEQAKKFGCTDFVNPKDHTKPVQEVIVEMTDGGVNRAVECTGNADAMISAFECVHDGWGVAHKEAVFKTHPMNFL

SEQ ID NO: 7801 - protein, 304 aa, Hordeum vulgare subsp. spontaneum
MATAGKVIKCKAAVAWEAGKPLSMEEVEVAPPQAMEVRDKILYTALCHTDVYFWEANGQTPVFPRILGHEAGGIVESVGEGVTELVPGDHVLPVFTGECKECAHCMSEESNLCDLLGINVDRGVMIDDGQSRFTIDGKPIFHFLGTSTFSEYTVIHVGCVAKIDPEAPLDKVCLLSCGISTGLGATLNVTKPKKGMTVAIFGLGAVGLAAMEGARMSGASRIIGVDLNPAKHEQAKKFGCTDFVNPKDHTKPVQEVIVEMTDGGVNRAVECTGNADAMISAFECVHDGWGVAWRTRSRCSRPTP

SEQ ID NO: 7802 - protein, 312 aa, Hordeum vulgare subsp. spontaneum
MATAGKVIKCKAAVAWEAGKPLSMEEVEVAPPQAMEVRVKILYTALCHTDVYFWEAKGQTPVFPRILGHEAGGIVESVGEGVTELVPGDHVLPVFTGECKECAHCMSEESNLCDLLRINVDRGVMISDGQPRFTIDGKPIFHFLGTSTFSEYTVIHVGCVAKIDPEAPLDKVCLLSCGISTGLGATLNVAKPKKGMAVAIFGLGAVGLAAMEGARMSGASRIIGVDLNPAKHEQAKKFGCTDFVNPKDHTKPVQEVIVEMTDGGVDRAVECTGNADAMISAFECVHDGWGVAVLVGVAHKEPVFKTHPMNFL

SEQ ID NO: 7803 - protein, 312 aa, Hordeum vulgare subsp. spontaneum
MATAGKVIKCKAAVAWEAGKPLSMEEVEVAPPQAMEVRVKILYTALCHTDVYFWEAKGQTPVFPRILGHEAGGIVESVGEGVTELVPGDHVLPVFTGECKECAHCMSEESNLCDLLRINVDRGVMISDGQPRFTIDGKPIFHFLGTSTFSEYTVIHVGCVAKIDPEAPLDKVCLLSCGISTGLGATLNVAKPKKGMVVAIFGLGAVGLAAMEGARMSGASRIIGVDLNPAKHEQAKKFGCTDFVNPKDHTKPVQEVIVEMTDGGVDRAVECTGNADAMISAFECVHDGWGVAVLVGVAHKEPVFKTHPMNFL

SEQ ID NO: 7804 - protein, 312 aa, Hordeum vulgare subsp. spontaneum
MATAGKVIKCKAAVAWEAGKPLSMEEVEVAPPQAMEVRVKILYTALCHTDVYFWEAKGQTPVFPRILGHEAGGIVESVGEGVTELVPGDHVLPVFTGECKECAHCMSEESNLCDLLRINVDRGVMISDGQPRFTIDGKPIFHFLGTSTFSEYTVIHVGCVAKIDPEAPLDKVCLLSCGISTGLGATLNVAKPKKGMVVAIFGLGAVGLAAMEGARMSGASRIIGVDLNPAKHEQAKKFGCTDFVNPKDHTKPVQEVIVEMTDGGVDRAVECTGNADAMISAFECVHDGWGVAVLVGVAHKEAVFKTHPMNFL

SEQ ID NO: 7805 - protein, 312 aa, Hordeum vulgare subsp. spontaneum
MATAGKVIKCKAAVAWEAGKPLSMEEVEVAPPQAMEVRVKILYTALCHTDVYFWEAKGQTPVFPRILGHEAGGIVESVGEGVTELVPGDHVLPVFTGECKECAHCMSEESNLCDLLRINVDRGVMISDGQPRFTIDGKPIFHFLGTSTFSEYTVIHVGCVAKIDPEAPLDKVCLLSCGISTGLGATLNVAKPKKGMAVAIFGLGAVGLAAMEGARLSGASRIIGVDLNPAKHEQAKKFGCTDFVNPKDHTKPVQEVIVEMTDGGVDRAVECTGNADAMISAFECVHDGWGVAVLVGVAQKEAVFKTHPMNFL

SEQ ID NO: 7806 - protein, 312 aa, Hordeum vulgare subsp. spontaneum
MATAGKVIKCKAAVAWEAGKPLSMEEVEVAPPQAMEVRVKILYTALCHTDVYFWEAKGQTPVFPRILGHEAGGIVESVGEGVTELVPGDHVLPVFTGECKECAHCMSEESNLCDLLRINVDRGVMISDGQPRFTIDGKPIFHFLGTSTFSEYTVIHVGCVAKIDPEAPLDKVCLLSCGISTGLGATLNVAKPKKGMAVAIFGLGAVGLAAMEGARLSGASRIIGVDLNPAKHEQAKKFGCTDFVNPKDHTKPVQEVIVEMTDGGVDRAVECTGNADAMISAFECVHDGWGVAVLVGVAHKEAVFKTHPMNFL

SEQ ID NO: 7807 - protein, 312 aa, Hordeum vulgare subsp. spontaneum
MATAGKVIKCKAAVAWEAGKPLSMEEVEVAPPQAMEVRVKILYTALCHTDVYFWEAKGQTPVFPRILGHEAGGIVESVGEGVTELVPGDHVLPVFTGECKECAHCMSEESNLCDLLRINVDRGVMISDGQPRFTIDGKPIFHFLGTSTFSEYTVIHVGCVAKIDPEAPLDKVCLLSCGISTGLGATLNVAKPKKGMAVAIFGLGAVGLAVMEGARLSGASRIIGVDLNPAKHEQAKKFGCTDFVNPKDHTKPVQEVIVEMTDGGVDRAVECTGNADAMISAFECVHDGWGVAVLVGVAHKEPVFKTHPMNFL

SEQ ID NO: 7808 - protein, 312 aa, Hordeum vulgare subsp. spontaneum
MATAGKVIKCKAAVAWEAGKPLSMEEVEVAPPQAMEVRVKILYTALCHTDVYFWEAKGQTPVFPRILGHEAGGIVESVGEGVTELVPGDHVLPVFTGECKECAHCMSEESNLCDLLRINVDRGVMISDGQPRFTIDGKPIFHFLGTSTFSEYTVIHVGCVAKIDPEAPLDKVCLLSCGISTGLGATLNVAKPKKGMAVAIFGLGAVGLAAMEGARLSGASRIIGVDLNPAKHEQAKKFGCTDFVNPKDHTKPVQEVIVEMTDGGVDRAVECTGNADAMISAFECVHDGWGVAVLVGVAHKEPVFKTHPMNFL

SEQ ID NO: 7809 - protein, 314 aa, Schizosaccharomyces pombe
MPEQLVLRATLEGHSGWVTSLSTAPENPDILLSGSRDKSILLWNLVRDDVNYGVAQRRLTGHSHFVSDCALSFDSHYALSASWDKTIRLWDLEKGECTHQFVGHTSDVLSVSISPDNRQVVSGSRDKTIKIWNIIGNCKYTITDGGHSDWVSCVRFSPNPDNLTFVSAGWDKAVKVWDLETFSLRTSHYGHTGYVSAVTISPDGSLCASGGRDGTLMLWDLNESTHLYSLEAKANINALVFSPNRYWLCAATGSSIRIFDLETQEKVDELTVDFVGVGKKSSEPECISLTWSPDGQTLFSGWTDNLIRVWQVTK

SEQ ID NO: 7810 - protein, 338 aa, Atrichum angustatum
QAQFEVVPTEPTLLYKRDGTTIAAKESRRLKELFKDFGVQPATLAIMGQMGFTLSTLINMKDDEVDFVIKSIIEEYHLDLLMGEQFGIKAAIRAKRRLLDEEMEQQRLDLAGRTGDRKRKVDDAPDTLLLKEGHGTSLDALGLLGLTDPESDSEDKKVAKKKQRKRRSKEVGEDGEERPREHPFIVTEPGEPAKGKKNGLDYLFNLYEQCGKFLEEVQQIAKEKGEKCPTKVTNEVFRHAKLTGAGYINKPKMRDYVHCYALHCLDVEQSNELRKAYKERGENVGAWCQACYYPLVLLARENEWDIDDLFNRNEKLRIWYVPTKLRQLCHIERIKHGE

SEQ ID NO: 7811 - protein, 339 aa, Atrichum angustatum
GHFEEVLAAPGLLFKRDAAASVGRESRRMKDLFKDFGVQPATLAVMGQMGFTMNTLTNMKDDEINFLIKSMIEEYHLELLMGEQFGIKAAIRAKRKLLDENMEQQRLELAACTNDKKRKGEDPPDCLLLTDGGGHGASLDALGLLGLTDPDSDSTEDKVAKRKQRKRRSKEVGEDGEERPREHPFIVTEPGEPAKGKKNGLDYLFDLYEQCGKFLEEVQLLAREKGEKCPFKVTNEVFRHAKHTGASYINKPKMRDYVHCYALHCLDLDQSNALRKVYKERGENVGAWCQACYFPLVSLARANDWDIDDLFNRNEKLRIWYVPTKLRQLCHIERIKHCK

SEQ ID NO: 7812 - protein, 241 aa, Marchantia polymorpha
GTVSEQRRESAMMMPESIAPVNALNLNSKEPPLLMGAGHSSLTPGLLALAENSSDSEDKRLGKKKQKRRRPKEHGEDGEDRPREHPFIVTEPGEAARGKKNGLDYLFDLYEQCGKFLEQVQQLAREKGEKCPTKVTNQVFRHAKHTGAGYINKPKMRHYVHCYALHCLDIDQSNALRKLYKERGENVGAWRGACYYPLVAMARDNNWDIEGLFNRNEKLRIWYVPTKLRQLCHVEKVKYGE

SEQ ID NO: 7813 - protein, 763 aa, Zymomonas mobilis
  unsure (1)..(763): unsure at all Xaa locations
MAETTTAEAKKNAGDAPLIDLNETSIRKFITQPKKTEYVTYDQLNEALPQDQDVFGTDRKYNVCPFVNGHQYRKNEDSGQDGQQEEENAAKKLQGQRWHFSGSGHYDQRKKHPTEQMIRCVCISAKWVRSSFWSREGEIAIAKRIEAGRDTMILGLCESPITFDNIIEWSNALNEGTLQLREIIDLDAMLTQGPSPDQFEEDGDDNDNEISERNAGPTFKEDDDEDDDSEGELDENGQRIQRENMDEEDENTLSLAQMEEQLKPASLEKFAKIADLYRQFSVLQNARMRALGANEEFPEDQENAYQQLREELTAEVESVKFHNARIEFLVEQLYNYNSRLRTLNGQMLRLAERYKVPRDSFLNAYLGNEMEEGWVERVFKNRQKMGNFTTSEAESIERIRSEVAEIAQVTGMTVKELRRIVTMVQKGRKRSPHSLKPEWLKPICVWLSLLPKNIPIAVCSSLXLFRXAISGLMKAVGKFEYRRGYKFSTYATWWIRQAITRSIADQARTIRIPVHMIETINKLVRTSRQILHEIGREPTPEELAERLSMPLEKVRKVMKIAKEPISLETPIGDEEDSHLGDFIEDKNAIIPVDAAIQANLKETVTRVLASLTPREERVLRMRFGIGMNTDHTLEEVGQQFSVTRERIRQIEAKALRKLKHPSRSRKMRSFPRPLENTAFSALSIKKPFETRCFSGVSKGFFDFRRRADDGGSLRLPIYESGLMFQPYPDQRSYGRLLTGDNKHEQKGASFLRRSSEFYALHHP

SEQ ID NO: 7814 - protein, 278 aa, Streptomyces nogalater
MTNSGTRPQEVADFYDGSSRLIAELNGGSLHFGCWDSLPADAGMDRASQRLTEMMTERIEVGPGQRVLDIGCGTGAPAVQLARATGAEVVGITISPEQVRLATAHAEREGVAERVTFRCADASAELPFPADSFDAVWFFESIFHLPDRLTALRRAAEVLRPGGRLALTDVLHNDETSPAAQESLDEHAYTPLVGEPMRLSDYPPLLRQARLVPVECRDISELTVGRTLECMHRTLDENRERFVERYGSELVDQFSTAVPLLDAVEFGYGIVTAARPDH

SEQ ID NO: 7815 - protein, 386 aa, Dactylis glomerata
MEGVEESNREAVQSCHRVLSLLSNPHGQLVPHKELVEATGEAVSKFGSVATKIATNGNGRQGHARVRKKINQPMPMFDSSLFLETTASAADAAAAKTSQPGPDTILRLFPRYQQVEGSSSKDPVRIPAQFPRRLLLENPSVGSNGPARGPPVQLVQPVSVAPPAGTPAPALPAAHLHFIQQQQSYQRFQLMHQMKLQSEMMKRGGLGEQGGSNGGVNLKFASSNCTGSSSRSFLSSLSMEGSMASLDVSRSSRPFQLVSGSQTSSTPELGLMQRKRCAGKEDGSGRCATGGRCHCAKKRKLRIRRSIKVPAISNKVADIPADEFSWRKYGQKPIKGSPHPRGYYKCSSVRGCPARKHVERCVDDPAMLIVTYEGDHNHNRAAAQPA

SEQ ID NO: 7816 - protein, 263 aa, Arabidopsis thaliana
MQKPYKFNIPNYIYISLALFFVLAPCSSSDFSFEVKWLTLQLRETLPAFVVEEYKADPYLATVLNCALWVFYGLPMVQPDSLLVITINGTGLAIELVYLAIFFFFSPTSRKVKVGLWLIGEMVFVGIVATCTLLLFHTHNQRSSFVGIFCVIFVSLMYIAPLTIMSKVIKTKSVKYMPFSLSLANFLNGVVWVIYALIKFDLFILIGNGLGTVSGAVQLILYACYYKTTPKDDEDEEDEENLSKVNSQLQLSGNSGQAKRVSA

SEQ ID NO: 7817 - protein, 307 aa, Arabidopsis thaliana
MYSAIRSLPLDGGHVGGDYHGPLDGTNLPGDACLVLTTDPKPRLRWTTELHERFVDAVTQLGGPDSEYYFVYLSLCSVSLLEATPKTIMRTMGVKGLTLYHLKSHLQKFRLGRQAGKESTENSKDGESQDTGSSSTSSMRMAQQEQNEGYQVTEALRAQMEVQRRLHDQLEVQRRLQLRIEAQGKYLQSILEKACKAFDEQAATFAGLEAAREELSELAIKVSNSSQGTSVPYFDATKMMMMPSLSELAVAIDNKNNITTNCSVESSLTSITHGSSISAASMKKRQRGDNLGVGYESGWIMPSSTIG

SEQ ID NO: 7818 - protein, 604 aa, Arabidopsis thaliana
MHMKNLSIKELKVLSDELRSDVIFNVSKTGGHLGSNLGVVELTVALHYIFNTPHDKILWDVGHQSYPHKILTGRRGKMKTIRQTNGLSGYTKRRESEHDSFGTGHSSTTLSAGLGMAVGRDLKGMNNSVVSVIGDGAMTAGQAYEAMNNAGYLHSNMIVILNDNKQVSLPTANLDGPTQPVGALSCALSRLQSNCGMIRETSSTLFEELGFHYVGPVDGHNIDDLVSILETLKSTKTIGPVLIHVVTEKGRGYPYAERADDKYHGVLKFDPETGKQFKNISKTQSYTSCFVEALIAEAEADKDIVAIHAAMGGGTMLNLFESRFPTRCFDVGIAEQHAVTFAAGLACEGLKPFCTIYSSFMQRAYDQVVHDVDLQKLPVRFAIDRAGLMGADGPTHCGAFDVTFMACLPNMIVMAPSDEAELFNMVATAAAIDDRPSCFRYHRGNGIGVSLPPGNKGVPLQIGRGRILRDGERVALLGYGSAVQRCLEAASMLSERGLKITVADARFCKPLDVALIRSLAKSHEVLITVEEGSIGGFGSHVVQFLALDGLLDGKLKWRPMVLPDRYIEHGSPMDQLAEAGLTASHIAATALNLMGTPREALFWE

SEQ ID NO: 7819 - protein, 177 aa, Arabidopsis thaliana
MSSNKIVLTSSDGESFQVEEVVARKLQIVKHLLEDDCVINEIPLQNVTGNILSIVLEYCKKHVDDVVDDDASEEPKGDDASEEAKQNLDAWDAEFMKNIDMETIFKLILAANYLNVEGLLGLTCQTVADYIKDKTPEEVRELFNIENDFTHEEEEEAIRKENAWAFEADTKHEDPKP

SEQ ID NO: 7820 - protein, 255 aa, Arabidopsis thaliana
MWNLASSYLTGNIGPKNDIRRPVHAHAECSDDDVSSVGSKDEGLECPICWESFNIVENVPYVLWCGHTMCKNCILGLQWAIVKLPTHPVQLPLFISCPWCNLLSFRLVFRGTLRFPHKNYFVLWMVERMNGERRNSPGGAQTDGNNDHTRETPSPCLHNRHHRSQPEPSRSVNDHRIPRDNIQTSLRKSLVFFVQLTAKFPLVVIFLLIILYAIPTSAAILAMYILVTLLLALPSFLILYFAYPCLDWLVREIVT

SEQ ID NO: 7821 - protein, 248 aa, Calystegia soldanella
MSEEKHHHLFGHHKDKEEERQPSYGENTYGSSDDSYERKNTYGDDSYEKKNTYGGDDSYERKNTYGEDSYEKKNTYGGDESYERKNTYGGDESYEKKNTYGGDESYERKNNYGDNNESSYENKPTGYGKTSYGEDSYGGGQTDKYGSATGIEEEGGRTHEDYEKEKKHHKHLEELGGLGTVAAGAYALYEKHEAKKDPENAHRHKIEEEVAAAVAVGSGGFAFHEHHEKKETKEEEEEAEGKKKHHFF

SEQ ID NO: 7822 - protein, 363 aa, Amia calva
  unsure (1)..(363): unsure at all Xaa locations
TKKGLFRAAVPSGASTGIYEALELRDKDKTRYMGKGVLKAVEHINKTIAPALVSQNVSVIEQEKIDKLMIAMDGTENKSKFGANAILGVSLAVCKAGAAEKGVPLYRHIADLAGNPEXILPVPAFNVINGGSHAGNKLAMQEFMILPVGASSFKEAMRIGAEIYHTLKDVIKAKYGKDATNVGDEGGFAPNILENKEALELLKNAIAKAGYTDKIVIGMDVAASEFYKDGKYDLDFKSPDDPSRYITXDQLADLYKGFVKDYPVVSIEDPFDQDDWAAWSNFTGSTSIQVVGDDLTVTNPKRISKAVTEKACNCLLLKVNQIGSVTESLQACKMAQSSGWGVMVSHRSGETEDTFIADLVVGL

SEQ ID NO: 7823 - protein, 363 aa, Amia calva
TAKGRFRAAVPSGASTGIYEALELRDGDKSRYLGKGVQKAVDHINKDIVPKLLEKKLSVVEQEKIDNFMLELDGTENKSKFGANAILGVSLAVCKAGAAEKGVPLYRHIADLAGNAELILPVPAFNVINGGSHAGNKLAMQEFMILPVGASSFREAMRIGAEVYHNLKGVIKSKYGKDATNVGDEGGFAPNILDNHEALELLKSAIEKAGYPDKIVIGMDVAASEFHRSGKYDLDFKSPDDPKRHITGEQLGDLYKSFIKDYPVVSIEDPFDQDDWEHWAKFTGSVNIQVVGDDLTVTNPKRIKQAVDKKACNCLLLKVNQIGSVTESIQACKLAQSNGWGVMVSHRSGETEDTFIADLVVGL

SEQ ID NO: 7824 - protein, 363 aa, Latimeria chalumnae
  unsure (1)..(363): unsure at all Xaa locations
TKKGLFRAAVPSGASTGIYEALELRDADKTRFLGKGVSRAVKYVNEFLGPALCNQNVNVVEQEKIDKLLLEMDGTANKSKFGANAILGVSLAVCKAGAAEKDVPLYRHIADLAGNPEVILPVPAFNVINGGSHAGNKLAMQEFMILPSGATSFKEAMRIGAEVYHNLKNVIKEKYGKDATNVGDEGGFAPNILENKEALELLKTAIEKAGYSDKIVIGMDVAASEFYRSGKYDLDFKSPDDPKRYITXDQLGDLYKGFVKNYPVVSIEDPFDQDDWEAWKKFTASAGIQVVGDDLTVTNPKRIAKAVAEKSCNCLLLKVNQIGSVTESLEACKLAQSNGWGVMVSHRSGETEDTFIADLVVGL

SEQ ID NO: 7825 - protein, 120 aa, Latimeria chalumnae
  unsure (1)..(120): unsure at all Xaa locations
RYITGNQLGDIYQGFIKNYPVVSIEDPFDQDDWGNWTSFTGNTTIQIVGDDLTVTNPERIQKAIEKKACNCFLLKVNQIGTVTESIXACRLAQKNGWGVMVSHRSGETEDAFIADLVVGL

SEQ ID NO: 7826 - protein, 245 aa, Lepidosiren paradoxa
  unsure (1)..(245): unsure at all Xaa locations
ILPVPAFNVINGGSHAGNKLAMQEFMILPVGASTFKEAMRIGAEVYHNLKNVIKKKYGQDATNVGDEGGFAPNILENKEALELLKEAIGKAGYTDKIVIGMDVAASEFYKDGKYDLDFKSPDDSSRYITGNQLGDIYQGFIKNYPVVSIEDPFDQDDWGNWTSFTGNTTIQIVGDDLTVTNPERIQKAIEKKACNCFLLKVNQIGTVTESIXACRLAQKNGWGVMVSHRSGETEDAFIADLVVGL

SEQ ID NO: 7827 - protein, 363 aa, Lepidosiren paradoxa
  unsure (1)..(363): unsure at all Xaa locations
TDKGLFRAAVPSGASTGIYEALELRDGDKSRYLGKGVTQAVDHINKTIAPELLKHKLSVVEQEKIDKVMIQLDGTENKSKFGANAILGVSLAVCKAGAAEKGVPLYRHIADLAGNAALVLPVPAFNVINGGSHAGNKLAMQEFMILPVGASNFKEAMRIGAEVYHNLKNVIKAKYGKDATNVGDEGGFAPNILENNEALELLKSAIEKAGYPDKIVIGMDVAASEFYRSGKYDLDFKSPDDPNRYITXEQLANIYKDFISHYPVVSIEDPFDQDDWPTWKAFNSSVNIQIVGDDLTVTNPKRIQKAVDEKACNCLLLKVNQIGSVTESIQACKLAQSNGWGVMVSHRSGETEDTFIADLVVGL

SEQ ID NO: 7828 - protein, 363 aa, Neoceratodus forsteri
  unsure (1)..(363): unsure at all Xaa locations
TAKGLFRAAVPSGASTGIYEALELRDGDKSRYLGKGVTKAVNHINQTIVPALLEKKLSVVDQEKIDTLMLQLDGTENKSKFGANAILGVSLAVCKAGAAEKGVPLYRHIADLAGNTDLILPVPAFNVINGGSHAGNKLAMQEFMILPVGASNFKEAMRIGAEVYHNLKNVIKAKYGKDATNVGDEGGFAPNILENNEALELLKSAIEKAGYPDKIVIGMDVAASEFHRGGKYDLDFKSPDDPSRYITXEQLGNIYKDFVKNYPVVSIEDPFDQDDWQNWKSFTASVNIQIVGDDLTVTNPKRIQKAVEEKACNCLLLKVNQIGSVTESIQACKLAQKNGWGVMVSHRSGETEDTFIADLVVGL

SEQ ID NO: 7829 - protein, 363 aa, Chiloscyllium punctatum
  unsure (1)..(363): unsure at all Xaa locations
TGKGLFRAAVPSGASTGIYEALELRDGDKTRFLGKGVSRAVKYINQFLGPALCSQHVNVIEQEKIDKLMLAMDGTENKSKYGANAILGVSLAVCKAGAAEKGVPLYRHISHLAGNTQXILPVPAFNVINGGSHAGNKLAMQEFMILPIGAANFREAMRIGAEVYHNLKNVIKDKYGRDAINVGDEGGFAPNILENKEALELLKLAIEKAGYSDKVVIGMDIAASEFFRDGKYDLDFKSPPNPNRYVTHDKLIELYSSFIKNYPVVSIEDPFDQDDWAAWKQFTAQTTIQVVGDDLLVTNPTRIAKAVAEGACNCLLLKVNQIGSVTESIEACKLAQSNGWGVMVSHRSGETEDTFIADLVVGL

SEQ ID NO: 7830 - protein, 363 aa, Chiloscyllium punctatum
  unsure (1)..(363): unsure at all Xaa locations
TAKGHFRAAVPSGASTGIYEALELRDGDKSRYLGKGVLKAVENINKHIGPALIEKKVNVLEQEKIDELMLHLDGTDNKSKFGANAILGVSLAVCKAGAKEKGVPLYRHIADLAGNKDXVLPVPAFNVINGGSHAGNKLAMQEFMILPVGAATFKEAMRIGAEVYHNLKNVIKAKYGKDATNVGDEGGFAPNILENNEALELLKTAIEKAGYTDKIIIGMDVAASEFCRKGQYDLDFKSPDDPSRYISXEKLGDLYKSFINNYPVMSIEDPFDQDDWENWSKFTSSVSIQIVGDDLTVTNPKRIQTAVDKKACNCLLLKVNQIGTVSESIKACKLAQTNGWGVMVSHRSGETEDPFIADLVVGL

SEQ ID NO: 7831 - protein, 369 aa, Salmo trutta
VEVDLYTKKGLFRAAVPSGASTGIYEALELRDNDKTRYLGKGVSKAVDHINKTIAPALVRQNVNVLEQEKVDKLMLDMDGTENKSKFGANAILGVSLAVCKAGAAEKGVPLYRHIADLAGNPNVILPVPAFNVINGGSHAGNKLAMQEFMILPVGASTFKEAMRIGAEVYHNLKNVIKKKYGQDATNVGDEGGFAPNILENKEALELLKEAIGKAGYTDKIVIGMDVAASEFYKDGKYDLDFKSPDDSSRYITPDQLGDLYKSFVKDYPVVSIEDPFDQDDWAAWSKFTAETSIQVVGDDLTVTNPKRIAKGVADKACNCLLLKVNQIGSVTESLQACKMAQTNGWGVMVSHRSGETEDTFIADLVVGL

SEQ ID NO: 7832 - protein, 363 aa, Salmo trutta
  unsure (1)..(363): unsure at all Xaa locations
TKKGLFRAAVPSGASTGIYEALELRDNDKTRYLGKGVKRAVKHINEFLAPALCNQNVNVLEQEKVDKLMLDMDGTENKSKFGANAILGVSLAVCKAGAAEKGVPLYRHIADLAGNPNXILPCPAFNVINGGSHAGNKLAMQEFMILPIGASNFHEAMRIGAEVYHNLKNVIKAKYGKDATNVGDEGGFAPNILENNEALELLKSAIEKAGYPDKIIIGMDVAASEFYKAGKYDLDFKSPDDPARYITXDQLGDLYKSFIKGYPVQSIEDPFDQDDWAAWSKFTAAVDIQVVGDDLTVTNPKRIQQAVEKKACNCLLLKVNQIGSVTESIKACKLAQSNGWGVMVSHRSGETEDTFIADLVVGL

SEQ ID NO: 7833 - protein, 58 aa, Allium cepa
RISGLIYEETRGVLKIFLENVIRDAVTYTEHARRKTVTAMDVVYALKRQGRTLYGFGG

SEQ ID NO: 7834 - protein, 368 aa, Candida albicans
MATLKNKNNHLKACSTYTDNENHFLVDSRYEIVRVLGKGSYGVVCSAIDTKSSVSAMEHKIAIKKVTKIFNKDILLIRAIRELKFMMFFRGHKNLDVVYVKPYEGLYCFQELADLDLARVLYSNVQFSEFHIQSFMYQVLCGLKYIHSADVIHRDLKPGNILVTTQGTLKICDFGLARGINPVYFRNRSAVITNYVATRWYRAPELIMSTKNYTKAVDIWAVGCILGELFGRRPLFPGKNSHEQIHELFKIIGNPPIETIKKYNWKVEGLLWVKYRPVKWKSLYPFAPLNALELLDSLLQWDYKARLGVEQILEPEFFKNLRNVHGEPSSKAIFDFSFEEKGKSIPQLKEILETEVRVFKEISKTGIE

SEQ ID NO: 7835 - protein, 372 aa, Candida albicans
MKKFTGPTQTRQVVFNISQNFKVLKILGEGAYGIVALAVHLPTETKVAIKKIEPFERPLFCLRTLREIKLLTKFKNHDNIVRLYDVQKPMNYDSFNEVYLIQGYMPSDLHNLIHTHLLSDQHVQYFIYQILKGLKMIHSARVIHRDLKPSNILVNEKCDLKICDFGLARLDTKHYNFDEAPRISMLTEYVATRWYRAPEIMLSASNYSTAIDLWSVGCILAELLTYRALFPGSDYINQLKLIFEVLGTPTDEDLQIIKSERAQKFIRSLPTKVKIDLSEFINNHPYRNIKHRGRDQVNPLAIDLLEKLLVFDPAKRITVQDALEHPYLNSYHEQLDEPVTSPIPIEEFDFDIDKKNLDTNDLKKQIFEIVMS

SEQ ID NO: 7836 - protein, 161 aa, Homo sapiens [sequence omitted]

SEQ ID NO: 7837 - protein, 270 aa, Zea mays; identical to SEQ ID NO: 6348

SEQ ID NO: 7838 - protein, 237 aa, Nicotiana tabacum
MTESSSSQSESASSDSLPFDFLSDSFDFEADFFQFGDEVSNSSSESANSVHNSTNFIMLELEPTISSSDYEKPQVIIDLTSPKLSNVSDRKPSLKIDLPPVKKFEWIGFCNSTTQSNSIVSVTMQQKRKTEEKRHYRGVRQRPWGKYAAEIRDPTRRGARVWLGTFNTAVEAAKAYDRAAFKMRGSKAILNFPLEVGKNLSYSSSAVDGGVKRRKESDACGEEKGVKKVERCKEEES

SEQ ID NO: 7839 - protein, 183 aa, Nicotiana tabacum
MLASNNPKKRAGRKKLRETRHPVYRGVRKRNSGKWVCEVREPNKQSRIWLGTFPSAEMAVRAHDVAAIALRGRSACLNFADSAWKLHIPASTDAKDIQKAAAEAAEAFRTSEAENMPEYSGEDSKEVNSTPENMFYMDEEALFCMPGLLANMAEGLMLPPPQCSQIGDHMEDDFDMPLWSYSI

SEQ ID NO: 7840 - protein, 219 aa, Nicotiana tabacum
MDIFRSYYSDPLAEYSSISDSSSSSCNRANHSDEEVMLASNNPKKRAGRKKFRETRHPVYRGVRKRNSDKWVCELREPNKKSRIWLGTFPSAEMAARAHDVAAIALRGRSACLNFADSAWKLPIPASTDAKDIQKAAAEAAEAFRSSEAENMPEYSGEDTKEVNSTPENMFYMDEEALFFMPGLLVNMAEGLMLPPPQCSQIGDHMEADVDMPLWSYSI

SEQ ID NO: 7841 - protein, 256 aa, Nicotiana tabacum
MGSGKLGESGMIELTAKIMMVVIIFLFLVVVFIFFLHLYTKWFWRYRQEDTGNPNGGTRRRRRRRFNFAGGYQEVNVLRRGLDPSVLKTIPVVPFNMKDFKDGLECSVCLSEVSEGENTRVLPKCNHGFHVDCIDMWFHSHSTCPLCRNPVSEQSAESISETIGSSVEEGSASTETQNIPTNVLFWGDETSTTSSASTSNRPEGILVIDIARQNTEQEEEEGQKTPTSTRLRSLTRLFSRVNPCNVDVEQGSRSQS

SEQ ID NO: 7842 - protein, 373 aa, Arthrobotrys dactyloides
MASPTPPNSTASPKPQAPPSQVQACRYKTGKTLGSGSYSVVRECVHIHTGRYYAAKIINQKLMAGREHMVRNEIAVLKKVSMGHQNILTLVDYFETMNNLYLVTDLALGGELFDRICRKGSYFESDAADLIRATLSAVAYLHDHGIVHRDLKPENLLFRTPEDNADLLIADFGLSRIMDEERFHVLTTTCGTPGYMAPEIFKKTGHGKPVDIWAIGVITYFLLCGYTPFDRDSNLEEMQAILKADYKFEPAQYWSDISENAKDFIRRCLTIDPKARPTAHAALEHPFICEDQPEREADLLPTVRKNFNARRTLHAAIDTIRAINKLREGGMMDGALSSAPENQKEKQPQNQPATGLWQGTAQAATAKGLWSKS

SEQ ID NO: 7843 - protein, 513 aa, Apium graveolens var. dulce
MITGEVSVDSYDTNKPKPKRNKYAFACALLASMNSILLGYDTGVLSGASIYIKEDLHFSDVQIEIIIGIINIYSLLGSAIAGRTSDWIGRRYTMVLAGIIFFLGAIFMGLATNFAFLMFGRFVAGIGVGYAMMIAPVYTAEVAPSSSRGFLTSFPEVFINSGVLLGYVSNFAFAKCPLWLGWRIMLGIGAFPSVALAIIVLYMPESPRWLVMQGRLGEARTVLEKTSTSKEEAHQRLSDIKEAAGIDKDCNDDVVQVPKRTKDEAVWKELILHPTKPVRHAAITGIGIHFFQQACGIDAVVLYSPRIFEKAGIKSNSKKLLATIAVGVCKTVFILISTFQLDKIGRRPLMLTSMGGMVIALFVLAGSLTVINKSHHTGHWAGGLAIFTVYAFVSIFSSGMGPIAWVYSSEVFPLRLRAQGCSIGVAVNRGMSGIIGMTFISMYKAMTIGGAFLLFAVVASIGWVFMYTMFPETQGRNLEEIELLFGSYFGWRKTLKDLKAKEAAEAKSRESEV

SEQ ID NO: 7844 - protein, 495 aa, Pisum sativum
MALQVLTLPSWVTLFTTFAILLLFSRRLRRRQYNLPPGPKPWPIIGNFNLIGTLPHQSLHGLTQKYGPIMHLWFGSKRVVVGSTVEMAKAFLKTHDATLAGRPKFSAGKYTTYNYSDITWSQYGPYWRQARRMCLLELFSAKRLESYEYIRKQELHVFLHELFDSRNKTILLKDHLSSLSLNVISRMVLGRKYLEKVENSIISPDEFKNMLDELFLLNGILNIGDFIPWIHFLDFQGYVKRMKVLSKKFDGFMEHVLEEHIERRKGVKDYVAKDMVDVLLQLAEDPDLEVKLERHGVKAFTQDLIAGGTESSAVTVEWAISELIRKPEIFKKATEELDRVIGRERWVEEKDIANLPYVYAIAKETMRLHPVAPMLVPREAREDCNINGYDIPKGSLILVNTWTIARDSNVWDNPNEFMPERFLGKDIDVKGHDYELLPFGAGRRMCPGYPLGIKVIQSSLANLLHGFNWRLSDDVKKEDLNMEEIFGLSTPKKIH

SEQ ID NO: 7845 - protein, 356 aa, Gaeumannomyces graminis
MSRAANPPSNSGSRKISFNVSEQYDIQDVVGEGAYGVVCSAIHKPSGQKVAIKKITPFDHSMFCLRTLREMKLLRYFNHENIISILDIQKPRSYETFNEVYLIQELMETDMHRVIRTQDLSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFRTLFPQDVGSRLDLLEKLLAFNPVKRITVEEALKHPYLEPYHDPDDEPTAPPIPEEFFDFDKHKDNLSKEQLKQFIYQEIMR

SEQ ID NO: 7846 - protein, 63 aa, Pfiesteria piscicida
MRGILVDWLVEVHLKYKLKAETLYLTVNLIDRYLEVQQVVHGELQLVGVTAMLIASKYEEIYP

SEQ ID NO: 7847 - protein, 63 aa, Cryptoperidiniopsoid sp. brodyi
MRGILADWLVEVHLKFKLVPETLYLTVNIIDRFLQIHKVSRPKLQLVGVTSLLIASKYEEIYP

SEQ ID NO: 7848 - protein, 522 aa, Synechococcus sp. WH 7803
MLGELWSFQGRYRTLHLTWFAFFLTFVVWFNLAPLATTVKADLGLTVGQIRTVAICNVALTIPARVLIGMLLDKFGPRLTYSTLLVFSVIPCLMFASAQDFNQLVVARLLLSIVGAGFVIGIRMVAEWFPPKEIGLAEGIYGGWGNFGSAFSALTLVGLAGWLSFSGGFTLPTGDVLNWRGAIALTGIISAVYGVIYYFNVSDTPPGKVYQRPERTAGLEVTSMRDFWGLLGMNVPFAAILCVLCWRLQKVGFLNASTYPLALLAVLVWFVFQTWGIIRTNRDLIMGTKVYPKEDRYEFKQVAILELTYIVNFGSELAVVSMLPTFFETTFDLPKATAGILASCFAFVNLVARPAGGLISDKLGSRKNTMGFLTAGLGVGYLIMSLIKPGTFTGTTGIVIAVLITMLASFFVQSGEGATFALVPLVKRRVTGQVAGLVGAYGNVGAVTYLTIFSLLPLWMGGAGEPTAETIAASNSAFFQILGIAGLIVAFFCFFFLKEPKGSFAELHEGETAAEGTPSMAR

SEQ ID NO: 7849 - protein, 755 aa, Bradyrhizobium japonicum
MRSASGGPRVLLRRLRETMAEQVSAQERLDKIVVLIAANMVAEVCSVYVLRIDNTLELYATEGLNREAVHHTVLSAHEGLVGLVASEATPLNLNDAQSHPAFSFRPETGEEIYHSFLGVPILRAGNTLGVLVVQNRAKRTYVEEELEALQTTAMVLAELIASGELSALAQPGLEPAARHSMQKVGAILSEGIALGHVVLHEPRVVIKDYIAEDLPKEIKRLDTALAKLRADLDRMLERGDVAEGGEHREVLEAYRMFANDQGWSHKLHEAVATGLTAEAAVERVQSDTRARMLRSTDPYLRDRLHDLEDLGYRLMRQLVGQDHAPSREQLPDNAIVIARAMGPAALLDYNRKRLRGIVLEEGTANSHVSIVARALGIPAVGEVPNAPGIADPGDAIIVDGTSGSIYVRPSQEIEAAFAERVRFRARRQAQYLALRDRPCVTKDGQKVELMINAGLAIDLPHIEDTGSAGIGLFRTELQFMVGQSLPRTSDQLALYRTVLDAAGTKPVTFRTLDIGGDKALPYMEAVIEENPALGWRAIRLGLDRPGLLRGQIRALLRAGGGRALRIMFPMISEVAEFDAAKALVERELTYLRQHGHTLPERIDIGTMVEVPALLYQLDELLKKVDFISVGSNDLFQFLFAVDRGNAKVSERFDTMSAPILRALRDIARKSHAAQKSLSLCGEMASKPIGALALIAMGYRSLSLSATALGPVKAMVIDLDAKKAEAMLGPLLDAPSGSVSIRQKLTEFAEAEGLAL

SEQ ID NO: 7850 - protein, 432 aa, Nicotiana glutinosa
MAGQTIIVSGLNPAAILQSTIGGGASPTAAAAENGTRKVIPLSRDALQDFMLSIITQKLQDEKQPFYVLDLGEVVSLMDQWKSSLPNIRPFYAVKCNPEPSFLSILSAMGSNFDCASRAEIEYVLALGISPDRIVFANPCKPESDIIFAAKVGVNLTTYDSEDEVYKIRKHHPKSELLPRIKPMFDGNARCPMGPKYGALPEEVEPLLRAAQAARLTVSGVSFHIGSGDADSNAYLGAIAAAKEVFETAAKLGMSKMTVLDVGGGFTSGHQFTTAAVAVKSALKQHFDDEPELTIIAEPGRFFAETAFTLATTVIGKRVRGELREYWINDGLYGSMNCVLYDHATVNATPLAVLSNRTNVTCGGSKTFPTTVFGPTCDALDTVLRDYQLPELQVNDWLVFPNMGAYTKAAGSNFNGFNTSTIVTHLAYTYPS

SEQ ID NO: 7851 - protein, 202 aa, Sinorhizobium meliloti
MSGATLEAYLASCTARGDDLSRDVAAVIQRLAKAALDIRKLVNQGALGTAFNGTHGGSNTDGDLQKDLDILCDDQFLTCLQGAPVACYASEELENPVLLDPSARLAVAIDPLDGSSNIDNNVSIGTIFSVLPAAKGPDVDPSQSFLQPGNRQLAAGFFIYGPQTALVLSLGKGTEIFIFSSRLGCFVEAYKSAIIPERAHEF

SEQ ID NO: 7852 - protein, 386 aa, Chlamydomonas reinhardtii
MRTSLWGHAQSGKMVFQFLTAAVVMVLATPAAAWHGSSSRYTAYPGYIINTPAIACWTGWFTYTTNLTACLTPVEANGINNKADGLASICTNYVPGCLSFHLDTGMFYASNDIALLQASPADNVYLKSLSPPSPMPPKPSSPPSPTPPSPMPPSPAPPSPAPPSPLPPSPVPPSPAPPSPAPPSPAPPSPAPPSPRPPSPVPPSPAPPSPLPPSPAPPSPAPPSPEPPSPAPPSPEPPSPEPPSPAPPSPEPPSPEPPSPAPPSPAPPSPVPPSPAPPSPVPPSPPPPSPSPPTPIITNGQGTGQQQISSGGATPGPVSGAATLTTSAGNDDVVIPILAVLVPCVVLSMIGVFTWWMLRQRRLKAAATGVTSGAAAPQPQQGEGRV

SEQ ID NO: 7853 - protein, 448 aa, Rattus norvegicus
MKGFIDDANYSVGLLDEGTNLGNVIDNYVYEHTLTGKNAFFVGDLGKIVKKHSQWQNVVAQIKPFYMVKCNSTPAVLEILAALGTGFACSTKNEMALVQELGVSPENIIYTSPCKQASQIKYAAKVGVNIMTCDNEVELKKIARNHPNAKVLLHIATEDNIGGEDGNMKFGTTLKNCRHLLECAKELDVQIIGVKFHISSACKEYQVYVHALSDARCVFDMAGEFGFTMNMLDIGGGFTGTEIQLEEVNHVISPLLDIYFPEGSGIQIISEPGSYYVSSAFTLAVNIIAKKVVENDKLSSGVEKNGSDEPAFVYYMNDGVYGSFASKLSEDLNTVPEVHKKYKEDEPLFTSSLWGPSCDELDQIVESCLLPELSVGDWLIFDNMGADSLHGPSAFSDTQRPAIYFMMSLSDWYEMQDAGITSDAMMKNFFFAPSCIQLSQEDNFSTEA

SEQ ID NO: 7854 - protein, 655 aa, Rattus norvegicus
MDPVRQIQCDREGKRFPFLSAPPASTSSPDRAMEGYHKPDQQKLQALKDTANRLRISSIQATTAAGSGHPTSCCSAAEIMAVLFFHTMRYKALDPRNPHNDRFVLSKGHAAPILYAVWAEAGFLPEAELLNLRKISSDLDGHPVPKQAFTDVATGSLGQGLGAACGMAYTGKYFDKASYRVYCMLGDGEVSEGSVWEAMAFAGIYKLDNLVAIFDINRLGQSDPAPLQHQVDVYQKRCEAFGWHAIIVDGHSVEELCKAFGQAKHQPTAIIAKTFKGRGITGIEDKEAWHGKPLPKNMAEQIIQEIYSQVQSKKKILATPPQEDAPSVDIANIRMPTPPNYKVGDKIATRKAYGLALAKLGHASDRIIALDGDTKNSTFSELFKKEHPDRFIECYIAEQNMVSIAVGCATRDRTVPFCSTFAAFFTRAFDQIRMAAISESNINLCGSHCGVSIGEDGPSQMALEDLAMFRSVPMSTVFYPSDGVATEKAVELAANTKGICFIRTSRPENAIIYSNNEDFQVGQAKVVLKSKDDQVTVIGAGVTLHEALAAAEMLKKEKIGVRVLDPFTIKPLDKKLILDCARATKGRILTVEDHYYEGGIGEAVSAVVVGEPGVTVTRLAVSQVPRSGKPAELLKMFGIDKDAIVQAVKGLVTKG

SEQ ID NO: 7855 - protein, 246 aa, Oryza sativa (indica cultivar-group)
MGRGKVQLKRIENTINRQVTFSKRRSGLLKKANEISVLCDAEVALIIFSTKGKLYKYATDSCMDKILERYERYSYAEKVLISAESDTQGNWCHEYRKLKAKVETIQKCQKHLMGEDLESLNLKELQQLEQQLENSLKHIRSRKSQLMLESINELQRKEKSLQEENKVLQKELVEKQKVQKQQVQWDQTQPQTSSSSSSFMMREALPTTNISNYPAAAGERIEDVAAGQPQHVRIGLPPWMLSHING

SEQ ID NO: 7856 - protein, 515 aa, Daucus carota
MENGTKELNKPQPPSSAAMQLQTPVQKIPTATWKLVLVAAIAAGVQFGWALQLSLLTPYVQLLGIPHKWAAYIWLCGPISGMLVQPIVGYYSDHCQSSFGRRRPFIASGAGCVAISVILIGFAADISYKAGDDMSKTLKPRAVTVFVIGFWILDVANNMLQGPCRALLADLCSGDTRRMRSANAFYSFFMAVGNILGYAAGSYNNLYKLFPFSKTHACDLYCANLKSCFIISIALLIIITVVALSVVRENSGPPDDADAAEEPPSSGKIPVFGELLGALKDLPRPMLLLLIVTCLNWIAWFPFILFDTDWMGREIYGGTAGKGKLYDQGVRAGALGLLLNSVVLGLTSIAVEYLVRGVGGVKILWGFVNFILAIGLVMTVVVSKVAQHQREHSANGQLLPPSAGVKAGALSLFSILGIPLSITYSIPFALASIYSSGSGAGQGLSLGVLNLAIVVPQMIVSVLAGPFDSLFGGGNLPAFVVGAISAAISGVLAIVLLPKPSKDAASKLSLSGTYH

SEQ ID NO: 7857 - protein, 299 aa, Oryza sativa (japonica cultivar-group)
MCDSLFWQSSADQGDLSDVVRASLQLQTAPRHQAASPPYVHLLGGGGGGGEDQLAAVSQHAEQQQQSMVDASAACDLLHALLPPPPVVQVQQQGASRTRTTIEEDTTGDGEELFAGAHYVVPPIKRRKSQTKKVVCIPAGASGGGGGEVVPSDLWAWRKYGQKPIKGSPYPRGYYRCSSSKGCSARKQVERSRADPTMLVVTYTSDHNHPWPTHRNALAGSTRPSSSNSSNIRLQDSTPVHHQSQTGHDRLTTTHLKQEDVIISPSLLQPDHHQLCTIIDTKHHLLFHQDYPHSFGLFD

SEQ ID NO: 7858 - protein, 810 aa, Oryza sativa (japonica cultivar-group)
MATLPDLGVSAFINILGAFVFLLIFAALRLQPINDRVYFPKLYLTGQRRHHPHPHGFVNLDLCSYLRFLAWVPGALRMSQPDLIHHAGLDSAVYLRIYTLGLKIFLPIMTVALLVLIPVNVSGGTLLNLRKEIVFSDIDKLSISNVNPGSNRFFIHLLMAYVFTFWTCFMLYKEYSNVAFMRLHFLASQKRCADQFTVIVRNIPHVSSHSTSETVDEFFRRNHPDHYLGQQAVYNANRYAKLVKKKERLQNWLDYYQLKFERHPGKRPIGRTGCLGFCGREVDQIDYYRARISELDKKLASERQRVLNDPKAVMPVAFVTFDSRWGAAVCAQTQQSKNPTQWLTDWAPEPRDVYWQNLAIPFFSLSIRKFLISIAVFALVFFYMIPIAFVQSLANLEGIEKVAPFLRPVIDTPVVKSFLQGFLPGLALKIFLYILPTVLMIMSKVEGYVSLSSLERRAASKYYYFMLVNVFLGSIIAGTAFEQLNAFFHQPPSQIPRTIGVAIPMKATFFMTYIMVDGWAGIANEILRVKPLVIYHLKNMFIVKTERDRERAMDPGSIGLAENLPSLQLYFLLGLVYAVVTPILLPFIIIFFAFAFLVYRHQIINVYNQEYESAAAFWPQVHSRIIASLLISHVTLFGLMSTMKAAYSTPLLIFLPLLTIWFHKYCKSRFEPAFRKYPLEEAMEKDNLERTSEPNLNLKSYLQNAYLHPIFHMFEQQQQQEQEQQREEKVEVRIDKAQQHHHRQVEEEEEESKSSQATTHYYHHHHEQTTTTTHHHYHQHEHMSHYHMGPSDTADSPSPPHFVYHYGVDP

SEQ ID NO: 7859 - protein, 976 aa, Pisum sativum
MEHLKKSPSSSSSSSMRPSFPRDPRGSLEVFNPTSNSSSPVRSPSNLKNWTEIEEPRNELSEQHNEFSDEVTNTSWMAIKEGETGAAVQRAAEWGLMLTTDAETGKPQGVAVRNSGGDEPSVKLETKRNSNNTVRTSGESSDGDDPRGFPRVSEDLKDALSAFQQTFVVSDATKPDYPILYASAGFFKMTGYTSKEVIGRNCRFLQGADTDPDDVARIREALEGGKSFCGRLLNYKKDGTPFWNLLTISPIKDDDGNVLKLIGMLVEVNKHTEGSKEKKLRPNGLPESLIRYDARQKEKATSSVSELLEAMKRPRALSESGQRPFIRKSGGGGGSEEDEEAVENKSRRKSDSVASFRPKPQGKIRHSMERISELPENKQKNSRRGSFMGFMRKSDSIDESIDNEVIVDVSSGSEDDERDDSFEFDDKEKLREKRKGLDLATTLERIEKNFVITDPRLPDNPIIFASDSFLELTEYSREEILGKNCRFLQGPETDPATVRKIREAIDNQTEVTVQLINYTKSGKKFWNLFHLQPMRDHKGEVQYFIGVQLDGSQHVEPLHNCIAEDTAKEGELLVKETAENVGEAVKELPDANQKPDDLWMNHSKVVRPKPHRKDDDAWRAIQKVLENGEQVGLKHFRPIKPLGSGDTGSVHLVELEGTGQYFAMKAMDKGVMLNRNKVHRACTEREILDMLDHPFLPALYASFQTKTHVCLITDYYPGGELFLLLDQQPTKVLKEDSVRFYAAEVVIALEYLHCLGIIYRDLKPENVLIQSNGHVSLTDFDLSCLTSCKPQLILPAIEEKKKRKKKKNKGQQKNQQVPMFMAEPMRASNSFVGTEEYIAPEIITGSGHTSAVDWWALGILLYEMLYGYTPFRGKTRQKTFANILHKDLKFPKSKPVSPHGKQLIYWLLHRDPKNRLGSLEGANEIKNHPFFKNINWALVRCTKPPELDGPILLDNDEKKEAKEIDPGLDDLQKNIF

SEQ ID NO: 7860 - protein, 353 aa, Botryotinia fuckeliana
MGCGMSTEEKEGKARNEEIENQLKRDKMLQRNEIKMLLLGAGESGKSTILKQMKLIHEGGYSRDERESFKEIIFSNTVQSMRVILEAMESLELPLDDQRAEYHVQTIFMQPQQIEGDNLPPEVGSAIAALWKDAGVQDCFKRSREYQLNDSARCYFDNIERIAQHDYMPNDQDVLRSRVKTTGITETTFIIGDLTYRMFDVGGQRSERKKWIHCFENVTTILFLVAISEYDQLLFEDETVNRMQEALTLFDSICNSRWFIKTSIILFLNKIDRFKEKLPVSPMKNYFPDYEGGDDYALACDYILNRFVSLNQHETKQIYTHFTCATDTTQIRFVMAAVNDIIIQENLRLCGLI

SEQ ID NO: 7861 - protein, 497 aa, Mycoplasma genitalium
MSTDKKTLGEKPNSTKPELSEELIAELKKQRILEKNRPYKKMIYVDNKVQRKHRHENIAFLKTLHENKESDVPKKRRGRKPKHAPLKEKNNLKLFDILEGSLKSHIENDDTNTVINLLTEAWEKKSKKKQKNITLSNKEIISVLAKFELPEDEIIYVLDELRDKGIQLQHDVEEHIHEFRANQDLSIIDEDIEELTSKNISNRDKVDDNVRFFLGSLDFSKMLDFESEQRIAKVLNSTDEESRKYAINQLVTSNLRLVVSIAKKHLERGLDFNDLIQEGNLGLLKAISKFNWSLGNKFSTYATWWIKQAITRAIADQARTVRIPVHMVETINRLAKAERALYQELGREPTDEELAEKMGGQAEGFNVKKIAEIKRLSLDPVSLDKTVGHDEESQFGDFVKDTDAQTPDEFTESRSNSEKIDELLNNNLSEQEELIVRMRIGMPPYNEPKTLDEVGQKILIPREKIRQIENKAIRKLRHAVRNNPISMSFLRINEKKD

SEQ ID NO: 7862 - protein, 458 aa, Mycoplasma genitalium [sequence omitted]

SEQ ID NO: 7863 - protein, 572 aa, Mycoplasma genitalium
MKKIIGIGVSDGIAVAKAFIIQTPQFDVKKYTNVKMTPTQAKKLLSSAFQKAKKDLEEIKTITVKNINQEAGMIFDAHIQILNDPTITEQLEQQLNKNIHPVIAVDNVFQQTALMFSEMDDKYFKERASDILDLHQRLLSYLTGVKLNDLIRIKSDVIIVANDLTPSQTATLNKKYVKGFLTESGGKTSHAAIMARSMEIPAIVGLKNITSKVEDGKTVGINGRKGIVGFDFSSKDITQWKQEKELESNFQNELKQYTNKLVKTLDGYEVIVASNIGNVKDMDLAVEYNTNGIGLFRTEFLYMSSQDWPDESVQFEAYKTVLQKAKNDLVIIRTLDIGGDKKLNYFQFPHEDNPFLGYRAIRLTLDKQAVFKTQLRALLRASDYGNLGIMFPMVATLDELVQVKQLLTKVQQEFNETKKFKLGIMIEIPSAALAADCLGKHVDFFSIGSNDLIQYSFAADRMNKNVSYLYQPLNPALLRLIKLVVEGGKLNNVWTGMCGEMASDQYAIPLLLGLGLTELSMSASSMFKARMVIAKITINECKSLVEKALKLTSDSAVRKLVENFFKKKNIFI

SEQ ID NO: 7864 - protein, 167 aa, Homo sapiens
MAKYQGEVQSLKLDDDSVIEGVSDQVLVAVVVSFALIATLVYALFRNVHQNIHPENQELVRVLREQLQTEQDAPAATRQQFYTDMYCPICLHQASFPVETNCGHLFCGACIIAYWRYGSWLGAISCPICRQTVTLLLTVFGEDDQSQDVLRLHQDINDYNRRFSGQP

SEQ ID NO: 7865 - protein, 626 aa, Homo sapiens
MMANDAKPDVKTVQVLRDTANRLRIHSIRATCASGSGQLTSCCSAAEVVSVLFFHTMKYKQTDPEHPDNDRFILSRGHAAPILYAAWVEVGDISESDLLNLRKLHSDLERHPTPRLPFVDVATGSLGQGLGTACGMAYTGKYLDKASYRVFCLMGDGESSEGSVWEAFAFASHYNLDNLVAVFDVNRLGQSGPAPLEHGADIYQNCCEAFGWNTYLVDGHDVEALCQAFWQASQVKNKPTAIVAKTFKGRGIPNIEDAENWHGKPVPKERADAIVKLIESQIQTNENLIPKSPVEDSPQISITDIKMTSPPAYKVGDKIATQKTYGLALAKLGRANERVIVLSGDTMNSTFSEIFRKEHPERFIECIIAEQNMVSVALGCATRGRTIAFAGAFAAFFTRAFDQLRMGAISQANINLIGSHCGVSTGEDGVSQMALEDLAMFRSIPNCTVFYPSDAISTEHAIYLAANTKGMCFIRTSQPETAVIYTPQENFEIGQAKVVRHGVNDKVTVIGAGVTLHEALEAADHLSQQGISVRVIDPFTIKPLDAATIISSAKATGGRVITVEDHYREGGIGEAVCAAVSREPDILVHQLAVSGVPQRGKTSELLDMFGISTRHIIAAVTLTLMK

SEQ ID NO: 7866 - protein, 264 aa, Hypocrea jecorina
MGHEDAVYLAKLAEQAERYEEMVENMKIVASEDRDLTVEERNLLSVAYKNVIGARRASWRIVTSIEQKEESKGNSSQVALIKEYRQKIEAELAKICDDILEVLDQHLIPSAKSGESKVFYHKMKGDYHRYLAEFAIGDRRKDSADKSLEAYKAATEVAQTELPPTHPIRLGLALNFSVFYYEILNAPDQACHLAKQAFDDAIAELDTLSEESYKDSTLIMQLLRDNLTLWTSSEAETSAGQVEAPPKEDTPAEAAAPAEEPKAE

SEQ ID NO: 7867 - protein, 272 aa, Hypocrea jecorina
MATERESKTFLARLCEQAERYDEMVTYMKEVAQLGGELSVDERNLLSVAYKNVVGTRRASWRIISSIEQKEESKGSDKHVATIKEYRSKIELELEKVCEDVLNVLDTSLIPNAATGESKVFYHKMKGDYHRYLAEFASGEKRKVAATAAHEAYKNATDVAQTELTPTHPIRLGLALNFSVFYYEILNSPDRACHLAKQAFDDAIAELDSLSEESYRDSTLIMQLLRDNLTLWTSSDSGEAEQAGEAKKDEGEAAKPAEEEPKAEEPAPEATS

SEQ ID NO: 7868 - protein, 1145 aa, Pinus sylvestris
MVSISSDQACTIPKLYANFFLGSDIEFVRPDGRPEFFNADRFLSYYHSMTFAVNQEGQALLPGRKLLAMELHEPFFESWDPRHENPCKWTGVICSLDHENLVTEINIQSVQIAGNVPSQFAVLGSLRSLVISAANLTGSIPAEIGGYESLEILDLSGNRLRGNIPAEISKLKNLKSLILNSNQLQGSIPAEIGNCHNLVDLVVFDNQLSGKIPAELGRLANLEVFRAGGNENIEGTLPDELSNCTNLVTLGLAETNISGKIPLSFGSLKKLQTLAIYTAFLSGTIPAELGNCSELVNLYLYENRLSGAIPRELGKLQKLEKLYLWDNELDGSIPAELGSCSSLKFVDLSTNSLSGSIPDSFGSLKNLSELEITDNNVSGSIPAALANCTELTQIQLYNNQISGQMPAELGALKKLTVLFLWQNNLEGPIPSSLGSCDNLQSLDLSHNRLTGSIPPSLFEIKNLTKLLLLSNELTGALPPEIGNCVALSRLRLGNNRLLNQIPREIGKLENLVFLDLAMNQFSGSIPAEIGGCSQLQMLDLHGNRLGGELPRALGFLHGLQVVDLSANELTGLIPANLGNLVALTKLTLNGNALSGAIPWEISRCTNLQLLDLSLNRFSGQIPPEMGKCKRLEIALNLSWNNLSGSIPAQFSGLTKLASLDLSHNLLSGNLSALAQLSESCFSQHFFQRFFRVSARYQVFSDLCLPSDLSGNAALCTSEEVCFMSSGAHFEQRVFEVKLVMILLFSVTAVMMILGIWLVTQSGEWVTGKWRIPRSGGHGRLTTFQKLNFSADDVVNALVDSNIIGKGCSGVVYKAEMGNGDVIAVKKLWTGKESECEKVRERDSFSAEVNTLGAIRHRNIVRLLGCCTNGRSKLLMYDYMPNGSLGGLLHEKRSMLDWEIRYNIVLGVRRGLSYLHHDCRPPILHRDVKANNILLGSQYEPYLADFGLAKLVDSADFNRSSTTVAGSYGYIAPEYGYTMKITQKIDVYSFGVVLLEVVTGKQPIDPTIPEGVHLVEWARDAVQSNKLADSAEVIDPRLQGRPDTQIQEMLQVLGVAFLCVNSNPDERPTMKDVAALLKEIRHDCHDYNGKADLLLKQTPAPGSTRSPNPTADARSPVGSSFGLEYSSASTTAHESYSLHSSVSNVI

SEQ ID NO: 7869 - protein, 48 aa, Sus scrofa
LTNRGIAQMLEKYQQGDFGYCPRVYCENQPMLPIGLSDIPGEAMVKLY

SEQ ID NO: 7870 - protein, 440 aa, Trypanosoma brucei
MSDVPKSQVGTDAKVAVAKKYTGEYYVKGMVGDKKSFAIEHSRGRQKKHTVNEFCVGDAIGRGAFAEVFQCWRPEEPHIVYAMKKIRKDLIAKRKQSLNVHTERDLLSDAEHRKLRQKRVSCPWITDLVVAFQDQDFLYIVTEYCSGGDLISWLIRYDVFPEETARFYFVELVLALNALHKMGYVHRDVKPDNVLIDREGHVKLADFGLSKRDPDQAESTSVADDSYLTEDVTVDDDVKKRFRIKRKERSWFFSTVASPAYIAPEVLIGRGYDYSCDWWSAGVILYEMIFGYPPFFNDNNTATAKKIIQFKEHLEFPKDQTTVSKEGIDLISHLIADSKERYGFEEIIRHPFCKGVPLTDSIRNEEAPFSVVLNDPKDLQYFEPAPDNADIQKQPMTAVSREDQSVFVGFTSKLCDRNQSTTCSRALGRFHELQNFSDDD

SEQ ID NO: 7871 - protein, 463 aa, Pseudomonas fluorescens
MGIKVLLVEDDRSLREALADTLLLAGHDYHAVGSAEEALNAVEREAFSLVVSDVNMPGMDGHQLLGLLRARQPQLPVLLMTAHGAVERAVDAMRQGAADYLVKPFEPKALLDLVARHALGSLVASDAEGPVAVEPASAQLLDLAARVARSDSTVLISGESGTGKEVLARYIHQQSHRASQPFIAINCAAIPDNMLEATLFGHEKGSFTGAIAAQAGKFEQADGGTILLDEISEMPLGLQAKLLRVLQEREVERVGARKPITLDIRVVATTNRDLAGEVAAGRFREDLYYRLSVFPLAWRPLRERTADILPLAERLLAKHVNKMKHAMAKFSSEAQACLIGYPWPGNVRELDNAVQRALILQQGGLIQPQDFCLSGPALFAPLPAVVPVAPVIREVEIEVDSAGALGDDLRRREFQMIIDTLRTERGRRKEAAEKLGISPRTLRYKLAQMRDAGMDVEGYLFAT

SEQ ID NO: 7872 - protein, 261 aa, Solanum tuberosum
MAAGRWNLEGCTALVTGGSRGIGYGIVEELASLGASVYTCSRNQKELNECLTQWRSKGFKVEASVCDLSSRSEREEFIKNVANHFDGKLNILVNNAGIVIYKEAKDYTMEDYSLIMSINFEAAYHLSVLAHPLLKASQRGNVVFISSISGASALPYEAVYGATKGAMDQLTRCLAFEWAKDNIRVNGVAPGVIASSMVEMTIQDPEQKENLDKLIDRCALHRMGEPKELAAVVAFLCFPAASYVTGQIIYVDGGFMANGGF

SEQ ID NO: 7873 - protein, 355 aa, Botryotinia fuckeliana
MMCFGSREDVEAKRSKEIDALIHRDEKVMQRQVKLLLLAGAGESGKSTILKQMRLIYTDKGFSKTEKEEWRIIIFHNILDGLRMTVEAMNDFNTPFEHENTKQYLPMITEEKDLRPCEPIPLEYLKAFKDMWADSGIQKTVERGNEFALHDNLGYFFEDLDRLFSKEFVPTDQDVLRARLRTTGITETHFDLGSLQYRMFDVGGQRSERKKWIHCFENVNALLFLVAISGYDQCLAEDKDENQMQEALMLWESIANSHWFKHSALILFLNKIDLFKAKIGHSPITKFGFSDFQGDTTSWQQTSKYFMDKFIALNRSPGREVYGHFTNATDTDLLKVTMSSVQDMIIQRNLQKLIL

SEQ ID NO: 7874 - protein, 293 aa, Schizosaccharomyces pombe
MPFIKAVKSSPYFSRYQTKYRRREGKIDYYARKRLIAQAKNKYNAPKYRLVVRFSNRFVTCQIVSSRVNGDYVLAHAHSSELPRYGIKWGLANWTAAYATGLLVARRALAKVGLADKYEGVTEPEGEFELTEAIEDGPRPFKVFLDVGLKRTSTGSRVFGAMKGASDGGLFIPHSPNRFPGFDIETEELDDETLRKYIYGGHVAEYMEMLIDDDEERYQKQSSGLIADGIESDQLEDIYAEAYAKIREDPSFQKSGKDAAAFKAESLKHTQRKLTAEERKERFNAKVIEAGRA

SEQ ID NO: 7875 - protein, 974 aa, Zea mays; identical to SEQ ID NO: 1202

SEQ ID NO: 7876 - protein, 105 aa, Thermosynechococcus elongatus
MPEILPLSETDPHDFWMQQAIALAEQAGAADEVPVGAVIVSAENELIATGENRRQRDHDPTAHAEIIALRRAGQRLGTWYLTGCRLYVTLEPCPMCAGAIVQARI

SEQ ID NO: 7877 - protein, 484 aa, Artemia franciscana
MAGVFDIELHEPDDTAHLTIQSELQSDEDSIEVEDVSMLDQGSYYETFVNQPDVEAIPISEQNVNQGKEKTGPQDFELRKVLGKGGYGKVFQVRKLTGQDSGHTFAMKVLKKATIVRNQKDTAHTKAERNILEAVKHPFIVDLIYAFQTGGKLYLILEYLSGGELFMHLEREGIFMEDTACFYLSEIILALEHLHHQGIIYRDLKPENILLDAQGHVKLTDFGLCKESVIEGSVTHTFCGTIEYMAPEILTRSGHGKAVDWWSLGALMYDMLTGAPPFTAENRKKTIEKILKGKLNLPPYLSPDARDLIRKLLKRTVNQRLGSGPEDGESLKDHPFFRLVNWNDVLMRRVDPPFKPALTSEDDVSQFDTRFTKQTPVDSPDESTLSESANLVFQGFTYVAPSVLEDVNRPHVIKARSPRKPTFHLTRMNSQPFSPRQTTYQHFPCFNSATRSSVDIGDTMDTGMPSIVNNATTDFQQQRFMPML

SEQ ID NO: 7878 - protein, 812 aa, Pyrus pyrifolia
MENRRKFTRALSLRERVEDTLSDHRNELVALLSRYLDQGKRILQPHDLIDQLDIVIGDDEAKQQLKNGPFSEVLKSAQEAIVLPPYVALAVRPRPGVWDYVRVNVYELSVEELTVSEYLHFKEELVDGESSDKYVLELDFEPFNAAFPRPTRSSSIGNGVQFLNRHLSSIMFRNRESLDPLLDFLRAHKYKGHPLMLNDRIQSVSKLQSALAKAEDHLSKLQPETPYSEFEYLFQGMGFERGWGDTAVHVLEMMHLLLDILQAPDPSILETFLGRIPMVFNVVILSPHGYFGQANVLGLPDTGGQIVYILDQVRALEKEMLERIRKQGLDFTPRILIVTRLIPEAKGTTCNQRLERISGTEHTHILRVPFRSEKGILRKWISRFDLWPYLETFAEDAAGEIVAELQGYPDFIIGNYSDGNLVASLLAYKMGVTQCTIAHALEKTKYPNSDIYWKKFEEEYHFSTQFTADLIAMNNADFIITSTYQEIAGTKDPVGQYESHSSYTLPGQYRVVHGINVFDPKFNIVSPGADMTIYFPYSEKQKRLTSLHGSLEELLYNPDQNDVHIGTLSDRSKPIIFSMARLDQVKNMTGLVECYAKCSKLRDLANLVIVAGYIDAKKSRDREEIAEIEKMHNLMIEYKLDGQFRWISSQTNRVSNGELYRYIADTRGAFAQPAFYEAFGLTVVEAMSCGLPTFATIHGGPAEIIEHGVSGFHIDPYHPEKAAALMADFFQRCKEDPSYWNTISDAGLQRIYEKYTWKIYSERLMTLAGVYGFWKYVSKLERRETRRYLEMFYILKFRDLAKSVPEAIDDAH

SEQ ID NO: 7879 - protein, 270 aa, Atriplex lentiformis
MALVPHYLFSFVFLLKISLLINSCLCFNPKLFNVSKYYQDNSHWSLGGATWYGSPNGAGSDGGACGYTNTVDKPPYSGMVTAAGSSLYSFGDGCGVCYEVKCTGNQACSGKPVTVTITDECPGCPSDKPHFDLSGTAFGAMAKSGQAEQLRNAGVLDIQYKKVKCNYPGVTVEVRVDPGSNPYYFASTIEYTDGLGIESVKIKQQSGEWVSLQQSWGAVWEFHAPNGLHPPLTLQLVEAQSGDTLTLSNVIPKGWNPGQTYRSHVNFNNN

SEQ ID NO: 7880 - protein, 188 aa, Streptococcus mutans
MEEQNIEKKILLCLTGSGPLLGIAEYITFLTVRFKHVRVIISDNAAKMLPVAAITQLCEKVYTDEVSFTDKQKSHIALTRWADITVVLPATANIIGKVANGIADNFMTTTLLSSSKPVLIYPCMNNIMWGNPVVQKNVEVLSGTQYKVIVGQESESFELASGKMKKNIAIPSLDELRRVVLENLQEER

SEQ ID NO: 7881 - protein, 587 aa, Oryza sativa; identical to SEQ ID NO: 3831

SEQ ID NO: 7882 - protein, 1216 aa, Homo sapiens
MAGAQPGVHALQLKPVCVSDSLKKGTKFVKWDDDSTIVTPIILRTDPQGFFFYWTDQNKETELLDLSLVKDARCGRHAKAPKDPKLRELLDVGNIGRLEQRMITVVYGPDLVNISHLNLVAFQEEVAKEWTNEVFSLATNLLAQNMSRDAFLEKAYTKLKLQVTPEGRIPLKNIYRLFSADRKRVETALEACSLPSSRNDSIPQEDFTPEVYRVFLNNLCPRPEIDNIFSEFGAKSKPYLTVDQMMDFINLKQRDPRLNEILYPPLKQEQVQVLIEKYEPNNSLARKGQISVDGFMRYLSGEENGVVSPEKLDLNEDMSQPLSHYFINSSHNTYLTAGQLAGNSSVEMYRQVLLSGCRCVELDCWKGRTAEEEPVITHGFTMTTEISFKEVIEAIAECAFKTSPFPILLSFENHVDSPKQQAKMAEYCRLIFGDALLMEPLEKYPLESGVPLPSPMDLMYKILVKNKKKSHKSSEGSGKKKLSEQASNTYSDSSSMFEPSSPGAGEADTESDDDDDDDDCKKSSMDEGTAGSEAMATEEMSNLVNYIQPVKFESFEISKKRNKSFEMSSFVETKGLEQLTKSPVEFVEYNKMQLSRIYPKGTRVDSSNYMPQLFWNAGCQMVALNFQTMDLAMQINMGMYEYNGKSGYRLKPEFMRRPDKHFDPFTEGIVDGIVANTLSVKIISGQFLSDKKVGTYVEVDMFGLPVDTRRKAFKTKTSQGNAVNPVWEEEPIVFKKVVLPTLACLRIAVYEEGGKFIGHRILPVQAIRPGYHYICLRNERNQPLTLPAVFVYIEVKDYVPDTYADVIEALSNPIRYVNLMEQRAKQLAALTLEDEEEVKKEADPGETPSEAPSEARTTPAENGVNHTTTLTPKPPSQALHSQPAPGSVKAPAKTEDLIQSVLTEVEAQTIEELKQQKSFVKLQKKHYKEMKDLVKRHHKKTTDLIKEHTTKYNEIQNDYLRRRAALEKSAKKDSKKKSEPSSPDHGSSTIEQDLAALDAEMTQKLIDLKDKQQQQLLNLRQEQYYSEKYQKREHIKLLIQKLTDVAEECQNNQLKKLKEICEKEKKELKKKMDKKRQEKITEAKSKDKSQMEEEKTEMIRSYIQEVVQYIKRLEEAQSKRQEKLVEKHKEIRQQILDEKPKLQVELEQEYQDKFKRLPLEILEFVQEAMKGKISEDSNHGSAPLSLSSDPGKVNHKTPSSEELGGDIPGKEFDTPL

SEQ ID NO: 7883 - protein, 363 aa, Leishmania panamensis
MTQLVPLAELPSGKKIYSVRGQRFEVDRQYDLVKVVGFGACGTVCSAVVNGSGERVAIKRLSRVFGDLREGKRILREMEIMTSLKHNNLIRLPTFMRPQSKETFEDIYLVMDLYDTDLNRIIRSRQKLTDEHLQYFMIQAFRGLHYLHSAKVMHRDLKPSNLLVNADCALAICDFGLARDDQVMSSSDLTQYVVTRWYRPPEVLGMGSNQYTSAVDVWSLGLIFAELMVGRALLPGTDYIGQLVMIVNLLGSPSIDDMEFLSSEAKAFILSQPHRPALSFRDLFPMATEEATDLLSKLLVFHPARRLTAKQVMEHPYFSKYRDAAEEADAPDPFVWNHSHIETKEQLREDLWRVVEVHSQSNG

SEQ ID NO: 7884 - protein, 328 aa, Saccharomyces cerevisiae
DYYFDSYDHYGIHEEMLQDTVRTLSYRNAIIQNKDLFKDKIVLDVGCGTGILSMFAAKHGAKHVIGVDMSSIIEMAKELVELNGFSDKITLLRGKLEDVHLPFPKVDIIISEWMGYFLLYESMMDTVLYARDHYLVEGGLIFPDKCSIHLAGLEDSQYKDEKLNYWQDVYGFDYSPFVPLVLHEPIVDTVERNNVNTTSDKLIEFDLNTVKISDLAFKSNFKLTAKRQDMINGIVTWFDIVFPAPKGKRPVEFSTGPHAPYTHWKQTIFYFPDDLDAETGDTIEGELVCSPNEKNNRDLNIKISYKFESNGIDGNSRSRKNEGSYLMH

SEQ ID NO: 7885 - protein, 375 aa, Pinus banksiana
QVIKCKAAVAWGAGEPLKIEEVEVDPPQSMEVRIKVHYTALCHSDLIFWEAKGQTPLFPRIFGHEAAGIIESVGEGVTDLKEGDTVLPVFTGECKECRHCKSEESNMCDLLRVDIETGVMKSDGKSRFSINGKPIYHFAGTSTFSEYTVVHSGCVAKINPKAPLNKVCILSCGVSTGMGAALNVAKPKQGSTVAIFGLGTVGLAAAEGSRMAGASRIIGIDLNSDKFERAKLFGVTESLNPLDYEKSIQQVIAEKTDGGVDYSIECTGNVKAMIQAFESCHIGGGVTVLVGFPPSDAVFATNPLNFLCERTLKGTFFGNYKPLSHLPGLVELYLNKKLELEKFITHEVSFADINKAFDYMIKGESLRCVINVIGN

SEQ ID NO: 7886 - protein, 375 aa, Pinus banksiana
QVIKCKAAVAWAAGEPLKIEEVEVAPPQAMEVRIKIHYTALCHTDVYFWEAKGQTPLFPRILGHEAAGVVESVGEGVTDLKEGDTVLPVFTGECGECRHCKSEESNMCDLLRINTERGVMISDGKTRFSKDGKPIYHFLGTSTFSEYTVAHAGCVAKINPEAPLDKVCVLSCGASTGMGAALNVAKPKKGSTVAVFGLGAVGLGAAEGARIAGASRIIGIDLISERFEKAKLFGVTEFINPLDHAKPVQEVIAEKTDGGVDYSIECTGNVKAMIQAFESCHDGWGVAVLVGVPHSDAVFQTSPLNFLTERTLKGTFYGNYKPRSDLPGLVEMYLAKKIELEKFITHEVSFADINKAFDYMLKGESLRCIINLIGN

SEQ ID NO: 7887 - protein, 375 aa, Pinus banksiana
QVIKCKAAVAWAAGEPLKIEEVEVAPPQAMEVRIKIHYTALCHTDLYFWEAKGQTPLFPRILGHEAAGVVESVGEGVTDLKEGDTVLPVFTGECGECRHCKSEESNVCDLLRINTDRGVMISDGKSRFSINGKPIYHFVGTSTFSEYTVTHVGSLAKINPEAPLDKVCILSCGVSTGMGATLNVAKPKKGSSVAIFGLGGVGLAAAEGARMAGASRIIGIDLNSDRFEKAKLFGVTEFINPLDYKKPIQEVIAEKTDGGVDYSIECTGNVKAMIQAFESCHDGWGVAVLVGVPHSDAVFATSPVNFLNERTLKGTFFGNYKPRTDLPGLVELYMDKKLQLERFITHEVSFADINKAFDYMIKGESLRCVTNVIGN

SEQ ID NO: 7888 - protein, 375 aa, Pinus banksiana
RVIKCKAAVAWAAGEPLKIEEVEVAPPQAMEVRVKIHYTALCHTDLYFWEAKGQTPLFPRILGHEAAGVVESVGEGVTDLKEGDTVLPVFTGECGECRHCKSEESNMCDLLRINTDRGVMISDGKSRFSINGKPIYHFVGTSTFSEYTVTHVGSLAKINPEAPLDKVCILSCGVSTGMGATLNVAKPKKGSSVAIFGLGGVGLAAAEGARIAGASRIIGIDLNSDRFEKAKLFGVTEFINPLDYKKPIQEVIAEKTDGGVDYSIECTGNVKAMIQAFESCHDGWGVAVLVGVPHSDAVFATSPVNFLNERTLKGTFFGNYKPRTDLPGLVELYLDKKLELEKFITHEVSFADINKAFDYMIKGESLRCVINVIGN

SEQ ID NO: 7889 - protein, 375 aa, Pinus banksiana
QAIKCKAAVAWAAGEPLKIEEVEVASPQAMEVRIKIHYTALCHTDLYFWEAKGQTPLFPRILGHEAAGVVESVGEGVTDLKEGDTVLPVFTGECGECRHCKSEESNMCDLLRINTDRGVMISDGKSRFSINGKPIYHFVGTSTFSEYTVTHVGSLAKINPEAPLDKVCILSCGVSTGMGATLNVAKPKKGSSVAIFGLGGVGLAAAEGARIAGASRIIGIDLNSDRFEKAKLFGVTEFINPLDYKKPIQEVIAEKTDGGVDCSIECTGNVKAMIQAFESCHDGWGVAVLVGVPHSDAVFATSPVNFLNERTLKGTFFGNYKPRTDLPGLVELYMDKKLELEKFITHEVSFADINKAFDYMIKGESLRCVINVIGN

SEQ ID NO: 7890 - protein, 375 aa, Pinus banksiana
KVITCKAAVAWGPSQPLKIEEVQVAPPKAMEVRIKVHYTSLCHTDLVFWQAEGHTPIFPRIFGHEAAGVIESVGEGVTDLKVGDCVLPVFTGECKECKHCKSEESNMCDLLRIDTERGVMMSDGNSRFSINGKPIHHFLGTSTFSEYTVAHAGCVAKINPKAPLDKVCVLSCGVPTGMGATLNAGKPKKGSIVAVFGLGAVGLAACEGARIAGAARIIGIDFNNERSERAKQFGVTEFINPKEYDKPIQQVIAEKTDGGVDCSVECTGSIEAMVQALECCHDGWGVAVLAGVPRADAVFKTNPVNFLSEKTLKGTFFGNYKPRTDLPGLVEMYLNGELELDKFVTDKVSFSDINKAFDHMLKGEGLRTVIKVIQD

SEQ ID NO: 7891 - protein, 374 aa, Pinus banksiana
QVITCKAAVAWGPGQPLKIEEVEVAPPQAMEVRIKVYYTALCRTDLVFWEAKGQTPLFPRIFGHEAAGIVESVGEGVTDLKPGDSVLPVFTGECKECRHCKSEESNMCALLRINTDRGVMISDGKSRFSVNGKPIYHFLGTSTFSEYTVVHVGCVAKINPKAPLSKVCILSCGVSTGMGATLNVGKPKKGSTVAIFGLGSVGLGAAEGARIAGASRIIGVDLNSDRYEQAKLFGVTEFINPQDYEKPVQEVIAEKTDGGVDCSIECTGNVKAMIQAFESCHDGWGVSVLVGVPHSDAVFATHPINFLNERTLKGTFFGNYKPRSDLPGLVEMYLDKKLELDKFITHEVSFADINKSFDYMIKGESLRTVIKVSD

SEQ ID NO: 7892 - protein, 375 aa, Pinus banksiana
QVIKCKAAVAWAAGEPLKIEEVEVAPPQAMEVRIKIHYTALCHTDLYFWEAKGQTPLFPRILGHEAAGVVESVGEGVTDLKEGDTVLPVFTGECGECRHCKSEESNMCDLLRINTDRGVMISDGKSRFSINGKPIYHFVGTSTFSEYTVTHVGSLAKINPEAPLDKVCILSCGVSTGMGATLNVAKPKKGSSVAIFGLGGVGLAAAEGARMAGASRIIGIDLNSDRFEKAKLFGVTEFINPLDYKKPIQEVIAEKTDGGVDYSIECTGNVKAMIQAFESCHDGWGVAVLVGVPHSDAVFATSPVNFLNERTLKGTFFGNYKPRTDLPGLVELYMDKKLQLEKFITHEVSFADINKAFDYMIKGESLRCVTNVIGN

SEQ ID NO: 7893 - protein, 375 aa, Pinus banksiana
QVIKCKAAVAWAAGEPLKIEEVEVAPPQAMEVRIKIHYTALCHTDLYFWEAKGQTPLFPRILGHEAAGVVESVGEGVTDLKEGDTVLPVFTGECGECRHCKSEESNMCDLLRINTDRGVMISDGKSRFSINGKPIYHFVGTSTFSEYTVTHVGSLAKINPEAPLDKVCILSCGVSTGMGATLNVAKPKKGSSVAIFGLGGVGLAAAEGARIAGASRIIGIDLNSDRFEKAKLFGVTEFINPLDYKKPIQEVIAEKTDGGVDYSIECTGNVKAMIQAFESCHDGWGVAVLVGVPHSDAVFATSPVNFLNERTLKGTFFGNYKPRTDLPGLVELYMDKKLELEKFITHEVSFADINKAFDYMIKGESLRCVINVIGN

SEQ ID NO: 7894 - protein, 375 aa, Pinus banksiana
KVITCKAAVAWGPSQPLKIEEVQVAPPKAMEVRIKVHYTSLCHTDLVFWQAEGHTPIFPRIFGHEAAGVIESVGEGVTDLKVGDCVLPVFTGECKECKHCKSEESNMCDLLRIDTERGVMMSDGNSRFSINGKPIHHFLGTSTFSEYTVAHAGCVAKINPKAPLDKVCVLSCGVPTGMGATLNAGKPKKGSIVAVFGLGAVGLAACEGARIAGAARIIGIDFNNERSERAKQFGVTEFINPKEYEKPIQQVIAEKTDGGVDCSVECTGSIEAMVQALECCHDGWGVAVLAGVPRADAVFKTNPVNFLSEKTLKGTFFGNYKPRTDLPGLVEMYLNGELELDKFVTDKVSFSDINKAFDHMLKGEGLRTVIKVIQD

SEQ ID NO: 7895 - protein, 82 aa, Dictyostelium discoideum
DLILIKKLVKSFEKYKYSDVKIHSFNQSRFPRILKDNLMPVPDKLFGSDSGWYPPGHGDVFFALQNSGLLETLINEGKEYIF

SEQ ID NO: 7896 - protein, 297 aa, Chironomus tentans
MADLHENGDQMQQDDGYNGQDMDHQNGGGDSSEIGRDDDRKLFVGGLSWETTEKELRDHFGQYGEIDSINVKTDPTTGRSRGFAFIVYKSADSIDKVVAAGDHIINNKKVDPKKAKARTGKIFVGGLIPEISDDEIRAYFAQFGNIVEMEMPFDKQKNQRKAFCFITFDSETVVNELLKTPKQTISGKEVDVKKATPKPDNAPMMNIRGGGGGRNMRGGRGGRQFQGGNWGGNYSSSGGPYGQSGGSWNQGNWGSNYDNYQGGYGGPMDGYYGNYDSGYGNYGSGGNYDRATFLPES

SEQ ID NO: 7897 - protein, 147 aa, Mycoplasma pneumoniae
HRSGLSEHDWEGMETLTKHWSTHQIVGDDLYCTNPAIAEKGVAHKATNSILIKLNQIGTLTETIKAINIAKDANWSQVISHRSGETEDTTIADLAVAACTGQIKTGSMSRSERIAKYNRLLQIELELGNNAKYLGWNTFKNIKPQKA

SEQ ID NO: 7898 - protein, 354 aa, Cricetulus longicaudatus
MGCTLSAEERAALERSKAIEKNLKEDGISAAKDVKLLLLGAGESGKSTIVKQMKIIHEDGFSGEDVKQYKPVVYSNTIQSLAAIVRAMDTLGVEYGDKERKADSKMVCDVVSRMEDTEPFSAELLSAMMRLWGDSGIQECFNRSREYQLNDSAKYYLDSLDRIGAADYQPTEQDILRTRVKTTGIVETHFTFKNLHFRLFDVGGQRSERKKWIHCFEDVTAIIFCVALSGYDQVLHEDETTNRMHESLKLFDSICNNKWFTDTSIILFLNKKDIFEEKITRSPLTICFPEYTGPSAFTEAVAHIQGQYESKNKSAHKEIYTHFTCATDTNNIQFVFDAVTDVIIAKNLRGCGLY

SEQ ID NO: 7899 - protein, 354 aa, Mus musculus
MGCTLSAEERAALERSKAIEKNLKEDGISAAKDVKLLLLGAGESGKSTIVKQMKIIHEDGFSGEDVKQYKPVVYSNTIQSLAAIVRAMDTLGVEYGDKERKTDSKMVCDVVSRMEDTEPFSAELLSAMMRLWGDSGIQECFNRSREYQLNDSAKYYLDSLDRIGAGDYQPTEQDILRTRVKTTGIVETHFTFKNLHFRLFDVGGQRSERKKWIHCFEDVTAIIFCVALSGYDQVLHEDETTNRMHESLKLFDSICNNKWFTDTSIILFLNKKDIFEEKIKKSPLTICFPEYTGPSAFTEAVAHIQGQYESKNKSAHKEVYSHVTCATDTNNIQFVFDAVTDVIIAKNLRGCGLY

SEQ ID NO: 7900 - protein, 356 aa, Dictyostelium discoideum
MGNICGKPELGSPEEIKANQHINSLLKQARSKLEGEIKLLLLGAGESGKSTIAKQMKIIHLNGFNDEEKSSYKTIIYNNTVGSMRVLVNAAEELKIGISENNKEAASRISNDLGDHFNGVLTAELAQDIKALWADPGIQNTFQRSSEFQLNDSAAYYFDSIDRISQPLYLPSENDVLRSRTKTTGIIETVFEIQNSTFRMVDVGGQRSERKKWMHCFQEVTAVIFCVALSEYDLKLYEDDTTNRMQESLKLFKEICNTKWFANTAMILFLNKRDIFSEKITKTPITVCFKEYDGPQTYEGCSEFIKQQFINQNENPKKSIYPHLTCATDTNNILVVFNAVKDIVLNLTLGEAGMIL

SEQ ID NO: 7901 - protein, 384 aa, Lycopersicon esculentum
MGSLCSRNKHYSQADDEENTQTAEIERRIEQETKAEKHIQKLLLLGAGDSGKSTIFKQIKLLFQTGFDEEELKNYIPVIHANVYQTTKILHDGSKELAQNELEASKYLLSAENKEIGEKLSEIGGRLDYPHLTKDLVQDIEALWKDPAIQETLLRGNELQVPDCAHYFMENLERFSDVHYIPTKEDVLFARIRTTGVVEIQFSPVGENKKSGEVYRLFDVGGQRNERRKWIHLFEGVTAVIFCAAISEYDQTLFEDERKNRMMETKELFEWVLKQPCFEKTSFMLFLNKFDIFEQKVPKVPLNACEWFKDYQSVSTGKQEIEHAYEFVKKKFEESYFQCTAPDRVDRVFKIYRTTALDQKLVKKTFKLVDETLRRRNLFEAGLL

SEQ ID NO: 7902 - protein, 357 aa, Dictyostelium discoideum
MGICASSMEGEKTNTDINLSIEKERKKKHNEVKLLLLGAGESGKSTISKQMKIIHQSGYSNEERKEFKPIITRNILDNMRVLLDGMGRLGMTIDPSNSDAAVMIKELTSLQASIVTDCWGELNEDQGKKIKALWTDPGVKQAMRRANEFSTLPDSAPYFFDSIDRMTSPVYIPTDQDILHTRVMTRGVHETNFEIGKIKFRLVDVGGQRSERKKWLSCFDDVTAVVFCVALSEYDLLLYEDNSTNRMLESLRVFSDVCNSWFVNTPIILFLNKSDLFREKIKHVDLSETFPEYKGGRDYERASNYIKERFWQINKTEQKAIYSHITCATDTNNIRVVFEAVKDIIFTQCVMKAGLYS

SEQ ID NO: 7903 - protein, 345 aa, Xenopus laevis
REAAERSKMIDRNLREDGEKASKEVKLLLLGAGESGKSTIVKQMKIIHEDGYSEEECRQYKVVVYSNTIQSIIAIIRAMGRLRIDFGDVARADDARQLFVLASSAEEGVMSPELAGVIQRLWEDSGVQACFSRSREYQLNDSASYYLSDIERIAQGSYIPTQQDVLRTRVKTTGIVETHFTFKDLYFKMFDVGGQRSERKKWIHCFEGVTAIIFCVALSDYDLLLAEDEEMNRMHESMKLFDSICNNKWFIDTSIILFLNKKDLFEEKISRSPLTICYPEYSGSNTYEEAAAYIQCQFEDLNRRKDTKEIYTHFTCATDTKNVQFVFDAVTDVIIKSNLMECGLY

SEQ ID NO: 7904 - protein, 394 aa, Cricetulus longicaudatus
MGCLGDSKTEDQRNEEKAQREANKKIEKQLQKDKQVYRATHRLLLLGAGESGKSTIVKQMRILHVNGFNGEGGEEDPQAARSNSDGEKATKVQDIKNNLKEAIETIVAAMSNLVPPVELANPENQFRVDYILSVMNVPNFDFPPEFYEHAKALWEDEGVRACYERSNEYQLIDCAQYFLDKIDVIKQADYVPSDQDLLRCRVLTSGIFETKFQVDKVNFHMFDVGGQRDERRKWIQCFNDVTAIIFVVASSSYNMVIREDNQTNRLQEALNLFKSIWNNRWLRTISVILFLNKQDLLAEKVLAGKSKIEDYFPEFARYTTPEDATPEPGEDPRVTRAKYFIRDEFLRISTASGDGRHYCYPHFTCAVDTENIRRVFNDCRDIIQRMHLRQYELL

SEQ ID NO: 7905 - protein, 379 aa, Xenopus laevis
MGCLGNSKTEDQRNEEKVQRETNKKIEKQLQKDKQVYRATHRLLLLGAGESGKSSIVKQMRILHVNGFNAEEKKTKVQDIKNNIKEAIETIVTAMGNLSPPVELVNPENQFRIDYILNLPNYKDFEFSPEFYEHTKTLWQDEGVRACYERSNEYQLIDCAQYFLDKIDIVKQNDYTPSDQDLLRCRVLTSGIFETKFQVDKVNFHMFDVGGQRDERRKWIQCFNDVTAIIFVVASSSYNMVIREDNHTNRLQEALNLFKSIWNNRWLRTISVILFLNKQDLLAEKVNAGKSKIEDYFPEFARYTTPDDATPEVGEDPRVTRAKYFIRDEFLRISTASGDGRHYCYPHFTCAVDTENIRRVFNDCRDIIQRMHLRQYELL

SEQ ID NO: 7906 - protein, 341 aa, Loligo forbesi
MTSELEALRQETEQLKNQIREARKAAADTTLAMATANVEPVGRIQMRTRRTLRGHLAKIYAMHWASDSRNLVSASQDGKLIVWDGYTTNKVHAIPLRSSWVMTCAYAPSGNYVACGGLDNICSIYSLKTREGNVRVSRELPGHTGYLSCCRFIDDNQIVTSSGDMTCALWNIETGNQITSFGGHTGDVMSLSLAPDMRTFVSGACDASAKLFDIRDGICKQTFTGHESDINAITYFPNGFAFATGSDDATCRLFDIRADQEIGMYSHDNIICGITSVAFSKSGRLLLGGYDDFNCNVWDVLKQERAGVLAGHDNRVSCLGVTEDGMAVATGSWDSFLKIWN

SEQ ID NO: 7907 - protein, 354 aa, Xenopus laevis
MGCTLSAEDKAAVERSKMIDRNLREDGEKAAREVKLLLLGAGESGKSTIVKQMKIIHEAGYSEEECKQYKAVVYSNTIQSIIAIIRAMGRLKIDFGDPSRADDARQLFVLAGAAEEGFMTAELAGVIKRLWKDGGVQACFNRSREYQLNDSAAYYLNDLDRIAQNSYIPTQQDVLRTRVKTTGIVETHFTFKDLHFKMFDVGGQRSERKKWIHCFEGVTAIIFCVALSDYDLVLAEDEEMNRMHESMKLFDSICNNKWFTDTSIILFLNKKDLFEEKIKRSPLTICYPEYPGSNTYEEAAAYIQCQFEDLNKRKDTKEIYTHFTCATDTKNVQFVFDAVTDVIIKNNLKDCGLF

SEQ ID NO: 7908 - protein, 318 aa, Chlamydomonas reinhardtii
MAETLTLRATLKGHTNWVTAIATPLDPSSNTLLSASRDKSVLVWELERSESNYGYARKALRGHSHFVQDVVISSDGQFCLTGSWDGTLRLWDLNTGTTTRRFVGHTKDVLSVAFSVDNRQIVSGSRDKTIKLWNTLGECKYTIGEPEGHTEWVSCVRFSPMTTNPIIVSGGWDKMVKVWNLTNCKLKNNLVGHHGYVNTVTVSPDGSLCASGGKDGIAMLWDLAEGKRLYSLDAGDVIHCLCFSPNRYWLCAATQSSIKIWDLESKSIVDDLRPEFNITSKKAQVPYCVSLAWSADGSTLYSGYTDGQIRVWAVGHSL

SEQ ID NO: 7909 - protein, 385 aa, Drosophila melanogaster
MGCFGSPTSKQSDVNSEDSKSQKRRSDAISRQLQKDKQLYRATHRLLLLGAGESGKSTIVKQMRILHVDGFSDSEKKQKIDDIKKNIRDAILTITGAMSTLNPPVALEKKENEPRVEYIQDYASSPDFNYPPEFYEHTEELWKDKGVLQTYERSNEYQLIDCAKYFLDRVSTIKNPNYTPNEQDILRCRVLTSGIFETRFQVDKVNFHMFDVGGQRDERRKWIQCFNDVTAIIFVTACSSYNMVLREDPTQNRLRESLDLFKSIWNNRWLRTISIILFLNKQDLLAEKIKAGKSKLSEYFSEFNKYQTPIDTGDAIMESNDDPEVIRAKYFIRDEFLRISTASGDGKHYCYPHFTCAVDTENIKRVFNDCRDIIQRMHLRQYELL

SEQ ID NO: 7910 - protein, 105 aa, Methanothermococcus thermolithotrophicus
MKMIKAIVRPDKVDDIVDSLENAGYPAFTKINSVGRGKQGGLKVGEIFYDELPKTILLIAVNDDEVDEVVGLIKSSASTGNFGDGKIFIQPITEAYTIRTGETGI

SEQ ID NO: 7911 - protein, 128 aa, Methanothermococcus thermolithotrophicus
MKEVIAIIRPNTVSKTVKALDVVGFPAVTMAECFGRGKQKGYFSANLPEIVDIQKIIEEGEKEGRFIKYIPKRLISIVVDDADVPLVVGIISKVNRTGSFGDGRIFVLPVEEAIRVRTGETGEIAIGN

SEQ ID NO: 7912 - protein, 884 aa, Giardia intestinalis
MSTRRVYFFGETPENQPANSELCRKVLGGKGISLAAMIKLGMPVPLGFTITCQTCVEYQKTASWPEGLKEEVASNLKLLEEKMGKTFGDNTNPLLVSVRSGAAVSMPGMMDTILNLGLNDESVKGLAAVTGNARFAYDSYRRFMQMFGDVCLGIDHDKFEHALDAVKTRYGRKTDPELTADELEEVCEAYRKICVAATGKTFPQCPHEQLELAINAVFRSWTNPRAQGYRTLNKLDHNMGTAVNVQSMVFGNTGDDSGTGVGFTRCPKTGEKFSYLYGEFLQNAQGEDVVAGIRTPVNLKEMPTINASWKACYDELSLIYAKLEGYYNDMVDLEFTVENGKLWMLQARAGKRTGFAMVRIAIDMCKEGMLTEEEALLRIDANKINEFLFKRFDPSVKPVVLGKGIPASPGAAVGVICFCPMRTCELAEQGKKVILTRIETSPEDILGMDRAVGILTARGGQTSHAAVVARGMGKCCVAGADCCQINYATKTLVIGDRKFKEGDFISINGTTGEIYNGAVQTIEPGITDDLQTIMDWSDKYRVLKIRTNADTPHDAAVARKFGAEGIGLCRTEHMFFAADRIMAMREMILSDDEGARRTALNKLLPFQREDFIGIFKAMDGKGVNIRLLDPPLHEFLPHTRDLQKKLAEDMNKKHRHIHERVEDLHEVNPMLGFRGVRLGIVYPEISEMQVRAILEAACIVSREGVTVKPEIMIPVLFSENEMEIMHALVNRVAASVFKEHGTTVDYEVGTMIELPRACVMADKIAQTAQYFSFGTNDLTQTTFGISRDDAGKFIPKYIDRGIFKVDPFVTLDQQGVGALMKMAIEGGRSTRTDMKIGICGEQTDPASILFLHKIGLNYVSCSPYRVPVARVAAAIAAIKARTNQ

SEQ ID NO: 7913 - protein, 112 aa, Azospirillum brasilense
MKKIEAIIKPFKLDEVKEALHEVGIKGITVTEAKGFGRQKGHTELYRGAEYVVDFLPKVKIEVVMEDSLVERAIEAIQQAAHTGRIGDGKIFVTPVEEVVRIRTGEKGGDAI

SEQ ID NO: 7914 - protein, 112 aa, Klebsiella pneumoniae
MKKIDAIIKPFKLDDVREALAEVGITGMTVTEVKGFGRQKGHTELYRGAEYMVDFLPKVKIEIVVTDDIVDTCVDTIIRTAQTGKIGDGKIFVFDVARVIRIRTGEEDDAAI

SEQ ID NO: 7915 - protein, 111 aa, Rhizobium leguminosarum bv. viciae
MKKIEAIIKPFKLDEVRSPSGVGLQGITVTEAKGFGRQKGHTELYRGAEYVVDFLPKVKVEVVLADENAEAVIEAIRKAAQTGRIGDGKIFVSNVEEVIRIRTGETGIDAI

SEQ ID NO: 7916 - protein, 112 aa, Rhodobacter capsulatus
MKKVEAIIKPFKLDEVKEALQEAGIQGLSVIEVKGFGRQKGHTELYRGAEYVVDFLPKVKIEMVLPDEMVDIAIEAIVGAARTEKIGDGKIFVSSIEQAIRIRTGETGEDAV

SEQ ID NO: 7917 - protein, 112 aa, Synechococcus sp. PCC 6301
MKKIEAIIRPFKLDEVKIALVNAGIVGMTVSEVRGFGRQKGQTERYRGSEYTVEFLQKLKLEIVVEDAQVDTVIDKIVAAARTGEIGDGKIFVSPVDQTIRIRTGEKNADAI

SEQ ID NO: 7918 - protein, 319 aa, Glycyrrhiza echinata
MAAAAAAAIEIPTKVLPNSTCELRVPVIGMGSAPDFTCKKDTKEAIIEAIKQGYRHFDTAAAYGSETALGEALKEARDLGLVTREELFVTSKLWVTENHPHLVIPALRKSLETLQLEYLDLYLIHWPLSSQPGKFSFPIQVEDLLPFDVKGVWESMEECLKLGLTKAIGVSNFSVKKLQNLLSVATIRPAVNQVEMNLAWQQKKLREFCTANGIVLTAFSPLRKGASRGPNEVMENDMLKGIAEAHGKSIAQVSLRWLYEQGVTFVAKSYDKERMNQNLQIFDWELTTEDHQKIDQIKQNRLIPGPTKPQLNDLWDDEL

SEQ ID NO: 7919 - protein, 145 aa, Streptococcus mutans
MTKKILLAVSGSIAAYKAADLSHQLTKLGYHVNVFMTNAAKQFIPPLTLQVLSKNPVYSNVMKEDDPQVINHIALAKQADLFLLPPASANTLAHLAHGFADNIVTSVALALPLEVPKFFAPAMNTKMYENPITQSNITLLKKFGY

SEQ ID NO: 7920 - protein, 451 aa, Sus scrofa
EFYNQTWLHRYGESISPATLTTLWSLSVAIFSVGGMIGSFSVGLFVNRFGRRNSMLMMNLLAFISAVLMGFSKLGKSFEMLILGRFIIGVYCGLTTGFVPMYVGEVSPTALRGALGTLHQLGIVVGILIAQVFGLDSIMGNEELWPLLLSVIFIPALLQCVLLPFCPESPRFLLINRNEENRAKSVLKKLRGTADVTRDLQEMKEESRQMMREKKVTILELFRSAAYRQPILIAVVLQLSQQLSGINAVFYYSTSIFEKAGVQQPVYATIGSGIVNTAFTVVSLFVVERAGRRTLHLIGLAGMAGCAVLMTIALALLEQLPWMSYLSIVAIFGFVAFFEVGPGPIPWFIVAELFSQGPRPAAIAVAGFSNWTSNFIVGMCFQYVEQLCGPYVFIIFTVLLVLFFIFTYFKVPETKGRTFDEIASGFRQGGASQSDKTPEELFHPLGADSQV

SEQ ID NO: 7921 - protein, 492 aa, Oryctolagus cuniculus
MEPSSKKVTGRLMLAVGGAVLGSLQFGYNTGVINAPQKVIEEFYNQTWIHRYGERILPTTLTTLWSLSVAIFSVGGMIGSFSVGLFVNRFGRRNSMLMMNLLAFVSAVLMGFSKLAKSFEMLILGRFIIGVYCGLTTGFVPMYVGEVSPTALRGALGTLHQLGIVVGILIAQVFGLDSIMGNEDLWPLLLSVIFVPALLQCIVLPLCPESPRFLLINRNEENRAKSVLKKLRGNADVTRDLQEMKEESRQMMREKKVTILELFRSPAYRQPILSAVVLQLSQQLSGINAVFYYSTSIFEKAGVQQPVYATIGSGIVNTAFTVVSLFVVERAGRRTLHLIGLAGMAACAVLMTIALALLEQLPWMSYLSIVAIFGFVAFFEVGPGPIPWFIVAELFSQGPRPAAVAVAGFSNWTSNFIVGMCFQYVEQLCGPYVFIIFTVLLVLFFIFTYFKVPETKGRTFDEIASGFRQGGASQSDKTPEELFHPLGADSQV

SEQ ID NO: 7922 - protein, 496 aa, Gallus gallus
MADKKKITASLIYAVSVAAIGSLQFGYNTGVINAPEKIIQAFYNRTLSQRSGETISPELLTSLWSLSVAIFSVGGMIGSFSVSLFFNRFGRRNSMLLVNVLAFAGGALMALSKIAKAVEMLIIGRFIIGLFCGLCTGFVPMYISEVSPTSLRGAFGTLNQLGIVVGILVAQIFGLEGIMGTEALWPLLLGFTIVPAVLQCVALLFCPESPRFLLINKMEEEKAQTVLQKLRGTQDVSQDISEMKEESAKMSQEKKATVLELFRSPNYRQPIIISITLQLSQQLSGINAVFYYSTGIFERAGITQPVYATIGAGVVNTVFTVVSLFLVERAGRRTLHLVGLGGMAVCAAVMTIALALKEKWIRYISIVATFGFVALFEIGPGPIPWFIVAELFSQGPRPAAMAVAGCSNWTSNFLVGMLFPYAEKLCGPYVFLIFLVFLLIFFIFTYFKVPETKGRTFEDISRGFEEQVETSSPSSPPIEKNPMVEMNSIEPDKEVA

SEQ ID NO: 7923 - protein, 150 aa, Lycopersicon esculentum
PGRTDEESDKEIVFHFKNNKRALLKDEDCESNSISDPKTPPVAKTQIVGWPPVRANRKNSFPSKKAEAECGMYVKVSMDGAPYLRKIDLKLYKGYPELLKALEKMFKLSIGEYSEREGYKGSEFAPAYEDKDGDLMLVGDVPFEMFLSSC

SEQ ID NO: 7924 - protein, 356 aa, Ascaris suum
MPRIEFEPKLDFKDVLLRPKRSTLRSRAEVDLMREYVFRNSKKTYVGVPVVASNMDTVGTFEMAEVLAKFSLFTTIHKHYQVDEWKAFVQRVDSNPQIMSQIGISSGISTSDFDKLRTVCDMIPELEYICLDVANGYSEVFVDFIRRVREQFPTHTIFAGNVVTGEMVEELILSGADVVKVGIGPGSVCTTRKKAGVGYPQLSAVLECADASHGLNGHVMSDGGCTNPGDVAKAFGGGADFVMIGGLLAGHDQCGGEVVEKDGKKYKLFYGMSSDTAMKKYQGSVAEYRASEGKTIYMPYRGDVSRTIHDLLGGLRSACTYIGATKLKELSKRATFVRVTQQTNDQYSAYEVPRID

SEQ ID NO: 7925 - protein, 334 aa, Cricetulus griseus
MGNPLLDISAVVDKDFLDKYSLKPNDQILAEEKHKELFDELVRKFKVEYHAGGSTQNSIKVAQWMIQKPHKAATFFGCIGIDKFGEILKSKAAEAHVDAHYYEQNEQPTGTCAACITGDNRSLVANLAAANCYKKEKHLDLENNWVLVEKARVYYIAGFFLTVSPESVLKVARYAAENNRIFTLNLSAPFISQFFKESLMEVMPYVDILFGNETEAATFAREQGFETKDIKEIAKKAQALAKVNSKRPRTVVFTQGRDDTVVATENEVMAFAVLDQNQKEIIDTNGAGDAFVGGFLSQLVYNKPLTECIRAGHYAASVIIRRTGCTFPEKPDFH

SEQ ID NO: 7926 - protein, 271 aa, Mus musculus
MIQEPHRAATFFGCIGIDKFGEILKSKAADAHVDAHYYEQNEQPTGTCAACITGGNRSLVANLRAANCYKKEKHLDLENNWMLVEKARVYYIAGFFLTVSPESVLKVARYAAENNRTFTLNLSAPFISQFFKEALMAVMPYVDILFGNETEAATFAREQGFETKDIKEIARKTQALPKVNSKRQRTVIFRNQGRDDTIVATGNDVTAFPVLDENQEEIVDTNGAGDAFVGGFLSQLVSNKPLTECIRAGHYAASVIIRRTGCTFPEKPNFH

SEQ ID NO: 7927 - protein, 181 aa, Antirrhinum majus
MAAKISSDPLVIGRVIGDVVDHFTSTVKMSVIYNANNSIKHVYNGHELFPSAVTSTPRVEVHGGDMRSFFTLIMTDPDVPGPSDPYLREHLHWIVTDIPGTTDSSFGKEVVSYEMPRPNIGIHRFVFLLFKQKKRGQAMLSPPVVCRDGFNTRKFTQENELGLPVAAVFFNCQRETAARRR

SEQ ID NO: 7928 - protein, 181 aa, Antirrhinum majus
MAAKISSDPLVIGRVIGDVVDHFTSTVQMSVIYNANNSIKHVYNGHELFPSAVTSTPRVEVHGGDMRSFFTLIMTDPDVPGPSDPYLREHLHWIVTDIPGTTDSSFGKEVVSYEMPRPNIGIHRFVFLLFKQKKRGQAMLSPPVVCRDGFNTRKFTQENELGLPVAAVFFNCQRETAARRR

SEQ ID NO: 7929 - protein, 132 aa, Leishmania donovani
MATPRSAKKAVRKSGSKSAKCGLIFPVGRVGGMMRRGQYARRIGASGAVYLAAVLEYLTAELLELSVKAAAQSGKKRCRLNPRTVMLAARHDDDIGTLLKNVTLSHSGVVPNISKAMAKKKGGKKGKATPSA

SEQ ID NO: 7930 - protein, 125 aa, Psammechinus miliaris
MSGRGKGKAKGTKSKTRSSRAGLQFPVGRVHRFLKKGNYGSRVGAGAPVYLAAVLEYLTAEILELAGNAARDNKKSRIIPRHLQLAVRNDEELNKLLGGVTIAQGGVLPNIQAVLLPKKTAKASK

SEQ ID NO: 7931 - protein, 137 aa, Tetrahymena pyriformis
STTGKGGKAKGKTASSKQVSRSARAGLQFPVGRISRFLKHGRYSERIGTGAPVYLAAVLEYLAAEVLELAGNAAKDNKKTRIVPRHILLAIRNDEELNKLMANTTIADGGVLPNINPMLLPSKSKKTESRGQASQDI

SEQ ID NO: 7932 - protein, 132 aa, Leishmania donovani
MATPRSAKKAARKSGSKSAKCGLIFPVGRVGGMMRRGQYARRIGASGAVYLAAVLEYLTAELLELSVKAAAQSGKKRCRLNPRTVMLAARHDDDIGTLLKNVTLSHSGVVPSVSKAVAKKKGGKKGRATPSA

SEQ ID NO: 7933 - protein, 124 aa, Psammechinus miliaris
MSGRGKGAKAKSKAKSRSSRAGLQFPVGRVHRFLKKGNYGNRVGAGAPVYLAAVLEYLTAEILELAGNAARDNKKSRIIPRHLQLAVRNDEELNKLLGGVTIAQGGVLPNIQTVLLPKKTGKSA

SEQ ID NO: 7934 - protein, 132 aa, Tetrahymena pyriformis
STTGKGGKAKGKTASSKQVSRSARAGLQFPVGRISRFLKNGRYSERIGTGAPVYLAAVLEYLAAEVLELAGNAAKDNKKTRIVPRHILLAIRNDEELNKLMANTTIADGGVLPNINPMLLPSKTKKTSEAEH

SEQ ID NO: 7935 - protein, 112 aa, Lytechinus pictus
AKSRSSRAGLQFPVGRVHRFLRKGNYAQRVGAGAPVYLAAVFEYLAAEILELAGNAAPDNKKTRIIPRHLQLAIRNDEELNKLLGGVTIAQGGVLPNIQAVLLPKKTAKSSK

SEQ ID NO: 7936 - protein, 126 aa, Parechinus angulosus
MSGRGKGAKAKGKAKSRSSRAGLQFPVGRVHRFLRKGNYANRVGAGAPVYLAAVLEYLAAEILELAGNAARDNKKTRIIPRHLQLAIRNDEELNKLLGGVTIAQGGVLPNIQAVLLPKKTGSKSSK

SEQ ID NO: 7937 - protein, 129 aa, Volvox carteri
MAGRGKGKTAGKKAVSRSAKAGLQFPVGRIARYLKKGKYAERIGAGAPVYLAAVLEYLTAEVLELAGNAARDNKKNRIVPRHIQLAIRNDEELGKLLGDVTIASGGVLPNIHAVLLPKKSKGGKGEEAA

SEQ ID NO: 7938 - protein, 120 aa, Psammechinus miliaris
MSGRGKGAKSKSKAKSRSSRAGLQFPVGRVHRFLRKGNYANRVGAGAPVYLAAVLEYLTAEILELAGNAARDNKKSRIIPRHLQLAVRNDEELNKLLGGVTIAQGGVLPNIQAVLLPKKK

SEQ ID NO: 7939 - protein, 129 aa, Volvox carteri
MAGRGKGKTAGKKAVSRSSKAGLQFPVGRIARYLKKGKYAERIGAGAPVYLAAVLEYLTAEVLELAGNAARDNKKNRIVPRHIQLAIRNDEELGKLLGDVTIASGGVLPNIHAVLLPKKSKGGKGEEAA

SEQ ID NO: 7940 - protein, 125 aa, Strongylocentrotus purpuratus
GKAGKDSGKAKAKAVSRSARAGLQFPVGRIHRHLKNRTTSHGRVGATAAVYSAAILEYLTAEVLELAGNASKDLKVKRITPRHLQLAIRGDEELDSLIKATIAGGGVIPHIHKSLIGKKGSQKAT

SEQ ID NO: 7941 - protein, 146 aa, Tetrahymena thermophila
MAGGKGGKGGKGGKGGKVGGAKNKKTPQSRSYKAGLQFPVGRIHRFLKGRVSAKNRVGATAAVYAAAILEYLTAEVLELAGNASKDFKVRRITPRHLLLAIRGDEELDILIKATIAGGGVIPHIHKALLGKHSTKNRSSAKTAEPR

SEQ ID NO: 7942 - protein, 132 aa, Emericella nidulans
MTGGKSGGKASGSKNAQSRSSKAGLAFPVGRVHRLLRKGNYAQRVGAGAPVYLAAVLEYLAAEILELAGNAARDNKKTRIIPRHLQLAIRNDEELNKLLGHVTIAQGGVLPNIHQNLLPKKTPKAGKGSQEL

SEQ ID NO: 7943 - protein, 124 aa, Asterias rubens
SGRGKGGKARAKAKSRSSRAGLQFPVGRVHRFLRKGNYAERVGAGAPVYLAAVMEYLAAEILELAGNAARDNKKTRINPRHLQLAIRNDEELNKLLSGVTIAQGGVLPNIQAVLLPKKTAKAAK

SEQ ID NO: 7944 - protein, 129 aa, Cairina moschata
MSGRGKQGGKARAKAKSRSSRAGLQFPVGRVHRLLRKGNYAERVGAGAPVYLAAVLEYLTAEILELAGNAARDNKKTRIIPRHLQLAIRNDEELNKLLGKVTIAQGGVLPNIQAVLLPKKTDSHKAKSK

SEQ ID NO: 7945 - protein, 129 aa, Gallus gallus
MSGRGKQGGKARAKAKSRSSRAGLQFPVGRVHRLLRKGNYAERVGAGAPVYLAAVLEYLTAEILELAGNAARDNKKTRIIPRHLQLAIRNDEELNKLLGKVTIAQGGVLPNIQAVLLPKKTDSHKAKAK

SEQ ID NO: 7946 - protein, 125 aa, Chironomus thummi thummi
MSGRGKGGKVKAKAKSRSSRAGLQFPVGRIHRLLRKGNYGERVGAGAPVYLAAVMEYLAAEVLELAGNAARDNKKTRIIPRHLQLAIRNDEELNKLLSGVTIAQGGVLPNIQAVLLPKKTESKKA

SEQ ID NO: 7947 - protein, 146 aa, Lycopersicon esculentum
MDATKTTKGAGGRKGGPRKKSVTKSIKAGLQFPVGRIGRYLKKGRYAQRVGSGAPIYLAAVLEYLAAEVLELAGNAARDNKKSRIIPRHVLLAVRNDEELGKLLAGVTIASGGVLPNINPVLLPKKSAVAEEKSPKAKAGKSPKKA

SEQ ID NO: 7948 - protein, 128 aa, Oncorhynchus mykiss
MSGRGKTGGKARAKAKTRSSRAGLQFPVGRVHRLLRKGNYAERVGAGAPVYLAAVLEYLTAEILELAGNAARDNKKTRIIPRHLQLAVRNDEELNKLLGGVTIAQGGVLPNIQAVLLPKKTEKAVKAK

SEQ ID NO: 7949 - protein, 124 aa, Paracentrotus lividus
MSGRGKSGKARTKAKSRSSRAGLQFPVGRVHRFLRKGNYAKRVGGGAPVYMAAVLEYLTAEILELAGNAARDNKKSRIIPRHLQLAVRNDEELNKLLGGVTIAQGGVLPNIQAVLLPKKTGKSS

SEQ ID NO: 7950 - protein, 150 aa, Pisum sativum
MDASTKTKKGAGGRKGGGPRKKSVTRSVRAGLQFPVGRVGRFLKKGRYAQRVGTGAPVYLAAVLEYLAAEVLELAGNAARDNKKNRISPRHLLLAVRNDEELGKLLAGVTIAYGGVLPNINPVLLPKRKENAAASTPKSPSKAKKSPKKA

SEQ ID NO: 7951 - protein, 149 aa, Petroselinum crispum
METAGKAKKGFGGRKGGPRKKSVTRSVKAGLQFPVGRIGRYLKKGRYAQRVGTGAPVYLAAVLEYLAAEVLELAGNAARDNKKTRIIPRHLLLAVRNDEELGKLLAGVTFAHGGVLPNINPVLLPKKTAEKAAKEPKSPSKAGKSPKKA

SEQ ID NO: 7952 - protein, 124 aa, Platynereis dumerilii
MSGRGKGGKAKGKSKTRSSRAGLQFPVGRIHRLLRKGNYAERVGAGAPVYLAAVMEYLAAEVLELAGNAARDNKKTRIIPRHLQLAIRNDEELNKLLSGVTIAQGGVLPNIQAVLLPKKTTKAK

SEQ ID NO: 7953 - protein, 124 aa, Sepia officinalis
SGRGKGGKVKGKSKTRSSRAGLQFPVGRIHRLLRKGNYAQRVGAGAPVYLAAVMEYLAAEVLELAGNAARDNKKSRIIPRHLQLAIRNDEELNKLLSGVTIAQGGVLPNIQAVLLPKKTQKAAK

SEQ ID NO: 7954 - protein, 123 aa, Sipunculus nudus
SGRGKGGKAKGKSKSRSSRAGLQFPVGRIHRLLRKGNYAERIGAGAPVYLAAVMEYLAAEVLELAGNAARDNKKTRIIPRHLQLAIRNDEELNKLLSGVTIAQGGVLPNIQAVLLPKKTQKSK

SEQ ID NO: 7955 - protein, 124 aa, Psammechinus miliaris
MSGRGKSGKARTKAKTRSSRAGLQFPVGRVHRFLRKGNYAKRVGGGAPVYMAAVLEYLTAEILELAGNAARDNKKSRIIPRHLQLAVRNDEELNKLLGGVTIAQGGVLPNIQAVLLPKKTAKSS

SEQ ID NO: 7956 - protein, 125 aa, Urechis caupo
MSGRGKGGKAKGKSKSRSSRAGLQFPVGRIHRLLRKGNYAERIGAGAPVYLAAVMEYLAAEVLELAGNAARDNKKTRIIPRHLQLAIRNDEELNKLLSGVTIAQGGVLPNIQAVLLPKKSSQKTK

SEQ ID NO: 7957 - protein, 146 aa, Schizosaccharomyces pombe
DHPWTSNPFTSLFALTPLMFLFLLVAGLIFEGPVRFIESPAWKEFGPFMSVVILVPGTLAFFMVASEFGLIQKTSIVTLSVCGILKEIITIIASTLFYHDILLPINIVGLVITLCGIGVYNYYRITKGNKKEAEKEVEYIVLNENA

SEQ ID NO: 7958 - protein, 407 aa, Solanum tuberosum
MALDESQQSDPLVVIRNGKEIILQAFDWESHKHDWWLNLDTKVPDIAKSGFTTAWLPPVCQSLAPEGYLPQNLYSLNSKYGSEDLLKALLNKMKQYKVRAMADIVINHRVGTTQGHGGMYNRYDGIPMSWDEHAITSCTGGRGNKSTGDNFNGVPNIDHTQSFVRKDLIDWMRWLRSSVGFQDFRFDFAKGYASKYVKEYIEGAEPIFAVGEYWDTCNYKGSNLDYNQDSHRQRIINWIDGAGQLSTAFDFTTKAVLQEAVKGEFWRLRDSKGKPPGVLGLWPSRAVTFIDNHDTGSTQAHWPFPSRHVMEGYAYILTHPGIPSVFFDHFYEWDNSMHDQIVKLIAIRRNQGIHSRSSIRILEAQPNLYAATIDEKVSVKIGDGSWSPAGKEWTLATSGHRYAVWQK

SEQ ID NO: 7959 - protein, 102 aa, Tetrahymena pyriformis
AGGKGGKGMGKVGAKRHSKRSNKASIEGITKPAIRRLARRGGVKRISSFIYDDSRQVLKSFLENVVRDAVTYTEHARRKTVTAMDVVYALKRQGRTLYGFGG

SEQ ID NO: 7960 - protein, 103 aa, Tetrahymena thermophila
MAGGKGGKGMGKVGAKRHSRKSNKASIEGITKPAIRRLARRGGVKRISSFIYDDSRQVLKSFLENVVRDAVTYTEHARRKTVTAMDVVYALKRQGRTLYGFGG

SEQ ID NO: 7961 - protein, 104 aa, Stylonychia lemnae
MAGRGKVGKGYGKVGAKRHTKKSLKETIMGITKPAIRRLARRGGVKRISSLIYEETRNVLRSFLENVIRDSVTYTEHAKRKTVTALDVVYALKRQGRTLYGFGG

SEQ ID NO: 7962 - protein, 103 aa, Physarum polycephalum
MSGRGKGGKGLGKGGAKRHRKVLRDNIQGITKPAIRRLARRGGVKRISNTIYEETRGVLKTFLENVIRDAVTYTEHARRKTVTAMDVVYALKRQGRTLYGFGG

SEQ ID NO: 7963 - protein, 103 aa, Solaster stimpsoni
MSGRGKGGKGLGKGGAKRHRKVLRDNIQGITKPAIRRLARRGGVKRISGLIYEETRGVLKVFLENVIRDAVTYCEHAKRKTVTSMDVVYALKRQGRTLYGFGG

SEQ ID NO: 7964 - protein, 103 aa, Volvox carteri
MSGRGKGGKGLGKGGAKRHRKVLRDNIQGITKPAIRRLARRGGVKRISGLIYEETRTVLKNFLENVIRDSVTYTEHARRKTVTAMDVVYALKRQGRTLYGFGG

SEQ ID NO: 7965 - protein, 423 aa, Euplotes octocarinatus
MGLVEAIKMDVLNLTPHEKELIKQDVLHKEAELNRKSRKKMYPSDFEPLTIIGKGAFGEVRICRHIETGDIVAVKKVVNKEMLYKNQVAHVRSERDILVKAKNPWIVGLKYSFQDDENLYLVMEYLPGGDLMNLLIKKDILSEEESRFYTAEMILAIESVHSLNYIHRDLKPDNVLLGVDGHIKLTDFGPCKHAEIKASQKVDTDKYELKHSENFNALKNMLNKRLGYKRDRKLAFSTVGTPDYIAPEVFGTKGYDETVDWWSVGVILFEMLVGYPPFFSDDSTVTCQKILHWKRTLVIPPEANLTPEATDLIEKLVCDAEDRLGRNGAIEIKEHPWFEGFDWDSLSSLKAPYIPEVSSPTSAENFDKFKEETPFFPLSQSKLQKQKMKRRKKDLDFVGYTYKADVEEEKQMFVSALQELDHL

SEQ ID NO: 7966 - protein, 259 aa, Lilium longiflorum
MSPAEPSREENVYMAKLAEQAERYEEMVEFMEKVARTVDTEELTVEERNLLSVAYKNVIGARRASWRIISSIEQKEESRGNEDHVALIKDYRGKIEAELSKICDGILKLLDSHLVPSSTAPESKVFYLKMKGDYHRYLAEFKSGAERKEAAESTLLAYKSAQDIALAELAPTHPIRLGLALNFSVFYYEILNSPDRACNLAKQAFDEAISELDTLGEESYKDSTLIMQLLRDNLTLWTSDINEEAGDEIKEASKAVEGQ

SEQ ID NO: 7967 - protein, 512 aa, Homo sapiens
DEPELSDSGDEAAWEDEDDADLPHGKQQTPCLFCNRLFTSAEETFSHCKSEHQFNIDSMVHKHGLEFYGYIKLINFIRLKNPTVEYMNSIYNPVPWEKEEYLKPVLEDDLLLQFDVEDLYEPVSVPFSYPNGLSENTSVVEKLKHMEARALSAEAALARAREDLQKMKQFAQDFVMHTDVRTCSSSTSVIADLQEDEDGVYFSSYGHYGIHEEMLKDKIRTESYRDFIYQNPHIFKDKVVLDVGCGTGILSMFAAKAGAKKVLGVDQSEILYQAMDIIRLNKLEDTITLIKGKIEEVHLPVEKVDVIISEWMGYFLLFESMLDSVLYAKNKYLAKGGSVYPDICTISLVAVSDVNKHADRIAFWDDVYGFKMSCMKKAVIPEAVVEVLDPKTLISEPCGIKHIDCHTTSISDLEFSSDFTLKITRTSMCTAIAGYFDIYFEKNCHNRVVFSTGPQSTKTHWKQTVFLLEKPFSVKAGEALKGKVTVHKNKKDPRSLTVTLTLNNSTQTYGLQ

SEQ ID NO: 7968 - protein, 334 aa, Homo sapiens
MSKLLNPEEMTSRDYYFDSYAHFGIHEEMLKDEVRTLTYRNSMYHNKHVFKDKVVLDVGSGTGILSMFAAKAGAKKVFGIECSSISDYSEKIIKANHLDNIITIFKGKVEEVELPVEKVDIIISEWMGYCLFYESMLNTVIFARDKWLKPGGLMFPDRAALYVVAIEDRQYKDFKIHWWENVYGFDMTCIRDVAMKEPLVDIVDPKQVVTNACLIKEVDIYTVKTEELSFTSAFCLQIQRNDYVHALVTYFNIEFTKCHKKMGFSTAPDAPYTHWKQTVFYLEDYLTVRRGEEIYGTISMKPNAKNVRDLDFTVDLDFKGQLCETSVSNDYKMR

SEQ ID NO: 7969 - protein, 237 aa, Paralichthys olivaceus
  unsure (1)..(237): unsure at all Xaa locations
MNVFDRNINFDSLFKFSQISHSTQVHLKNVYSSLAVCMFVAAAGSYVHVVTRLFQGGMLSVLGSLGMMFWLAMTPHNSETEKKRLAILAGFAFLTGVGLCPTLDFVIAINPSIIVTAFLGTSVIFVCFTLSALYAKRRSYLFLGGTLMSGLSILFLMSMMNMFFGSVMLFKAHMYLGLLIMCGFVLXDTQLIIEKAENGDKDYVWHSVDLFLDFITIFRKLMVILALNDKDKKKEKK

SEQ ID NO: 7970 - protein, 249 aa, Oryza sativa; identical to SEQ ID NO: 3605

SEQ ID NO: 7971 - protein, 112 aa, Rhizobium etli
MKIVMAIIKPFKLDEVREALTAIGIQGLTVTEVKGYGRQKGHTEIYRGTVYAVSFLPKLKIEIAVASELVDRAVEAIGASAKTGQIGDGKIFVYSIDHAVRIRTGETDSEAL

SEQ ID NO: 7972 - protein, 500 aa, Agaricus bisporus
MPSIFTHQWDTPVYKGSTSINTGLFINGEFVDGVKNTTIDVVNPANGKLITKISEATEADIDIAVEAAHKAFETTWGLNCSGSKRGDMLYKLAQLMEKNIDDLSAIEALDNGKTFLWAKSVDLSLSISTIKHYAGWADKNFGQVIETDEKKLTYSRHEPIGVVGQIIPWNFPLLMLAWKIGPALATGNCIVLKPSEFTPLSALRMCALIQEAGFPPGVVNVVTGYGSTTGQAISSHMKIDKVAFTGSTLVGRKVMEAAAKSNLKNVTLELGGKSPVVIFDDADLEQSVNWTAHGLFWNHGQACCAGTRIFVQEGIYDKFLQKFTDKIKEIKLGDPFGLGIDQGPQVSQIQYDRIMSYIESGRAEGATVHVGGERHGNEGYFIQPTIFTDTTPDMKIVKEEIFGPVGAVIKFKDGKEVIKQANDSNYGLAAAVFSQDINKAIETAHAFKAGTAWVNCANTIDAGVPFGGYKQSGIGRELGEYALHNYTNVKAVHVNLNWKM

SEQ ID NO: 7973 - protein, 447 aa, Kluyveromyces lactis
MGCVASTGNYENEDDPFIQNKRANDLIEQNLQQERNKNKNEVKLLLLGAGESGKSTVLKQMKLLHQGGFTHRERMQYGQVIWADAIESMRTLILQAGKLGIELDSDLKNAHSGQLVNTELHQCKEKIFRANTLDQIDARMAGGSEFLNEYVLKYNGIGSKKKRQTTLGFKESNGADPEEEDETDAFLSEKLAGTSYTGSSETSELKRIDQSTNEEIAYAIKKLWTQDKGIRQCFNRSSEFQLEGSASYYFDNIEKFARVDYVCDDMDILKVRIKTTGITENSFKIGPSTFKVYDAGGQRSERRKWIHCFEGITAVVFVIAISEYDQMLFEDERVNRMHESIVLLDTLLNSRWFANTPFILFLNKVDIFQEKVKRSPIRTWFPNYPGKLGDSETGLKYFESLFLSLNRSNKPIYVHRTCATDTQSMRFVLGAVTDLVIQQNLKKSGIL

SEQ ID NO: 7974 - protein, 262 aa, Agaricus bisporus
MAPGFTISFVNKTIIVTGGNRGIGLAFTRAVAAAGANVAVIYRSAKDAVEVTEKVGKEFGVKTKAYQCDVSNTDIVTKTIQQIDADLGAISGLIANAGVSVVKPATELTHEDFKFVYDVNVFGVFNTCRAVAKLWLQKQQKGSIVVTSSMSSQIINQSSLNGSLTQVFYNSSKAACSNLVKGLAAEWASAGIRVNALSPGYVNTDQTAHMDKKIRDHQASNIPLNRFAQPEEMTGQAILLLSDHATYMTGGEYFIDGGQLIW

SEQ ID NO: 7975 - protein, 368 aa, Helicobacter pylori
MLTQEDVLNALKTIIYPNFEKDIVSFGFVKNITLHDDQLGLLIEIPSSSEETSAILRENISKAMQEKGVKALNLDIKTPPKPQAPKPTTKNLAKNIKHVVMISSGKGGVGKSTTSVNLSIALANLNQKVGLLDADVYGPNIPRMMGLQSADVIMDPSGKKLIPLKAFGVSVMSMGLLYDEGQSLIWRGPMLMRAIEQMLSDIIWGDLDVLVVDMPPGTGDAQLTLAQAVPLSAGITVTTPQIVSLDDAKRSLDMFKKLHIPIAGIVENMGSFVCEHCKKESEIFGSNSMSELLEAYHTQILAKLPLEPKVRLGGDRGEPIVISHPNSVSAKIFEKMAQDLSAFLERVKKEKLADNKDIQPTQTHACSH

SEQ ID NO: 7976 - protein, 381 aa, Mycobacterium tuberculosis
MSGTRDGDLNAAIRTALGKVIDPELRRPITELGMVKSIDTGPDGSVHVEIYLTIAGCPKKSEITERVTRAVADVPGTSAVRVSLDVMSDEQRTELRKQLRGDTREPVIPFAQPDSLTRVYAVASGKGGVGKSTVTVNLAAAMAVRGLSIGVLDADIHGHSIPRMMGTTDRPTQVESMILPPIAHQVKVISIAQFTQGNTPVVWRGPMLHRALQQFLADVYWGDLDVLLLDLPPGTGDVAISVAQLIPNAELLVVTTPQLAAAEVAERAGSIALQTRQRIVGVVENMSGLTLPDGTTMQVFGEGGGRLVAERLSRAVGADVPLLGQIPLDPALVAAGDSGVPLVLSSPDSAIGKELHSIADGLSTRRRGLAGMSLGLDPTRR

SEQ ID NO: 7977 - protein, 369 aa, Escherichia coli O6
MNEQSQAKSPEALRAMVAGTLANFQHPTLKHNLTTLKALHHVAWMDDTLHVELVMPFVWHSAFEELKEQCSAELLRITGAKAIDWKLSHNIATLKRVKNQPGINGVKNIIAVSSGKGGVGKSSTAVNLALALAAEGAKVGILDADIYGPSIPTMLGAENQRPTSPDGTHMAPIMSHGLATNSIGYLVTDDNAMVWRGPMASKALMQMLQETLWPDLDYLVLDMPPGTGDIQLTLAQNIPVTGAVVVTTPQDIALIDAKKGIVMFEKVEVPVLGIVENMSVHICSNCGHHEPIFGTGGAEKLAEKYHTQLLGQMPLHISLREDLDKGTPTVISRPESEFTAIYRQLADRVAAQLYWQGEVIPGEISFRAV

SEQ ID NO: 7978 - protein, 392 aa, Malus x domestica
MAVECMIKPSSLQTMTQPPSPKTQQTQQHKEDDQKPLVFDASVFRYQTEIPSQFIWPDHEKPCKNTPELQVALIDLGGFLSGDKEAVAKASQLVGEACQKHGFFLIVNHGVDNKLIADAHCYMDDFFGMPLSEKQRAERKAGESCGYASSFTGRFSSKLPWKETLSFSYSAEKGSTNFIQDYFCDKMGEEFKEFGRVYQDYCKAMSTLSIGIMELLGLSLGVDRAYFKEFFEDNNSIMRLNYYPPCQRPEQTLGTGPHCDPTALTILHEDQVGGLEVFVDDQWHSVTPNLNAFVVNIGDTFMALSNGKYKSGLHRAVVNSETPRKSLAFFLCPRDDKVVKPPSGLVDTSSPRKYPDFTWSMLLEFTMKHYRADMKTLQVFSNWVQQKSNQKL

SEQ ID NO: 7979 - protein, 214 aa, Lycopersicon esculentum
AAGRKPSLNISIPSVKKTEEPKTGEVKTGEPKTEEPKTGEVKTEYSVKEKMVENSEKKRYRGVRQRPWGKFAAEIRDPTRKGTRVWLGTFDTAMDAAMAYDRAAFRLRGSKAILNFPLEVSNFKQENHEIEKNVVNLNSNTNSCGKRVRREMENDDGIVMKKEVKREQMVATPLTPSNWSSIWDCGNGKGIFEVPPLSPLSPHSNFGYSQLLVS

SEQ ID NO: 7980 - protein, 447 aa, Lycopersicon esculentum
MGSVIDENQQPLLLAENKIEDLKTRVWIETKKLWHIVGPAIFSRIASYTMNIITQSFAGHLGEVQLAAISISNTVIVGLNFGLLLGMASALETLCGQAYGAKKHHMLGIYMQRSWIVLTLCCFLLLPMYIYATPILKSLGQPDDVAELSGIVALWFIPLHFSFAFQFPIQRFLQSQLKTVVIAWISLAVLAIHTVISWLFVYKLNLGLVGAAVALDISWWLLVVGMFMYAACGGCPETWTGFSAQAFSGLCEFFRLSAAAGVMLCLENWYYRILMLMTGYLENATLALDALSICMNIIGWEMMIPLAFFAATGVRVANELGAGRGKAAKFATAVSVIQSTIIGLIFCVLIMIYEDKFALIFSSSFDVLKAFKKISYLLAFTILLNSVQPVLSGFAVGSGWQSKVAYINLGCYYLVGVPLGILMGMILRTGLEGMWAGMIFGGTALQI

SEQ ID NO: 7981 - protein, 518 aa, Callistephus chinensis
MTILPFIFYTCITALVLYVLLNLLTRNPNRLPPGPTPWPIVGNLPHLGMIPHHSLAALAQKYGPLMHLRLGFVDVVVAASASVAAQFLKTHDANFASRPPNSGAKHIAYNYQDLVFAPYGPRWRMLRKICSVHLFSTKALDDFRHVREEEVAILTRVLVHAGESAVKLGQLLNVCTTNALARVMLGRRVFADGSEGRGVDPKADEFKDMVVELMELAGEFNIGDFIPPLDCLDLQGITKKMKKLHARFDKFLNIILDDHKIEKGAAGRRHSDLLTTLISLKDVDAADDDEEGKLSDIEIKALLLNLFAAGTDTSSSTVEWAVAELIRHPELLKQAREEMDIVVGRDRLVTELDLSRLTFLQAIVKETFRLHPSTPLSLPRMASESCEVDGYYIPKGSTLLVNVWAIARDPKMWTNPLEFRPSRFLPGGEKPDADIKGNDFEVIPFGAGRRICAGMSLGMRMVQLLIATLVQTFDWELANGLDPEKLNMEEAYGLTLQRAEPLMVHPRPRLSPHVYESR

SEQ ID NO: 7982 - protein, 510 aa, Callistephus chinensis
MSILSLLVYFCISLLVIIALVNMFITRHTNRLPPGPAPWPVVGNLPHLGAIPHHTLAALATKYGPLVYLRLGFVHVVVASSPSVAAQFLKVHDLKFASRPPNSGAKHIAYNYQDMVFAPYGPQWTMFRKICKDHLFSSKALDDFRHVRQEEVAILARGLAGAGRSKVNLGQQLNMCTANTLARMMLDKRVFGNESGGDDPKANEFKEMATELMFLAGQFNIGDYIPVLDWLDLQGIVKKMKKLHTRFDKFLDVILDEHKVIASGHIDMLSTLISLKDDTSVDGRKPSDIEIKALLLELFVAGTDTSSNTVEWAIAELIRQPHLLKRAQEEMDSVVGQNRLVTEMDLSQLTFLQAIVKEAFRLHPSTPLSLPRIASESCEVDGYYIPKGSTLLVNIWAIGRHPEVWTDPLEFRPTRFLPGGEKPGIVVKVNDFEVLPFGAGRRICAGMSLALRTVQLLMGTLVQAFDWELANGIKPEKLNMDEAFGLSVQRAEPLVVHPRPRLPPHVYKSG

SEQ ID NO: 7983 - protein, 511 aa, Lycianthes rantonnei
MVLLLISELCASAIIFIIVHIIISKLIATGWGRRQRLPPGPMGWPVIGALPLLGTMPHVALAKMAKKYGPIMYLKVGTCGMVVASTPNAAKAFLKTLDINFSNRPPNAGATHLAYDAQDMVFAHYGPRWKLLRKLSNLHMLGGKALEDWANVRANELGHMLKSMFDASRVGGRVVVADMLTFAMANMIGQVILSKRVFVEKGAEVNKFKDMVVELMTVAGYFNIGDFIPQLAWMDLQGIEKGMKCLHKKFDDLLTKMFDEHKATTNERKGKPDFLDVVMANRDNSEGERLSTNNIKALLLNLFTAGTDTSSSAIEWALAEMMKNPQILKKVQQEMDQIIGKNRRLIESDIPNLPYLRAVCKETFRKHPSTPLNLPRISNEPCMVDGYYIPKNIRLSVNIWAIGRDPDVWENPLEFNPERFLSGKNVKIDPRGNDFELIPFGAGRRICAGTRMGIVMVEYILGTLVHSFDWKFSNDVKEINMEESFGLALQKAVPLEAMVTPRLPFDVYYTN

SEQ ID NO: 7984 - protein, 513 aa, Matthiola incana
MTTLILTILLATFLSLFIFFLLRRNRNRNHRLPPGPNPWPIVGNLPHMGPKPHQTLAAMVTTYGPILHLRLGFVNVVVAASKSVAEQFLKIHDANFASRPPNSGAKHIAYNYQDLVFAPYGQRWRMLRKISSVHLFSAKALEDFKHVRQEEIGRLTREVARADTKPVNLGQLVNMCVVNALGREMIGRRLFGDGADHKAEEFRSMVTEMMALAGVFNVGDFVPALDWLDLQGVAGKMKRLHKRFDAFLSSILKEHEINNGGDQKHTDMLTTLISLKGTDFDGDGASITDTEIKALLLNMFTAGTDTSASTVDWAIAELIRHPHIMKRTQEELDAVVGRNRPINESDLSRLPYLQAVIKENFRLHPPTPLSLPHIAAESCEINGYHIPKGSTLLTNIWAIARDPEQWSDPLAFRPERFLPGGEKFGVDVKGSDFELIPFGAGRRICAGLSLGLRTIQLLTATLVHGFEWELAGGVTPEKLNMEETYGITVQRAVPLIVHPKPRLALNVYGVGSG

SEQ ID NO: 7985 - protein, 511 aa, Pelargonium x hortorum
MYNMSLYLLLGSSALAFAAYLVLFSFSKSRRRLPPGPKAWPIVGNLPHMGSMPHQNLAAMARTYGPLVYLRLGFVDVVVALSASMASQFLKTHDSNFSSRPPNAGAKHIAYNYHDLVFAPYGPRWRLFRKITSIHLFSGKALDDYRHVRQEEVGVLASNLARAVSTIVNLGQLLNICATNALGRAVIGKKVFKDGTDDVDPKADEFKSMVVELMVLAGVFNIGDFIPPLDCLDLQGVASKMKNLHKRFDAFLSAILQEHNINSAASATPSMLTTLISLKDSVEDSEGGKLTDTEIKALLLNMFTAGTDTTSSTVEWAIAELIRQPEILIRAQKEIDSVVGRDRLVTELDLSKLPYLQAIVKETFRLHSSTPLSLPRIATQSCEINGYHIPKGATLLVNVWAIARDPDVWADPLSFRPERFLPGSEKENVDVKGNDFELIPFGAGRRICAGMSLGLRMVQLLTATLLHAFNWDLPQGQIPQELNMDEAYGLTLQRASPLHVRPRPRLPSHLY

SEQ ID NO: 7986 - protein, 391 aa, Homo sapiens
MDQCVTVERELEKVLHKFSGYGQLCERGLEELIDYTGGLKHEILQSHGQDAELSGTLSLVLTQCCKRIKDTVQKLASDHKDIHSSVSRVGKAIDKNFDSDISSVGIDGCWQADSQRLLNEVMVEHFFRQGMLDVAEELCQESGLSVDPSQKEPFVELNRILEALKVRVLRPALEWAVSNREMLIAQNSSLEFKLHRLYFISLLMGGTTNQREALQYAKNFQPFALNHQKDIQVLMGSLVYLRQGIENSPYVHLLDANQWADICDIFTRDACALLGLSVESPLSVSFSAGCVALPALINIKAVIEQRQCTGVWNQKDELPIEVDLGKKCWYHSIFACPILRQQTTDNNPPMKLVCGHIISRDALNKMFNGSKLKCPYCPMEQSPGDAKQIFF

SEQ ID NO: 7987 - protein, 163 aa, Dunaliella tertiolecta
ASAQQPLNQQAPPPPTSFASQLQHTLGQQQFCDPTLIDRGLQHADKRRRDWIDVDALNEDDTQACSAYAVPIFEHLREAELVRRPNALYPEAFQTDVNAKMRAILVDWLVEVAEEYKLCADTLYLSVNYIDRFLSIHPVQRSNLQLVGIACMWIASKYEEIYP

SEQ ID NO: 7988 - protein, 1050 aa, Lycopersicon esculentum
MAGNDWINSYLEAILDVGPGLDDKKSSLLLRERGRFSPTRYFVEEVITGFDETDLRRSWIRAQATRSPQRRNTRLENMCWRIWNLARQKKQLEGEQARWMAKRRQERERGRREAVADMSEDLSEGEKGDIVTDMSSHGESTRGRLPRISCVETMEAWVSQQRGKKLYIVLISLHGLIRGENMELGRDSDTGGQVKYVVELARLGSMPGVYRVDLLTRQVSSPEVDWSYGEPTEIVTPISTDGLMSEMGESSGAYIIRIPFGPREKYIPKEQLWPYIPEFVDGALTHIIQMSKVLGEEIGNGHPVWPVAIHGHYADAGDSTRLLSGASNVPMLFTGHSLRRDKLEQLLRQGRFVKDEVNSTYRYTRIEAENTLDRSEIVITSTRHEIDEQWRLYDGFDPILERKLRARIKRNVSCYGRFMPRMAVIPPGMEFHHIVPHEGDMDGDTEGSEDGKIPDPPIWAEIMRFFSNPRKPMILALARPDPKKNLTTLVKAFGECRPLRELANLTLIMGNRDNIDEMSSTNSALLLSILKMIDKYDLYGQVAYPKHHKQSDVPDIYRLAGKTKGVFINPAFIEPFGLTLIEAAAYGLPMVATKNGGPVDIHRVLDNGLLVDPHDQQAIADALLKLVADKQLWTKCRANGLKNIHLFSWPEHCKTYLSRIASCKPRQPRWLRPDDDDDENSETDSPSDSLRDIHDISLNLRFSLDGEKNDNKENADSTLDPEVRKSKLENAVLSLSKGAPKSTSKSWSSDKADQRSGAGKFPAIRRRHIFVIAVDCDASSGLSGSVKKIFEAVEKERSEGSIGFILASSFNISEVQSFLVSEGMSPTDFDAYICNSGGDLYYSSFHSEQNPFVVDLYYHSHIEYRWGGEGLRKTLVRWAASITDKNGENGEHIVVEDEDNSADYCYTFKVCKPGKVPPAKELRKVMRIQALRCHAVYCQNGGRINMIPVLASRSQALRYLYLRWGMDLSKLVVFVGESGDTDYEGLIGGLRKAVIMKGLCTNASSLIHGNRNYPLSDVLPFDSPNVIQADEECSSTEIRSLLEKLAVLKG

SEQ ID NO: 7989 - protein, 376 aa, Homo sapiens
MSTAGKVIKCKAAVLWEVKKPFSIEDVEVAPPKAYEVRIKMVAVGICHTDDHVVSGNLVTPLPVILGHEAAGIVESVGEGVTTVKPGDKVIPLFTPQCGKCRVCKNPESNYCLKNDLGNPRGTLQDGTRRFTCRGKPIHHFLGTSTFSQYTVVDENAVAKIDAASPLEKVCLIGCGFSTGYGSAVNVAKVVTPGSTCAVFGLGGVGLSAVMGCKAAGAARIIAVDINKDKFAKAKELGATECINPQDYKKPIQEVLKEMTDGGVDFSFEVIGRLDTMMASLLCCHEACGTSVIVGVPPASQNLSINPMLLLTGRTWKGAVYGGFKSKEGIPKLVADFMAKKFSLDALITHVLPFEKINEGFDLLHSGKSIRTVLTF

SEQ ID NO: 7990 - protein, 657 aa, Trypanosoma brucei
MDAYETLGMLGEGTYGVVVKARHRATSRIVAIKKYKQAEDDDHVRKTSLREVRVLKQLRHPNVIALLDVFRRDGKLYLVFEYVENTILQLIEEKKYGLSPDEVRRYTFQLLNGVSYCHAHNIIHRDVKPENILVSRDGVLKLCDFGFARQLSCRGNYTEYVATRWYRAPELLVGDVSYGKAVDVWAIGCVFSELSDGQPLFPGDSDLDQLSLIMRACGPVPQQMVSTFEHNALYRRVTFPSVDVEETLQQRFPTAASPWLEFLTSCLRMDPVERPSCTALMSMAYFTENNFRATYELELRELFQHCQPPLVDVAPTSPDHNFSREQQHQQQTLGNDRVDAELTLPRLAAPSLDAETTDKVDSAESKNTTMGVSSEVVGGVGGSVVVDSNSNSFHQLGALWSHYIGSTVGATMALSGELPNIGPRQAHPYPSGLPPGVQVTKPVPRSGTNSVGDKNYNGVQAMKVTGCLRLSAKNISRSPDVQRVKASAAQSGPKVKQAKSEVKPEQKREWKSCSALGKSVKPNYLFPLLPNGTNNSGITSYGPSGVAVGAGPAPQDACSPLVSKGLRPPSSNGIPGAGLHSNGSTTSFSAHKDEKMDLGCGEQNNNGSDHKQRKKHVKRTHDNGELEGPPRKVSDKPSSQHSVAGHRYSFRDGATKR

SEQ ID NO: 7991 - protein, 345 aa, Homo sapiens [sequence omitted]

SEQ ID NO: 7992 - protein, 827 aa, Brassica rapa
IYFNTLSSTETLTISSNRTLVSPGDVFELGFFRTNSSSGWYLGIWYKKVSYRTSVWVANRDSPLFNAIGTLKISSNNLVLRGQSNKSVWSTNLTRGNERFPVVAELLANGNFVIRYSNKNDASGFLWQSFDYPTDTLLPEMKLGYDLKTEQNRFLTSWRNSDDPSSGEISYFLDTESGMPEFYLLKSGLRAYRSGPWNGVRFSGIPGDQYLSYMVYNYTENSEEVAYTFRMTTHSIYSRLKISSKGFLERLTWTPTSIAWNLIWYLPVENQCDVYMVCGVYSYCDENTSPMCNCIQGFMPLNEQRWDLRDWSSGCTRRTRLSCSGDGFTRMRKMKLPETKMANVYRSIGVKECEKRCLSDCNCTAFANADIRNGGTGCVIWTGRLDDIRNYYADGQDLYVRLAAADLVKKRDANWKIISLIVGVSVVLLLMIMFCLWKKKQNRAKAMASSIVNHQRNQNVLMNTMTQSNKRQLSRENKIEEFELPLIELEAVVKATENFSNCNELGRSGFGIVYKGMLDGQEVAVKRLSKTSLQGIDEFMNEVRLIARLQHINLVRILGCCIEADEKILIYEYLENSSLDYFLFGKKRSSNLNWKDRFAITNGVARGLLYLHQDSRFRIIHRDLKPGNILLDKYMIPKISDFGMARIFARDETQARTDNAVGTYGYMSPEYAMDGVISEKTDVFSFGVIVLEIVSGKRNRGFYQVNPENNLPSYAWTHWAEGRALEIVDPVIVDSLSSLPSTFKPKEVLKCIQIGLLCIQERAEHRPTMSSVVWMLGSEATEIPQPKPPVYCLIASYYANNPSSSRQFDDDESWTVNKYTCSVIDAR

SEQ ID NO: 7993 - protein, 195 aa, Zea diploperennis
APLDKVCILSCGISTGLGASINVAKPPKGSTVAVFGLGAVGLAAAEGARIAGASRIIGVDLNPSRFEEARKFGCTEFVNPKDHNKPVQEVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFAEINKA

SEQ ID NO: 7994 - protein, 195 aa, Zea diploperennis
APLDKVCVLSCGISTGLGASINVAKPPKGSTVAVFGLGAVGLAAAEGARIAGASRIIGVDLSPSRFEEARKFGCTEFVNPKDHNKPVQEVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFAEINKA

SEQ ID NO: 7995 - protein, 195 aa, Zea perennis
APLDKVCVLSCGISTGLGASINVAKPPKGSTVAVFGLGAVGLAAAEGARIAGASRIIGVDLNPSRFEEARKFGCTEFVNPKEHNKPVQEVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFAEINKA

SEQ ID NO: 7996 - protein, 195 aa, Zea perennis
APLDKVCVLSCGISTGLDASINVAKPPKGSTVAVFGLGAVGLAAAEGARIAGASRIIGVDLNPSRFEEAMKFGCTEFVNPKDHNKPVQEVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFAEINKA

SEQ ID NO: 7997 - protein, 195 aa, Zea perennis
APLDKVCILSCGISTGLGASINVAKPPKGSTVAVFGLGAVGLAAAEGARIAGASRIIGVDLNPSRFEEARKFGCTEFVNPKDHIKPVQEVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFAEINKA

SEQ ID NO: 7998 - protein, 893 aa, Oryza sativa; identical to SEQ ID NO: 1050

SEQ ID NO: 7999 - protein, 172 aa, Silurana tropicalis
MRAILVDWLVQVQMKFRLLQETMFMTVGIIDRFLQDHPVPKNQLQLVGVTAMFLAAKYEEMYPPEIGDFTFVTDHTYTKAQIRDMEMKVLRVLKFAIGRPLPLHFLRRASKIGEVTAEQHSLAKYLMELVMVDYDMVHYSPSQIAAAASCLSLKILNTGEWTPTMHHYMAYS

SEQ ID NO: 8000 - protein, 166 aa, Silurana tropicalis
MRAILVDWIVQVHSRFQLLQETLYMGIAIMDRFLQVQPVSRSKLQLVGVTSLLVASKYEEMYTPEVADFVYITDNAYTASQIREMEMIILRVLNFDLGRPLPLHFLRRASKSCSADAEQHTLAKYLMELTLIDYEMVHFNPSEIAAAALCLSQKILAQGSWGATQH

SEQ ID NO: 8001 - protein, 166 aa, Silurana tropicalis
MRAILVDWLVQVHLRFKLLQETMSMTIAILDRFLQENPVPKKLLQLAGVSAMFIACKYEEIYCPTIGDFAFVTDHTYTKSQIRNMEMQILRVLKFDIGRPLPLHFLRRASKIGEVDSVHHTLAKYLIELVMTDYDMVHVPPSQLAAAAFCLAMKILNSGEWTPVLE

SEQ ID NO: 8002 - protein, 182 aa, Silurana tropicalis
MSAILVDWLIQVHLKFQLLQETLYMAIAIMDRFLQGQPISRSKLQLVGVTSLFIASKYEEMYYPEISDFVYITDNTYSKAQIREMEMMILKELNFDLGRPLPLNFLRRASKCCSADAGQHTLAKYFMELTLLDYDMVHFHPSAIAAAALCLTQKVLNIGTWDATLQFYTGYSQDDLILPMKH

SEQ ID NO: 8003 - protein, 160 aa, Casuarina glauca
MSTLEGRGFTEEQEALVVKSWSAMKPNAGELGLKFFLKIFEIAPSAQKLFSFLKDSNVPLERNPKLKSHAMSVFLMTCESAVQLRKAGKVTVRESSLKKLGASHFKHGVADEHFEVTKFALLETIKEAVPETWSPEMKNAWGEAYDKLVAAIKLEMKPSS

SEQ ID NO: 8004 - protein, 162 aa, Parasponia rigida
MSSSEVNKVFTEEQEALVVKAWAVMKKNSAELGLQFFLKIFEIAPSAKNLFSYLKDSPVPLEQNPKLKPHATTVFVMTCESAVQLRKAGKATVKESDLKRIGAIHFKTGVVNEHFEVTRFALLETIKEAVPEMWSPEMKNAWGVAYDQLVAAIKFEMKPSST

SEQ ID NO: 8005 - protein, 161 aa, Trema tomentosa
MSSSEVDKVFTEEQEALVVKSWAVMKKNSAELGLKFFLKIFEIAPSAKNLFSYLKDSPIPLEQNPKLKPHAMTVFVMTCESAVQLRKAGKVTVRESNLKRLGAIHFKNGVVNEHFETRFALLETIKEAVPEMWSPEMKNAWGEAYDQLVAAIKSEMKPSST

SEQ ID NO: 8006 - protein, 825 aa, Hordeum vulgare subsp. vulgare
MAFSPRSPWSRSKKPDIYSTVVVHDDEDDAHGGGAARAEDDDDDDPSALPPLLQRLPKDFGGASFDDDDDPYSSDLDDASLSATVVIKRGAPASTSSSSRSPFLDLRRSSPRAAEADPYSTFVVHGTARSGGASSPRESVSGTFIRHSGGPPSPRESVSGTFIRHTRGSSSPRESYSGTFIHHTSGASSPRDPASGAGAGFGSSFMTPSTGQAEEDRQPSLLMQQQQSRRQASMSSVPDSVTREDPSTKYELLHELGKGSYGAVYKARDLRTQELVAVKIISLTEGEEGYEDIRGEIEMLQQCSHPNVVRYFGSYQGEEYLWIVMEYCGGGSVADLIGITEEPLDEPQIAYICRETLKGLAYLHTIFKVHRDIKGGNILLTEQGEVKLGDFGVAAQLTRTMSKRNTFIGTPHWMAPEVIQESRYDGKVDVWALGVSAIEMAEGMPPRSTVHPMRVIFMISSEPAPMLEDKEKWSLLFHDFIAKCLTKDARLRPAAIEMLKHKFIEKCNTGASKMLAKIKEAKIIRETAVQNQLPDSDDAMDATVRINEDYGETVPTNSQSTHETKNDGSGGDFGTMIVHPEDGDEAVESSIFPRAEFIPGLGSINSFTHDPKRAELISKFWAENTADSDATKGRDLDGLPDTQEPKAMPRSIGTFKHHKGVEGTVLRHDNTASPGVASTMTKLSSSPSRKAFSVQDKLWSIYAAGNTVPIPFLKAIDISPLALVSDSVAGNGPAGSSTTDALEAVRELFSGDGQAKKGRKGQNEVPLPPGVHDRLTTSPTLMNLAQALAYHKTCYEDMPLQDSQATEEQQTIQNLCDTLRTILRL

SEQ ID NO: 8007 - protein, 122 aa, Allium cepa
GYLKKGRYAQRVGTGAPVYLAAVLEYLAAEVLELAGNAAKDNKKNRIIPRHVLLAIRNDEELGKLLGGVTIAHGGVLPNINPVLLPKKIAAKGIRDSKSPKKTAAKSPKKVAAENTQKSVAA

SEQ ID NO: 8008 - protein, 616 aa, Candida albicans
ARASADQQQHQHNHHHHHHHHHHNENQSQQQVPIDPAANPANRIGRYQILKTLGEGSFGKVKLAQHLGTGQKVALKIINRKTLAKSDMQGRVEREISYLRLLRHPHIIKLYDVIKSKDEIIMVIEFAGKELFDYIVQRGKMPEDEARRFFQQIIAAVEYCHRHKIVHRDLKPENLLLDDQLNVKIADFGLSNIMTDGNFLKTSCGSPNYMPAPEVISGKLYSSVQKLMIWSAGVILGMSCCVVDYHSMTSSIPALFKKISNGVYTLPNYLSAGAKHLLTRMLVVNPLNRITIHEIMEDDWFKQDMPDYLLPPDLSKNKNSKIDVDEDVIRALSVTMGYDRDCKIVNVIEKANKQVAAGNSSSQQSKSSNEILDAYLLMKENHRLVKDLKKSKSENIESFLSQSPPPSPFPNAGSTSSAPGVQQSLTYQTLATVPDLSTLPNSTIAILPTSLPSIHRAYMAETKQNGDPSQQHAPPPTKKSKTRWHFGIRLRSYPLDVMGEIYRALKNLGAEWAKPTEEELWTIRVRWKYDTSAQFECGSAPNLMKMQIQLFQLEPNNYLVSFKFSGWESAHGNAGTDSPQSHRQQDLDEVGSFSAYPFLHLATRLIMELAVNSQSG

SEQ ID NO: 8009 - protein, 396 aa, Antirrhinum majus
MDPDAFLFKWDHRTALPQPNRLLDAVAPPPPPPPQAPSYSMRPRELGGLEELFQAYGIRYYTAAKIAELGFTVNTLLDMRDEELDEMMNSLCQIFRWDLLVGERYGIKAAVRAERRRIDEEEVRRRHLLLGDTTHALDALSQEGLSEEPVQQEKEAMGSGGGGVGGVWEMMGAGGRKAPQRRRKNYKGRSRMASMEEDDDDDDDETEGAEDDENIVSERQREHPFIVTEPGEVARGKKNGLDYLFHLYEQCRDFLIQVQTIAKERGEKCPTKVTNQVFRYAKKAGANYINKPKMRHYVHCYALHCLDEAASNALRRAFKERGENVGAWRQACYKPLVAIAARQGWDIDTIFNAHPRLSIWYVPTKLRQLCHAERSSAAVAATSSITGGGPADHLPF

SEQ ID NO: 8010 - protein, 671 aa, Leishmania major
MVHKKQAWAKRVKKERFKKKFLTRMQATRLLQMESVQFRRLCILKGIYPRALNRSKQKQSGNEKQYYLAREIKWLVRDQIAEKMMAYRAWEKKVKRAEAMGRSEDLKVLQTSRVKPRHSLVATIKERYPYFIDAIRDVDDAMSMIHLYAFLSPEIKSDTTIEIHHSLTSGLSERAKEVCERWDRYVARARVLTKGFISIKGYYYEAIVKGERVRWLCPHEYAHRFPPGIQQYVMLSFLEFYLEMMKFVLFKLESDLARDEADRLAAEDEEGVTRANAEDFANGAALAVLDVGANQAQAKAVKEAESKRSLMEEELHKVRELFRGLTFFISREVPAKHFALVINACGGRVATDYVPSNITHVVVDRPALPPGMKKHDQLEYVQPQYIFDCLNARLVLPVTGYRIGEELPPHVSPFSVSITNSAEDNAAVVQVKKDHPRIVGYVPARVHEIRKLINPSYSAVDPEGKVAHLEDEYSDEESHVAVPEMDMEDDVSLSGDELAEARRKPAWQEEEVTEEVQRPKLSAFKVKKQREMNLMNAPTNEVVARRRQALRKAQEKSRQTETSEARLQRKMSEVKRQEAATRKMQLQVARKKAARFYKMVSGVVQGTAKKVATLEAKAKHIAEGKLRKTEDGKGLVNKRLEARRQRAEAKGKKLKERKAGNPYKKLPKWVQ

SEQ ID NO: 8011 - protein, 444 aa, Leishmania major
MRGDRSPCSHARSSQDEDVSIYLCVCVCACPSLSAPCYTSSAPSHIALPAPPWHMRQPTLTHTHAHRESFRFHRIREWQIRNESHTHTHTQAARIGPSPLPPTQSSAQLLLYRSVSRRRRVLSFACRVGRVLDISPPSLLSLSLSLCVCVCEKESETPMSSDAALDEKLTELLRVMVSRLPVNKTLPAAVVQQLLRAKYGDTYPEAYVESCSAFISDTVMKLMIEKEKAATAVTANGDASDEDDDDDDDSNASDEDDSDEGDSEEDEEEDAASDSDDEDFDSDDDDDDGDDDDDDAEEPKKKSVRAEEVDGIVLKDQEAAAAPSSAVPVAERCKAMAECLRKLSYHVRAPTAEESLEDYLREFLLVEFEKHGMDPNKYSKSDIKRYRIKREVELLQQDGASLSLDRRNRAGRGFSKGAGGSGSQASPSPSAASARQASMFLDDE

SEQ ID NO: 8012 - protein, 351 aa, Leishmania major
MDVRRTPTPTTLTQYIIKSQPPHSRGDFTLLMMAIQTSVKVIEKNIRRAGMKGMLGYIAGQSANATGDHQAKLDVISNIAFKAYLLSSTSVCVLGSEEEEQMIIAESGRRGDYLIFFDPLDGSSNIDANVSVGSIWGVWRLPKDTTINSVEDANAVIRMLKGTDMVSAGYAVYGSATNLVLTSGHGVDGFTLDPNIGEFILTHPHISIPKKRSIYSVNEGNYGKWEPWFKEYIDYLKMNKTTRYSARYIGSMVGDIHRTLLYGGIFCYPKDANQVEGKLRLLYEAAPMAMIVEQAGGKAVGSNGRILEQSITRLHQRTPVYFGSRQEVDLCMAFRDRNVKTEALAPTSSKL

SEQ ID NO: 8013 - protein, 416 aa, Xenopus laevis
MMPSLRPSRPVASKLPKLGKPVTAENNRLDKVEISQTKRSPSSPQGGAKKRAAFGDITNAHKNPQLIQKKKEGQKVAIKKTKSAPTSDITKNNELNIKKTQKKATVTEEHLPEVKEEKINTEQKTSVPTKEIPEEKVLPPGVEDIDQDSLDDPFSNSEYATDIFSYMRDREEKFLLPNYLEMQTDISKDMRAILVDWMVEVQENFELNHETLYLAVKMVDHYLAVSVVMKEKLQLIGSTAVLIASKFEERCPPCVDDFMYICDDAYKRDEVIAMEMEILQKLYFDINIPVPYRFLRRFAKCAHATMETLTLARYICELTLQEYDFVQERASKMAASCLLLALQMKGLGRWTATLHYYSGYQTNDLLPLVKRLNFLLTYPPNKKLKAVRSKYSHRVFFEVAKLPPMDMLTLTEALQS

SEQ ID NO: 8014 - protein, 393 aa, Xenopus laevis
MALIMTRSMRLNAENVAQGMAGKKAAVSKPVPKPRNALGDIGNQIGKAKVPLKKTTKALRKPTVQKSEKLAVLEENVPKEAEKAAPDSPSPMETSVCVIEEMQPEPAFSSALIPVTDVDAEDSDNPMLCSDYVKDIYCYLRNLEAEQAIGPHYLDGQEINGNMRAILVDWLVQVQLRFKLLQETMSMTVSILDRFLQENPVPKKLLQLAGVSAMFIACKYEEIYCPSIGDFVFVTDNTYTKSQIRNMEMQILRVLNFDIGRPLPLHFLRRASKIGEVDSVHHTLAKYLIELVMTDYDMVHIPPSQLAAAAFCLAMKILNSGEWTPTLEHYMAYKESSLTPVMQHIAKNIVKVNGGHTKFMSVKNKYTSSRQMKISCLPHLKSELVENLAKAAS

SEQ ID NO: 8015 - protein, 390 aa, Xenopus laevis
MATWAAMRTGQMDNAVVGGVVAAKVKVHGHRPPLEEISNRTAILGRKPAAMNCKVPVKVVRQVTSRANLPLRVKQAFGPKSEEPPPIPMDVADNEEVLCQAFSEALNSVEDIDAEDSSNPQLCADYVKDIYSYLRQLEVQQAVRPRHLQGMEINDRMRAILVDWLIQVHLKFQLLQETLYMAIAIMDRFLQGQPISRSKLQLVGVTSLFIASKYEEMYYPEISDFVYITDNTYSKTQIREMEMMILKEINFDLGRPLPLNFLRRASKCCSADAGQHTLAKYFMELTLLDYDMVHFHPSAIAAAALCLTQKVLNMGTWDAALQFYTGYSQDDLSLPMKHMAKNIVQVNQNLSKFLSVKNKYSSSKLLKISTIPQLNSRVLTGLAAAVTPGS

SEQ ID NO: 8016 - protein, 744 aa, Mus musculus
MSTRTPLPTVNERDTENHISHGDGRQEVTSRTGRSGARCRNSIASCADEQPHIGNYRLLKTIGKGNFAKVKLARHILTGREVAIKIIDKTQLNPTSLQKLFREVRIMKILNHPNIVKLFEVIETEKTLYLIMEYASGGEVFDYLVAHGRMKEKEARAKFRQIVSAVQYCHQKRIVHRDLKAENLLLDADMNIKIADFGFSNEFTVGSKLDTFCGSPPYAAPELFQGKKYDGPEVDVWSLGVILYTLVSGSLPFDGQNLKELRERVLRGKYRIPFYMSTDCENLLKRFLVLNPVKRGTLEQIMKDRWINAGHEEDELKPFVEPELDISDQKRIDIMVGMGYSQEEIQESLSKMKYDEITATYLLLGRKSAELDASDSSSSSNLSLAKVRPNSDLSNSTGQSPHHKGQRSVSSSQKQRRYSDHAGPAIPSVVAYPKRSQTSTADSDLKEDGIPSRKSSSSAVGGKGIAPASPMLGNAGNPNKADIPERKKSPAVPSSSTASGGMTRRNTYVCSERCAADRHSVIQNGKENSAIPDERTPVASTHSISSATTPDRIRFPRGTASRSTFHGQPRERRTATYNGPPASPSLSHEATPLSQTRSRGSTNLFSKLTSKLTRRLPTEYERNGRYEGSSRNVSSEQKDENREAKPRSLRFTWSMKTTSSMDPSDMMREIRKVLDANNCDYEQRERFLLFCVHGDGHAENLVQWEMEVCKLPRLSLNGVRFKRISGTSIAFKNIASKIANELKL

SEQ ID NO: 8017 - protein, 729 aa, Mus musculus
MSTRTPLPTVNERDTENHISHGDGRQEVTSRTGRSGARCRNSIASCADEQPHIGNYRLLKTIGKGNFAKVKLARHILTGREVAIKIIDKTQLNPTSLQKLFREVRIMKILNHPNIVKLFEVIETEKTLYLIMEYASGGEVFDYLVAHGRMKEKEARAKFRQIVSAVQYCHQKRIVHRDLKAENLLLDADMNIKIADFGFSNEFTVGSKLDTFCGSPPYAAPELFQGKKYDGPEVDVWSLGVILYTLVSGSLPFDGQNLKELRERVLRGKYRIPFYMSTDCENLLKRFLVLNPVKRGTLEQIMKDRWINAGHEEDELKPFVEPELDISDQKRIDIMVGMGYSQEEIQESLSKMKYDEITATYLLLGRKSAELDASDSSSSSNLSLAKVRPNSDLSNSTGQSPHHKGQRSVSSSQKQRRYSDHAGPAIPSVVAYPKRSQTSTADSDLKEDGIPSRKSSSSAVGGKGIAPASPMLGNAGNPNKADIPERKKSPAVPSSSTASGGMTRRNTYVCSERCAADRHSVIQNGKENSAIPDERTPVASTHSISSATTPDRIRFPRGTASRSTFHGQPRERRTATYNGPPASPSLSHEATPLSQTRSRGSTNLFSKLTSKLTRSRNVSSEQKDENREAKPRSLRFTWSMKTTSSMDPSDMMREIRKVLDANNCDYEQRERFLLFCVHGDGHAENLVQWEMEVCKLPRLSLNGVRFKRISGTSIAFKNIASKIANELKL

SEQ ID NO: 8018 - protein, 1957 aa, Homo sapiens
VGLDDIMDEGVVKESGNDTIDEEELILPNRNLRDKVEENSVRSPRKSPRLMAQEQVRSLRQSTIAKRSNAAPLSNTKKASGKTVSTAKAGVKQPERSQVKEEVCMSLKPEYHKENRRCSRNSGQIEVVPEVSVSSSHSSVSSCLEMKDEDGLDSKHKCNNPGEIDVPSHELNCSLLSETCVTIGEKKNEALMECKAKPVGSPLFKFSDKEEHEQNDSISGKTGETVVEEMIATRKVEQDSKETVKLSHEDDHILEDAGSSDISSDAACTNPNKTENSLVGLPSCVDEVTECNLELKDTMGIADKTENTLERNKIEPLGYCEDAESNRQLESTEFNKSNLEVVDTSTFGPESNILENAICDVPDQNSKQLNAIESTKIESHETANLQDDRNSQSSSVSYLESKSVKSKHTKPVIHSKQNMTTDAPKKIVAAKYEVIHSKTKVNVKSVKRNTDVPESQQNFHRPVKVRKKQIDKEPKIQSCNSGVKSVKNQAHSVLKKTLQDQTLVQIFKPLTHSLSDKSHAHPGCLKEPHHPAQTGHVSHSSQKQCHKPQQQAPAMKTNSHVKEELEHPGVEHFKEEDKLKLKKPEKNLQPRQRRSSKSFSLDEPPLFIPDNIATIRREGSDHSSSFESKYMWTPSKQCGFCKKPHGNRFMVGCGRCDDWFHGDCVGLSLSQAQQMGEEDKEYVCVKCCAEEDKKTEILDPDTLENQATVEFHSGDKTMECEKLGLSKHTTNDRTKYIDDTVKHKVKILKRESGEGRNSSDCRDNEIKKWQLAPLRKMGQPVLPRRSSEEKSEKIPKESTTVTCTGEKASKPGTHEKQEMKKKKVEKGVLNVHPAASASKPSADQIRQSVRHSLKDILMKRLTDSNLKVPEEKAAKVATKIEKELFSFFRDTDAKYKNKYRSLMFNLKDPKNNILFKKVLKGEVTPDHLIRMSPEELASKELAAWRRRENRHTIEMIEKEQREVERRPITKITHKGEIEIESDAPMKEQEAAMEIQEPAANKSLEKPEGSEKQKEEVDSMSKDTTSQHRQHLFDLNCKICIGRMAPPVDDLSPKKVKVVVGVARKHSDNEAESIADALSSTSNILASEFFEEEKQESPKSTFSPAPRPEMPGTVEVESTFLARLNFIWKGFINMPSVAKFVTKAYPVSGSPEYLTEDLPDSIQVGGRISPQTVWDYVEKIKASGTKEICVVRFTPVTEEDQISYTLLFAYFSSRKRYGVAANNMKQVKDMYLIPLGATDKIPHPLVPFDGPGLELHRPNLLLGLIIRQKLKRQHSACASTSHIAETPESAPPIALPPDKKSKIEVSTEEAPEEENDFFNSFTTVLHKQRNKPQQNLQEDLPTAVEPLMEVTKQEPPKPLRFLPGVLIGWENQPTTLELANKPLPVDDILQSLLGTTGQVYDQAQSVMEQNTVKEIPFLNEQTNSKIEKTDNVEVTDGENKEIKVKVDNISESTDKSAEIETSVVGSSSISAGSLTSLSLRGKPPDVSTEAFLTNLSIQSKQEETVESKEKTLKRQLQEDQENNLQDNQTSNSSPCRSNVGKGNIDGNVSCSENLVANTARSPQFINLKRDPRQAAGRSQPVTTSESKDGDSCRNGEKHMLPGLSHNKEHLTEQINVEEKLCSAEKNSCVQQSDNLKVAQNSPSVENIQTSQAEQAKPLQEDILMQNIETVHPFRRGSAVATSHFEVGNTCPSEFPSKSITFTSRSTSPRTSTNFSPMRPQQPNLQHLKSSPPGFPFPGPPNFPPQSMFGFPPHLPPPLLPPPGFGFAQNPMVPWPPVVHLPGQPQRMMGPLSQASRYIGPQNFYQVKDIRRPERRHSDPWGRQDQQQLDRPFNRGKGDRQRFYSDSHHLKRERHEKEWEQESERHRRRDRSQDKDRDRKSREEGHKDKERARLSHGDRGTDGKASRDSRNVDKKPDKPKSEDYEKDKEREKSKHREGEKDRDRYHKDRDHTDRTKSKR

SEQ ID NO: 8019 - protein, 175 aa, Homo sapiens
LLDCFVIPVVILLSWFFLLIRYKAVHFIGIVVCILGMGCMVGADVLVGRHQGAGENKLVGDLLVLGGATLYGISNVWEEYIIRTLSRVEFLGMIGLFGAFFSGIQLAIMEHKELLKVPWDWQIGLLYVGFSACMFGLYSFMPVVIKKTSATSVNLSLLTADLYSLFCGLFLFHYK

SEQ ID NO: 8020 - protein, 295 aa, Arabidopsis thaliana
NSYELSLVSCKCIGAYVRNKKNQNQICWLWQKVSSDNDRGFQRFLDNVQYKSSGILRYERVFGEGFVSTGGLETTKEFVDMLDLKPGQKVLDVGCGIGGGDFYMAENFDVDVVGIDLSVNMISFALEHAIGLKCSVEFEVADCTKKEYPDNTFDVIYSRDTILHIQDKPALFRRFYKWLKPGGKVLITDYCRSPKTPSPDFAIYIKKRGYDLHDVQAYGQMLRDAGFEEVIAEDRTDQFMKVLKRELDAVEKEKEEFISDFSKEDYEDIIGGWKSKLLRSSSGEQKWGLFIAKRN

SEQ ID NO: 8021 - protein, 731 aa, Oryza sativa (japonica cultivar-group); identical to SEQ ID NO: 3804

SEQ ID NO: 8022 - protein, 273 aa, Nicotiana tabacum
MSYPPIPQYSFYLFIILAMFSLSLKTCSSVPSKLVNISMAETDPFLPAVATWYGDPDGAGSDGGACGYGNDVRNPPFSAMVSAGNSNLFKGGKGCGACYQVICKEKVDCSEIPITVTITDECPATCGDGAPFHFDLSGTAFGALAKPGQADLFRGAGILNITYKRVACNYPQTTVTFKIDLGSNPSYFSCVIEFENGDGDLDIVELQTSGSDQWLPMKQLWGANWNIDLVPPQATAPFSIRLTTLDSKKTLVAENVIPVDWAPGKSYRSIVNF

SEQ ID NO: 8023 - protein, 134 aa, Schistosoma japonicum
MAVKSTSSKSDHKSVSAKVSSDSQSFTSVVKEFLYKYKTTTPKRLRVLDAYLAYVLLTGIIQFIYCCIAGTFPFNSFLSGFISCVASFILAVCLRMHSNPQNKNVFIPFCPESAYADFIFAHVILHLVVFNFIG

SEQ ID NO: 8024 - protein, 502 aa, Solanum tuberosum
MQFLSLASIFLFLSFLFLLRKWKNSNSQSKKLPPGPWKLPLLGSMLHMAGGLPHHVLRDLAKKYGPLMHLQLGEVSAVVVTSPDMAKEVLKTHDIAFASRPKLLAPEIVCYNRSDIAFCPYGDYWRQMRKICVLELLSAKNVRSYGSIRRDEVDRLVNFIRSSSGEPVNFTERLFLFTSSMTCRSAFGKVFKEQDKFIQLIKEVIGLAGGFDVADIFPSLKFLHVLSGMKGKIMNAHHKVDAIVEDVINEHKKKFAIGKTNGALGGEDLIDVLIRLMNDGGLQFPITNDNIKAIIFDMFAAGTETSSSTLVWAMVQMMKNPSVIAKAQAEVREAFKDKETFDENDVEELKYLKLVIKETLRLHPPVPLLVPRECREETDINGYTIPVKTKVMVNVWALGRDPKYWDDAESFKPERFEQRSVDFVGNNFEYLPFGGGRRICPGISFGLANVYLPLAHLLYHFDWKLPIGMEPKDLNLTELVGVTAARKDDLILVATPYEPPRQ

SEQ ID NO: 8025 - protein, 294 aa, Brassica napus
MDQYEKVEKIGEGTYGVVYKARDKVTNETIALKKIRLEQEDEGVPSTAIREISLLKEMQHSNIVKLQDVVHSEKRLYLVFEYLDLDLKKHMDSSPDFSKDLHMIKRYVYQILRGIAYCHSHRVLHRDLKPQNLLIDRRTNSLKLADFGLARAFGIPVRTFTHEVVTLWYRAPEILLGSHHYSTPVDIWSVGCIFAEMISQKPLFPGDSEIDQLFKIFRIMGTPTEDTWPGVTSLPDYKSAFPKWKPTDLESFVPNLDPNGIDLLSKMLLMDPTKRINARAALEHDYFKDIGVMP

SEQ ID NO: 8026 - protein, 301 aa, Lycopersicon peruvianum
MSQRTAPAPFLLKTYQLVDDAATDDVISWNEIGTTFVVWKTAEFAKDLLPKYFKHNNFSSFVRQLNTYGFRKIVPDKWEFANENFKRGQKELLTAIRRRKTVTSTPAGGKSVAAGASASPDNSGDDIGSSSTSSPDSKNPGSVDTPGKLSQFTDLSDENEKLKKDNQMLSSELVQAKKQCNELVAFLSQYVKVAPDMINRIMSQGTPSGSSLEELVKEVGGVKDLEEQGSYNDNDDKEDDDEKGDTLKLFGVLLKEKKKKRGPDENIETCGGRGKMMKTVDYNGPWMKMSSPAGESSKVCN

SEQ ID NO: 8027 - protein, 691 aa, Drosophila melanogaster
MSRSRSSAKAVQFKHESEEEEEDEEEQLPSRRMHSYGDAAAIGSGVPAFLAKLWRLVDDADTNRLICWTKDGQSFVIQNQAQFAKELLPLNYKHNNMASFIRQLNMYGFHKITSIDNGGLRFDRDEIEFSHPFFKRNSPFLLDQIKRKISNNKNGDDKGVLKPEAMSKILTDVKVMRGRQDNLDSRFSAMKQENEVLWREIASLRQKHAKQQQIVNKLIQFLITIVQPSRNMSGVKRHVQLMINNTPEIDRARTTSETESESGGGPVIHELREELLDEVMNPSPAGYTAASHYDQESVSPPAVERPRSNMSISSHNVDYSNQSVEDLLLQGNGTAGGNILVGGAASPMAQSVSQSPAQHDVYTVTEAPDSHVQEVPNSPPYYEEQNVLTTPMVREQEQQKRQQLKENNKLRRQAGDVILDAGDILVDSSSPKAQRTSIQHSTQPDVMVQPMIIKSEPENSSGLMDLMTPANDLYSVNFISEDMPTDIFEDALLPDGVEEAAKLDQQQKFGQSTVSSGKFASNFDVPTNSTLLDANQASTSKAAAKAQASEEEGMAVAKYSGAENGNNRDTNNSQLLRMASVDELHGHLESMQDELETLKDLLRGDGVAIDQNMLMGLFNDSDLMDNYGLSFPNDSISSEKKAPSGSELISYQPMYDLSDILDTDDGNNDQEASRRQMQTQSSVLNTPRHEL

SEQ ID NO: 8028 - protein, 677 aa, Kluyveromyces lactis
MGHNDSVETMDEISNPNNILLPHDGTGLDATGISGSQEPYGMVDVLNPDSLKDDSNVDEPLIEDIVNPSLDPEGVVSAEPSNEVGTPLLQQPISLDHVITRPASAGGVYSIGNSSTSSAAKLSDGDLTNATDPLLNNAHGHGQPSSESQSHSNGYHKQGQSQQPLLSLNKRKLLAKAHVDKHHSKKKLSTTRARPAFVNKLWSMVNDKSNEKFIHWSTSGESIVVPNRERFVQEVLPKYFKHSNFASFVRQLNMYGWHKVQDVKSGSMLSNNDSRWEFENENFKRGKEYLLENIVRQKSNTNILGGTTNAEVDIHILLNELETVKYNQLAIAEDLKRITKDNEMLWKENMMARERHQSQQQVLEKLLRFLSSVFGPNSAKTIGNGFQPDLIHELSDMQVNHMSNNNHNNTGNINPNAYHNETDDPMANVFGPLTPTDQGKVPLQDYKLRPRLLLKNRSMSSSSSSNLNQRQSPQNRIVGQSPPPQQQQQQQQQQGQPQGQQFSYPIQGGNQMMNQLGSPIGTQVGSPVGSQYGNQYGNQYSNQFGNQLQQQTSRPALHHGSNGEIRELTPSIVSSDSPDPAFFQDLQNNIDKQEESIQEIQDWITKLNPGPGEDGNTPIFPELNMPSYFANTGGSGQSEQPSDYGDSQIEELRNSRLHEPDRSFEEKNNGQKRRRAA

SEQ ID NO: 8029 - protein, 1670 aa, Dictyostelium discoideum
MSSPHIELHSQRTLSPQPSSNNFELTGNKSCALSASLNGSIDDLNNNNNNNNNNNNNNNNNNNNNNNNNNNNNNNNNNNNNNNDGDKNDKKLLIITNAPTPPLTPPQPTKTQQTLLELNQKFQEQQQQQQQQQQLQKQNKQQQSQKQQEEPPSSQQEEPPLSQQQQEQEQEQEQEQEQEEQSKQKIEGKGGGGEEEECEGGGGGEGEGEEQFKEGDEEETRVLKLIQSTNNWIYWYRRSSLQINEASPKLIQTPSVDRTLCILDSLPCPIFQIGIIENTENGNITLTGFANERLTTLLSCSSNLLVDSLKSIPSPHYNTVPSLESCNSIPINNLAPGLLPNTDPTKILDPYISLYNKKQLKERYSNNNNNTNTNNNNNNNNNNNNNNNNNNNNNNNDTTTTTTTTTTTTTTTTTTTTTTTTNESDNNNNNNNNNNNNNNNNNNNNNNNEEIKQNTKEGEEILHESTNSTGTGNSISRPNSILQCILDSFHEQKTITEKVLLSNFLIRQQYKSRATIKPFPDGCICIFEYIENINLNYQQPPTSLNDRINSTNKLTNEMELLSLSPDSNHQHVQKLHNHNHNHHNHNHNNTTQRASSTDSPFIHSVSANSLSSMSSNSSVTSACASLSSNSSSNSNNNSNNASSSNCSSNANSNNTNSSSSNCCCCCNNNNNNNTSSTSSTISSASSTKSKSYLHQQHKNSKVYSTLLNSFENLSFLLKSTPIIIWRADHNGEMVFFKKSDEIPIDEKKVVGNNFQDFLQWVPQTYRTNFQEMFQNSLKCGKIFEFLFWFQTPQNYVQLFKIAGYPIFHIDGKDCIASKRYLIGWLGVTYNYLINDGAEISIKGSANLDSMYEKFKIIYEMPNIERTKLTNNGISSGGDITNANNNGGSSESSNKILEKKKHLISEAEKECFLKCKETYNILFKLSLLGVMFSTFKGIILDANDMLLQTIGYTRGDLENGKIDWMLLTPPEHFEISARALQELKAKRWCQPIEKAYIHKSGKRVPVLITSAMIDGSTEQCITFVFDLSRYRQAEMAAIEATRLKTQFITNISHELRTPCHGIVGMSQLLLDSQLTNTQRDNIDSIKRSTDSLISLINDILDFSKLEYGKVTLENESFELLPMIEEVLDSQATAANRKGIDLIFVMGRDYPVPPVIFGDRNSLKKVLLNLVGNAVKFTETGFVLLEISTDYESGDQISLRFTVKDSGIGIPENKIEQIFVPFGQIDGSFSRKYGGSGLGLSFCKELVALMGGYIRVESGDQEGGKGTTFWFAIKVSISSPSYLPNSVPAANQFFYPEYRPSHYNNVIGNGDSPKNVLIIESNQMVIMSIQSILLSMKCECISASKAITALDLLESSKSTENQIDIIVCSDKSTFVQQILDYVTTEKVILYGVDPNSKYNENSKVYSYLVTPITHSKLISSILLSKNLKSKNSFLTTTNNTNNTNNTNNIENKSSIDSPLSITSTSSSIITPILTSNNLDLNNNNNNNNNSILVSNNGGVDGGNNVPSTLTTIQQSQPKKYILVAEDNDINIKVVVRQLEKLGYTAIVGINGLKALEIIGSFPICLILLDCQMPQMDGFTCSTILRQIEPTGQRIPIIAMTANDSKDRCFEVGMDDYLSKPVRVDRLQKTLSDWIKTDENGNPTNSYNFYPLSYSLVYNNFIDTQLKKEKNDD

SEQ ID NO: 8030 - protein, 344 aa, Hyoscyamus niger
MATFVSNWSTKSVSESFIAPLQKRAEKDVPVGNDVPIIDLQQHHHLLVQQITKACQDFGLFQVINHGFPEELMLETMEVCKEFFALPAEEKEKFKPKGEAAKFELPLEQKAKLYVEGEQLSNEEFLYWKDTLAHGCHPLDQDLVNSWPEKPAKYREVVAKYSVEVRKLTMRMLDYICEGLGLKLGYFDNELSQIQMMLTNYYPPCPDPSSTLGSGGHYDGNLITLLQQDLPGLQQLIVKDATWIAVQPIPTAFVVNLGLTLKVITNEKFEGSIHRVVTDPTRDRVSIATLIGPDYSCTIEPAKELLNQDNPPLYKPYSYSEFADIYLSDKSDYDSGVKPYKINV

SEQ ID NO: 8031 - protein, 410 aa, Blumeria graminis
MSDMQGRKVFKVFNQDFVVDERYNVTKELGQGAYGIVCAATNISTQEGVAIKKVTNVFSKKILAKRALREIKLLQHFRGHRNITCLYDMDIPRPENFNETYLYEELMECDLAAIIRSGQPLTDAHFQSFIYQILCGLKYVHSANVLHRDLKPGNLLVNADCELKICDFGLARGFSVDPEENAGYMTEYVATRWYRAPEIMLSFQSYTKAIDVWSVGCILAELLGGRPFFKGRDYVDQLNQILHVLGTPNEETLARIGSPRAQEYVRNLPFMAKRPFAQIFPNANPDALDLLNRMLAFDPASRISVEEALEHPFLQIWHDVSDEPCCPTTFNFDFEVTDDVGEMRKMILDEVARFRHHVRVQPGMQSPSNDPSVPTLQTSVAWGSEDPRPQENNDQEITGLERDLTVGLDR

SEQ ID NO: 8032 - protein, 385 aa, Xenopus laevis
MLKVTLPSSSSSSSSTTSSSTSSSSSSSRSASAAPDYWIDGSNKDTLAHYYELESELGRGATSVVYRCRQKGTQRPAVKMLKKTVDKKIVRTEIGVLLRLSHPNIIKLKEIFETPTEISLVLELVTGGELFDRIVEKGYYSERDAADAVKQILEAVAYLHENGIVHRDLKPENLLYATPAPDAPLKIADFGLSKIVDDQVTMKTVCGTPGYCAPEILRGCAYGPEVDMWSVGIITYILLCGFEPFYDERRDQYMFKRILNCDYDFVSPWWDDVSLNAKDLVKKLIVFDPKKRLTTQQALQHPWVTGKAANFAHMDNAQKKLQEFNARRKLKAAVKAVVASSRLGSAGSHSSHDSNKPSRNPSPVQESGCEETPTQETKQVEEGGS

SEQ ID NO: 8033 - protein, 514 aa, Homo sapiens
MADYLISGGTSYVPDDGLTAQQLFNCGDGLTYNDFLILPGYIDFTADQVDLTSALTKKITLKTPLVSSPMDTVTEAGMAIAMALTGGIGFIHHNCTPEFQANEVRKVKKYEQGFITDPVVLSPKDRVRDVFEAKARHGFCGIPITDTGRMGSRLVGIISSRDIDFLKEEEHDCFLEEIMTKREDLVVAPAGITLKEANEILQRSKKGKLPIVNEDDELVAIIARTDLKKNRDYPLASKDAKKQLLCGAAIGTHEDDKYRLDLLAQAGVDVVVLDSSQGNSIFQINMIKYIKDKYPNLQVIGGNVVTAAQAKNLIDAGVDALRVGMGSGSICITQEVLACGRPQATAVYKVSEYARRFGVPVIADGGIQNVGHIAKALALGASTVMMGSLLAATTEAPGEYFFSDGIRLKKYRGMGSLDAMDKHLSSQNRYFSEADKIKVAQGVSGAVQDKGSIHKFVPYLIAGIQHSCQDIGAKSLTQVRAMMYSGELKFEKRTSSAQVEGGVHSLHSYEKRLF

SEQ ID NO: 8034 - protein, 513 aa, Bacillus subtilis
MWESKFSKEGLTFDDVLLVPAKSEVLPHDVDLSVELTKTLKLNIPVISAGMDTVTESAMAIAMARQGGLGIIHKNMSIEQQAEQVDKVKRSERGVITNPFFLTPDHQVFDAEHLMGKYRISGVPIVNNEEDQKLVGIITNRDLRFISDYSMKISDVMTKEELVTASVGTTLDEAEKILQKHKIEKLPLVDDQNKLKGLITIKDIEKVIEFPNSSKDIHGRLIVGAAVGVTGDTMTRVKKLVEANVDVIVIDTAHGHSQGVLNTVTKIRETYPELNIIAGNVATAEATRALIEAGADVVKVGIGPGSICTTRVVAGVGVPQITAIYDCATEARKHGKTIIADGGIKFSGDITKALAAGGHAVMLGSLLAGTSESPGETEIYQGRRFKVYRGMGSVAAMEKGSKDRYFQEENKKFVPEGIEGRTPYKGPVEETVYQLVGGLRSGMGYCGSKDLRALREEAQFIRMTGAGLRESHPHDVQITVHRNKALPGLFGSHQKKTGFVYDECCQSGFFSSD

SEQ ID NO: 8035 - protein, 514 aa, Leishmania donovani
MATNNANYRIKTIKDGCTAEELFRGDGLTYNDFIILPGFIDFGAADVNISGQFTKRIRLHIPIVSSPMDTITENEMAKTMALMGGVGVLHNNCTVERQVEMVKSVKAYRNGFISKPKSVPPNTPISNIIRIKEEKGISGILVTENGDPHGKLLGIVCTKDIDYVKNKDTPVSAVMTRREKMTVERAPIQLEEAMDVLNRSRYGYLPIVNENDEVVNLCSRRDAVRARDYPHSTLDKSGRLICAAATSTRPEDKRRVAALADVGVDVLVLDSSQGNTIYQIAFIKWVKSTYPHLEVVAGNVVTQDQAKNLIDAGADGIRIGMGSGSICITQEVLACGRPQGTAVYKVAQYCASRGVPCTADGGLRQVGDICKALAIGANCAMLGGMLSGTTETPGEYFFKGGVRLKVYRGMGSLEAMSQGKESGKRYLSENEAVQVAQGVSGNVVDKGSAAKLIAYVSKGLQQSAQDIGEISFDAIREKMYAGQVLFSRRSPTAQGEGGVHSLHSYEKKLFAAKM

SEQ ID NO: 8036 - protein, 514 aa, Mesocricetus auratus
MADYLISGGTSYVPDDGLTAQQLFNCGDGLTYNDFLILPGYIDFTADQVDLTSALTKKITLKTPLVSSPMDTVTEAGMAIAMALTGGIGFIHHNCTPEFQANEVRKVKKYEQGFITDPVVLSPKDRVRDVFEAKARHGFCGIPITDTGRMGSRLVGIISSRDIDFLKEEEHDRFLEEIMTKREDLVVAPAGITLKEANEILQRSKKGKLPIVNENDELVAIIARTDLKKNRDYPLASKDAKKQLLCGAAIGTHEDDKYRLDLLALAGVDVVVLDSSQGNSIFQINMIKYMKEKYPNLQVIGGNVVTAAQAKNLIDAGVDALRVGMGCGSICITQEVLACGRPQATAVYKVSEYARRFGVPVIADGGIQNVGHIAKALALGASTVMMGSLLAATTEAPGEYFFSDGIRLKKYRGMGSLDAMDKHLSSQNRYFSEADKIKVAQGVSGAVQDKGSIHKFVPYLIAGIQHSCQDIGAKSLTQVRAMMYSGELKFEKRTSSAQVEGGVHSLHSYEKRLF

SEQ ID NO: 8037 - protein, 514 aa, Mus musculus
MADYLISGGTSYVPDDGLTAQQLFNCGDGLTYNDFLILPGYIDFTADQVDLTSALTKKITLKTPLVSSPMDTVTEAGMAIAMALTGGIGFIHHNCTPEFQANEVRKVKKYEQGFITDPVVLSPKDRVRDVFEAKARHGFCGIPITDTGRMGSRLVGIISSRDIDFLKEEEHDRFLEEIMTKREDLVVAPAGVTLKEANEILQRSKKGKLPIVNENDELVAIIARTDLKKNRDYPLASKDAKKQLLCGAAIGTHEDDKYRLDLLALAGVDVVVLDSSQGNSIFQINMIKYIKEKYPSLQVIGGNVVTAAQAKNLIDAGVDALRVGMGSGSICITQEVLACGRPQATAVYKVSEYARRFGVPVIADGGIQNVGHIAKALALGASTVMMGSLLAATTEAPGEYFFSDGIRLKKYRGMGSLDAMDKHLSSQNRYFSEADKIKVAQGVSGAVQDKGSIHKFVPYLIAGIQHSCQDIGAKSLTQVRAMTYSGELKFEKRTSSAQVEGGVHSLHSYEKRLF

SEQ ID NO: 8038 - protein, 919 aa, Oryctolagus cuniculus
MLATTSARVSSSSLYSFWQPHMVLNGAARAPQSWVPQMNGLRLGLVPGLSRVRLGTMLLWGMIFLPSIYMELVHYSSYEMVIPESLTVEGSEKPGEKASYILFMQGQKQLVHLHVKRDYFVDDFPVYSYHNRVLGQEMLFISRNCYYEGYIDGVPGSFVSVNTCSGLRGVLVKGETSYSIEPILSSKRFEHALYTMAHGAHVSCSVTSKGGQGMSTSRQQGSRKLHNPQALSYLWSHTKSVEMFVVVDNQRFQMWGRNVSETVQRVMDIIALANSFTRGINTEVVLAGMEIWTEGDLTEVAADLQVTLRNFNSWRQEQLVHRVRHDVAHMIVGRHPGENTGQAFLNGACSSGFAAAVESFHHEDILLFAALMAHELGHNLGIQHDHSACTCKNQPFCLMGENITKESSFSNCSSDDFYRFLREHRGACLFNKPRHRSRTRRLSRCGNGVVETPEQCDCGSDCALDPCCDSMCRLKDNAQCGYGLCCFRCKYRRKGFLCRSIRGNCDLPEYCSGKSASCPPDAYKQDGTPCDRVYRCLGGQCMNPDKQCSNIYGIPARSAPEECYVLMNSKGDRFGNCGSPPALQSSYVPCADENIFCGKLICTEVKLLPQILPQHTVIQVAYEDDWCWSIDSNSGCSDYGDVQRNTYCALNKVCKDHSCVVYQAPNSDCQADEMCSGKGVCNNFRHCHCDSGYAPPDCRNPGTGGSVDSGPPGKPYNRNISSSTNSSRITKKKKSENLNVLFFVVPIFLIIVLCVLIILSYLWSEVKSVVVSIAESKEESEESSEELPSEESVEAPPPEQPAQQQEAPQQQEAPPAREAPPPEAARPAEAPPPPEQAPPPEQAPPPEAPKPAEAPPPPEAAPPPQAPPPPEAAPPPEAPPPPEAAPPPEAPPPPEAAPPPEAPPPPEAPPPPEAPPPPQ

SEQ ID NO: 8039 - protein, 452 aa, Medicago sativa subsp. falcata
MKEVAPGTQDQKQPLRANSKRALSDVTYLPHKKRAILQDVTNNCGENTKRSCLNPTEIQAKKRKVAKPAQPNVSNEVPSAAELPPFIADSKPVSSMEMRLRSSEDFRCLDDLEDNAPFRMSSNQCGTNNNLLQSQTSRISARPSSSQKKASQIVAAKKANISELLDVSKHPDVADIDADFEDPQLCSHYAADIYDHLRVAELSRRPYPNFMETVQQDITPSMRAILVDWLVEVSEGYKLQANTLYLAVYLIDWFLSKNCIEKERLQLLGITCMLIASKYEEINAPRIEDFCFITDNTYTKEEVVKLESLVLKSSSYQLFAPTTKTFLRRFLRAAQASYKRPSIELEYLTNYLAELTLLNYGFLNFLPSMIAASAVFLARWTLDQSSHPWNPTLEHYASYKASDLKATVLALQDLQLNSNDDCPLTAIRKKYTQDKLNCVAALSSPKLLETLF

SEQ ID NO: 8040 - protein, 471 aa, Saccharomyces paradoxus
MFNLNFFNYTCHCEWCFWVLPSYNGLGLTPQMGWDNWNTFACNVSEDLLLNTADRISDIGLKDLGYKYVILDDCWSSGRDEDGFLVADEQKFPNGMGHVADRLHNNSFLFGMYSSAGEYTCAGYPGSLGREEEDAQFFANNRVDYLKYDNCYNKGRFGTPESSHKRYKAMSDALNKTGRPIFYSLCNWGQDLTFYWGSDIANSWRMSGDITAEFSRPDSRCPCDGDEYDCKYAGYHCSIMNILNKAAPMGQNGGIGGWNDLDNLEVGVGNLTDDEEKTHFSMWAMVKSPLIIGADVNHLKASSYSIYSQSSVIAINQDPKGIPATRVWRYYVPQTDKYGQGEIQFWSGPLENGDQVIALLNGGMKARPMNATLEDIFFDSYQGSEELSTSWDIYDLWANRIDNATASAILENNKVTNNTLYNATKLSYKEGLLNGDSRLFGTKVGTISPDGIINTTVPAHGIALYRLRSSS

SEQ ID NO: 8041 - protein, 471 aa, Saccharomyces sp. IFO 1816
MSYIYLFITAAAVTGALGSSPSYNGLGLTPQMGWDNWNTFACDVSEQLLLNTADRISEIGLKDLGYKYVILDDCWSSGRNSNGTLVADKNKFPNGMDHVARHLHNNNFLFGMYSSAGEYTCAGYPGSLGHEQEDAEFFARNGVDYLKYDNCYNKGKFGTPETSYKRYKAMSDALNKTGRPIFYSLCNWGQDLTFYWGSDIANSWRMSGDIYPEFDRPDSRCPCDGDQYDCSYAGFHCSIMNILNKAAPMGQNAGIGGWNDLDNLEVGVGNLTDDEEKAHFSMWAMVKSPLIIGADVNHLKESSYSIYSQASVIAINQDPKGVPATRVWRHYVSQTDKYGKGEIQLWSCPLDNGDQVIALLNGSNKKRPMNASLEDIFFDSYLGSEELSSSWDIYDLWANRIDNTIASNILKNNKVTNSSLYNATELSYKEGLSKNDTRLFGVQIGTVSPGGLLNTTVPAHGVALYRLRRSR

SEQ ID NO: 8042 - protein, 366 aa, Escherichia coli
MFRQGITGRSHLMSQNTLKVHDLNEDAEFDENGVEVFDEKALVEEEPSDNDLAEEELLSQGATQRVLDATQLYLGEIGYSPLLTAEEEVYFARRALRGDVASRRRMIESNLRLVVKIARRYGNRGLALLDLIEEGNLGLIRAVEKFDPERGFRFSTYATWWIRQTIERAIMNQTRTIRLPIHIVKELNVYLRTARELSHKLDHEPSAEEIAEQLDKPVDDVSRMLRLNERITSVDTPLGGDSEKALLDILADEKENGPEDTTQDDDMKQSIVKWLFELNAKQREVLARRFGLLGYEAATLEDVGREIGLTRERVRQIQVEGLRRLREILQTQGLNIEALFREKVSICQKGQSQARLAFFLLVHGTC

SEQ ID NO: 8043 - protein, 507 aa, Toxoplasma gondii
MGQQESTLGGAAGEPRSRGHAAGTSGGPGDHLHATPGMFVQHSTAIFSDRYKGQRVLGKGSFGEVILCKDKITGQECAVKVISKRQVKQKTDKESLLREVQLLKQLDHPNIMKLYEFFEDKGYFYLVGEVYTGGELFDEIISRKRFSEVDAARIIRQVLSGITYMHKNKIVHRDLKPENLLLESKSKDANIRIIDFGLSTHFEASKKMKDKIGTAYYIAPEVLHGTYDEKCDVWSTGVILYILLSGCPPFNGANEYDILKKVEKGKYTFELPQWKKVSESAKDLIRKMLTYVPSMRISARDALDHEWIQTYTKEQISVDVPSLDNAILNIRQFQGTQKLAQAALLYMGSKLTSQDETKELTAIFHKMDKNGDGQLDRAELIEGYKELMRMKGQDASMLDASAVEHEVDQVLDAVDFDKNGYIEYSEFVTVAMDRKTLLSRERLERAFRMFDSDNSGKISSTELATIFGVSDVDSETWKSVLSEVDKNNDGEVDFDEFQQMLLKLCGN

SEQ ID NO: 8044 - protein, 520 aa, Toxoplasma gondii
MPHHQCSTSQRRHSISTQAADEAAGGGNRVSFKRSAFILANTGPITNYYTVSKTIGRGTWGEVKLVIDNGTGARRAAKKIPKCYVEDADRFRQEIEIMKSLDHPNIVRLYETFEDMTDFYLVMEYCTGGELFDRLVHQGVFTEALACRIMRQILAAVAYCHAHRVAHRDLKPENFLFLHDNPESPIKLIDFGLAARFKPGQPMRTRAGTPYYVSPQVLEGRYGPECDVWSAGVMMYILLCGYPPFNAPSDRAIMNKVRAGHYTFPDSEWSRVSLQAKDLISRLLDRHPRTRISAEQALRHAWFAMHAPGDHFEPLGLDILSKFRRFQGLSRLKKLALTVIAQHLEDSEIEGLKNLFTQLDTEGDGVLTVEEIRKGIERSGVHLPPDMVLEDVLREVDTAGTGSIDYTEFIAACLHQSHYIREEACRAAFRVLDINGDGLVSAQELRQVFHMAGDLETDAAAELLEADADGDGHITFDEFCGLMRKVPSLALVTEHTVSMMRRTCSRTNISEASLTPRATG

SEQ ID NO: 8045 - protein, 517 aa, Coriolopsis gallica
MLHTRTRLGNVLALLSLLGTAWGAIGPKTDLHIVNKVIAPDGFPRDTILAGGTFPGPLITGKTGDRFLIDVYDDLTNTTMLTPTSIHWHGLFQHTTNWADGPAFVTQCPISSGHNFLYNFRVPDQSGTYWYHSHFGLQYCDGLRGPIVVYDPHDPQKHLYDVDDDSTVITLSDWYHVAAASVPVPPQSDSTLINGLGRWGGDPTSELAVITVEHGKRYRFRLASLSCDPFFTFSIDGHDMTIIEADGVNTQPLKVDQLDIFAAQRYSFVLEANQPKGNYWMRANPNHANFVGFENGINSAILRYKGAPVAEPNTTQTPSKKPLLETNLHPLTKQAVPGKPHPGGADVNINLELGVDVNAGLFLVNGSPFIPPDIPVLLQILSGNYSAQSLLPPGVVYTLPPNQSVELSIPGGVLGGPHPFHLHGHAFSVVRSAGSSVYNYKNPVQRDTVSIGDSTDNVTIRFFTDNPGPWFLHCHIDFHLNAGLAVVFAEDPKDTAFVNPVPSSWKELCPTYYAENP

SEQ ID NO: 8046 - protein, 351 aa, Cricetulus griseus
MGNAAAAKKGSEQESVKEFLAKAKEEFLKKWESPSQNTAQLDHFDRIKTLGTGSFGRVMLVKHKETGNHYAMKILDKQKVVKLKQIEHTLNEKRILQAVNFPFLVKLEFSFKDNSNLYMVMEYVPGGEMFSHLRRIGRFSEPHARFYAAQIVLTFEYLHSLDLIYRDLKPENLLIDQQGYIQVTDFGFAKRVKGRTWTLCGTPEYLAPEIILSKGYNKAVDWWALGVLIYEMAAGYPPFFADQPIQIYEKIVSGKVRFPSHFSSDLKDLLRNLLQVDLTKRFGNLKNGVNDIKNHKWFATTDWIAIYQRKVEAPFIPKFKGPGDTSNFDDYEEEEIRVSINEKCGKEFTEF

SEQ ID NO: 8047 - protein, 338 aa, Sus scrofa
ESVKEFLAKAKEDFLKKWENPAPNNAGLEDFERKKTLGTGSFGRVMLVKHKATEQYYAMKILDKQKVVKLKQIEHTLNEKRILQAVNFPFLVRLEFSFKDNSNLYMVMEYVPGGEMFSHLRRIGRFSEPHARFYAAQIVLTFEYLHSLDLIYRDLKPENLLIDHQGYIQVTDFGFAKRVKGRTWTLCGTPEYLAPEIILSKGYNKAVDWWALGVLIYEMAAGYPPFFADQPIQIYEKIVSGKVRFPSHFSSDLKDLLRNLLQVDLTKRFGNLKNGVSDIKTHKWFATTDWIAIYQRKVEAPFIPKFRGSGDTSNFDDYEEEDIRVSITEKCGKEFCEF

SEQ ID NO: 8048 - protein, 391 aa, Gallus gallus
MSGPVPSRARVYTDVNTHRPREYWDYESHVVEWGNQDDYQLVRKLGRGKYSEVFEAINITNNEKVVVKILKPVKKKKIKREIKILENLRGGPNIITLADIVKDPVSRTPALVFEHVNNTDFKQLYQTLTDYDIRFYMYEILKALDYCHSMGIMHRDVKPHNVMIDHEHRKLRLIDWGLAEFYHPGQEYNVRVASRYFKGPELLVDYQMYDYSLDMWSLGCMLASMIFRKEPFFHGHDNYDQLVRIAKVLGTEDLYDYIDKYNIELDPRFNDILGRHSRKRWERFVHSENQHLVSPEALDFLDKLLRYDHQSRLTAREAMEHPYFYPIVKDQARMGSSNMPGGSTPVSSASMMSGISSVPTPSPLGPLAGSPVISATTTLGMPVPAAAGAQQ

SEQ ID NO: 8049 - protein, 350 aa, Gallus gallus
MPGPAAGSRARVYAEVNSLRSREYWDYEAHVPSWGNQDDYQLVRKLGRGKYSEVFEAINITNNERVVVKILKPVKKKKIKREVKILENLRGGTNIINLIDTVKDPVSKTPALVFEYINNTDFKQLYQILTDFDIRFYMYELLKALDYCHSMGIMHRDVKPHNVMIDHQQKKLRLIDWGLAEFYHPAQEYNVRVASRYFKGPELLVDYQMYDYSLDMWSLGCMLASMIFRKEPFFHGQDNYDQLVRIAKVLGTDELYGYLKKYHIELDPHFNDILGQHSRKRWENFIHSENRHLVSPEVLDLLDKLLRYDHQQRLTAKEAMEHPYFYPVVKEQSQPSSENAVLSSGLTTAR

SEQ ID NO: 8050 - protein, 332 aa, Zea mays; identical to SEQ ID NO: 6526

SEQ ID NO: 8051 - protein, 420 aa, Theileria parva
MIYRYKFYKYIIYLFAIIIHKSYCIEFHKYINQYNLSFVKPINNKDIIYRLKRDYLQLNKEENGIFNQPILNMDQMDLVDTDKSRKYPAKDLKIILPKTYADVNSKKGPEYWDYENITLKWNVPDSYEIVRKIGRGKFSEVFEGINTVTKDKCVIKILKPVKKKKIKREIKILQNLRGGPNIIKLLDIVKDPQSRTPSLIFEHVNNTDFKTLYPTLSIQDIKYYIYQLLKAMNYCHSQGIMHRDIKPHNVMIDHEKKILRLIDWGLAEFYHPEQEYSVRVATRYYKGPELLVDMRYYDYSLDIWSIGCMLAGIIFKKEPFFYGHDNYDQLVKIAKVLGTEDLHRYFEKYGLKFAPAYQEILGNHSKKPWTKFVHHENQHLVSPEVMDLLDRMLVYDHTKRITPLEAMEHPFFNEIKNNSV

SEQ ID NO: 8052 - protein, 234 aa, Caenorhabditis elegans
MSSSEEVSWITWFCGLRGNEFFCEVDEEYIQDRFNLTGLNEQVPKYRQALDMILDLEPDDIEDNATNTDLVEQAAEMLYGLIHARYILTNRGISQMVEKWRDHDFGVCPRVYCENQPMLPIGLSDVPGEAMVKLYCPRCNMVFVPRSSRHQHTDGSYFGTGFPHMLFFVHPDLRPRRPVTQFVPKLYGFKIHPVAYGGQEGNSGGNTANNVAAAQNNTTPAGQQSGGQFNNYGL

SEQ ID NO: 8053 - protein, 215 aa, Xenopus laevis
MSSSEEVSWISWFCGLRGNEFFCEVDEDYIQDKFNLTGLNEQVPHYRQALDMILDLEPDEELEDNPNQSDLIEQAAEMLYGLIHARYILTNRGIAQMLEKYQQGDFGYCPRVYCENQPMLPIGLSDIPGEAMVKLYCPKCMDVYTPKSSRHHHTDGAYFGTGFPHMLFMVHPEYRPKRPANQFVPRLYGFKIHPMAYQLQLQAASNFKSPVKTMR

SEQ ID NO: 8054 - protein, 478 aa, Mus musculus
MATITCTRFTEEYQLFEELGKGAFSVVRRCVKVLAGQEYPAKIINTKKLSARDHQKLEREARICRLLKHPNIVRLHDSISEEGHHYLIFDLVTGGELFEDIVAREYYSEADASHCIQQILEAVLHCHQMGVVHRDLKPENLLLASKLKGAAVKLADFGLAIEVEGEQQRWFGFAGTPGYLSPEVLRKDPYGKPVDLWACGVILYILLVGYPPFWDEDQHRLYQQIKARAYDFPSPEWDTVTPEAKDLINKMLTINPSKRITAAEALKHPWISHRSTVASCMHRQETVDCLKKFNARRKLKGAILTTMLATRNFSGGKSGGNKKNDGVKESSESTNTTIEDEDTKVRKQEIIKVTEQLIEAISNGDFESYTKMCDPGMTAFEPEALGNLVEGLDFHRFYFENLWSRNSKPVHTTILNPHIHLMGDESACIAYIRITQYLDAGGIPRTAQSEETRVWHRRDGKWQIVHFHRSGAPSVLPH

SEQ ID NO: 8055 - protein, 542 aa, Mus musculus
MATTVTCTRFTDEYQLYEEIGKGAFSVVRRCVKLCTGHEYAAKIINTKKLSARDHQKLEREARICRLLKHSNIVRLHDSISEEGFHYLVFDLVTGGELFEDIVAREYYSEADASHCIQQILEAVLHCHQMGVVHRDLKPENLLLASKCKGAAVKLADFGLAIEVQGDQQAWFGFAGTPGYLSPEVLRKEAYGKPVDIWACGVILYILLVGYPPFWDEDQHKLYQQIKAGAYDFPSPEWDTVTPEAKNLINQMLTINPAKRITAHEALKHPWVCQRSTVASMMHRQETVECLKKFNARRKLKGAILTTMLATRNFSVGRQTTAPATMSTAASGTTMGLVEQAKSLLNKKADGVKPQTNSTKNSSAITSPKGSLPPAALEPQTTVIHNPVDGIKESSDSTNTTIEDEDAKARKQEIIKTTEQLIEAVNNGDFEAYAKICDPGLTSFEPEALGNLVEGMDFHRFYFENLLAKNSKPIHTTILNPHVHVIGEDAACIAYIRLTQYIDGQGRPRTSQSEETRVWHRRDGKWQNVHFHCSGAPVAPLQ

SEQ ID NO: 8056 - protein, 734 aa, Sus scrofa
MSKERGLISPSDFAQLQKYMEYSTKKVSDVLKLFEDGEMAEYLQGDAIGYEGFQQFLKIYLEVDSVPSHLSLALFQSFQTSYCSEETVKRDVVCLSDVSCYFSLLEGGRPEDKLEFTFKLYDTDRNGILDSSEVDRIIIQMMRMAEYLDWDVSELRPILQEMMKEIDYDGSGSVSLAEWLRAGATTVPLLVLLGLEMTLKDNGQHMWRPKRFPRPVYCNLCESSIGLGKQGLSCNLCKYTVHDQCAMKALPCEVSTYAKSRKDIGVQTHVWVRGGCESGRCDRCQKKIRIYHSLVGLHCVWCHLEIHDDCLPAMGHECDCGLLRDHILPPSSIYPSVLASGQERKVSKTSQKTTDDLNLSTSEALRIDPVSNTHPLLVFVNPKSGGKQGERVLWKFQYLLNPRQVFNLLKDGPEPGLRFFREVPDYRILVCGGDGTVGWILETIDKANLPFVPPVAVLPLGTGNDLARCLRWGGGYEGQNLGKILKDLEASKVVHMDRWSVEVIPQQTEEKSDPVPFQIINNYFSIGVDASIAHRFHIMREKYPEKFNSRMKNKLWYFEFATSESIFSTCKKLEESLTVEICGKPLDLSNLSLEGIAVLNIPSTHGGSNLWGDTKRPHGDIHGINQALGAMAKVITDPDILKTCVPDLSDKRLEVVGLEGAIEMGQIYTKLKNAGHRLAKCSEITFHTTKTLPMQIDGEPWMQTPCTIKITHRNQMPMLVGPPPRSSNFFGFLC

SEQ ID NO: 8057 - protein, 342 aa, Burkholderia sp. NK8
MSSYNIALNFEDGVTRFVECKAGEKVLDAAFRAKINLPMDCSDGVCGTCKCRAESGSYDLGEDYIEDALSDDEKEGGLVLTCQMVPQSDCVIAVPASSTACKTAQSKFAAKVTKVAPHNDAAVVLELDVDAAASAPVFLPGQYVNIDVPGSGQHRSYSFSSAPGETKISFLIKKIPGGVMSTWLESAETGSTVELTGPLGSFYLRAVERPLLFLAGGTGLAPFLSMLEVLARANSQQKIHLIYGVTRDLDLVQVEAIEAYTAKLSNFTFSTVVADADSDHPRKGWVTQHMPAESLNDGDVDVYLCGPPPMVDAVRKHFDDNGVKPNSFHYEKFTPNAAPVTA

SEQ ID NO: 8058 - protein, 608 aa, Oryctolagus cuniculus
MATENGAVELGIQSLSTDEASKGAASEESLAAEKDPAPPDPEKGPGPSDTKQDPDPSTPKKDANTPAPEKGDVVPAQPSAGGSQGPAGEGGQVEAPAEGSAGKPAALPQQTATAEASEKKPEAEKGPSGHQDPGEPTVGKKVAEGQAAARRGSPAFLHSPSCPAIIASTEKLPAQKPLSEASELIFEGVPATPGPTEPGPAKAEGGVDLLAESQKEAGEKAPGQADQAKVQGDTSRGIEFQAVPSERPRPEVGQALCLPAREEDCFQILDDCPPPPAPFPHRIVELRTGNVSSEFSMNSKEALGGGKFGAVCTCTEKSTGLKLAAKVIKKQTPKDKEMVMLEIEVMNQLNHRNLIQLYAAIETPHEIVLFMEYIEGGELFERIVDEDYHLTEVDTMVFVRQICDGILFMHKMRVLHLDLKPENILCVNTTGHLVKIIDFGLARRYNPNEKLKVNFGTPEFLSPEVVNYDQISDKTDMWSLGVITYMLLSGLSPFLGDDDTETLNNVLSGNWYFDEETFEAVSDEAKDFVSNLIVKEQGARMSAAQCLAHPWLNNLAEKAKRCNRRLKSQILLKKYLMKRRWKKNFIAVSAANRFKKISSSGALMALGV

SEQ ID NO: 8059 - protein, 387 aa, Oryctolagus cuniculus
MTRDAALPGSHSTHGFYENYEPKEILGRGVSSVVRRCIHKPTCKEYAVKIIDVTGGGSFSAEEVQELREATLKEVDILRKVSGHPNIIQLKDTYETNTFFFLVFDLMKKGELFDYLTEKVTLSEKETRKIMRALLEVICALHKLNIVHRDLKPENILLDDDMNIKLTDFGFSCQLDPGEKLREVCGTPSYLAPEIIECSMNDNHPGYGKEVDMWSTGVIMYTLLAGSPPFWHRKQMLMLRMIMSGNYQFGSPEWDDYSDTVKDLVSRFLVVQPQKRYTAEEALAHPFFQQYVVEEVRHFSPRGKFKVICLTVLASVRIYYQYRRVKPVTREIVIRDPYALRPLRRLIDAYAFRIYGHWVKKGQQQNRAALFENTPKAVLFSLAEDDY

SEQ ID NO: 8060 - protein, 483 aa, Pseudomonas aeruginosa
MNTKLFINNVWINSSDQQTFERKHPVSGEVMTECANSTVMDALKAAQAAQEAFQTWKTVGPSERRRLLLRVAEVMESKTPEFIEVMAKEVGASALWAGFNVQMSANVFREAASLATQIQGETIPTDKSDTLSMTLRQPVGPILSIVPWNGTAVLAARAIAYPLVCGNAVVFKGSEFSPATHALITQCVQEAGLPAGVLNYLNSSPDRSPEIADALISAKEIRRINFTGSTRVGSIIAQKAAQHLKRCLLELGGKSPLIVLDDADIDAAVKAAVFGSFLFQGQICMSTERLIVDEKIADEFVAKFVEKTKRLSAGDPCVTGDCIIGPMVSPNSGERINGLFKDAIDKGAKVVCGGLAQGALMPATILDHVKSDMRIYDEETFGPITVVIRCKGEAEAVRIANDSVYGLSSGVFGRDINRALRVGMSIEYGSVHINGSTVQNEAQAPYGGTKNTGYGRFDGRAVIDEFTEIKWLTIEPFEQQYPF

SEQ ID NO: 8061 - protein, 609 aa, Phaseolus vulgaris
MESSVNGVDSLSEVQNSVSGVHHHDPLPSGTPQPSRPPLRASRNYDGGHQTKAIHHHNSHVINQKHSHQEGKTLKQEGLPTKLSSKQPPLDDSKGCEPNGVLESEKKRVVDNHGKNYSQPDATFCASPQNSFYSATVYSEAKESFTNTEVSECASVDKSCESEVANSSDFNESRKTSICRASTGSDASDESSTSSLSSVLYKPHKANDIRWEAIQAVRTRDGMLEMRHFRLLKKLGCGDIGSVYLAELSGTRTSFAMKVMNKTELANRKKLLRAQTEREILQSLDHPFLPTLYTHFETEIFSCLVMEFCPGGDLHALRQRQPGKYFSEHAVRFYVAEVLLSLEYLHMLGIIYRDLKPENVLVREDGHIMLSDFDLSLRCSVSPTLVKSSNNLQTKSSGYCVQPSCIEPTCVMQPDCIKPSCFTPRFLSGKSKKDKKSKPKNDMHNQVTPLPELIAEPTNARSMSFVGTHEYLAPEIIKGEGHGSAVDWWTFGIFLYELLFGRTPFKGSANRATLFNVIGQPLRFPESPTVSFAARDLIRGLLVKEPQHRLAYRRGATEIKQHPFFQNVNWALIRCATPPEVPRQVINLPQTEKDLGVKPSGNYLDIDFF

SEQ ID NO: 8062 - protein, 107 aa, Synechococcus sp. PCC 6301
MSIYVGNLSYEVTEADLTAVFTEYGAVKRVQLPIDRETGRMRGFGFVEMSADAEEDAAIAALGGAEWMGRGLRVNKAKPREERSGGGSFGGGGGRRGGGGGGGYRNY

SEQ ID NO: 8063 - protein, 540 aa, Nicotiana tabacum
MVPLKLAVAAFLVVGLIANTLAEDPYRFFEWNVTYGTIYPLGVPQQGILINGQFPGPDIYSVTNDNLIINVFNSLDEPFLLSWNGIQNRRNSFEDGVYGTTCPIPPGRNFTYILQMKDQIGSYYYFPSLAFHKAAGGFGGIKILSRPRIPVPFPDPADDYTLLIGDWYKKNHTALKAILDGGKKLPFPDGILINGRGPNGVSFTVEQGKTYRLRISNVGLQNSLNFRIEGHRMKLVEVEGTHTLQTTYSSLDVHVGQTYSVLITADQEAKDHYIVVSSRFTSQVLTTTGVLHYSNSNTPVSGPPPGGPTIQIDWSLNQARSIRTNLSASGPRPNPQGSYHYGMINTTRTIRLASSAGQVNGKQRYAVNSVSFVPLDTPLKLLDYFKVGGFRVGSISDAPSGGGIFLDTSVLGADYRQFIEIVFENTEDIVQSWHLNGYSFWVVGMDGGHWTQASRNGYNLRDAVARYTTQVYPKSWTAIYIALDNVGMWNLRTEFWARQYLGQQLYMRVYTTSTSLRDEYPIPRNARLCGKVAGRHTRPL

SEQ ID NO: 8064 - protein, 435 aa, Saccharomyces cerevisiae
MTTNEEFIGTQIFGTVFEITNRYNDLNPVGMGAFGLVCSATDTLTSQPVAIKKIMKPFSTAVLAKRTYRELKLLKHLRHENLICLQDIFLSPLEDIYFVTELQGTDLHRLLQTRPLEKQFVQYFLYQILRGLKYVHSAGVIHRDLKPSNILINENCDLKICDFGLARIQDPQMTGYVSTRYYRAPEIMLTWQKYDVEVDIWSAGCIFAEMIEGKPLFPGKDHVHQFSIITDLLGSPPKDVINTICSENTLKFVTSLPHRDPIPFSERFKTVEPDAVDLLEKMLVFDPKKRITAADALAHPYSAPYHDPTDEPVADAKFDWHFNDADLPVDTWRVMMYSEILDFHKIGGSDGQIDISATFDDQVAAATAAAAQAQAQAQAQVQLNMAAHSHNGAGTTGNDHSDIAGGNKVSDHVAANDTITDYGNQAIQYANEFQQ

SEQ ID NO: 8065 - protein, 453 aa, Arabidopsis lyrata subsp. petraea
MESSISQTLSKVSDPTTALLIVVSLFIFIGFITRRRRPPYPPGPRGWPIIGNMLMMDQLTHRGLANLAKKYGGLCHLRMGFLHMYAVSSPDVARQVLQVQDSVFSNRPATIAISYLTYDRADMAFAHYGPFWRQMRKVCVMKVFSRKRAESWASVRDEVDKMVRSVSCNVGKPINVGEHIFALTRNITYRAAFGSACEKGQDEFIRILQEFSKLFGAFNVADFIPYFGWIDPQGINKRLVKARNDLDGFIDDIIDEHMKKKENQNAVDDGDVVDTDMVDDLLAFYSEEAKLVSEAADLQNSIKLTRDNIKAIIMDVMFGGTETVASAIEWALTELLRSPEDLKRVQQELAEVVGLDRRVEEADIEKLTYLKCTLKETLRMHPPIPLLLHETAEDTSIDGFFIPKKSRVMINAFAIGRDPTSWADPDTFRPSRFLEPGVPDFKGSNFEFIPFGS

SEQ ID NO: 8066 - protein, 262 aa, Picea abies
RLAEPYKGIGDCFGRTIKDEGFIALWRGNTANVIRYFPTQALNFAFKDYFKRLFNFKKDRDGYWKWFAGNLASGGAAGASSLLFVYSLDYARTRLANDSKAAKKGGERQFNGLVDVYKKTLKSDGIAGLYRGFNISCVGIIVYRGLYFGMYDSLKPVVLTGDLQNNFLASFLLGWGITIGAGLASYPIDTVRRRMMMTSGEAVKYKSSLDAFNQIVKNEGTKSLFKGAGANILRAIAGAGVLAGYDQLQLILLGKKYGSGGG

SEQ ID NO: 8067 - protein, 249 aa, Hordeum vulgare subsp. vulgare
MDMGLEVSSSSPSSSSVSSSPEHAARRASPAKRPAGRTKFRETRHPVYRGVRRRGNTERWVCEVRVPGKRGARLWLGTYATAEVAARANDAAMLALGGRSATCLNFADSAWLLAVPSALSDLADVRRAAVEAVADFQRREAADGSLAIAVPKEASSGAPSLSPSSGSDSAGSTGTSEPSANGVFEGPVVMDSEMFRLDLFPEMDLGSYYMSLAEALLMDPPPTATIIHAYEDNGDGGADVRLWSYSVDM

SEQ ID NO: 8068 - protein, 380 aa, Picea abies
NNVNPIKEVQDSPKEPNPITEQISVHADCKQTVEKPNENEIVVSANKAAVASLKQQSTLQSPRISRQPKTSLNQGNPVPLAKLHEDAGRSSSLDFVNIDSEYKDPQMCTAYVTDIYANMRVVELKRRPLPNFMETIQRDINANMRSVLIDWLVEVSEEYKLVPDTLYLTISYIDRFLSANVVNRQRLQLLGVSCMLVASKYEEICAPPVEEFCYITDNTYKKEEVLDMEINVLNRLQYDLTNTKPLRPFSGVSFEQLKHPVRFQACIWEFMGNYLAELTLVEYDFLKYLPSLIAAAAVFLARMTLDPMVHPWNSTLQHYTGYKVSDMRDCICAIHDLQLNRKGCTLAAIRDKYNQPKFKCVANLFPPPVISPQFFIDNEV

SEQ ID NO: 8069 - protein, 120 aa, Picea abies
GRVGTVLHIELRQWADAMVIAPLSANTLAKIAGGLCDNLLTCIIRAWDFNKPLFVAPAMNTFMWNNPFTQRHLDSISEMGVSLIPPITKTLACGDYGNGAMSEPSSIDTTLRFSLDPSIK

SEQ ID NO: 8070 - protein, 491 aa, Lycopersicon esculentum
MAAASGQEREVQKSYWIEHTAELTVEAMMLDSKAADLDKEERPEVLSLLPPYEGKTVLELGAGIGRFTGELAQKAGQLIALDFIEGAIKKNENINGHYKNVKFMCADVTSPNLIFSPESVDLIFSNWLLMYLSDEEVKALVERMVIWLKVGGHIFFRESCFHQSGDHKRKNNPTHYRDPSFYTKVFRECHVNAGDGKSFELSLAGCKCIGAYVKNKKNQNQICWTWQKVTSKDDMEFQRFLDTVQYKCSGILRYERVFGQGFVSTGGLETTKEFVAMLDLQRGQKVLDVGCGIGGGNFYMAEKYDVHVVGIDLSINMISFALERAIGLKCAVEFEVADCTKKTYPDCTFDVIYSRDTILHIQDKPALFRSFYKWLRPGGKVLISDYCKRAGPASKEFEGYIKQRGYDLHDVEAYGQMLRDAGFHEVVAEDRTEQFIKVLQKELDTVEKERESFIHEFSEQDYNEIVGGWKSKLIRSSSGEQRWGLFIAKKK

SEQ ID NO: 8071 - protein, 363 aa, Mus musculus
MAPAGSTRAKKGVLERLDSGEVVVGDSGFLFTLEKGGFVKAGLWTPEAVVEHPSAVRQLHTEFLRAGADVLQTFTFSATEDNMASKWEAVNAAACDLAQEVAGGGGALVAGGICQTSLYKYHKDETRIKNIFRLQLEVFARKNVDFLIAEYFEHVEEAVWAVEVLREVGAPVAVTMCIGPEGDMHDVTPGECAVKLARAGADIIGVNCRFGPWTSLQTMKLMKEGLRDASLQAHLMVQCLGFHTPDCGKGGFVDLPEYPFGLEPRVATRWDIQKYAREAYNLGIRYIGGCCGFEPYHIRAIAEELAPERGFLPPASEKHGSWGSGLSMHTKPWIRARARREYWENLLPASGRPFCPSLSKPDA

SEQ ID NO: 8072 - protein, 584 aa, Mus musculus
MGGLEKKKYERGSATNYITRNKARKKLQLSLPDFRRLCILKGIYPHEPKHKKKVNKGSTAARTFYLIKDIKFLLHEPIVNKFREYKVFVRKLRKAYGKSEWNAVERLKDNKPCYKLDHIVKERYPTFIDALRDLDDALSMCFLFSTFPRTGKCHVQTIQLCRRLTVEFLHYVITARALRKVFLSIKGIYYQAEVLGQPIVWIAPYAFSHDHPTDVDYRVMATFTEFYTTLLGFVNFRLYQSLNLHYPPKLEGQAQAETKISEDTYALDSESSMEKLAALSASLARVVVPAIEEAEADEFPTDGEVTAQEEDRKKELEAQEKHKKLFEGLKFFLNREVPREALAFIIRSFGGDVSWDKSLCIGATYDVTDSCITHQIVDRPGQQTPIIGRYYVQPQWVFDCVNARLLLPVAEYFPGMQLPPHLSPFVSEKEGDYIPPEKLKLLALQRGEDPGHLEEEEEEDEDDDNEGDVAAENEEEDVEVESEEEEEEEVHLSALEQHRLEEKKPQVMAGTVKLEDKQRLAQEEESEAKRLAIMMMKKREKYLYQKIMFGKRRKIREANKLAEKRKAHDDAVRSEKKAKRTRPV

SEQ ID NO: 8073 - protein, 471 aa, Astragalus membranaceus
MATATATDRLSNLKSSVAGLNQISENEKSGFINLVARYLSGEAQHVEWSKIQTPTDEVVVPYDTLAPTPDGSLEIKNLLDKLVVLKLNGGLGTTMGCTGPKSVIEVRDGLTFLDLIVIQIENLNSKYGSNVPLLLMNSFNTHDDTQTIVEKYQNSNIEIHTFNQSQYPRLVVDDFLPLPSKGRTDKDGWYPPGHGSMFPSLSNSGKLDALISQGKEYVFVANSDNLGAIVDLKILNHLVAHKNEYCMEVTPKTLADVKGGTLISYEGRVQLLEIAQVPDEHVGEFKSIEKFKIFNTNNLWVNLKAIKRLVEADALKMEIIPNPKEVDGVKVLQLETAAGAAIRFFDKAIGINVPRSRFLPVKATSDLLLVQSDLYTVENGSVIRNKARTNPENPSIELGPEFKKVSNFLGRFKSIPSIVELDSLKVVGDVWFGTGVILKGKVSIVAKSGVKVEIPDGAVIANKEINGPKDL

SEQ ID NO: 8074 - protein, 467 aa, Musa acuminata
MADAKIAKLQSAVAELNQISENEKSGFISLVSRYLSGEAEQIEWSKIQTPTDEVVVPYDTLSPPPEDLEATKKLLDKLAVLKLNGGLGTTMGCTGPKSVIEVRNGFTFLDLIVIQIESLNKKYGCNVPLLLMNSFNTHDDTQKIVEKYANSNIEIHTFNQSQYPRLVMEDFQPLPSKGHAGKDGWYPPGHGDVFPSLMNSGKLDALLSQGKEYVFIANSDNLGAIVDIKILNHLINNQNEYCMEVTPKTLADVKGGTLISYEGRVQLLEIAQVPDAHVNEFKSIEKFKIFNTNNLWVNLKAIKRLVEADALKMEIIPNPKEVDGVKVLQLETAAGAAIRFFDHAIGINVPRSRFLPVKATSDLLLVQSDLYMLVDGFVIRNKARTNPSNPSIELGPEFKKVANFLSRFKSIPSIVELDSLKVSGDVWFGEGVVLKGNVSIAAKSGVKLEISDGAVLENKVINGPEDI

SEQ ID NO: 8075 - protein, 619 aa, Neurospora crassa
MKFLGIAALVAGLLAPPLVLAAPAPGTEGVNLLTPVDKRQDSQAERYGGGGGGGCNSPTNRQCWSPGFNINTDYELGTPNTGKTRRYKLTLTETDNWIGPDGVIKDKVMMVNDKIIGPTIQADWGDYIEITVINKLKSNGTSIHWHGMHQRNSNIQDGVNGVTECPIPPRGGSKVYRWRATQYGTSWYHSHFSAQYGNGIVGPIVINGPASANYDVDLGPFPLTDYYYDTADRLVLLTQHAGPPPSNNVLFNGFAKHPTTGAGQYATVSLTKGKKHRLRLINTSVENHFQLLLVNHSMTIISADLVPVQPYKVDSLFLGVGQRYDVIIDANQAVGNYWFNVTFGGSKLCGDSDNHYPAAIFRYQGAPKALPTNQGVAPVDHQCLDLNDLKPVLQRSLNTNSIALNTGNTIPITLDGFVWRVNGTAININWNKPVLEYVLTGNTNYSQSDNIVQVEGVNQWKYWLIENDPDGAFSLPHPIHLHGHDFLILGRSPDVTAISQTRYVFDPAVDMARLNGNNPTRRDTAMLPAKGWLLIAFRTDNPGSWLMHCHIAWHVSGGLSNQFLERAQDLRNSISPADKKAFNDNCDAWRAYFPDNAPFPKDDSGLRSGVKAREVKMKW

SEQ ID NO: 8076 - protein, 587 aa, Kluyveromyces lactis
MADHSSSSSSLQKKPINTIEHKDTLGNDRDHKEALNSDNDNTSGLKINGVPIEDAREEVLLPGYLSKQYYKLYGLCFITYLCATMQGYDGALMGSIYTEDAYLKYYHLDINSSSGTGLVFSIFNVGQICGAFFVPLMDWKGRKPAILIGCLGVVIGAIISSLTTTKSALIGGRWFVAFFATIANAAAPTYCAEVAPAHLRGKVAGLYNTLWSVGSIVAAFSTYGTNKNFPNSSKAFKIPLYLQMMFPGLVCIFGWLIPESPRWLVGVGREEEAREFIIKYHLNGDRTHPLLDMEMAEIIESFHGTDLSNPLEMLDVRSLFRTRSDRYRAMLVILMAWFGQFSGNNVCSYYLPTMLRNVGMKSVSLNVLMNGVYSIVTWISSICGAFFIDKIGRREGFLGSISGAALALTGLSICTARYEKTKKKSASNGALVFIYLFGGIFSFAFTPMQSMYSTEVSTNLTRSKAQLLNFVVSGVAQFVNQFATPKAMKNIKYWFYVFYVFFDIFEFIVIYFFFVETKGRSLEELEVVFEAPNPRKASVDQAFLAQVRATLVQRNDVRVANAQNLKEQEPLKSDADHVEKLSEAESV

SEQ ID NO: 8077 - protein, 202 aa, Oryza sativa (japonica cultivar-group)
MEPEAMPAPDPNDARQRFLLELEFIQCLANPTYIHYLAQNRYFEDEAFIGYLKYLKYWQRPEYIKYIMYPHCLFFLELLQNANFRNAMAHPASKEVAHRQQYFFWKNYRNNRLKHILPRPPPEPTPAPAPAPAPATVPPAAPVPSTVVPPVAAPSSSLPPMSAAGASAMSPMQFAGTPGTNIPKNDMRNVMGGQGGRKRKMG

SEQ ID NO: 8078 - protein, 378 aa, Oryza sativa (japonica cultivar-group); identical to SEQ ID NO: 3792

SEQ ID NO: 8079 - protein, 280 aa, Oryza sativa (japonica cultivar-group); identical to SEQ ID NO: 968

SEQ ID NO: 8080 - protein, 302 aa, Gossypium hirsutum
MASSWFFIVFLVLTVASVRCTTVDHMPSTDEDARDYSKLKTKTEEATDEHHSRTQQAKDELKSKADHAANEVKSNTQQAKDRASEVGKEAKEYTESWTEWAKEKISEGLGFKQDDDPKGSVEKAFDSVADTATKTKDKLQDMASGAGEYSAGKAKDMKDTAYKKTDDVKNAAKGKSSEMRQATTEKARELADSAKENANTAYIAAKEKVRDMADRTSEMTNEAQERGARKAEEAKEVVAEKAEGAAEETKKKNEERGESLKWAKEKAKQGYDAAKSKAEETIESAKDTIASGYESRSRNHKN

SEQ ID NO: 8081 - protein, 280 aa, Brassica napus
MASNQQSYKAGETRGKTQEKTGQAMGAMRDKAEEGKDKTSQTAQKAQQKAQETAQAAKDKTSQAAQTTQQKAQETAQAAKDKTSQAAQTTQQKAQETAQAAKDKTSQAAQTTQQKAHETTQSSKEKTSQAAQTAQEKARETKDKTGSYLSETGEAVKQKAQDAAQYTKETAQNAAQYTKETAEAGKDKTGGFLSQTGEHVKQMAMGAADAVKHTFGMATEEEDREHYPGTTTCTTQSTDPTRHTYEKEVRITGTIYEPSFFCFNNVMCLCFVISVVSLCL

SEQ ID NO: 8082 - protein, 136 aa, Gossypium hirsutum
MASHEQSYKAGRAEGRAHEKGEQMKESMKEKAEAAKQKTMETAEAAKQKTMETAEAAKQKTRGAAETTNDKTKQTAGAARGKAEETKETSGGILQQAGEKVRNAAQGATDAVKHTFGMADADEDEHNYPATVTRKD

SEQ ID NO: 8083 - protein, 213 aa, Hordeum vulgare
MASNQNQGSYHAGETKARTEEKTGQMMGATKQKAGQTTEATKQKAGETAEATKQKTGETAEAAKQKAAEAKDKTAQTAQAAKDKTYETAQAAKERAAQGKDQTGSALGEKTEAAKQKAAETTEAAKQKAAEATEAAKQKASDTAQYTKESAVAGKDKTGSVLQQAGETVVNAVVGAKDAVANTLGMGGDNTSATKDATTGATVKDTTTTTRNH

SEQ ID NO: 8084 - protein, 282 aa, Homo sapiens
MRAILILYFTNFISWDDNLSTAIYHTFVALCYLTPILGALIADSWLGKFKTIVSLSIVYTIGQAVTSVSSINDLTDHNHDGTPDSLPVHVVLSLIGLALIALGTGGIKPCVSAFGGDQFEEGQEKQRNRFFSIFYLAINAGSLLSTIITPMLRGKRYLKGTSVGLFLVRPSPCLLRFVLFFPSALFSSCQLHAGMHVGIWSKCFLPCEFHLLFVLFKSLIPVTTGESKPSLAWASIFLNCYSCKVMLVVRGKRQERCLGSQAGGRSCHFSLQALLPSDISVT

SEQ ID NO: 8085 - protein, 605 aa, Homo sapiens
MGMSKSHSFFGYPLSIFFIVVNEFCERFSYYGMRAILILYFTNFISWDDNLSTAIYHTFVALCYLTPILGALIADSWLGKFKTIVSLSIVYTIGQAVTSVSSINDLTDHNHDGTPDSLPVHVVLSLIGLALIALGTGGIKPCVSAFGGDQFEEGQEKQRNRFFSIFYLAINAGSLLSTIITPMLRVQQCGIHSKQACYPLAFGVPAALMAVALIVFVLGSGMYKKFKPQGNIMGKVAKCIGFAIKNRFRHRSKAFPKREHWLDWAKEKYDERLISQIKMVTRVMFLYIPLPMFWALFDQQGSRWTLQATTMSGKIGALEIQPDQMQTVNAILIVIMVPIFDAVLYPLIAKCGFNFTSLKKMAVGMVLASMAFVVAAIVQVEIDKTLPVFPKGNEVQIKVLNIGNNTMNISLPGEMVTLGPMSQTNAFMTFDVNKLTRINISSPGSPVTAVTDDFKQGQRHTLLVWAPNHYQVVKDGLNQKPEKGENGIRFVNTFNELITITMSGKVYANISSYNASTYQFFPSGIKGFTISSTEIPPQCQPNFNTFYLEFGSAYTYIVQRKNDSCPEVKVFEDISANTVNMALQIPQYFLLTCGEVVFSVTGLEF

SEQ ID NO: 8086 - protein, 444 aa, Toxoplasma gondii
MVAIKDITARQILDSRGNPTVEVDLLTDGGCFRAAVPSGASTGIYEALELRDKDQTKFMGKGVMKAVENIHKIIKPALIGKDPCDQKGIDKLMVEELDGTKNEWGWCKSKLGANAILAVSMACCRAGAAAKGMPLYKYIATLAGNPTDKMVMPVPFFNVINGGSHAGNKVAMQEFMIAPVGASTIQEAIQIGAEVYQHLKVVIKKKYGLDATNVGDEGGFAPNISGATEALDLLMEAIKVSGHEGKVKIAADVAASEFFLQDDKVYDLDFKTPNNDKSQRKTGEELRNLYKDLCQKYPFVSIEDPFDQDDFHSYAQLTNEVGEKVQIVGDDLLVTNPTRIEKAVQEKACNGLLLKVNQIGTVSESIEACQLAQKNKWGVMVSHRSGETEDSFIADLVVGLRTGQIKTGAPCRSERLCKYNQLMRIEESLGSDCQYAGAGFRHPN

SEQ ID NO: 8087 - protein, 522 aa, Aplysia californica
MSNMTGAFDLELTEDGGRTEDVSDEEYFEADESSGRQQEYGGDGLPNEEIMETIELSAQTVNPSNVRKIGRERFEIISLLGKGGYGKVLLAEMLDESKSKYDPPRLYAMKVLKKATIARNQKDTAHTRAERNILEAVKHPFIVDLHYAFQTDGKLYLILEYLPGGELFTHLEREGIFMEDMASFYLGEILLAIEHLHTLGVIYRDLKPENVLLDCKGHIKLTDFGLCKESISLGEVTHTFCGTIEYMAPEIVQRSGHGKGVDWWSLGALMYDMLTGQPPFSGENRKKTIDKILRAKLSLPPYLTNEARALLKKLLKKNPSDRLGSGPDDAAPIKSHMFFRHTNWDDLLNKRIEPPIKIGVTSAYDVSLFDTKFTKQTPCDSPVDMTVFSPSINIFDGFTYVAPSVLTEMATQPWISERGPRSPRKSYKNESLLLNNGLEGFYQANAAAAHAIATQRGNHPGHVNQGPTTVVASSRAVNGYDTSAQEDMDTSGGAAAAATASTSGGGVTSSQGGATGGVHHRP

SEQ ID NO: 8088 - protein, 927 aa, Vibrio fischeri
MKNQLLRYSLITIITCTLIIIYLMLTRNHPVKQYQRAYLTPSHNIIQSRENIYHFNHQDSKTYDEYASLLVDSELQASFLYNRRTASWLEFFLISDSQVFVSQNTYSNIVVIVTDLESLLKLKVFKEYTIHTIFLLEKQLTNNVQNVEDKYLTSQLTLHRTLPKEIALSDTAINDSDFTSLPNYIKLRKRIESKPKEQSIDSTVKQTLTKQNAYWITQSETIKTQLFITTLFLLCCIALYFYIRLNDKLIKTLTIKRELIRSEKEKAKLALVAEYAHDAIFILDKQGRLTWINQSYSALSGNTLEDIEGKDLPSILQLDKIKHANIIILLQSLETGTSISFELTNHHKDGTLFWIDVSITPILEPNGNIMHYIAVERDITKKKELEDKLIKAANKADVSNRAKSTFLATMSHELRTPLNGILGMAQIIESNIKDKEQHKQIKMLLESGDHLLFLLNEILDFSKIEQNKLELNHASFYFVDIIEPITNTYLSVCENKGLKFIIDNKINNEIVFIGDKPRIRQIIFNLISNAVKFTHEGSITLNFSHTLTGKGKQAVQIKIKDTGVGIRENRLKHIFEPYIQAEASTTRQYGGTGLGLAIVKQLTDIMRGYISVSSSEGKGSCFTLVLPLDITKSKQLKDNDALLPSGQSKSTNPIPMANLSILIAEDNKINALVAQMFCQRLGHKAIIAENGKVAIDKLKETHFDLIIMDNHMPVMDGILATKIIREKLKISTVIFAYTANAFQKAHDNFLKAGANYVLTKPLQENDFIGAIKQYQDAIIQQKRTSYPTQEKNSNIIELKRPSKYKLSDDALTEAEIKLTSIQDICGTDSEIICVFLQSFIDTSEENITEIITAFERKDIKSIRFNAHSIKGMASNFSASRLIKIATSIELCAKKKNMPKLEDVQQLINLLKINIQQASRLLEKYETQ

SEQ ID NO: 8089 - protein, 910 aa, Oryza sativa (japonica cultivar-group); identical to SEQ ID NO: 855

SEQ ID NO: 8090 - protein, 391 aa, Mus musculus
MSGPVPSRARVYTDVNTHRPREYWDYESHVVEWGNQDDYQLVRKLGRGKYSEVFEAINITNNEKVVVKILKPVKKKKIKREIKILENLRGGPNIITLADIVKDPVSRTPALVFEHVNNTDFKQLYQTLTDYDIRFYMYEILKALDYCHSMGIMHRDVKPHNVMIDHEHRKLRLIDWGLAEFYHPGQEYNVRVASRYFKGPELLVDYQMYDYSLDMWSLGCMLASMIFRKEPFFHGHDNYDQLVRIAKVLGTEDLYDYIDKYNIELDPRFNDILGRHSRKRWERFVHSENQHLVSPEALDFLDKLLRYDHQSRLTAREAMEHPYFYTVVKDQARMSSTSMAGGSTPVSSANMMSGISSVPTPSPLGPLAGSPVIAAANSLGIPVPAAACAQQ

SEQ ID NO: 8091 - protein, 154 aa, Lupinus luteus
MGVLTDVQVALVKSSFEEFNANIPKNTHRFFTLVLEIAPGAKDLFSFLKGSSEVPQNNPDLQAHAGKVFKLTYEAAIQLQVNGAVASDATLKSLGSVHVSKGVVDAHFPVVKEAILKTIKEVVGDKWSEELNTAWTIAYDELAIIIKKEMKDAA

SEQ ID NO: 8092 - protein, 147 aa, Medicago sativa
MSFTDKQEALVNSSWEAFKQNLPRYSVFFYTVVLEKAPAAKGLFSFLKNSAEVQDSPQLQAHAEKVFGLVRDSAVQLRATGGVVLGDATLGAIHVRKGVVDPHFVVVKEALLKTIKEAAGDKWSEELNTAWEVAYDALATAIKKAMS

SEQ ID NO: 8093 - protein, 147 aa, Medicago truncatula
MSFTDKQEALVNSSYEAFKQNLSGYSVFFYTVILEKAPAAKGLFSFLKDSAGVQDSPQLQAHAEKVFGLVRDSASQLRATGGVVLGDAALGAIHIQKGVVDPHFVVVKEALLKTIKEAAGDKWSEELSTAWEVAYDALATEIKKAMS

SEQ ID NO: 8094 - protein, 147 aa, Pisum sativum
GFTDKQEALVNSSSEFKQNLPGYSILFYTIVLEKAPAAKGLFSFLKDTAGVEDSPKLQAHAEQVFGLVRDSAAQLRTKGEVVLGNATLGAIHVQKGVTNPHFVVVKEALLQTIKKASGNNWSEELNTAWEVAYDGLATAIKKAMKTA

SEQ ID NO: 8095 - protein, 143 aa, Vicia faba
GFTEKQEALVNSSSQLFKQNPSNYSVLFYTIILQKAPTAKAMFSFLKDSAGVVDSPKLGAHAEKVFGMVRDSAVQLRATGEVVLDGKDGSIHIQKGVLDPHFVVVKEALLKTIKEASGDKWSEELSAAWEVAYDGLATAIKAA

SEQ ID NO: 8096 - protein, 153 aa, Lupinus luteus
GALTESQAALVKSSWEEFNANIPKHTHRFFILVLEIAPAAKDLFSFLKGTSEVPQNNPELQAHAGKVFKLVYEAAIQLQVTGVVVTDATLKNLGSVHVSKGVADAHFPVVKEAILKTIKEVVGAKWSEELNSAWTIAYDELAIVIKKEMNDAA

SEQ ID NO: 8097 - protein, 146 aa, Medicago truncatula
MGFTEKQEALVNSSWELFKQNPGNSVLFYTIILEKAPAAKGMFSFLKDTAGVQDSPKLQSHAEKVFGMVRDSAVQLRATGGVVLGDATLGAIHIQKGVVDPHFVVVKEALLKTIKEVSGDKWSEELSTAWEVAYDALAAAIKKAMG

SEQ ID NO: 8098 - protein, 148 aa, Sesbania rostrata
MGFTEKQEALVNASYEAFKQNLPGNSVLFYSFILEKAPAAKGMFSFLKDSDGVPQNNPSLQAHAEKVFGLVRDSAAQLRATGVVVLADASLGSVHVQKGVLDPHFVVVKEALLKTLKEAAGATWSDEVSNAWEVAYDGLSAAIKKAMS

SEQ ID NO: 8099 - protein, 146 aa, Medicago sativa
MGFTDKQEALVNSSWESFKQNPGNSVLFYTIILEKAPAAKGMFSFLKDSAGVQDSPKLQSHAEKVFGMVRDSAAQLRATGGVVLGDATLGAIHIQKGVVDPHFAVVKEALLKTIKEVSGDKWSEELNTAWEVAYDALATAIKKAMV

SEQ ID NO: 8100 - protein, 148 aa, Sesbania rostrata
MGFTEKQEALVNASYEAFKQNLPGNSVLFYSFILEKAPAAKGMFSFLKDFDEVPQNNPSLQAHAEKVFGLVRDSAAQLRATGVVVLADASLGSVHVQKGVLDPHFVVVKEALLKTLKEAGGATWSDEVSNAWEVAYDELSAAIKKAMS

SEQ ID NO: 8101 - protein, 765 aa, Plasmodium falciparum
MPKEDCKTEKSIDSIDENVLKKYDILKKVGKGAYGVVFKGRCKKNKNIVAVKKIFGAFQNCTDAQRTFREIIFLYELNGHDNIIKLMDVIKAKNDNDIYLIFDFMETDLHEVIKADLLEEIHKKYIIYQLLRALKYIHSGGLLHRDIKPSNILVNSECHIKVADFGLARSISTHVNENKVPILTDYVATRWYRAPEILLGSTHYTEDVDMWSLGCIMGELLCGKPLFTGNSTMNQLEKIIQVIGKPNKKDIEDIRSPFAEKIISSFVDLKKKNLKDICYKASNESLDLLEKLLQFNPSKRISAENALKHKYVEEFHSIIDEPTCRHIITIPINDNTKYRVNFYRNVVYFVIMRRNKFHSNVLNQGESKKEEKKDRYYRRDKDKKKCICENNKVHMEDKEYKNKIIFSQGDKPEDIKEDHKKCKICDEIHVDTSKQIDSINLEHVVLNNNDVSYVDKKKKTKYEPVYKERGKMKKDKMGNVYCKDRERRVFYEARKKESITNFTTATTISKSDDTEVEMSQMEINEIESNEMKGKIKEQIKEQIKEQIKEQIKEQIKKTQNNISKISIGSNTMSSTISKTEPNSRNYFINKKSVESFYTKERKNNDILFHANNKKVIFFKDKNKIKNHSSEKKKIKYKVFYGFKKLYENEQNVPHYLETKCSNTPLGRIIIIKNMWMEVTKNMWMEVTKNMWMEVTKNMWMEVTKNMWTEVVKNMWMEVTKNMWTEVVKNMWMEVTKNMWMDVIKNITIIITILIIITITIVVEAL

SEQ ID NO: 8102 - protein, 147 aa, Medicago sativa
MGFTADQEALVNSSWESFKQNLPGYSVFFYTTILEKAPAAKGMFSFLKDSAGVQDSPQLQAHAEKVFGMVRDSAVQLRATGEVVLGDATLGSIHIQKGVVDPHFVVVKEALLKTIKEAVGDKWSEELSTSWEVAYDGLASAIKKAMS

SEQ ID NO: 8103 - protein, 145 aa, Phaseolus vulgaris
GAFTEKQEALVNSSWEAFKGNIPQYSVVFYTSILEKAPAAKNLFSFLANGVDPTNPKLTAHAESLFGLVRDSAAQLRANGAVVADAALGSIHSQKGVSNDQFLVVKEALLKTLKQAVGDKWTDQLSTALELAYDELAAAIKKAYA

SEQ ID NO: 8104 - protein, 145 aa, Psophocarpus tetragonolobus
MGGFTEKQEALVNSSYEAFKANVPQYSVVFYTSILEKAPAAKDLFPFLANGVDPTNPKLIGHAEKLFGLVHDSAAQLRAKGAVVADAALGSLHAQKGVTDPQFVVVKEALLKTVKEAVGDKWSDELSNAWEVAYNELAAALKKAF

SEQ ID NO: 8105 - protein, 263 aa, Lolium perenne
MASSSSVLLVVALFAVFLGSAHGIAKVPPGPNITAEYGDKWLDAKSTWYGKPTGAGPKDNGGACGYKNVDKAPFNGMTGCGNTPIFKDGRGCGSCFEIKCTKPESCSGEAVTVTITDDNEEPIAPYHFDLSGHAFGSMAKKGEEQNVRSAGELELQFRRVKCKYPDDTKPTFHVEKASNPNYLAILVKYVDGDGDVVAVDIKEKGKDKWIELKESWGAVWRIDTPDKLTGPFTVRYTTEGGTKSEFEDVIPEGWKADTSYSAK

SEQ ID NO: 8106 - protein, 255 aa, Eimeria tenella
LRLLLKLLLLLLGQQKHWPERQQQQQPQPWLDRQQQQQQHNQQLQKQQWPEGQRQQLWPEQQQQQWPEQHQQAQQQQQWPQQQPQMQQEQWPQQQPQVQQQQQWPQQQHRRQHGQQQQCMNSQQQLQQCGQQQQQQLQQQWSEQQQQQQQQQWPEQPEQQQQQQWPEQQQQQWSDQNQQQQAQQWQAQQQQQWPQQQQQPQQQQQQQQQQDLGPDGVGIVVPYLGSSPADFEVQNLGVSVLPRIKLPLPKFDNDD

SEQ ID NO: 8107 - protein, 359 aa, Pneumocystis carinii
MHGKDAAKERGLLSSFRRIKKPKTERLDSYFGFWGDKCTSEKKNDVHPPERFKFYATLTRHYYSLVTDFYEYGWSISFHFCRLCKNESFSQAIARHEHYIALHAGIREGETVLDVGCGVGGPDCQISVFTGANIVGLNNNDYQIQRAKYYSEKKGLSDKLKFIKGDFMQMPFPENSFDKIYSIEATIHAPSLEGVYSEIYRVLKPGGLYASYEWVMLTEYDENDPEHQQIVYGIEIGDSIPKISKIGEAEAALIKVGFEIIHSEELSTKNSPLPWYYYLDGYLKRVRSFRDFISIARMTTIGKWLISSFIGLMEFIGLLPKGSKKVNDILLVAADSLVKAGKKEIFTPMQLWVCRKPLV

SEQ ID NO: 8108 - protein, 112 aa, Rhodospirillum rubrum
MKFVIAITKPFKLDEVREALGALGIQGMTVTEVKGFGRQKGQTEVYRGAEYVVNFLPKVKIELAVPDNLLDQVVETIQSTAQTGKIGDGKIFVFDLGEAVRIRTGERGEEAL

SEQ ID NO: 8109 - protein, 458 aa, Oryza sativa (japonica cultivar-group); identical to SEQ ID NO: 3170

SEQ ID NO: 8110 - protein, 394 aa, Drosophila melanogaster
MAAATPEIQFYERELNIRRVIEECDLQRLDQALNICDLSSVERNVRLWQKLLPRIKPFYAVKCNDDPMVVRLLAQLGAGFDCASKNEVKLVLGFDVSPERIIFANPCRPVSHLEYAKEHQVSNGTVDNEFEVYKLHTHYPNSNLIVRFKSEAKEAQCPLGDKFGCDADVDAAALMLLAKSLELKVTGTSFHVGSGCSELQAYDRAIKKAKNLFKFGALLGYDMDFLDIGGGFPGSDDVKFEKIAESVNTSVQRHFPDERVHIIAEPGRFFVAAACTLVCKIHAKREIRNEAGKLDTVMYYLNDGVYGSFNCILYDHQVVIAEHYLDNAESLPHLKSLIWGPSCDALDKISEDLHLPNLNRGDLLGFRNMGAYTMPIASAFNGFEVPKTLYFQAI

SEQ ID NO: 8111 - protein, 664 aa, Homo sapiens [sequence omitted]

SEQ ID NO: 8112 - protein, 499 aa, Homo sapiens [sequence omitted]

SEQ ID NO: 8113 - protein, 1175 aa, Rattus norvegicus
MAKPYEFNWQKEVPSFLQEGAVFDRYEEESFVFEPNCLFKVDEFGFFLTWKSEGKEGQVLECSLINSIRLAAIPKDPKILAALESVGKSENDLEGRILCVCSGTDLVNIGFTYMVAENPEITKQWVEGLRSIIHNFRANNVSPMTCLKKHWMKLAFLTNTSGKIPVRSITRTFASGKTEKVIFQALKELGLPSGKNDEIEPAAFTYEKFYELTQKICPRTDIEDLFKKINGDKTDYLTVDQLVSFLNEHQRDPRLNEILFPFYDAKRAMQIIEMYEPDEELKKKGLISSDGFCRYLMSDENAPVFLDRLELYQEMDHPLAHYFISSSHNTYLTGRQFGGKSSVEMYRQVLLAGCRCVELDCWDGKGEDQEPIITHGKAMCTDILFKDVIQAIKETAFVTSEYPVILSFENHCSKYQQYQMSKYCEDLFGDLLLKQALESHPLEPGRLLPSPNDLKRKILIKNKRLKPEVEKKQLEALKSMMEAGESAAPASILEDDNEEEIESADQEEEAHPEYKFGNELSADDFSHKEAVANSVKKGLVTVEDEQAWMASYKYVGATTNIHPYLSTMINYAQPVKFQGFHVAEERNIHYNMSSFNESVGLGYLKTHAIEFVNYNKRQMSRIYPKGGRVDSSNYMPQIFWNAGCQMVSLNYQTPDLAMQLNQGKFEYNGSCGYLLKPDFMRRPDRTFDPFSETPVDGVIAATCSVQVISGQFLSDKKIGTYVEVDMYGLPTDTIRKEFRTRMVMNNGLNPVYNEESFVFRKVILPDLAVLRIAVYDDNNKLIGQRILPLDGLQAGYRHISLRNEGNKPLSLPTIFCNIVLKTYVPDGFGDIVDALSDPKKFLSITEKRADQLRAMGIETSDIADVPSDTSKNDKKGKANPAKANVTPQSSSELRPTTTAALGSGQEAKKGIELIPQVRIEDLKQMKAYLKHLKKQQKELNSLKKKHAKEHSTMQKLHCTQVDKIVAQYDKEKSTHEKILEKAMKKKGGSNCLEIKKETEIKIQTLTSDHKSKVKEIVAQHTKEWSEMINTHSAEEQEIRDLHLSQQCELLRKLLINAHEQQTQQLKLSHDRESKEMRAHQAKISMENSKAISQDKSIKNKAERERRVRELNSSNTKKFLEERKRLAMKQSKEMDQLKKVQLEHLEFLEKQNEQAKEMQQMVKLEAEMDRRPATVV

SEQ ID NO: 8114 - protein, 776 aa, Rattus norvegicus
MVIMSEFSAVPTGTGQGQQKPLRVGFYDVERTLGKGNFAVVKLARHRVTKTQVAIKIIDKTRLDSSNLEKIYREVQLMKLLNHPNIIKLYQVMETKDMLYIVTEFAKNGEMFDYLTSNGHLSENEARKKFWQILSAVEYCHNHHIVHRDLKTENLLLDGNMDIKLADFGFGNFYKPGEPLSTWCGSPPYAAPEVFEGKEYEGPQLDIWSLGVVLYVLVCGSLPFDGPNLPTLRQRVLEGRFRIPFFMSQDCETLIRRMLVVDPAKRITIAQIRQHRWMQADPTLLQQDDPAFSMQGYTSNLGDYNEQVLGIMQALGIDRQRTVESLQNSSYNHFAAIYYLLLERLREHRSTQPSSRATPAPARQPQLRNSDLSSLEVPQEILPCDPFRPSLLCPQPQALAQSVLQAEIDCDLHSSLQPLFFPLDTNCSGVFRHRSISPSSLLDTAISEEARQGPSLEEEQEVQEPLPGSTGRRHTLAEVSTHFSPLNPPCIIVSSSAAVSPSEGTSSDSCLPFSASEGPAGLGGGLATPGLLGTSSPVRLASPFLGSQSATPVLQSQAGLGATVLPPVSFQEGRRASDTSLTQGLKAFRQQLRKNARTKGFLGLNKIKGLARQVCQSSIRGSRGGMSTFHTPAPSSGLQGCTASSREGRSLLEEVLHQQRLLQLQHHSAVSSDYQQAPQLSPVPYVLTPCDGLLVSGIPLLPTPLLQPGMSPVASAAQLLDAHLHISAGPVALPTGPLPQCLTRLSPSCDPAGLPQGDCEMEDLTSGQRGTFVLVQ

SEQ ID NO: 8115 - protein, 1023 aa, Bos taurus
PVRSITRTFASGKTEKVIFQALKELGLPSGKNDEIEPAAFTYEKFYELTQKICPRTDIEDLFKKINGDKTDYLTVDQLVSFLNEHQRDPRLNEILFPFYDAKRAMQIIEMYEPDEDLKKQGLISSDGFCRYLMSDENAPVFLDRLELYQEMDHPLAHYFISSSHNTYLTGRQFGGKSSVEMYRQVLLAGCRCVELDCWDGKGEDQEPIITHGKAMCTDILFKDVIQAIKETAFVTSEYPVILSFENHCSKYQQYKMSKYCEDLFGDLLLKQALESHPLEPGRPLPSPNDLKRKILIKKQTTETEVEKKQLEALKSMMEAGESAAPVNMLEDDNEEEIESAEQEEEAHPEYKYGNELSADDLGHKEAIANSVKKASDDLEHENSKKGLVTVEDEQAWMASYKYVGATTNIHPYLSTMINYAQPVKFQGFHVAEERNIHYNMSSFNESVGLGYLKTHAIEFVNYNKRQMSRIYPKGGRVDSSNYMPQIFWNSGCQMVSLNYQTPDLAMQLNQGKFEYNGSCGYLLKPDFMRRPDRTFDPFSETPVDGVIAATCSVQVISGQFLSDKKIGTYVEVDMYGLPTDTIRKEFRTRMVMNNGLNPVYNEESFVFRKVILPDLAVLRIAVYDDNNKLIGQRILPLDGLQAGYRHISLRNEGNKPLSLPTIFCNIVLKTYVPDGFGDIVDALSDPKKFLSITEKRADQMRAMGIETSDIADVPSDTSKNDKKGKANTAKANVTPQSSSELRPTTTAALGAGLEAKKGIELIPQVRIEDLKQMKAYLKHLKKQQKELSSLKKKHAKEHSTMQKLHCTQVDKIVAQYDKEKLTHEKILEKAMKKKGGSNCLEMKKETEIKIQTLTSDHKSKVKEIVAQHTKEWSDMINTHSAEEQEIRDLLLSQQCELLRKLLISAHEQQTQQLKLSHDRESKEMRAHQAKISMENSKAISQDKSIKNKAERERRVRELNSSNTKKFLEERKRLAMKQSKEMDQLKKVQLEHLEFVEKQNEQAKEMQQMVKLEAEMDRRPATVV

SEQ ID NO: 8116 - protein, 199 aa, Homo sapiens
MTRLLGYVDPLDPSFVAAVITITFNPLYWNVVARWEHKTRKLSRAFGSPYLACYSLSVTILLLNFLRSHCFTQAMLSQPRMESLDTPAAYSLGLALLGLGVVLVLSSFFALGFAGTFLGDYFGILKEARVTVFPFNILDNPMYWGSTANYLGWAIMHASPTGLLLTVLVALTYIMALLYEEPFTAEIYRQKASGSHKRS

SEQ ID NO: 8117 - protein, 415 aa, Schizosaccharomyces pombe
MDVSTQTRHATYFQDENQLQKDHIYVKKKSHIKLNTGVRAPFKAVDNINQQDEPTLIEGNNESSISSSTGDTFEEDFAYQDKVEIEERSIRSTPKSIGDDDLENREGSFDAPEGILTHGKHRLPTIPEWTKEDLAALSEAAARLQANPSPEDIETDPSMVPDYDPEIFHYMQSLERKLAPPPNYMSVQQEIDWVTRHMLVDWIVQVQIHFRLLPETLFLAVNLIDRFLSIKVVSLQKVQLVGLSALLIACKYEEIHPPSIYNFAHVVQGIFTVDEIIRAERYMLMLLDFDISWPGPMSFLRRISRADSYDHDIRMLAKYLQEVTLMDEIFIGAHISFIAATAYYLSMQMLGHLDWTPCHVYYSGYTARQLKPCAIIIMECLVDAPNHHNAIYRKYSENRMKRVSAFAHNWVLSVI

SEQ ID NO: 8118 - protein, 294 aa, Drosophila melanogaster
MQKYDKMEKIGEGTYGTVFKGRNRDTMEIVALKRVRLDEDDEGVPSSALREICLLKELKHKNIVRLIDVLHSDKKLTLVFEHCDQDLKKYFDSLNGEIDMAVCRSFMLQLLRGLAFCHSHNVLHRDLKPQNLLINKNGELKLADFGLARAFGIPVKCYSAEVVTLWYRPPDVLFGAKLYTTSIDMWSAGCILAELADAGRPLFPGSDVLDQLMKIFRVLGTPNEDSWPGVSHLSDYVALPSFPAITSWSQLVPRLNSKGRDLLQKLLICRPNQRISAEAAMQHPYFTDSSSSGH

SEQ ID NO: 8119 - protein, 1117 aa, Homo sapiens [sequence omitted]

SEQ ID NO: 8120 - protein, 1195 aa, Homo sapiens
PPEESSDSEPEAEPGSPQKLIRKVSTSGQIRQKTIIKEGMLTKQNNSFQRSKRRYFKLRGRTLYYAKTAKSIIFDEVDLTDASVAESSTKNVNNSFTVITPCRKLILCADNRKEMEDWIAALKTVQNREHFEPTQYSMDHFSGMHNWYACSHARPTYCNVCREALSGVTSHGLSCEVCKFKAHKRCAVRATNNCKWTTLASIGKDIIEDADGIAMPHQWLEGNLPVSAKCTVCDKTCGSVLRLQDWRCLWCKAMVHTSCKESLLTKCPLGLCKVSVIPPTALNSIDSDGFWKASCPPSCTSPLLVFVNSKSGDNQGVKFLRRFKQLLNPAQVFDLMNGGPHLGLRLFQKFDTFRILVCGGDGSVGWVLSEIDSLNLHKQCQLGVLPLGTGNDLARVLGWGSACDDDTQLPQILEKLERASTKMLDRWSVMAYEAKLPRQASSSTVTEDFSEDSEVQQILFYEDSVAAHLSKILTSDQHSVVISSAKVLCETVKDFVARVGKAYEKTTESSEESEVMAKKCSVLKEKLDSLLKTLDDESQASSSLPNPPPTIAEEAEDGDGSGSICGSTGDRLVASACPARPQIFRPREQLMLRANSLKKAIRQIIEHTEKAVDEQNAQTQEQEGFVLGLSESEEKMDHRVCPPLSHSESFGVPKGRSQRKVSKSPCEKLISKGSLSLGSSASLPPQPGSRDGLPALNTKILYPNVRAGMSGSLPGGSVISRLLINADPFNSEPETLEYYTEKCVMNNYFGIGLDAKISLDFNNKRDEHPEKCRSRTKNMMWYGVLGTKELLHRTYKNLEQKVLLECDGRPIPLPSLQGIAVLNIPSYAGGTNFWGGTKEDDTFAAPSFDDKILEVVAVFGSMQMAVSRVIRLQHHRIAQCRTVKISILGDEGVPVQVDGEAWVQPPGYIRIVHKNRAQTLTRDRAFESTLKSWEDKQKCELPRPPSCSLHPEMLSEEEATQMDQFGQAAGVLIHSIREIAQSHRDMEQELAHAVNASSKSMDRVYGKPRTTEGLNCSFVLEMVNNFRALRSETELLLSGKMALQLDPPQKEQLGSALAEMDRQLRRLADTPWLCQSAEPGDEESVMLDLAKRSRSGKFRLVTKFKKEKNNKNKEAHSSLGAPVHLWGTEEVAAWLEHLSLCEYKDIFTRHDIRGSELLHLERRDLKDLGVTKVGHMKRILCGIKELSRSAPAVEA

SEQ ID NO: 8121 - protein, 365 aa, Pan troglodytes
  unsure (1)..(365): unsure at all Xaa locations
MSLIRKKGFYKQDVNKXXXELXKTYVSPTHVGSGAYGSVCSAIDKRSGEKVAIKKLSRPFQSEIFAKRAYRELLLLKHMQHENVIGLLDVFTPASSLRNFHDFYLVMXFMQTDLQKIMXMEFSEEKIQYLVYQMLKGLKYIHSAGVVHRDLKPGNLAVNEDCELKILDFGLARHADAEMTGYVVTRWYRAPEVILSWMHYNQTVDIWSVGCIMAEMLTGKTLFKGKDYLDQLTQILKVTGVPGTEFVQKLNDXAAKSYIQSLPQTPRKDFTQLFPRASPQAADLLEKMLELDVDKRLTAAQALTHPFFEPFRDPEEETEAQQPFDDSLEHEKLTVDEWKQHIYKEIVNFSPIARKDSRRRXGXKL

SEQ ID NO: 8122 - protein, 290 aa, Homo sapiens
CTAIREVSLLKNLKHANIVTLHDLIHTDRSLTLVFEYLDSDLKQYLDHCGNLMSMHNVKIFMFQLLRGLAYCHHRKILHRDLKPQNLLINERGELKLADFGLARAKSVPTKTYSNEVVTLWYRPPDVLLGSTEYSTPIDMWGVGCIHYEMATGRPLFPGSTVKEELHLIFRLLGTPTEETWPGVTAFSEFRTYSFPCYLPQPLINHAPRLDTDGIHLLSSLLLYESKSRMSAEAALSHSYFRSLGERVHQLEDTASIFSLKEIQLQKDPGYRGLAFQQPGRGKNRRQSIF

SEQ ID NO: 8123 - protein, 372 aa, Homo sapiens
MKQLPVLEPGDKPRKATWYTLTVPGDSPCARVGHSCSYLPPVGNAKRGKVFIVGGANPNRSFSDVHTMDLGKYQWDLDTCKGLLPRYEHASFIPSCTPDRIWVFGGANQSGNRNCLQVLNPETRTWTTPEVTSPPPSPRTFHTSSAAIGNQLYVFGGGERGAQPVQDTKLHVFDANTLTWSQPETLGNPPSPRHGHVMVAAGTKLFIHGGLAGDRFYDDLHCIDISDMKWQKLNPTGAAPAGCAAHSAVAMGKHVYIFGGMTPAGALDTMYQYHTEEQHWTLLKFDTLLPPGRLDHSMCIIPWPVTCASEKEGSNSLTLNHEAEKEDSADKVMSHSGDSHEESQTATLLCLVFGGMNTEGEIYDDCIVTVVD

SEQ ID NO: 8124 - protein, 236 aa, Homo sapiens [sequence omitted]

SEQ ID NO: 8125 - protein, 479 aa, Homo sapiens
MIRAAPPPLFLLLLLLLLVSWASRGEAAPDQDEIQRLPGLAKQPSFRQYSGYLKGSGSKHLHYWFVESQKDPENSPVVLWLNGGPGCSSLDGLLTEHGPFLVQPDGVTLEYNPYSWNLIANVLYLESPAGVGFSYSDDKFYATNDTEVAQSNFEALQDFFRLFPEYKNNKLFLTGESYAGIYIPTLAVLVMQDPSMNLQGLAVGNGLSSYEQNDNSLVYFAYYHGLLGNRLWSSLQTHCCSQNKCNFYDNKDLECVTNLQEVARIVGNSGLNIYNLYAPCAGGVPSHFRYEKDTVVVQDLGNIFTRLPLKRMWHQALLRSGDKVRMDPPCTNTTAASTYLNNPYVRKALNIPEQLPQWDMCNFLVNLQYRRLYRSMNSQYLKLLSSQKYQILLYNGDVDMACNFMGDEWFVDSLNQKMEVQRRPWLVKYGDSGEQIAGFVKEFSHIAFLTIKGAGHMVPTDKPLAAFTMFSRFLNKQPY

SEQ ID NO: 8126 - protein, 433 aa, Homo sapiens
MATSGDCPRSESQGEEPAECSEAGLLQEGVQPEEFVAIADYAATDETQLSFLRGEKILILRQTTADWWWGERAGCCGYIPANHVGKHVDEYDPEDTWQDEEYFGSYGTLKLHLEMLADQPRTTKYHSVILQNKESLTDKVILDVGCGTGIISLFCAHYARPRAVYAVEASEMAQHTGQLVLQNGFADIITVYQQKVEDVVLPEKVDVLVSEWMGTCLLFEFMIESILYARDAWLKEDGVIWPTMAALHLVPCSADKDYRSKVLFWDNAYEFNLSALKSLAVKEFFSKPKYNHILKPEDCLSEPCTILQLDMRTVQISDLETLRGELRFDIRKAGTLHGFTAWFSVHFQSLQEGQPPQVLSTGPFHPTTHWKQTLFMMDDPVPVHTGDVVTGSVVLQRNPVWIRHMSVALSWAVTSRQDPTSQKVGEKVFPIWR

SEQ ID NO: 8127 - protein, 317 aa, Homo sapiens
MPREDRATWKSNYFLKIIQLLDDYPKCFIVGADNVGSKQMQQIRMSLRGKAVVLMGKNTMMRKAIRGHLENNPALEKLLPHIRGNVGFVFTKEDLTEIRDMLLANKVPAAARAGAIAPCEVTVPAQNTGLGPEKTSFFQALGITTKISRGTIEILSDVQLIKTGDKVGASEATLLNMLNISPFSFGLVIQQVFDNGSIYNPEVLDITEETLHSRFLEGVRNVASVCLQIGYPTVASVPHSIINGYERVLALSVETDYTFPLAEKVKAFLADPSAFVAAAPVAAATTAAPAAAAAPAKVEAKEESEESDEDMGFGLFD

SEQ ID NO: 8128 - protein, 326 aa, Homo sapiens
MAEASPHPGRYFCHCCSVEIVPRLPDYICPRCESGFIEELPEETRSTENGSAPSTAPTDQSRPPLEHVDQHLFTLPQGYGQFAFGIFDDSFEIPTFPPGAQADDGRDPESRRERDHPSRHRYGARQPRARLTTRRATGRHEGVPTLEGIIQQLVNGIITPATIPSLGPWGVLHSNPMDYAWGANGLDAIITQLLNQFENTGPPPADKEKIQALPTVPVTEEHVGSGLECPVCKDDYALGERVRQLPCNHLFHDGCIVPWLEQHDSCPVCRKSLTGQNTATNPPGLTGVSFSSSSSSSSSSSPSNENATWSPLGRPQPPRPLSNLTL

SEQ ID NO: 8129 - protein, 249 aa, Brassica napus
MDEGGSSHDAESSKKIGRGKIEIKRIENTTNRQVTFCKRRNGLLKKAYELSVLCDAEVALVIFSTRGLLYEYASNSVKGTIERYKKACSDAVNPPTVTEANTKHYQQEASKLRRQIRDIQNSNRHIVGESLGSLNFKELKNLEGRLEKGISRVRSKKSELLVAEIEYMQKREMELQHVNMYLRAKIEQGARLNPEQHGSGVIQGTAVYESGLSSSHDQSQHYNRNYIPVNLLEPNQQFSGQDQPPLQLV

SEQ ID NO: 8130 - protein, 78 aa, Culicoides nubeculosus
APHSIANGFKNLLALAATTDVDSKEAETIKEYIKDPSKIAAAAAATAPAAETKKEEKKEEKKEETEESDDDIGLSLFH

SEQ ID NO: 8131 - protein, 355 aa, Glomerella cingulata
MSRANPPNASGSRKISFNVSEQYDIQDVVGEGAYGVVCSAIHKPSGQKVAIKKITPFDHSMFCLRTLREMKLLRYFNHENIISILDIQKPRSYETFNEVYLIQELMETDMHRVIRTQDLSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFRTLFPKTSDLALDLLEKLLAFNPVKRITVEDALKHPYLEPYHDPDDEPTAPPIPEEFFDFDKHKDNLSKEQLKQLIYQEIMR

SEQ ID NO: 8132 - protein, 51 aa, Cucumis sativus
LTCEDKDGDWMLVGDVPWEMFTESCRRLRIMKGSEAIGLAPRATEKCKNRN

SEQ ID NO: 8133 - protein, 293 aa, Hordeum vulgare subsp. vulgare
MSPTLSLKLKKSSHTPQSSVSSSTMLRLFKKEAACQSPSTLPVAMDMGLEVSSSSPSSSSVSSSPEHAARRASPAKRPAGRTKFRETRHPVYRGVRRRGNTERWVCEVRVPGKRGARLWLGTYATAEVAARANDAAMLALGGRSATCLNFADSAWLLAVPSALSDLADVRRAAVEAVADFQRREAADGSLAIAVPKEASSGAPSLSPSSGSDSAGSTGTSEPSANGVFEGPVVMDSEMFRLDLFPEMDLGSYYMSLAEALLMDPPPTATIIHAYEDNGDGGADVRLWSYSVDM

SEQ ID NO: 8134 - protein, 585 aa, Arabidopsis thaliana
MGLRFPPKVLEHILSFIDSNEDRNSVSLVCKSWFETERKTRKRVFVGNCYAVSPAAVTRRFPEMRSLTLKGKPHFADYNLVPDGWGGYAWPWIEAMAAKSSSLEEIRMKRMVVTDECLEKIAASFKDFKVLVLTSCEGFSTDGIAAIASTCRNLRVLELRECIVEDLGGDWLSYFPESSTSLVSLDFSCLDSEVKISDLERLVSRSPNLKSLKLNPAVTLDGLVSLLRCAPQLTELGTGSFAAQLKPEAFSKLSEAFSNCKQLQSLSGLWDVLPEYLPALYSVCPGLTSLNLTYATVRMPDLVELLRRCSKLQKLWVMDLIEDKGLEAVASYCKELRELRVFPSEPDLDATNIPLTEQGLVFVSKGCRKLESVLYFCVQFTNAALFTIARKRPNLKCFRLCVIEPFAPDYKTNEPLDKGFKAIAEGCRDLRRLSVSGLLSDKAFKYIGKHAKKVRMLSIAFAGDSDLMLHHLLSGCESLKKLEIRDCPFGDTALLEHAAKLETMRSLWMSSCFVSFGACKLLSQKMPRLNVEVIDEHPPESRPESSPVERIYIYRTVAGPRMDTPEFVWTIHKNPENGVSHLAIK

SEQ ID NO: 8135 - protein, 183 aa, Triticum aestivum; identical to SEQ ID NO: 4122

SEQ ID NO: 8136 - protein, 215 aa, Malus x domestica
MGRGKVEIKRIENSSNRQVTYSKRRNGIIKKAKEITVLCDAKVSLIIYSSSGKMVEYCSPSTTLTEILDKYHGQSGKKLWDAKHENLSNEVDRVKKDNDSMQVELRHLKGEDITSLNHVELMALEEALENGLTSIRDKQSKFVDMMRDNGKALEDENKRLTYELQKQQEMKIKENVRNMENGYHQRQLGNYNNNQQQIPFAFRVQPIQPNLQERI

SEQ ID NO: 8137 - protein, 215 aa, Malus x domestica
MGRGKVEIKRIENSSNRQVTYSKRRNGIIKKAKEITVLCDAKVSLIIYSSSGKMVEYCSPSTTLTEILDKYHGQSGKKLWDAKHENLSNEVDRVKKDNDSMQVELRHLKGEDITSLNHVELMALEEALENGLTSIRDKQSKFVDMMRDNGKALEDENKRLTYELQKQQEMKIEENVRNMENGYHQRQLGNYNNNQQQIPFAFRVQPIQPNLQERI

SEQ ID NO: 8138 - protein, 260 aa, Thauera aromatica
MTHSRALSGKHAVITGGGRGIGAAIAHSLAEQGAAVTLMGRTLPRLEQQAEELRAFSQVHCEAVDVAQADSVAAAFAAAQARLGPVDILVNNAGQALSAPFVKTDPALWQQMLDVNLTGVFLGTRAVLPGMLAAGWGRVINITSTAGQKGYPYVSAYCAAKHGVIGLTRALALETARKNVTVNAVCPGYTDTDIVRDSVSNIQTKTGRSEAEALAELTRFNPQGRLVRPQEVANAVLWLCLPGSEAITGQSISVAGGEMM

SEQ ID NO: 8139 - protein, 95 aa, Platichthys flesus
DSQKQSILVSWMIAQSVTAVAGLTSYPFDTVRRRMMMQSGRKGADIMYSGTIDCWRKIARDEGGKAFFKGALSNVLRGMGGAFVLVLYDELKKVM

SEQ ID NO: 8140 - protein, 153 aa, Platichthys flesus
ADKNVVVFDKNEEQIVATLKGHTKKVTSVIYHPSQSVVFSASPDNTIRVWSVTGGNCVQVIRAHEGGVTGLSLHATGDYLLSSSEDQYWAFSDIQTGRVLTKVTDESAGCALTCAQFHPDGLIFGTGTADSQIKIWDLKERTNVANFPGHSGP

SEQ ID NO: 8141 - protein, 150 aa, Carassius auratus gibelio
MSGRGKKLVAAPKSKSSSVSRSTRAELQFPVGRVARLLRKGNYAPRIGSGASVYLTAVIEYLCAEVLELAGDACRDNKKLRITPRHIQLAVRKDEELNALLGGVTISEGGVLPKIQAQLLPKKTKAPRDPPTPKTSSPRTSEADSARALD

SEQ ID NO: 8142 - protein, 140 aa, Carassius auratus
MSGRGKKIVAAPKTKSSVSRSSRAGLQFPVGRIARLLRKGNYAARIGSGAAVYLTAVIEYLCAEVLELAGNASRDNKKLRIAPRHIQLAVRNDEELNTLLGGVTISEGGVLPNIQAQLLPKKTKVSRDPNTSKEVQSQDF

SEQ ID NO: 8143 - protein, 134 aa, Methanosarcina barkeri
MKEITAIIRMNKAQRTKDVLLECGFPSFTIRRVMGRGKQRGLCHEFNPPLPDPEKEAETCIRFIPKRMFTIVVDDENVSEVVQKIIEVNQTGNAGDGKIFVSDVTEAIRIRTGESGEATVNKSWYNGSRNRFKN

SEQ ID NO: 8144 - protein, 333 aa, Oryza sativa (indica cultivar-group)
MSKARVYADVNVLRPKEYWDYEALTVQWGEQDDYEVVRKVGRGKYSEVFEGINVNNNEKCIIKILKPVKKKKIKREIKILQNLCGGPNIVKLLDIVRDQHSKTPSLIFEYVNNTDFKVLYPTLTDYDIRYYIYELLKALDYCHSQGIMHRDVKPHNVMIDHELRKLRLIDWGLAEFYHPGKEYNVRVASRYFKGPELLVDLQDYDYSLDMWSLGCMFAGMIFRKEPFFYGHDNHDQLVKIAKVLGTEALNAYLNKYHIELDPQLEALVGRHSRKPWSKFINADNQHLVSPEAVDFLDKLLRYDHQDRLTAREAMAHPYFLQVRAAENSRARPQ

SEQ ID NO: 8145 - protein, 579 aa, Physcomitrella patens
MAAVSSACVVLPETRGVVGQRGQDGNASCSSGWRDGGAEHASRLSKASRRRVAAVRSMLPSRSLVFAPLSLHPLGRTVHCRALKVDDALVTESGLISEEGVSRAAAEEAMTLALAAAKAAMEAASYADAMAVEQEEFPTEFDLLRLERARLSDVEHSFRVELDTEAAMMEAEQSYVQKLESLLGGVSTLVREEEETASVSEDEDDSNSLPQIQVAVKSKRKGERRKRRERALERAEKVATDLASAPPLPKPKKPQLAADPSDPVRAYLRDIGRTKLLTAREEVDLSHQIQDLLKLENIKSNLEREIGRNATIGEWSRAVGMEQNAFEARLKKGRFAKDKMVNSNLRLVVSIAKNYQGRGMTLQDLIQEGSMGLVRGAEKFDPTKGFKFSTYAHWWIRQAVTRSIADQSRTIRLPIHLYEVISRINKAKRMLVQEHGREARNEEVAELVGLTVEKLKSVVKSAKAPGSMERPIGKDGDTTLGELVADTDVDSPEDAIVKQLMRQDIEGVLRTLNPREREVLRLRFGLDDGRSKTLEEIGQIFKVTRERIRQIEAKAMRKLRQPSRNSILREYLDVKSDAI

SEQ ID NO: 8146 - protein, 608 aa, Homo sapiens
SRLFSKALKGDHRCGETETPKSCSEVAGCKAAMRHQGKIPEELSLDDRARTQKKWGRGKWEPEPSSKPPREATLEERHARGEKHLGVEIEKTSGEIIRCEKCKRERELQQSLERERLSLGTSELDMGKGPMYDVEKLVRTRSCRRSPEANPASGEEGWKGDSHRSSPRNPTQELRRPSKSMDKKEDRGPEDQESHAQGAAKAKKDLVEVLPVTEEGLREVKKDTRPMSRSKHGGWLLREHQAGFEKLRRTRGEEKEAEKEKKPCMSGGRRMTLRDDQPAKLEKEPKTRPEENKPERPSGRKPRPMGIIAANVEKHYETGRVIGDGNFAVVKECRHRETRQAYAMKIIDKSRLKGKEDMVDSEILIIQSLSHPNIVKLHEVYETDMEIYLILEYVQGGDLFDAIIESVKFPEPDAALMIMDLCKALVHMHDKSIVHRDLKPENLLVQRNEDKSTTLKLADFGLAKHVVRPIFTVCGTPTYVAPEILSEKGYGLEVDMWAAGVILYILLCGFPPFRSPERDQDELFNIIQLGHFEFLPPYWDNISDAAKDLVSRLLVVDPKKRYTAHQVLQHPWIETAGKTNTVKRQKQVSPSSEGHFRSQHKRVVEQVS

SEQ ID NO: 8147 - protein, 255 aa, Pseudomonas aeruginosa
MQPNLTRLFALDGRRALVTGASSGLGRHFAMTLAAAGAEVVVTARRQAPLQALVEAIEVAGGRAQAFALDVTCREDICRVLDAAGPLDVLVNNAGVSDSQPLLACDDQSWDRVLDTNLKGAWAVAQESARRMVAAGKGGSLINVTSILASRVAGAVGPYLAAKAGLAHLTRAMALELARHGIRVNALAPGYVMTDLNEAFLASEAGDKLRSRIPSRRFSVPADLDGALLLLASDAGRAMSGAEIVVDGGHLCSSL

SEQ ID NO: 8148 - protein, 474 aa, Pseudomonas aeruginosa
MQTKLLINGALVAGEGESHAVYNPSQGNVLVRITEASGAQVHAAVQSADAAFDAWSQTPPKDRAALLLKLAERIDAQAHVFARLEADNCGKPFNAVLLDELPAVSDVFRFFAGAVRCLQGSAAGEYVAGHTSMIRRDAVGVVASIAPWNYPLLMAAWKLGPALAGGNTVVLKPSEHTPLSTLKLGELLAEIFPAGVVNIVHGRGASVGEPLTSHAQVRMVSLTGSVRTGSRIIEGTAESVKRMHMELGGKAPVLIFDDADIDAAVEGIRAFGFYNAGQDCTAACRLYVQKGVYQEFVRKLGEAVSSIRCGLPDDPATEMGPLITKEHLERVEGFVNRARELPHIEVVTGGKRAEGAGFFFEPTVLAGATQEDEVMRREIFGPVVTVSSFEDEAQALAWANDSDYGLASSVWTADVGRAHRLAARLQYGCTWVNTHFMLVSEMPHGGVKLSGYGKDLSMYGLEDYTVVRHVMFKH

SEQ ID NO: 8149 - protein, 394 aa, Toxoplasma gondii
MGSVSAVAGPLGRMWGKLSSMSTMATSRGDSLLSTSSRTSVAVECSPRATQPPPNVADRESQILSQVRYDLLARNLSIDDFLFHETVGTGSFGRVCIVDLRGAAGWYPPMALKILSKHKIVKMKQVEHVKDEKRILSSIEHPFIVNLLAAFQDEKRLFILMEYVNGGELFSHLRRRNCIPTDQARLYAAEITLAFQYLHQRHIVYRDLKPENLLIDSQGHIKITDFGFAKVVKDRTWTLCGTHEYLAPESITRRGHGLPVDWWALGILLFEMLAGHPPFVDENPLGIYRKIIAGKIEFPRSFDYAAKSLVKRLLTHDPLKRYGCLKDGAEDVKNHKFFKGIDWVKCYNKNIRAPYLPNTRGPQDSSMFDKYAESTESSSPPIGAAEQQAFFDNF

SEQ ID NO: 8150 - protein, 112 aa, Azospirillum brasilense
MKKIEAIIKPFKLDEVKEALHEVGIKGITVTEAKGFGRQKGHTELYRGAEYVVDFLPKVKIEVVMEDSLVERAIEAIQQAAHTGRIGDGKIFVTPVERIVRIRTGEKGGDAI

SEQ ID NO: 8151 - protein, 369 aa, Oryza sativa
MDGAPVAEFRPTMTHGGRYLLYDIFGNKFEVTNKYQPPIMPIGRGAYGIVCSVMNFETREMVAIKKIANAFNNDMDAKRTLREIKLLRHLDHENIIGIRDVIPPPIPQAFNDVYIATELMDTDLHHIIRSNQELSEEHCQYFLYQILRGLKYIHSANVIHRDLKPSNLLLNANCDLKICDFGLARPSSESDMMTEYVVTRWYRAPELLLNSTDYSAAIDVWSVGCIFMELINRQPLFPGRDHMHQMRLITEVIGTPTDDELGFIRNEDARKYMRHLPQYPRRTFASMFPRVQPAALDLIERMLTFNPLQRITVEEALDHPYLERLHDIADEPICLEPFSFDFEQKALNEDQMKQLIFNEAIEMNPNFRY

SEQ ID NO: 8152 - protein, 358 aa, Gallus gallus
MHHFSISPCLHVPTSLCPPAATGSDEEDDSDASTKPIRSGKKNPASLFQTGGDPPRERKTRKKAPKTAESEEETLETQQKNSNKKGKGKKSKKKEERPLSPVIEVDNLEKFVLSPAPQGVTIKCRVTRDKRGMDRGLYPTHYLHLDNDKKVFLLAGRKRKKSKTSNYLISIDPTDLSRGGENFIGKLRSNLMGTKFTVFDNGANPDRASADWSNVRQELSAVVYETNVLGFKGPRKMTVIIPGMNSDNERVPIRPRNDNDGLLMRWQNKNMDNIIELHNKAPVWNDETQSYVLNFHGRVTHASVKNFQIVHGSDPDYIVMQFGRVADDAFTMDYNYPLCAVQAFAIALSSFDGKLACE

SEQ ID NO: 8153 - protein, 706 aa, Lycopersicon esculentum
YFSIPIELVYFVQKSAVFPYRWVLVQFGAFIVLCGATHLINLWTSTPHTRTVAMVMTTAKFSTAAVSCATAVMLVHIIPDLLSVKTRELFLKNKAAELDREMGLIRTQEETGRYVRMLTHEIRSTLDRHTILKTTLVELGRALQLEECALWMPTRTGVELQLSYTLHHQNPVGFTVPIQLPVINQVFSANCAVKISPNSAVARLRPTRKYIPGEVVAVRVPLLHLSNFQTNDWPELSPKSYALMVLMLPSNSARQWHVHELELVDVVADQVAVALSHAAILEESMRARDLLIEQNVALDLARREAETAVRARNDFLGVMNHEMRTPMHAVVALSSLLQESELIPEQRLMVETILKSSNLLATLINDVLDLSRLEDGSLQLDVGTFNLHALFREVLNLIKPVAAVKKLFVTLSLSSDFPEVAIGDEKRLMQILLNVVGNAVKFSEEGSVSVSAVNAKSESLIDPRAPEFFPVQSENHFYLRVQVKDTGSGINPQDFPKLFCKFAQNQEPATKNSAGTGLGLAICKRFVNLMEGHIWIESEGVGKGSTAIFIVKLGIPGRLNESKLPFTAGLPANHMQMTFQGLKVLVMDDNGFSRMVTKSLLVHLGCDVTTIGSGDECLRILTREHKVLIMDASITGMNCYDVAVSVHEKFGKRLERPLIVALTGNTDQVTKENCLRVGMDGVILKPVSIDKMRSVLSGLLEHGTVL

SEQ ID NO: 8154 - protein, 261 aa, Streptomyces antibioticus
MPGQKQQVALVTGATSGIGLAVVRALAAQGHQVFFCARNAEKVAVTIKELRGEGLDVDGTSCDVRSVADVKAFVAAAVERFGPVDVLVNNAGRSGGGVTAELTDELWADVIETNLTSVFMVTREVLTAGGMREKSSGRIVNIASTAGKQGVVLGAPYSASKHGVVGFTKALGNELAPTGITVNAVCPGYVETPMAERVRQGYAAAYGTSEEAILEKFQAKIPLGRYSTPEEVAGLVGYLVSDTAASITAQALNVCGGLGNF

SEQ ID NO: 8155 - protein, 456 aa, Streptomyces antibioticus
MSTRRPYQGAFTPVDQEVTAFDLPVTGRIPAELRGRYLRNGPNPLRLDDPRAHLFLGEGMVHGVRLRDGRAEWYRNRWVRSAAVARSLGEKPRRGTRFAGAEFAPNTHVIGHAGRTLALVENGFRPYELTEELETVGPCDFRGTLQAGYVAHPKLDPHTGELHAVSYATRWEFVQYSVISPTGMVTRTVNIPAPHRPVMHDFALTASYVVLYDLPVVNSLAAAAAGAPMVYDWQENRGARLGLLPRNGTEVRWFDISPCWVFHTLNAYEDGDRVVVDVIRYPRMFTGLRLDGNSTPTMDRWVIDTVSGRVTETRLDDRAQEFPGVNPAVVSGPHRYGYAAVVPDMHTYFGPDDDLDDLPDQAYSDALIKHDFSAGSSSVRPLGRGHYTGEPVFVATASPAAEDDGYLLAYVHDPDRGASDLVILSAQDFTGEPVATVHLPARVPLGLHGSWIADPA

SEQ ID NO: 8156 - protein, 281 aa, Burkholderia pseudomallei
MLPGHLGNIDAYIQAVNRIPLLSAEEERQYATEYREQNNLDAARRLVLSHLRLVVSVARNYLGYGLPHGDLIQEGNIGLMKAVKRFDPAQNVRLVSYAIHWIKAEIHEYILRNWRMVKVGDDEGAAQAFFNLRSHKKGTQAFTPEEIDGLAQELNVKREEVAEMETRLSGGDIALEGQIDDGEESYAPIAYLADSHNEPTAVLAARQRDMLQTDGIARALESLDARSRRIIEARWLNVDDDGSGGSTLHDLAAEFGVSAERIRQIEASAMKKMRTALAAYA

SEQ ID NO: 8157 - protein, 90 aa, Synechocystis sp. PCC 9413
  unsure (1)..(90): unsure at all Xaa locations
KKVEAXXRPFKLDEVKIALVNSGVVGMTVSEVRGFGRQKGQTERYRGSEYTVEFLQKLKVEIVVEDNQVDMVIDKIIAAARTGEIGDGKN

SEQ ID NO: 8158 - protein, 578 aa, Mus musculus
MSAPRAEEQPSRSGERQPLVARGPRGPRRWRRTAAAAVLLVQMLERAAFFGVTSNLVLYLNSLNFNWDGQQASRATLLFLGASYLLAPVGGWLADVYLGRFLTISLSLLLYLAASGLLLTTITNDGRRSFCGEMPELPLEPACPSSSCQGSWSSPYCATTLYLVLLLLALAASSVRSTLTSFGADQVMDLGRDATRRFFNWFYWSINLGAILSLLVVAFIEQNISFLWGYSIIVGLVGLAFFIFLFATPVFITKPPTGSQVSSMLKLAFQNCCPCRKSSSRDSESAHLLPDQRSNQPGPSPQEDMANFQVLVKILPVMVTLVPYWMVYFQMQSTYVLQGLHLHIPNIFRTNPNISLLLRSDSSNYRIPEAWLLLANVAVILILIPVKDHLIDPLLLRCKLLPSSLQKMALGMFFGFTSIIVAGVLEKERLQYIAANQTVPQLIGKDLYYAAPLSIWWQIPQYLLIGVSEIFASIPGLEFAYSEAPRSMQGAIMGIFFCLSGVGSLLGSGLVALLSFPGGWMYCPKDFGNINNCQMDRYFFLLAGIEAVTAVLFLWIAGRYERTRQDPASQRSSSRVRG

SEQ ID NO: 8159 - protein, 267 aa, Hordeum vulgare
MGRSPCCEKAHTNKGAWTKEEDDRLTAYIKAHGEGCWRSLPKAAGLLRCGKSCRLRWINYLRPDLKRGNFSHEEDELIIKLHSLLGNKWSLIAGRLPGRTDNEIKNYWNTHIRRKLTSRGIDPVTHRAINSDHAASNITISFESAQRDDKGAVFRRDAEPAKAAAAAAAISHHVDHHHRSNPQLDWGQGKPLKCPDLNLDLCISPPIHEDPMVDTKPVVKREAGVGVGVVGLCFSCSMGLPRSSDCKCSSFMGLRTAMLDFRSIEMK

SEQ ID NO: 8160 - protein, 816 aa, Oryctolagus cuniculus
MLLWSAVRGLSPPRIVPSLLVVVALAGLLPGLRSHGLQLSPTDSTTPDSQPSRERSIGDVTTAPPEVTPESRPVNRSVTEHGMKPRKAFPVLGIDYTHVRTPFEISLWILLACLMKIGFHVIPTISSIVPESCLLIVVGLLVGGLIKGVGEKPPFLQSEVFFLFLLPPIILDAGYFLPLRQFTENLGTILIFAVVGTLWNAFFLGGLMYAVCLVGGEQINNIGLLDNLLFGSIISAVDPVAVLAVFEEIHINELLHILVFGESLLNDAVTVVLYHLFEEFANYDHVGIVDIVLGFLSFFVVALGGVFVGVVYGVIAAFTSRFTAHIRVIEPLFVFLYSYMAYLSAELFHLSGIMALIASGVVMRPYVEANISHKSHTTIKYFLKMWSSVSETLIFIFLGVSTVAGSHHWNWTFVISTLLFCLIARVLGVLGLTWFINKFRIVKLTPKDQFIIAYGGLRGAIAFSLGYLLDKKHFPMCDLFLTAIITVIFFTVFVQGMTIRPLVDLLAVKKKQETKRSINEEIHTQFLDHLLTGIEDICGHYGHHHWKDKLNRFNKKYVKKCLIAGERSKEPQLIAFYHKMEMKQAIELVESGGMGKIPSAVSTVSMQNIHPKALPAERILPALSKDKEEEIRKILRNNLQKTRQRLRSYNRHTLVADPYEEAWNQMLLRRQKARQLEQKINNYLTVPAHKLDSPTMSRARIGSDPLAYEPKADLPVITIDPASPQSPESVDLVNEELKGKVLGLSREPRVAEEAAEEDEDGGIVMRPKEPSSPGTDDVFSPAPSDSPSSQRMQRCLSDPGPHPEPGEGEPFIPKGQ

SEQ ID NO: 8161 - protein, 832 aa, Oryctolagus cuniculus
MSGRGGCGPCWGLLLALVLALGALPWTQGAEQEHHDEIQGFQIVTFKWHHVQDPYIIALWVLVASLAKIVFHLSHKVTSVVPESALLIVLGLVLGGIVLAADHIASFTLTPTVFFFYLLPPIVLDAGYFMPNRLFFSNLGSILLYAVVGTVWNAATTGLSLYGVFLSGIMGELKIGLLDFLLFGSLIAAVDPVAVLAVFEEVHVNEVLFIIVFGESLLNDAVTVVLYNVFQSFVTLGGDKVTGVDCVKGIVSFFVVSLGGTLVGVVFAFLLSLVTRFTKHVRVIEPGFVFIISYLSYLTSEMLSLSSILAITFCGICCQKYVKANISEQSATTVRYTMKMLASGAETIIFMFLGISAVDPLIWTWNTAFVLLTLLFVSVFRAIGVVLQTWLLNRYRMVQLELIDQVVMSYGGLRGAVAFALVALLDGNKVKEKNLFVSTTIIVVFFTVIFQGLTIKPLVQWLKVKRSEHREPKLNEKLHGRAFDHILSAIEDISGQIGHNYLRDKWANFDRRFLSKLLMRQSAQKSRDRILNVFHELNLKDAISYVTEGERRGSLAFIRSPSTDNMVNVDFSTPRPSTVEASVSYLLRESASAVCLDMQSLEQRRRSVRDAEDVITHHTLQQYLYKPRQEYKHLYSRHVLSPSEDEKQDKEIFHRTMRKRLESFKSAKLGLGQSKKATKHKRERERAQKRRNSSVPNGKLPLDSPAYGLTLKERELELSDPEEAPDYYEAEKMSGGIEFLASVTKDTTSDSPAGIDNPVFSPDEDLAPSLLARVPPWLSPGEAVVPSQRARVQIPYSPGNFRRLAPFRLSNKSVDSFLLAEDGAEHPESTHM

SEQ ID NO: 8162 - protein, 227 aa, Cicer arietinum
PVYKPPVEKPPVYKPPIEKPPVYKPPVEKPPVYKPPVEKPPVYKPPIEKPPVYKPPVEKPPIYKPPVEKPPVYKPPVEKPPVYKPPVEKPPVYKPPVEKPPVYKPPVEKPPVYKPPVEKPPVYKPPVEKPPVYKPPVEKPPIYKPPVEKPPVYKPPIEKPPVYTPPVEKPPVYKPPIEEPPVYKPPVEKPPVYGPPYEKPPHYPGYPPYEKPPHHPGYPPADDDNRF

SEQ ID NO: 8163 - protein, 414 aa, Eimeria maxima
EVELLKKLDHPNIMKLYEFFEDKGYFYLVTEVYTGGELFDEIINRKRFSEADAARIVRQVLSGINYMHRNKIVHRDLKPENLLLENKKKDANIRIIDFGLSTHFEPQKKMKDKIGTAYYIAPEVLHGTYDEKCDVWSTGVILYILLSGCPPFNGANEFEILKKVEKGKFTFDLPQWRKVSEPAKDLIRKMLAYVPSMRISAKDALDHPWIKSTDVTAKDSINLPSLESTILNIRQFQGTQKLAAAALLYMGSKLTTNEETDELNKIFQKMDKNGDGQLDKQELMEGYVELMKLKGEDVSVLDKSAIETEVEQVLEAVDFDKNGFIEYSEFVTVAMDRRTLLSRQRLERAFEMFDSDGSGKISSSELATIFGVSELDSEAWRRVLAEVDRNNDGEVDFEEFQQMLLKLCGNTAAE

SEQ ID NO: 8164 - protein, 487 aa, Eimeria tenella
PAASKSDKLAATPGMFVQHSTAAFSDRYKGQRVLGKGSFGEVILCKDKVTGQEYAVKVISKRQVKQKTDKELLLKEVELLKKLDHPNIMKLYEFFEDKGYFYLVTEVYTGGELFDEIISRKRFSEVDAARIIRQVLSGITYMHKNKIVHRDLKPENLLLENKRKDANIRIIDFGLSTHFESTKKMKDKIGTAYYIAPEVLHGTYDEKCDVWSTGVILYILLSGCPPFNGANEFDILKKVEKGKFTFDLPQWKKVSEPAKDLIRKMLAYVPTMRISARDALEHEWLKTTDAATDSIDVPSLESTILNIRQFQGTQKLAAAALLYMGSKLTTNEETVELNKIFQRMDKNGDGQLDKQELMEGYVELMKLKGEDVSALDQSAIEFEVEQVLDAVAFDKNGFIEYSEFVTVAMDRKTLLSRQRLERAFGMFDADGSGKISSSELATIFGVSEVDSETWRRVLAEVDRNNDGEVDFEEFRQMLLKLCGDTAA

SEQ ID NO: 8165 - protein, 203 aa, Nicotiana plumbaginifolia
MAIKVHGSPMSTATMRVAACLIEKDLDFEFVPVDMASGEHKKLPYLSLNPFGQVPAFEDGDLKLFESRAITQYIAHVYADNGYQLILQDPKKMPIMSVWMEVEGQKFDPPASKLTFELGIKPIIGMTTDDAAVKESEEQLSKVLDIYETRLAESKYLGGDSFTLVDLHHIPNIYYLMSTKVKEVFDSRPRVSAWCADILARPA

SEQ ID NO: 8166 - protein, 355 aa, Fusarium solani
MSRSNPPNPTGSRKISFNVSEQYDIQDVVGEGAYGVVCSAIHKPSGQKVAIKKITPFDHSMFCLRTLREMKLLRYFNHENIISILDIQKPRNYESFNEVYLIQELMETDMHRAIRTQDLSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFRTLFPKTSDLALDLLEKLLAFNPVKRITVEEALKHPYLEPYHDPEDEPTAPPIPEEFFDFDKHKDNLSKEQLKQLIYQEIMR

SEQ ID NO: 8167 - protein, 613 aa, Homo sapiens
MGDEVLDQDGTFIEELIKNYDGKVHGDRECGFINDEIFVELVNALGQYNDDDDDDDGDDPEEREEKQKDLEDHRDDKESRPPRKFPSDKIFEAISSMFPDKGTAEELKEKYKELTEQQLPGALPPECTPNIDGPNAKSVQREQSLHSFHTLFCRRCFKYDCFLHPFHATPNTYKRKNTETALDNKPCGPQCYQHLEGAKEFAAALTAERIKTPPKRPGGRRRGRLPNNSSRPSTPTINVLESKDTDSDREAGTETGGENNDKEEEEKKDETSSSSEANSRCQTPIKMKPNIEPPENVEWSGAEASMFRVLIGTYYDNFCAIARLIGTKTCRQVYEFRVKESSIIAPAPAEDVDTPPRKKKRKHRLWAAHCRKIQLKKDGSSNHVYNYQPCDHPRQPCDSSCPCVIAQNFCEKFCQCSSECQNRFPGCRCKAQCNTKQCPCYLAVRECDPDLCLTCGAADHWDSKNVSCKNCSIQRGSKKHLLLAPSDVAGWGIFIKDPVQKNEFISEYCGEIISQDEADRRGKVYDKYMCSFLFNLNNDFVVDATRKGNKIRFANHSVNPNCYAKVMMVNGDHRIGIFAKRAIQTGEELFFDYRYSQADALKYVGIEREMEIP

SEQ ID NO: 8168 - protein, 463 aa, Homo sapiens
MGRKKKKQLKPWCWYCNRDFDDEKILIQHQKAKHFKCHICHKKLYTGPGLAIHCMQVHKETIDAVPNAIPGRTDIELEIYGMEGIPEKDMDERRRLLEQKTQESQKKKQQDDSDEYDDDDSAASTSFQPQPVQPQQGYIPPMAQPGLPPVPGAPGMPPGIPPLMPGVPPLMPGMPPVMPGMPPGLHHQRKYTQSFCGENIMMPMGGMMPPGPGIPPLMPGMPPGMPPPVPRPGIPPMTQAQAVSAPGILNRPPAPTATVPAPQPPVTKPLFPSAGQAQAAVQGPVGTDFKPLNSTPATTTEPPKPTFPAYTQSTASTTSTTNSTAAKPAASITSKPATLTTTSATSKLIHPDEDISLEERRAQLPKYQRNLPRPGQAPIGNPPVGPIGGMMPPQPGIPQQQGMRPPMPPHGQYGGHHQGMPGYLPGAMPPYGQGPPMVPPYQGGPPRPPMGMRPPVMSQGGRY

SEQ ID NO: 8169 - protein, 459 aa, Mus musculus
MVQANADGRPRSRRARQSEEQAPLVESYLSSSGSTSYQVQEADSIASVQLGATRPPAPASAKKSKGAAASGGQGGAPRKEKKGKHKGTSGPATLAEDKSEAQGPVQILTVGQSDHDKDAGETAAGGGAQPSGQDLRATMQRKGISSSMSFDEDEDEDENSSSSSQLNSNTRPSSATSRKSIREAASAPSPAAPEPPVDIEVQDLEEFALRPAPQGITIKCRITRDKKGMDRGMYPTYFLHLDREDGKKVFLLAGRKRKKSKTSNYLISVDPTDLSRGGDSYIGKLRSNLMGTKFTVYDNGVNPQKASSSTLESGTLRQELAAVCYETNVLGFKGPRKMSVIVPGMNMVHERVCIRPRNEHETLLARWQNKNTESIIELQNKTPVWNDDTQSYVLNFHGRVTQASVKNFQIIHGNDPDYIVMQFGRVAEDVFTMDYNYPLCALQAFAIALSSFDSKLACE

SEQ ID NO: 8170 - protein, 320 aa, Mus musculus
PRVRDEELERDEKVFLLGEEVAQYDGAYKVSRGLWKKYGDKRIIDTPISEMGFAGIAVGAAMAGLRPICEFMTFNFSMQAIDQVINSAAKTYYMSAGLQPVPIVFRGPNGASAGVAAQHSQCFAAWYGHCPGLKVVSPWNSEDAKGLIKSAIRDNNPVVMLENELMYGVAFELPAEAQSKDFLIPIGKAKIERQGTHITVVAHSRPVGHCLEAAAVLSKEGIECEVINLRTIRPMDIEAIEASVMKTNHLVTVEGGWPQFGVGAEICARIMEGPAFNFLDAPAVRVTGADVPMPYAKVLEDNSVPQVKDIIFAVKKTLNI

SEQ ID NO: 8171 - protein, 99 aa, Saccharomyces cerevisiae
MAATKEAKQPKEPKKRTTRRKKDPNAPKRGLSAYMFFANENRDIVRSENPDVTFGQVGRILGERWKALTAEEKQPYESKAQADKKRYESEKELYNATRA

SEQ ID NO: 8172 - protein, 193 aa, Phaseolus acutifolius
MVPSEIRGVHYLAPENPFLVPPNFGLLQNDIPNLHLNTLLSNFPNCHFPPSGLEFVAPHSCLSSNSTSDEADEIQFNIIDERKHRRMISNRESARRSRMRKQKHLDELWSQVVRLRTENHNLIDKLNHMSDSHDRVLQKNTRLKEEASDLRQMLADMQIGISFACTMEELEDLPCNKPGPSNQLITPADMIHE

SEQ ID NO: 8173 - protein, 269 aa, Azotobacter chroococcum (strain mcd 1)
MSLLAQWREDIRCVFERDPAARTTFEVLTTYPGVHAIMLYRLAHRLWRPNALPRPAAVVRARLVSNVDIHPGAVIGARFFIDHGACVVIGETAEIGRDVTLYHGVTLGGTTGAKGKRHPTLGDVVLVGAGAKILGPITIGANARVGANSVVVQDVPEGCTVVGIPGKVVKLREAGQLNPYGIDLDHHLIPDPVGKAIACLLERIDSLEKRVEAGGLVAAAASSTFYEGCNPDNSICETNLRRSAPWSSGRPRRPAHAGDRVSGRAKGSD

SEQ ID NO: 8174 - protein, 258 aa, Pseudomonas sp. S-47
MNKRFQGKVAVITGAAQGIGRRVAERMAAEGGRLLLVDRSELIHELADELVGVAEVLTLTADLEQFAECQRVMAAALERFGRLDILINNVGGTIWAKPFEHYQEREIEAEVRRSLFPTLWCCHAALAPMIEQGSGAIVNVSSVATRGIHRVPYGAAKGGVNALTACLAFETAERGIRVNATAPGGTEAPPRRIPRNSAEPSEQEKVWYQQIVDQSLDSSLMKRYGSIDEQVEAILFLASDAASYITGITLPVAGGDLG

SEQ ID NO: 8175 - protein, 669 aa, Agelaius phoeniceus
MELEQRTKLFPHSGTRDTHRALPGVEVLPLLMRDLWAFSSSSIRPQLGNDRSWFGETKGTKAAPAPPGAPSASKEEAQEEEDSSELPAALGDDGELPSAPGDDSELPAALGDEGEHPAGWECNGEAPAGWDKDRGHLPAWDEDSGCPLVWDQNGQAPTEWDEDGGHLPVWDEDGAHPVAWEEESEHPPVWEVDSEHPLAWKDDGEPAVFWEEDGEAAAFWEEDEGAPSAWEEEIEPPSAVGSWAEHSDSSTALQPEGRGEWCLMQLSTSALFLGARAGNTVSEAEPAEKYLEVEQIGQGAFRAVYKGLDRATGGEVAIKKMSLRGQDRERAVNEILLLKDKKSPNIVDSLDSFLVDGDLWLVMEYMDGGTLWDLVRQTRMAEGEMAAVSRECLQGLDFLHSNRVIHRDLQSSNILLGMDGSVRLADFGLCAQLSPEQDQRSSMVGTAHWMAPEVVTRSPYGPKVDIWSFGIVTIEMVEGEPPHFRETAAMARALIRQNWTPQLQEPRRLSALLRDFLECSLEPDEERRWAAQELLQNLVEEAIWNGSTAQESNGEEKPQRSHTRRGCKPSPGSCEEVKAFCARKDAEIILQIHEDVEIPPQIRGDAEIPLQTHGDAEIPLQTHGDAEIPLQPPEQPRWSTGMPERRLCPRGQRGPAGAACPGRTDPGAQ

SEQ ID NO: 8176 - protein, 625 aa, Chlorella sorokiniana
MVDDSAHGAKVAKGSPTFGDGAYSMGASTPRFSVPVDSENKSKVLKIWSFQRPHHLSFHLSWMSFMLAFFATFAAPPMMPVIRNNLDLTKPDIGGASIAAVTGAVFSRILLGAVCDSYGPRYGHGVLQLLCSAATFAMASITNAAGFIICRMVIGFSLATFVPCQFWCSVMFNAKIVGTANAVAAGWGNMGAGLTHLIMPYIFTGMASHQPDFIAWRCAYFVPGFAHIIIGLLVLMFGQDLPDGNYGALRKAGKKDKAKTHMELLVAVKNYRTWLLVLNYGYCFGVELTVDNNISPYLYDQFGIDLHLAGVLGAVFGLSNLFARALGGLASDYASRRFGMRGRLWTLWIVQSLGGVCSILMFYTSHSLGATMAIVVCWSIFVPMGCGATYGIAPFITRRGLGVATGLIGAGGNTGSAITQALFFTGTSMTTTEGFKWMGVMILAVTATLVLMHFPMWGGMLTRANPEVTEEEYYSRDYTAAEKEQGLHRAILNWASESRSNRGFKEQLAKLSADLTAAAPTTAAAVAQHAERACSLLQAACCRNCPLQAPLHPTLQIAPQLYHHRHPPPLSALTKPETSPFVALVCAPFIACFAGRPATPCSYLVSSSPVHQWYVPLTLLTRHFP

SEQ ID NO: 8177 - protein, 347 aa, Mus musculus
MGLEEEPLRIAKKLEKMVSRKKTEGALDLLKKLNSCQMSIQLLQTTRIGVAVNGVRKHCSDKVLVSLAKVLIKNWKRLLDSPRTTKGEREEREKARREEGLGCSDWKPEAGLSPPRKKGGGEPKTRRDSVDSRSSTTSSPKRPSLERSNSSKSKVETPTTPSSPSTPTFAPAVCLLAPCYLTGDSVRDKCVEMLSAALKAEDNFKDYGVNCDKLASEIEDHIYQELKSTDMKYRNRVRSRISNLKDPRNPGLRRNVLSGAISPELIAKMTAEEMASDELRELRNAMTQEAIREHQMAKTGGTTTDLLRCSKCKKKNCTYNQVQTRSADEPMTTFVLCNECGNRWKFC

SEQ ID NO: 8178 - protein, 352 aa, Mus musculus
MESGSRPSLGQVILLGTSSMVTAVLYSIYRQKAQVAQELKGAKKIHLGEDLKGILSEAPGKCVPYAVIEGAVRSVKETLNSQFVENCKGVIQRLSLQEHKMVWNRTTHLWNDYSKIIHQRTNTVPFDLVPHEDGVAVSVRVLKPLDSVDLGLETVYEKFHPSVQSFTDAIGHYISGERPKGIQETEEMLKVGATLTGIGELVLDNNAFRLQPPKQGMQYYLSSQDFDSLLHRQESSVRLWKILVLVFGFATCATLFFILRKQYLHRQERLRQQQLQEEFLEHEAQLLSQASPEDRESLKSACVVCLSNFKSCVFLECGHVCSCRQCYLALPEPKRCPICRREITRVIPLYNS

SEQ ID NO: 8179 - protein, 304 aa, Mus musculus
MKGKEEKEGGARLGTGGGGTPDKSPSAQELKEQGNRLFVGRKYPEAAACYGRAITRNPLVAVYYTNRALCYLKMQQPEQALADCRRALELDGQSVKAHFFLGQCQLEMESYDEAIANLQRAYSLAKEQRLNFGDDIPSALRIAKKKRWNSIEERRIHQESELHSYLTRLIAAERERELEECQRNHEGHEDDGHIRAQQACIEAKHDKYMADMDELFSQVDEKRKKRDIPDYLCGKISFELMREPCITPSGITYDRKDIEEHLQRVGHFDPVTRSPLTQEQLIPNLAMKEVIDAFISENGWVEDY

SEQ ID NO: 8180 - protein, 335 aa, Mus musculus
MALLGRAFFAGVSRLPCDPGPQRFFSFGTKTLYQSKDAPQSKFFQPVLKPMLPPDAFQGKVAFITGGGTGLGKAMTTFLSTLGAQCVIASRNIDVLKATAEEISSKTGNKVHAIRCDVRDPDMVHNTVLELIKVAGHPDVVINNAAGNFISPSERLTPNGWKTITDIVLNGTAYVTLEIGKQLIKAQKGAAFLAITTIYAESVSGFVMPSSSAKSGVEAMNKSLAAEWGRYGMRFNIIQPGPIKTKGAFSRLDPTGRFEKEMIDRIPCGRLGTMEELANLATFLCSDYASWINGAVIRFDGGEEVFLSGEFNSLKKVTKEEWDIIEGLIRKTKGS

SEQ ID NO: 8181 - protein, 108 aa, Mus musculus
MAAAMDVDTPSGTNSGAGKKRFEVKKWNAVALWAWDIVVDNFAICRNHIMDLCIECQANQASATSEECTVAWGVCNHAFHFHCISRWLKTRQVCPLDNREWEFQKYGH

SEQ ID NO: 8182 - protein, 233 aa, Mus musculus
MGEPQQVSALPPPPMQYIKEYTDENIQEGLAPKPPPPIKDSYMMFGNQFQCDDLIIRPLESQGIERLHPMQFYHKKELRKLNMSILITFLDLLDILIRSPGSIKREEKLEDLKLLFVHVHHLINEYRPHQARETLRVMMEVQKRQRLETAERFQKHLERVIEMIQNCLASLPDDLPHSEAGMRVKAEPMDTDDNSNCPGQNEQQRESSGHRRDQIIEKDAALCVLIDEMNERP

SEQ ID NO: 8183 - protein, 985 aa, Arabidopsis thaliana
MMESRSPICNTCGEEIGAKSNGEFFVACHECSFPICKACLEYEFKEGRRICLRCGNPYDENVFDDVETKTSKTQSIVPTQTNNTSQDSGIHARHISTVSTIDSELNDEYGNPIWKNRVESWKDKKDKKSKKKKKDPKATKAEQQDAQVPTQQHMEDMPPNTESGATDVLSVVIPIPRTKITSYRIVIIMRLIILALFFNYRITHPVDSAYGLWLTSVICEIWFAVSWVLDQFPKWSPINRETYIDRLSARFEREGEQSQLAAVDFFVSTVDPLKEPPLITANTVLSILALDYPVDKVSCYVSDDGAAMLSFESLVETADFARKWVPFCKKYSIEPRAPEFYFSLKIDYLRDKVQPSFVKERRAMKRDYEEFKIRMNALVAKAQKTPEEGWTMQDGTSWPGNNTRDHPGMIQVFLGYSGARDIEGNELPRLVYVSREKRPGYQHHKKAGAENALVRVSAVLTNAPFILNLDCDHYVNNSKAVREAMCFLMDPVVGQDVCFVQFPQRFDGIDKSDRYANRNIVFFDVNMRGLDGIQGPVYVGTGTVFRRQALYGYSPPSKPRILPQSSSSSCCCLTKKKQPQDPAEIYKDAKREELDAAIFNLGDLDNYDEYDRSMLISQTSFEKTFGLSTVFIESTLMENGGVPDSVNPSTLIKEAIHVISCGYEEKTEWGKEIGWIYGSITEDILTGFKMHCRGWRSIYCMPLRPAFKGSAPINLSDRLHQVLRWALGSVEIFLSRHCPLWYGCSGGRLKLLQRLAYINTIVYPFTSLPLVAYCTLPAICLLTGKFIIPTLSNLASMLFLGLFISIILTSVLELRWSGVSIEDLWRNEQFWVIGGVSAHLFAVFQGFLKMLAGLDTNFTVTSKTADDLEFGELYIVKWTTLLIPPTSLLIINLVGVVAGFSDALNKGYEAWGPLFGKVFFAFWVILHLYPFLKGLMGRQNRTPTIVILWSILLASVFSLVWVRINPFVSKTDTTSLSLNCLLIDC

SEQ ID NO: 8184 - protein, 131 aa, Mus musculus
MAAAVAMETDDAGNRLRFQLELEFVQCLANPNYLNFLAQRGYFKDKAFVNYLKYLLYWKEPEYAKYLKYPQCLHMLELLQYEHFRKELVNAQCAKFIDEQQILHWQHYSRKRVRLQQALAEQQQQNNTAGK

SEQ ID NO: 8185 - protein, 327 aa, Mus musculus
MARFAWTRVAPVALVTFWLVLSLSPTDAQVNLSSVDFLDLPALLGVPVDPKRARGYLLVARPADACHAIEGPWPDNHSLDPLVLVRPLGCSWEQTGRRAQRAGATAASVGPEAPGQLREFEDLEVTVRCDQPARVLLPHAEPCPDPECHPVVVASWALARALALAASTLFVLRQLWPWVRGLGSRGTAVKTQTCQKAQVRTFTRLSDLCAICLDDYEEGERLKILPCAHAYHCRCIDPWFSRAAQRSCPLCKQSVASTHDGSTDGSVGGEEPPLPGHRPPIWAIQARLRSRRLELLARTVPCRRCSSTTSLGVAENVAQSEATSELS

SEQ ID NO: 8186 - protein, 242 aa, Mus musculus
MTMKLVAAALCLRLLAAGLWVGLSLTAESIEEGKPGGEKPGGGKPGGSGRGCFLPPLPKEDVSLCRNLEVFYMEMGNISCKIVPKCNLYRQKIPAWQAPIVKFHTALDGALYLLVMVDPDAPSRSNPVMKYWRHWLVSNITGADMKSGSIRGNVLSDYSPPTPPPETGVHRYQFFVYLQGDRDISLSVEEKANLGGWNLDKFLQQYGLRDPDTSTQFMTQFDEELSSEFGRINDDQEQFNQK

SEQ ID NO: 8187 - protein, 234 aa, Mus musculus
MGGGVPVPQFRPVTHLIFDREGFILNTEDLYTDVFEEICNRYGKKYNWDVKSLVMGKKALETAQTIVEFLNLPISKEELLKESQEKLQMVLHTAGFMPGAEELIHHLKKHRLPFALATSSETVTFQTKTSRHTGFFGLFHHIVLGDDPEVKNGKPGMDIFLTCAKRFSPPPDPKDCLVFEDSPNGVEAAIHCGMQVVMVPHENLSADLTRKATQVLSSLHDFKPELFGLPAFTE

SEQ ID NO: 8188 - protein, 375 aa, Mus musculus
MNTLGKTLTCRAAIAWAKNSPLSIEEVQVEPPKSGEVRIKMISSGICGSDDHVLKGELVVNFPLIPGHEGAGIVESVGDGVCSMKPGDKVLILIIPQCRECDACLHPKGNFCYKQDVLPCSGVMLDGTSRFSCRGQKIYHSFRTSSFTEYTVVPEIAAVKIDDAAPMDKVCLISCGFPTGYGGAVNSAKVTPGSTCVVFGLGGVGSAIVMGCKASGASRIIGVDINEEKFPRARALGVTDCLNPNKLEKPVQEVVMEMTGVGVDFAFEAIGLVDTMVAAWNSCNNSYGVCLIAGLAPSDAQLSLEAPKILSGKTLKGVCLGDYKTRDCIPQIVTDYLQNKINIDPLVTYQLPFNQLHEALELFHSGKAIRCVLLF

SEQ ID NO: 8189 - protein, 187 aa, Mus musculus
MAADISQWAGPFCLQEVDEPPQHALRVDYAGVTVDELGKVLTPTQVMNRPSSISWDGLDPGKLYTLVLTDPDAPSRKDPKFREWHHFLVVNMKGNDISSGTVLSDYVGSGPPSGTGLHRYVWLVYEQEQPLSCDEPILSNKSGDNRGKFKVETFRKKYNLGAPVAGTCYQAEWDDYVPKLYEQLSGK

SEQ ID NO: 8190 - protein, 266 aa, Mus musculus
VGKRAWAHGKACRHSSRHSGPRHWLCHIVRVFPPGGRGKKVLIVYAHQEPKSFNGSLKKVAVEELSKQGCTVTVSDLYSMNFEPRATRNDITGAPSNPDVFSYGIETHEAYKKKALTSDIFEEQRKVQEADLVIFQFPLYWFSVPAILKGWMDRVLCRGFAFDIPGFYDSGFLKGKLALLSLTTGGTAEMYTKDGVSGDFRYFLWPLQHGTLHFCGFKVLAPQISFGLDVSSEEERKVMLASWAQRLKSIWKEEPIHCTPPWYFQE

SEQ ID NO: 8191 - protein, 305 aa, Mus musculus
MAEASAAGADAGSAVAAHRFFCHFCKGEVNPKLPEYICPGCDSGFIEEVTDDSSFLGGGGSRTDNSTATHFAELWDHLDHTMFLQDFRPFLSSNPLDQDNRANERGHQTHTDFWGPSRPPRLPMTRRYRSRGSTRPDRSPAIEGIIQQIFAGFFANSAIPGSPHPFSWSGMLHSNPGDYAWGQTGLDAIVTQLLGQLENTGPPPADKEKITSLPTVTVTQEQVNTGLECPVCKEDYTVEEKVRQLPCNHFFHSSCIVPWLELHDTCPVCRKSLNGEDSTRQTQSSEASASNRFSNDSQLHDRWTF

SEQ ID NO: 8192 - protein, 267 aa, Mus musculus
RWGKRPWAQRQSVQASSRHSGPRHWLCHIVRVFPPGGRGKKVLIVYAHQEPKSFNGSLKKVAVEELSKQGCTVTVSDLYSMNFEPRATRNDITGAPSNPDVFSYGIETHEAYKKKALTSDIFEEQRKVQEADLVIFQFPLYWFSVPAILKGWMDRVLCRGFAFDIPGFYDSGFLKGKLALLSLTTGGTAEMYTKDGVSGDFRYFLWPLQHGTLHFCGFKVLAPQISFGLDVSSEEERKVMLASWAQRLKSIWKEEPIHCTPPWYFQE

SEQ ID NO: 8193 - protein, 368 aa, Mus musculus
KEASRAVGQMMSTMFYPLVTFVLLVICIGYWAVTALYLATSGQPQYIYWASNTSTPGCENVPVNMTCDPMAPLNSSCPNLKCVFKGYSTTGLAQRSLFNLQIYGVLGLFWTVNWVLALGQCVLAGAFASFYWAFHKPRDIPTFPLSSAFIRTLRYHTGSLAFGALILSLVQIARVILEYIDHKLRGSQNPVARCIICCFKCCLWCLEKFIKFLNRNAYIMIAIYGKNFCVSAKNAFMLLMRNVLRVVVLDKVTDLLLFFGKLLVVGGVGVLSFFFFSGRIKGLGKDFENPNLNYYWLPIMTSIMGAYVIASGFFSVFGMCVDTLFLCFLEDLERNDGSQERPYYMPKALLKILGKKNEAPTGGKTRKK

SEQ ID NO: 8194 - protein, 103 aa, Mus musculus
MSGRGKGGKGLGKGGAKRHRKVLRDNIQGITKPVIRRLARRGGVKRISGLIYEETRGVLKVFLENVIRDAVTYTEHAKRKTVTAMDVVYALKRQGRTLYGFGG

SEQ ID NO: 8195 - protein, 233 aa, Mus musculus
MGEPQQVSALPPPPMQYIKEYTDENIQEGLAPKPPPPIKDSYMMFGNQFQCDDLIIRPLESQGIERLHPMQFDHKKELRKLNMSILINFLDLLDILIRSPGSIKREEKLEDLKLLFVHVHHLINEYRPHQARETLRVMMEVQKRQRLETAERFQKHLERVIEMIQNCLASLPDDLPHSEAGMRVKAEPMDTDDNSNCPGQNEQQRESSGHRRDQIIEKDAALCVLIDEMNERP

SEQ ID NO: 8196 - protein, 415 aa, Mus musculus
MAENLYRARSRVYSPSVLFLHPDMGIGGAERLVLDAALALQEYGCDVKIWTAHYDPNHCFIETRELSVQCAGDWLPRSLGWGGRGAAICSYVRMVFLALYVLFLSGEEFDVVVCDQVSACIPVFKLARRRKRVLFYCHFPDLLLTQRNSALKKFYRAPIDWIEEYTTGMADRILVNSQYTASVFKETFKTLSHRNPDVLYPSLNIGSFDLAIPEKIDDLVPKGKQFLFLSINRYERKKNLPLALRSLVQLRNRLPSQEWDKVHLFMAGGYDDRIPENVEHYKELKKMVQESDLERYVTFLRSFSDRQKISLLHGCLCVLYTPSNEHFGIVPLEAMYMQCPVIAVNNGGPLESIVHKVTGFLCEPDPVHFSEAMEKFIHKPSLKATMGLAGKARVAEKFSADAFADQLYQYVTKLV

SEQ ID NO: 8197 - protein, 325 aa, Mus musculus
MTASSVLLHTGQKMPLIGLGTWKSEPGQVKAAIKHALSAGYRHIDCASVYGNEAEIGEALKESVGSGKAVPREELFVTSKLWNTKHHPEDVEPALRKTLADLQLEYLDLYLMHWPYAFERGDNPFPKNADGTVRYDSTHYKETWKALEVLVAKGLVKALGLSNFNSRQIDDVLSVASVRPAVLQVECHPYLAQNELIAHCHARGLEVTAYSPLGSSDRAWRHPDEPVLLEEPVVLALAEKHGRSPAQILLRWQVQRKVICIPKSINPSRILQNIQVFDFTFSPEEMKQLDALNKNWRYIVPMITVDGKRVPRDAGHPLYPFNDPY

SEQ ID NO: 8198 - protein, 248 aa, Mus musculus
MSGPVPSRARVYTDVNTHRPREYWDYESHVVEWGNQDDYQLVRKLGRGKYSEVFEAINITNNEKVVVKILKPVKKKKIKREIKILENLRGGPNIITLADIVKDPVSRTPALVFEHVNNTDFKQLYQTLTDYDIRFYMYEILKALDYCHSMGIMHRDVKPHNVMIDHEHRKLRLIDWGLAEFYHPGQEYNVRVASRYFKGPELLVDYQMYDYSLDMWSLGCMLASMIFRKEPFFHGHDNYDQVMTCFSH

SEQ ID NO: 8199 - protein, 103 aa, Mus musculus
MSGRGKGGKGLGKGGAKRHRKVLRDNIQGITKPAIRRLARRGGVKRISGLIYEETRGVLKVFLENVIRDAVTYTEHAKRETVTAMDVVYALKRQGRTLYGFGG

SEQ ID NO: 8200 - protein, 325 aa, Mus musculus
MTASSVLLHTGQKMPLIGLGTWKSEPGQVKAAIKHALSAGYRHIDCASVYGNETEIGEALKESVGSGKAVPREELFVTSKLWNTKHHPEDVEPAIRKTLADLQLEYLDLYLMHWPYAFERGDNPFPKNADGTVRYDSTHYKETWKALEVLVAKGLVKALGLSNFNSRQIDDVLSVASVRPAVLQVECHPYLAQNELIAHCHARGLEVTAYSPLGSSDRAWRHPDEPVLLEEPVVLALAEKHGRSPAQILLRWQVQRKVICIPKSINPSRILQNIQVFDFTFSPEEMKQLDALNKNWRYIVPMITVDGKRVPRDAGHPLYPFNDPY

SEQ ID NO: 8201 - protein, 169 aa, Mus musculus
MNDHEDTNGSKESFREQDIYLPIANVARIMKNAIPQTGKIAKDAKECVQECVSEFISFITSEASERCHQEKRKTINGEDILFAMSTLGFDSYVEPLKLYLQKFREAMKGEKGIGGAVSATDGLSEELTEEAFTNQLPAGLITADGQQQNVMVYTTSYQHISGVQQIQFS

SEQ ID NO: 8202 - protein, 300 aa, Mus musculus
LSWACSQEVWQNMLQKENRYVHDKHFQVLHSDLEPQMRSILLDWLLEVCEVYTLHRETFYLAQDFFDRFMLTQKDVNKNMLQLIGITSLFIASKLEEIYAPKLQEFAYVTDGACSEVDILKMELNILKALKWELCPVTVISWLNLFLQVDAVKDVPKVLLPQYSQETFIQIAQLLDLCILAIDSLEFQNRILAAAALCHFTSIEVVKKASGLEWDDISECVDWMVPFVSVVKSVSPVKLKTFKKIPMEDRHNIQTHTNYLALLNEVNYVNIYRKGGQLSPVCNGGIMTPPKSTEKPPGKH

SEQ ID NO: 8203 - protein, 325 aa, Mus musculus
MTASSVLLHTGQKMPLIGLGTWKSEPGQVKAAIKHALSAGYRHIDCASVYGNETEIGEALKESVGSGKAVPREELFVTSKLWNTKHHPEDVEPALRKTLADLQLEYLDLYLMHWPYAFELGDNPFPKNADGTVRYDSTHYKETWKALEVLVAKGLVKALGLSNFNSRQIDDVLSVASVRPAVLQVECHPYLAQNELIAHCHARGLEVTAYSPLGSSDRAWRHPDEPVLLEEPVVLALAEKHGRSPAQILLRWQVQRKVICIPKSINPSRILQNIQVFDFTFSPEEMKQLDALNKNWRYIVPMITVDGKRVPRDAGHPLYPFNDPY

SEQ ID NO: 8204 - protein, 325 aa, Mus musculus
MTASSVLLHTGQKMPLIGLGTWKSEPGQVKAAIKHALSAGYRHIDCASVYGNETEIGEAPKESVGSGKAVPREELFVTSKLWNTKHHPEDVEPALRKTLADLQLEYLDLYLMHWPYAFERGDNPFPKNADGTVRYDSTHYKETWKALEVLVAKGLVKALGLSNFNSRQIDDVLSVASVRPAVLQVECHPYLAQNELIAHCHARGLEVTAYSPLGSSDRAWRHPDEPVLLEEPVVLALAEKHGRSPAQILLRWQVQRKVICIPKSINPSRILQNIQVFDFTFSPEEMKQLDALNKNWRYIVPMITVDGKRVPRDAGHPLYPFNDPY

SEQ ID NO: 8205 - protein, 233 aa, Mus musculus
MGEPQQVSALPPPPMQYIKEYTDENIQEGLAPKPPPPIKDSYMMFGNQFQCDDLIIRPLESQGIERLHPMQFDHKKELRKLNMSILINFLNLLDILIRSPGSINREEKLEDLKLLFVHVHHLINEYRPHQARETLRVMMEVQKRQRLETAERFQKHLERVIEMIQNCLASLPDDLPHSEAGMRVKAEPMDTDDNSNCPGQNEQQRESSGHRRDQIIEKDAALCVLIDEMNERP

SEQ ID NO: 8206 - protein, 398 aa, Mus musculus
MALLRRPTVSSDLKNIDTEVIPKAKSHVTIRRAVLEEIGNKVRNRTTQVAKKPQNTKVPALPNKVTNVNKQPKPTASVKPVQMEALLPRIVLPPPEDVSMKEESLCQAFSDALLCKIEDIDNEDRENPQLCSDYVKDIYQYLRQLEVLQSINPHFLDGRDINGRMRAILVDWLVQVHSKFRLLQETLYMCIAIMDRFLQAQLVCRKKLQLVGITALLLAPKYEEMFSPNIEDFVYITDNAYTSSQIREMETLILKELKFELGRPLPLHFLRRASKAGEVDVEQHTLAKYLMELTLVDYDMVHYHPSQVAAAASCLSQKVLGQGKWNLKQQYYTGYMESEVLEVMQHMAKNVVKVNDNRTKFIAVKNKYASSRLLKISTIPQLNSKIIKDLASPLLGSP

SEQ ID NO: 8207 - protein, 221 aa, Mus musculus
MEAGGVADSFLSSACVLFTLGMFSTGLSDLRHMQRTRSVDNIQFLPFLTTDVNNLSWLSYGVLKGDGTLIIVNSVGAVLQTLYILAYLHYSPQKHGVLLQTATLLAVLLLGYGYFWLLVPDLEARLQQLGLFCSVFTISMYLSPLADLAKIVQTKSTQRLSFSLTIATLFCSASWSIYGFRLRDPYITVPNLPGILTSLIRLGLFCKYPPEQDRKYRLLQT

SEQ ID NO: 8208 - protein, 627 aa, Mus musculus
MALARDAKLESDTLQVLQDVANRLRIHSIRATCACSSGHPTSCCSVAEIMAVLFFHTMRYKQADPEHPDNDRFVLSKGHAAPILYAVWVEVGRICESDLLNLRKIHCDLEGHPTPRLSFVDVATGSLGQGLGAACGMAYTGKYFDKASYRVFCLMGDGESSEGSVWEALAFASHYNLDNLVAIFDVNRLGQSGTAPLEHCTAVYEKRCQAFGWNTYVVDGHDVEALCQAFWKAAQVKNKPTALIAKTFKGRGIPNVEDAENWHGKPMPKDRADGIVKLIENRIQTNRNLTPKPPIEDSPRISMSNTKMTSLPVYKLGDMIATREAYGLALAKLGQSNQRVIVLDGDTKNSTFSEVFKKEHPERFIECFIAEQNMVSVALGCATRGRTIAFVSTFAAFLTRAFDQIRMGAISQTNINFVGSHCGVSVGEDGPSQMALEDLAMFRSIPNCTVFYPSDAVSTEHAVYLAANTKGMCFIRTTRPKTAVIYTAEENFVIGQAKVIRQSAVDKVTVIGAGVTLHEALVAAEELSQQGIFIRVIDLFTIKPLDAVTIIQSAKATGGQIITVEDHYREGGIGEAVCAAISREPDIVVRQLAVTEVPRSGKPSELLDMFGISARHIIAAVKDTVMK

SEQ ID NO: 8209 - protein, 316 aa, Mus musculus
MLLCVSCLSVNGEMNPLGPTPSVHRSVSFWLLRLSVFLLLSLRDSKGKAIWTAHLNITFQVGNRIISELGESGVFGNHSPLERVSGAVVLPEGWNQNACSPLTNFSRPDQTDTWLALIERGGCTFTHKINLAAEKGANGVIIYNYPGTGNKVFPMSHQGTENIVAVMIGNLKGMELLHLIQQGVYVTIIIEVGRMHMPWLSHYVMSLFTFLAATVTYLFLYCAWRPRVSNSSTRRQRQLKADVKKAIGQLQLRVLQDEDKELDPNEDSCVVCFDMYKAQDVIRILTCKHFFHKTCIDPWLLAHRTCPMCKCDILKP

SEQ ID NO: 8210 - protein, 479 aa, Mus musculus
  unsure (1)..(479): unsure at all Xaa locations
FLLPLSLIFDIYYYVRAWVVFKLTNAPRLHNXPLRDIQKQVREWKEQGSKTFMCTGPPGWLTVSLRVGKYKKTHKNIMINLMDILEVDTKKQIVRVEPLVSMGQVTALLNSIGWTLPVLPELDDLTVGGLIMGTGIESSSHKYGLFQHICTAYELILADGSFVRCTPSENSDLFYAVPWSCGTLGFLVAAEIRIIPAKKYVKLRFEPVRGLEAICEKFTRESQRLENHFVEGLLYSLDEAVIMTGVMTDDVEPSKLNSIGSYYKPWFFKHVENYLKTNREGLEYIPLRHYYHRHTRSIFWELQDIIPFGNNPIFRYLFGWMVPPKISLLKLTQGETLRKLYEQHHVVQDMLVPMKCMSQALHTFQNDIHVYPIWLCPFILPSQPGLVHPKGDEAELYVDIGAYGEPRVKHFEARSCMRQLEKFVRSVHGFQMLYADCYMNREEFWEMFDGSLYHKLRKQLGCQDAFPEVYDKICKAARH

SEQ ID NO: 8211 - protein, 259 aa, Mus musculus
MLRERESKEPAMNPFQKNESKETLFSPVSTEEMLPGPPSPPKKSTPKLFGSSYPLSIAFIVVNEFCERFSYYGMKAVLTLYFLYFLHWNEDTSTSVYHAFSSLCYFTPILGAAIADSWLGKFKTIIYLSLVYVLGHVFKSLGAIPILGGKMLHTILSLVGLSLIALGTGGIKPCVAAFGGDQFEEEHAEARTRYFSVFYLSINAGSLISTFITPMLRGDVKRFGEDCYALAFGIPGLLMVLALGEWSGKGCEQPLIPAT

SEQ ID NO: 8212 - protein, 428 aa, Mus musculus
MGPPPGIGVYCRGGCGAARLLAWCFLLALSPHAPGSRGAEAVWTAYLNVSWRVPHTGVNRTVWELSEEGVYGQDSPLEPVSGVLVPPDGPGALNACNPHTNFTVPTVWGSTVQVSWLALIQRGGGCTFADKIHLASERGASGAVIFNFPGTRNEVIPMSHPGAGDIVAIMIGNLKGTKILQSIQRGIQVTMVIEVGKKHGPWVNHYSIFFVSVSFFIITAATVGYFIFYSARRLRNARAQSRKQRQLKADAKKAIGKLQLRTLKQGDKEIGPDGDSCAVCIELYKPNDLVRILTCNHIFHKTCVDPWLLEHRTCPMCKCDILKALGIEVDVEDGSVSLQVPVSNEASNTASPHEEDSRSETASSGYASVQGADEPPLEEHAQSANENLQLVNHEANSVAVDVVPHVDNPTFEEDETPDQEAAVREIKS

SEQ ID NO: 8213 - protein, 305 aa, Mus musculus
MENSQLCKLFIGGLNVQTSESGLRGHFEAFGTLTDCVVVVNPQTKRSRCFGFVTYSNVEEADAAMAASPHAVDGNTVELKRAVSREDSARPGAHAKVKKLFVGGLKGDVAEGDLIEHFSQFGAVEKAEIIADKQSGKKRGFGFVYFQSHDAADKAAVVKFHPIQGHRVEVKKAVPKEDIHAGGGGARAARGGRGGGRGRGGGGGGGGRDQNGLAKGGGGGGGGYNSYGGYGGYGAYGGGGGGGGSYGGSDYGNGFGGFGSYSQHQSSYGPMKSGGGGGGGGSWGGRSNSGPYRGGYGGGYGGGSF

SEQ ID NO: 8214 - protein, 474 aa, Mus musculus
MPGTALSPLLVLLLLSWASRNEAAPDQDEIDCLPGLAKQPSFRQYSGYLRASDSKHFHYWFVESQNDPKNSPVVLWLNGGPGCSSLDGLLTEHGPFLIQPDGVTLEYNPYAWNLIANVLYIESPAGVGFSYSDDKMYVTNDTEVAENNYEALKDFFRLFPEYKDNKLFLTGESYAGIYIPTLAVLVMQDPSMNLQGLAVGNGLASYEQNDNSLVYFAYYHGLLGNRLWTSLQTHCCAQNKCNFYDNKDPECVNNLLEVSRIVGKSGLNIYNLYAPCAGGVPGRHRYEDTLVVQDFGNIFTRLPLKRRFPEALMRSGDKVRLDPPCTNTTAPSNYLNNPYVRKALHIPESLPRWDMCNFLVNLQYRRLYQSMNSQYLKLLSSQKYQILLYNGDVDMACNFMGDEWFVDSLNQKMEVQRRPWLVDYGESGEQVAGFVKECSHITFLTIKGAGHMVPTDKPRAAFTMFSRFLNKEPY

SEQ ID NO: 8215 - protein, 254 aa, Mus musculus
MAAAEAANCIMEVSCGQAESSEKPNAEDMTSKDYYFDSYAHFGIHEEMLKDEVRTLTYRNSMFHNRHLFKDKVVLDVGSGTGILCMFAAKAGARKVIGIECSSISDYAVKIVKANKLDHVVTIIKGKVEEVELPVEEVDIYTVKVEDLTFTSPFCLQVKRNDYVHALVAYFNIEFTRCHKRTGFSTSPESPYTHWKQTVFYMEDYLTVKTGEEIFGTIGMRPNAKNNRDLDFTIDLDFKGQLCELSCSTDYRMR

SEQ ID NO: 8216 - protein, 178 aa, Mus musculus
IWRGPKKNGMIKQFLRDVDWGDVDYLIVDTPPGTSDEHLSVVQYLAAAHIDGAVILTTPQEVALQDVRKEISFCHKVKLPIIGVVENMSGFISPKCKKESQIFPPTTGGAEAMCQDLRIPLLGKVPLDPHIGKSCDKGQSFFVEAPDSPATAAYRSIIQRIRDFCNSHQSHAETLISP

SEQ ID NO: 8217 - protein, 188 aa, Mus musculus
MEEAPHGCPGADSAQAGRGASCQGCPNQRLCASGAGAAPDPAVEEIREKMKTVRHKLLVLSGKGGVGKSTFSAHLAHGLAEDGDTQVALLDIDICGPSIPKIMGLEGEQVHQSGSGWSPVYVDDNLGVMSVGFLLSSPDDAVIWRGPKKNGLSLLPGSDSWFWLLGRLWVPDGLGGVFMLLFWSWGGA

SEQ ID NO: 8218 - protein, 563 aa, Cyprinus carpio
MDIGGLTTVVANSAYISARGSFDGTANPAANRDKKYHAKLKLPHITVCEGLRETLDLQFKSICVEQPIGKRLFQEFLETTNEYKGPCRLWKDIETYDTAEDKDRAQKAAKILQRYMEPSAKHFCPFLPENDITKVKERHEEAADDLFVQIQASVFDFLKEVPFTFYLETMYFKRFLQWKWLEMQPVAEDWFLDFRVLGKGGFGEVSACQMKATGKLYACKKLNKKRLKKRKGYEGAMVEKRILARVHSRFIVSLAYAFQTKTELCLVMTIMNGGDLRYHIYNVDENNPGFSEARACYYAAQIIQGLEHLHQKRIIYRDLKPENVLLDNEGHVRISDLGLAVELADDQLKTKGYAGTPGFMAPELLKGEEYDYSVDYFTLGVTLYEFIAAKGPFRTRGEKVENKEVKKRILNDPVTYPESFSEKAKSVCEGLLAKEVDKRLGFKNGSCDELRTHPFFSEINWRKLDAGILPPPFVPDSKTVYAKNLDDVGAFSTVKGVCLEDDDKTFYDEFASGNISIPWQEEMIETGIYGELNVWGPNGTVPNDLRRESILEQPPKSSTCSIS

SEQ ID NO: 8219 - protein, 379 aa, Arabidopsis thaliana
MSTTGQIIRCKAAVAWEAGKPLVIEEVEVAPPQKHEVRIKILFTSLCHTDLYFWEAKGQTPLFPRIFGHEAGGIVESVGEGVTDLQPGDHVLPIFTGECGECRHCHSEESNMCDLLRINTERGGMIHDGESRFSINGKPIYHFLGTSTFSEYTVVHSGQVAKINPDAPLDKVCIVSCGLSTGLGATLNVAKPKKGQTVAIFGLGAVGLGAAEGARIAGASRIIGVDFNSKRFDQAKEFGVTECVNPKDHDKPIQQVIAEMTDGGVDRSVECTGSVQAMIQAFECVHDGWGVAVLVGVPSKDDAFKTHPMNFLNERTLKGTFFGNYKPKTDIPGVVEKYMNKELELEKFITHTVPFSEINKAFDYMLKGESIRCIITMGA

SEQ ID NO: 8220 - protein, 379 aa, Arabidopsis thaliana
MSTTGQIIRCKAAVAWEAGKPLVIEEVEVAPPQKHEVRIKILFTSLCHTDLYFWEAKGQTPLFPRIFGHEAGGIVESVGEGVTDLQPGDHVLPIFTGECGECRHCHSEESNMCDLLRINTERGGMIHDGESRFSINGKPIYHFLGTSTFSEYTVVHSGQVAKINPDAPLDKVCIVSCGLSTGLGATLNVAKPKKGQSVAIFGLGAVGLGAAEGARIVGASRIIGVDFNSKRFDQAKEFGVTECVNPKDHDKPIQQVIAEMTDGGVDRSVECTGSVQAMIQAFECVHDGWGVAVLVGVPSKDDAFKTHPMNFLNERTLKGTFFGNYKPKTDIPGVVEKYMNKELELEKFITHTVPFSEINKAFDYMLKGESIRCIITMGA

SEQ ID NO: 8221 - protein, 589 aa, Colletotrichum lagenarium
MRYNLIRSAFQAGLVLASLSSAKPLRSLNTRTNDTSCGTHGPTNRACWNGDININSDYETSIPSTGQTRVYDFTITNVTDFAADGISKPAMLINGQFPGPTIEADWGDWVEINVHNQLADNGTSIHWHGMHQRNSNDQDGANGVTECPIAPGHSKTYKFQMIQYGTSWYHSHFSSQYGNGVVGAIKINGPASADYDIDLGPYTVSDWYYDTADRLERQAELVANGPPPDSDNVLFNGTNINAQGGGQYSKTKLTPGKKHLLRLINPSVDNTFTVSLVGHSFTVIATDLVPVKPVVKDSLFISVGQRYDVIIEADKDVGNYWFNATLASSGLCGTSNAKFPASIFTYEGAADELPTEQGVVPAADCVDTTGFSPVLARHAPEAEFTPNKNILDVSLEQPEIHGEKIYRWRVNGSSMDVQWDKPTLQYIAEGNDSWPHQANVVDLSGADVWTWWVIENTGALPHPIHLHGHDFLLLGIGDGKFSNSSSTNGTGPYSSVKYPSLNFANPTRRDVAQLPGNGWMVIAFRTDNPGAWLMHCHIAWHVSMGLSVQFIERKDEITSALKLETLDQTCQTWKDYAHAAFYPKYDSGL

SEQ ID NO: 8222 - protein, 359 aa, Homo sapiens [sequence omitted]

SEQ ID NO: 8223 - protein, 501 aa, Oryza sativa (japonica cultivar-group); identical to SEQ ID NO: 1150

SEQ ID NO: 8224 - protein, 498 aa, Brevibacterium flavum
MESSMVENNVAKKTVAKKTARKTARKAAPRVATPLGVASESPISATPARSIDGTSTPVEAADTIETTAPAAKAPAAKAPAKKVAKKTARKAPAKKTVAKKATTAKAAPATAKDENAPVDDDEENLAQDEQDFDGDDFVDGIEDEEDEDGVEALGEESEDDEEDGSSVWDEDESATLRQARKDAELTASADSVRAYLKQIGKVALLNAEQEVSLAKRIEAGLYATHRMEEMEEAFAAGDKDAKLTPAVRRDLRAIARDGRKAKNHLLEANLRLVVSLAKRYTGRGMAFLDLIQEGNLGLIRAVEKFDYSKGYKFSTYATWWIRQAITRAMADQARTIRIPVHMVEVINKLGRIQRELLQELGREPTPQELSKEMDISEEKVLEIQQYAREPISLDQTIGDEGDSQLGDFIEDSEAVVAVDAVSFTLLQDQLQDVLETLSEREAGVVKLRFGLTDGMPRTLDEIGQVYGVTRERIRQIESKTMSKLRHPSRSQVLRDYLD

SEQ ID NO: 8225 - protein, 331 aa, Brevibacterium flavum
MTAPSTQDLATTEREVDPGSRRGQTNDNPSQDLVRVYLNGIGKTALLTAEDEVELAQTIEVGLYAEHLLKNSEEPLTRAMKRDLKVLAKDGKKARSHLLEANLRLVVSLAKRYTGRGMPLLDLIQEGNLGLIRAMEKFDYSKGFKFSTYATWWIRQAITRGMADQSRTIRLPVHLVEQVNKLSRIKREMYQHLGREATNEELAEESGIEESKIEMLLRQSRDPVSLDMPVGADEEAPLGDFIEDSEATDAESAVVASMRHSDIRAVLNTLEPREQDVIRLRYGLDDGVPRTLDQIGRRFGLSRERVRQIEREVMSKLRDGERASRLREYAQ

SEQ ID NO: 8226 - protein, 327 aa, Vibrio harveyi
MSISNTVTKVEEFEYDNAQSEGISNGLEKPSNGTKTAAREEFDASSKSLDATQLYLGEIGFSPLLTAEEEVLYARRALRGDEAARKRMIESNLRLVVKISRRYSNRGLALLDLIEEGNLGLIRAVEKFDPERGFRFSTYATWWIRQTIERALMNQTRTIRLPIHVVKELNIYLRTARELSQKLDHEPTAEEIAAQLDIPVEDVSKMLRLNERISSVDTPIGGDGEKALLDIIPDANNSDPEVSTQDDDIKSSLIHWLEELNPKQKEVLARRFGLLGYEPSTLEEVGREIGLTRERVRQIQVEGLRRLREILIKQGLNMENLFNVEDD

SEQ ID NO: 8227 - protein, 422 aa, Triticum aestivum; identical to SEQ ID NO: 5125

SEQ ID NO: 8228 - protein, 422 aa, Triticum aestivum; identical to SEQ ID NO: 4637

SEQ ID NO: 8229 - protein, 482 aa, Oncorhynchus mykiss
  unsure (1)..(482): unsure at all Xaa locations
MESGKQLTGTLTLAVFSAVLGSLQYGYSLGVINAPQKVIEQHYGRSLGVLPEEPLLLSENGTGTEKQEVHPSVVMYWSLSVSIFSIGGVVSSFLVGFVGDLRGRVKGMLMVNVLAVIAGLLMVMAKMWKPHVMVIAGRCVMGFYCGLSSGLVPMYIGEIAPMAYRGALGTLHQLATVTGILLSQVLGLEFLLGNDYYWPLLLGLSGAPAVLQSLLLPLCPESPRXLYIKRGMXEEAKNSLRRLKGEYDPSADLEEMRREKEEVEKEAQVSIAVLVRSSLYRQQLFVALMMHLSQQLSGINAIFYYSTAIFERAGVTQPVYATIGVGVLNTVFTMVSVALVDRAGRRTLTLIGLGGMCICAIAMTVGLVYLRVYSWMSYVSMSAIFLFVCFFEIGPGPIPWFIVAELFSQGPQAAAIALAGCTNWTSNFIIGMTFPYIEALCGSYVFILFAVLLFGFTVFTYLRVPETKGKTFEEIAAVFKRE

SEQ ID NO: 8230 - protein, 139 aa, Solanum tuberosum
NSEKIGEGTYGVVYKARDRVTNETIALKKIRLEQEDEGVPSTAIREISLLKEMQHGNIVRLQDVVHSEKRLYLVFEYLDLDLKKHMDSCPEFSKDPRLVKMFLYQILRGIAYCHSHRVLHRDLKPQNLLIDRRTNVLKL

SEQ ID NO: 8231 - protein, 169 aa, Haloferax volcanii
GTVVYRGSFDGRDVAVKRMLVESYDIASHEVGLLQESDDHNNVIRYYCREQAAGFFYIALELCPASLQDVVERPTAFPQLVNGGLDMPDVLRQIVAGVRYLHSLKIVHRDLKPQNILVAAPRGRTGSRSIRLLISDFGLCKKLEDNQSSFRATTAHAAGTSGWRAPELL

SEQ ID NO: 8232 - protein, 707 aa, Mus musculus
MGRKQNENEAHGNSAKYDPSFRGPIKNRGCTDIICCVLFLIFILGYIIVGLVAWVYGDPRQVLYPRNSTGAYCGVGDNKDKPYVLYFDILSCAAAINIISIAENGLQCPTPQVCVSSCPLAPWAVEVFQFSKTVGEVYGERRNFCLPAVSPDMIVEESLQKGLCPRFLLPSTPALGRCFPLPNINFTLPEDLRINNTTVSNGISGLLDSINARDVSVKIFEDFAQSWYWILVALGVALALSLLFILLLRLVAAPLVLLLIVGVLAVLAYGIYHCWQQYQVFRDKGASITQLGFTTNFSAYQSVKETWLAALIVLAVLEGILLLMLIFLRQRIRIAIALLKEASRAVGQMMSTMFYPLVTFVLLVICIGYWAVTALYLATSGQPQYIYWASNTSTPGCENVPVNMTCDPMAPLNSSCPNLKCVFKGYSTTGLAQRSLFNLQIYGVLGLFWTVNWVLALGQCVLAGAFASFYWAFHKPRDIPTFPLSSAFIRTLRYHTGSLAFGALILSLVQIARVILEYIDHKLRGSQNPVARCIICCFKCCLWCLEKFIKFLNRNAYIMIAIYGKNFCVSAKNAFMLLMRNVLRVVVLDKVTDLLLFFGKLLVVGGVGVLSFFFFSGRIKGLGKDFENPNLNYYWLPIMTSIMGAYVIASGFFSVFGMCVDTLFLCFLEDLERNDGSQERPYYMPKALLKILGKKNEAPTGGKTRKK

SEQ ID NO: 8233 - protein, 152 aa, Lycopersicon esculentum
MSSFSEEQEALVVKSWGSMKKDAGEWGLKFFLKIFEIAPSAKKMFSFLKDSNVPLDQNPKLKIHAKSVLVMTCEAAVQLRKAGKVVVRDSTLKKIGATHFKYGVVDEHFEVTKYALLETIKEASQEMWSVEMKNAWGEAYDQLVSAIKTEMK

SEQ ID NO: 8234 - protein, 320 aa, Persea americana
MDSFPVINMEKLEGQERAATMKLINDACENWGFFELVNHSIPVELMDEVERLTKEHYKKCMEQRFKELMASKVEGAVVDANDMDWESTFFIRHLPVSNLSEIPDLTDEHRKVMKEFAEKLEKLAEQVLDLLCENLGLEKGYLKMAFAGTTTGLPTFGTKVSNYPPCPRPELFKGLRAHTDAGGLILLFQDDRVAGLQLLKDGEWVDVPPMNHSIVINLGDQVEVITNGKYKSVMHRVVAQTDGNRMSLASFYNPGSDAVIFPAPALVEKEAEEKKEVYPKFVFEDYMNLYAGLKFQAKEPRFEVMKMKAVETANLSPITT

SEQ ID NO: 8235 - protein, 150 aa, Porphyromonas gingivalis
MTAPTFATDDIRYMRIALEEARAAADEGEIPIGAVIVCKGQIVARAHNRVERLNDPTAHAEMLAITMAVDAIGGKYLRDCTLYVTVEPCLMCAGALRWTQIPRVVYGASEPKVGYRLFTDHALHPKCLVEGGILADESENLMRSFFAERR

SEQ ID NO: 8236 - protein, 396 aa, Musca domestica
MFKENEINFYENEIDLKQVIAGQNLQSADEALFVCDLTRLKEKYDMWTKYMPRVKPYYAVKCNDDGHIVKTLAELGTNFDCASKGEIKQVLDLGVHPDRIIFAQPCKPISHLEYAKEMGVMTSTVDTEFEIHKLHKHFPESNLVIRFRCEAKEAQCPLGDKFGCDAENEATSLMLLAKSLNLKVIGTSFHVGSGCNDLPAYDRAITIAKNLFKFGALLGYEMNLLDIGGGFPGSDNKKFEKIAEIVNKSLMRHFPDDKVNIIAEPGRFFVASAYTLICKIHAKGEARLPNGKLLTKMYYLNDGVYGSFNCILYDHQHAEVQHFVDEENAEVPKFNSLIWGPTCDALDKIAEDLQLPDLKCGDFLAFPNMGAYTIPIASPFNGFMLPKILYFHKAKI

SEQ ID NO: 8237 - protein, 379 aa, Gossypium hirsutum
MSTAGQVIRCRAAVAWESGKPLSIEEVEVAPPQKDEVRIKILFTSLCHTDVYFWDAKGQNPLFPRILGHEAGGIVESVGEGVTDLKPGDHVLPIFTGECKECPHCLSEESNMCDLLRINTDRGEMINDGKSRFSINGKPIYHFLGTSTFSEYTVVHVGQVAKINPEAPLDKVCVLSCGMSTGFGATVNVAKPKKGQSVAIFGLGAVGLAAAEGARVSGASRIIGVDLNPSRFEQAKKFGVTEFVNPKDYNKPVQEAIVEMTGGGVDRSVECTGSIQAMISAFECVHDGWGVAVLVGVPNKDDAFKTHPVNLLNEKTVKGTFFGNYKPRSDIPAVVEKYMNKELELDKFITHTVPFSEINKAFELMLAGEGLRCVIRMDE

SEQ ID NO: 8238 - protein, 158 aa, Gossypium hirsutum
IIGIDLNPSRFEQAKKFGVTEFVNPKDYNKPVQEVIVEMTGGGVDRTVQCTGSIQAMISAFECVHDGWGVAVLVGVPNKDDAFKTHPVNLLNERTLKGTFFGNYKPRSDIPAVVEKYMNKELELDKFITHTVPFSEINKAFELMLAGEGLRCCIRMDA

SEQ ID NO: 8239 - protein, 323 aa, Bos taurus
MDPKSQRVKLNDGHFIPVLGFGTYAPEEVPKSEALEATKFAIEVGFRHVDSAHLYQNEEQVGQAIRSKIADGTVKREDIFYTSKLWCNSLQPELVRPALEKSLQNLQLDYVDLYIIHSPVSLKPGNKFVPKDESGKLIFDSVDLCHTWEALEKCKDAGLTKSIGVSNFNHKQLEKILNKPGLKYKPVCNQVECHPYLNQSKLLEFCKSHDIVLVAYAALGAQLLSEWVNSNNPVLLEDPVLCAIAKKHKQTPALVALRYQVQRGVVVLAKSFNKKRIKENMQVFDFELTPEDMKAIDGLNRNIRYYDFQKGIGHPEYPFSEEY

SEQ ID NO: 8240 - protein, 241 aa, Zoogloea ramigera
MSRVALVTGGSRGIGAAISIALKAAGYKVAASYAGNDDAAKPFKAETGIAVYKWDVSSYEACVEGIAKVEADLGPIDVLVNNAGITKDAMFHKMTPDQWNAVINTNLTGLFNMTHPVWSGMRDRSFGRIVNISSINGQKGQMGQANYSAAKAGDLGFTKALAQEGAAKGITVNAICPGYIGTEMVRAIPEKVLNERIIPQIPVGRLGEPDEIARIVVFLASDEAGFITGSTISANGGQFFV

SEQ ID NO: 8241 - protein, 242 aa, Methylobacterium extorquens
MAQERVALVTGGTRGIGAAISKRLKDKGYKVAANYGGNDEAANAFKAETGIPVFKFDVGDLASCEAGIKAIEAELGPIDILVNNAGITRDGAFHKMTFEKWQAVIRTNLDSMFTCTRPLIEGMRSRNFGRIIIISSINGQKGQAGQTNYSAAKAGVIGFAKALAQESASKGVTVNVVAPGYIATEMVMAVPEDIRNKIISTIPTGRLGEADEIAHAVEYLASDEAGFVNGSTLTINGGQHFV

SEQ ID NO: 8242 - protein, 69 aa, Brucella melitensis biovar Abortus
MSRPSTPLLDKAPTPDRLRALPEQDLPQLAEELRTELIDAVSTTGGHLGAGLGRCGIDGCVASCFQHTL

SEQ ID NO: 8243 - protein, 319 aa, Lycopersicon hirsutum
MGSKYSKATNSINDALSSSYLVPFESYRVPLVDLEEATNNFDDKFFIGAGVFGKVYKGVLRDGTKVALKRRKPESSQGIEEFETEIEILSFCSHPHLVSLIGFCDERNEMILIYKYMENGNLKSHLYGSDLPSMSWEQRLEICIGAARGLYYLHTRAVIHRDVKSINILLDENFVPKITDFGISKKGTELDQTHLSTVVQGTLGYLDPEYFIKGRLTEKSDVYSFGVVLFEVLCARSAIVQSLPREMVNLAEWAVESHNNGQLEQIIDPNLADKITPESLRKFGETAVKCLALSSEDRPSMGDVLWKLEYALRLQESVI

SEQ ID NO: 8244 - protein, 314 aa, Lycopersicon hirsutum
MGSKYSKATNSISDASNSFESYRFPLVDLEEATNNFDDKFVIGESGFGKVYRGVLRDGTKVALKRHNRDSRESIEEFETEIEILPRRSHPHLVSLIGYCDDRNEMILIYDYMENGNLKSHLTGSDLPSMSWEQRLEICIGAARGLLYLHTNGVIHRDVKSTNILLDENFVPKITDFGLSKKGPQLYQTHVSTNVKGTFGYMDPEYVIRQKLTEKSDVYSFGVVLFEVFCARSTIDPYLRREIVTLAEWAVKSHNNGQLEQIVDPNLAAKIRPESLRKFGETAVKCLALSGKDRPSMGDVLWKLEYALCLQESVI

SEQ ID NO: 8245 - protein, 320 aa, Lycopersicon hirsutum
MGSKYSKATNSINDASNLSYGVPFENYRVPFVDLDEATNNFDDKFFIGEGGFGKVYRGVLRDGTKVALKRHNHDSRQSIKEFETEIEILSFCSHPHLVSLIGFCDERNEMILIYDYMENGNLKSHLYGSDLPTMSMSWEQRLEICIGAARGLHYLHTNGVIHRDVKSSNILLDENFVPKITDFGISKTMSELDQTHLSTAVKGNIGYIAPEYALWGQLTEKSDVYSFGVVLLEVLCARPALDLSEMMSLGDETQTMGQLEQIVDPTIAAKIRPESLRMFGETAIKCIAPSSKNRPSMGDVLWKLEYALCLQEPTIQDDPE

SEQ ID NO: 8246 - protein, 323 aa, Lycopersicon hirsutum
MGTNYSKPTTSINDASNLRNRVPFESFRVPFVDLQEATNNFDDKFLIGVGIFGKVYRGVLRDGTKVALKRRKPESPQGFEEFRTEIEILSHCSHPHLVSLIGYCDERNEMILIYDYMENGNLSKRLYGSDLCLPTMSWEQRLEICIGAARGLHYLHNSAVIHRDVKSTNILLDENFVAKITDFGISKTMPEFDQTHLSTMVQGSIGYIDPEYFIRRQLTKKSDVYSFGVVLFEVLCARPAISRSHMISLAEWAVETQKMGQLEQIVDPTIVAKIRPESLRMFGETAVKCLASSSENRPSMGDVLWKLEYALHLQEPIIQDNPE

SEQ ID NO: 8247 - protein, 504 aa, Zinnia elegans
VREAMCFMMDPQVGRDVCYIQFPQRFDGIDRSDRYANRNTVFFDVNMKGLDGIQGPVYVGTGCVFYRQALYGYGPQSLPTLPSPSSSSSCCCCGPKKPKKDLEEFKRDARRDDLNAAIFNLKEIESYDDYERSLLISQMSFEKTFGMSSVFIESTLMENGGLAESANPATMINEAIHVISCGYEEKTAWGKEIGWIYGSVTEDILTGFKMHCRGWRSIYCMPVRPAFKGSAPINLSDRLHQVLRWALGSVEIFLSRHCPLWYGWGGGRLKLLQRLAYINTIVYPFTSLPLVAYCTLPAICLLTGKFIIPTLSNIAAVWFLGLFLSIITTSVLEIRWSGVSIEELWRNEQFWVIGGVSAHLFAVFQGFLKMLAGVDTNFTVTAKAADDQEFGELYMIKWTTVLIPPTTLLVLNLVGVVAGFSDALNKGYEAWGPLFGEVFFAFWVILHFTRFLKSLMGRQNRTPTIVILWSVLLASVYSLVWVKIDPFVSKGDSNLTQGCIAIDC

SEQ ID NO: 8248 - protein, 505 aa, Zinnia elegans
  unsure (1)..(505): unsure at all Xaa locations
VKEAMCFMMDPQVGRDVCYIQFPQRFDGIDRSDRYANRNTVFFDVNMKGLDGFXGPVYVRTGCVFYRQALHGYGPQSLPTLPSPSSSSSCCCCGPKKPKKDLEEFKRDARRDDLNAAIFNLKEIESYDDYERSLLISQMSFEKTFGMSSVFIESTLMENGGLAESANPATMINEAIHVISCGYEEKTAWGKEIGWIYGSVTEDILTGFKMHCRGWRSIYCMPVRPAFKGSAPINLSDRLHQVLRWALGSVEIFLSRHCPLWYGWGGGRLKLLQRLAYINTIVYPFTSLPLVAYCTLPAICLLTGKFIIPTLSNIAAVWFLGLFLSIITTSVLEIRWSGVSIEELWRNEQFWVIGGVSAHLFAVFQGSLKMLAGVDTNFTVTAKAADDQEFGELYMIKWTTVLIPPTTLLVLNLVGVVAGFSDALNKGYEAWGPLFGKVSLRSKGDFFICTRFLKGLMGRQNRTPTIVILWSVLLASVFSLVWVKIDPFVSKGDSNLTQGCIAIDC

SEQ ID NO: 8249 - protein, 1216 aa, Rattus norvegicus
MAGAQPGVHALQLKPVCVSDSLKKGTKFVKWDDDSTIVTPIILRTDPQGFFFYWTDQNKETELLDLSLVKDARCGKHAKAPKDPKLRELLDVGNIGHLEQRMITVVYGPDLVNISHLNLVAFQEEVAKEWTNEVFSLATNLLAQNMSRDAFLEKAYTKLKLQVTPEGRIPLKNIYRLFSADRKRVETALEACSLPSSRNDSIPQEDFTPDVYRVFLNNLCPRPEIDNIFSEFGAKSKPYLTVDQMMDFINLKQRDPRLNEILYPPLKQEQVQVLIEKYEPNSSLAKKGQMSVDGFMRYLSGEENGVVSPEKLDLNEDMSQPLSHYFINSSHNTYLTAGQLAGNSSVEMYRQVLLSGCRCVELDCWKGRTAEEEPVITHGFTMTTEISFKEVIEAIAECAFKTSPFPILLSFENHVDSPKQQAKMAEYCRLIFGDALLMEPLEKYPLESGVPLPSPMDLMYKILVKNKKKSHKSSEGSGKKKLSEQASNTYSDSSSVFEPSSPGAGEADTESDDDDDDDDCKKSSMDEGTAGSEAMATEEMSNLVNYIQPVKFESFETSKKRNKSFEMSSFVETKGLEQLTKSPVEFVEYNKMQLSRIYPKGTRVDSSNYMPQLFWNAGCQMVALNFQTVDLAMQINMGMYEYNGKSGYRLKPEFMRRPDKHFDPFTEGIVDGIVANTLSVKIISGQFLSDKKVGTYVEVDMFGLPVDTRRKAFKTKTSQGNAVNPVWEEEPIVFKKVVLPSLACLRIAAYEEGGKFIGHRILPVQAIRPGYHYICLRNERNQPLMLPAVFVYIEVKDYVPDTYADVIEALSNPIRYVNLMEQRAKQLAALTLEDEEEVKKEADPGETSSEAPSETRTTPAENGVNHTATLAPKPPSQAPHSQPAPGSVKAPAKTEDLIQSVLTEVEAQTIEELKQQKSFVKLQKKHYKEMKDLVKRHHKKTTELIKEHTTKYNEIQNDYLRRRAALEKSAKKDSKKKSEPSSPDHGSSAIEQDLAALDAEMTQKLIDLKDKQQQQLLNLRQEQYYSEKYQKREHIKLLIQKLTDVAEECQNNQLKKLKEICEKEKKELKKKMDKKRQEKITEAKSKDKSQMEEEKTEMIRSYIQEVVQYIKRLEEAQSKRQEKLVEKHKEIRQQILDEKPKLQMELEQEYQDKFKRLPLEILEFVQEAMKGKVSEDSNHGSAPPSLASDPAKVNLKSPSSEEVQGENAGREFDTPL

SEQ ID NO: 8250 - protein, 695 aa, Bos taurus
PESQLFSIEDIQEVRMGHRTEGLEKFARDVPENRCFSIVFKDQRNTLDLIAPSPADAQHWVQGLGKIIHHSGSMDQQQKLRHWIHSCLRKADKNKDNKMSFKELQNFLKELNIQVDDSYARKIFKECDHSQTDSLEDEEIETFYKILTQRKEIDRTFEEATGSKETLSVDQLVTFLQHQQREEEAGPALALSLIERYEPSETAKAQRQMTKDGFLMYLLSADGSAFDLADRRVYQDMDQPLSHYLVSSSHNTYLLEDQLTGPSSTEAYIRALCKGCRCLELDCWDGPNQEPIIYHGYTFTSKILFCDVVRAIRDYAFKASPYPVILSLENHCSLEQQRVMARHLRTLLGPMLLDRPLDGVVTSLPSPEQLRGKILLKGKKLGGLFPPGGEGGPEATVVSDEDEAAEMEDEAVRSQVQHKSKEDKLRLAKELSDMVIYCKSVHFRGFPSSGTSGQAFYEMSSFSENRALRLLQESGNSFVRHNVNHLSRIYPAGWRTDSSNYSPVEMWNGGCQIVALNFQTPGSEMDVYQGRFLDNGACGYVLKPAFLRDPNSTFNSRALAHGPWWTPKRLNVRVISGQQLPKVNKNKNSIVDPKVTVEIHGVTGDVASRQTAVVTNNGFNPWWDTELEFEVAVPELALVRFVVEDYDASSKNDFIGQSTIPLKSLKQGYRHIHLLSKNGDQHPSATLFVKVALQD

SEQ ID NO: 8251 - protein, 552 aa, Rattus norvegicus
MAEKQKHDGRVKIGHYVLGDTLGVGTFGKVKIGEHQLTGHKVAVKILNRQKIRSLDVVGKIKREIQNLKLFRHPHIIKLYQVISTPTDFFMVMEYVSGGELFDYICKHGRVEEVEARRLFQQILSAVDYCHRHMVVHRDLKPENVLLDAQMNAKIADFGLSNMMSDGEFLRTSCGSPNYAAPEVISGRLYAGPEVDIWSCGVILYALLCGTLPFDDEHVPTLFKKIRGGVFYIPEYLNRSIATLLMHMLQVDPLKRATIKDIREHEWFKQDLPSYLFPEDPSYDANVIDDEAVKEVCEKFECTESEVMNSLYSGDPQDQLAVAYHLIIDNRRIMNQASEFYLASSPPTGSFMDDMAMHIPPGLKPHPERMPPLIADSPKARCPLDALNTTKPKSLAVKKAKWHLGIRSQSKPYDIMAEVYRAMKQLDFEWKVVNAYHLRVRRKNPVTGNYVKMSLQLYLVDNRSYLLDFKSIDDEVVEQRSGSSTPQRSCSAAGLHRPRSSVDSSTAENHSLSGSLTGSLTGSTLSSASPRLGSHTMDFFEMCASLITALAR

SEQ ID NO: 8252 - protein, 508 aa, Homo sapiens
MSRFVQDLSKAMSQDGASQFQEVIRQELELSVKKELEKILTTASSHEFEHTKKDLDGFRKLFHRFLQEKGPSVDWGKIQRPPEDSIQPYEKIKARGLPDNISSVLNKLVVVKLNGGLGTSMGCKGPKSLIGVRNENTFLDLTVQQIEHLNKTYNTDVPLVLMNSFNTDEDTKKILQKYNHCRVKIYTFNQSRYPRINKESLRPVAKDVSYSGENTEAWYPPGHGDIYASFYNSGLLDTFIGEGKEYIFVSNIDNLGATVDLYILNHLINPPNGKRCEFVMEVTNKTRADVKGGTLTQYEGKLRLVEIAQVPKAHVDEFKSVSKFKIFNTNNLWISLAAVKRLQEQNAIDMEIIVNAKTLDGGLNVIQLETAVGAAIKSFENSLGINVPRSRFLPVKTTSDLLLVMSNLYSLNAGSLTMSEKREFPTVPLVKLGSSFTKVQDYLRRFESIPDMLELDHLTVSGDVTFGKNVSLKGTVIIIANHGDRIDIPPGAVLENKIVSGNLRILDH

SEQ ID NO: 8253 - protein, 953 aa, Flaveria trinervia
MMSSLSVEGMLLKSARESCLPARVNQRRNGDLRRLNHHRQSSFVRCLTPARVSRPELRSSGLTPPRAVLNPVSPPVTTAKKRVFTFGKGRSEGNRDMKSLLGGKGANLAEMSSIGLSVPPGLTISTEACEEYQQNGKSLPPGSWDEISEGLDYVQKEMSASLGDPSKPLLLSVRSGAAISMPGMMDTVLNLGLNDEVVAGLAGKSGARFAYDSYRRFLDMFGNVVMGIPHSLFDEKLEQMKAEKGIHLDTDLTAADLKDLVEKYKNVYVEAKGEKFPTDPKKQLELAVNAVFDSWDSPRANKYRSINQITGLKGTAVNIQSMVFGNMGNTSGTGVLFTRNPSTGEKKLYGEFLINAQGEDVVAGIRTPEDLGTMETCMPEAYKELVENCEILERHYKDMMDIEFTVQENRLWMLQCRTGKRTGKGAVRIAVDMVNEGLIDTRTAIKRVETQHLDQLLHPQFEDPSAYKSHVVATGLPASPGAAVGQVCFSAEDAETWHAQGKSAILVRTETSPEDVGGMHAAAGILTARGGMTSHAAVVARGWGKCCVSGCADIRVNDDMKIFTIGDRVIKEGDWLSLNGTTGEVILGKQLLAPPAMSNDLEIFMSWADQARRLKVMANADTPNDALTARNNGAQGIGLCRTEHMFFASDERIKAVRKMIMAVTPEQRKVALDLLLPYQRSDFEGIFRAMDGLPVTIRLLDPPLHEFLPEGDLEHIVNELAVDTGMSADEIYSKIENLSEVNPMLGFRGCRLGISYPELTEMQVRAIFQAAVSMTNQGVTVIPEIMVPLVGTPQELRHQISVIRGVAANVFAEMGVTLEYKVGTMIEIPRAALIAEEIGKEADFFSFGTNDLTQMTFGYSRDDVGKFLQIYLAQGILQHDPFEVIDQKGVGQLIKMATEKGRAANPSLKVGICGEHGGEPSSVAFFDGVGLDYVSCSPFRVPIARLAAAQVIV

SEQ ID NO: 8254 - protein, 771 aa, Rattus norvegicus
MASQIQKLLTTNQDLLLMQKGTMMRKVRTKSWKKLRYFRLQDDGMTVWHGRHLESISKPTFSISDVERIRKGQDSELLRYLVEEFPLEQGFTIVFNGRRPNLDLVANSVEEAQTWMRGLQLLVDLVARMNYQEQLDQMLREWFQQADRNQDSRMSFREAQRLLLLMNVEMDEEYAFSLFQEADVSQSNTLDSEEFVQFYKALTKRTEIEELFENFSSDKQKLTLLEFVDFLREEQKESDHSSDLALKLIDRYEPSENGRLLRVLSKDGFLSYLCSADGNIFNPDCLPIYQDMTQPLSHYYINSSHNTYLLGDQFCGQSSVEGYIRALKRGCRCVEVDTWDGPDGEPVVYHGRTLTSRILFKDVLATLAQYAFQSSDYPLILSLDNHCTWEQQKTMLAHHLIAILGEQLLSTTLEEQIDIMPSPELRGKILVKGKKLRTIEVVESDKEEEELEKDEGSDLDPASAELDMQSQPESQEQASGNKSKNKKKFLLQSSTTILCPDLSALVVYLRTAPFCSFTHSKENYHIYDISSFSESKAKNLIREAGNEFVQHNARQLCRVYPSGLRTDSSNYNPQEHWNVGCQMVAMNMQTAGSAMDICDGLFRQNGGSGYVLKPEFLRDTQSSFNPMKPVSLYKAQILVVQVISGQRLPKVDKTKETTVVDPLVRVELYGVPEDTKQQETSYVENNGINPYWGETFYFQIQVPELAMLRFVVKDYSRTSRNNFIGQYTLPWTCMKHGYRHVSLLSKDGTSLHPASHFVYTCMQEDLDMDEP

SEQ ID NO: 8255 - protein, 342 aa, Pseudomonas resinovorans
MSHKVAFSFADGKTLFFPVQSHEILLDAALRNGINIPLDCREGVCGTCQGRCESGQYSQDYVDDEALSAEDLRQRKMLTCQTRVSSDAAFYFDFASSLCNAPGPGRLKGIVRAVEQVSPNTAILHLDAGADGQQLDFLPGQYARLQIPGTHGQRSYSFANRPNSGNQLQFLIRLLPDGLMSNYIRERSLIGDEILLEAPLGAFYLRHVDKPLVFVAGGKPLSAFLGMLDEIAERGGCGHPVHLYYGVRNAADLCETQRIAAYAERIPGFRLHPGSSATPARTWHGKRGYITEHFDLAEFRDQALDMYLCGPPPMVESIKQWLDTQALDQTRLYYEKFTQSNT

SEQ ID NO: 8256 - protein, 220 aa, Eustoma grandiflorum
AHATFYGGGDASGTMGGACGYGNLYSQGYGTNTAALSTALFNNGLSCGSCYTIRCDSSSAGKWCLNGMITVTATNFCPPNPSLPNDDGGWCNPPRQHFDLAEPAFLQIAQYRAGIVPVEFMRVPCRKKGGIRFVINGHSYFNLVLVTNVGGAGDVHSVSIKGSRTGWQPMSRNWGQNWQNNAYLNGQALSIQVTTSDGRTVTSNTVAPADWQFGQTIFGG

SEQ ID NO: 8257 - protein, 244 aa, Brassica napus
SPVVVVTGASRGIGKAIALSLGKAGCKVLVNYARSAKAAEEVSKQIEAYGGQAITFGGDVSKEADVEAMMKTAIDAWGTIDVVVNNAGITRDTLLIRMKKSQWDEVIDLNLTGVFLCTQAATKIMMKKRKGRIINIASVVGLIGNIGQANYAAAKAGVIGFSKTAAREGASRNINVNVVCPGFIASDMTAKLGEDMEKKILGTIPLGRTGQPENVAGLVEFLALSPAASYITGQAFTIDGGIAI

SEQ ID NO: 8258 - protein, 431 aa, Rattus norvegicus
ADKLPYKVADIGLAAWGRKALDIAENEMPGLMRMREMYSASKPLKGARIAGCLHMTVETAVLIETLVALGAEVRWSSCNIFSTQDHAAAAIAKAGIPVFAWKGETDEEYLWCIEQTLHFKDGPLNMILDDGGDLTNLIHTKHPQLLSGIRGISEETTTGVHNLYKMMANGILKVPAINVNDSVTKSKFDNLYGCRESLIDGIKRATDVMIAGKVAVVAGYGDVGKGCAQALRGFGARVIITEIEPINALQAAMEGYEVTTMDEACKEGNIFVTTTGCVDIILGRHFEQMKDDAIVCNIGHFDVEIDVKWLNENAVEKVNIKPQVDRYLLKNGHRIILLAEGRLVNLGCAMGHPSFVMSNSFTNQVMAQIELWTHPDKYPVGVHFLPKKLDEAVAEAHLGKLNVKLTKLTEKQAQYLGMPINGPFKPDHYRY

SEQ ID NO: 8259 - protein, 430 aa, Rattus norvegicus
DKLPYKVADIGLAAWGRKALDIAENEMPGLMRMREMYSASKPLKGARIAGCLHMTVETAVLIETLVALGAEVRWSSCNIFSTQNHAAAAIAKAGIPVFAWKGETDEEYLWCIEQTLHFKDGPLNMILDDGGDLTNLIHTKHPQLLSGIRGISEETTTGVHNLYKMMANGILKVPAINVNDSVTKSKFDNLYGCRESLIDGIKRATDVMIAGKVAVVAGYGDVGKGCAQALRGFGARVIITEIDPINALQAAMEGYEVTTMDEACKEGNIFVTTTGCVDIILGRHFEQMKDDAIVCNIGHFDVEIDVKWLNENAVEKVNIKPQVDRYLLKNGRRIILLAEGRLVNLGCAMGHPSFVMSNSFTNQVMAQIELWTHPDKYPVGVHFLPKKLDEAVAEAHLGKLNVKLTKLTEKQAQYLGMPINGPFKPDHYRY

SEQ ID NO: 8260 - protein, 90 aa, Kluyveromyces lactis
PAFVNKLWSMVNDKSNEKFIHWSTSGESIVVPNRERFVQEVLKKYFKHSNFASFVRQLNMYGWHKVQDVKSGSMLSNNDSRWEFENERHA

SEQ ID NO: 8261 - protein, 90 aa, Kluyveromyces lactis
PAFVNKLWSMVNDKSNEKFIHWSTSGESIVVPNRERFVQEVLAKYFKHSNFASFVRQLNMYGWHKVQDVKSGSMLSNNDSRWEFENERHA

SEQ ID NO: 8262 - protein, 380 aa, Bos taurus
MGCLGNSKTEDQRNEEKAQREANKKIEKQLQKDKQVYRATHRLLLLGAGESGKSTIVKQMRILHVNGFNGDGEKATKVQDIKNNLKEAIETIVAAMSNLVPPVELANPENQFRVDYILSVMNVPDFDFPPEFYEHAKALWEDEGVRACYERSNEYQLIDCAQYFLDKIDVIKQDDYVPSDQDLLRCRVLTSGIFETKFQVDKVNFHMFDVGGQRDERRKWIQCFNDVTAIIFVVASSSYNMVIREDNQTNRLQEALNLFKSIWNNRWLRTISVILFLNKQDLLAEKVLAGKSKIEDYFPEFARYTTPEDATPEPGEDPRVTRAKYFIRDEFLRISTASGDGRHYCYPHFTCAVDTENIRRVFNDCRDIIQRMHLRQYELL

SEQ ID NO: 8263 - protein, 90 aa, Kluyveromyces lactis
PAFVNKLWSMVNDKSNEKFIHWSTSGESIVVPNRERFVQEVLPKYFKHSNFASFVRQLNMYGWHKVQDVKSGSMLSNNDSRWEFENERHA

SEQ ID NO: 8264 - protein, 873 aa, Clostridium symbiosum
AKWVYKFEEGNASMRNLLGGKGCNLAEMTILGMPIPQGFTVTTEACTEYYNSGKQITQEIQDQIFEAITWLEELNGKKFGDTEDPLLVSVRSGARASMPGMMDTILNLGLNDVAVEGFAKKTGNPRFAYDSYRRFIQMYSDVVMEVPKSHFEKIIDAMKEEKGVHFDTDLTADDLKELAEKFKAVYKEAMNGEEFPQEPKDQLMGAVKAVFRSWDNPRAIVYRRMNDIPGDWGTAVNVQTMVFGNKGETSGTGVAFTRNPSTGEKGIYGEYLINAQGEDVVAGVRTPQPITQLENDMPDCYKQFMDLAMKLEKHFRDMQDMEFTIEEGKLYFLQTRNGKRTAPAALQIACDLVDEGMITEEEAVVRIEAKSLDQLLHPTFNPAALKAGEVIGSALPASPGAAAGKVYFTADEAKAAHEKGERVILVRLETSPEDIEGMHAAEGILTVRGGMASHAAVVARGMGTCCVSGCGEIKINEEAKTFELGGHTFAEGDYISLDGSTGKIYKGDIETQEASVSGSFERIMVWADKFRTLKVRTNADTPEDTLNAVKLGAEGIGLCRTEHMFFEADRIMKIRKMILSDSVEAREEALNELIPFQKGDFKAMYKALEGRPMTVRYLDPPLHEFVPHTEEEQAELAKNMGLTLAEVKAKVDELHEFNPMMGHRGCRLAVTYPEIAKMQTRAVMEAAIEVKEETGIDIVPEIMIPLVGEKKELKFVKDVVVEVAEQVKKEKGSDMQYHIGTMIEIPRAALTADAIAEEAEFFSFGTNDLTQMTFGFSRDDAGKFLDSYYKAKIYESDPFARLDQTGVGQLVEMAVKKGRQTRPGLKCGICGEHGGDPSSVEFCHKVGLNYVSCSPFRVPIARLAAAQAALNNK

SEQ ID NO: 8265 - protein, 374 aa, Homo sapiens
STAGKVIKCKAAVLWELKKPFSIEEVEVAPPKAHEVRIKMVAVGICGTDDHVVSGTMVTPLPVILGHEAAGIVESVGEGVTTVKPGDKVIPLAIPQCGKCRICKNPESNYCLKNDVSNPQGTLQDGTSRFTCRRKPIHHFLGISTFSQYTVVDENAVAKIDAASPLEKVCLIGCGFSTGYGSAVNVAKVTPGSTCAVFGLGGVGLSAIMGCKAAGAARIIAVDINKDKFAKAKELGATECINPQDYKKPIQEVLKEMTDGGVDFSFEVIGRLDTMMASLLCCHEACGTSVIVGVPPDSQNLSMNPMLLLTGRTWKGAILGGFKSKECVPKLVADFMAKKFSLDALITHVLPFEKINEGFDLLHSGKSIRTILMF

SEQ ID NO: 8266 - protein, 374 aa, Homo sapiens
STAGKVIKCKAAVLWELKKPFSIEEVEVAPPKAHEVRIKMVAAGICRSDEHVVSGNLVTPLPVILGHEAAGIVESVGEGVTTVKPGDKVIPLFTPQCGKCRICKNPESNYCLKNDLGNPRGTLQDGTRRFTCSGKPIHHFVGVSTFSQYTVVDENAVAKIDAASPLEKVCLIGCGFSTGYGSAVKVAKVTPGSTCAVFGLGGVGLSVVMGCKAAGAARIIAVDINKDKFAKAKELGATECINPQDYKKPIQEVLKEMTDGGVDFSFEVIGQLDTMMASLLCCHEACGTSVIVGVPPDSQNLSINPMLLLTGRTWKGAIFGGFKSKESVPKLVADFMAKKFSLDALITNVLPFEKINEGFDLLRSGKSIRTVLTF

SEQ ID NO: 8267 - protein, 260 aa, Mus musculus
MASSGLTRRNPLSNKVALVTASTDGIGFAIARRLAEDGAHVVVSSRKQQNVDRAVATLQGEGLSVTGIVCHVGKAEDREKLITTALKRHRGIDILVSNAAVNPFFGNLMDVTEEVWDKVLSINVTATAMMIKAVVPEMEKRGGGSVVIVGSVAGFTRFPSLGPYNVSKTALLGLTKNFAAELAPKNIRVNCLAPGLIKTRFSSVLWEEKAREDFIKEAMQIRRLGKPEDCAGIVSFLCSEDASYINGETVVVGGGTPSRL

SEQ ID NO: 8268 - protein, 345 aa, Homo sapiens [sequence omitted]

SEQ ID NO: 8269 - protein, 243 aa, Homo sapiens
MGSNSGQAGRHIYKSLADDGPFDSVEPPKRPTSRLIMHSMAMFGREFCYAVEAAYVTPVLLSVGLPSSLYSIVWFLSPILGFLLQPVVGSASDHCRSRWGRRRPYILTLGVMMLVGMALYLNGATVVAALIANPRRKLVWAISVTMIGVVLFDFAADFIDGPIKAYLFDVCSHQDKEKGLHYHALFTDSQGNDIKVTAESTGEHASSLPLPLHQPPHWMDGLPVQHAVLHRFHGPDCVPRGSL

SEQ ID NO: 8270 - protein, 374 aa, Homo sapiens
STAGKVIKCKAAVLWEVKKPFSIEDVEVAPPKAYEVRIKMVAVGICRTDDHVVSGNLVTPLPVILGHEAAGIVESVGEGVTTVKPGDKVIPLFTPQCGKCRVCKNPESNYCLKNDLGNPRGTLQDGTRRFTCRGKPIHHFLGTSTFSQYTVVDENAVAKIDAASPLEKVCLIGCGFSTGYGSAVNVAKVTPGSTCAVFGLGGVGLSAVMGCKAAGAARIIAVDINKDKFAKAKELGATECINPQDYKKPIQEVLKEMTDGGVDFSFEVIGRLDTMMASLLCCHEACGTSVIVGVPPASQNLSINPMLLLTGRTWKGAVYGGFKSKEGIPKLVADFMAKKFSLDALITHVLPFEKINEGFDLLHSGKSICTVLTF

SEQ ID NO: 8271 - protein, 501 aa, Oryza sativa (japonica cultivar-group); identical to SEQ ID NO: 3380

SEQ ID NO: 8272 - protein, 337 aa, Homo sapiens
ADQAPFDTDVVTLTRFVMEEGRKARGTGELTQLLNSLCTAVKAISSAVRKAGIAHLYGIAGSTNVTGDQVKKLDVLSNDLVMNMLKSSFATCVLVSEEDKHAIIVEPEKRGKYVVCFDPLDGSSNIDCLVSVGTIFGIYRKKSTDEPSEKDALQPGRNLVAAGYALYGSATMLVLAMDCGVNCFMLDPAIGEFILVDKDVKIKKKGKIYSLNEAYAKDFDPAVTEYIQRKKFPPDNSAPYGARYVGSMVADVHRTLVYGGIFLYPANKKSPNGKLRLLYECNPMAYVMEKAGGMATTGKEAVLDVIPTDIHQRAPIILGSPDDVLEFLKVYEKHSAQ

SEQ ID NO: 8273 - protein, 393 aa, Selenomonas ruminantium
MKNFRLSEKEVKTLAKRIPTPFLVASLDKVEENYQFMRRHLPRAGVFYAMKANPTPEILSLLAGLGSHFDVASAGEMEILHELGVDGSQMIYANPVKDARGLKAAADYNVRRFTFDDPSEIDKMAKAVPGADVLVRIAVRNNKALVDLNTKFGAPVEEALDLLKAAQDAGLHAMGICFHVGSQSLSTAAYEEALLVARRLFDEAEEMGMHLTDLDIGGGFPVPDAKGLNVDLAAMMEAINKQIDRLFPDTAVWTEPGRYMCGTAVNLVTSVIGTKTRGEQPWYILDEGIYGCFSGIMYDHWTYPLHCFGKGNKKPSTFGGPSCDGIDVLYRDFMAPELKIGDKVLVTEMGSYTSVSATRFNGFYLAPTIIFEDQPEYAARLTEDDDVKKKAAV

SEQ ID NO: 8274 - protein, 437 aa, Actinosynnema pretiosum subsp. auranticum
MTLAELLPSVGMTGEPALETGLWPLGTRLERGELLLGGVPATELAARFGTPCQVLDEGTVRARARAFREALPEAEVVFAGKALPCREVYRWVADEGLSLDVCSAGELAIARSVGFPAERVLLHGNVKTPEDLKAALGYGVGRVVVDSFDEIEQLGALAEGPQDVLVRVTPGVDPRTHRAVATGVEDQKFGFSLAGGDALEAVLRVVEQPSLRLVGLHCHVGSQVRHVAVYEEAARRVVGLIASCGVRIEQLDLGGGFAVPYLPGEGEFDLGGFAHRVRVALSHECALRRVPVPRLSIEPGRAVVARAGVTLYRVAAVKRGVRRVFVAVDGGMSDNPRPALYGSRYAVRLVRRGGRRAPVTVVGRHCEAGDVLAEDVPLPEDVRAGDLLAVPVTGAYHHALASNYNAVGRPPVVGVRDGVARVLVRRETEEDLLRREV

SEQ ID NO: 8275 - protein, 474 aa, Mycobacterium smegmatis
MNAHPAGPRHAEELHHADVPDKPQSPDEIMLLAPNVWPRNLVRGADGVVTIAGVPVTDLAAKFGTPLFVIDEDDFRTRCRDIAAAFGGGQYVHYAAKAFLCSEIARWVDEEGLSLDVATGGELAVALHAGFPASRITVHGNNKSVAELTAAVQAGVGHVVLDSEIEIERLDQIAGAAGVVQDVLVRVTVGVEAHTHEFISTAHEDQKFGLSLATGAAMNAIRRVFATDNLRLVGLHSHIGSQIFDVAGFEIAAHRVIGLLRDVVAEFGVEKTSQMSIVDLGGGLGISYLPHDDPPPMKELADKLLEIVRTESAAVGLPTPKLVVEPGRAIAGPGTITLYEVGTVKDVAVSQTAHRRYVSVDGGMSDNIRTSLYAAQYDARLVSRVSDAPPALARIVGKHCESGDIVVRDTWVSDDIAPGDLIGVAATGAYCYSMSSRYNLLCRPAVVAVADGQARLVLRRETVEDLLSLEVKGQ

SEQ ID NO: 8276 - protein, 421 aa, Zymomonas mobilis
MIPFSLKNGTLCVEDIPLPEIAAQYGTPCYVYSHSYLTERARRFTKALDGAGKGKSLVAFAVKANPSQAILASFAKEGLGADVVSAGEIRRAVHAGIPPERIVFSGVGKTAEEMRYALEIGIGQFNIESVSEIEMLAEVATSLGKKAAVALRINPDVDPHTHAKIATGKADTKFGIAAEDALSAYEKLASYPSLKIQGIASHIGSQITDLAPFEAAAERIYEIITALEKAGHAIETADLGGGLGVRYKDDQPEPPSVEAYGEMIKRVTKGWNCRLIFEPGRSLIANAGVLLSKVIRIKESKTARFVILDAAMNDLVRPTLYDAYHEIKAVTPSAQTYQADIVGPVCETGDIFARNRSISAVKADDLMAIMSAGAYGATMASAYNSRPLVAEVMVSGNKSALIRKRQSVEDLMRDEQKVEWL

SEQ ID NO: 8277 - protein, 382 aa, Bacillus halodurans
MKGISVLGATGSIGTQTLDVLANHRDKFRLVAMSVGKNLTLAEEQIHQFKPPLVSVMTDEDRKTLASKVPEGTRVVCGEEGLIEVATAEKAEILVNAVIGSVGLAPTLAAIEAKKTIALANKETLVTAGHLVTEKAREHGVKLLPVDSEHSAIFQALQGERMDRLHRIIITASGGSFRDKSRDELNGVTVEDALKHPNWSMGAKITIDSATMMNKGLEVIEAHWLFNLPYEKIDVLLHKESIIHSMVEFVDRSVIAQLGTPDMRVPIQYALSYPDRLEFHEGQQLNLWEVGKLHFAPLDMERFRCMAFAYESGKQGGTMPTVLNAANEEAVELFLNNQLSFLGIEDVIEKALERHERIDSPSLADILHVDQETRAFVHSLIK

SEQ ID NO: 8278 - protein, 635 aa, Xylella fastidiosa
MIDSTCYPRLSRIQIPEDLRTFQESELRAVADELRNYLIESVGLSGGHFAAGLGVVELTIALHYLYCTPIDHLVWDVGHQTYPHKILTGRRDKISTVKHQGGLAPFPKREESIYDTFGVGHSSTSISAALGMAIVAQRHGDERKVVAIIGDGAMTAGMAYEALNHAGGMSPAPNLLVILNDNRMSISEAVGGLTKMLGRATGSKALNAIREGGKRIFGDKKTNATARFLRRWEEHWKGMFVPSTLFEEMGFHYTGPIDGHDLPALLGALKTLRTLKGPQLLHVITTKGKGYELAEGDQIGYHAVAPFDPQKGLIKAGAKKQTYTDVFSEWLCDMAAVEPRLLAITPAMREGSGLVRFSQEYPQRYFDVAIAEQHAITLAAGMATQGAKPVVAIYSTFLQRGYDQLVHDVALQKLDVLFAVDRGGVVGPDGATHAGNLDLSFLRCVPNMMLMAPADEAECRKMLSTGFHYSGPVAVRYPRGTGPGVVPSAELDVLPVGVAQLRHSGTRIALLGFGVCVAPAEQVGRRLGLTVVNMRFIKPLDRTLLLELARTHEGFVTIEDNVVAGGAGSGVAELLNAEGIVLPIVHLGLPDAFQQHASREDLLAEAGIDAAGVYAALLSRWPDLAVQNHPLSAVS

SEQ ID NO: 8279 - protein, 430 aa, Xylella fastidiosa
MTAIAKIYAREILDSRGNPTLEAEVTLENAVCGRAAVPSGASTGTKEAVELRDGDKTRYLGKGVRAAVDNVNGVIAAALVGFDGADQTGLDHRLINLDGTENKGRLGANALLGVSLATAHAVAAARKQPLWMYLSTLGESKVSLPVPMMNIINGGAHADNNVDFQEFMVLPVGFASFSEALRAGTEIFHALKSVLKGQGLSTAVGDEGGFAPDLRSNVEALDAILEAIGRAGYIAGEDVLLGLDVASSEFRDNGKYNLVGENKRLTSEQFVDFLDDWVTQYPIISIEDGLAEDDWAGWKQLTERIGHKVQLVGDDLFVTNPKVFQEGITSGIANAILIKLNQIGTLTETLESIAMAHRAQYAAIVSHRSGETEDTSIADIAVATTATQIKTGSLCRSDRVAKYNQLLRIEQALGVGARYAGRDAFVSLKS

SEQ ID NO: 8280 - protein, 636 aa, Synechococcus leopoliensis
MHLSEITHPNQLHGLSVAQLEQIGHQIREKHLQTVAATGGHLGPGLGVVELTLALYQTLDLDRDKVVWDVGHQAYPHKLLTGRYHNFHTLRQKDGIAGYPKRTENRFDHFGAGHASTSISAGLGMALARDAQGEDYRCVAVIGDGSLTGGMALEAINHAGHLPKTRLLVVLNDNDMSISPNVGALSRYLNKIRVSEPMQLLTDGLTQGMQQIPFVGGAITQGFEPVKEGMKRLSYSKIGAVFEELGFTYMGPVDGHNLEELIATFREAHKHTGPVLVHVATTKGKGYPYAEEDQVGYHAQNPFDLATGKAKPASKPKPPSYSKVFGQTLTTLAKSDRRIVGITAAMATGTGLDILQKALPKQYIDVGIAEQHAVVLAAGMACDGMRPVVAIYSTFLQRAFDQVIHDVCIQKLPVFFCLDRAGIVGADGPTHQGMYDIAYLRLIPNMVLMAPKDEAELQRMLVTGIEYDGPIAMRFPRGNGIGVPLPEEGWESLPIGKAEQLRQGDDLLMLAYGSMVYPALQTAELLNEHGISATVINARFAKPLDEELIVPLARQIGKVVTFEEGCLPGGFGSAIMESLQAHDLQVPVLPIGVPDLLVEHASPDESKQELGLTPRQMADRILEKFGSRQRIGAASA

SEQ ID NO: 8281 - protein, 631 aa, Streptomyces sp. CL190
MTILENIRQPRDLKALPEEQLHELSEEIRQFLVHAVTRTGGHLGPNLGVVELTIALHRVFESPVDRILWDTGHQSYVHKLLTGRQDFSKLRGKGGLSGYPSREESEHDVIENSHASTALGWADGLAKARRVQGEKGHVVAVIGGRALTGGMAWEALNNIAAAKDQPLIIVVNDNERSYAPTIGGLANHLATLRTTDGYEKVLAWGKDVLLRTPIVGHPLYEALHGAKKGFKDAFAPQGMFEDLGLKYVGPIDGHDIGAVESALRRAKRFHGPVLVHCLTVKGRGYEPALAHEEDHFHTVGVMDPLTCEPLSPTDGPSWTSVFGDEIVRIGAEREDIVAITAAMLHPVGLARFADRFPDRVWDVGIAEQHAAVSAAGLATGGLHPVVAVYATFLNRAFDQLLMDVALHRCGVTFVLDRAGVTGVDGASHNGMWDMSVLQVVPGLRIAAPRDADHVRAQLREAVAVDDAPTLIRFPKESVGPRIPALDRVGGLDVLHRDERPEVLLVAVGVMAQVCLQTAELLRARGIGCTVVDPRWVKPVDPVLPPLAAEHRLVAVVEDNSRAAGVGSAVALALGDADVDVPVRRFGIPEQFLAHARRGEVLADIGLTPVEIAGRIGASLPVREEPAEEQPA

SEQ ID NO: 8282 - protein, 402 aa, Synechococcus leopoliensis
MKAVTLLGSTGSIGTQTLDILEQYPDRFRLVGLAAGRNVALLSEQIRRHRPEIVAIQDAAQLSELQAAIADLDNPPLILTGEAGVTEVARYGDAEIVVTGIVGCAGLLPTIAAIEAGKDIALANKETLIAAGPVVLPLLQKHGVTITPADSEHSAIFQCIQGLSTHADFRPAQVVAGLRRILLTASGGAFRDWPVERLSQVTVADALKHPNWSMGRKITVDSATLMNKGLEVIEAHYLFGLDYDYIDIVIHPQSIIHSLIELEDTSVLAQLGWPDMRLPLLYALSWPDRLSTQWSALDLVKAGSLEFREPDHAKYPCMDLAYAAGRKGGTMPAVLNAANEQAVALFLEEQIHFSDIPRLIERACDRHQTEWQQQPSLDDILAYDAWARQFVQASYQSLESVV

SEQ ID NO: 8283 - protein, 428 aa, Pyrococcus abyssi [sequence omitted]

SEQ ID NO: 8284 - protein, 434 aa, Streptococcus intermedius
MSIITDVYAREVLDSRGNPTLEVEVYTESGAFGRGMVPSGASTGEHEAVELRDGDKSRYGGLGTQKAVDNVNNIIAEAVIGYDVRDQQAIDRAMIALDGTPNKGKLGANAILGVSIAVARAAADYLEIPLYSYLGGFNTKVLPTPMMNIINGGSHSDAPIAFQEFMIVPAGAPTFKEALRWGAEIFHALKKILKSRGLATAVGDEGGFAPRFDGTEDGVETILAAIEAAGYVPGKDVFLGFDCASSEFYDKERKVYDYTKFEGEGAAVRTADEQIDYLEELVNKYPIITIEDGMDENDWDGWKKLTERLGKKVQPVGDDFFVTNTSYLEKGINEACANSILIKVNQIGTLTETFDAIEMAKEAGYTAVVSHRSGETEDSTIADIAVAANAGQIKTGSLSRTDRIAKYNQLLRIEDQLGEVAEYRGLKSFYNLSK

SEQ ID NO: 8285 - protein, 201 aa, Arabidopsis thaliana
MNMEVDTVTRKPRILLAASGSVASIKFSNLCHCFSEWAEVKAVASKSSLNFVDKPSLPQNVTLYTDEDEWSSWNKIGDPVLHIELRRWADVMIIAPLSANTLAKIAGGLCDNLLTCIVRAWDYSKPLFVAPAMNTLMWNNPFTERHLVLLDELGITLIPPIKKKLACGDYGNGAMAEPSLIYSTVRLFWESQARKQRDGTS

SEQ ID NO: 8286 - protein, 423 aa, Mus musculus
MSDSKSDGQFYSVQVADSTFTVLKRYQQLKPIGSGAQGIVCAAFDTVLGINVAVKKLSRPFQNQTHAKRAYRELVLLKCVNHKNIISLLNVFTPQKTLEEFQDVYLVMELMDANLCQVIHMELDHERMSYLLYQMLCGIKHLHSAGIIHRDLKPSNIVVKSDCTLKILDFGLARTACTNFMMTPYVVTRYYRAPEVILGMGYKENVDIWSVGCIMAEMVLHKVLFPGRDYIDQWNKVIEQLGTPSAEFMKKLQPTVRNYVENRPKYPGIKFEELFPDWIFPSESERDKIKTSQARDLLSKMLVIDPDKRISVDEALRHPYITVWYDPAEAEAPPPQIYDAQLEEREHAIEEWKELIYKEVMDWEERSKNGVKDQPSDAAVSSKATPSQSSSINDISSMSTEHTLASDTDSSLDASTGPLEGCR

SEQ ID NO: 8287 - protein, 399 aa, Archaeoglobus fulgidus
MIIEDVHYRVVFDSRGNETVECEVVAGEVVAKAMAPSGASTGSGEAVVVSPYRYEEIEEEVSKAIIGMSVFDQESVDEALRELDGTDNFSRIGGNFAITASLAVAKAAAEILGLPLYAYVGGVFAKELPYPLGNVIGGGRHAEGSTSIQEFLVIPVGAKTFFEAQRANAAVHKQLKKIFKERGIFAAKGDEGAWAAQISDEQAFEILSEAIQRVEDELGVKVRMGIDVAATELWDGERYVYSDRKLTTEEQIAYMAELADRYDLLYIEDPLHEKDFEGFAELTKQVKCMVCGDDIFVTNPEIIKKGIEVGAANTVLIKPNQNGTLSGTAKAVKIAKDNGYSVVVSHRSGETEDETLAHLAVAFNAKLIKTGVVGGERISKLNELIRIEELMDKPRMVMI

SEQ ID NO: 8288 - protein, 434 aa, Desulfovibrio vulgaris (strain Miyazaki) [sequence omitted]

SEQ ID NO: 8289 - protein, 423 aa, Methanocaldococcus jannaschii [sequence omitted]

SEQ ID NO: 8290 - protein, 388 aa, Zymomonas mobilis
MSQPRTVTVLGATGSIGHSTLDLIERNLDRYQVIALTANRNVKDLADAAKRTNAKRAVIADPSLYNDLKEALAGSSVEAAAGADALVEAAMMGADWTMAAIIGCAGLKATLAAIRKGKTVALANKESLVSAGGLMIDAVREHGTTLLPVDSEHNAIFQCFPHHNRDYVRRIIITASGGPFRTTSLAEMATVTPERAVQHPNWSMGAKISIDSATMMNKGLELIEAFHLFQIPLEKFEILVHPQSVIHSMVEYLDGSILAQIGSPDMRTPIGHTLAWPKRMETPAESLDFTKLRQMDFEAPDYERFPALTLAMESIKSGGARPAVMNAANEIAVAAFLDKKIGFLDIAKIVEKTLDHYTPATPSSLEDVFAIDNEARIQAAALMESLPA

SEQ ID NO: 8291 - protein, 720 aa, Mus musculus
MAEKFESLMNIHGFDLGSRYMDLKPLGCGGNGLVFSAVDNDCDKRVAIKKIVLTDPQSVKHALREIKIIRRLDHDNIVKVFEILGPSGSQLTDDVGSLTELNSVYIVQEYMETDLANVLEQGSLLEEHARLFMYQLLRGLKYIHSANVLHRDLKPANLFINTEDLVLKIGDFGLARIMDPHYSHKGHLSEGLVTKWYRSPRLLLSPNNYTKAIDMWAAGCIFAEMLTGKTLFAGAHELEQMQLILDSIPVVHEEDRQELLSVIPVYIRNDMTEPHRPLTQLLPGISREALDFLEQILTFSPMDRLTAEEALSHPYMSIYSFPTDEPISSHPFHIEDEVDDILLMDETHSHIYNWERYHDCQFSEHDWPIHNNFDIDEVQLDPRALSDVTDEEEVQVDPRKYLDGDREKYLEDPAFDTSYSAEPCWQYPDHHENKYCDLECSHTCNYKTRSSPYLDNLVWRESEVNHYYEPKLIIDLSNWKEQSKEKSDKRGKSKCERNGLVKAQIALEEASQQLAERERGQGFDFDSFIAGTIQLSAQHQSADVVDKLNDLNSSVSQLELKSLISKSVSREKQEKGRANLAQLGALYQSSWDSQFVSGGEECFLISQFCCEVRKDEHAEKENTYTSYLDKFFSRKEDSEMLETEPVEEGKRGERGREAGLLSGGGEFLLSKQLESIGTPQFHSPVGSPLKSIQATLTPSAMKSSPQIPHKTYSSILKHLN

SEQ ID NO: 8292 - protein, 203 aa, Pyrococcus horikoshii
MAHGPRYRVPFRRRREGKTNYRKRLKLLKSGKPRLVVRKSLNHHIAQIIVYDPKGDRTLVSAHTRELIRDFGWKGHCGNTPSAYLLGLLIGYKAKKAGIEEAILDIGLHPPVRGSSIFAVLKGAIDAGLNVPHSPEIFPEDYRIRGEHIAEYARMLKEQDEDRFRRQFGGYLEKGLDPEKLPEHFEEVKARIIEKFESEGARE

SEQ ID NO: 8293 - protein, 312 aa, Oryza sativa; identical to SEQ ID NO: 3084

SEQ ID NO: 8294 - protein, 627 aa, Oryza sativa
MAVLVSDQVPDVLIGDPWRFRQIITNLVGNSMKFTEQGHIFIRVHLIEEVKRKMEALDDTSPENIEVTANSKNTMPYNTLSGLEVANNRKTLESFRMFKDSSDAIDSVNLLVTVEDTGIGITKDAQTRIFTPFMQADGSTSRTYGGTGIGLSITKRLVELMGGEIGFVSKPGVSSTFSFTAIFKENRKDPGDIKRYCPEPTPPDFQGMRALVVDGRCARAEVTMYHLRRLGIQCDLAATSESALSALLESCNSSVKSSLNMVLVDKEAWGEDSGLAFFRCLIDLRLKGTLKSWQTMPKFFLLAGSITPADSDCLRLAGYSNSIRKPLRLSTVAACLSKALGVGLTGRRSRDNSLVLRSVLTGKNILVVDDNAVNRIVAAGALKKYGAIVTCVDSGKEAISRLQPPHKFDACFMDVQMPEMDGFEATRLVRSVESKINDTIQAGEVSSEIYGNKAHWHVPILAMTADVIQATFEGSSAKNPFGDNNIAKQKSYAVNREQKFDWTAIYVSFEPTHPDSNTFNTGRAGPDRGRAVQPHWAPQIVGAPPHPPRSLYAAVAQVTGANMLCNDTEQKLQTQRRSQFLPMRRDCRRTALHDSSRVVVVVGGGGGTSVRGAVTPWSSAIDCNRIC

SEQ ID NO: 8295 - protein, 528 aa, Oryza sativa (japonica cultivar-group)
MDSARSWFTKLQTREKSIGKKKELPPNGKEGTDEAPSSATKQRVAAAKQYIEKHYKEQMKNLQDRKERRCSLEKKLADANVSEEEQHNIVKQFEKKETEYMRMQRHKMSVDDFDLLTMIGKGAFGEVRVCREKNTGNVYAMKKLRKSEMLRRGQVEHVKAERNLLAEVDHHCIVKLYCSFQDSEYLYLIMEYLPGGDMMTLLMRKDTLTEDEARFYVGETVLAIEAIHRHNYIHRDIKPDNLLLDRHGHLRLSDFGLCKPLDYSNFPDLNEKDVTSTKPQSTNGDGRQQSMPKRTQQEQLEHWQKNRRTLAYSTVGTPDYIAPEVLLKKGYGMECDWWSLGAIMYEMLVGYPPFYSDEPMTTCRKIVNWRTHLKFPEEARLMTDAKDLISKLLCNVDQRLGTKGAEEIKEHSWFSGVEWDKLYEIEAAYQPQVTDELDTQNFEKFEESSDNIQCSAKAGPWRKMLSSKDLNFVGYTYKNFELVNDPEVLGMAELKKKEKAKRPSAKSLFGIPSRALAVLCSSSIRRHI

SEQ ID NO: 8296 - protein, 827 aa, Rhodobacter capsulatus
MIPLTSELVAIGKTATDKADAIAQAVDLLTAAGKIDPRYGQSMMGREAVANTFLGNGIAIPHGLPQDRDLIHDTAIAVVQLPAGVEWAPGDTARLVVAIAAKSDEHLQVLSNLTDVLGDEAEAERLATTLDAAVIVARLTGAAAPVAAPAETPADFAQGIDVVVTGAHGLHARPATTLVDLAKGFAAEIRIRNGAKVANGKSLISLLNLGAAQGAALRISAEGADATAALAAIAAAFEAGLEDEEDTGAAAPEAATPGLTGAGASMASYEGRTLVGISSSPGYALAPVFRFARDEVVFDTDAADAAFETDRLDTALQTAWHELEELHDEVWKTSGPARAAIFRAHQEFLHDPEMVAEAKALIGQGRSAGFAWHRVFSDRADMLGAMKDAVLSGRAIDLRDAGQRVLQHLGRVRTGETHLPTAPCILLADDLTPSDTARLDPALVRGLATAQGGPTSHTSIIARALDIPAVAGVGPRLLDLATGTPVLLDGGAGVIVVAPTEADKARAETAMAALTAQRELEARERYKPALTVDGARVEVVANISDVAEAIASVEAGAEGVGLLRTEFLFVNREAPPGEDEQLAIYAAMLSALNGLPIIIRTLDVGGDKEIPYLRMPVEQNPFLGERGIRFCLSHEDLFRTQLRAIYRASAGGQVRIMFPMIAMIEELETARRIAEEVRLEVGAAPVEIGIMIEIPSAVMMAPELAKRVDFFSIGTNDLTQYALAMDRMHPVLAKQADGLHPAVLRLIDSTVRAAEAARIWVGACGGIAGDPVGAAVLSGLGVRELSVSIPAVAGIKAQLRHSAMAENRDLARRALACTTAAEVRGLK

SEQ ID NO: 8297 - protein, 312 aa, Trypanosoma brucei
MEGFYGVEVSAGQKVKPKIPEDHVLRLTQIAVPANASGAITLVISFQGKEFTIATLDPKRSLFQMGIDLVLTAEQGTTLSATGSGSVHLTGYVQPVDDGSDFDEEDDLDEVDAEDMESYGVPPKRGGKSAKFPVSEENSDEANGDGVDGDDESDDEEGIEKDNEGIDAGDEDDNDDDDEAYDEDDSDDDDDDDDDDDDDDDDDDDDEPASKVQRTEQQGFRGGNRGGFRGGDRNGNGGNRGGFRGGDRGGNRGNFRGGDRSGNGGNRGNFRGGDRGGNRGNFRGGDRGGNRGNFRGGNRGNFRGGNSGRCRY

SEQ ID NO: 8298 - protein, 574 aa, Staphylococcus carnosus
MAKQIKGIAASDGVAIAKAYLLVEPDLSFDNESVTDTDAEVAKFNGALNKSKVELTKIRNNAEKQLGADKAAIFDAHLLVLEDPELIQPIEDKIKNESVNAAQALTDVSNQFITIFESMDNEYIAERAKADIRDVSKRVLAHILGVELPNPSIVDESVVIIGNDLTPSDTAQLNKEYVQGFVTNIGGRTSHSAIMSRSLEIPAVVGTKSITEEVEAGDTIVVDGMTGDVLINPSDEVIAEYQEKRENFFKDKQELQKLRDAESVTADGHHVELAANIGTPNDLPGVIENGAEGIGLYRTEFLYMGRDQMPTEEEQFEAYKAVLEAMKGKRVVVRTLDIGGDKELPYLDLPEEMNPFLGYRAIRLCLDQPEIFRPQLRALLRASVFGKLNIMFPMVATIQEFRDAKAFLKKNVLTLKMKAMKVADDIELGIMVEIPSTAALADIFAKEVDFFSIGTNDLIQYTMAADRMSERVSYLYQPYISNFSFLVKQVIEASHAEGKWTGMCGEMAGDQTAIPLLLGLGLDEFSMSATSILKARVLIRSLNESEMKELSERAVQCATSEEVVDLVEEYTKNA

SEQ ID NO: 8299 - protein, 510 aa, Helobdella triserialis
MEMANKKKRLALEDVSNEYDTQKNIGGNKRAKCPSIVQPSLKLPNKLVKPIKTTTTTTTVAVRPKKREAVILGTKKPAVEKQQSATKRRKSCNVDNLVNPIERLTVNLGYKVDESNVAAGVAVATAAAGVAVATAATRRKATAARKTSTTSTAATKTAASNQQQQQQQHPSTKPFNEPIHAEIDSLISSSSPLADHNNDEGDVEIVCVQSSAQLQDIQEQQQHQQQQHQQQQQQQQAWVDVDVGTSIYYLPNYVNDIFDYYRDREVKFRIPDYMFQQTDLTPSMRAILVDWLVEVQQSFELNHETLYMAVKLIDIFSSKVTIKRNKLQLIGAVALNLACKFEERCPPMLDDFVYVCTCLPPTEFLKMEDLVFQAVGFDIGLPLSYTFLRRFATCVGANLKTLTLSRFLLESSLMDYQFVVCLDSILACACLFIAMCMNQDGSWDDTIYHYTQYRPVDFEEVVYKLNDMICNPPEPSLTTILSKYSHPVFLEVAKIDKLTNEQLRAVVHSL

SEQ ID NO: 8300 - protein, 804 aa, Pisum sativum
MASLTHSTSLRQRFDETLTAHRNEILSLLSRIEAKGKGILQHHQIIAEFEEIPEENRQKLVNGVFGEVLRSTQEAIVLVPFVALAVRPRPGVWEYLRVDVHGLVVDELSAAEYLKFKEELVEGSSNENFVLELDFEPFNASIPKPTQNKSIGNGVEFLNRHLSAKLFHGKESLQPLLEFLRLHNHNGKTIMVNDRIQNLNSLQHVLRKAEDYLIKIAPETPYSEFEHKFQEIGLERGWGDTAERVVETIQLLLDLLDGPDPGTLETFLGRIPMVFNVVILSPHGYFAQDNVLGYPDTGGQIVYILDQVRALEEEMLKRIKQQGLDITPRILIITRLLPDAVGTTCGQRLEKVYNTEHCHILRVPFRTEKGIVRKWISRFEVWPYLETFSEDVANELAKELQGKPDLIVGNYSDGNIVASLLAHKLGVTQCTIAHALEKTKYPESDIYWKKFDDKYHFSSQFTADLFAMNHTDFIITSTFQEIAGSKDTVGQYESHTAFTLPGLYRVVHGIDVFDPKFNIVSPGADLSIYFPYTETERRLTSFHPDIEELLYSTVENEEHICVLKDRSKPIIFTMARLDRVKNITGLVECYGKNARLRELVNLVVVAGDRRKESKDLEEIAEMKKMYGLIETYKLNGQFRWISAQMDRIRNGELYRVICDTKGAFVQPAIYEAFGLTVIEAMSCGLPTFATCNGGPAEIIVHGKSGYHIDPYHGDRAAETLVEFFEKSKADPTYWDKISHGGLKRIHEKYTWQIYSDRLLTLTGVYGFWKHVTNLERRESKRYLEMFYALKYSKLAESVPLAVEE

SEQ ID NO: 8301 - protein, 315 aa, Digitalis purpurea
MAEEIRFFKLNTGAKIPSVGLGTWQSSPGDAAQAVEVAIKCGYRHIDGARLYENEKEIGVVLKKLFDDGVVKREDLFITSKLWSTDHAPEDVPVALDKTLEDLQLDYIDLYLIHWPVRLKKGSVGLDPENFIPTDIPGTWKAMEALYDSGKARAIGVSNFTLKKLSDLLDVARIPPAVNQVGCHPSCAQTKLRAFCKSKGVHLSGYSPLGSPGTPWVKHDVLENPILVDVAEKLGKTPAQVAIRWGLQMGHSVLPKSVHESRIKENIDVFSWCIPDDLFAKFSEIEQVSPGKPEFPVHPEISQYKTVEEMWDGGI

SEQ ID NO: 8302 - protein, 315 aa, Digitalis purpurea
MAEEIRFFELNTGAKIPSVGLGTWQSSPGDAAQAVEVAIKCGYRHIDGARLYENEKEIGVVLKKLFDDGVVKREDLFITSKLWSTDHAPEDVPVALDKTLEDLQLDYIDLYLIHWPVRLKKGSVGLDPENFVPTDIPGTWKAMEALYDSGKARAIGVSNFTLKKLSDLLDVARIPPAVNQVGCHPSCAQTKLRAFCKSKGIHLSGYSPLGSPGTPWVKHDVLENPILVDVAEKLGKTPAQVALRWGLQMGHSVLPKSVHESRIKENIDVFSWCIPDVLFAKFSEIEQVSPGKPEFPVHPEISQYKTVEEMWDGGI

SEQ ID NO: 8303 - protein, 254 aa, Oryza sativa (japonica cultivar-group)
MTRRVAGVAAAAAAVAAAVVVLAAASCCEARDFYVGGRDGWTTNPAEPYNRWAERNRFQVNDRLVFRYNKEDSVVVVSQGHYDGCNATDPLLRDAGGDSTFVFDSSGPFFFISGDPARCQAGERLIVVVLAVRGNATATPTTPSPPPPPTVPAAPTPRPSPPPPAAGTNGTARAPSPPVPAPAPAGSPPPPPPPPAGGNFTAPSPAGGMNFTAPAPGTNGTAAPPPRPSSAPSVRGGALLMLLVVATAGAMALV

SEQ ID NO: 8304 - protein, 143 aa, Homo sapiens
MPGLMRMRERYSASKPLKGARIAGCLHMTVETAVLIETLVTLGAEVQWSSCNIFSTQDHAAAAIAKAGIPVYAWKGETDEEYLWCIEQTLYFKDGPLNMILDDGGDLTNLIHTKYPQLLPGIRGISEETTTGVHNLYKMMANG

SEQ ID NO: 8305 - protein, 363 aa, Homo sapiens
MAPAGRPGAKKGILERLESGEVVIGDGSFLITLEKRGYVKAGLWTPEAVIEHPDAVRQLHMEFLRAGSNVMQTFTFSASEDNMESKWEDVNAAACDLAREVAGKGDALVAGGICQTSIYKYQKDEARIKKLFRQQLEVFAWKNVDFLIAEYFEHVEEAVWAVEVLKESDRPVAVTMCIGPEGDMHDITPGECAVRLVKAGASIVGVNCRFGPDTSLKTMELMKEGLEWAGLKAHLMVQPLGFHAPDCGKEGFVDLPEYPFGLESRVATRWDIQKYAREAYNLGVRYIGGCCGFEPYHIRAIAEELAPERGFLPPASEKHGSWGSGLDMHTKPWIRARARREYWENLLPASGRPFCPSLSKPDF

SEQ ID NO: 8306 - protein, 283 aa, Saccharopolyspora spinosa
MESIFDALAHGRPLHHGYWAGGYREDAGATPWSDAADQLTDLFIDKAALRPGAHLFDLGCGNGQPVVRAACASGVRVTGITVNAQHLAAATRLANETGLAGSLEFDLVDGAQLPYPDGFFQAAWAMQSVVQIVDQAAAIREVHRILEPGGRFVLGDIITRVRLPEEYAAVWTGTTAHTLNSFTALVSEAGFEILEVTDLTAQTRCMVSWYVDELLRKLDELAGVEPAAVGTYQQRYLGDIAAKHGPGPAQLIAAVAEYRKHPDYARNEESMGFMLLQARKKQS

SEQ ID NO: 8307 - protein, 609 aa, Pichia pastoris
ETHTWNFTTGFVNANPDGVYERDDVIGLNGQWPLPVLEADKGDRIELYLTNGFEDYNTSLHFHGLFQNGTNSMDGPELITQCPIPPGETMLYNFTVDQVGAYWYHSHTAGQYGDGMRAAFIVHDGSDDDDFPYEYDEEFTFTISEWYHESSVDLIPNFMSRFNPTGAEPIPQNFLFNDTRNFTWNVEPSKTYKVNLINVGGFVSQYLWMEDHTFKVVQVDGVYTQPNETDMIYITVAQRYTVLIETKDDTSRNYALMQRVDDTMLDVIPKDLELNGTNYIVYNESAGLPEEYKVESLDIFLDDFWLEPLEAQEAYPDPDYQIVVDVAMDNLDDGVNYAFFNNLTYVAPKVPVLGTVFSAGEDAINPLVYGSNTNSFVLEKDEVIEIVLNNLDTGKHPFHLHGHVFQTVVRGPDYGEESTPVPYNASEAHDIPENPMRRDTVYVNPQSYFVIRFKADNPGVWFFHCHIEWHLDQGLALVLIEDPLSIQSQQNLDDNWKRMCEVNNMPYVGNAAANTENFLDLTDENVQVKNLPAGFTARGIVALVFSCIAGILGCVAIGLYGLAATDDNPVKLSQDLGIDEEFIQDETSSQLSHNGSKDTTEKTATELLN

SEQ ID NO: 8308 - protein, 771 aa, Emericella nidulans
MPQLDHLYSGCSTCPPLATPPPRLIVVHATMSRTVHNFCTSHKAVSGKPYKHSVVVRIFFPSHFQIPHDKYIRTVTADPSILAHLLGEELYRKLGEYLSRHLEWVHGESMGHTDEALLSFYIREWQRYTTAAKYINHLFRYLNRHWVKREIDEGKKNVYDVYTQHLVKWKEDFFLKVHEKVMGAVLKLVEKQRNGETIEQSRIKSIVDSFVSLGLDETDPTKSTLEIYRYYFQRPFLEATRIYYEDESRQLCGQQRCGDMKKAEIRLEEEKARVGLYLNNDISKDLTSTCLDVLVTAHSELLRDEFQPLLDNERQDDLARMYRLLSRIKDGLDPLRTKFEAHVRRAGLSAVEKVAAEGDSFEPKMYVDALLSVHTRYHSLVKEAFNGESEFVRSLDNACREFVNRNKISKSGSTKTPELLAKYTDSLRKRGSKAAEESELEEMLVQIMTVFKYIEDKDVFQKFYSKMLAKRLVHVSSVSDDAETSMISKLKEACGFEYTNKLQRMFQDIQISKDLNSSYKDWLEKSFMDDDDRKKLVDSHFQILGTGFWPLTAPSTSFLAPPEIVKTSERFQKFYCDKHNRRKLTWLWQLCKGELKANYIKNTKVPYTFLVSTYQMGILLLFNESDTLTYSDIQKATTLTPEILDPNLSIFLKAKVLNISPEGSKPGPDSTFSLNYNFKNKKIKVNLNIQIKSEQKVETDDPHKTIEEDRKLLLQSAIVRIMKSRKKMKHVQLVQEVIHQVKSRFPPQVPDIKKNIEALMEKDYIERLDGD

SEQ ID NO: 8309 - protein, 264 aa, Dianthus caryophyllus
MLNFGATARNGVVSTRRWKSDTCIDLGPSDVRSEAHVLAVDDSLIDRKVIERLLKTTSCKVTVVDSGMRALEFLGLDAEQRTSVVDGLKIDLIITDYCMPGMTGYELLKKIKESSTFKETPVVIMSSENVIARIDRCLEEGAEDFILKPVKLSDVKRLRDYMTNKYDKSNSRVISGTNKRKQMDGSDQSYDSSSSSSSSSSLSLSPISTQSQPLISPSSSTPSSPCGPLDSNSMPSSPSGPSDTPSRRRRMAVDVDDDQTAVMP

SEQ ID NO: 8310 - protein, 1049 aa, Oryza sativa (japonica cultivar-group); identical to SEQ ID NO: 1146

SEQ ID NO: 8311 - protein, 164 aa, Lupinus polyphyllus
MARPQQRYRGFRQRHWGSWVSEIRHSILKTRIWQGTFESAEDAARAYDEAARLMCGTRARTNFPYNPNASQSSSSKLLSATLIAKLHRCYMASLQMTRPSSLPEAPRIIASPNNAVKGIGADAMLLPKKREQEEQETGGNLDFKKVKVECSQQFKPLEEDHIAQ

SEQ ID NO: 8312 - protein, 533 aa, Emericella nidulans
MSILALVEDRPTPREVYNWRVYLLAAVASFTSCMIGYDSAFIGTTLSLQSFQNEFNWESLNTDLISANIVSLYQRGAFFGALFAYPIGHFWGRRWGLMFSALIFFLGAGMMLGANGDRGLGLIYGGRVLAGIGVGAGSNICPIYISEMAPSAIRGRLVGVYELGWQIGGVVGFWINYGVDETLAPSHKQWIIPFAVQLIPAGLLIIGALLIRESPRWLFLRGNREKGIETLAWIRNLPADHIYMVEEINMIEQSLEQQRVKIGLGFWKPFKAAWTNKRILYRLFLGSMLFLWQNGSGINAINYYSPRVFKSIGVSGGNTSLLTTGIFGVVTAVITFVWLLYLIDHFGRRNLLLVGAAGGSVCLWIVGGYIKIAKPENNPEGTQLDSGGIAAIFFFYLWTAFYTPSWNGTPWVINSEMFDPTVRSLAQACAAASNWLWNFLISRFTPQMFTSMGYGVYFFFASLMILSIVFVFFLIPETKGVPLESMETLFDKKPVWHAHSQLIRELRENEEAFRADMGASGKGGVTKEYVEEA

SEQ ID NO: 8313 - protein, 1218 aa, Rattus norvegicus
AVVETLRRGSKFIKWDEEASSRNLVTLRLDPNGFFLYWTGPNMEVDTLDISSIRDTRTGRYARLPKDPKIREVLGFGGPDTRLEEKLMTVVAGPDPVNTTFLNFMAVQDDTVKVWSEELFKLAMNILAQNAPEHVLRKAYTKLKLQVNQDGRIPVKNILKMFSADKKRVETALICGLNFNRSESIRPDEFSLEIFERFLNKLLLRPDIDKILLEIGAKGKPYLTLEQLMDFINQKQRDPRLNEVLYPPLRSSQARLLIEKYEPNKQFLERDQMSMEGFSRYLGGEENGILPLEALDLSMDMTQPLSAYFINSSHNTYLTAGQLAGTSSVEMYRQALLWGCRCVELDVWKGRPPEEEPFITHGFTMTTEVPLRDVLEAIAETAFKTSPYPVILSFENHVDSAKQQAKMAEYCRSIFGEALLIDPLDKYPLSAGTPLPSPQDLMGRILVKNKKRHRPSTGVPDSSVAKRPLEQSNSALSESSAATEPSSPQLGSPSSDSCPGLSNGEEVGLEKTSLEPQKSLGEEGLNRGPNVLMPDRDREDEEEDEEEEETTDPKKPTTDEGTASSEVNATEEMSTLVNYVEPVKFKSFEASRKRNKCFEMSSFVETKAMEQLTKSPMEFVEYNKQQLSRIYPKGTRVDSSNYMPQLFWNVGCQLVALNFQTLDLPMQLNAGVFEYNGRSGYLLKPEFMRRPDKSFDPFTEVIVDGIVANALRVKVISGQFLSDRKVGIYVEVDMFGLPVDTRRKYRTRTSQGNSFNPVWDEEPFDFPKVVLPTLASLRIAAFEEGGRFVGHRILPVSAIRSGYHYVCLRNEANQPLCLPALLIYTEASDYIPDDHQDYAEALINPIKHVSLMDQRAKQLAALIGESEAQASTEMCQETPSQQQGSQLSSNPVPNPLDDSPRWPPGPTTSPTSTSLSSPGQRDDLIASILSEVTPTPLEELRSHKAMVKLRSRQDRDLRELHKKHQRKAVALTRRLLDGLAQARAEGKCRPSSSALSRATNVEDVKEEEKEAARQYREFQNRQVQSLLELREAQADAETERRLEHLKQAQQRLREVVLDAHTTQFKRLKELNEREKKELQKILDRKRNNSISEAKTREKHKKEVELTEINRRHITESVNSIRRLEEAQKQRHERLLAGQQQVLQQLVEEEPKLVAQLTQECQEQRERLPQEIRRCLLGETSEGLGDGPLVACASNGHAAGSGGHQSGADSESQEENTQL

SEQ ID NO: 8314 - protein, 367 aa, Homo sapiens [sequence omitted]

SEQ ID NO: 8315 - protein, 202 aa, Homo sapiens
HEEALGAIVYITEIDPICALQACMDGFRVVKLNEVIRQVDVVITCTGNKNVVTREHLDRMKNSCIVCNMGHSNTEIDVTSLRTPELTWERVRSQVDHVIWPDGKRVVLLAEGRLLNLSCSTVPTFVLSITATTQALALIELYNAPEGRYKQDVYLLPKKMDEYVASLHLPSFDAHLTELTDDQAKYLGLNKNGPFKPNYYRY

SEQ ID NO: 8316 - protein, 322 aa, Homo sapiens
MSLRPRRACAQLLWHPAAGMASWAKGRSYLAPGLLQGQVAIVTGGATGIGKAIVKELLELGSNVVIASRKLERLKSAADELQANLPPTKQARVIPIQCNIRNEEEVNNLVKSTLDTFGKINFLVNNGGGQFLSPAEHISSKGWHAVLETNLTGTFYMCKAVYSSWMKEHGGSIVNIIVPTKAGFPLAVHSGAARAGVYNLTKSLALEWACSGIRINCVAPGVIYSQTAVENYGSWGQSFFEGSFQKIPAKRIGVPEEVSSVVCFLLSPAASFITGQSVDVDGGRSLYTHSYEVPDHDNWPKGAGDLSVVKKMKETFKEKAKL

SEQ ID NO: 8317 - protein, 567 aa, Kluyveromyces lactis
MSNQMTDSTSAGSGTEHSVDTNTALKAGSPNDLKVSHEEDLNDLEKTAEETLQQKPAKEYIFVSLCCVMVAFGGFVFGWDTGTISGFVNQTDFLRRFGQEKADGSHYLSNVRTGLIVSIFNIGCAVGGIVLSNIGDRWGRRIGLITVIIIYVIGIIIQIASVDKWYQYFIGRIISGLGVGGITVLSPMLISETAPKHLRGTLVSCYQLMITFGIFLGYCTNYGTKNYSNSVQWRVPLGLCFAWAIFMVLGMMFVPESARFLVETDQIEEARKSLAKTNKVSIDDPVVKYELLKIQSSIELEKAAGNASWGELITGKPSMFRRTLMGIMIQSLQQLTGDNYFFYYGTTIFQSVGMDDSFETSIVLGIVNFASTFFALYTVDHFGRRNCLLYGCVGMVACYVVYASVGVTRLWPDGPDHPDISSKGAGNCMIVFACFYIFCFATTWAPIAYVVISESYPLRVKGKAMAIASASNWIWGFLIGFFTPFITSAIHFYYGYVFMGCMVFAFFYVYFFVPETKGLTLEEVNEMYSEGVLPWKSSSWVPSSRRGAEYDVDALQHDDKPWYKAML

SEQ ID NO: 8318 - protein, 306 aa, Ricinus communis
MVASIAAGIQFGWALQLSLLTPYVQLLGIPHTWAAFIWLCGPISGMLVQPIVGYHSDRCTSRFGRRRPFIASGAAFVAIAVFLIGYAADLGHLSGDSLDKSPKTRAIAIFVVGFWILDVANNMLQGPCRALLADLSGTSQKKTRTANALFSFFMAVGNVLGYAAGAYTHLYKLFPFTKTTACDVYCANLKSCFFISIVLLLSLTVLALSYVKEKPWSPDQAVDNAEDDTASQASSSAQPMPFFGEILGAFKNLKRPMWILLLVTCLNWIAWFPFLLFDTDWMGREVYGGDSSGSAEQLKLYDRGVR

SEQ ID NO: 8319 - protein, 485 aa, Sphingomonas paucimobilis
MAHFPQTPGFSGTLRPLRIEGDILDIEIEGEVPPQLNGTFHRVHPDAQFPPRFEDDQFFNGDGMVSLFRFHDGKIDFRQRYAQTDKWKVERKAGKSLFGAYRNPLTDDASVQGMIRGTANTNVMVHAGKLYAMKEDSPCLIMDPLTLETEGYTNFDGKLQSQTFCAHPKIDPVTGNLCAFAYGAKGLMTLDMAYIEISPTGKLLKEIPFQNPYYCMMHDFGVTEDYAVFAVMPLLSSWDRLEQRLPFFGFDTTLPCYLGILPRNGDARDLRWFKTGNCFVGHVMNAFNDGTKVHIDMPVSRNNSFPFFDVHGAPFDPVAGQGFLTRWTVDMASNGDSFEKTERLFDRPDEFPRIDERYATRAYRHGWMLILDTEKPYEAPGGAFYALTNTLGHIDLATGKSSSWWAGPRCAIQEPCFIPRSPDAPEGDGYVIALVDDHVANYSDLAIFDAQHVDQGPIARAKLPVRIRQGLHGNWADASRLAVAA

SEQ ID NO: 8320 - protein, 567 aa, Pisum sativum
MSDLEAPLRPKRKKIWVDYFVKFRWILVIFVVLPISFTLYFLTYLGDVRSEWKSFKTRQKEHDENVQKVVNRLKKRNPSKDGLVCTARKPWVAVGMRNVDYKRARHFEVDLSPFRNILDIDKERMIARVEPLVNMGQITRVTVPMNLALAVVAELDDLTVGGLINGYGIEGSSHKYGLFSDTVVAFEIILADGSLVKATKDNEYSDLFYAIPWSQGTLGLLVAAEVKLIPIKEYMKLTYKPVVGNLKDIAQAYSDSFAPRDGDQDNDEKVPDFVETMIYSPTRAVCMTGRYASKEEAKKKGNKINNVGWWYKTWFYQHAETALKKGLFVEYIPTREYYHRHTRCLYWEGKLILPFGDQFWFRFLFGWLMPPKVSLLKATQGEAIRNYYHEMHVIQDMLVPLYKVGDALEWVDREMEVYPIWLCPHKLFKLPIKTMIYPEAGFELQRRQGDTQNAQMFTDVGVYYAPGPVLRGEVFDGAEAVRKMESWMIENHCFQPQYAVSELNEKNFWRMFDAGLYEHCRRKYGAVGTFMSVYYKCKKGRKTEKEVREAEQAHLDTAYAEVDQPAD

SEQ ID NO: 8321 - protein, 360 aa, Rattus norvegicus
MSQERPTFYRQELNKTVWEVPERYQNLSPVGSGAYGSVCAAFDTKTGHRVAVKKLSRPFQSIIHAKRTYRELRLLKHMKHENVIGLLDVFTPARSLEEFNDVYLVTHLMGADLNNIVKCQKLTDDHVQFLIYQILRGLKYIHSADIIHRDLKPSNLAVNEDCELKILDFGLARHTDDEMTGYVATRWYRAPEIMLNWMHYNQTVDIWSVGCIMAELLTGRTLFPGTDHINQLQQIMRLTGTPPAYLINRMPSHEARNYIQSLAQMPKMNFANVFIGANPLAVDLLEKMLVLDSDKRITAAQALAHAYFAQYHDPDDEPVADPYDQSFESRDLLIDEWKSLTYDEVISFVPPPLDQEEMDS

SEQ ID NO: 8322 - protein, 467 aa, Corynebacterium ammoniagenes
MAATESSDQAFGEGAEETPAVKAPAKKTAKKTAKKTAKKTAKKTAKKTAKKTAKKTAAKKTVRKSAAKKATSPAEASAESNDEEALEDQDVRPTADEDQAEVDFDPNAADEDEFGEPDDLEEDEDEEEEEDAGASVWDEDESATLRQARKDAQLTASADSVRAYLKQIGKVALLNAEQEVSLAERIEAGLYAQHRLDEMERLIAEGDAAAKLSPAQKRDLRWIARDGRKAKNHLLEANLRLVVSLAKRYTGRGMAFLDLIQEGNLGLIRAVEKFDYTKGYKFSTYATWWIRQAITRAMADQARTIRIPVHMVEVINKLGRIQRELLQDLGREPTPQELAKEMDITEEKVLEIQQYAREPISLDQTIGDEGDSQLGDFIEDSEAVIAVDAVSFTLLQDQLQDVLTTLSEREAGVVRLRFGLTDGMPRTLDEIGQVYGVTRERIRQIESKTMSKLRHPSRSQVLRDYLD

SEQ ID NO: 8323 - protein, 354 aa, Pisolithus sp. 441
MGCVQSTGVDGDAKARNDEIENQLRRDKMLAKNEIKMLLLGAGESGKSTVLKQMKLIHHGGYNDSERDSYKEIIFSNTIQSMRAILEAMPQLDISLSPQNDARRAVILALPIQIEGDVLPRDVADAIRGLWKDPGVKEAVRRSREFQLNDSAVYYFNAIDRMAAPGYLPTDQDILRSRVKTTGITETTFKVGELTYRLFDVGGQRSERKKWIHCFENVTALVFLVSLSEYDQMLYEDESVNRMQEALTLFDSICNSRWFVKTSIILFLNKIDLFAEKLPTSPLSDYFPDYTGGENYDAACDYLLHRFVALNQNAATKQIYAHYTCATDTQQIKFVLSAIQDILLQIHLRECGLL

SEQ ID NO: 8324 - protein, 602 aa, Rickettsia montanensis
MTKEIDINKLLAQENNALNTILSQVNELCEQNKQLQGLIEIQNETKALEKEYNRSLPWFKRFVNTVSNVKYIFIKSEEQLTNEAIKYNNKILKDIDNKIYNIAEKSVSLKQELQEEIEKNFKDLTKKDLSKDQRERLSEVFFSYKSKPERFSALHMTNPLQFINAEELEKQYNSLNATKQNIQNLISENSNVKELKEIQKQVAEIREEVPYTFFEKLNNIWQNVKNVFVNNSEQVLAKNKESNTRTIRKIDEQLYKTKHKFEELIENKERNINDIIAKLPDNEELQKIVSNLTNHMASTKEPILTNSSLAKPLENNITPPPPLPGNNIPSPPPPPPPLPGNNIPSPPPPPPPLPGNNIPSPPPPPPPLPGNNIPSPPPPPPPLSGNNIPSPPPPPPPLSGNNIPSPPPPPPPLPGNNIPSPPPPPPPLSQNNIPPPPPPPMAPVSAQTEKLSKPVEATTVKKPENQPRPSIDTSDLMREIAGPKKLRKVEETDVKVQDSRDLLLQSIRGEHKLKKVEFDPNTGKPVAHSHSKPVQNVNKLSGVASILARRVVMEMSDSSGSESDSGNWSDVGVNRNTKTLKTKRERRKILNNRNSQKPSFVK

SEQ ID NO: 8325 - protein, 707 aa, Ovis aries
MGMSVPKSCFGYPLSIFFIVVNEFCERFSYYGMRALLILYFQRFLGWNDNLGTAIYHTFVALCYLTPILGALIADSWLGKFKTIVSLSIVYTIGQVVIAVSSINDLTDFNHDGTPNNISVHVALSMIGLVLIALGTGGIKPCVSAFGGDQFEEGQEKQRNRFFSIFYLAINAGSLLSTIITPMLRVQVCGIHSKQACYPLAFGVPAALMAVSLIVFVIGSGMYKKVQPQGNIMSKVARCIGFAIKNRISHRSKKFPKREHWLDWASEKYDERLISQIKMVTRVMFLYIPLPMFWALFDQQGSRWTLQATTMSGKIGIIEIQPDQMQTVNAILIVVMVPIVDAVVYPLIAKCGLNFTSLKKMTVGMFLASMAFVAAAIVQVDIDKTLPVFPKGNEVQIKVLNIGNNSMTVSFPGTTVTCDQMSQTNGFLTFNVDNLSINISSTGTPVTPVTHNFESGHRHTLLVWAPSNYQVVKDGLNQKPEKGRNGIRFVNAFGESFGVTMDGEVYNNVSGHNASEYLFFSSGVKSFTINSPEISQQCEKQFKTSYLEFGSAFTYVISRKSDGCPEPKIFEDISPNTVSMALQIPQYFLLTCGEVVFSITGLEFSYSQAPSNMKSVLQAGWLLTVAVGNIIVLIVAGAGQFSEQWAEYVLFAALLLVVCIIFAIMARFYTYVNPAEIEAQFDEDDKEDDLEKSNPYAKLDFVSQTQM

SEQ ID NO: 8326 - protein, 348 aa, Trypanosoma cruzi
MNRLEVIRKSISYVGLDPAMFKPYPFNVSSSALSELMDCMSYIVFPEFSEPPMNPVTVPEQRLGGSALLQWTLTRMADIINSQIYSALMLQGHTKCSKDEAGIPHSLNAESGSNDDGFTPQNETHAFGEVRSFHLEAKKRAEEITEAFLTRKLRSIRWLLRTDAESILNNDIASNSLSEVVLCYPGLRCMKHQRTAHALHELGAPSIFTRLLTEMAHSTTGIDIHPATSIGHHFFIDHGTGIVIGSTAIIGNYVSIYHGVTLGTRSFPVVAKTGEKVRNLARHPIIEDRVTIYANAMVLGRIRIGKDSVIGSHCLVLKDLPPKSMIRRTSNAKLPTPYITLQKGGSDI

SEQ ID NO: 8327 - protein, 287 aa, Arthrobacter keyseri
MTTETIDTTASETPRLRLLHGHSIPRLGLGTWPMLEDECEAAVRVAVQSGYRLVDTAFQYRNEEAVGRGIRTAGVPRSELFISSKFNKESHSIDGVQRAYDESLRKLGLDHLDMFMCHWPVPALGKYVDAWKGLVKLLEEGRVKAIGVSNFKPSHLKEIIDATGVVPDVNQIQLSPDIARTEPRAVHRLLGTVTEAWSPIGRSSGLRANPIIIEIAQRLNKSPAQILLRWHVQQDIVPIPQASDPLWLTENLSVFDFSLSATEMAAIRQLDKGEGAARDSDLPENGH

SEQ ID NO: 8328 - protein, 1176 aa, Rattus norvegicus
MAKPYEFNWQKEVPSFLQEGAVFDRYEEESFVFEPNCLFKVDEFGFFLTWKSEGKEGQVLECSLINSIRLAAIPKDPKILAALESVGKSENDLEGRILCVCSGTDLVNIGFTYMVAENPEITKQWVEGLRSIIHNFRANNVSPMTCLKKHWMKLAFLTNTSGKIPVRSITRTFASGKTEKVIFQALKELGLPSGKNDEIEPAAFTYEKFYELTQKICPRTDIEDLFKKINGDKTDYLTVDQLVSFLNEHQRDPRLNEILFPFYDAKRAMQIIEMYEPDEELKKKGLISSDGFCRYLMSDENAPVFLDRLELYQEMDHPLAHYFISSSHNTYLTGRQFGGKSSVEMYRQVLLAGCRCVELDCWDGKGEDQEPIITHGKAMCTDILFKDVIQAIKETAFVTSEYPVILSFENHCSKYQQYQMSKYCEDLFGDLLLKQALESHPLEPGRLLPSPNDLKRKILIKNKRLKPEVEKKQLEALKSMMEAGESAAPASILEDDNEEEIESAADQEEEAHPEYKFGNELSADDFSHKEAVANSVKKGLVTVEDEQAWMASYKYVGATTNIHPYLSTMINYAQPVKFQGFHVAEERNIHYNMSSFNESVGLGYLKTHAIEFVNYNKRQMSRIYPKGGRVDSSNYMPQIFWNAGCQMVSLNYQTPDLAMQLNQGKFEYNGSCGYLLKPDFMRRPDRTFDPFSETPVDGVIAATCSVQVISGQFLSDKKIGTYVEVDMYGLPTDTIRKEFRTRMVMNNGLNPVYNEESFVFRKVILPDLAVLRIAVYDDNNKLIGQRILPLDGLQAGYRHISLRNEGNKPLSLPTIFCNIVLKTYVPDGLGDIVDALSDPKKFLSITEKRADQLRAMGIETSDIADVPSDTSKNDKKGKANPAKANVTPQSSSELRPTTTAALGSGQEAKKGIELIPQVRIEDLKQMKAYLKHLKKQQKELNSLKKKHAKEHSTMQKLHCTQVDKIVAQYDKEKSTHEKILEKAMKKKGGSNCLEIKKETEIKIQTLTSDHKSKVKEIVAQHTKEWSEMINTHSAEEQEIRDLHLSQQCELLRKLLINAHEQQTQQLKLSHDRESKEMRAHQAKISMENSKAISQDKSIKNKAERERRVRELNSSNTKKFLEERKRLAMKQSKEMDQLKKVQLEHLEFLEKQNEQAKEMQQMVKLEAEMDRRPATVV

SEQ ID NO: 8329 - protein, 353 aa, Rattus norvegicus
MAAAEAANCIMEVSCGQAESSEKPNAEDMTSKDYYFDSYAHFGIHEEMLKDEVRTLTYRNSMFHNRHLFKDKVVLDVGSGTGILCMFAAKAGARKVIGIECSSISDYAVKIVKANKLDHVVTIIKGKVEEVELPVEKVDIIISEWMGYCLFYESMLNTVLHARDKWLAPDGLIFPDRATLYVTAIEDRQYKDYKIHWWENVYGFDMSCIKDVAIKEPLVDVVDPKQLVTNACLIKEVDIYTVKVEDLTFTSPFCLQVKRNDYVHALVAYFNIEFTRCHKRTGFSTSPESPYTHWKQTVFYMEDYLTVKTGEEIFGTIGMRPNAKNNRDLDFTIDLDFKGQLCELSCSTDYRMR

SEQ ID NO: 8330 - protein, 767 aa, Ectocarpus siliculosus virus
MRGFARMVCFATFAGLFLGCYFASESIYQTLVKSRSDKYELAKAVVITDISDLMVNAVTPSVLTVMFNVFQVSLEDFTLAAETYANRNEIDLLIYSPLVSPNGLTQQEFEEEASNVHGFGVVMTEIVDGELAPITNDNDSQSVSWPIYYRYPENPALIGYDMYTSEEIRTGIDSMVTNKKVDLSDPIIYIDTGESGLVILQPIYDKSNTTAVIGVIARGIRSSIVSTFPGVETFSEMYPLTEIEMFISRDGGAQNIFYDPNPSVSLHEVDVKDRISLELTTDVTLFMYVSDDITLDRSTTYYLTIAFGFFVVVLLATMVEGYRYVIDTAKESKFKSRFIADMSHEIRTPMNGIMGSAELLRDQDLNPVCTEYVSMISSCGTSLLTIIDDVLDMSKIQANMMNIENKQMNTNGTFHDAVHATWAGYTRSPHFKNSVCLNLEISPAATASEVASDSTRIRQIVCNLVSNALKFTDNGSVSVSVDVENGPGEGTAYIRASVTDTGIGMSESAMKKLFQPFSQVHRGRDVGGTGLGLVITQQLVTLMGGKISCDSKAGLGTKFTFCVLAKGTVNSSRNDQPPLLYTFGTFGGAENVQVCPQNACMDTATSIDSHGQSTFDIDMACETGTQPKILVVDDNKVNRLVASKLLQSFGCLTELADHGLQAIEACDVSSYSLIIMDKVMPVMDGVEATKEIRRGNGLNKNTKILFLTATVSTEAILECNRAGGNDFLTKPLSKHLLYDKLTDNLVVKEIAWMRRHIHANRNVNDTN

SEQ ID NO: 8331 - protein, 635 aa, Populus tremula x Populus tremuloides
MITNKKPRSSETDSNYMRDDRTEMSEDDDRSPPSNSITHDSSPTRTCTPGPGSGSSSVPEYLAPYPDQVLENVLENVLWFLTSRKDRNAASLVCRSWYRVEALTRSDLFIGNCYAVSPKRAMSRFTRIRSVTLKGKPRFADFNLMPPYWGAHFAPWVSAMAMTYPWLEKVHLKRMSVTDDDLALLAESFSGFKELVLVCCEGFGTSGLAIVVSRCRQLKVLDLIESDVSDDEVDWISCFPDTETCLESLIFDCVDCPIDFDELERLVARSPSLKKLRLNRYVSIGQLYRLMIRAPHLTHLGTGSFSPSEDVSQVEQGPDYASAFAACKSLVCLSGFREIIPDYLPAINPVCANLTSLNFSFADVSAEQLKPIISNCHKLQIFWVLDSICDEGLQAVAATCKELRELRVFPVDPREDIEGPVSEVGLQAISEGCRKLQSILYFCHRMTNAAVVAMSKNCPDLVVFRLCIMGRHQPDHVTGEPMDEGFGAIVKNCKKLTRLAVSGLLTDRAFAYIGKYGKIVRTLSVAFAGDSDMGLKYVLEGCPRLQKLEIRDSPFGDAALLSGLHHYYNMRFLWMSACKLSRQGCQQITQALPRLVVEVIKHDDNVDMDEYVDTLYMYRSLEGPRDDAPRFVSIL

SEQ ID NO: 8332 - protein, 294 aa, Populus tremula x Populus tremuloides
MDQYEKVEKIGEGTYGVVYKARDRVTNETIALKKIRLEQEDEGVPSTAIREISLLKEMQHGNIVRLQDVVHSEKRLYLVFEYLDLDLKKHMDSSPEFAKDPRLVKTFLYQILRGIAYCHSHRVLHRDLKPQNLLIDRRTNALKLADFGLARAFGIPVRTFTHEVVTLWYRAPEILLGSRHYSTPVDVWSVGCIFAEMVNQKPLFPGDSEIDELFKIFRILGTPNEDTWPGVTSLPDFKSAFPKWPSKDLATVVPTLEKAGVDLLSKMLFLDPTKRITARSALEHEYFKDIGFVP

SEQ ID NO: 8333 - protein, 977 aa, Mus musculus
MPARWLLLLLALLLPPPGPGSFGRTSTVTLPETLLFVSTLDGSLHAVSKRTGSIKWTLKEDPVLQVPTHVEEPAFLPDPNDGSLYTLGGKNNEGLTKLPFTIPELVQASPCRSSDGILYMGKKQDIWYVIDLLTGEKQQTLSSAFADSLCPSTSLLYLGRTEYTITMYDTKTRELRWNATYFDYAASLPEDDVDYKMSHFVSNGDGLVVTVDSESGDVLWIQNYASPVVAFYVWQGEVLRKVVHINVAVETLRYLTFMSGEVGRITKWKYPFPKETEAKSKLTPTLYVGKYSTSLYASPSMVHEGVAVVPRGSTLPLLEGPQTDGVTIGDKGECVITPSTDLKFDPGLKGKSKLNYLRNYWLLIGHHETPLSASTKMLERFPNNLPKHRENVIPADSEKRSFEEVINIVGQTSDNTPTTVSQDVEEKLARAPAKPEAPVDSMLKDMATIILSTFLLVGWVAFIITYPLSVHQQRQLQHQQFQKELEKIQLLQQQQLPFHPHGDLTQDPEFLDSSGPFSESSGTSSPSPSPRASNHSLHPSSSASRAGTSPSLEQDDEDEETRMVIVGKISFCPKDVLGHGAEGTIVYKGMFDNRDVAVKRILPECFSFADREVQLLRESDEHPNVIRYFCTEKDRQFQYIAIELCAATLQEYVEQKDFAHLGLEPITLLHQTTSGLAHLHSLNIVHRDLKPHNILLSMPNAHGRIKAMISDFGLCKKLAVGRHSFSRRSGVPGTEGWIAPEMLSEDCKDNPTYTVDIFSAGCVFYYVISEGNHPFGKSLQRQANILLGACNLDCFHSDKHEDVIARELIEKMIAMDPQQRPSAKHVLKHPFFWSLEKQLQFFQDVSDRIEKEALDGPIVRQLERGGRAVVKMDWRENITVPLQTDLRKFRTYKGGSVRDLLRAMRNKKHHYRELPVEVQETLGSIPDDFVRYFTSRFPHLLSHTYQAMELCRHERLFQTYYWHEPTEPQPPVIPYAL

SEQ ID NO: 8334 - protein, 112 aa, Azospirillum brasilense
MKLVMAIIKPFKLDEVREALTSLGIQGLTVSEVKGFGRQKGQTEIYRGAEYSVSFLPKVKVEVAVSDDQYEQVVEAIQKAANTGRIGDGKIFVLDIAQAVRIRTGETNTEAL

SEQ ID NO: 8335 - protein, 303 aa, Xenopus laevis
MSSTGDEIIRIAKKMDRMVQKKNTVGALDLLKELKNLPMTLELLQSTRIGMSVNAIRKQSGEEDVTSLAKALIKSWKKLLDGPSADMEEKKKDQPAPAQNSPEPKEENSSSTNFAAQKDEFPAPSDGFITSFPKAPITSDSVRIKCRELLAAALKTGDDHIAIGANVDELGAQIEDAVFQEFKNTEAKYKNRIRSRIANLKDAKNPNLRRNVLCGNIAPDFFARMTAEEMASDELKEMRKNLTKEAIREHQMAKTGGTETDLFSCGKCKKKNCTYTQVQTRSADEPMTTFVFCNECGNRWKFC

SEQ ID NO: 8336 - protein, 464 aa, Listeria monocytogenes
MLYSKENKESYLEPVFGSSAEDRDIPKYTLGKEPLEPRIAYRLVKDELLDEGSARQNLATFCQTYMEDEATKLMSETLEKNAIDKSEYPRTAELENRCVNIIADLWHAPKDQKFMGTSTIGSSEACMLGGMAMKFAWRKRAEKLGLDIYAKKPNLVISSGYQVCWEKFCVYWDIDMRVVPMDKEHMQLNTDQVLDYVDEYTIGVVGILGITYTGRYDDIYALNEKLEEYNSKTDYKVYIHVDAASGGFFTPFVEPDIIWDLRLKNVISINTSGHKYGLVYPGIGWVLWKDESYLPEELIFKVSYLGGEMPTMQINFSRSASHIIGQYYNFLRYGFEGYRTIHQKTSDVAQYLAHAVEQTGYFDIFNDGSHLPIVRYKLKDDANVNWTLYDLADRLQMRGWQVPAYPLPKSLENIIIQRYVCRADLGFNMAEEFIQDFQASIQELNNAHILFHDTQQSGVHGFTH

SEQ ID NO: 8337 - protein, 187 aa, Haloarcula marismortui
MATGPRYKVPMRRRREARTDYHQRLRLLKSGKPRLVARKSNKHVRAQLVTLGPNGDDTLASAHSSDLAEYGWEAPTGNMPSAYLTGLLAGLRAQEAGVEEAVLDIGLNSPTPGSKVFAIQEGAIDAGLDIPHNDDVLADWQRTRGAHIAEYDEQLEEPLYSGDFDAADLPEHFDELRETLLDGDIEL

SEQ ID NO: 8338 - protein, 195 aa, Methanococcus vannielii
MIMAQNAKHRVPFRRRREGKTDFRQRLGLLLSGKPRLVARKSLNNIIAQLMAYDEKGDIVLVSAHSRELVKMGYKGHCGNLPAAYLTGLLLGKKAVEEGLEEAILDKGLHRATKGAAIFAVLKGALDAGMDIPCGEEIIADEERLNGTHIKQYAELLKEDEEAYKKQFSKYLEKGLNPEDLPEHFEELKGKILNL

SEQ ID NO: 8339 - protein, 150 aa, Entamoeba dispar
MFSASDTPQQDHNAQQDKWKSQPVDSLSLPVANTIRVMRKSVSMPNGSAVRISKDAQEYMTELATEFLSFIASEAADVPKGSVKSKHTLTGADVIDALDRLGFEDYCPSLQKHLNHFRQVNAQDDGYEPRKEFYESHISMNDEFPPQPPC

SEQ ID NO: 8340 - protein, 194 aa, Medicago sativa
MTLIAKPNVFNGLNFNINETQIPFSSFSVIRKRFGDSSHRNVVLRSNGNASVLPKIRAQNLPDYVPESKFYKVEAILRPWRIPQVSSGLLKMGIRGVTVSDVKGFGAQGGSKERQGGSEFSEDNFVAKVKMEIVVRKDQVEAVINKIMETARTGEIGDGKIFLIPVSDVIRIRTGERGEQAERMAGGLTDALYV

SEQ ID NO: 8341 - protein, 464 aa, Mus musculus
MGRKKKKQLKPWCWYCNRDFDDEKILIQHQKAKHFKCHICHKKLYTGPGLAIHCMQVHKETIDAVPNAIPGRTDIELEIYGMEGIPEKDMDERRRLLEQKTQESQKKKQQDDSDEYDDDESAASTSFQPQPVQPQQGYIPPMAQPGLPPVPGAPGMPPGIPPLMPGVPPLMPGMPPVMPGMPPGLHHQRKYTQSFCGENIMMPMGGMMPPGPGIPPLMPGMPPGMPPPVPRPGIPPMTQAQAVSAPGILNRPPAPTAAVPAPQPPVTKPLFPSAGQAQAAVQGPVGTDFKPLNSTPAATTTEPPKPTFPAYTQSTASTTSTTNSTAAKPAASITSKPATLTTTSATSKLIHPDEDISLEERRAQLPKYQRNLPRPGQTPIGNPPVGPIGGMMPPQPGLPQQQAMRPPMPPHGQYGGHHQGMPGYLPGAMPPYGQGPPMVPPYQGGPPRPPMGMRPPVMSQGGRY

SEQ ID NO: 8342 - protein, 746 aa, Mus musculus
MGQTGKKSEKGPVCWRKRVKSEYMRLRQLKRFRRADEVKTMFSSNRQKILERTETLNQEWKQRRIQPVHIMTSVSSLRGTRECSVTSDLDFPAQVIPLKTLNAVASVPIMYSWSPLQQNFMVEDETVLHNIPYMGDEVLDQDGTFIEELIKNYDGKVHGDRECGFINDEIFVELVNALGQYNDDDDDDDGDDPDEREEKQKDLEDNRDDKETCPPRKFPADKIFEAISSMFPDKGTAEELKEKYKELTEQQLPGALPPECTPNIDGPNAKSVQREQSLHSFHTLFCRRCFKYDCFLHPFHATPNTYKRKNTETALDNKPCGPQCYQHLEGAKEFAAALTAERIKTPPKRPGGRRRGRLPNNSSRPSTPTISVLESKDTDSDREAGTETGGENNDKEEEEKKDETSSSSEANSRCQTPIKMKPNIEPPENVEWSGAEASMFRVLIGTYYDNFCAIARLIGTKTCRQVYEFRVKESSIIAPVPTEDVDTPPRKKKRKHRLWAAHCRKIQLKKDGSSNHVYNYQPCDHPRQPCDSSCPCVIAQNFCEKFCQCSSECQNRFPGCRCKAQCNTKQCPCYLAVRECDPDLCLTCGAADHWDSKNVSCKNCSIQRGSKKHLLLAPSDVAGWGIFIKDPVQKNEFISEYCGEIISQDEADRRGKVYDKYMCSFLFNLNNDFVVDATRKGNKIRFANHSVNPNCYAKVMMVNGDHRIGIFAKRAIQTGEELFFDYRYSQADALKYVGIEREMEIP

SEQ ID NO: 8343 - protein, 348 aa, Mus musculus
GYMLFNERMLESYLHAKKYLKPSGNMFPTIGDVHLAPFTDEQLYMEQFTKANFWYQPSFHGVDLSALRGAAVDEYFRQPVVDTFDIRILMAKSVKYTVNFLEAKEGDLHRIEIPFKFHMLHSGLVHGLAFWFDVAFIGSIMTVWLSTAPTEPLTHWYQVRCLFQSPLFAKAGDTLSGTCLLIANKRQSYDISIVAQVDQTGSKSSNLLDLKNPFFRYTGTTPSPPPGSHYTSPSENMWNTGSTYNLSSGVAVAGMPTAYDLSSVIAGGSSVGHNNLIPLANTGIVNHTHSRMGSIMSTGIVQGSSGAQGGGGSSSAHYAVNNQFTMGGPAISMASPMSIPTNTMHYGS

SEQ ID NO: 8344 - protein, 257 aa, Mus musculus
MYEQLKDEWNRKSPNLSKCGEELGRLKLVLLELNFLPTTGTKLTKQQLILARDILEIGAQWSILCKDIPSFERYMAQLKCYYFDYKEQLPESAYMHQLLGLNLLFLLSQNRVAEFHTELERLPAKDIQTNVYIKHPVSLEQYLMEGSYNKVFLAKGNIPAESYTFFIDILLDTIRDEIAGCIEKAYEKILFAEATRILFFSTPKKMTDYAKKRGWVLGPNNYYSFASQQQKPEDSTIPSTELAKQVIEYARQLEMIV

SEQ ID NO: 8345 - protein, 296 aa, Xenopus laevis
MGFVKVVKNKAYFKRYQVKFRRRREGKTDYYARKRLVIQDKNKYNTPKYRMIVRVTNRDIICQIAYARIEGDMIVCAAYAHELPKYGIKVGLTNYAAAYCTGLLLARRLLNKFGLDKVYEGQVEVTGDEYNVESIDGEPGAFTCYLDAGLTRTTTGNKVFGALKGAVDGGLSIPHSTKRFPGYDSESKEFNPEVHRKHIFAQNVAEYMRLLMEEDEDAYKKQFSQYIKNGVTADQVEDLYKKAHAGIRENPVHEKKPKKEVKKKRWNRAKLSLEQKKDRVAQKKASFLRAQEKADS

SEQ ID NO: 8346 - protein, 296 aa, Xenopus laevis
MGFVKVVKNKAYFKRYQVKFRRRREGKTDYYARKRLVIQDKNKYNTPKYRMIVRVTNRDIICQIAYARIEGDMIVCAAYAHELPKYGVKVGLTNYAAAYCTGLLLARRLLNKFGLDKVYEGQVEVTGDEYNVESVDGEPGAFTCYLDAGLTRTTTGNKVFGALKGAVDGGLSIPHSTKRFPGYDSESKEFNPEVHRKHIFAQNIAEYMRLLMEEDEDAYKKQFSQYIKNGVAADQLEDIYKKAHAGIRENPVHEKKPKKEVKKKRWNRAKLSLEQKKDRVAQKKASFLRAQEKADS

SEQ ID NO: 8347 - protein, 297 aa, Gallus gallus
MGFVKVVKNKAYFKRYQVKFRRRREGKTDYYARKRLVIQDKNKYNTPKYRMIVRVTNRDIICQIAYARIEGDMIVCAAYAHELPKYGVKVGLTNYAAAYCTGLLLARRLLNKFGLDKIYEGQVEVTGDEYNVESVDGKPGAFTCYLDAGLARTTTGNKVFGALKGAVDGGLSIPHSTKRFPGYDSESKEFNAEVHRKHIMGQNVADYMRYLMEEDEDAYKKQFSQYIKNNITPDGMEEMYKKAHAAIRDNPVHEKKPKREVKKKRVNSTKMSLAQKKDRVAQKKASFLRAQERAADS

SEQ ID NO: 8348 - protein, 297 aa, Saccharomyces cerevisiae
MAFQKDAKSSAYSSRFQTPFRRRREGKTDYYQRKRLVTQHKAKYNTPKYRLVVRFTNKDIICQIISSTITGDVVLAAAYSHELPRYGITHGLTNWAAAYATGLLIARRTLQRLGLDETYKGVEEVEGEYELTEAVEDGPRPFKVFLDIGLQRTTTGARVFGALKGASDGGLYVPHSENRFPGWDFETEEIDPELLRSYIFGGHVSQYMEELADDDEERFSELFKGYLADDIDADSLEDIYTSAHEAIRADPAFKPTEKKFTKEQYAAESKKYRQTKLSKEERAARVAAKIAALAGQQ

SEQ ID NO: 8349 - protein, 305 aa, Dictyostelium discoideum
MSGAGSKRKKLFIEKATKLFTTYDKMIVAEADFVGSSQLQKIRKSIRGIGAVLMGKKTMIRKVIRDLADSKPELDALNTYLKQNTCIIFCKDNIAEVKRVINTQRVGAPAKAGVFAPNDVIIPAGPTGMEPTQTSFLQDLKIATKINRGQIDIVNEVHIIKTGQKVGASEATLLQKLNIKPFTYGLEPKIIYDAGACYSPSISEEDLINKFKQGIFNIAAISLEIGYPTVASIPHSVMNAFKNLLAISFETSYTFDAAEKFKSAAAAAPVRAAPSAAAPRAAAKKVVVEEKKEESDDDMGMGLFD

SEQ ID NO: 8350 - protein, 352 aa, Halobacterium salinarum
MSAEEQRTTEEVPEWKRQEVAELVDLLETYDSVGVVNVTGIPSKQLQDMRRGLHGQAAVRMSRNTLLVRALEEAGDGLDTLTEYVEGEVGLVATNDNPFGLYQQLENSKTPAPINAGEVAPNDIVVPEGDTGIDPGPFVGELQTIGANARIQEGSIQVLDDSVVTEEGETVSDDVSNVLSELGIEPKEVGLDLRGVFSEGVLFTPEELEIDVDEYRADIQSAAASARNLSVNAAYPTERTAPDLIAKGRGEAKSLGLQASVESPDLADDLVSKADAQVRALAAQIDDEDALPEELQDVDAPAAPAGGEADTTADEQSDETQASEADDADDSDDDDDDDDGNAGAEGLGEMFG

SEQ ID NO: 8351 - protein, 348 aa, Haloarcula marismortui
MSAESERKTETIPEWKQEEVDAIVEMIESYESVGVVNIAGIPSRQLQDMRRDLHGTAELRVSRNTLLERALDDVDDGLEDLNGYITGQVGLIGTDDNPFSLFQELEASKTPAPIGAGEVAPNDIVIPEGDTGVDPGPFVGELQSVGADARIQEGSIQVLSDSTVLDTGEEVSQELSNVLNELGIEPKEVGLDLRAVFADGVLFEPEELELDIDEYRSDIQAAAGRAFNLSVNADYPTATTAPTMLQSDRGNAKSLALQAAIEDPEVVPDLVSKADAQVRALASQIDDEEALPEELQGVEADVATEEPTDDQDDDTASEDDADADDAAEEADDDDDDDEDAGDALGAMF

SEQ ID NO: 8352 - protein, 336 aa, Methanococcus vannielii
MIDAKSEHKIAPWKIEEVNALKELLKSANVIALIDMMEVPAVQLQEIRDKIRDQMTLKMSRNTLIKRAVEEVAEETGNPEFAKLVDYLDKGAAIVVTEMNPFKLFKTLEESKSPAPIKGGAIAPCDIEVKSGSTGMPPGPFLSELKAVGIPAAIDKGKIGIKEDKVVAKEGDVISPKLAVVLSALGIKPVTVGLNVLGVYEEGVIYTSDVLRIDEEEFLGKLQKAYTNAFNLSVNAVIPTSATIETIVQKAFNDAKAVSVESAFITEKTADAILGKAHAQMIAVAKLAGDEALDDDLKEQISSSAVVATEEAPKAETKKEEKKEEAAPAAGLGLLF

SEQ ID NO: 8353 - protein, 312 aa, Saccharomyces cerevisiae
MGGIREKKAEYFAKLREYLEEYKSLFVVGVDNVSSQQMHEVRKELRGRAVVLMGKNTMVRRAIRGFLSDLPDFEKLLPFVKGYVGFVFTNEPLTEIKNVIVSNRVAAPARAGAVAPEDIWVRAVNTGMEPGKTSFFQALGVPTKIARGTIEIVSDVKVVDAGNKVGQSEASLLNLLNISPFTFGLTVVQVYDNGQVFPSSILDITDEELVSHFVSAVSTIASISLAIGYPTLPSVGHTLINNYKDLLAVAIAASYHYPEIEDLVDRIENPEKYAAAAPAATSAASGDAAPAEEAAAEEEEESDDDMGFGLFD

SEQ ID NO: 8354 - protein, 496 aa, Nicotiana tabacum
MVLSKTASESDVSIHSTFASRYVRTSLPRFKMPENSIPKEAAYQIINDELMLDGNPRLNLASFVTTWMEPECNKLMMDSINKNYVDMGEYPVTTELQNRCVNMIAHLFNAPLGDGETAVGVGTVGSSEAIMLAGLAFKRKWQNKMKAQGKPCDKPNIVTGANVQVCWEKFARYFEVELKEVKLSDGYYVMDPEKAVEMVDENTICVAAILGSTLNGEFEDVKRLNDLLIEKNKETGWDTPIHVDAASGGFIAPFLYPELEWDFRLPLVKSINVSGHKYGLVYAGIGWAIWRNKEDLPDELIFHINYLGADQPTFTLNFSKGSSQVIAQYYQLIRLGFEGYKNVMENCQENARVLREGLEKSGRFNIISKEIGVPLVAFSLKDNSQHNEFEISETLRRFGWIIPAYTMPPNAQHVTVLRVVIREDFSRTLAERLVIDIEKVLHELDTLPARVNAKLAVAEANGSGVHKKTDREVQLEITAAWKKFVADKKKKTNGVC

SEQ ID NO: 8355 - protein, 264 aa, Solanum tuberosum
MAELREKWSLKGTTALVTGGSKGIGYAIVEELANFGARVYTCSRNENELQECLDIWRKKGLKVEGSVCDLLSRTEREKLMKTVEDVFDGKLNILVNNAGVAIHKEAKDFTKEDYNIIMGTNFEAAYHLSQIAYPLLKASQNGNVIFVSSIAGFSALPSLSLYSASKGAINQMTKNLACEWAKDNIRVNSVAPAVILTPLVETAIKKNPQQKEEIDSFVVKTPLGRAGKPEEASAVIAFLCFPAASYITGQIIWADGGFTANGGF

SEQ ID NO: 8356 - protein, 446 aa, Streptococcus thermophilus
MTSIGLNITSFELALLFMLLFVAFYFIFLAYRDYQQVKNIRKLTKRVKSLMAGNYNEKLCIKGDSELLELANSLNDLSDVFRLTHENLIQEKNRLSSVLSYMSDGVIATNRLGQITMINSTAQRLLNLDRETATQMSILDILDGENPYTYSELLSKTPEIHLSRRDANDEFVTLRVNFALIRKESGFISGLVAVLHDATEQEKEERERRLFVSNVSHELRTPLTSVKSYLEALDDGALNEEIAPNFIKVSLDETNRMMRMISDLLALSRIDNKSTQLNVEMTNFTAFMTYILNRFGQIKSQETNPGKSYEIIRDYPVNSIWVEIDTDKMTQVIDNILNNAIKYSPDGGKITVSMKTTDTQLIVSISDQGLGIPKKDLPLIFDRFYRVDKARSRAQGGTGLGLSIAKEIVKQHNGFIWAKSEYGKGSTFTIVLPYDQDAMMVDEWEM

SEQ ID NO: 8357 - protein, 1274 aa, Oryza sativa (japonica cultivar-group); identical to SEQ ID NO: 3161

SEQ ID NO: 8358 - protein, 233 aa, Spinacia oleracea
CVAQTSEWEQEGSTNAVLEGESDPEGAVSWGSETQVSDEGGVEGGQGFSEPPEEAKLFVGNLPYDVDSEKLAGIFDAAGVVEIAEVIYNRETDRSRGFGFVTMSTVEEAEKAVELLNGYDMDGRQLTVNKAAPRGSPERAPRGDFEPSCRVYVGNLPWDVDTSRLEQLFSEHGKVVSARVVSDRETGRSRGFGFVTMSSESEVNDAIAALDGQTLDGRAVRVNVAEERPRRAF

SEQ ID NO: 8359 - protein, 490 aa, Sphingomonas paucimobilis
MAHFPDTSGMTGVLRPLRIEGDILDLEVEGEIPAQLDGTFHRVHPDAQFPPRFEDDQFFNGDGMVSLFRFHDGKIDFRQRYAQTDKWKVERKAGKSLFGAYRNPLTDDASVQGMIRGTANTNVMVHAGKLYAMKEDSPCLIMDPLTLETEGYTNFDGKLKNQTFSAHAKIDPVTGNFCNFGYAATGLLTTDCSYFEIDPAGNLLFETEFQVPYYCMMHDYGLTEHYAIFHIVPCSPNWDRLKAGLPHFGFDTTLPVWLGVVPRGPGVTNKDVRWFKAPKTIFASHVMNAFEEGSKIHFDTPQAENNAFPFFPDIHGAPFDPVAARPYLHRWTVDLGSNSEDFAEVRQLTSWIDEFPRVDARYVGQPYRHGWGLVMDPEMEMEFARGRASGFKMNRIGHWDHATGKEDSWWCGPQSIIQEPCFVPRMADSAEGDGYIIALVDNLITNYSDLVVLDALNLKDGPIGRAKLPIRLRSGLHGNWADASKLPIAA

SEQ ID NO: 8360 - protein, 321 aa, Mucor mucedo
MSTDYLTLNRTGDKMPIRGFGCWKIDTKDCEETVYQAIKTGYRLFDGACDYGNEVEVGRGINKAINEGLVKREDLFIVTKLWNTFHSKKHVRALFDRQLKDTGLEYFDLYLIHFPVPLQYVDPATVYPPGWYVGDAKSLQFEQSPIHECWAELEKIVDAGLARNIGVANFNCQAILDLLTYARIKPAVLQIELHPYLPQERLVKWVKEQGIQITAYSSFGPTSYVDLTESGKTYTSLLEHASVKSVADKHNVSTGQVLLRWALDREFAVIPKSVNAGRMKANLEILDIKLDAEDNKTLDSLKTNQRFNDPMTYGFGLPLFD

SEQ ID NO: 8361 - protein, 342 aa, Schistocerca americana
MVNMDRENDHGEPEHVRKLFIGGLDYRTTDESLKQHFEQWGEIVDVVVMKDPKTKRSRGFGFITYSRAHMVDDAQNARPHKVDGRVVEPKRAVPRTEIGRPEAGATVKKLFVGGIKEEMEENDLRDYFKQYGTVVSAAIVVDKETRKKRGFAFVEFDDYDPVDKICLSRNHQIRGKHIDVKKALPKGDAPGGRGGGGRGGVGGGAGGGWGGGRGDWGGSAGGGGGGGWGGADPWENGRGGGGDRWGGGGGGMGGGDRWGGGGGMGGGDRYGGGGGRSGGWSNDGYNSGPQSDGFGGGYKQSYGGGAVRGSSGYGGSRSAPYSDRGSRGGGGGGYGSGGGRRY

SEQ ID NO: 8362 - protein, 284 aa, Citrobacter freundii
MTKEMQNLALAPVGNLESYIRAANAWPMLSADEERALAEKLHYQGDLEAAKTLILSHLRFVVHVARNYAGYGLRQADLIQEGNIGLMKAVRRFNPEVGVRLVSFAVHWIKAEIHEYVLRNWRIVKVATTKAQRKLFFNLRKTKQRLGWFNQDEVEMVARELGVSSKDVREMESRMAAQDMTFDMSSDDESDSQPMAPVLYLQDKSSNFADGIEEDNWEDQAANKLTHAMEGLDERSQDIIRARWLDEDNKSTLQELADRYGVSAERVRQLEKNAMKKLRAAIEA

SEQ ID NO: 8363 - protein, 615 aa, Salmonella typhi
MEQNPQSQLKLLVTRGKEQGYLTYAEVNDHLPEDIVDSDQIEDIIQMINDMGIQVMEEAPDADDLLLAENTTSTDEDAEEAAAQVLSSVESEIGRTTDPVRMYMREMGTVELLTREGEIDIAKRIEDGINQVQCSVAEYPEAITYLLEQYDRVEAEEARLSDLITGFVDPNAEEEMAPTATHVGSELSQEDLDDDEDEDEEDGDDDAADDDNSIDPELAREKFAELRAQYVVTRDTIKAKGRSHAAAQEEILKLSEVFKQFRLVPKQFDYLVNSMRVMMDRVRTQERLIMKLCVEQCKMPKKNFITLFTGNETSETWFNAAIAMNKPWSEKLHDVAEEVQRCLQKLRQIEEETGLTIEQVKDINRRMSIGEAKARRAKKEMVEANLRLVISIAKKYTNRGLQFLDLIQEGNIGLMKAVDKFEYRRGYKFSTYATWWIRQAITRSIADQARTIRIPVHMIETINKLNRISRQMLQEMGREPTPEELAERMLMPEDKIRKVLKIAKEPISMETPIGDDEDSHLGDFIEDTTLELPLDSATTESLRAATHDVLAGLTAREAKVLRMRFGIDMNTDHTLEEVGKQFDVTRERIRQIEAKALRKLRHPSRSEVLRSFLDD

SEQ ID NO: 8364 - protein, 708 aa, Myxococcus xanthus
MPTQKPSKASVKPTKKKVDPVIRKKKAPDGAAAKGAKTGAEEKEELVARDVVAEATEKLKKKKKGVAPAMGDDVDPEEAAEEAAAAVQVDPDAVEDDIEEDPVAERKEVKDLLAAGREKGFLTYDEVNDALPADIVSSDQIDDVMSMFGDNDIEIVDAQKAAQNNEIKPTVTVEEEKEDADEDEKDEDDEPGGKSNDPVRLYLRKMGSVSLLTREGEVEIAKRIEDGEKEVLRALLACKVAVEEILDIGNKLKTAKLRVRDVIKDAPEETQSEGAEEAPEEVGEGDAPAQLAQSELNKIEQICKQIERFRKFAQDCDVLEEELSSKKKLTEVRKKEVKQEIKDLRTKMMEVLEEMRLNKKQVDRIVINLKALIERVDKAEDELRDLERRYDCSMKELRPQLKESRENPNIGKKLQKQLNLTPEQLEVLDRDVRTAVRKIKKVEEEANLPVESLRRNYDAIRLGERRAERAKSELVEANLRLVVSIAKKYTNRGLQFLDLIQEGNIGLMKAVDKFEYKRGYKFSTYATWWIRQAITRAIADQARTIRIPVHMIETINKLIRTSRYLVQEIGREPTPEEIAEKMELPLDKVRKVLKIAKEPISLETPIGEEEDSHLGDFIEDKSLVSPADAVINMNLAEQTRKVLATLTPREEKVLRMRFGIGEKSDHTLEEVGQDFEVTRERIRQIEAKALRKLRHPSRSKRLRSFVES

SEQ ID NO: 8365 - protein, 507 aa, Triticum aestivum
MEVQAGSHADAAASKFTLPVDSEHKAKSFRLFSFANPHMRTFHLSWISFFTCFVSTFAAAPLVPIIRDNLNLAKADIGNAGVASVSGSIFSRLAMGAICDLLGPRYGCAFLVMLSAPTVFCMAVIDDASGYIAVRFLIGFSLATFVSCQYWMSTMFNSKIIGTVNGLAAGWGNMGGGATQLIMPLVFHAIQKCGATPFVAWRIAYFVPGMMHIVMGLLVLTMGQDLPDGNLASLQKKGDMAKDKFSKVLWGAVTNYRTWIFVLLYGYCMGVELTTDNVIAEYYYDHFHLDLRAAGTIAACFGMANIVARPMGGYLSDLGARYFGMRARLWNIWILQTAGGAFCIWLGRASALPASVTAMVLFSICAQAACGAVFGVAPFVSRRSLGIISGLTGAGGNVGAGLTQLLFFTSSQYSTGRGLEYMGIMIMACTLPVALVHFPQWGSMFFPASADATEEEYYASEWSEEEKNKGLHIAGQKFAENSRSERGRRNVILATSATPPNNTPQHV

SEQ ID NO: 8366 - protein, 345 aa, Gossypium hirsutum
MENSTQESHLRSDNSVTYESAYTVYAMALSSTPSSTNINHQRIALGSFLEDYTNRVDIISFDPETLSFKTHPKLAFDHPYPPTKLMFQPNRKSASSSSSCSDLLASTGDFLRLWEVRESSIEPVTVLNNSKTSEFCAPLTSFDWNDVEPKRIGTSSIDTTCTIWDIEKCVVETQLIAHDKEVYDIAWGEARVFASVSADGSVRIFDLRDKEHSTIIYESPQPDTPLLRLAWNKQDLKYMATIQMDSNKVVILDIRSPTTPVAELERHHASVNAIAWAPQSCKHICSAGDDTQALIWELPTVAGPNGIDPLCVYSAGYEINQLQWSRAQPDWIAIAFSNKLQLLKV

SEQ ID NO: 8367 - protein, 309 aa, Gossypium hirsutum
MGRSPCCEKVGLKKGPWTPEEDQKLLAYIEQHGHGSWRALPLKAGLQRCGKSCRLRWINYLRPDIKRGKFSLQEEQTIIQLHALLGNRWSAIATHLPKRTDNEIKNYWNTHLKKRLTKMGIDPVTHKPKTDALGSTTGNPIDAANLSHMAQWESARLEAEARLVRESKLVPSNPPQSNHFTAVAPSPTPATRPQCLDVLKAWQGVVCGLFTFNMDNNNLQSPTSTLNFMENTTTLPMSSSSSVNGMFNENFGWNSSINPCESGDILKVEYGSDQIPELKERLDHPMELHEMDCSSEGTWFQELFGFNGL

SEQ ID NO: 8368 - protein, 314 aa, Gossypium hirsutum
MNWSVRRDKKYRLAIASLLEHYNNRLEIVQLDDSNGEIRSDPNLSFDHPYPPTKTIFIPDKECQKPDLLATSSDFLRIWRISDDHSRVDLKSLLNGNKNSEFCGPLTSFDWNEAEPKRIGTSSIDTTCTIWDIERETVDTQLIAHDKEVYDIAWGGVGVFASVSADGSVRVFDLRDKEHSTIIYESSEPDTPLVRLGWNKQDPRYMATIIMDSAKVVVLDIRFPTLTVVELQRHQASVNAIAWAPHSSCHICTAGDDSQALIWDLSSMSQPVEGGLDPILAYTAGAEIEQLQWSSSQPDWVAIAFSTKLQILRV

SEQ ID NO: 8369 - protein, 317 aa, Streptomyces aureofaciens
MPPPRTRGAESGGAGPSADLFRQYLREIGRIPLLTAAEEVDLARRVEAGLFAEEKLGGAADLDSQLAVDLDRLVVMGRMAKRRLIESNLRLVVSVAKRYVGRGLTMLDLVQEGNLGLIRAVEKFDYARGYKFSTYATWWIRQAMSRALADQARTIRVPVHVVELINRVVRVQRRMLQERGYEPTAEEVAVHLELTPERVLEVLRLAQEPVSLHAPVGEEDDVALGDLIEDGDAASPVESAAFFLRCEHLEAVLSTLGERERKVVQLRYGLADGRPRTLEEIGRIFGVTRERIRQIESKTLNKLRDHAFADQLRGYLD

SEQ ID NO: 8370 - protein, 246 aa, Myxococcus xanthus
MVTANLRFVVKVAYEYRSYGIKMSDLIQEGNIGLMKAVQKFDPDKGIRLISYAVWWIRAYIQNYILKSWSLVKLGTTQAHGKLFFSLARTRRELEKFGSGDAAVNVDDIARRLHVKPGEVREMEQRMGGRDLSLDAPMGEDGGNSHVDFVVSAAAPQDDEFADKEEAGLINARVRAALMRLDPREPFIIEQRVMNERPMTLKELGEHFGFSRERARQLEIRAKDKLKSELAALMAEVDPEAVAAQQ

SEQ ID NO: 8371 - protein, 255 aa, Bacillus licheniformis
MDVEVKKENQNTQLKDHEVKELIKNSQNGDQKARDLLIEKNMRLVWSVVQRFLNRGYEPDDLFQIGCIGLLKSVDKFDLSYDVRFSTYAVPMIIGEIQRFIRDDGTVKVSRSLKELGNKIRRAKEELSKSNGRIPTVQEIADYLEISSEEVVMAQEAVRSPSSIHETVYENDGDPITLLDQIADQSEEKWFDKIALKEAIKDLDEREKLIVYLRYYKDKTQSEVADRLGISQVQVSRLEKKILKQIKNQMDHFES

SEQ ID NO: 8372 - protein, 355 aa, Homo sapiens
PGEVEMVKGQPFDVGPRYTQLQYIGEGAYGMVSSAYDHVRKTRVAIKKISPFEHQTYCQRTLREIQILLRFRHENVIGIRDILRASTLEAMRDVYIVQDLMETDLYKLLKSQQLSNDHICYFLYQILRGLKYIHSANVLHRDLKPSNLLINTTCDLKICDFGLARIADPEHDHTGFLTEYVATRWYRAPEIMLNSKGYTKSIDIWSVGCILAEMLSNRPIFPGKHYLDQLNHILGILGSPSQEDLNCIINMKARNYLQSLPSKTKVAWAKLFPKSDSKALDLLDRMLTFNPNKRITVEEALAHPYLEQYYDPTDEPVAEEPFTFAMELDDLPKERLKELIFQETARFQPGVLEAP

SEQ ID NO: 8373 - protein, 233 aa, Oryza sativa (japonica cultivar-group); identical to SEQ ID NO: 3931

SEQ ID NO: 8374 - protein, 440 aa, Ureaplasma urealyticum [sequence omitted]

SEQ ID NO: 8375 - protein, 448 aa, Ureaplasma urealyticum
MSTKQNEPLFVNLEDLKQKVKLSFTEEFSFSYALSELEAGIFESRNLKGADAGDPEEILLNVVLDVSKKKRSRNEIKFNKLQNYFIHMNLREEHFSEIIDVLEAIGIRVPDYDLVMQSKSKTNTKKKDEYGIDDTLEISTSKIGFSSTTTEKVDDGIKAYLGVLGESKMLRSDEETEYAKMVISDDPSLVKIGKNQLYTSNMRLVTSIAKKYLNRGLDLEDLIQEGSSGLLKAIDKFDHEKGHKFSTYATWWIRQSITRAIADQARQIRIPVHMVETINKLTKAERNLIQELGRDPTAEEIAQAMNKVSQAKNQKEQLITAQKVVEIKKLNVDPVSLDKQIGHDEESQFSDFISDDEIISPEKYTEKKALNDQINEMFEKVLNDNEQRVIKMRYGLLPFERPYTLEEVGEYLGVTRERARQIESKAIRKLKHPSKTAKLRSFIGESEN

SEQ ID NO: 8376 - protein, 1057 aa, Arabidopsis thaliana
MNWALNNHQEEEEEPRRIEISDSESLENLKSSDFYQLGGGGALNSSEKPRKIDFWRSGLMGFAKMQQQQQLQHSVAVKMNNNNNNDLMGNKKGSTFIQEHRALLPKALILWIIIVGFISSGIYQWMDDANKIRREEVLVSMCDQRARMLQDQFSVSVNHVHALAILVSTFHYHKNPSAIDQETFAEYTARTAFERPLLSGVAYAEKVVNFEREMFERQHNWVIKTMDRGEPSPVRDEYAPVIFSQDSVSYLESLDMMSGEEDRENILRARETGKAVLTSPFRLLETHHLGVVLTFPVYKSSLPENPTVEERIAATAGYLGGAFDVESLVENLLGQLAGNQAIVVHVYDITNASDPLVMYGNQDEEADRSLSHESKLDFGDPFRKHKMICRYHQKAPIPLNVLTTVPLFFAIGFLVGYILYGAAMHIVKVEDDFHEMQELKVRAEAADVAKSQFLATVSHEIRTPMNGILGMLAMLLDTELSSTQRDYAQTAQVCGKALIALINEVLDRAKIEAGKLELESVPFDIRSILDDVLSLFSEESRNKGIELAVFVSDKVPEIVKGDSGRFRQIIINLVGNSVKFTEKGHIFVKVHLAEQSKDESEPKNALNGGVSEEMIVVSKQSSYNTLSGYEAADGRNSWDSFKHLVSEEQSLSEFDISSNVRLMVSIEDTGIGIPLVAQGRVFMPFMQADSSTSRNYGGTGIGLSISKCLVELMRGQINFISRPHIGSTFWFTAVLEKCDKCSAINHMKKPNVEHLPSTFKGMKAIVVDAKPVRAAVTRYHMKRLGINVDVVTSLKTAVVAAAAFERNGSPLPTKPQLDMILVEKDSWISTEDNDSEIRLLNSRTNGNVHHKSPKLALFATNITNSEFDRAKSAGFADTVIMKPLRASMIGACLQQVLELRKTRQQHPEGSSPATLKSLLTGKKILVVDDNIVNRRVAAGALKKFGAEVVCAESGQVALGLLQIPHTFDACFMDIQMPQMDGFEATRQIRMMEKEAKEKTNLEWHLPILAMTADVIHATYEECLKSGMDGYVSKPFEEENLYKSVAKSFKPNPISPSS

SEQ ID NO: 8377 - protein, 1080 aa, Arabidopsis thaliana; identical to SEQ ID NO: 1203

SEQ ID NO: 8378 - protein, 279 aa, Pisum sativum
MSRREEEVRLITEPGFVDSTGQDKYNFPSIVCCRFTNKDIVAQIVSASIAGDIVLCAAYAHELPHYGLEVGLTNYAAAYCTGLLLARRVLKTLEMDEEYEGNVEASGEDYSVEPADSRRPFRALLDVGLVKTTTGNRVFGALKGALDGGLDIPHSDKRFAGFDKEKKELDAEVHRKYIFGGHVTAYMKTLIEDEPEKYQTHFSQYIKKGIEADGIEELYKKVHAAIRADPANKKAEKQPPKEHKRYNLKKLTYDERRTKLIARLEALNSAVDEDEDDDE

SEQ ID NO: 8379 - protein, 819 aa, Pisum sativum
MAACALFNGVGGGNTTPDETNNNSTSNSSNISTEDFHNMPQQQPHHSERKLLRKRMASEMELQLHNNNNNNDYHRFSRRTNNTSSLNCSLPATTQKGVTTTTTTTLASSGNNNNNNNNNNNYHYHNNNNNSIINNNNNNVALSRDNVAIQNFPTVTVTTNYSTMLLPSSCSSNLNNSSTSAANYTHYQQPLVEEQNTLPEICGFSGLPLFPSQNNQTNRTNNNSSNNRNNTNTVVDVVSSSPSMEETSATTNWIDGILKDLIHTSNSVSIPQLINNVREIIYPCNPNLALVLEHRLRLLTEPNTCVPERKRNSTEQSGVNVNGNVLAASNVNNSSVKLMNRVDDVVPTSLHFSDSSTLLNQNQNQNMFPNWGATQINNNNNPSVSLVTLPSQPLSTQQDQQHQLQQHPEDLAPATTTTTTSAELALARKKKEEIKEQKKKDEEGLHLLTLLLQCAEAVSAENLEQANKMLLEISQLSTPFGTSAQRVAAYFSEAISARLVSSCLGIYATLPVSSHTPHNQKVASAFQVFNGISPFVKFSHFTANQAIQEAFEREERVHIIDLDIMQGLQWPGLFHILASRPGGPPYVRLTGLGTSMETLEATGKRLSDFANKLGLPFEFFPVAEKVGNIDVEKLNVSKSEAVAVHWLQHSLYDVTGSDTNTLWLLQRLAPKVVTVVEQDLSNAGSFLGRFVEAIHYYSALFDSLGSSYGEESEERHVVEQQLLSREIRNVLAVGGPSRSGEIKFHNWREKLQQCGFRGVSLAGNAATQASLLLGMFPSEGYTLVEDNGILKLGWKDLCLLTASAWRPPYHTNTIIPHHN

SEQ ID NO: 8380 - protein, 344 aa, Trypanosoma congolense
MPSISQEKRDYEDRLNGCLTKYSRVLFCLMDNVRSQQVHGVRRDLRGKGELVMGKKTLQKKIVEKRAEDSKATDSDKLFHQTCADKQLLCGNTSMIFTNEDVTEITKVLDGHRVQAPARVGAIAPCDVIVPAGNTGMEPKATAFFQALNIATKISKGTVEIVSDKKVLSTGDKVDNSTATLLQKLDISPFYYQVEVQSVWDRGVLFTREDLAVTDDVVEKYLLEGISNISAMSMGAGIPTAATLPHMIVDAFKTLLGASVATNYEFEEYDGKNLRQAALEGKLGGGAAPAASSGGAAAAAAPAAAALPLRLRKRRKTTTLAWALSSKKCNGDLIDFFSNFFPFS

SEQ ID NO: 8381 - protein, 295 aa, Oryza sativa; identical to SEQ ID NO: 3499

SEQ ID NO: 8382 - protein, 621 aa, Macaca fascicularis
MVPVENTEGPNLLNQKGTAVETEGSYRASGSRHPPWARGCGMFTFLSSVTAAVSGLLVGYELGIISGALLQIKTLLTLSCHEQEMVVSSLLIGALLASLTGGVLIDRYGRRTAIILSSCLLGLGSLVLILSLSYTVLIVGRIAIGVSISLSSIATCVYIAEIAPQHRRGLLVSLNELMIVIGILSAYISNYAFANVFHGWKYMFGLVIPLGILQAIAMYFLPPSPRFLVMKGQEGAASKVLGRLRALSDATEELTVIKSSLKDEYQYSFWDLFRSKDNMRTRIMIGLTLVFFVQITGQPNILFYASTVLKSVGFQSNEAASLASTGVGVVKVISTIPATLLVDHVGSKTFLCIGSSVMAASLVTMGIVNLNIHMNFTNICRSHNSINQSLDESVIYGPGNLSASNNTLRDHFKGIASHSRSSLMPLRNDVDKRGETTSASLLNAVLSHTEYQIVTDPGDVPAFLKWLSLASLLVYVAAFSIGLGPMPWLVLSEIFPGGIRGRAMALTSSMNWGINLLISLTFLTVTDLIGLPWVCFIYTIMSLASLLFVVMFIPETKGCSLEQISMELAKVNYVKNNICFMSHHQEELVPRQPQKRKPQEQLLECNKLCGRGQSRQLSPEN

SEQ ID NO: 8383 - protein, 641 aa, Macaca fascicularis
MKSRRPKSSLPPVLGTESDATVKKKPAPKTPPKAAMPPQIIQFPEDQKVRAGESVELFGKVTGTQPITCTWMKFRKQIQESEHMKVENSENGSKLTILAARQEHCGCYTLLVENKLGSRQAQVNLTVVDKPDPPAGTPCASDIRSSSLTLSWYGSSYDGGSAVQSYSIEIWDSANKTWKELATCRSTSFNVQDLLPDHEYKFRVRAINVYGTSEPSQESELTTVGEKPEEPKDEVEVSDDDEKEPEVDYRTVTINTEQKVSDVYDIEERLGSGKFGQVFRLVEKKTRKIWAGKFFKAYSAKEKENIRQEISIMNCLHHPKLVQCVDAFEEKANIVMVLEIVSGGELFERIIDEDFELTERECIKYMRQISEGVEYIHKQGIVHLDLKPENIMCVNKTGTRIKLIDFGLARRLEDAGSLKVLFGTPEFVAPEVINYEPIGYATDMWSIGVICYILVSGLSPFMGDNDNETLANVTSATWDFDDEAFDEISDDAKDFISNLLKKDMKNRLDCTQCLQHPWLMKDTKNMEAKKLSKDRMKKYMARRKWQKTGNAVRAIGRLSSMAMISGLSGRKSSTGSPTSPLNAEKLESEEDVSQAFLEAVAEEKPHVKPYFSKTIRDLEVVEGSAARFDCKIEGYPDPEVV

SEQ ID NO: 8384 - protein, 1226 aa, Vibrio fischeri
MAGSNIKVQIEKQLSERILLIDGGMGTMIQGYKFEEKDYRGGRFNQWHCDLKGNNDLLVLSQPQIIRDIHEAYLEAGADILETNTFNATTIAMADYDMESLSEEINFEAAKLAREVADKWTEKTPNKPRYVAGVLGPTNRTCSISPDVNDPGFRNVSFDELVEAYSESTRALIRGGSDLILIETIFDTLNAKACSFAVESVFEELGITLPVMISGTITDASGRTLSGQTTEAFYNALRHVKPISFGLNCALGPDELREYVSELSRISECYVSAHPNAGLPNAFGEYDLSPEDMAEHVAEWASSGFLNLIGGCCGTTPEHIRQMALVVEGVKPRQLPELPVACRLSGLEPLTIEKDSLFINVGERTNVTGSARFKRLIKEELYDEALSVAQEQVENGAQIIDINMDEGMLDAEACMVRFLNLCASEPEISKVPVMVDSSKWEVIEAGLKCIQGKGIVNSISLKEGKEKFVHQAKLIRRYGAAVIVMAFDEVGQADTRERKIEICTNAYNILVDEVGFPPEDIIFDPNIFAVATGIDEHNNYAVDFIEAVGDIKRTLPHAMISGGVSNVSFSFRGNNYVREAIHAVFLYHCFKNGMDMGIVNAGQLEIYDNVPEDLREAVEDVVLNRRDDSTERLLDIATEYLERAVGKVEDKSALEWRDWPVEKRLEHSLVKGITEFIVEDTEEARINAERPIEVIEGPLMDGMNVVGDLFGEGKMFLPQVVKSARVMKQAVAHLEPFINASKEVGATNGKILLATVKGDVHDIGKNIVGVVLQCNNYEIIDLGVMVSCETILKVAKEENVDIIGLSGLITPSLDEMVHVAKEMERQGFDLPLLIGGATTSKAHTAVKIEQNYSQPVVYVNNASRAVGVCTSLLSNELKPSFVEKLDIDYERVREQHSRKQPRTKPVTLEVARANKVAIDWASYTPPVPLKPGVHIFDNFDVSTLRNYIDWTPFFMTWSLVGKYPKILEHEEVGEEAKRLFKDANDLLDRVEKEGLLKARGMCALFPASSVGDDIEVYTDESRTTVAKVLHNLRQQTEKPKGFNYCLSDYIAPKESGKNDWIGGFAVTGGIGERELADEYKANGDDYNAIMIQAVADRLAEAFAEYLHEKVRKEIWGYSPNETLSNDDLIREKYQGIRPAPGYPACPEHTEKGALWELMNVEESIGMSLTSSYAMWPGASVSGMYFSHPDSRYFAIAQIQQDQAESYADRKGWNMLEAEKWLGPNLN

SEQ ID NO: 8385 - protein, 516 aa, Homo sapiens
MEPAVSLAVCALLFLLWVRLKGLEFVLIHQRWVFVCLFLLPLSLIFDIYYYVRAWVVFKLSSAPRLHEQRVRDIQKQVREWKEQGSKTFMCTGRPGWLTVSLRVGKYKKTHKNIMINLMDILEVDTKKQIVRVEPLVTMGQVTALLTSIGWTLPVLPELDDLTVGGLIMGTGIESSSHKYGLFQHICTAYELVLADGSFVRCTPSENSDLFYAVPWSCGTLGFLVAAEIRIIPAKKYVKLRFEPVRGLEAICAKFTHESQRQENHFVEGLLYSLDEAVIMTGVMTDEAEPSKLNSIGNYYKPWFFKHVENYLKTNREGLEYIPLRHYYHRHTRSIFWELQDIIPFGNNPIFRYLFGWMVPPKISLLKLTQGETLRKLYEQHHVVQDMLVPMKCLQQALHTFQNDIHVYPIWLCPFILPSQPGLVHPKGNEAELYIDIGAYGEPRVKHFEARSCMRQLEKFVRSVHGFQMLYADCYMNREEFWEMFDGSLYHKLREKLGCQDAFPEVYDKICKAARH

SEQ ID NO: 8386 - protein, 352 aa, Homo sapiens
MESGGRPSLCQFILLGTTSVVTAALYSVYRQKARVSQELKGAKKVHLGEDLKSILSEAPGKCVPYAVIEGAVRSVKETLNSQFVENCKGVIQRLTLQEHKMVWNRTTHLWNDCSKIIHQRTNTVPFDLVPHEDGVDVAVRVLKPLDSVDLGLETVYEKFHPSIQSFTDVIGHYISGERPKGIQETEEMLKVGATLTGVGELVLDNNSVRLQPPKQGMQYYLSSQDFDSLLQRQESSVRLCKVLALVFGFATCATLFFILRKQYLQRQERLRLKQMQEEFQEHEAQLLSRAKPEDRESLKSACVVCLSSFKSCVFLECGHVCSCTECYRALPEPKKCPICRQAITRVIPLYNS

SEQ ID NO: 8387 - protein, 712 aa, Homo sapiens
MGGKQRDEDDEAYGKPVKYDPSFRGPIKNRSCTDVICCVLFLLFILGYIVVGIVAWLYGDPRQVLYPRNSTGAYCGMGENKDKPYLLYFNIFSCILSSNIISVAENGLQCPTPQVCVSSCPEDPWTVGKNEFSQTVGEVFYTKNRNFCLPGVPWNMTVITSLQQELCPSFLLPSAPALGRCFPWTNITPPALPGITNDTTIQQGISGLIDSLNARDISVKIFEDFAQSWYWILVALGVALVLSLLFILLLRLVAGPLVLVLILGVLGVLAYGIYYCWEEYRVLRDKGASISQLGFTTNLSAYQSVQETWLAALIVLAVLEAILLLVLIFLRQRIRIAIALLKEASKAVGQMMSTMFYPLVTFVLLLICIAYWAMTALYPLPTQPATLGYVLWASNISSPGCEKVPINTSCNPTAHLVNSSCPGLMCVFQGYSSKGLIQRSVFNLQIYGVLGLFWTLNWVLALGQCVLAGAFASFYWAFHKPQDIPTFPLISAFIRTLRYHTGSLAFGALILTLVQIARVILEYIDHKLRGVQNPVARCIMCCFKCCLWCLEKFIKFLNRNAYIMIAIYGKNFCVSAKNAFMLLMRNIVRVVVLDKVTDLLLFFGKLLVVGGVGVLSFFFFSGRIPGLGKDFKSPHLNYYWLPIMTSILGAYVIASGFFSVFGMCVDTLFLCFLEDLERNNGSLDRPYYMSKSLLKILGKKNEAPPDNKKRKK

SEQ ID NO: 8388 - protein, 284 aa, Aeromonas hydrophila
MGTSLQRTMALIPQGSLEGYIQAVNSIPVLTADEERELAERLQQGGDLEAARQLVMSHLRFVVHVAKSYAGYGLPQADLVQEGNIGLMKAVKRFDPTVGVRLVSFAVHWIKADIHEYVLRNWRMVKVATTKAQRKLFFNLRKSKKRLGWFSHDEVQAVAAELGVSPTDVTEMEARMSNYDQAFDLVGDDEDEGGFAPVHYLEDKSSDLAATIENDNWDDHATRRLSSALATLDERSQHIIRARWLDDDSKTTLQELADTYGVSAERVRQLEKNALKKLKDAMEA

SEQ ID NO: 8389 - protein, 692 aa, Cricetulus longicaudatus
MKVFCGRANPTTGSLEWLEEDEHYDYHQEIARSSYADMLHDKDRNIKYYQGIRAAVSRVKDRGQKALVLDIGTGTGLLSMMAVTAGADFCYAIEVFKPMADAAVKIVEKNGFSDKIKVINKHSTEVTVGPDGDLPCRANILVTELFDTELIGEGALPSYEHAHRHLVQENCEAVPHKATVYAQLVESRRMWSWNKLFPVHVQTSLGEQVIVPPSELERCPGAPSVYDIQLNQVPSTDFTALSDVLPMFSVDFSKQVSSSAACHSKQFVPLASGQAQVVLSWWDIEMDPEGKITCTMAPFWAQTNPQELQWRDHWMQCVYFLPQEEPVVQGSPRCLVAHHDDYCVWYSLQRTSADENEEVYQVRPVCDCQAHLLWNRPRFGEINDQDRTDQYAQALRTVLMPGTICLCVSDGSLLSLLAHHLGAEQVFTVESSAASYRLMKRIFKANHLEDKVSIIKKRPELLTSADLEGKKVSLLLGEPFFATSLLPWHNLYFWYARTSVDQHLEPGAVVMPQAASLYAMIVEFRDLWRIRSPCGDCEGFDVHIMDDMIKHSLDFRESREAEPHPLWEYPCRSLSEPQQILTFDFQQPVPQKPVHAEGSMELRRPGKSHGAVLWMEYHLTPDSTVSTGLMNPLEDKGDCCWNPHCKQAVYFLSTTVDPRVPLDGPQSVSYAVEFHPLTGDITMEFRLADTLN

SEQ ID NO: 8390 - protein, 240 aa, Petunia x hybrida
MGRGKVELKRIENKINRQVTFAKRRNGLLKKAYELSVLCDAEVALIIFSNRGKLYEFCSSSSMSTTLEKYHRYCYGALEGSQPSTDSQNIYQEYLKLKTRVEALQQSQRHMLGADLGQLGTKDLEQLERQLDSSLRQIRSTRTQNMLDQLSELQEKQEQSLIEMNKSLRMKLEELGVAFQTSMHSGEESVQYRQQPAEPEGLFHPVECNNSLPIRYNTLPREHVVPSAQDSTGVLPGWML

SEQ ID NO: 8391 - protein, 246 aa, Petunia x hybrida
MGRGRVELKKIENKINRQVTFAKRRNGLLKKAYELSVLCEAEVALIIFSNRGKLYEFSSTSNMVKTLDRYQKCSYGTLEVNHRSVKDNNEERIYREYLKLKAKYESLQRYQRQLLGDELGPLNIDELEHLELQLDSSLKLIKSTRTQLMLDQLSDLQTKEKLWVEANKVLERKLEQIYAENNIQQSWGGGEQSGAYGQQHAQTQGFFQPLECNSTLQIGYDPATSSQITAVTSGQNVNGIIPGWML

SEQ ID NO: 8392 - protein, 245 aa, Petunia x hybrida
MGRGRVELKRIENKINRQVTFAKRRNGLLKKAYELSVLCDAEVALIIFSSRGKLYEFCSTSSMMKTLEKYQQCSYASLDPMQSANDTQNNYHEYLRLKARVELLQRSQRNLLGEDLGSLNSKELEQLEHQLDSSLKQIRSKKTQHMLDQLADLQQKEQMLAEANKQLRRKLEESAARIPLRLSWDNGGQPMQHNRLPPQTEGFFQPLGLNSSSPQFGYSPMGANEVNNAVSTAQNMNGFIPGWML

SEQ ID NO: 8393 - protein, 216 aa, Petunia x hybrida
MVRGKTQMRRIENATSRQVTFSKRRNGLLKKAFELSVLCDAQVGLVIFSPRGKQYEFSSSSMQEIIERYKGHTKDKVQTENQAGEQNLQHETAGLMKKIEFLETSKRKLLGEGLGSCTLEELQKIEKQLERSVSIIRARKMQVFKEQIEKLNEKEKALAAENAMLREKFGGLQQRQASSGEKEGEVVCTEGSDKSDVETELFIGPPECRIRHRLQN

SEQ ID NO: 8394 - protein, 218 aa, Petunia x hybrida
MVRGKTQMRRIENATSRQVTFSKRRNGLLKKAFELSVLCDAEVGLVIFSPRGKLYEFASSCMQEIIERYKRHTKDKVQNENQAGEQNLQLQHEAASLMKKIELLEISRRRLMGEGLQSCTLQEIQQLEKQLERSVSTIRARKIQVFKEQIARLKEKEKILAAENAMLKEKFGGFQERQVSSGEQVGEALCAEGNEKSDVETELFIGPPEGRIRRPSQN

SEQ ID NO: 8395 - protein, 218 aa, Petunia x hybrida
MQEMVRGKVQMKRIENATSRQVTFSKRRNGLMKKAYELSVLCDAEVAVVIFSQRGRLYEFSSSSMQKTIDRYRECARETLTNNSIQAQQQIQYLKEETENMAKKIEVLEVSRRKLTGQSLGSCSMNELQQIDSQLERSLKNIRARKSQLFEDEIERLKAKKNLLLEENARLSEKCGQMSREPALAPPDPLIQQQEKGNCSLSIKNSEVETDLFIGLRS

SEQ ID NO: 8396 - protein, 245 aa, Petunia x hybrida
MGRGRVELKRIENKINRQVTFAKRRNGLLKKAYELSVLCDAEVALIIFSNRGKLYEFCSTSSMTKTIEKYQRCSYATLEANQSATDNQNNYHEYLRLKARVELLQRSQRNLLGEDLGTLSTKDLEQLENQLESSLKQIRSRKTQFMLDQLADLQQREQMLAESNKQLRQKLEESVAGIPHRLCWEDGLQAMQHNSRLPQTEGFFQPLGLNSSNSPQFGYNPAGTDVENAAATTHNMNGFIHGWML

SEQ ID NO: 8397 - protein, 215 aa, Petunia x hybrida
MVRGKTQMRRIENATSRQVTFSKRRNGLLKKAFELSVLCDAEVSLIIFSTRGKLYEFSSSSMQEIIERYRRHSEDVQGEKPAVEQNNMQNLKLDAASLMKKIEILETSKRKLLGEDLGSCSLEELQQIEKQLERSISTIRARKMEVFREQIERLKGNVKVLATENAMLWEKCGDLEMQQTSGGEDLSIEGSEKSDVETELFIGLPECRTKRPLQN

SEQ ID NO: 8398 - protein, 245 aa, Petunia x hybrida
MGRGRIQLKRIENKISRQVTFSKRRSGLLKKAHEISVLCDADVALIVFSTKGKLFEYSTESSMESILERYERYSYAERKLNANDSDPKENWTLEYPKLMSRIELIQRNIRHYMGQDLDPLSLRELQSLEQQIDTALKRIRSRKNQLMHESISELHKKERALQEQNNLMTKKLKENEKTQSGQTQPISSQNDATFMVPQPPSLSHHVANLTIGGAFGAKTVTNTNGVQASNSQMPPWMIRHVNNEG

SEQ ID NO: 8399 - protein, 132 aa, Leishmania infantum
MATPRSAKKAARKSGSKSAKCGLIFPVGRVGGMMRRGQYARRIGVSGAVYLAAVLEYLTAELLELSVKAAAQSGKKRCRLNPRTVMLAARHDDDIGMLLKNVTLSHSGVVPNISKAMAKKKGGKKGRATPSA

SEQ ID NO: 8400 - protein, 370 aa, Oryza sativa (japonica cultivar-group); identical to SEQ ID NO: 1191

SEQ ID NO: 8401 - protein, 84 aa, Mus musculus
MKVKIKCWNGVATWLWVANDENCGICRMAFNGCCPDCKVPGDDCPLVWGQCSHCFHMHCILKWLNAQQVQQHCPMCRQEWKFKE

SEQ ID NO: 8402 - protein, 301 aa, Mus musculus
MTRHGKNCTAGAVYTYHEKKKDTAASGYGTQNIRLSRDAVKDFDCCCLSLQPCHDPVVTPDGYLYEREAILEYILHQKREIARQVKAYEKQRGARREEQKELQRAAAQDQVRGFLEKEAAIVSRPLNPFMPKAATLPNTEGEQPGPSVGPVGKDKDKALPSFWIPSLTPEAKATKLEKPSRTVTCPMSGKPLRMSDLTSVRFTQLDDSVDRVGLITRSERYVCAVTRDSLSNATPCAVLRPSGAVVTLECVEKLIRKDMVDPVNGDTLTERDIIVLQRGGTGFAGSGVKLQAEMSRPVMQA

SEQ ID NO: 8403 - protein, 131 aa, Mus musculus
MAAAVAMETDDAGNRLRFQLELEFVQCLANPNYLNFLAQRGYFKDKAFVNYLKYLLYWKEPEYAKYLKYPQCLHMLELLQYEHFREELVNAQCAKFIDEQQILHWQHYSRKRVRLQQALAEQQQQNNTAGK

SEQ ID NO: 8404 - protein, 234 aa, Mus musculus
MAAAVPVPQFRPVTPLIFDLDGLILNTEDLYTDVFEEICNRYGKKYNWDVKSLVMGKKALETAQTIVEFLNLPISKEELLKESQEKLQMVLHTAGFMPGAEELIHHLKKHRLPFALATSSETVTFQTKTSRHTGFFGLFHHIVLGDDPEVKNGKPGMDIFLTCAKRFSPPPDPKDCLVFEDSPNGVEAAIHCGMQVVMVPHENLSADLTRKATLVLSSLHDFKPELFGLPAFTE

SEQ ID NO: 8405 - protein, 335 aa, Mus musculus
MALLGRAFFAGVSRLPCDPGPQRFFSFGTKTLYQSKDAPQSKFFQPVLKPMLPPDAFQGKVAFITGGGTGLGKAMTTFLSTLGAQCVIASRNIDVLKATAEEISSKTGNKVHAIRCDVRDPDMVHNTVLELIKVAGHPDVVINNAAGNFISPSERLTPNGWKTITDIVLNGTAYVTLEIGKQLIKAQKGAAFLAITTIYAESGSGFVMPSSSAKSGVEAMNKSLAAEWGRYGMRFNIIQPGPIKTKGAFSRLDPTGRFEKEMIDRIPCGRLGTMEELANLATFLCSDYASWINGAVIRFDGGEEVFLSGEFNSLKKVTKEEWDIIEGLIRKTKGS

SEQ ID NO: 8406 - protein, 425 aa, Mus musculus
MSDTSPQAGVLSRARLLQLRRHSSQRPERSGLAGLLERVGIVLPQIMTGIAANLVNALANYVFLYHLHLGVMGSALANTISQFALAIFLFLYILWRRLHQATWGGWSWECLQDWASFLRLAIPSMLMLCIEWWAYEVGSFLSGILGMVELGAQSITYELAIIVYMIPSGFSVAANVRVGNALGAGNIDQAKKSSAISLIVTELFAVTFCVLLLGCKDLVGYIFTTDRDIVALVAQVIPIYAVSHLFEGLACTCGGILRGTGNQKVGAIVNAIGYYVIGLPIGIALMFAAKLGVIGLWSGIIICTTCQTTCFLAFIARLNWKRACQQAQVHANLKVNVALNSAVSHEPAHPVCPESHGEIMMTDLEKKDETQLDQPMNQQQALPIRPKDSNKLSGKQLALRRGLLLLGVVLVLVGGILVRVYIRIE

SEQ ID NO: 8407 - protein, 156 aa, Mus musculus
MSGGLLKALRSDSYVELSEYRDQHFRGDNEEQEKLLKKSCTLYVGNLSFYTTEEQIYELFSKSGDIKKIIMGLDKMKKTACGFCFVEYYSRADAENAMRYINGTRLDDRIIRTDWDAGFKEGRQYGRGRSGGQVRDEYREDYDAGRGGYGKLAQKQ

SEQ ID NO: 8408 - protein, 261 aa, Mus musculus
MAATAREDGVRNLAQGPRGCEHYDRACLLKAPCCDKLYTCRLCHDTNEDHQLDRFKVKEVQCINCEKLQHAQQTCEDCSTLFGEYYCSICHLFDKDKRQYHCESCGICRIGPKEDFFHCLKCNLCLTTNLRGKHKCIENVSRQNCPICLEDIHTSRVVAHVLPCGHLLHRTCYEEMLKEGYRCPLCMHSALDMTRYWRQLDTEVAQTPMPSEYQNVTVDILCNDCNGRSTVQFHILGMKCKLCDSYNTAQAGGRRVPVDQQ

SEQ ID NO: 8409 - protein, 282 aa, Mus musculus
MAAIFRPIPWAFRGSLCLPLSARRFSKTADENRSLAGKVAVITGSTRGIGFAIARRLAQDGAHVVISSRKQENVDEAVTILKEEGLSVTGTMCHVGKAEDRQHLVTTALKHSGGIDFLVCVAGVNPLVGSTLGASEQIWDKILDVNVKSPALLLSKVLPYMENRRGGSVVLVSSGVAYVPVPKLGVYNTSKTALLGLCKSLAVELAPKGIRVNCLVPGIIKTDFTLREKTMPNMLPDMNKIFGVKRLGEPEECAGLVSFLCSSDASYITGENIMVAGFSSKL

SEQ ID NO: 8410 - protein, 119 aa, Penicillium marneffei
PFLLSLGMSKALLAIVWVAGPLTGTLVQPYIGILSDNCRIPWGKRKPFMIGGGLATIFCLMLLAWVREIIAGVLGIFGADAQSSGVKVTTLVFATIMMFCLDFAINTGMFWICLVLLHC

SEQ ID NO: 8411 - protein, 325 aa, synthetic construct
DARTVKLLLLGAGESGKSTIVKQMKIIHQDGYSLEECLEFIAIIYGNTLQSILAIVRAMTTLNIQYGDSARQDDARKLMHMADTIEEGTMPKEMSDIIQRLWKDSGIQACFDRASEYQLNDSAGYYLSDLERLVTPGYVPTEQDVLRSRVKTTGIIETQFSFKDLNFRMFDVGGQRSERKKWIHCFEGVTAIIFCVALSDYDLVLAEDEEMNRMHESMKLFDSICNNKWFTDTSIILFLNKKDLFEEKIKKSPLTICYPEYAGSNTYEEAGNYIKVQFLELNMRRDVKEIYSHMTCATDTQNVKFVFDAVTDIIIKENLKDCGLF

SEQ ID NO: 8412 - protein, 310 aa, Malus x domestica
MSTVTLSSGYEMPVIGLGLWRLEKDELKEVILNAIKIGYRHFDCAAHYKSEADVGEALAEAFKTGLVKREELFITTKIWNSDHGHVVEACKNSLEKLQIDYLDLYLVHYPMPTKHNAIGKTASLLGEDKVLDIDVTISLQQTWEGMEKTVSLGLVRSIGLSNYELFLTRDCLAYSKIKPAVSQFETHPYFQRDSLVKFCMKHGVLPTAHTPLGGAAANKDMFGSVSPLDDPVLNDVAKKYGKSVAQICLRWGIQRKTAVIPKSSKIQRLKENLEVLEFQLSDEDMQLIYSIDRKYRTSLPSKTWGLDVYA

SEQ ID NO: 8413 - protein, 430 aa, Dictyostelium discoideum
MTKLHYKVKDISLAAWGRKEIEIAANEMPGLMTLRKKYGPAQILKGARIAGCLHMTIQTAVLIETLTALGAQVQWSSCNIFSTQDQAAAAIAATGVPVYAWKGETEEEYNWCVEQTIVFQDGPLNMILDDGGDLTTLVHEKYPQFLAGIKGISEETTHGVHNLYKMFKEGKLKVPAINVNDSVTKSKFDNLYGCRESLIDGIKRATDVMIAGKVAVVAGYGDVGKGCAQSLSKMGARVLVTEIDPINALQACMDGYQIVTMETAAPLSNIFVTTTGCRDIVRGEHFAVMKEDAIVCNIGHFDCEIDVAWLNANAKKDTVKPQVDRYTLANGVHIILLAEGRLVNLGCGTGHPSFVMSNSFCNQTLAQIALWTKTEEYPLGVHLLPKILDEEVARLHLDQLGAKLTTLTEKQSEYLSVPVAGPYKVDHYRY

SEQ ID NO: 8414 - protein, 463 aa, Rhodobacter capsulatus
MADYIVKDIKLAEFGRKELDIAETEMPGLMACREEFGPSQPLKGARIAGSLHMTIQTAVLIETLKALGADVRWASCNIFSTQDHAAAAIAAGGTPVFAVKGETLEEYWAYTDKIFQFPEGTCNMILDDGGDATLYILLGARVEAGETDLIATPTSEDEVCLFNQIKKRMVESPGWFTQQRAAIKGVSEETTTGVHRLYDLHKKGLLPFPAINVNDSVTKSKFDNKYGCKESLVDGIRRATDVMMAGKVAVVCGYGDVGKGSAASLRGAGARVKVTEVDPICALQAAMDGFEVVVLEDVVADADIFITTTGNKDVIRIEHMREMKDMAIVGNIGHFDNEIQVAALKNHKWTNIKDQVDMIEMPSGARIILLSEGRLLNLGNATGHPSFVMSASFTNQVLAQIELWTKGAEYQPGVYILPKSLDEKVARLHLKKIGVKLTTLRPDQAEYIGVTVEGPFKSDHYRY

SEQ ID NO: 8415 - protein, 120 aa, Streptomyces fradiae
IPGIVKDEVKPQVHTWTFADGKKIIVLSEGRLLNLGNATGHPSFVMSNSFADQTLAQIELYTKPEQYPTDVYVLPKHLDEKVARLHLDALGVKLTTLRPEQAEYIGVEVEGPYKPDHYRY

SEQ ID NO: 8416 - protein, 472 aa, Mus musculus
MATKCTKCGPGYSTPLEAMKGPREEIVYLPCIYRNTGTEAPDYLATVDVDPKSPQYSQVIHRLPMPYLKDELHHSGWNTCSSCFGDSTKSRNKLILPGLISSRIYVVDVGSEPRAPKLHKVIEASEIQAKCNVSSLHTSHCLASGEVMVSTLGDLQGNGKGSFVLLDGETFEVKGTWEKPGDAAPMGYDFWYQPRHNVMVSTEWAAPNVFKDGFNPAHVEAGLYGSRIFVWDWQRHEIIQTLQMTDGLIPLEIRFLHDPSATQGFVGCASAPNIQRFYKNAEGTWSVEKVIQVPSKKVKGWMLPGVPGLITDILLSLDDRFLYFSNWLHGDIRQYDISNPQKPRLAGQIFLGGSIVRGGSVQVLEDQELTCQPEPLVVKGKRIPGGPQMIQLSLDGKRLYATTSLYSAWDKQFYPDLIREGSMMLQIDVDTVNGGLKLNPNFLVDFGKEPLGAALAHELRYPGGDCSSDIWI

SEQ ID NO: 8417 - protein, 261 aa, Emericella nidulans
MGHEDAVYLAKLAEQAERYEEMVENMKVVAASDVELTVEERNLLSVAYKNVIGARRASWRIVTSIEQKEESKGNKSQVALIKEYRQKIEGELAKICQDILDVLDQHLIKSAQSGESKVFYHKMKGDYHRYLAEFAVGDNRKAAADASLEAYKSATEVAQTDLAPTHPIRLGLALNFSVFYYEILNSPDQACHLAKLAFDDAIAELDTLSEESYKDSTLIMQLLRDNLTLWTSSEAEPAAENAPAEKKEEAPAAEGEEKPAE

SEQ ID NO: 8418 - protein, 350 aa, Arabidopsis thaliana
MENGDIPEDANEHCPGPQSESAGKSDSCAGCPNQEACATAPKGPDPDLVAIAERMSTVKHKILVLSGKGGVGKSTFSAQLSFALAGMDHQVGLMDIDICGPSIPKMLGLEGQEIHQSNLGWSPVYVEDNLGVMSIGFMLPNSDEAVIWRGPRKNGLIKQFLKDVYWGEIDYLVVDAPPGTSDEHISIVQYLLPTGIDGAIIVTTPQEVSLIDVRKEVSFCKKVGVPVLGVVENMSGLSQPLKDVKFMKLATETGSSINVTEDVIACLRKNAPELLDIVACSEVFDSSGGGAERMCREMGVPFLGKVPMDPQLCKAAEQGKSCFEDNKCLISAPALKSIIQKVFPSTVMTE

SEQ ID NO: 8419 - protein, 259 aa, Pseudomonas putida
MSTLSRNALPLEGQVAVVTGGAHGIGLGIVERLLGLGARVTASDIDESGLSLLCERLAAKHADAIAVHAADLSEEQGAQGLHRAAVERFGSVQILVNCAGGGVIRPFLEHTPETLKATIDRNLWTALWCSRVFLPDMLARQYGRIINIGADSVRNGLPDHAAYNAAKGGMHGLTTGLAREFARQGVTVNTVAPCAVNTEVWVRIKNANPELAQRFLDVIPMGRVGEIEEVASMVGYLAQPEAAFVTGQVISVNGGSTML

SEQ ID NO: 8420 - protein, 379 aa, Pichia pastoris
MSTEGQIIKCKAAVAWEAGKDLSIEEIEVLPPRAHEVRVKVEFTGVCHTDAYTLSGADAEGSFPVVFGHEGAGVVESVGEGVESVKVGDSVVLLYTPECRECKFCLSGKTNLCGKIRATQGKGLLPDGTSRFRCKGKDLFHYMGCSSFSQYTVVADISVVKVQDEAPKDKTCLLGCGVTTGYGAAINTAKISKGDKIGVFGAGCIGLSVIQGAVSKGASEIIVIDINDSKKAWADQFGATKFVNPTTLPEGTNIVDYLIDITDGGFDYTFDCTGNVQVMRNALESCHKGWGESIIIGVAAAGKEISTRPFQLVTGRVWRGCAFGGIKGRTQMPSLVQDYLDGKIKVDEFITHRHDLDNINKAFHDMHAGNCIRAVITMH

SEQ ID NO: 8421 - protein, 448 aa, Homo sapiens
MKGFIDDANYSVGLLDEGTDLGNVIDNYVYEHTLTGKNAFFVGDLGKIVKKHSQWQNVVAQIKPFYTVKCNSAPAVLEILAALGTGFACSSKNEMALVQELGVPPENIIYISPCKQVSQIKYAAKVGVNILTCDNEIELKKIARNHPNAKVLLHIATEDNIGGEEGNMKFGTTLKNCRHLLECAKELDVQIIGVKFHVSSACKESQVYVHALSDARCVFDMAGEIGFTMNMLDIGGGFTGTEFQLEEVNHVISPLLDIYFPEGSGVKIISEPGSYYVSSAFTLAVNIIAKKVVENDKFPSGVEKTGSDEPAFMYYMNDGVYGSFASKLSEDLNTIPEVHKKYKEDEPLFTSSLWGPSCDELDQIVESCLLPELNVGDWLIFDNMGADSFHEPSAFNDFQRPAIYYMMSFSDWYEMQDAGITSDSMMKNFFFVPSCIQLSQEDSFSAEA

SEQ ID NO: 8422 - protein, 406 aa, Escherichia coli O6
MSLAGKKIVLGVSGGIAAYKTPELVRRLRDRGADVRVAMTEAAKAFITPLSLQAVSGYPVSDSLLDPAAEAAMGHIELGKWADLVILAPATADLIARVAAGMANDLVSTICLATPAPVAVLPAMNQQMYRAAATQHNLEVLASRGLLIWGPDSGSQACGDIGPGRMLDPLTIVDMAVAHFSPVNDLKHLNIMITAGPTREPLDPVRYISNHSSGKMGFAIAAAAARRGANVTLVSGPVSLPTPPFVKRVDVMTALEMEAAVNASVQQQNIFIGCAAVADYRAATVAPEKIKKQATQGDELTIKMVKNPDIVAGVAALKDHRPYVVGFAAETNNVEEYARQKRIRKNLDLICANDVSQPTQGFNSDNNALHLFWQDGDKVLPLERKELLGQLLLDEIVTRYDEKNRR

SEQ ID NO: 8423 - protein, 208 aa, Shigella flexneri
MITLWGRNNSTNVKKVLLTLEELELPYEQILAGREFGINHDADFLAMNPNGLVPLLRDDESDLILWESNAIVRYLAAQYGQKRLWIDSPARRAEAEKWMDWANQTLSNAHRGILMGLVRTPPEERDQAAIDASCKECDALFALLDAELAKVKWFSGDEFGVGDIAIAPFIYNLFNVGLTWTPRPNLQRWYQQLTERPAVRKVVMIPVS

SEQ ID NO: 8424 - protein, 301 aa, Populus balsamifera subsp. trichocarpa X Populus deltoides
MWSSPGANIDNNNTSNSKVSGNSPSKCFSSTCSSPSPPSPSPPIPNQSMNGASMEEVWDDINLASLHDHSNTNTSSNTNHHSFNGMVFQDFLARPSNKDTSTRAASKEPSSGGGNSFLKNSLGPPPATMLSLNSGSDHFHYLESSNTVPVRPNPQMHSHANGGTISFDSSLDSPFDALGSSSAFLSICKKRPQENGDVSGGDRRHKRMIKNRESAARSRARKQESSSPFENLFLVKFNDYRMLMFYLLLILQAYTVELEREAAHLAQENAKLRRQQERFLAAAPAQLPKKNTLYRTSTAPF

SEQ ID NO: 8425 - protein, 274 aa, Mus musculus
MAARRALIVLAHSEKTSFNYAMKEAAVEALKKRGWEVLESDLYAMNFNPIISRNDITGELKDSKNFQYPSESSLAHKEGRLSPDIVAEHKKLEAADLVIFQFPLQWFGVPAILKGWFERVLVAGFAYTYAAMYDNGPFQNKKTLLSITTGGSGSMYSLQGVHGDMNVILWPIQSGILRFCGFQVLEPQLVYSIGHTPPDARMQILEGWKKRLETVWEETPLYFAPSSLFDLNFQAGFLMKKEVQEEQKKNKFGLSVGHHLGKSIPADNQIKARK

SEQ ID NO: 8426 - protein, 48 aa, Mus musculus
MWKRRSDPVLHIDLRRWADLMLVAPLDANTLGKVASGICDNLLDQARA

SEQ ID NO: 8427 - protein, 430 aa, Heterodera glycines
IERQVRNDALWAGLAIRRGWKKYFFCSKDQATRAISQSWRQPKNGEDALEFQHKFYRELYPKITADIRQIEQNWREGRHRLERINCQSENSKGVYCLQYDDEKIISGLRDNTIKIWSRPSLGCVQTLSGHTGSVLCLQYDNQMIASGSSDATVRIWDVNTGEQLKTLVHHCEAVLHLRFQDGMLVTCSKDRSIAVWDMASPRDIEVRRVLVGHRAAVNVVDFDHKYIVSASGDRTIKVWNASTCEFVRTLNGHKRGIACLQYRDRLIVSGSSDYSIRLWDIECGNCLRVLEGHEELVRCIRFDSKRIVSGAYDGKIMIWDLAAALDPMTPPNSICIKTLSQHTGRVFRLQFDEFQIISSSHDDTILIWDFLNTGPSAAVAAGAAAAAAHNQAVQHHQAAPAAQPAAAAMPGGAGAAPAAAIIPLAPPPSP

SEQ ID NO: 8428 - protein, 318 aa, Toxoplasma gondii
MAAPTVSAGGKEKKGNADSQLMNTAKDFLAGGISAGVSKTIVAPIERVKMLIQTQDSIPEIKEGKIPRYTGIVDCFRRVSAEQGVASLWRGNMANVIRYFPTQAFNFAFKDTFKRMFPRYDQKKEFWKFFCTNVASGGLAGASSLVIVYPLDFARTRLASDVGNGNEREFTGLVDCLGKIFRRTGFFSLYQGFGVSVQGIIVYRGAYFGLFDTAKAMLFGPNNDANLFYKWAVAQTVTAAAGVASYPFDTVRRRMMMMAGRKKGEQEIQYTGTADCWKKVYQQEGFKGFFKGAWANVLRGAGGALVLVFYDELKKMLM

SEQ ID NO: 8429 - protein, 240 aa, Pisum sativum
MGRGRVQLKRIENKINRQVTFSKRRAGLLKKAHEISVLCDAEVALIVFSHKGKLFEYATDSCMEKILERYERYSYAERQLVANDSESQGNWTIEYTRLKAKIDLLQRNYRHYMGEDLGTMSLKELQSLEQQLDTALKLIRTRRNQLMYESISELQKKEKVIQEQNNMLAKKIKEKEKIAAEQQVQWEHPNHHGVNPNYLLHQQLPSLNMGGNYREEAPEMGRNELDLTLEPLYTCHLGCF

SEQ ID NO: 8430 - protein, 260 aa, Brassica napus
MAVSAREEFVYMAKLAEQAERYEEMVEFMEKVSAAVDGDELTVEERNLLSVAYKNVIGARRASWRIISSIEQKEESRGNDDHVTAIRDYRSKIETELSGICDGILKLLDSRLVPAAASGDSKVFYLKMKGDYHRYLAEFKTGQERKDAAENTLSAYKAAQDIANAELAPTHPIRLGLALNFSVFYYEILNSPDRACSLAKQAFDDAIAELDTLGEGSYKDSTLIMQLLRDNLTLWTSDMQDDAADEIKEASAPKPTEEQQ

SEQ ID NO: 8431 - protein, 147 aa, Brassica napus
SWRIISSIEQKEESRGNEDHVAIIKDYRGKIETELSKICDGILNLLDSPLVPAASLAESKVFYLKMKGDYHRYLAEFKTGAERKDAAESTLVAHKSAQDIALADLAPTHPIRLGLANFSVFYYEILNSPDRACSLAKQAFDEAISEL

SEQ ID NO: 8432 - protein, 225 aa, Brassica napus
RYEEMVNFMEKLVTGATPSSELTVEERNLLSVAYKNVIGSLRAAWRIVSSIEQKEESRKNEEHVALVKDYRSKVETELSSVCEGILKLLEENLIPSAAASESKVFYLKMKGDYHRYMAEFKAGEERKAAAEDTMVAYKAAQDIAAADMAPTHPIRLGLALNFSVFYYEILNSSDKACDMAKQAFEEAIAELDTLGEESYKDSTLIMQLLRDNLTLWTSDMQEQMD

SEQ ID NO: 8433 - protein, 179 aa, Brassica napus
MAAATMSRDQYVYMAKLAEQAERYEEMVQFMEQLVTSATPAGELTVEERNLLSVAYKNVIGSLRAAWRIVSSIEQKEESRKNEEHVSLVKDYRSKVETELSTICSGILKLLDTHLIPSASASECRVFYLKMKGDYHRYMAEYKSGDERKTAAEDTMVAYKAAQDVAVADLAPTHPIRLG

SEQ ID NO: 8434 - protein, 163 aa, Brassica napus
AEQAERYEEMVEFMEKVAKSVDVEELSVEERNLLSVAYKNVIGARRASWRIISSIEQKEESKGNEDHVAIIKDYRGKIEAELSKICDGILNVLEAHLIPSASPAEFKVFLLKMKGDYHRYLAEFKAGAERKDAAESTLVAYKSAQDIATAELAPTHPIRLGLA

SEQ ID NO: 8435 - protein, 647 aa, Brassica napus
MSSAPSPGTGSPPSPPSNSTTTTPPPASAPPPTTPSSPPPPSTIPTSPPPSSRSTPSAPPPSPPTPSTPGSPPPLPQPSPPAPTTPGSPPAPVTPPTRNPPPSVPGPPSNPSREGGSPRPPSSPSPPSPSSDGLSTGVVVGIAIGGVALLVIVTLICLLCKKKRRRDEEDAYYVPPPPPPGPKAGGPYGGQQQQWRQQNATPPSDHVVTSLPPPPKAPSPPRQPPPPPPPPFMSSSGGSDYSDRPVLPPPSPGLVLGFSKSTFTYEELARATNGFSEANLLGQGGFGYVHKGVLPSGKEVAVKQLKVGSGQGEREFQAEVEIISRVHHRHLVSLVGYCIAGAKRLLVYEFVPNNNLELHLHGEGRPTMEWSTRLKIALGSAKGLSYLHEDCNPKIIHRDIKASNILIDFKFEAKVADFGLAKIASDTNTHVSTRVMGTFGYLAPEYAASGKLTEKSDVFSFGVVLLELITGRRPVDANNVYVDDSLVDWARPLLNRASEQGDFEGLADAKMNNGYDREEMARMVACAAACVRHSARRRPRMSQIVRALEGNVSLSDLNEGMRPGQSNVYSSYGGSTDYDSSQYNEDMKKFRKMALGTQEYNATGEYSNPTSDYGLYPSGSSSEGQTTREMEMGKIKRTGQGYSGPSL

SEQ ID NO: 8436 - protein, 377 aa, Branchiostoma floridae
MADTAGKPISCRAAVAWEAKKPLEIETIEVAPPRAHEVRIKVLATGVCHTDAYTLSGADSEGKFPVVLGHEGGGVVESVGEGVTGFQPGDHVIPLYIPQCRDCKFCRSPKTNLCQKIRVSQGQGVMPDGSSRFTCKGQTVYHFMGTSTFSEYTVVADISLCKVAESAPLEKVCLLGCGISTGYGAALNTAKVESGSTVAVWGLGAVGLAVIMGAKVAGASRIIGVDINPDKAEIAQKFGMTEFVNPKDHDRPIQQVLADMTDGGLDYTFECIGNVHTMRAALESCHKGWGTSVIIGVAAAGQEISTRPFQLVTGRVWKGTAFGGWKSVESVPRLVGEYQAGKIKVDEFISHTFPLDNINESFRLMHDGESIRSVIHF

SEQ ID NO: 8437 - protein, 377 aa, Branchiostoma floridae
MADTAGKPISCRAAVAWEAKKPLVIETIEVAPPKAHEVRIKVLATGVCHTDAYTLSGADSEGKFPVVLGHEGGGVVESVGEGVTGFQPGDHVIPLYIPQCRDCKFCRSPKTNLCQKIRVSQGQGVMPDGSSRFTCKGQTVYHFMGTSTFSEYTVVADISLCKVAESAPLEKVCLLGCGISTGYGAALNTAKVESGSTVAVWGLGAVGLAVIMGAKVAGASRIIGVDINPDKAEIAQKFGMTEFVNPKDHDRPIQQVLADMTDGGLDYTFECIGNVHTMRAALESCHKGWGTSVIIGVAAAGQEISTRPFQLVTGRVWKGTAFGGWKSVESVPRLVGEYQAGKIKVDEFISHTFPLDNINQSFQLMHDGESIRSVIHF

SEQ ID NO: 8438 - protein, 227 aa, Ipomoea batatas
MAREKIKIKKIDNITARQVTFSKRRRGLFKKAEELSVLCDADVALIIFSSTGKLFDYASSSMKGILERRNLHSKNLEKMDQPSLELQLVENANHSRLSKEIADMTHRLRQMRGEDLQGMSIEELQQLERSLETGLSRVIEKKGEKIMKEINELQQKGMNLMEEKERLTQQVMAISNGQRVTAVINSDNMLNEEGLSSESITNVCNSTSPPQDYDDSSDTSLKLGLPY

SEQ ID NO: 8439 - protein, 229 aa, Ipomoea batatas
MAREKIKIKKIDNITARQVTFSKRRRGLFKKAEELAVLCDADVALIVFSATGKLFEFASSNMKDILGKYELHSSNLDQATQPSRELQLENSLHVRLSKEVADKTRELRQMKGEELQGLSLEELQKLEKRLENGLTRVLETKGERVVTEIATLQRKGAELMKENKQLKEKMARVNGEKFPVIADVEAAGLIPEEGQSSESITTNVCSCNSGPPPEDDCSDTSLKLGLPIN

SEQ ID NO: 8440 - protein, 314 aa, Drosophila virilis
MSNKINPKRREPTVAAAVAAATAVVATNTSSSTGSSAGNTSSANTSSSSSSSLSSAGGGDAGMSADLTSLFECPVCFDYVLPPILQCSSGHLVCVSCRSKLTCCPTCRGPLANIRNLAMEEVASNVKFPCKHSGYGCTASLVYTEKTEHEETCECRPYLCPCPGASCKWQGPLDLVMQHLMMSHKSITTLQGEDIVFLATDINLPGAVDWVMMQSCFGHHFMLVLEKQEKYDGHQQFFAIVQLIGSRKEAENFVYRLELNGNRRRLTWEAMPRSIHEGVASAIHNSDCLVFDTSIAQLFADNGNLGINVTISLV

SEQ ID NO: 8441 - protein, 354 aa, Pneumocystis carinii f. sp. ratti
MGCSPLQSYKQDTSRSREIELYLRRDQEEAIHEAKILLLGAGESGKTTILKQMKLIHLSGFTLKEREYYRTIIFSNMLQAMRLIIEAMEEFDICFERRENEQYLDLLLQERELTDRENLPPEYYRPFISLWEDAGVMRAVNRGNEYALHDNCFSFFENIHRLFERKYIPTDQDILRCRLKTTGITETCFKVSRLTYRMIDVGGQRSERRKWFHCFENVTAVLFLVAISGYDQCLAEDIGANQMQEALVLFDSICNSQWFINTSIILFLNKIDLFRVKLHVSLISNYFPDFNSEHQTDYRASCLFFRQKFLKLNRNHQKTIYTHFTNATDTTLLKSVMISVTDIIFNRNLQNLML

SEQ ID NO: 8442 - protein, 354 aa, Pneumocystis carinii
MGCCFSATYNQDTLRSKEIESYLRQEQEHACHEAKILLLGAGESGETTILKQMKLIHLSGFTLKEREYYRTIIFSNMLQSMRLIIEAMEEFDICFERRENEQYLDLLLQERELTNRENLPPEYYRPFISLWKDAGVTRAVNRGNEYALHDNCFYFYENIHRLFERKYIPTDQDILRCRLKTTGITETCFKVSRLTYRMIDVGGQRSERRKWIHCFENVTAVLFLVAISGYDQCLTEDIGANQMQEALVLFDSICNSQWFINTSIILFLNKIDLFKVKLHVSLISNYFPDFNNENQTDYRACCLFFRQKFLRLNRNHQKTIYTHFTNATDTTLLKNVMISVTDIIFNRNLQNLML

SEQ ID NO: 8443 - protein, 318 aa, Pneumocystis carinii
FSATYNQDTLRSKEIESYLRQEQEHACHEAKILLLGAGESGKTTILKQMKLLHLSGLTLKEREYYRTIIFSNMLQSMRLIIEAMEEFDICVERRENEQYLDLLLQERELTNRENLPPEYYRPFISLWEDAGVTRAVNRGNEYALHDNCFYFFENIHRLFERKYTPTDQDILRCRLKTTGITETCFKVSRLTYRMIDVGGQRSERRKWIHCFENVTAVLFLVAISGYDQCLTEDIGANRMQEALVLFDSICNSQWFINTSIILFLNKIDLFKVKLHVSLISNYFPDFNNENQTDYRACCLFFRQKFLRLNRNHQKTIYT

SEQ ID NO: 8444 - protein, 444 aa, Brassica oleracea var. alboglabra
MRGVIPNYHHSYTLFFFVILVLFPHVFSTNTLSPNEALTISSNKTLVSPGDVFELGFFKTTTRNSPDGTDRWYLGIWYKTTSGHRTYVWVANRDNALHNSMGTLKISHASLVLLDHSNTPVWSTNFTGVAHLPVTAELLANGNFVLRDSKTNDLDRFMWQSFDYPVDTLLPEMKLGRNLIGSENEKILTSWKSPTDPSSGDFSFILETEGFLHEFYLLKNEFKVYRTGPWNGVRFNGIPKMQNWSYIDNSFIDNNEEVAYSFQVNNNHNIHTRFRMSSTGYLQVITWTKTVPQRNMFWSFPEDTCDLYKVCGPYAYCDMHTSPTCNCIKGFVPKNAGRWDLRDMSGGCVRSSKLSCGEGDGFLRMSQMKLPETSEAVVDKRIGLKECREKCVRDCNCTGYANMDIMNGGSGCVMWTGELDDMRKYNAGGQDLYVKVAAASLVPS

SEQ ID NO: 8445 - protein, 444 aa, Brassica oleracea var. alboglabra
MRGVIPNYHHSYTLLFFVILVLFPHVFSTNTLSPNEALTISSNKTLVSPGDVFELGFFKTTTRNSPDGTDRWYLGIWYKTTSGHRTYVWVANRDNALHNSMGTLKISHASLVLLDHSNTPVWSTNFTGVAHLPVTAELLANGNFVLRDSKTTALDRFMWQSFDYPVDTLLPEMKLGRNRNGSGNEKILTSWKSPTDPSSGDYSFILETEGFLHEFYLLNNEFKVYRTGPWNGVRFNGIPKMQNWSYIDNSFIDNNKEVAYSFQVNNNHNIHTRFRMSSTGYLQVITWTKTVPQRNMFWSFPEDTCDLYKVCGPYAYCDMHTSPTCNCIKGFVPKNAGRWDLRDMSGGCVRSSKLSCGEGDGFLRMSQMKLPETSEAVVDKRIGLKECREKCVRDCNCTGYANMDIMNGGSGCVMWTGELDDMRKYNAGGQDLYLKVAAASLVPS

SEQ ID NO: 8446 - protein, 435 aa, Brassica oleracea var. alboglabra
MKGVGKPYENSHTSFLLVFFVLTLFSPAFSINTLSSIESLKISNSRTLVSPGNVLELGFFRTPSSSRWYLGMWYKKLSERTYVWVANRDNPLSCSIGTLKISNMNLVLLDHSNKSLWSTNHTRGNERSPVVAELLANGNFVLRDSNKNDRSGFLWQSFDYPTDTLLPEMKLGYDLRTGLNRFLTSWRSSDDPSSGDFSYKLQTRRLPEFYLFKDDFLVHRSGPWNGVGFSGMPEDQKLSYMVYNFTQNSEEVAYTFLMTNNSIYSRLTISSSGYFERLTWTPSSGMWNVFWSSPEDFQCDVYKICGAYSYCDVNTSPVCNCIQRFDPSNVQEWGLRAWSGGCRRRTRLSCSGDGFTRMKKMKLPETTMAIVDRSIGLKECEKRCLSDCNCTAFANADIRNGGTGCVIWTGQLEDIRTYFANGQDLYVRLAPADLV

SEQ ID NO: 8447 - protein, 261 aa, Zea mays; identical to SEQ ID NO: 6426

SEQ ID NO: 8448 - protein, 261 aa, Zea mays
MASAELSREENVYMAKLAEQAERYEEMVEFMEKVAKTVDSEELTVEERNLLSVAYKNVIGARRASWRIISSIEQKEEGRGNEDRVTLIKDYRGKIETELTKICDGILKLLESHLVPSSTAPESKVFYLKMKGDYYRYLAEFKTGAERKDAAENTMVAYKAAQDIALAELAPTHPIRLGLALNFSVFYYEILNSPDRACSLAKQAFDEAISELDTLSEESYKDSTLIMQLLHDNLTLWTSDISEDPAEEIREAPKHDLSEGQ

SEQ ID NO: 8449 - protein, 246 aa, Ovis aries
MTMDKSELVQKAKLAEQAERYDDMAAAMKAVTEQGHELSNEERNLLSVAYKNVVGARRSSWRVISSIEQKTERNEKKQQMGKEYREKIEAELQDICNDVLQLLDKYLIPNATQPESKVFYLKMKGDYFRYLSEVASGDNKQTTVSNSQQAYQEAFEISKKEMQPTHPIRLGLALNFSVFYYEILNSPEKACSLAKTAFDEAIAELDTLNEESYKDSTLIMQLLRDNLTLWTSENQGDEGDAGEGEN

SEQ ID NO: 8450 - protein, 496 aa, Thlaspi arvense
MDLLYIVAALVIFASLLIAKSKRKPKKNLPPGPPRLPIIGNLHQLGEKPHRAMVELSKTYGPLMSLKLGSVTTVVATSVETVRDVLKTYDLECCSRPYMTYPARITYNLKDLVFSPYDKYWRQVRKLTVVELYTAKRVQSFRHIREEEVASFVRFNKQAASSEETVNLSQKILKMSGSVICRIGFGINLEGSKLENTYQEIIVQAFEVLGSLAAVDYFPVIGTIIDRITGLHAKCEKVFHGIDSFFDQAIQRHIDDPSIKDDIIDLLLKMERGEGSLGEYELTREHTKGILMNILTAGIDTSAQTMTWAMTHLLANPRVMKKLQAEIREKIKNIDEITDDDVEQLDYFKLVLKETFRISPIVPVLVPRVAAKDLKIAGYDVPEKTWIHVNMWAVHMSPSIWKDPETFNPERFIDNQTDFKGLNFELLPFGSGRRMCPGMGMGLAVVHLTLINLLYRFDWKLPNGMKAEELSIEENYGLICVKKLPLEAIPVLTQWT

SEQ ID NO: 8451 - protein, 298 aa, Mesocricetus auratus
MENFQKVEKIGEGTYGVVYKAKNKLTGEVVALKKIRLDTETEGVPSTAIREISLLKELNHPNIVKLLDVIHTENKLYLVFELLHQDLKKFMDASAVTGIPLPLIKSYLFQLLQGLAFCHSHRVLHRDLKPQNLLINAEGSIKLADFGLARAFGVPVRTYTHEVVTLWYRAPEILLGCKYYSTAVDIWSLGCIFAEMVTRRALFPGDSEIDQLFRIFRTLGTPDEVVWPGVTSMPDYKPSFPKWARQDFSKVVPPLDEDGRSLLSQMLHYDPNKRISAKAALAHPFFQDVTKPVPHLRL

SEQ ID NO: 8452 - protein, 492 aa, Candida albicans
MPQVTKTNNENEFRLTRSKVQHQESISTIKNTTISNSQHKQQTQQQISSPPQVSVTSSEGVSHVNTRQYLGDVSNQYITNAKPTNKRKPLGGDNAPLQKQQHRPSRPIPIASDNNNNGSTSSSSNSSNNNNNDANRLASLAVPSRLPQKRQATESSTNLVEKLRVPQPEVGERSQSYHKKSRLIDYEWQDLDEEDNDDQLMVSEYVNEIFSYYYELETRMLPDPQYLFKQTLLKPRMRSILVDWLVEMHLKFKLLPESLFLAVNVMDRFMSVEVVQIDKLQLLATAALFTAAKNEEVFSPSVKNYAYFTDGSYTPEEVVQAEKYMLTILNFDLNYPNPMNFLRRISKADDYDVQSRTLGKYLLEITIVDYKFIGMRPSLCCASAMYLARLILGKLPVWNGNLIHYSGGYRISDMRECIELMFQYLIAPIEHDEFFKKYAMRKFMRASTLCRNWAKKFQASGRDLFDERLSTHRLTLEDDDEEEEIVVAEAEE

SEQ ID NO: 8453 - protein, 415 aa, Xenopus laevis
MSDHLLRDEHQENVQPRKLLVPVGGRTVLGVLQENHRGPKALKVSKPALQQTQVLSVNHLGVNDENYGKIPARKAASKQPAFTIHVDEPDCATNKRKAVHKKTVQDENLQQLNSVLGSIGTRKPLHPIQIAMETSFGSPMDVSIVDEEQKVVGCNNVADYAKEIHTYLREMEVKCKPKAGYMQKQPDITGNMRAILVDWLVEVGEEYKLQNETLYLAVNYIDRFLSSMSVLRGKLQLVGTAAMLLASKFEEIYPPEVAEFVYITDDTYTKKQVLKMEHLVLKVLSFDLAAPTILQYLNQYFQIHPVSPKVESLSMFLGELSLVDADPFLRYLPSVVAAAAFVIANCTINERTWSDPLVEYTSYTLETLKPCILDLYQTYLSAASHQQQAVREKYKAPKNHAVSLIIPPESMSTFL

SEQ ID NO: 8454 - protein, 507 aa, Emericella nidulans
MDFAKLLVASPEVNPNNRKALTIPVLNPFNTYGRVFFFSWFGFMLAFLSWYAFPPLLTVTIRDDLDMSQTQIANSNIIALLATLLVRLICGPLCDRFGPRLVFIGLLLVGSIPTAMAGLVTSPQGLIALRFFIGILGGTFVPCQVWCTGFFDKSIVGTANSLAAGLGNAGGGITYFVMPAIFDSLIRDQGLPAHKAWRVAYIVPFILIVAAALGMLFTCDDTPTGKWSERHIWMKEDTQTASKGNIVDLSSGAQSSRPSGPPSIIAYAIPDVEKKGTETPLEPQSQAIGQFDAFRANAVASPSRKEAFNVIFSLATMAVAVPYACSFGSELAINSILGDYYDKNFPYMGQTQTGKWAAMFGFLNIVCRPAGGFLADFLYRKTNTPWAKKLLLSFLGVVMGAFMIAMGFSDPKSEATMFGLTAGLAFFLESCNGAIFSLVPHVHPYANGIVSGMVGGFGNLGGIIFAIIFRYSHHDYARGIWILGVISMAVFISVSWVRPVPKSQMRE

SEQ ID NO: 8455 - protein, 324 aa, Rana temporaria
MTLTKETRVTLNDGNMMPILGLGTYASPHVPKSLAEEAVKIAIDVGYRHIDCAFITGNEMHIGNGIRSKISDGTVKREDIFYTGKLWCTYFSPEMVRKGLERSLRDVGMDYLDLFLMHWPVSLKPSGASDPSDKDKPFIYDNVDLCATWEALEARKDAGLVRSLGVSNFNRRQLERILNKPGLKYKPVCNQVECHVYLNQNKLHSYCKSKDIVLVTYSVLGSHRDRNWVDLSLPVLLDDPILNKVAAKYNRTSAEIAMRFILQKGIVVLAKSFTPARIKQNLGVFEFELKPEDMKSLESLDRNLHYGPFREVKQHPEYPFHDEY

SEQ ID NO: 8456 - protein, 241 aa, Petunia x hybrida
MGRGRVELKRIENKINRQVTFAKRRNGLLKKAYELSVLCDAEVALIIFSNRGKLYEFCSSSSMLKTLERYQKCNYGAPETNISTREALEISSQQEYLKLKARYEALQRSQRNLLGEDLGPLNSKELESLERQLDMSLKQIRSTRTQLMLDQLQDLQRKEHALNEANRTLKQRLMEGSTLNLQWQQNAQDVGYGRQATQTQGDGFFHPLECEPTLQIGYQNDPITVGGAGPSVNNYMAGWLP

SEQ ID NO: 8457 - protein, 354 aa, Xenopus laevis
MGCTLSAEERAALERSKQIEKNLKEDGVTAAKDVKLLLLGAGESGKSTIVKQMKIIHEDGFSGEDVKQYKPVVYSNTIQSLAAIVRAMDTLGIEYGDKERRADAKMVCDVVSRMEDTEPYSPELLSAMVRLWADSGIQECFNRSREYQLNDSAKYYLDSLDRIGAPDYQPTEQDILRTRVKTTGIVETHFTFKNLHFRLFDVGGQRSERKKWWHCFEDVTAIIFCVALTGYDQVLHEDETTNRMHESLKLFDSICNNKWFTDTSIILFLNKKDIFQEKIKSSPLTICFPEYTGPNSFTEAVAHTQHQYESRNKSENKEIYTHITCATDTQNIQFVFDAVTDVIIAYNLRGCGLY

SEQ ID NO: 8458 - protein, 384 aa, Lotus japonicus
MGLLCSKNRRYNDADTEENTQTAEIERRIELETKAEKHIQKLLLLGAGESGKSTIFKQIKLLFQTGFDEAELKSYQPVIHANVYQTIKLLHDGAKELAQNDVDFSKYVISDENKEIGEKLSEIGGRLDYPCLTKELALEIENLWKDAAIQETYARGNELQVPDCTHYFMENLHRLSDANYVPTKDDVLYARVRTTGVVEIQFSPVGENKKSGEVYRLFDVGGQRNERRKWIHLFEGVSAVIFCAAISEYDQTLFEDENKNRMMETKELFEWVLKQPCFEKTSFMLFLNKFDIFEKKILKVPLNVCEWFKDYQPVSTGKQEIEHAYEFVKKKFEESYFQNTAPDRVDRVFKIYRTTALDQKVVKKTFKLVDETLRRRNLFEAGLL

SEQ ID NO: 8459 - protein, 380 aa, Oryza sativa
MGSSCSRSHSLSEAETTKNAKSADIDRRILQETKAEQHIHKLLLLGAGESGKSTIFKQIKLLFQTGFDEAELRSYTSVIHANVYQTIKILYEGAKELSQVESDSSKYVISPDNQEIGEKLSDIDGRLDYPLLNKELVLDVKRLWQDPAIQETYLRGSILQLPDCAQYFMENLDRLAEAGYVPTKEDVLYARVRTNGVVQIQFSPVGENKRGGEVYRLYDVGGQRNERRKWIHLFEGVNAVIFCAAISEYDQMLFEDETKNRMMETKELFDWVLKQRCFEKTSFILFLNKFDIFEKKIQKVPLSVCEWFKDYQPIAPGKQEVEHAYEFVKKKFEELYFQSSKPDRVDRVFKIYRTTALDQKLVKKTFKLIDESMRRSREGT

SEQ ID NO: 8460 - protein, 385 aa, Glycine max; identical to SEQ ID NO: 1511

SEQ ID NO: 8461 - protein, 334 aa, Oryza sativa; identical to SEQ ID NO: 3554

SEQ ID NO: 8462 - protein, 166 aa, Sinapis alba
MASPDVEYRCFVGGLAWATDDRALETAFSQYGEVLDSKIINDRETGRSRGFGFVTFKDEKSMKDAIEGMNGQDLDGRSITVNEAQSRGSGGGGGGRGGGGGYRSGGGGGYGGGGGGYGGGGREGGYSGGGGGYSSRGGGGGGYGGGGRRDGGEGGGYGGSGGGGGW

SEQ ID NO: 8463 - protein, 169 aa, Sinapis alba
MASPDVEYRCFVGGLAWATDERSLETAFSQFGELVDSKIINDRETGRSRGFGFVTFKDEKSMKDAIEGMNGQDLDGRSITVNEAQSRGSGAGGGGRGGGGGYRGGGGYGGGGGGYGGGRREGGGYSGGGGGYSSRGGGGGGYGGGGRRDGGGYGGGEGGGYGGGGGGGW

SEQ ID NO: 8464 - protein, 495 aa, Canis familiaris
MGTQKVTVSLIFALSIATIGSFQFGYNTGVINAPETIIKDFLNYTLEEKSENLPTEVLLTSLWSLSVAIFSVGGMIGSFSVGLFVNRFGRRNSMLMVNLLAVAGGCLMGFCKIAQSVEMLILGRLIIGLFCGLCTGFVPMYIGEISPTALRGAFGTLNQLGIVIGILVAQIFGLKVIMGTEELWPLLLGFTIIPAVLQSAALPFCPESPRFLLINRKEEENAKEILQRLWGTQDVSQDIQEMKDESARMAQEKQVTVLELFRSRSYRQPIIISIMLQLSQQLSGINAVFYYSTGIFKDAGVEEPIYATIGAGVVNTIFTVVSLFLVERAGRRTLHMIGLGGMAVCSILMTISLLLKDNYNWMSFVCIGAILVFVAFFEIGPGPIPWFIVAELFSQGPRPAAMAVAGCSNWTSNFLVGLLFPSAAFYLGAYVFIIFTGFLIVFLVFTFFKVPETRGRTFEEITRAFEGQGQDANRAEKGPIVEMNSMQPVKETATV

SEQ ID NO: 8465 - protein, 494 aa, Ovis aries
MGTTKVTTPLIFAISIATIGSFQFGYNTGVINAPEAIIKDFLNYTLEERSETPPSSVLLTSLWSLSVAIFSVGGMIGSFSVGLFVNRFGRRNSMLIVNLLAIAGGCLMGFCKIAESVEMLILGRLIIGLFCGLCTGFVPMYIGEISPTALRGAFGTLNQLGIVIGILVAQIFGLKVILGTEDLWPLLLGFTILPAIIQCAALPFCPESPRFLLINRKEEEKAKEILQRLWGTEDVAQDIQEMKDESMRMSQEKQVTVLELFRAPNYRQPIIISIMLQLSQQLSGINAVFYYSTGIFKDAGVQEPVYATIGAGVVNTIFTVVSVFLVERAGRRTLHLIGLGGMAFCSILMTISLLLKDNYSWMSFICIGAILVFVAFFEIGPGPIPWFIVAELFGQGPRPAAMAVAGCSNWTSNFLVGLLFPSATFYLGAYVFIVFTVFLVIFWVFTFFKVPETRGRTFEEITRAFEGQVQTGTRGEKGPIMEMNSIQPTKDTNA

SEQ ID NO: 8466 - protein, 551 aa, Kluyveromyces lactis
MSLKNWLLLRDIQYEGTFYKKFPHVYNIYVIGFIACISGLMFGFDIASMSSMIGTDVYKDYFSNPDSLTYGGITASMAGGSFLGSLISPNFSDAFGRKVSLHICAALWIIGAILQCAAQDQAMLIVGRVISGMGIGFGSSAAPVYCSEISPPKIRGTISGLFQFSVTVGIMVLFYIGYGCHFIDGAAAFRITWGLQMVPGLILMVGVFFIPESPRWLANHDRWEETSLIVANIVANGDVNNEQVRFQLEEIKEQVIIDSAAKNFGYKDLFRKKTLPKTIVGVSAQMWQQLCGMNVMMYYIVYIFNMAGYTGNTNLVASSIQYVLNVVMTIPALFLIDKFGRRPVLIIGGIFMFTWLFSVAGILATYSVPAPGGVNGDDTVTIQIPSENTSAANGVIASSYLFVCFFAPTWGIGIWIYCSEIFNNMERAKGSALSAATNWAFNFALAMFVPSAFKNISWKTYIIFGVFSVALTIQTFFMFPETKGKTLEEIDQMWVDNIPAWRTANYIPQLPIVKDEEGNKLGLLGNPQHLEDVHSNEKGLLDRSDSASNSN

SEQ ID NO: 8467 - protein, 411 aa, Rattus norvegicus
MSRSKRDNNFYSVEIADSTFTVLKRYQNLKPIGSGAQGIVCAAYDAILERNVAIKKLSRPFQNQTHAKRAYRELVLMKCVNHKNIIGLLNVFTPQKSLEEFQDVYIVMELMDANLCQVIQMELDHERMSYLLYQMLCGIKHLHSAGIIHRDLKPSNIVVKSDCTLKILDFGLARTAGTSFMMTPYVVTRYYRAPEVILGMGYKENVDLWSVGCIMGEMVCLKILFPGRDYIDQWNKVIEQLGTPCPEFMKKLQPTVRTYVENRPKYAGYSFEKLFPDVLFPADSEHNKLKASQARDLLSKMLVIDASKRISVDEALQHPYINVWYDPSEAEAPPPKIPDKQLDEREHTIEEWKELIYKEVMDLEERTKNGVIRGQPSPLGAAVINGSQHPVSSPSVNDMSSMSTDPTLASD

SEQ ID NO: 8468 - protein, 337 aa, Ascaris suum
MENREQEEIEPCVSITIDPNNNKLNVDDFDRICTIGTGSFGRVYLVQHRASEQYFALKKMAIREVVSMRQTEHVHSEKRLLSRLSHPFIVKMYCASWDKYNLYMLFEYLAGGELFSYLRASRTFSNSMARFYAAEIVCALQYLHSKNIAYRDLKPENLMLNKEGHLKMTDFGFAKEVIDRTWTMCGTPEYLAPEVIGNKGHDTAVDWWSLGVLIYEMMIGIPPFRGKTLDEIYEKIILGKLRFTRSFDLFAKDLVKKLLQVDRTQRLGNQKDGAADVMNHKWFTDIDWDDVQNMKLTPPIIPTLYSNGDTGNFDSYDECSDDEIAAPQHELELFEDW

SEQ ID NO: 8469 - protein, 619 aa, Neurospora crassa
MKFLGIAALVAGLLAPSLVLGAPAPGTEGVNLLTPVDKRQDSQAERYGGGGGGGCNSPTNRQCWSPGFNINTDYELGTPNTGKTRRYKLTLTETDNWLGPDGVIKDKVMMVNDNIIGPTIQADWGDYIEITVINKLKSNGTSIHWHGMHQRNSNIQDGVNGVTECPIPPRGGSKVYRWRATQYGTSWYHSHFSAQYGNGIVGPIVINGPASANYDVDLGPFPLTDYYYDTADRLVLLTQHAGPPPSNNVLFNGFAKHPTTGAGQYATVSLTKGKKHRLRLINTSVENHFQLSLVNHSMTIISADLVPVQPYKVDSLLLGIGQRYDVIIDANQAVGNYWFNVTFGGNDLCGTSDNKYPAAIFRYQGAPKALPTNKGVAPPDHQCLDLNDLKPVLQRSLNTNSIALNTGNTIPITLDGFVWRVNGTAININWNKPVLEYVMTGNTNYSQSDNIVQVEGVNQWKYWLIENDPDGAFSLPHPIHLHGHDFLILGRSPDVTAISQTRYVFDPAVDMARLNGNNPTRRDTAMLPAKGWLLIAFRTDNPGSWLMHCHIAWHVSGGLSNQFLERAQDLRNSISPADKKAFNDNCDAWRAYFPDNAPFPKDDSGLRSGVKAREVKMKW

SEQ ID NO: 8470 - protein, 907 aa, Pseudomonas syringae pv. syringae
MLLLTILPASLMAAMLGGYFTWMQLSELQSQLLQRGEMIAQDLAPLAANALGRKDKVLLSRIATQTLEQTDVRAVSFLDTDRTVLAHAGPTMISPSPIGSGSQLLSSTGTDATRYLLPVFGSQRHLTSPIIPAEADTLLGWVELEISHNGTLLRGYRSLFASLLLILTGLAFTATLAVRMSRTINGPMSQIKQAVSQLKDGNLETRLPPLGSRELDELASGINRMAATLQNAQEELQLSIDQATEDVRQNLETIEIQNIELDLARKEALEASRIKSEFLANMSHEIRTPLNGILGFTHLLQKSELTPRQFDYLGTIEKSADNLLSIINEILDFSKIEAGKLVLDNIPFNLRDLLQDTLTILAPAAHAKQLELVSLVYRDTPLALSGDPLRLRQILTNLVSNAIKFTREGTIVARAMLEDETEEHAQLRISVQDTGIGLSSQDVRALFQAFSQADNSLSRQPGGTGLGLVISKRLIEQMGGEIGVDSTPGEGSEFWISLKLPKAREDKEESLNIPLGGLRAAVLEHHDLARQALEHQLEDCGLQTIVFNNLENLLNGVTAAHETPAAIDLAVLGVTALEISPERLRQHIWDLENLNCKVMVLCPTTEHALFQLAVHDVYTQLQAKPACTRKLQKALSELIAPRAVRADIGPPLSSRAPRVLCVDDNPANLLLVQTLLEDMGAEVVAVEGGYAAVNAVQQEAFDLVLMDVQMPGMDGRQATEAIRAWEAERNQSSLPIVALTAHAMANEKRSLLQSGMDDYLTKPISERQLAQVVLKWTGLALRNPAPERQNEALEVHVGPLVLDHEEGLRLAAGKADLAADMLAMLLASLDADREAIRVARANQDVHALIERIHRLHGATRYCGVPQLRSACQRAETLLKQNAPHTEEALNDLDKAIIRLEAEARVMA

SEQ ID NO: 8471 - protein, 361 aa, Xenopus laevis
MSSNQSYVFYRQELNKTLWEVPDRYQNLTPVGSGAYGSVCSSFDTRTALRIAVKKLSRPFQSIIHAKRTYRELRLLKHMKHENVIGLLDVFSPAKSFEEFNDVYLVTHLMGADLNNIVKCQKLTDDHVQFLIYQILRGLKYIHSAGIIHRDLKPSNLAVNEDCELKILDFGLARHTDEEMTGYVATRWYRAPEIMLNWMHYNQTVDIWSVGCIMAELLTGRTLFPGTDHIDQLKLILRLVGTPEPELLQKISSEAARNYIQSLPYMPKMNFEDVFLGANPQAVDLLEKMLVLDTDKRITAAEALAHSYFAQYHDPDDEPIAEPYDQSFESRELDIEEWKRLTYEEVTCFVPPPLDSEEMES

SEQ ID NO: 8472 - protein, 822 aa, Cricetulus griseus
MMLRWSGIWGLSPPRIFPSLLVVVALVGLLPVLRSHGLQPSPTANTIRGAEPPRERSIGDVTTAPSEPVHHPDDRNLTNLHIEHGAKTLRKAFPVLDIDYLHVRTPFEISLWILLACLMKIGFHVIPTISSIVPESCLLIVVGLLVGGLIKGVGETPPFLQSDVFFLFLLPPIILDAGYFLPLRQFTENLGTILIFAVVGTLWNAFFLGGLLYAVCLVGGEQINNIGLLDTLLFGSIISAVDPVAVVAVFEEIHINELLHILVFGESLLNDAVTVVLYHLFEEFANYDSIGISDIFLGFLSFFVVALGGVFVGVVYGVIAAFTSRFTSHIRVIEPLFVFLYSYMAYLSAELFHLSGIMALIASGVVMRPYVEANISHKSHTTIKYFLKMWSSVSETLIFIFLGVSTVAGSHQWNWTFVISTLLFCLIARVLGVLVLTWFINKFRIVKLTPKDQFIIAYGGLRGAIAFSLGYLMDKKHFPMCDLFLTAIITVIFFTVFVQGMTIRPLVDLLAVKKKQETKRSINEEIHTQFLDHLLTGIEDICGHYGHHHWKDKLNRFNKKYVKKCLIAGERSKEPQLIAFYHKMEMKQAIELVESGGMGKIPSAVSTVSMQNIHPKSMASERILPALSKDKEEEIRKILRSNLQKTRQRLRSYNRHTLVADPYEEAWNQMLLRRQKARQLEQKMSNYLTVPAHKLDSPTMSRARIGSDPLAYEPKADLPVITIDPASPQSPESVDLVNEELKAKVLGVNRDPTRLTRGEEDEDEDEDGVIMMRRKEPSSPGTDVFTPAPMYSPSSQRIQRCLSDPGPHPEPGEGEPFIPKGE

SEQ ID NO: 8473 - protein, 818 aa, Sus scrofa
MLLWSGICGLSPPRIFPSLLVVVALVGLLPVLRSHGLQPSPTASTIRGSEPPRERSIGDVTTAPPELAPESRPVNHSVTEHGMKARKAFPVLGIDYTHVRTPFEISLWILLACLMKIGFHVIPTISSIVPESCLLIVVGLLVGGLIKAVGETPPFLQSEVFFLFLLPPIILDAGYFLPLRQFTENLGTILIFAVVGTLWNAFFLGGLMYAVCLVGGEQINNIGLLDNLLFGSIISAVDPVAVLAVFEEIHINELLHILVFGESLLNDAVTVVLYHLFEEFANYDRVGIVDIVLGFLSFFVVSLGGVFVGVVYGVIAAFTSRFTSHIRVIEPLFVFLYSYMAYLSAELFHLSGIMALIASGVVMRPYVEANISHKSHTTIKYFLKMWSSVSETLIFIFLGVSTVAGSHHWNWTFVISTLLFCLIARVLGVLGLTWFINKFRIVKLTPKDQFIIAYGGLRGAIAFSLGHLLDKNHFPMCDLFLTAIITVIFFTVFVQGMTIRPLVDLLAVKKKQETKRSINEEIHTQFLDHLLTGIEDICGHYGHHHWKDKLNRFNKKYVKKCLIAGERSKEPQLIAFYHKMEMKQAIELVESGGMGKIPSAVSTVSMQNIHPKTLPTERILPALSKDKEEEIRKILRNNLQKTRQRLRSYNRHTLVADPYEEAWNQMLLRRQKARQLEQKINNHLTVPAHKLDSPTMSRARIGSDPLAYEPKADLPVITIDPASPQSPESVDLVNEELKGKVLGLSREPGRATEEEDDDEDHDGGLVMRTKEPSSPGTDDVFTPAPSDSPSSQRIQRCLSDPGPHPEPGEGEPFIPKGQ

SEQ ID NO: 8474 - protein, 813 aa, Rattus norvegicus
MGPSGTAHRMRAPLSWLLLLLLSLQVAVPAGALAETLLDAPGARGASSNPPSPASVVAPGTTPFEESRLPVFTLDYPHVQIPFEITLWILLASLAKIGFHLYHKLPTIVPESCLLIMVGLLLGGIIFGVDEKSPPAMKTDVFFLYLLPPIVLDAGYFMPTRPFFENLGTIFWYAVVGTLWNSIGIGLSLFGICQIEAFGLSDITLLQNLLFGSLISAVDPVAVLAVFENIHVNEQLYILVFGESLLNDAVTVVLYNLFKSFCQMKTIQTVDVFAGIANFFVVGIGGVLIGILLGFIAAFTTRFTHNIRVIEPLFVFLYSYLSYITAEMFHLSGIMAITACAMTMNKYVEENVSQKSYTTIKYFMKMLSSVSETLIFIFMGVSTVGKNHEWNWAFVCFTLAFCLIWRALGVFVLTQVINWFRTIPLTFKDQFIIAYGGLRGAICFALVFLLPATVFPRKKLFITAAIVVIFFTVFILGITIRPLVEFLDVKRSNKKQQAVSEEIHCRFFDHVKTGIEDVCGHWGHNFWRDKFKKFDDKYLRKLLIRENQPKSSIVSLYKKLEIKHAIEMAETGMISTVPSFASLNDCREEKIRKLTPGEMDEIREILSRNLYQIRQRTLSYNRHNLTADTSERQAKEILIRRRHSLRESLRKDNSLNRERRASTSTSRYLSLPKNTKLPEKLQKKNKVSNADGNSSDSDMDGTTVLNLQPRARRFLPDQFSKKASPAYKMEWKNEVDVGSARAPPSVTPAPRSKEGGTQTPGVLRQPLLSKDQRFGRGREDSLTEDVPPKPPPRLVRRASEPGNRKGRLGNEKP

SEQ ID NO: 8475 - protein, 742 aa, Thermomonospora curvata
MIEPLQPGDPGRIGPYRLVSRLGAGGMGQVFLARSPGGRPVVVKVILPEYANDDEYRIRFAREVEAARRVGGFHTAQVIDADPTADPPWMATAYIPGPSLRKAVTERGPLYGNNLRTLAAGLVEGLAAIHACGLVHRDFKPSNIVLAADGPRVIDFGVARPLDSSVMTQSGAVIGTLAYMSPEQTDGSQVGPASDVFSLGTVLAFAATGRSPFMADSIGEIIARISGPPPELPELPDDLRELVYACWEQNPDLRPTTAELLAQLSTDHTGDDWPPPHLSDLIGSMLPLGATTSPNPSLAIEPPPPSHGPPRPSEPLPDPGDDADEPSAEKPSRTLPEPEPPELEEKPIQVIHEPERPAPTPPRPREPARGAIKPKNPRPAAPQPPWSPPRVQPPRWKQLITKKPVAGILTAVATAGLVVSFLVWQWTLPETPLRPDSSTAPSESADPHELNEPRILTTDREAVAVAFSPGGSLLAGGSGDKLIHVWDVASGDELHTLEGHTDWVRAVAFSPDGALLASGSDDATVRLWDVAAAEERAVFEGHTHYVLDIAFSPDGSMVASGSRDGTARLWNVATGTEHAVLKGHTDYVYAVAFSPDGSMVASGSRDGTIRLWDVATGKERDVLQAPAENVVSLAFSPDGSMLVHGSDSTVHLWDVASGEALHTFEGHTDWVRAVAFSPDGALLASGSDDRTIRLWDVAAQEEHTTLEGHTEPVHSVAFHPEGTTLASASEDGTIRIWPIATE

SEQ ID NO: 8476 - protein, 208 aa, Mesorhizobium loti
MTRPILYGADYSVYVRIARMALEEKGVDYELVPLDIFAADGIPAWYLEHHPFGRIPAFEHDGFRLFETNAITRYVDEAFDGPALQPADARGRARMGQMTGMLDAYGYRAMVWDVAVERLEKVEPDWALIASGLAQAETVLKVLRSLKAQGPWLLGDQLTLADLHAAPIIAYFVKVTQGRDLLARFADMRDWYARVADRASFARSEKAD

SEQ ID NO: 8477 - protein, 342 aa, Mesorhizobium loti
MTQDIETIGIADLFGPPSPGRDRADISIMAAASGIGFMAVRDFPGDAWLMPERRAQLLHIFALPDTEKQKLLRWNFDRTRKNVYRGWFSLQPTAVSYKEGIDMGPDIADAAGVSASDDPLCEPTPLPTEDALPGWRAAAADYYRAMETVSNALMRSIARGLDLPETIFDSYFEHGISTLRLIRYPLRDANAGIDISGPEFSVVHKGETRTIIGREHADSGFVTLLAQDGVEGLQAKNLAGEWIDVPPANSTLAVNFGQLLERWTGGRVRATRHRVIAPKTARFSIPFFYEPRVDAEIAPLPLSGAEPFEPFLYGDYLWEAATNFVEMAGIKHLRQPRRAKAS

SEQ ID NO: 8478 - protein, 271 aa, Mesorhizobium loti
MQPVDPIWRSIRDEAMDAVNRDPLLAAFLYSTILNQESLEEAVIHRIAERLAHQDIGSDLIRQTFKTMLADDKEWPTTVRVDIQAYYDRDPACDRFIMPVLYFKGFHAIQTHRLAHWLWNQGRKDFALYLQSRSSSVFQTDINPAARIGKGIFIDHATGLVVGETAVIEDDVSILHGVTLGGTGKAGGDRHPKIRRGVLIGAGAKILGNIEIGHCSKVAAGSVVLSPVPHNKTVAGVPARVVGETGCDQPSRQMDQLLPSQSMDQVVSFDI

SEQ ID NO: 8479 - protein, 290 aa, Mesorhizobium loti
MAVAAIMVGLTFSWGLNYVAAKISYAGYDPVFLSIARSIIGGFCVFLWCRWRGIALFTRDGTLLAGIAVGVLFGIEFLCLYVGLEHTTVARNTLLVNSMPFWMLIGGHLLLGEQITMRKFLGLLLAFAGLAAVFSDKLGGGGDMLFGDLLSLGSGFFWALTNILIKRSKLVEASAEKLLLYQLAGAAMVGILVLPLAGPPVRDPSLLPTLALLFQAIYIVAFTYVLWFWLLRRYPASGLSSFTFLSPVFGVLCGAVILNEPLTMRIFLALGLIAAGLIIVNRPARKLTPV

SEQ ID NO: 8480 - protein, 112 aa, Mesorhizobium loti
MKKIEAIIKPFKLDEVKEALQEAGLQGITVTEAKGFGRQKGHTELYRGAEYVVDFLPKVKIEVVLGDDAVEGAIEAIRKAAQTGRIGDGKIFVSNIEEVVRIRTGETGMDAV

SEQ ID NO: 8481 - protein, 424 aa, Mesorhizobium loti
MTAIIDIVGREILDSRGNPTVEVDVVLEDGSMGRAAVPSGASTGAHEAVELRDGGARYLGKGVLKAVEAVNGELFEAIGGMEAENQIHIDQTMIELDGTPNKSRLGANAILGVSLAVAKAAADAAGLPLYRYVGGTKAHILPVPMMNIINGGAHADNPIDFQEFMILPVGAPTLREGVRWGSEIFHTLRKKLKDAGHNTNVGDEGGFAPNLKSAPVALDFIMESIEKAGFKPGEEIALGLDCAATEFFKDGNYVYEGEKKTRDPKAQAKYLAKLAADYPIVSIEDGLAEDDWEGWKYLTDLIGKKTQLVGDDLFVTNTARLRDGIRMGVANSILVKVNQIGSLTETLDAVETAHKAGYTAVMSHRSGETEDSTIADLAVATNCGQIKTGSLSRSDRMAKYNQLIRIEEELGKQARYAGKSVIKG

SEQ ID NO: 8482 - protein, 461 aa, Mesorhizobium loti
MPIEILMPALSPTMEEGNLSKWLKNEGDKVVAGDVIAEIETDKATMEVEAVDEGTLAKIVVPAGTEGVKVNAVIAVLAVEGEDTDKAGEGIGEEPAKAETASPAPVAAKSEAAAPVAAAPKTEIAADPDIPAGTEMVSTTVREALRDAMAEEMRRDGDVFVMGEEVAEYQGAYKITQGLLQEFGPRRVVDTPITEHGFAGVGVGAAMAGLKPIVEFMTFNFAMQAIDQIINSAAKTLYMSGGQMGAPIVFRGPNGAAARVAAQHSQCYAAWYSHIPGLKVVMPYTAADAKGLLKAAIRDPNPVIFLENEILYGQSFDVPKLDDFVLPIGKARIHKQGKDVTIVSFGIGMTYAVKAEAELRGLGIDAEIIDLRTIRPLDLDTIIASVKKTNRLVVVEEGFPQSSVGDHIANQVSQRAFDFLDAPVITIAGKDVPMPYAANLEKLALPNVGEVIEAVKAVTYR

SEQ ID NO: 8483 - protein, 506 aa, Mesorhizobium loti
MPLQRSNTADKFIVDRRKPHRNSDVARAVRKTRDRLSQQAGNPDFDRELLKLHAGAMTSGAVVIPLLVLAIAAAGWLAGVGNEIGLWALFTLTCYTIVAFMARRIERTEASELNPLQTRREFLVGHFLCGLGWGWFVVLGCGACAVDQFPVVKAVVLLLAMAGTALMASSLSGALLATFAVPVALYAYVGTRLWMPVEAMMAGLLVLSLPFFVYVARQLNRASLMLLSFRSEKDALIAELETAKSMSDEARRRAEDANLAKSRFLASMSHELRTPLNAILGFSEVMANEVLGPMSNPTYRDYAHDVHDSGQHLLDLINEILDLSRIEAGRYQLNEEPVMLLNIVEDCCHMMELKARNKDIRVVQDFEQTLPRLFADERAVRQITLNLLSNAIKFTATGGEIRVRVGWTAGGGQYISVKDNGPGIPEDEIPVVLSAFGQGSIAIKSAEQGTGLGLPIVQGLLAMHGGEFELHSKLREGTEAIAIFPLSRVMEELPALPTAAVAARRR

SEQ ID NO: 8484 - protein, 375 aa, Mesorhizobium loti
MKTRAAVAVAAGKPLEIMEVDLDGPREGEVLVEIKATGICHTDEFTLSGADPEGLFPAILGHEGAGVVVDVGKGVTSVKKGDHVIPLYTPECRQCPSCLSRKTNLCTAIRATQGQGLMPDGSSRFSIGKDKIFHYMGCSTFSNFTVLPEIALAKVNPDAPFDKICYIGCGVTTGIGAVINTAKVEQGATAVVFGLGGIGLNVIQGLKLAGADMIIGVDLNNDKKAWGERFGMTHFVNPKEIDGDIVPHLVNMTKRGADQIGGADYTFDCTGNTKVMRQALEASHRGWGKSVVIGVAGAGQEISTRPFQLVTGRTWMGTAFGGARGRTDVPRIVDWYMDGKIQIDPMITHLLKLEDINKGFDLMHEGKSIRSVVVY

SEQ ID NO: 8485 - protein, 327 aa, Mesorhizobium loti
MNVAQNIVAGLDRILTMELVRVTERAAVAAARLRGRGDEKAADQVAVDAMRQELNRLAIKGTVVIGEGERDEAPMLYIGEEVGTGKGPAVDIALDPLEGTTICAKNLPNALAVIAIAEKGSLLFAPDVYMDKIAIGPGYAEGVIDIDASPAENIASLARAKGVAVSDITTCILDRPRHAKLIDAVRATGAAIRLIGDGDVAGVIHTTDPEETGIDLYLGTGGAPEGVLAAAALRCTGGQMQGRLILDTPEKVARAAKMGISDPKRIYHAEDMARGDVLFAATGVTDGNMLAGVKFGRTYITTHTIVLRSSSRTVREIKARHQDLDKF

SEQ ID NO: 8486 - protein, 308 aa, Mesorhizobium loti
MAILQNEATHIDTSFLPPFPERPSDCLVRRVLPTLHHRTVGPFILVDQRGPADLDVGRGFDLAPHPHIGIETLTYLVDGEIIHRDNLGNVQTVGPGEVNWMAAGSGIVHSEHTPPAMRTTGSNLFGMHAWIALSLRHEAAPPDFAHYAASEVPRTRDNGVEVTLIAGASDGLTSPVRTFSDLVCAEILLTSGSRYQVRPGYHERAIYVVAGEVEIVGKHGTFSEAELLMLDPGVEVVLRAPAFHAARLLLIGGEPFAEPRHIYWNFVSSSAERIEQAEADWRERRFPGVPGEEVSAPLSADHIEGTGD

SEQ ID NO: 8487 - protein, 495 aa, Mesorhizobium loti
MAVRNDVSTRSYQQFIGGRFVDGSGSGSIERRSPATGDLVARYADGTPEDVDLAVEAARIAFEDGPWPRMSGMERAEVLNRLADLIRTNRDRLVRIEVEEVGKPVRFARGDIDGAAGLTRYAASLAMQMAGLTYTNIGDGKTALISREAVGVVALVTPWNFPALILSQKVPFALAAGCTVVLKPSEFTPGSAFEIAALAAEAGVPAGAFNVVSGYGATAGDHLTGHMGIDFVSFTGSTRTGSRVVGNTSRHLVKSSVELGGKSANIVFADADLEAAADGALMGVFFNNGECCVSGSRLFVQSSIADDFIAKVIARSRKMKVGDPFDDDTDVGALIDRNHLAKVTGFVKSGIEEGAQLVLGGNVAAGAVGHFHEATIFDRVEPHMTIFREEIFGPVLSITRFDTVDDAVRLANDTAYGLSNYIWSKNIDTVLTVAKRLKSGWVQANTIIDGAPQLPLTGVKGSGFGYEMGQAGFEEFTQLKTLLIQTGPRAPVFPV

SEQ ID NO: 8488 - protein, 446 aa, Mesorhizobium loti
MPLRDINDLEKLKKINAALVDRVERSMDQQGNAFSLFQTAISLENRVRTRTEELHSTLRRLEQSNIDLSAAKENAEFANLSKTRFLAAASHDVLQPLNAAHLSVSALAELQTSDEGRKLVRQVERSLETMEDLLRTLLDISKLDAGVVHPDIGDVSLEALFSSLRSDFQPVAEMKRLSLKFRPVNAVVRSDRTLLRRILQNILSNALGYTRSGGVLVGTRHRGDTIRIDVADTGCGIPEDQREAVFEEFHRGTLPANAGLDGGGLGLGLAIVRRMAGALGHPVTFSSKVGRGTIFHIDVPVGIGAPADAIASATSLERSRGYGLFGTKVLLVENDAEVLEAMTFLLERWQCLVRAATSTDDALDLLGDTDWVPDIIIADQHLDGGDLGTTTISEVRDYLGRAVPALIVTADSSEAVAKAARAGGIELMRKPLKPAQLRALLAHLLA

SEQ ID NO: 8489 - protein, 485 aa, Mesorhizobium loti
MLQKTSHFMRQANLINGEWVQADSGQTVDVNNPATGLKIGTVPKSGKAETRRAIEAADAAFKTWRKTTALERSKLLRKLHDAMMDNQDVLAELLTIEQGKSLFESKGEIGSAAAYILWFAEEGRRTYGDVVPSPWADRRILVTKEPVGVIAAITPWNFPSSMLARKLGPALAAGCTAVVKPASQTPYSGLAWGALAEEVGFPKGVVNILTGSASEIGDEICANPLVSKITFTGSTEVGKLLIQKSSVTVKKVSMELGGNAPFIVFDDADIERAVAGAITAKYRNSGQTCVCTNRFLVQAGVYDKFVEKLAAASNGLKVGSGLEEGVQQGPLIDEKAVEKVEELIADATSKGGKIVAGGKRHALGGSFFQPTVIANATPKMRFMKEEIFGPVAPVFKFETEAEAIALANDTEFGLACYFYTGDLGRAFRVMEGLKYGMVGVNEGLITTPEAPFGGVKESGLGKEGGHQGIEDYLDTKYVCIGGLGL

SEQ ID NO: 8490 - protein, 301 aa, Mesorhizobium loti
MKNVILTDGGMGQELVRRSKSEPTPLWSARVLIDEPDLVRDLHAEFIRAGARVITINTYSATPERLAREGAEDLFKPLQKRGIELARQACDEAGEAAIAGCLSPLFGSYAPALTISYQETLDIYRRIVAEQADGVDLFLCETMASSDEARAAVTAASESGKPVWVSWTLADHGTPRLRSGETIAAAASALDGLPIAARLLNCCRPETIAAALPELIDLGGPVGAYANGFTSTEALKHGGTVDVLHARHDLAPDAYAEQAIGWVEAGADIVGGCCEVGPPHIAALRDRLQQDSYEISGVLHA

SEQ ID NO: 8491 - protein, 406 aa, Mesorhizobium loti
MQRFENAREAALALRPDDPVYCFRPQVLKADARQFMGMFPGKTAYAVKTNGEQIVLKTLVEAGVTAFDVASPGEFAAVRAVSPDAEMLYMHPVKAQSDIKLALEKYGIRVISLDHEDEITKLTRVVRALDIDPGSISVFVRIQTKGSAAYELSKKFGAGPAYAVELAERLNRTGYKVGLCFHVGSQIEDPDTYERALASADWVRNRLTFDIAGLDVGGGFPAEYGHDPNRKQIEMPSLGQIMSRLSGDLKEYQFDQMPLVAEPGRVIVARCLSLIVRVLLRKGKRLYINDGIWASLSDSWTGKITLPARFIPDPAIRTRNGAEKNVVPFKVCGATCDSVDILSRPFWLPETVDTGDWIEIGHIGAYSLSLRTRFNGFYPDTFVEVTTPFDEGDAPQGFASLETMAD

SEQ ID NO: 8492 - protein, 305 aa, Mesorhizobium loti
MAIAATSAPRGPMTLTDWGQLLLLGAIWGGSFFFARIAVAELHPLVLVLFRVAIAAIALQIYLGLRGPSFRLAFPHAGLFFLLAFTNNVVPFSLIFAGQTELGAGVASVLNATTPFWTLILANALTSDEKLSWNKLAGIGLGVAGTAVMIGPGLLAGLGGPVWAKFALIGASLSYGVALMVARRFKGVPSPVIATGQLTASTIIMIPIVLLTHGPADLFSASPSVWAAVLALALLSTAFAYILYFNLVASAGATNASLVTLIVPASAMLLGFLFLGERLELFEIGGVVLIGLGLLTIDGRVLGRR

SEQ ID NO: 8493 - protein, 276 aa, Mesorhizobium loti
MPELITLNDGAAIPQLGLGVWQVDHGITADVVGWAIKAGYRLIDTAQGYQNEEGVGEAIRAADVARSELYITSKLRNGAHERDAALRAFDDTMEKLGIEQIDLFLIHWPVPSRDKYVEAWKTLIELKQAGRIKSIGVSNFNRDHLERIIGETGVVPVANQIELHPRFQQRELREFHAGHNIQTESWSPLGSGRLLGDPTIAGIAKKHGKSAAQTIIRWHLQQGLIVIPKSVRQDRIAANFDVFDFELDAQDLKTIAGMDSADGRDGPNPATAAFLF

SEQ ID NO: 8494 - protein, 586 aa, Mesorhizobium loti
MSSHFRAFAPTRHSHRRPLDSAAALRKIGCGEGIRCDHNLPISTPMPSPAGLPHEPRTMTRLADRLLAVLLMALAAACLVHLYLLPGGKDFGLTAMREPWATQLVAFSLLAFACLAGAVLFWAGLLPGRPAHLTGAPLFGRAAEVQETGRPGLRKIFLALPLIVLAALAVDRFGPWGGGEVTARPNEPKMAEPKPSEPKPDEPKLTEPKPAEPKGQDVASAPPAPVPAPAPQPAPPPIAANPPPVAVPAAPPVAMPPAPVAPPEVAVIPPPTVAPLPPPPPAAPTQPDGHRDAVVWLAVAPDGRSIMSASTDRVIKLWDIGGKQLIRNLGVHKDMARTALYMPDGVSALTGGDDGEIVLRKLADGAVLHVFQAGQNGGVNKLAISPDGKRAVSGHDTGNVIVWDLVNNSVLHVLTGHDWSISAVAVSPDGKQALSGSIDGTLKLWDIESGKQLRSWHGHEQGTYGAVFTADAHRLITGSGDLTIKVWDLDSGREVKRFEGHEGTVYALALSADGKRLLSGSLDGTARLWDMETGNQIALFDSQTGPIYAVAFAPDGTVLTGGYDRTIRDWPAAGGDGVVLFAGAPG

SEQ ID NO: 8495 - protein, 477 aa, Mesorhizobium loti
MSHNLQFYVDGAWVDPVVPNTLDVIDPSNEDAFAQISLGSKADVDKAVAAAKRAFNSFGFTSVEERLDILNRVIEVYKKRSKDLALAVSREMGAPRQMALDSQVGVGLAHLEKMAEVLRTFQFRHVKGSALIVKEPIGVVGLITPWNWPLNQITCKVGPALAAGCTMVLKPSEIAPLDAIIFAEIIDEAGVPKGVFNLVNGDGPGVGQALSSHPDVDMMSFTGSTRAGILVAKAAADTVKRVHQELGGKSANILFPDVDLARAVTKGVAGCFGNSGQSCNAPTRMFVPRDRHDEAAGYAKAAAEKFVVGPADGANTKLGPVVSQMQFDKIQDLIQAGIDEGATLVAGGPGRPAELNRGYYVRPTVFADVTHDMRIAREEIFGPVLAILPYDTVEKAVEQANDTVYGLASYIQAKDIQKARDVAARMRSGNVYINYPAWDAGLPFGGYKQSGNGREYAEYGLEDFLEIKGIAGYEAAE

SEQ ID NO: 8496 - protein, 498 aa, Mesorhizobium loti
MTLSFDPRAKATTLYHGEFRPMFIGGKWVAAQSGQEMQALNPATGEVLTTVPRGGAADVDAAVAAARAAFEGPWSKFSPYERQCVLLRIADLFETHWEELSVSDTLDMGLPITRTLANRRRVIGMLRFYGGMATALHGEAIDNSIPGEIVSFTRREPVGVVGAIIPWNAPTAASIWKIAPALATGCTIVLKPSEEASLTPLLIARLMQEAGVPDGVVNIVTGTGAEAGARLAEHPDVNKIVFTGSTLTGQAIARAGVTNLKRVSLELGGKSPIIVCRDADIDKAVPVAAMAVFVHSGQICIAGSRLFVAREIHDEFVRRVAEFAGRLRIGHGIEAETEIGPLINARQAGKVEGYIKAGSDEGAKLVAGGSRLTGALYDGGNFIAPTVFGSVSDKMTIAREEIFGPVISAMPFDTLDEVVARANATPYGLAAGIFTTHLGTAHKLARRIRAGSVWVNMYHAIDPAVPFGGMKMSGYGREGGIEHLHEYLETKSVWIQTD

SEQ ID NO: 8497 - protein, 1622 aa, Mesorhizobium loti
MAENLTGQVRNIAEVTTAVALGDLSKKITVDVKGEILELKNTINTMVDQLNSFASEVTRVAREVGTEGKLGGQAQVRGVAGTWKDLTDNVNSMAENLTGQVRNIAEVTTAVASGDLSKKITVAVQGEILELKDTINTMVDQLNSFASEVTRVAREVGTEGKLGGQAEVRGVGGTWKDLTDNVNLMAANLTGQVRNIAEVTTAVARGDLSKKITVDVKGEILELKDTVNTMVDQLNSFASEVTRVAREVGSEGKLGGQAHVEGVGGTWKDLTDNVNAMAGNLTVQLRDVSKVATAIATGDLTQKITVDALGEILQIKDVINTMVDQLNSFASEVTRVAREVGSDGKLGGQAQVRGVAGTWKDLTDNVNAMAANLTGQVRNIAEVTTAVALGDLSKKITVDVKGEILELKSTINTMVDQLNSFAGEVTRVAREVGTEGKLGGQAQVRGVAGTWKDLTDNVNSMAENLTGQVRNIAEVTTAVARGDLSKKITVDVKGEILELKSTINTMVDQLNSFAGEVTRVAREVGTEGKLGGQAQVRGVAGTWKDLTDNVNLMATNLTNQVRGIADVVTAVAQGNLKRKLTVDAKGEIASLADTINGMIETLATFADQVTNVAREVGIEGKLGGQARVPGAAGLWRDLTDNVNQLAANLTTQVRAIAEVSTAVTKGDLTRSISVEASGEVAALKDNINEMIRNLKDQTLKNAEQDWLKTNLARFSRMLQGERDLATVSRLIMSELAPLVNAQYGVFYVTNRDEEESYLELAASYGAESKAAIKQRLDLREGLVGQSAADKRAIMLDDVPPDFLRITSGLGGASPANVIILPALFEDEVKAVIELASFSEFRDTHQSFLNQLMESVGIVLNTIAATMRTEGLLKQSQLLTSELQARQTELTKKQEELHATNEELQEKAQLLENEKKQVENKNLEIEMARRALEEKAEQLALTSKYKSEFLANMSHELRTPLNSLLILSNLLAANQQGNLNEKQVEFARTINSAGTDLLSLINDILDLSKIESGTVSIDINDMPVAHLRQHMDRTFRQLAADKGLGFTINVDPELPETVRTDEKRLQQIVLNLLSNAFKFTSAGEVRLDFRVEKTGRRNGARQPKRALAIAVTDTGIGIPEDKQKLIFEAFQQADGTTSRKYGGTGLGLSISREIARLLGGELRVESTPGKGSTFTLMIPLDGPRVAMTTQPELLPAAEAIGTAGSPSGLPSAELMDDRDAISPEDRVVLIVEDDPTFGGLLLGLARSAGLKGVLSTAGSGTLALARKLVPDAITLDLGLSDIDGWVLFDLLRHDPKTSGIPVHVISGAEDIDDLASKGASSISTKPVSSDELMNVFQDIHSRKLRIQRRVLVADPDPERRLSLVEAIRDGVTSVTAIGRVAANADDIELASYDAVVLGFGRSAKDNAQALDELASQSAGALPPLLFFAPHSEAIEQVLTLNPAWADVPRAENFAQLALHISATLPGGARQDSGRETGEADKSNLAGAKVLIVDDDIRNIYSLTSVLETYDIEVMHAERGREGIALLEQVPDVDAALIDIMMPEMDGYETMRQIRNTPAIAHIPLISVTAKAMKGDRQKCLDAGASDYIAKPVDLDLLLALLRVWIGRSRARVETSEKLLSSVN

SEQ ID NO: 8498 - protein, 674 aa, Mesorhizobium loti
MATKEKEEVETEREGATDGPLLDLSDDAVKKMIKAAKKRGYVTMDELNSVLPSEEVTSEQIEDTMAMLSDMGINVVEDDEQGEEAEAGDTAADAEEDANELAEQTGTAVAATTTKKEPTDRTDDPVRMYLREMGSVELLSREGEIAIAKRIEAGRETMIAGLCESPLTFQAIIIWRDELNESKILLREIIDLEATYAGPEAKQAPVVERIEEAPKAEEKPRRGRDDEDDVTNVGADTRGIGDDDEEDEDEASLSLAAMEAELRPQVMETLDVIADTYKKLRKLQDQQVENRLAAAGTLSPSQDRRLKELKDQLIKAVKSLSLNTARIEALVEQLYDINKRLVQNEGKLLRLAESYGVRREEFLKEYQGSELDPNWTRAIGNLTSRGWKEFTKNEKDAIKDLRAEIQHLATETAISILEFRKIVNQVQKGEREAAIAKKEMVEANLRLVISIAKKYTNRGLQFLDLIQEGNIGLMKAVDKFEYRRGYKFSTYATWWIRQAITRSIADQARTIRIPVHMIETINKIVRTSRQMLHEIGREPTPEELAEKLAMPLEKVRKVLKIAKEPISLETPVGDEEDSHLGDFIEDKMAILPIDAAIQANLRETTTRVLASLTPREERVLRMRFGIGMNTDHTLEEVGQQFSVTRERIRQIEAKALRKLKHPSRSRKLRSFLDS

SEQ ID NO: 8499 - protein, 301 aa, Mesorhizobium loti
MKPRDIAAYAFLTVTWGLSFLVLLKVVHAFGWIGAVTLRSLIAGITLFLLAAATRRRLDFSAGWRHFAAVGATTVAAQLIGLSYATPRIGTAMAAILVAAIPLFSMILGQLWGLERITVRGLAGLLLGAAGIVVLVGFPSVPITPSFVFGCAASLFSSFSAAFGSNYTNRHLRSAGSFELTGAAFLFGGLMTLPLLLVVPVPAMPRPVDFLYLVLLACVMSALTYVVYFRLVASIGATRTISVEFAVTTIAVLVGTVMLGESLAIIQGFGAVAIIGGCILVLDPFPRRAKAAALPSAPPLV

SEQ ID NO: 8500 - protein, 185 aa, Mesorhizobium loti
MTGSERAKMAAGEWYTCLDDELEALRALARDAVFEHNCLPPRQRGNLGPGLKALLGGVGDGARVEAPFHCAYGLNIFLGDGVFLNAGCTILDTAAVRIGKGTLLGPNVQIYCAEHHRQAAGRQAGLEIARPVEIGAHAWIGGSAIILGGVTIGEGAIVGAGAVVTRDVPANETAVGNPARPVKRG

SEQ ID NO: 8501 - protein, 1430 aa, Mesorhizobium loti
MRCASEIQHEVDRRNFDVPETKRLRFRIGVHLGYVVAEGDHIAGEAVEVVAHLQTLSRPGGICVTEAVHAQAQDRLSLEFLDLGEHNLKNVARALRIYRVPLASEQPVRSPFRGLDAFEFEDADLFFGRARAIAACTARLEQQAASGTAFLLIYGMSGCGKSSLLRAGLLPSLTRPGAVAGISLWRRCLIRLSEGPDAFAVLAAALLSEAAVPELSCEVTAAQFALLCRSAPDRALAMVRQALGKAAGSAHSQIRLLVAIDQLEELFTTEKQPATREALVRLMAALAASGLVWVVGAIRSDFFHRCGEIPGFSALKDGLSSYELLPPTGPEIAQIIREPAGVAGLRFDESAELGRLDDVLQEAAAADPGSLPLLEFVLDALYQAGRERRVLTFAHYRALGGLEGAIARRADEVVDLLAPEIQEALPAVLRALTTASPGDETVTARPALLTEVAGTPARSALVRALIDARLLVSDEDAGGHVFVRVAHEALLSRWPRAGDIVNANRNFLETRERLRADAHRWYMESRNRELLLPSGKRLAEGEELLLSRREEVDDDVVEYIEASLRAHRQKAEKDRQAQLALIEAAEEAKRERLEREAERRSLAAAAANLLARRTRNAAIVAIVLALMAGAGALVAFRAQQEARWQRDQALRNHSLSLSFLSQQSAATGNTEAAILLALEALSSKDQSERPYLFDAEAALYKALLSHHQIKIFRHAAGVADAAFNSSGDHIVTASYDKTAGVWDISSGAETAVLKGHEGTVERAEFSRDGNRILTAARDGTARVWNAISGQQLFILQPVGDYPTAIFSPNGNQVLTAGENSDAALWDARTGKKIVSVSSGGYARAGFSSDGRSFATARKHSVSIWNSADGALTRSIRVNSRPYSLAFSPDGSRLLAGACGPLSYGGTSSLLDVSKGTEIAKLVDQKSDTQLNGVIFSHGGQRIATVSLDGAARIWDGASGTLHDLLGQEVSGLKLADIGADERDEEMNGAFSPDDRFLATASVNGPIRIWDVERASLVTTIAGHESLVEHLEFSPVDSNILLTASHDGTARLWDVDGALTTTLSHEYRPTFAVFSPDNVHLLTGGGDSAAHLWDALSGREIIRLDTHEIVQTATFSPDGKHVATASLGGQVRIWEIARGVETAQFQSHGGLIQIQFGRDGKSLVSASIDGTAQLWDAATGAELAVIDTSSKLPQAILSPDGRLILAAREDNSGHLLKADGAELKALVGHRDRITAAAFNPNGQLVATGSRDHTARIWSTADGASVLTLEGHTGEVTVVAFSPDGQSLLTASRDRTVRIWSVSGGLERAVLRGHSSAVDSAQFSPNGLYLVTASSEDRTVRLWATQSGRQIAVLASQDEATVRPSLTRAAFSSDGTRVAIISGEERVRIVRVFQTPNDLIDFARRTVPRELTPCERRSFFLPADPATGICPS

SEQ ID NO: 8502 - protein, 377 aa, Mesorhizobium loti
MATQRILDFLATRRPSGPCLVVDLDVVRDNFRAFEKALPDSKIYYAVKANPAPEILRLLAAMGSSFDTASVAEVEMAMDAGAPADRISFGNTIKKERDIARAYQLGIRLFAVDCVEEVEKIARVAPGARVFCRVLTDGEGAEWPLSRKFGCVPAMAVDVLRHAKGLGLDAYGVSFHVGSQQTDLTAWDRALADAKKVFATLAEEGIVLKMVNMGGGFPTRYLRDVPAAQAYGQAIFSALRKHFGNAIPETIIEPGRGMVGNAGVIKSEVVLISKKADNDNVRWVFLDIGKFGGLAETMDEAIRYPLVTRHDGSETAPCVLAGPTCDSADVMYEKTPYPLPLSLTIGDEVLIEGTGAYTTTYSAVAFNGFEPLRSYVI

SEQ ID NO: 8503 - protein, 524 aa, Mesorhizobium loti
MSTPSRPSRCRYSQEARETVPMNAPLNIAMPAEASAAPKNYRLLIDGKHVDARDGRTIARKSPGHGFTVSRYAQAGEAEVEAAVQAAHKAFETGPWPRMKAGERAAILFRAADLIEARLEDIARLDALESGKPIAQARGEIGGAVDIWRYGASLARTLHGESYANLGDAMLGVVLREPIGVVSIITPWNFPFLIVSQKLPFALAAGCTAVVKPSEMTSASTFVLGDILLEAGLPAGVVNILAGLGADVGAPMVSHPLVEMVSFTGSTRVGKMTMASAAQSLKKVSMELGGKNGQIVFPDADLEAAADAAVFGGFFNAGECCNAGSRLIVHEAIADDFLSAVKALTARVTVGDPLDDQTKVGAMISSDHLAKVTDYVTAAAGEGSNVYSGGKQLASNAGQYLDPTIIRGVTEDMAIAREEVFGPVLSVLTFESIEKALHIANNTPYGLSAGVWSASIDTCMSVARGVRSGTVWVNTFMEGYPELPFGGYKQSGLGRELGKRAVEDYTEEKTIQFHRGQRTGWWVG

SEQ ID NO: 8504 - protein, 517 aa, Mesorhizobium loti
MALFELTLVLLLTAVALTALSRRLEVPYPSLLALAGVGIAFVPGAPMIEIDPELALALFIAPVLLDAAYDTSLRDLKRYRLSLLLLALGAVVFTTVVVAFVGWKMAGLPIAAAIALGAIVAPPDAVAASAVLGQFKVPHRITAILQGESLLNDATALLIYRLAVSAALGSIMLSNAIPVILLSTIGSLIAGYLLGRLSLLTLTRIEDAASSTVVQFAGTFGVWILADKLGLSAIITIVVYAITIARRAPRRMSARRRVSTYSVWESAVFVLNVLAFVLMGLQARSIVGRLSGEGQGEAFLFAATVLVVVIVARLVWVASYVAIIRWFARVGSEDKKRDLPTFGGAVLVGWCGMRGLVTLVVAIALPAGFPGRDPIVLAAFAVVLGTLVLQGMTLKPLLRILDFDPDRTIDNEVAQARVAVMQAALDVLSRKTSAAAAVVREQYEAQRVIAENPEDAQAATEYDRLRLYAINRQRDTLEELRSNGTIGDEAYHRLEEEIDWAELAASPAGRFQPLTTD

SEQ ID NO: 8505 - protein, 518 aa, Mesorhizobium loti
MAAPGYTDVDKAEDVKALHSMGYAQELERRLSRFSNFAVSFSIICILSGGINSLAQATSGAGGIGIGIGWLVGCFVSLTFAVAMSQISSAYPTAGGLYHWGSILGNRGTGWVTAWLNLLGLITVLGAINVGTWTFFIGAFGPALGIDGSLTNQMIFLVVVTGLQALINHLGIKLTAKLTDFSGYLIFFGAILIAVVCLIFAEHWDVSRLFTFHNYSGDAGGGVWPSVSNAWVFALGLLLPIYTITGYDASAHTSEETIKAASSVPRAMVMSVVWSALFGYLFLAAFVLMIPNMDDAAKQGWNVFFWAFDQRVPSGIKEFVYLVVFVSQLLCGLATVTSASRMIFAFSRDGGLPGSAALAKVSPTYRTPVAAIWTASILSVLFVWGSTLVSVAGTSAYTIVVSCTVIFLFLSFTVPIVLGMLAWGTPKWDKMGPWNMGRGVFMLFAVLSIVSMILIFVIGIQPPNDWALYITVGFFILTAIVWFAFERNRFQGPPLGDIIAARQAAIKAAEQAVGETGN

SEQ ID NO: 8506 - protein, 271 aa, Mesorhizobium loti
MAYLDELFSVAGKTALVTGAATGIGRMAAAALVKAGASVMIASRKGEDCIKVANAFNGLGAPGRAEGFAGDVSSEAGIAALVAEVKARTGKLGILINNAGVSWGAPLESFPYSAWAKVLGVNVTAVFHLTRELLPLLEAAASDADPARVINLGSVMGTQPLADDAYSYTASKAAVHHLTRTLALEFAARRITVNAFAPGPFQSRMTAFATGTDEQAKHVGGHVPIGRIGAPDDIAGATLYLCSRAGSYVTGAILPIDGGQSVQHGLTLFKE

SEQ ID NO: 8507 - protein, 258 aa, Mesorhizobium loti
MGRFDGATVLITGAAGGLGRGAAKGFASEGARLVLSDIDEKALADLAATLPAETAILAGNVADEKLSEDLVRLAVEKFGRLDVTVNNAGIVQSFVRLPQVPSDEARRVLEIDLLGVFYAMKHQIPQMERQFRATAKGGAIVNIASVAGLVGAPKLSVYAAAKHGVVGLTKSAAAEYATKGVRINAICPAHTRTAMVDSFVRASGAPEAEALAELTRGVPMKRVAEVDEITTAILFAADPANSFMTGHALAVDGGVGAI

SEQ ID NO: 8508 - protein, 259 aa, Mesorhizobium loti
MQKMLALANKIAIVTGASSGIGRATAKLFAEEGARVVVAARRQAELDTLVAEISDAEGTAVALAGDVRDEAYAKALVDLAVESFGGLDVAFNNAGAVGQMGPISGLSLEGWRETLDTNLTSAFLGAKYQVPAMIERGGGSLIFTSTFVGHTIGMPGMTSYAASKAGLIGLTQVLAAEHGPQGVRVNALLPGGTDTPASITNAPDAGPEVLAFVQALHALKRMAQPEEIARSALYLASDASSFTTGTALFADGGVSINRT

SEQ ID NO: 8509 - protein, 434 aa, Mesorhizobium loti
MRELTSTHNAATPVATPAGRTLPQGTLSGKRILLIIGGGIAAYKALDLIRRLRERGAAVRVVMTAAAREFVTTLSVGALSTDHVFTELFDRNDEHDVGHIRLSREADLLVVAPATADLMAKLANGHANDLASTVLLATDKPVLMAPAMNPKMWSHAATRRNRATLGKDGVTFVGPARGEMAESNEAGEGRMAEPLEIVAAVEARLDAGPRPLAGRKIIVTSGPTHEPIDPVRYIANRSSGKQGHAIAAALARLGADVHLVSGPVSIADPAGVKTIHVERAQEMRDAVEQLLPADAAVFVAAVADWRSENSADEKIKKVAGEGPPVLRMIENPDILAGVGHHSQRPGLVVGFAAETQDLLRNAQAKLAKKGADLIVANDVSHESGIGPSGVMGGDRNRVRIVSKAGVEEWPEMTKDEVAARLATFIAERLKTIVV

SEQ ID NO: 8510 - protein, 306 aa, Mesorhizobium loti
MIVVVGSINLDLIAKVDRLPSPGETVRGSGFSTAPGGKGANQALAAARAGVPVRMVGAVGKDSFAGEALALLREAKVDLSGVAETFASTGTALIMVGDDGENIIAVVSGANASVVTGDLSKAFLKKGDVVLLQHEIPLATVDAALDQARAAGAITVLNTAPFQGDATAFLGKADYVVANETEFDLYGEALALNGRDRAARMRDFAAKTGRSIVVTLGGDGVMAATPSDFLTVAAMKITPVDTVGAGDTFCGYFAAGLSSGLALDQALARAGAAGSLACLKPGAQPAIPLAKDVDQALQEVSRNDAP

SEQ ID NO: 8511 - protein, 760 aa, Mesorhizobium loti
MIAESDSQQANKGDDAVAAPAAARRFIAAPPLVPEQQLARREGLPLLTFVAIMVLAGLAHLTGAPIFISLALLATGLAGLALHLHARRSVHRTVVLLDETTARSRAEIETLADRMWEMQESEERFRGLIDALGDLVIHRDRDGYIVYANKVFADLVETDQRDLAGKTLAELGIEVGIVPDAAFSDHECLSSTDVAIRTPGGPRWFSWIELSVRDKDSGAASHRAIARDITARKRAESSLITARERAEYASQAKSRFLATVSHEIRTPMNGIMGMARLLADTSLSPEQQTYVGAISTSASALLALIEDLLDYSKIEAGRFDPEPQPMSVREIADNIIELLAARAFAKDIGLGCHVEPDVPQLITADPGRVRQVLLNLIGNAIKFTDGGGVLVSIARARSETSDRICFTITDTGPGLREEDMERIFEEFEQADGTSTRAHGGAGLGLAISKRLVAAMGGTISVSSRLGQGSEFVFEIPATEATEAPQGRQNVLAGRRAVILSRNAVEADAIARTIRANGGTAGIATTVAQAAPLAEGCDVLLVDAAMEESDGRVLKRLRQSGFTDCEAITLIAPTDRGMLGEFRASGYATFLARPVRGGTLLRVLLTSHAPALAQPQPEKRRTPALRASSDRQQGLSVLIAEDNDINAMLARATLLKAGHRVKVVGNGKAAVEAVTGAGHKHRFDVVLMDLHMPVMDGLDAIAAIRRHEEETSAPPVPIMVLSADSQEKTRHAVLAHGASGFVTKPLDPDALVNAVEGQVAA

SEQ ID NO: 8512 - protein, 250 aa, Mesorhizobium loti
MAEFDTRKTIVLTGASRGIGHATVKRFSREGWRVITCSRQAFAEDCPWPAGPEDHIKVDLADQEDVGIAVSEIRHRLEAHGGQLNALVNNAGISPKLKDGNSRMNSIDTPMHVWRDVFQVNFFAPIMLARGLFKELATAKGSIVNVTSIAGTRVHPFAGTAYATSKAALGSLTREMAHDFGPHGIRVNAIAPGEIDTAILSPGTEKIVETIPLRRLGTTAEVADIIFFLCSQQASYVTGSEIHINGGQHV

SEQ ID NO: 8513 - protein, 747 aa, Mesorhizobium loti
MVSLGKFDRAWGSNMIKLTRRTLLVGTSALVAAGTVSFRAMAASRTYHALLVACTEYPALPQRNWLIGPKNDAGLVHEYLLKNVPDPVRFAPENVTLLAKDVPGAKGLPTHAAIKAALADLAAKVQRDDFVYLHLSGHGAQQPERAKGDETDGLDEIFLPVDIEKWINRDAGVPNALVDNEIGDALDAIRNKGAFVWAVFDCCHSGTATRAVEVDDELERKVEFADLVGGDEAARAAAIKTYEDTVAGASRGLDENGARKPAFNLTPTGGEPITKGKLVAFYAAQTVETTPEMPLPKGTADAPRFGLFTFTILSKLAENPNVTYRQLGQAVLQQYSADSRTRPTPLFEGELDARVFGTDKTDAVMQWPIIVKDGQATIGAGLLHRLTPGSKLAILPSALSSLSDAVGYLEVESAKNLESRVKPVEFEKKPALKLADIPANAYARVAEIAVDYRLTVARPAETKGLEKETELVNSVLDELATAKETGFNIELVDPGKSAELRFAVMCENAIAGAAKDASDKPALWFLPASGDVTLKDGSKPPLIIIHPDDRQKLVDPTTRNLRTIFRATGLSRLAAASDYKPEDVDVQFQVKRRDKDGLEPLQASAVPRVSPGDEVHVLAKNSSDQLVDINVLYVGSDYSITHIVAERLAPQATLEEGLLAFTDTSFGMERMIAVLTEAPPESEKEDLSFLAQDGVAAMTRGLGPASFSDMLADIGMAAPTRSVMRLADKSGPKGAVMIFPMETVPRA

SEQ ID NO: 8514 - protein, 992 aa, Mesorhizobium loti
MAGALITASAACAEDAPDFRLDLDTGGHTARIARLAFTPDGEDIVSASDDKTIRIWDWQSGVTLRTIRGYLGNGSDGKIFAVSVSPDGKTIAAGGYFGAGLGDKPPYGDIRLFDFATGKMKAVLRAADYATYDLAFSPDGKTLAAGGGDGMVYLWRLDDKSATGWTLDKKLDADSWHIDKLAFAAAGTRLAATTTDNGIRLWDVAKGEEIALPDEAEPLRDVSVLALAISQDGSLFATGSKDGQVQLWRAADGTLVHAMPKQDFLIGSLTFAKGSRLVASCGYRCADKHRSIVWNTDSGEKLLDYSGHDGTVYASAANADGSLVATAGGTRNAIQVWDPATGERKALLQGVGEPVTAIGIDAANGIIAWGNTNPCPERVACPEQLGALDKRLELPTTERFFDDPQPLTEPGSFARAAQSDGEWSLHATKGGKDALENAVLEIANGGKVVRSIENDATNGFAHSAFTLIDNGLGLITGGNDGTLLEYKAATARVSGEFTGHTGEINAMAASEKAGLLVTGSADQTLRLWNLKTHELIVSMFFAGPQWIAWMPQGYYYSSDEGDKLIGWHVNQGRDHEGRFIRAGQLKKYLWSPEMVRRAIILRSAKQAVKEMRPGVDNELQKLLQRKPPEFGVRLADDQSKVRDGYVAVEITGAKEAGTDVAGFSILSNSRNVGDIATRSAEGDKTTVEVPVENGQNTIRITGTNEYGYLTERSVTALARKTEKAEAKGKLYVAVIGVDKYPFLTDACSGHACDLRYPVDDATEFLEVVAQKSAPLFSSMETLVLVNREALDESPDKAKQTYTVASADNIMEPDSHTIDDQLADFLDRPGEHDTTIVFVAGHGINIDEDYYFIPTDGRKQDADRWKRSSLVDWGDIQKSVERAKGMRFMLLDTCHAANAFNPRLEKDAQDARIVVFSATAANNTAAELPELGHGVFTYSILEGLRGKARTSDGGITLFGLADFISHEVVRLTASKQKPFYYVGGVENIVLAEP

SEQ ID NO: 8515 - protein, 303 aa, Mesorhizobium loti
MQSIKRFIPATFVVLWATGFIGARYAMPWAEPFTFLAARFVIAAILLAVLMPVLGSKRATRKEALHATGAGVLMHGVYLGAVFWAIHRGMPAGFSALIVGLQPLITAVLAGKFLGEAILPRHWLGLGIGLIGIVIVLWPKLGALGGGVTAATLTASLVSVLGMSAGTIWQKRFASGGDLVAATMWQYVGGASLMILAALAFETHTVIINGELIFAMAWLVLVLSLGAIFLLMVMIRDGEMSKVASLFYLVPAVTAIIAWALFDEQLNALQIVGMAITTFGVGLATARPAKGRTERLGIGEMKN

SEQ ID NO: 8516 - protein, 422 aa, Mesorhizobium loti
MNHFDYRDGVLHAEDVAIPDIAAQVGTPFYCYSTATLTRHYRVFAQAFAGLDALVCYAMKANSNQAVLRTLARLGAGADVVSEGELRRALAAGIPASKILFSGVGKTAREIDLALEAGILCFNVESEPELELLSARAVALGKVAPISLRINPDVDAKTHKKISTGKAENKFGIAWQRARQVYARAATLPGIKVTGIDTHIGSQITELQPFDDAFALLVDLVGALRADGHAIEHVDLGGGLGIPYRVDNNPPPLPDAYAQIVRKHVTKLGLKVMFEPGRLIVGNAGILVSEVIFVKEGDAKNFLVVDAAMNDLIRPTLYDAFHDIRPVVQPPADTPRMMVDVVGQVCETGDYLGLDRDLPRLKAGDLVAVSTAGAYGAVQAGTYNTRLLVPEVLVDGDRFHIVRPRLTYDDLIGLDSVPDWLA

SEQ ID NO: 8517 - protein, 549 aa, Mesorhizobium loti
MPAVTGEANGLRGVAASEGVAIGPAFAHFPPEIAAQGRVLQASEIVGEIDRFRAAVAAVQARMDRALAQDSLSAGDRGIVAALRDIAADDSLTGEAEKAIRGGNDAVSAVITAAATIAADFSAVDDHYLNARADDVHAVGRQICLVLLGQDDVSLESMPEGAILIADDIGAWDLARAPLKRIGGVICGHGGATSHIAIIARSHGIPAVLGLGDQVNALRTARDVALDGNTGHVIVDPDAATRADYGGRVEAAAKERAGLTTFKTVTPKRADGKVIEVAANIGSLEEIEAAQEAGAMGVGLFRTELLFMRHMHLPSEDMQAETYAALAKAFAPHPVIVRTLDIGGDKPIAGIEFPDEDNPFLGWRGIRMCLDRPDIFKRQLRALLRAAVQGNIKVMLPMVSDISEVTRTRALVDECAAELKAEGVPHATFDLGVMIETPAAVLIAPALAKEVAFFSIGTNDLTQYIMAADRLNPTVAKLNDVTNPAVMSAIELTAKAGVAAGIMVGMCGEAAGRPDLIPAFIEMGLTELSMSPASIQRAKKTITAMAAGE

SEQ ID NO: 8518 - protein, 332 aa, Mesorhizobium loti
MDATVRELSYAQAIQEAMAIAMDMDERVFLMGEDIGVYGGAFQVTGDLVERYGTERVIDTPISELGGAGVAVGAALTGMRPIFEFQFSDFATLAMEQIVNQAAKMRFMLGGEVSVPVVMRFPAGSGTGAAAQHSQSLEAWLGHVPGLKVIQPATPYDAKGMLLAAVADPDPVMIFEHKLLYKMKGPVPEGYYTVPIGKADIRREGRDLTIVATSIMVQKALDAAATLEAEGIDVEVVDLRTIRPMDKQTVIDSVKKTSRLMCVYEAVKTLGIGAEVSAMIAESEAFDYLDAPIVRLGGAETPIPYNPELEKATVPQVPDIISAARDLVKGVR

SEQ ID NO: 8519 - protein, 262 aa, Mesorhizobium loti
MGSLSSKNALVTGSTSGIGLAIARAFAAEGANVTINGLGDPAAIEQERAGIEKDFGVKCRYSDANMMDGAAVSAMVHDAEAAFGSLDILVNNAGIQHVAPIEEFPDDKWEAIIRINLLAAFYAIKAAVPGMKARKWGRIINTASAHALVASPFKSAYVSAKHGIAGLTKTVALEVAQDGITVNAIAPGYVWTPLVEKQIPDTMKARGMTEEQVKHDVLLAAQPTKEFVTVEELAALTLFLCSDAARQITGTTLPMDGGWTAQ

SEQ ID NO: 8520 - protein, 264 aa, Mesorhizobium loti
MIETADAEYDDTAIRFLEALWGDGYLSPGGPEEVDRVVEGLSLEGKTVLDIGCGSGGITLHLVERHGAARATGFDVEQPVIEAARRRAAGRGLSDRASFVQAPPGALPFADRSFDAVFSKDALLHVPDKDGVFAEIFRVLKPGGVFAASNWMIGHDSEPSPEMKAYIAAEGLSFAMASPARYAHAMRNAGFADVTVRDRNPWYREVARGELERLKGPLYTPVAAVVGAAYVDKNIRTWEAMQKVLDSGEHRPTHLRGWKPDAIG

SEQ ID NO: 8521 - protein, 1391 aa, Mesorhizobium loti
MAEADEAIGARGKRGPDKPVHRGDAPPCADRDSPDALRQLLEAGSDWIWETDAELRFSWLSPTYQAATGIDPADVLGRFRFDFLNQDLKGSRSAAAHLEDLQARRPFRDFVYELKAGGADCRWVLTSGFPRFDNEGKFAGYRGIGRNVTTLAGAFETVEQNPLSGSDPDRHLADLERTMDAMHMGVVLLDAKLDTLIVNKAYRDLSSIPDGAVTVGAPFSRLMELNRRNGIYGDIDEQQWQRYLASRIEEIRAGSVAPREFVHASGRTMMFSVTALSGGKRLLTYYEVTELKRRDAEIESANAKIAETFVNLRTMVDEMPIGVLVLDADMRAEVINSAFYDFWRIDPGRAGIGSAFRELMEASRAIDPYGADELAWQRHTTEREAEIRAGVAGSKQLPHNDGRTLVASLAPLPGGKRLISYVDVTDMKGRETEAQDARKHLASVLESLPAGVIIYDRDDKFVFANRKLQDTLPALKPFWQPGCSFREALEFGQSIGYFRSSGDAGIDRLYEVEPEHWLDSMLARYRLPNSSYERLNADGRWYQVYDMRTDDGTFIGVRVDITDIKSREAALRDSMRQIDLFRHVMDELPVAAFIKAQDLSIEFVNKAWCALTGIAKEDVIGRTDRELFGTQDAEGYSHDDTQVVVTGKGIEVEEPVTHRDGTVRQLMTRKSRLVATDGSVHLVGSSTDITDVKAREKALEESMRENEVFRSLIDNVPVSIYAKRSDLRQFYVNKGWCDLTGLSREDAIGKTDIEIFGEDGEAFVAGDLAVLRTGETQEVEETVRLADGSVRHQFARKGAMIASDGSLYLIGSTTDITELKMREAELSEARQRAVLADRAKSEFLANMSHEIRTPMNGVLGMAELLAKSNLDPKQKTFTDIIVKSGNALLTIINDILDFSKIDAGQMVLDPAPFNLAEAIEDVATLVSTRAKEKDLELIVRVEPRLESLFVGDVGRIRQIVTNLLGNAVKFTDEGHVLVDVTGERVPTGTRLTISVTDTGIGIPEEKLKLVFEKFSQVDTSSTRRHEGTGLGLAITSRLVELMGGTIGVESAEGKGSTFWFTVTLPRAGQQNGQRIMPVDVTGARVLIVDDNAVNRAILTEQMTSWTFDSCAAESGAEGLKVLIAAAAYGVPVDCVVLDYQMPEMSGAEMARIVRNTGGLADTPIIMLTSVDQSLANTSYRDLGIDAQLIKPARSSVLLETLVATIQRHRHATDSHAVQPLAAERPDVPQPPPLALSEQRAQLQPPPVRPRLPATGGDGHRLDILVAEDNEVNQMVFTQILGETGYGFEIVGNGRKALDAFGKLNPCMILMDVSMPEMSGLEATAAIRQLEQQTGTHVPIVGVTAHALKGDRERCLEAGMDDYLPKPISPRALLEKVERWLGAGRQVQRNAG

SEQ ID NO: 8522 - protein, 303 aa, Mesorhizobium loti
MAQSLPSIVSGEGGLSRYLEEIRRFPMLQPQEEYMLAKRYAEHEDTSAAHKLVTSHLRLVAKIAMGYRGYGLPIGEVISEGNVGLMQAVKKFEPERGFRLATYAMWWIKASIQEYILRSWSLVKMGTTANQKRLFFNLRKVKGKIQALDDGDLKPDQIAEIATRLNVTEAEVVSMNRRLSGDASLNAPIRATEGESGEWQDWLVDDHESQEEMLIEQDELENRRGMLSGALAVLNERERRIFEARRLAEEPLTLEELSAEFDISRERVRQIEVRAFEKVQDAVKAAAKRQTQALRTIEAQPAA

SEQ ID NO: 8523 - protein, 251 aa, Mesorhizobium loti
MSANLFDLSGRQALVTGSSQGIGLALAKGLAQAGASVILNGRDTAKLAATAAQIPGAQTLAFDATEHDAVRSAIDNFELSGGPIDILVNNAGMQFRTPLEDFPADAFERLLQTNVASVFHVGQAVARHMIRRGRGKIINIASVQTALARPGIAPYTATKGAVGNLTKGMATDWAKHGLQCNAIAPGYFDTPLNAALVADPAFSGWLEKRTPAGRWGKVEELVGACVFLASDASSFVNGHILYVDGGITASI

SEQ ID NO: 8524 - protein, 786 aa, Mesorhizobium loti
MLGLRMPEYSSFIRFVRVRYLSGLLIFALASTAIMVALNRVNSFRHEIDALSSNLVVFTRDLRNATSFAETTGSAWRNETRDALTASARDHSERLTSEIDTLSAQFAALRSRLSAKTLNELETASVNGDLFWSAHDMVRNFNLMSVAQKADEWSYREIRNQNDLFVQPMLVRVRTAMDEERHLADASSDRLLLWASGLLFGVLAIVAFWIFRPMEQAIRRAFAQSAESLFKAEAADRAKSEFLANMSHEIRTPMNGVLGMAELLAKTELTPRQKTFTDVIVKSGNALLTIINDILDFSKINAGQLTLDPAPFRLTEAVEDVATLVSARVAEKNLELIVRVDPRLPAHVVGDAGRFRQIVTNLVGNAVKFTEKGHVLIDVGGETVNDVVQLRLRVEDTGIGIPAEKLQNVFEKFAQVDGSSTRRHEGTGLGLAIAARLVDLMAGKIGVESEIGRGSVFWFAVPLPVHHAEAREAIVPVDVTGARVLVIDDNPVNREILLEQLRSWSFDCAAAESGAVGLAFLDRACQLGASVDCIILDYQMPGMNGADVARAIAADSRLSAIPIVILTSVDQVDFGKMIIDFGISAHLTKPARSAVLLGTVISVIQKARSQGGKAQFIREPVQPKPVPQAAPPAFTVIRGPAVPVMAVPESTAMPNGPIDILIAEDNEVNQLVFGQILNGLGLSYRIAGNGRTAVEMYRSLHPKLILMDVSMPEMNGYEATRAIRAIETSSGGHIPIIGVTAHALKGDRDKCIEAGMDDYLPKPVSPDRLGTKIGTWLSETVVAKTA

SEQ ID NO: 8525 - protein, 287 aa, Mesorhizobium loti
MMEDTAGRIMVRAAMKAPYLERDEEHRLALLWKQDNDQNALHSITVAHMRLVISMASKFRHYGLPLGDLIQEGHVGLLEAAARFEPEREVRFSTYATWWIRASMQDYILRNWSIVRGGTSSAQKALFFNLRRLRARLANGAEPLSNTTLYREVSVALGVSEADVAMMDSRLSAPDSSLNMPLADDAGATERMDFLVSDDPLPDEIVGDKIDVARRSLWLKEALHALNARELRIIEERRLNDEGATLEALGETLGISKERVRQIEARAMEKLKVALVKQNPEFLATAA

SEQ ID NO: 8526 - protein, 258 aa, Mesorhizobium loti
MNSTGIDLSAFSLAGKRILVTGANTGIGQGIVLSIARAGGVVIGVGRSSMDETASKVAAIGARFETVSADLADTATAGPMLDRVWDESGPLDGLVNNAGIIRRADAVDLTETDWDDVMDVNLKTVFLLCQSFARRALADGRRGKIVNIASVLSFQGGIRVASYTASKHGVLGITRLLACEWAAKGINVNAIAPGYVETNNTQALRADPDRSAAILGRIPAGRWGEPSDIGDAAVFLLARASDYMHGAAVPVDGGWLAR

SEQ ID NO: 8527 - protein, 255 aa, Mesorhizobium loti
MGERLAGKVAIISGGATGMGGAASELFAAEGAKVAIIDRNGEAAAATAAAIRARGRVAEHFVADVSDEAQVQAAVKGATEKLGPVTVLFNHAGTIVIKPFLETTVQEWDWLHAVNVRSMFLMTRAVLPGMIAAGGGSIVCTSSISAVAATPMEVLYDTTKGACHMFARAIAVEFRDRNIRCNAVCPGFIRTPHGLREVADLGKLGVDVSDAALAAQQGRIGEPEEVAKAALYLASDESSFVNGAHLFVDNGFTAM

SEQ ID NO: 8528 - protein, 507 aa, Mesorhizobium loti
MEEDNMHFSPDRPTFFVNPDYRQMADTSKPVIDPATLETVGAIASASDGEIDAALAAATKAQAAWKRLDAKSRAKHLHAVANAIEAADFTRCAELMVREMGKPYPEAIGEIANCAPIFRYYAEMARDDAGKVAGTTQAGSFQYARYEPYGVSVHIMPYNFPILLMCWTVAASLAAGNACIIKPAEATTLSTLDYMAVFRSLPEGLVSCLPGGAATAQALITSDRTHAVAFTGSVAAGKAVAVACAERMKPCVIEAGGSDPLIISKHAPLEVAAAGSVTAAFHLTGQVCTSAERFFVVDAVHDRFVELFAERTRALRIGNGMDKTEIGPLVSEAARAKVMRLVDDAIAHGAKAVTGGRIPPSHNTGWFYEPTILTGVTPDMAIVREECFGPVAAICRVKDFDEAIRLANDSLFGLGASVFTTDLAEAHEAAERLEAGMVWVNNPLIDNDALPFGGWKASGLGRELGRQGLDAFRRSKMVIIDHRPAIQDWWYPYPDSWFRETGGRKHV

SEQ ID NO: 8529 - protein, 112 aa, Mesorhizobium loti
MKIVMAIIKPFKLDEVREALTAVGIQGLTVTEVKGYGRQKGHTEIYRGAEYAVSFLPKIKIEVAVSADTVDKAVEAITAAAKTGQIGDGKIFVFGIDQAVRIRTGETDTDAL

SEQ ID NO: 8530 - protein, 781 aa, Mesorhizobium loti
MEYGPAPEARNEADAWLAARDFGKALFIDGAWKAASGGKTFDTSEPSSGKLLAKVSDASAADIDAAVAAATKALPKWSASSGYARAKVLYAIGRAMQRHQRLFAVLESIDNGKPIRESRDIDVPLAIRHFIHHAGWAQALDRDFPGHKGVGVVGQIIPWNFPLLMLAWKIAPALAAGCTVVLKPAEFTPLTAILFAEICERAGVPKGVVNIVQGGPEAGAAIVNHPGIQKIAFTGSSEVGKIIRKATAGSGKKLSLELGGKSAFIVFEDADLDSAVEGLVDGIWFNQGQVCCAGSRLLVQEGIAEALIAKVKTRMSRLRVGSPLDKNTDIGPLVDLTQLDRVKGLVAEGAKQGAVCWQPDAALPSSGYYHLPTLATGVSPANILAQEEVFGPVLATMTFRNTEEAIELANNTRYGLAASVWSENVNLALHVAPQLKAGVVWVNGTNMFDAACGFGGYRESGFGREGGREGMFEYLTAKLPLGPVIKPAAVSAQPVEQADGAAIDRTAKLFIGGKQVRPDGNYSLAVATAKGKLAGEVGFGNRKDIRDAVSAARACKGWPEATAYNRSQVLYYLAENLSGRAGEFAARLTELTGATPKAAREEVDQSIERLFLYAGLADKFEGRVHQPPARAVTLALHEPVGVVGIVAPDASPLLGLISLVAPALAMGNTVVAVPSERYPLLATDLYQVIEYSDVPAGAINIVTGRSAELAGVLAKHDDVDGLWVFADAETCARAEAESIGNLKRVWSGNGRSLDWASDEAAGDAFLRRAVEVKNVWVPYGD

SEQ ID NO: 8531 - protein, 467 aa, Mesorhizobium loti
MSAIDAGARAPENLWRQEIRATLALAWPMVLTNLGQTAMTATDVMMMGRLGPDTLASGALGANLYFMPLIFGLGLMLATSPMIATELGRRRYSVRDLRRTVRQGLWLAILISIPIWIVLWHGEAILLAMGQEPALAHQAGIYLRWLEWAVLPFYGYIVLRSFISALERPGWALIIVFVAVACNALFNWVFMFGNLGFPAMGIAGSGLATSLSSTLMFAGMAAVVMLEKKFRRYRLFGRFWRSDWPRFNGLLRLGLPIAGILAFEVTIFNAAALLMGLIDADSLAAHAIAIQIASISFMVPLGLNQAVTVRVGLAHGAGNPEGVSRAGWTAFVIGVSFMALMGLVMVLWPHLLISAFIDLANPANARVIALAVSFLVFAALFQVFDGAQAVAAGMLRGLHDTKVPMIYAAIGYWGVGLPLGVLLAFHFGFHGVGIWIGLSSGLAVVAALLLTRWLRRDRIAPPLAFGH

SEQ ID NO: 8532 - protein, 227 aa, Mesorhizobium loti
MTPELVIFDCDGVLVDSEALSVSALLGMIERAGGTVSEDAAYEHFLGKSMKSVREILGRDFGLEISDQHLTAMRVDLMRKFREELKPIPGVKEMLPKLGLPFCVASSGTLERIRYALDVTGLLGLMEPHLFSAAMVAKGKPAPDLFLHAAASMRAHPRKCLVIEDSPAGVAAARAAGMRVLAFTGGAHAGNPALKARLASSEPDFIFADMLQLPDLIAGLGARVRAS

SEQ ID NO: 8533 - protein, 466 aa, Mesorhizobium loti
MTGSKDYVVADISLAGWGRKELDIAETEMPGLMACREEFGAKKPLKGARITGSLHMTIQTAVLIETLKALGADIRWASCNIFSTQDHAAAAIAEAGIPVFAVKGESLEQYWDYTDRIFQWADGGLSNMILDDGGDATMYILIGARAEAGEDVLSNPQSEEEEYFYAQVKKRLKASPGFFTKQKAAIRGVTEETTTGVNRLYQLQKKGLLPFPAINVNDSVTKSKFDNKYGCKESLVDGIRRGTDTMMAGKVAVVCGYGDVGKGSSASLKGAGARVKVTEVDPICALQAAMDGFEVVTLEDAAPTADIVITTTGNKDVVTLDHMRSMKDMVIVGNIGHFDNEIQVASLRNLKWTNVKPQVDMITFPDGKRMILLSEGRLLNLGNATGHPSFVMSASFTNQVLAQIELFTKGEQYQNQVYVLPKHLDEKVARLHLDKLGARLTELSGEQAAYIGVTPQGPFKPEHYRY

SEQ ID NO: 8534 - protein, 479 aa, Mesorhizobium loti
MAQFRKNLIDGEWVGDAGSHNINPSDTGDVVGEYASAGVEQAKQAIAAAKAAFPSWSRSGPLARHAVLKKASDEIMARKDEIGRNLAREEGKTLAEGIGETIRAAQIFDFFAGETLRLTGEMVPSVRPGVGVEITREAVGVVGIITPWNFPIAIPAWKIAPALAHGNTIVFKPAELVPESAWSIVDILHRAGLPKGVLNLVMGKGSVVGQAMLDSPDINAITFTGSVGTGKRVAAASVEHMRKFQLEMGGKNPLVVLDDADLAVAVDCALNGAFFSTGQRCTASSRLIVTEDIHDRFVEALKERMGKLVIGDALDAQTQIGPVVDATQLKQDEDYIAIGVREGATLAFGGERLDRKTPGFYLSPALLTEATNAMRSSREEIFGPVASVIRVKNYDEALSVANDTPFGLTSGICTTSLKHATHFKRNSEAGMVMVNLPTAGVDFHVPFGGRKGSSYGPREQGRYATEFYTTVKTAYTFAG

SEQ ID NO: 8535 - protein, 249 aa, Mesorhizobium loti
MPNFAGRFAGRSAVITGGASGIGLAVAQRIVEEGGRISVWDRDPAQIEQAKTVIPGLHGVAIDVADAAGVEGAAARTIEALGGVDILVTSAAITGPNMTTWAYSTEDWQKVIDININGVFYCNRALVPHMLERNYGRIVNIASIAGKEGNPNASAYSTSKAAVIGLTKSLGKELAKTKVTVNCVTPAAVRTAIFKQMSQEHIDFMLSKIPMARFGEVEEVAALICWIASEECSFTTAAVFDVSGGRATY

SEQ ID NO: 8536 - protein, 250 aa, Mesorhizobium loti
MKKLEGKIAVITGGSSGIGLATAKRFVEEGAHVVITGRREKELKEAAAFIMRNVTTVVGDVSLLEDLDRLYAVVKEKHGHIDVLFANAGAGTIAPLAAATEAHFDQTFDVNVKGLFFTVQKALPLFKDGGSIILNSSVSNVLGLPGFSTYAASKAAVRNFSRAWTLELKDRKIRVNTMSPGAIETPALETTTGLTPEQAEQAVAQFASQIPMGRRGKPEEIAAAVTFLASDDSSYVTGVDLAVDGGMAQV

SEQ ID NO: 8537 - protein, 527 aa, Mesorhizobium loti
MRAMRIEGVPASAGYAEGPLFDLDRPPAVYAGKATLAEEKTSLQAAIGTAVSRLSAMAEAADSDAAGILEFHIAMLEDDALRGPAFASITSGQTADVAWREALDAEIAGYEASDQDYFRARATDLRDIRDQVLRALTEDVDSAAPTGAILCGEDIAPTRFLETDWSHGGGIALKAGSTASHVAMLARSRGVPMVVGLREMSASPAGMALLDAEHGSIVLAPSPAEIGAFRQSSASFAARQGKAQRFLARPAVTKAGTAVRVQVNIADPSDVDGIDVATCDGVGLMRTEFLFGKNLPDEETQYRAYRKVLEWAGEKPVTIRTVDAGGDKPVPGFTVEEGNPFLGLRGIRLSLARLDIFRIQIRALLRAAPHGNLRVMFPMIAMADEYERAAALFAEEQAALAAGGVAQKMPPLGIMVEVPSVAIAPEAFAGVAFFSIGSNDLTQYVMAAARDNAAVAHFNSVRHPAVLRLIGSVAAFGRENGIPVSLCGDAGGDPAAIPSLLEAGLRDLSVAPAQLAMAKAAIADVSV

SEQ ID NO: 8538 - protein, 281 aa, Mesorhizobium loti
MPSTVRTTTLPSGETVQVLGQGTWKMGEDSRRRADEVNALKLGLDLGLTLIDTAEMYASGGAEEVVAEAIAGRRAEVFVVSKVLPSNASHAGVQRACENSLKRLRTDRIDLYLLHWPGSVPLAETVEAFEAVKKAGKIRHWGVSNFDTEDMDDLAGLPDGSNVQTNQVLYNLVRRGPEFDLAPWSRKRGIPLMAYSPVEQGALARNTGLDAVAARHNATAAQIALAWVMHQDGIIAIPKASSQEHVRQNFAALDIKLTPQDITDLDRAFPPPTRKRGLEMI

SEQ ID NO: 8539 - protein, 343 aa, Mesorhizobium loti
MARSRLGFLAETLMPDYDVLCIGNAIVDIIAQCEEEFLETNGIIKGAMNLIDTHRAELLYSRMGPAIEASGGSAGNTAAGVASFGGRAAFFGKVSNDGLGEIYTHDIRAQGVAFDTTPLQGEPPTARSMIFVTPDGERSMNTYLGACVELGPEDVEADKASGAKVTYFEGYLWDPPRAKEAIRQTARLAHAAGREVSMTLSDSFCVDRYRDEFLDLMRSGTVDIVFANSHEIKSLYQTSSFDEALANIRKDCRIAAVTRSEKGSVIVRGDETVVIQATAIRELVDTTGAGDLYAAGFLHGYTQGRDLKTCGDLGSLAAGLVIQQIGPRPRQNLRREAEQAGLL

SEQ ID NO: 8540 - protein, 475 aa, Mesorhizobium loti
MDTQMLIGSKFENGAETEESILNPKTGATILNLPEASQAQIEAAVAAAEKAFVSWSRTTPAQRSGYLLKIADRIEAEAKEFAALEALNCGKPINSVLNDEIPAIVDCYRFFAGAVRSMPGVVAGEYLPGHTSMVRRDPIGIVASIAPWNYPLMMMAWKLAPAIGGGNTVVFKPSEQTPLTALRLARILAEILPEGVVNVVLGRGDSVGNALINHPKVNMISITGDVATGKKVLQAAAKSVKRTHLELGGKAPVIVFDDADLGAVVNGLRAFGYYNAGQDCTAACRIYAGKKIYDKLVADLSSAVSTIKYNQPDDTENEIGPLISRRQRDRVSSFVERASELKHIEITTGGRPGEGTGFYYQPTVVAGALQEDEIVRREVFGPVVSITRFTEVDEAVNWANDSDYGLASSVWTKDVSRAMATAARLQYGCTWINTHFMLTNEMPHGGLKQSGYGKDMSLYALEDYTAVRHVMVAHA

SEQ ID NO: 8541 - protein, 389 aa, Mesorhizobium loti
MSVTKEIVTERLKTVNGPDFTGNIVDLGMVSEIFIADSKVFFSITVPAARAQEMEPLRAAAERVVKAIPGVAGAVVALTAEKKGGGMEAPVPARPAPRPAPPATPQRPAPQAPASHSSGKRGVPGIEAIIAVASGKGGVGKSTTAVNLALGLAANGLRVGVLDADIYGPSMPKLLNIHGRPQTVDGKILKPMENYGLKVMSMGFLVDEETPMIWRGPMVMSALTQMLREVEWGRLDVLVVDMPPGTGDAQLTMAQQVPLAGAVIVSTPQDLALIDARKGLNMFKKVDVPLLGIVENMSYFIAPDTGKRYDIFGHGGARREAERLGVTFLGEVPLEMGIRESSDAGTPVVVSKPDSAEAKIYRDIAAKVWDRVNEERGAAEAAVPSIVFE

SEQ ID NO: 8542 - protein, 257 aa, Mesorhizobium loti
MTAVPAISGKHALVTGGGSGVGRAIALALAGAGIDVTICGRRDAELAKVAGESDRIFGIAADVTDEASMASLYQAAEAARGAFDIVIANAGMAGSTPAHKTTLADWQKTLDVNLTGAFLTVKPALAGMAVRKAGRIVFVASTAGLKGYAYVAPYVAAKHGVVGLMRALAAETAKSGVTVNAVCPGFVETDMLEESIQRIIEKTGRSAGEARASLVSTNPQGRFIQPQEVAAAVLWLCGDAASSITGQAISISGGETW

SEQ ID NO: 8543 - protein, 495 aa, Mesorhizobium loti
MNLPPNALWIDQDDYDVRGFSHGLYIDGRWRPSSDGRVIDVVDPSSGSVIAAVPDATLEDALAAVDAAAKAATAWRETAPRKRSEILRRCFELMVERSETLAMLISLENGKALRDARGEVAYAAEFFRWNAEEAVRITGEFGTAPSGANRIVVDYEPIGICVLITPWNFPAAMATRKIAPALAAGCTVILKPASETPLTAYALAALYSEAGVPAGVVNVLTTTSPGPLTSAMLADPRVRKLSFTGSTGVGRTLLGEAAKHVVSCSMELGGNAPFVVFDDADLDAALDGAMIAKMRNAGEACTAANRIYVQSGIHDAFADGLRKRMAALKVGPGMSADTECGPMITRKAVDKIDRLVKDAVGRGAKVLCGGSIPEEEGFFYPPTVLSQVPPDADMAHEEIFGPVAPVTRFETEAEVIMHANNTEYGLAAYIYTRDVGRGLRVASRIEAGMIGLNRGLMSDPAAPFGGVKQSGLGREGGQHHGIAEFMEAKYIAVTF

SEQ ID NO: 8544 - protein, 340 aa, Mesorhizobium loti
MRQSKFAPRHAVNAGERKTTSAMIASIAPNGVPTRSAPFGHTLARLAHQRPGIVGLTADLAKYTDLHVFAQEHPDRFYQMGMAEQVLMSAAAGLAREGFTPFATTYAVFASRRAYDFICMAIAEEKLDVKIVCALPGLTTGYGPSHQATEDIAIFRGMPNLTIIDPCDALDIEQATEAIADYKGPVYMRLLRGKVPVVLDEYDYTFEIGKARLLRDGADVLFISSGLMTMRVLEAAKALEADRIDCAVLHVPTIKPLDTQAILDGARRPGRLVVVAENHTIIGGLGEGVAALLMREGVAPVFRQIALPDEFLDAGALLTLHDRYGISSSELVRRVRKWTE

SEQ ID NO: 8545 - protein, 497 aa, Mesorhizobium loti
MKGDDGLTVTQSLTRRLKNPELFDDLAGVPGRKAEQSTRRFSVFNPSTGELLAELPDMDVRDVSKAIDKAEAAQEHWAALTARERSDILWEWHQLILDHSEDLAAILTAEMGKPLAEAKSEIAHAAAYLQWYAEEANRIYGETISPPSNDRRMLVIKQPIGVVGAITPWNFPASMVARKISPALAAGCAIVLKPAEQTPLVAGAMFTLARMAGFPDGVLNLIYASEGDAVGRELCSNPKVRKISFTGSTEVGRLLMRECSDQIKRTSFELGGNAPFIVFDDADVDAAVDGALQAKFRNAGQTCVSANRLYVQSSVYNEFCDKFTKRVSALRVGDGFEPEVAIGPLIDKCALAKIEDHIRDAVRQGGKIRCGGNRIGESGTFFEPTVITDVERTMRVAQEETFGPLAPIIRFNDPDQVVREANDTIYGLAAYFYASNLKRVWRVAEALEYGMVGINTGRMSSEAAPFGGMKQSGIGREGSRHGLEDYLEMKYLCMGGL

SEQ ID NO: 8546 - protein, 405 aa, Mesorhizobium loti
MKQAGRVVIITGAAGGIGRALVEIVAADGDIVVAVDLPGSGVLELAGGLGHPHLGLECDVSREEDIVALYGRIEAQFAKIDVLVNNAAIGPAMAATIDTGFEAFRRVLATNLIGPFIMAGEAARRMQPGAAIVNVASLAGVLGNPKRNAYASSKAGLIALTRSLACEWASRGIRVTAVAPGYVRTPMVAELERAGKMDLAAVRRRVPMGRMARPDEIARAVRFLASAQTGYITGSVLTVDGGWMSFNQPGDAHPPVDETPRAELFRPAERTGARTVVVTGGANGIGAAVVRRFAANSDTVVIADKDGAGAAELADLLGGRHVAKSVDLAVESDVVALFEEIRGRFGRIEVLVNCAAIADTFVRGIEIPQQIERVLDVNLTGTFTCARGDQVDGRRRRNPQSWIDQ

SEQ ID NO: 8547 - protein, 481 aa, Mesorhizobium loti
MEHAMFDARTYELFINGKWRAGGSKATLPVINPATEKVFASVASATVSDLDEALASAERSRKAWSSRPAKDRGEILVAAARILAEKAAAAARDLSAEQGKTIAEATGEYARAVETLEWNGRNVEELSASIPLGPNRMIVPEALGVVAAFTPWNYPAVLIARKLAPALAAGCPVILKGAEETPSVAVHIVESLRQAGIPDGVVNLVFGIPVHISRHLLSSPTVKVLTFTGSTAVGKQLAMLAANNLQRCILELGGHSPVIVCEDADLAKAIPAISEYKFECAGQSCNAPSRILVARSLYEQFLSRMTDAARKIKIGAPDDPATEMGPMANARRIEAMQRLTKDAVDRGARIETGGTRLDGPGFYWPPTILTGVPKDARVLHEEPFGPILTVAPFDTLEEAIEEANATEYGLAAYFFTGAADAQQKLINSLSAGAVSVNYLKGVSADAPYGGVKQSGYGYEGGEQGVRSFQILKMVNGLSSFG

SEQ ID NO: 8548 - protein, 352 aa, Mesorhizobium loti
MPDYDVLCIGNAIVDIIAQCDEAFLETNGIIKGAMNLIDTRRAELLYSRMGPAIEASGGSAGNTAAGVGSFGGRAAFFGKVSNDGLGEIYAHDIRAQGVAFDTKPLTGEPPTARSMIFVTPDGERSMNTYLGACVELGPEDVEADKASGAKVTYFEGYLWDPPRAKEAIRQTARLAHAAGREVSMTLSDSFCVDRYRDEFLELMPLGHGRHRLCQQPRDQVALPDIVLRRGAGQDPQGLQNSRRHPLGKRLGHRARRRDRGDPGDGDPGTGRHDGRRRSLRRRFPAWLYARPRPQDLRRPWLTGGRIGDPADRTQATAEPAPRGGTGGVAVGGRFSDELPVCPPGGCAEKCA

SEQ ID NO: 8549 - protein, 369 aa, Mesorhizobium loti
MLEPQDQKKLDELFSSMQEANGCFLGYPFAKDFDYEPLWRFMSLTGNNLGDPFEPGTYRVNSHAFECDVVDFFARLFRACSCEVWGYVTNGGTEGNIYGLYLARELYPNAVAYFSQDTHYSVSKGVRLLRLEHSVVRSQSNGEINYDDLAQKATRYRTRPAVVVANIGTTMKEGKDDTLKIRAVLHDVGISAIYVHSDAALCGPYAPLLNPKPAFDFADGADSITLSGHKFLGAPMPCGVVLSHKLHVQRVMRNIDYIGSSDTTLSGSRNAFTPIILWYAIRSLGIEGIKQTFQQCERLAAYTADELNVRGVSAWRNPNALTVVLPPVEDSIKTKWQIATQDVSHLVVTPGTTKQQADALIETISNRNR

SEQ ID NO: 8550 - protein, 374 aa, Mesorhizobium loti
MRVVIDQDLCGTTGQCVLTLPGTFRQREPDGVAEVCVATVPQALHAAARLAASQCPVAAIRVIESDAGERASADPAPSPAQAERHAAKDQRNPGGRFEGKVAVVTGAGAGIGKACALAIAREGGRVVVADIDGSAAVACTAQIAAEAGHALALAMDIADAQAVAALFETAERHFGGVDLLVNNASAMHLTPRDRTILDLDLAVWDQTMATNLRGTLLCCRQAIPRMIARGGGAIVNMSSCQGLSGDTAQTSYAASKAAMNMLSASLATQYGHAQIRCNAVAPGLIMTERLLAKLDECMQRHLSRHQLLQRVGRPEDVAALVAFLLSDDAAFITGQVLCIDGGMLAHVPTYADGGNSRAARPAGDTAKAAAGPRC

SEQ ID NO: 8551 - protein, 1348 aa, Mesorhizobium loti
MPSEYSFLDVAVLDAVRQRFAAGDAIAILSVDLEQVIWANGPGAAVFGYPDIEAIIGASAQLPLIARRQIMATSGFPEIGSDRGITVRLATGMTSRTIGFQASAVTMPDAEKAIMLAVPAAQTGSRGAAEVASRAISGFTEDGHFIAFIDAGGNVEAASDGFSKLGIQPATLAALVADVAAEGERIVKRLVPGGNTSYPAGLARLTPERHLLVVIDEDQLEDNAAAAVAGASADGPSAATESPATEIGRATAAEGAAAQSDPHQDNQPTADVPLTQAVERSPGTAEIEPEPAAGQPVAEDRPERATQEIAGPTEPTPVAADNDQPAAGSTPAQHDHWYFHAGEDGAPPAPATPEAKNVAQATGAEASVDSAKESKPASPAAQTPPARTIDRSAAPLRFVWRTDAEGKFSALSPEFADIVGKPAADVIGRRFRDVAAAFGLDASGEIAGLLERRDTWSGRSVLWPVVGTDLKIPVDLAALPVYGRSRAFEGFRGFGVARASDATVDPEAIGMALVPNGKAPAVSVPQAVEHPAEEPKTEEPKAKEPNAADPFKGEVPALTIVPKQERRFADKVIRLAEHRQPANDKGLSTLERSAFREIGERLKKDSAPAEPPEADKPGTERPPEPVINTPAEPTAETAAEAPVAKTETPILPADEVVATPDTVPDQKPSEAGEITAESESDAALAEPSETDAEDEADLARLDGGHPDDVADAEPADTLPGAGGSLLNYADRNDEPGPVADNDEPPVSEAVAAEPEVTEPVATGDGGDAKDATHDAVDDDDSMTSADFRDAEDNEDWGDGEKAAAADEQAATFGAGASDVVESPAGQPRLKVPPLRTEGIVPSAFSVGNESKAPDTSLLGKLPVPLLIHSGDQLHYANDEFLDLTGYDTLEDLEDAGGLGALFADPYADDGTSDGSDRALRLKTRDGQEFPIDAILRSVPWRDGKALMLVVRRSGDDDAPVALHAVGEEPTQPDISELKARIAEMRTIIDTATDGVVLIGSDGTIRSISRPAEALFGFDSDEVTGKPFASLFAIESQRAARDYLTGLSEPGVASVMNDGREVIGREAQGRFIPLFMTIGRLPNDSGFCAVVRDITQWKRAEEDLTQARAVAERASSLKTDFLARISHEIRTPLNAIIGFSELMVDEKFGPVANDRYRDYLRDINRSGNHVLDLVNDLLDISKIEAGQQEMAYEAVSLNDTLAETVAMMQPQANRERVIIRSSFASRLPEVVADLRSVRQIALNILSNAIRYTQAGGQVIVSTAYETSGDVVMRVRDTGIGMSQAEIEQALKPFKQINALKRGRGDGTGLGLPLTKAMVEANRARFTINSTPGEGTLVEVAFPSTRVLAE

SEQ ID NO: 8552 - protein, 505 aa, Mesorhizobium loti
MNKVEFSRPVKAPFDKRYGNFIGGKWTEPRSGRYFENHSPVNGQLLCEVARSDADDIEAALDAAHAAKDAWGRTSVAERSLILNRIADRMEENLDLLACAETWDNGKPIRETTVADLPLAIDHFRYFASAVRGQEGSLSQIDDDTVAYHFHEPLGVVGQIIPWNFPLLMACWKLAPALAAGNCVVLKPAEQTPAAILLWADLIGDLLPPGVLNIVNGFGLEAGKPLASSPRIAKIAFTGETTTGRLIMQYASQNLIPVTLELGGKSPNIFFKDVVAEDDDFFDKAIEGFVMFALNQGEVCTCPSRALIHESIYDRFMERALKRVEAIVQGDPLDPATMIGAQASSEQLEKILSYIDIGRQEGAEVLTGGARNVLPGDLAGGYYVKPTVFRGHNKMRIFQEEIFGPVVSVTTFKDDDEALSIANDTLYGLGAGVWTRDGNRAYRFGRAIQAGRVWTNCYHAYPAHAAFGGYKQSGIGRETHKMMLDHYQQTKNMLVSYSPKKLGFF

SEQ ID NO: 8553 - protein, 638 aa, Mesorhizobium loti
MVIGILLDRQQRRRDLSRSNMIYRAMVRELPDCLNIKDVDGRFIAANPATAEMLGAASVEELIGKTDFDFYSKDVAERFRQDEMGALKAGQTLRIEQPAVFPDGKQGWLYTLKAPFRDEAGKITGVITYNREITEQKRNAQLKNDFISTVSHELRTPLTSIRGSLGLIAAGVVGELPPKAANLVNIAHTNSERLVLLINDILDMEKIESGVIAFKIKQMPVRPIMEQAIAASSNYMAESRIRIVLVDDAPRAEANIDPDRLHQVMANLLSNAIKFSHADGTVMVKLQRRDRDMLRISVIDQGAGIPEAFRSRIFGKFEQADASSTRKKGGTGLGLSIVKTIVEKLGGAVSFETEEEKGTSFHVDLAEARRLHPRPYPPPRPPREPDGRLRVLICEDETDVATVIAALLDSEGFSSDVAPDIATAKALLQSRDYAALTLDIKLAEESGIKLFHDIRASPVNSDIAVIVISAVADEARRSLNGTAVGIVDWLEKPVDSGRLHAALAKIVASRNEQRPKILHVEDDEGVLAVMSAGLGSDVSIISAKTLQEARRAVAKRHFDLVILDIALPDGSGLDLLADLPLETGVIVFSAAEPDQKLGDRVQAMMTKTRASEIDVAKLVRTMLASSRDGTRPAGRAKE

SEQ ID NO: 8554 - protein, 268 aa, Mesorhizobium loti
MSDTKVYLLDGGSLVLDGYHVFWNRGPGGEVRFPVYSILIEHAEGRFLIDTGYDYDHVMKVLPFEKPIQEKHQTIPGALGLLGLEPRDIDVVVNSHFHFDHCGGNKYFPHAKKICHRSEVPQACNPQPFEHLGYSDLSFSAEAAEARGATAQLLEGTTRANSTFEGIDGDVDLARGVKLISTPGHSIGHYSLLVEFPRRKPILFTIDAAYTQKSLETLCQAAFHIDPVAGVNSMRKVKKLAEDHGAELMYSHDMDNFKTYRTGTQFYG

SEQ ID NO: 8555 - protein, 248 aa, Mesorhizobium loti
MTERLAGKTALVTGAAQGIGKAIAARLAADGATVIVSDINAEGAKAAAASIGKKARAIAADISDPGSVKALFAEIQALTGGIDILVNNASIVPFVAWDDVDLDHWRKIIDVNLTGTFIVTRAGTDQMRAAGKAGRVISIASNTFFAGTPNMAAYVAAKGGVIGFTRALATELGKYNITANAVTPGLIESDGVKASPHNEAFGFVEMLQAMKGKGQPEHIADVVSFLASDDARWITGQTLNVDAGMVRH

SEQ ID NO: 8556 - protein, 287 aa, Mesorhizobium loti
MQAGARKYPEPPFPEQHHPKPGDEWAIDPAPLYDAPFYLGSKKLEDKVALITGGDSGIGRSVAVLFAREGADIAIVYLAEDRDAKATKSAVEAEGRRCILVKADVSERDQCRNAVAQTVKAFGRIDVLVNNAAFQIHSSEFAELTEEHFDTTLKTNLYGYFHMAQEAVPHMKPGSAIINTGSVTGIDGSKALVDYSMTKGGIHAFTRALSGNLLGKGIRVNAVAPGPVWTPLNPSDKEAGDVSKFGADTPMKRPAQPEELAPAYVFLASPHCSSYITGEILPVVGGY

SEQ ID NO: 8557 - protein, 261 aa, Mesorhizobium loti
MSDFENKVALITGTTGIALATARRLAQGGAAIIACGIDRAANAAMQESLAKAGADALVQTVDVSISDQVRDAVVAGVAKFGGIDVIVNSAAVHPYGTATTTDWETWNRAMSVNVGSIYLTAHFGIPEMIKRGGGAIVNVASVQGFACQQNVAAYATTKGAIHTLTRSLALDYAAAGIRVNSVSPGSIRTPILEKAARGDHGSDADVEEAYKRFGAAHPLGRIGEPEEVAEFIAFLCSSKASFCTGADYKIDGGLTAGIGVR

SEQ ID NO: 8558 - protein, 496 aa, Mesorhizobium loti
MPSAAEPMARTNNNLTGASMQSDNASKFYIDGQWVMPGGAGRMDVVNPATEQSFMQIAIGTTEDADLAVQAAFEAFPTFSQTSRTERVELLRNVLRCYNDRYDDIARAVSTELGAPLKFAREAQAWAGQIHLESTIAALEAFSFDELHGSSMITWEPIGVCALITPWNWPLNQIVCKVAPALAAGCTVVLKPSELAPLSAIIFAEVLEEAAIPKGVFNLINGTGPEVGQYLAGHPRVDMVSFTGSTRAGIMVAKTAAETVKRVAQELGGKSANIVLADADLENAVVKGVEACFSNSGQSCDAPTRLLIPADRHAEALDIARRVAAATRVGDPSSEDTDMGPVISQQQFDKIQRMIGLGIEEGATLVAGGPGKPEGLDVGFYVKPTIFGGVTPEMTIAREEIFGPVLSIIPYDTEADAIRIANDSIYGLAAYVQGGSLEGARAVARKLQAGSVYVNYAPWDTHAPFGGYKQSGNGREYSHWGIRDFMEVKGIVGWGA

SEQ ID NO: 8559 - protein, 485 aa, Mesorhizobium loti
MKTLKDKNLFREAGLIGGEWVAAGSGKTVDVIDPATQAAIGTVPDMAGSDTRAAIDAAASAYGDWKKKTNAERADLLEAWHGLMLAHLDDLALILTTEQGKPLDEAKGEIRYGASFVKWFAEEARRINGHTIPSPTQDRRIIVLKEPVGVCGIITPWNFPNAMITRKVAPALAAGCTVVIKPSEFTPYSALALGVLAERAGIPAGVINIVTGMPAEIGNEIMANETVRKISFTGSTRVGSLLMRGAADSVKRLSLELGGNAPFIVFDDADLDLAVEGALVSKFRNGGQTCVCANRILVQAGVYEAFAAKLSARVNAMTVGPGTQPGVAIGPMINMAAVEKINRHVEDALAKGAAIITEKPALPEGPQYVAPLVLSGATKDMQLAGEETFGPVAPLFRFETEEEAIALANGTPYGLASYFYTENLKRAWRVGEALEFGMVGLNTGSVSMEVAPFGGIKQSGLGREGAQAGIEEYLEMKSFHIGGLG

SEQ ID NO: 8560 - protein, 487 aa, Mesorhizobium loti
MGLSFDPDTVSLPVGHFIGGELIAAEGAIEMRRPSDGKAYAASPVADVDMVDRAVASAKAALKASNWGGVRPRERTKALQAWADLIEAEAEALAKIEALCSTRPVGQLVAGDIAITAEQIRFFAEFADKEGSELVPTDDSSLGMIMSEPYGVVGAITPWNFPISMAGWKLGPALAAGNAVVLKPSEMTPFSAVYMAQLALRAGLPAGLVNVVLGDGPTTGTALTGHSEIAKVSFTGSTRAGSAIMENVARTGVKPMTLELGGKSPQIVFADADLDKAATAIAGSVTFNAGQACVAGTRLIAEKSVADRLTATILEKMKAARPGPTWDDATQYSPIISERQRARVDGIVRAAVEAGGECLTGGHTMDGPGYFYEPTLITDVDQANPAIVEEIFGPVLTVQTFETEEEALALSTHPTYGLASGLFTADLSRTIRFARKLEAGTVWVNRYSRSRDHILPTGGYKRSGIGKDLGREAYLANRRSKSVLISL

SEQ ID NO: 8561 - protein, 258 aa, Mesorhizobium loti
MTGRLQGKIAIVTGAGQGIGAATARAFAMQGAKTVIAELNAATGKAAADELRANGADALFVETDVTDTAAVADMVAKTIAAYGGVNVLVNNAGANVFYEPLSMPDAEWDRCLRLDLQAAWSCAKAVLPTMLANGSGSIVNIASCHAFKIIPHTFPYPVAKHALVGLTRSLGIEYAARGIRVNAIAPGYIETPIAEAYWNTFPDPAEEKRRAYDLHPPKRIGRPDEVAMTAVFLASDEAPFINAETITIDGGRSVLYHD

SEQ ID NO: 8562 - protein, 257 aa, Mesorhizobium loti
MRNASLFDLAGRKALVTGASRGIGRSIAEALSAAGADVAVTARSLASLDGTTAAIRAAGGVAHAVALDVTDVNRCRTATAEAAGLLGGLDILVNNAGMEEVRPSLDVDEALWDRIVDTNLKGAFFCAQAAARQMRDAGHGGAIINLCSLTSEVGIPTAVPYGSSKSGLLGMTRALAAEWAGLGIRVNAIAPGYFRTAMTDVFYSNEAWQQSMLAKIPQHRFGDLGDLHGVAVFLASDAAAYITGQSIPVDGGFLASI

SEQ ID NO: 8563 - protein, 497 aa, Mesorhizobium loti
MSAHFARSHRHEALDRLADRRLLRELAYVDGHWTASEAAESFEVTDPATGSTVAFVAALDARQTTQAIDAAALAFPAWRSLLPQERSRILRKWFELIITAKDDLALLMTLEQGKPLQESLGEIDYAASFVEWYAEEAKRLNAESVTSHLANAEMMVRREPLGVVGIVTPWNFPSAMLTRKAAAALAAGCTIVAHPSSETPLSALALAELGERAGLPAGVFNIVTGKAATIVGRMCEDTRVRAMSFTGSTEIGRLIAAQSAPTMKRLVMELGGHAPLIVFADADLDKAVSIAIDAKFATSGQDCLAANRIYVQRPIHDRFCAAFAKRIEALRTGNGLDDMTDIGPLLHERAVQKVEEQVADALAHGARCLAGGKRHQAGPLFYQPTLLADVSDAALIMREETFGPVAAVTPFDSEDEVIARANATEYGLVAYVVTDNGARQQRMGRALDYGMVAINRVKITGAPIPFGGVKQSGIGREGSRHGLEAFTDLKYLCLDVA

SEQ ID NO: 8564 - protein, 481 aa, Mesorhizobium loti
MDIGLLIDGDKRDASGAAAYERLDPFTGKLATRAAAASVADANAAVEAAAAAFATWSKTGPGERRALLSRAADVMASKVGEFTKLMMEETGATAPWAGFNVMLAANMLREAAAMTTQISGEIIPSDKPGTLAMAIRQPAGVCLGIAPWNAPVILGTRAIAMPIASGNTVVLKASEMCPGTHRLIGQVLVEAGLPKGVINVVTNDPKDAAAIVEALVAHPSVKRVNFTGSTKVGRIIAELAGRHLKPALLELGGKAPLLVLDDAAIDAAVNAATFGAFMHQGQICMSTERLIVDERIADEFVSKLAARASQLPAGDPRGHVVLGSLISSQAADKMEELIADAVAKGAKLVAGGKRTGTVVEATLLDHVTPAMRVYAEESFGPVKPVIRVKDEDEAVRVANDTEYGLSSAVFSRDIKRAMAVAARIEAGICHINGPTVGDEAQMPFGGVKGSGYGRFGGKASIAEFTDLRWVTIEDPGQHYPF

SEQ ID NO: 8565 - protein, 268 aa, Mesorhizobium loti
MAQRIPSLKRGGLSMDLFKLDGDVALVTGAGSGIGQAIAIGLAEAGADVACFGHASKGGLEETAQQVTTLGRKALVLTGTVTSQSDLAAAIDRVEAELGALTVAVNNAGIAGSEPAETLSLEKWQKVHEVNVAGVFLSCQAEARKMLARRKGSIINIASMSGTIVNRGLTQAHYNSSKAAVIHMSKSLAMEWADRGLRVNVVSPGYTLTPMNKRPEVAEEIKIFKRDTPMGRMAAPEEMVGPTVFLASRASSFVTGLDLIVDGGYVCW

SEQ ID NO: 8566 - protein, 306 aa, Mesorhizobium loti
MSFFPGKDPEAGDAFASDQIELMVIPNAKDIGGFEVRRALPTAKRRLVGPFIFFDRMGPAILRAGQALDVRPHPHIGLSTVTYLFDGKIRHRDSLGTEMVIQPGDVNLMTAGRGIVHSERTPEELRGAPMSISGLQTWLALPDNKEEVAPVFENTAALRLPEIDAEGVRGRIVIGDFQGLRSPVRADTETLYADLRLAPGASVKIAADAEERAIYTLEGEVAISGDVFPAERLLVFRPGDEIIISSQTGAHFMLFGGASLGSQRYIWWNFVSSSKERIEQAKQEWKTGRFDIVPGDEKEFIPLPES

SEQ ID NO: 8567 - protein, 637 aa, Mesorhizobium loti
MNATPHTPLLDKVRIPADLRALDESELPQLASELRLELVDAVSRTGGHLGAGLGVVELTVALHYVFNTPDDRLIWDVGHQAYPHKILTGRRDRIRTLRQEGGLSGFTRRAESEYDPFGAAHSSTSISAGLGMAAARDLSGGRNNVIAVIGDGAMSAGMAYEAMNNAGALDARLIVILNDNDMSIAPPTGAMSAYLARLASGKAYAGLRDFGKKLTSYLGKRADRAITRAVEHARGYVTGGTLFEELGFYHIGPIDGHNLEHLIPVLKNVRDNGEGPVLIHVVTQKGKGYAPAEAAADKYHGVNKFDVITGAQAKAPANAPAYTKVFAESLIREAREDDRIVAVTAAMPSGTGLDLFGEVFPSRTFDVGIAEQHAVTFAAGLATEGYKPFAAIYSTFLQRAYDQVVHDVAIQKLPVRFPIDRAGFVGADGATHCGAFDTTFLASLPGFVVMAAADEAELRHMVRTAAAYDDGPIAFRYPRGNGVGVDMPERGEVLELGKGRVVREGSKVALLSFGTRLQDCLIAAEELGAAGLSTTVADARFAKPLDEDLIRRLARSHEVLVTVEEGAIGGFASHVLQFLAHEGLLESGLKVRPLVLPDVFTDHAKPEKMYADAGLDAAGIVRTVFTALDHTARAQRA

SEQ ID NO: 8568 - protein, 892 aa, Mesorhizobium loti
MTKWVFTFGDGAAEGRAGDKNLLGGKGANLAEMCSLGLPVPPGFTITTEVCNAYYANGRAYPAGLEADVAVALDHIGRLTDRRFGDPSKLLLVSVRSGARASMPGMMDTVLNLGLNDETVEALATDSGDARFAYDSYRRFIQMYSDVVMGLDHEVFEEILEDQKASLGHELDTELTAIEWQGVIALYKAKVEEELGRPFPQDPQEQLWGAIGAVFSSWMNNRAITYRRLHDIPESWGTAVNVQAMVFGNMGETSATGVAFTRNPSTGEKQLYGEFLVNAQGEDVVAGIRTPQNITEAARIAAGSDKPSLQKLMPDAFQSFVSISDSLEKHYRDMQDLEFTIERGKLWMLQTRSGKRTAKAALKIAVEMARDGLITKEEAVARIDPASLDQLLHPTIDPKAARDVIGVGLPASPGAATGEIVFSSGDAEDLKAQGRKAILVRIETSPEDIHGMHAAEGILTTRGGMTSHAAVVARGMGKPCVSGAGSLRVDYKAGTLLSMGQTFRKGDIITIDGGNGQVLKGAVAMLQPELSGDFAAIMEWADAVRRMKVRTNAETPLDARMARSFGAEGIGLCRTEHMFFDGARIVAMREMILADTEKDRRIALAKLLPMQRSDFLELFEIMAGLPVTIRLLDPPLHEFLPKTEAEIAEVAAVMDVSPDKLRQRTEALHEFNPMLGHRGCRLAVSYPEIAEMQARAIFEAAVEAGQKAGALVVPEIMVPLVGLVKELDYVKARIDAVAKSVMEESGVKIDYLTGTMIELPRAAIRAHVIAATAEFFSFGTNDLTQTTFGISRDDAASFLETYRQKGIIEQDPFVSLDVDGVGELVRMAAQKGRATRPDIKLGICGEHGGDPASIRFCEEVGLDYVSCSPYRVPIARLAAAQAAVQVSKAGRG

SEQ ID NO: 8569 - protein, 487 aa, Mesorhizobium loti
MRAQPTASHYVNGRYIDDEQGAPLPVIYPATGETIAMLRSATPNVLELAIEAARAAQPAWARLKPVERGRILRRAADILRARNADLARIETLDTGKAIQETLVADAPSAADCLEYFGGAVAAYNGEAVDLGGPFAYTRREALGVCVGIGAWNYPIQIAGWKSAPALAMGNAMVFKPSENTPLSALALAEIYSEAGLPDGLFNVVQGYGDVGAGLVGHDVVAKVSVTGSVPTGRKVLSLAGSKMKHATMELGGKSPLIVFDDADIENAIGGAMLGNFYSTGQICSNGTRVFVQSGIHDRFVERLVERTKKIRIGNPLDPETQMGPLVSKAQHEKVVGYIGIGKQDGAVLACGGNVPSLQGFDGGFFVEPTVFTGVTDTMRIAREEIFGPVMSVLKFDGEDEVIDRANDTEFGLAAGVFTRDLPRAHRVIAELQAGTCWINAYNLTPVEIPFGGFKQSGIGRENSLAALALYSQLKSIYVETGDVASPY

SEQ ID NO: 8570 - protein, 541 aa, Mesorhizobium loti
MAAIFAAFGLCWFVALLVAATGKMAAAAPVALAMAAVALGGLIAAAGGLSSPVAVLAVALPFEAWWIGASRRAALWGAVSAIAAIALQPLAAAFLPFAGAQIAAWHWLVPLAWALTLIPRLSAVGDSAGATDTLDAGGRLEDIIDAVILRVARHGEVLDASDKARTLLKLPPELLSGTGFFDRVHLSDRVSYLSALADMRDGAASRRLELRVRLPQNGNGQNDTRQSDSRLMADNYRPFLLELLRGEEQSDVFTLVLRENDETARLREELAQANETAAAAEVAKGRFLAVVSHELRTPLNAIIGFSDMLLHEMFGAFKDPRQKEYVTLVRDSGQHLLAVVTSILDVSRIESGAYTADPEPFRFMEAVDMCQSMMRLQAQAKNIDLQTQIAPDAGDINADRRAVQQMLINLVSNAIKFTPDGGDVVVGAKRIGSRLHFWVRDTGIGIAEEDFANLGKPFTQIQNDYTRRFEGTGLGLSLVKGLVALHEGTMSIESMPGEGTTVTISLPVNGPKGRPANEAGVLTMPVTRAKGDRNGSLRKTA

SEQ ID NO: 8571 - protein, 239 aa, Mesorhizobium loti
MSVTYDFTGRTAIVTGGARGIGRAIAHKLSLSGADVWIWDIEPVELEGTRSLSVDVTKRDNVMQALTIMGEVGVDILVNNAGWLGGYKPFEEFEPAEWQRILQVNLLGTFEVTHRVLPLMRRAGKGRIVNMGSLAGKEGLPSLAAYSAASAGVIAFTKALSREVSDTDIRVNCIAPGPIDTRLIRDLGNETVDAMISASPLKRLGDPNEVAALVVWLCSDASAFNTGAVFDMSGGRARY

SEQ ID NO: 8572 - protein, 356 aa, Mesorhizobium loti
MPGVTRASLEGRMLAFASERRLANTNGPQGGATFERQLSDGRWLQVNELKTRDGGIVSVGSDITQIKLHQEKLVDSERRLMATIHDLSLARRAEEERSRELVDLNRKYMKETERAEAANRAKSEFLANMSHELRTPLNAIIGFSELMEQGLFGPLGSARYEEYATDINSSGKYLLGVINDILDMSKIEAGQFSLDQEQIDLGPLISETVRVVSLQAAQKAITVETRIADALSLFADRRAIKQIVINLLSNAVKFTGQGGHISVRARNTSGALVLTIEDNGCGIPKEALGKLGRPFEQVQNQFSKNHAGSGLGLAISRSLAELQGGALKIRSTEGVGTIVSVRIPVKKAPPAVKAAA

SEQ ID NO: 8573 - protein, 265 aa, Mesorhizobium loti
MKVLLVFAHPESRSLSGALRDVAIRELEAQGHEVRVSDLYADGWKSEIDRADFPSLEPDARLIPVAASKKGFEANTLTADVKAEIEKLLWADTLILQFPLWWFAMPAILKGWVDRVFAYGFAYGVGEHSDRRWGDRYGEGTLVGKRAMLIVTAGGWEEHYTPRGINGPIDDLLFPINHGILYYPGYDVLPPFVVYKVDRLDETGFEPVAERLRDRMRTLATTAPIPYRRQNGGDYLIPSMNLRPELGDPGANGFALHSNQAGDAS

SEQ ID NO: 8574 - protein, 245 aa, Mesorhizobium loti
MFELTGRKALVTGASGGIGEAIARVLHAQGAIVGLHGTRIEKLEALAAELGDRVKLFPANLSNRDEVKALGQKAEADLEGVDILVNNAGITKDGLFVRMSDADWDSVIEVNLTAVFRLTRELTHPMMRRRHGRIINITSVVGVTGNPGQTNYCASKAGMIGFSKSLAQEIATRNITVNCVAPGFIESAMTDKLNDKQKEAIMAAIPTRRMGTGAEVASAVAYLASNEAAYVTGQTVHVNGGMAMI

SEQ ID NO: 8575 - protein, 257 aa, Mesorhizobium loti
MRLLHKRTLVTGGSDGIGLAIAEAFLSEGADVLIVGRDAAKLEAARQKLAALGQAGAVETSSADLATSLGVATVVEQVKETGRPLDIPINNAGVADLVPFESVSEAQFQHSFALNVAAAFFLTQGLLPHFGAGASIINISSYFARKMIPKRPSSVYSLSKGALNSLTRSLAFELGPRGIRVNAIAPGTVDTAMRRKTVDNLPAEAKAELKAYVERSYPLGRIGRPDDLAGMAVYLASDEAAWTSGGIFAVDGGYTAG

SEQ ID NO: 8576 - protein, 319 aa, Mesorhizobium loti
MQAIPIAHQAAQPVVGPISSLTGYPAAILCWLLSAGVYIAAKWVAPEMPPWGLCFWRLTLACAILLPIVHRHHGAMIGLLRTRAVEVVAVGAIGLTLCQGMIYHGLNDTNATTAGIIMALSPVMTMVLARFVLGEPLGLWKSLGALVALAGMIFIVAHGNLTALLQLEFNAGELWIVGSAFCWGLYTVLLRRAKFGIELLPMVVLLLGAGALVALPFHLWELFNDERSVMNVHSILALAYLAGPGGALMYYLYNKSVETLGASRASMLLYLQTVFVAMLAYLLLGEDLHDYDLIGAAFIVAGIILATVIKPRSAEPRVA

SEQ ID NO: 8577 - protein, 149 aa, Mesorhizobium loti
MKRPDFMALALKEAEAAALRGEVPVGAVIANGSTVVAKAGNRTRELADPTAHAEMLVIREACGKLSSERLTGHDLYVTLEPCAMCAGAISFARLRRLYFGAPDEKGGAVVNGVRFFASPTCHHTPDIYPGMGETEAALLLKDFFKERRD

SEQ ID NO: 8578 - protein, 297 aa, Mesorhizobium loti
MSAMTGTLNQTQRMDTTAAIAVALTVVGWASAFPAIRAGLAAFGPLELGALRFAIAAVPAAIFLAVKRPALPRLDEVWRLVFGGAIFVALYTAMLNFGELTVSAGAAGFIINVSPIFTAIMAMALLGERFSRWAWAGTAISFAGIGVIAMADGQGLHFNAGALLVLGSALCSAVNTIVQKPLFARHHPLTISASNMVLGALCLSPFLPSGFAQAAVANTAGLGAVIFLGIVPSLIAYAAWATALSRLPAARASNFLYLVSPMSALIGFFWLGEVPTLLGILGGALALGGVIVVNLKR

SEQ ID NO: 8579 - protein, 500 aa, Mesorhizobium loti
MAKIIETSTGALALTFDDVLLQPGHSEVMPGETDVRTRIAGDIDLNVPILSAAMDTVTEARLAIAMAQAGGIGVIHRNFSPAEQAEQVRQVKKFESGMVVNPVTIGPDATLADALSLMRTYSISGIPVVENGGTGGHKTGRLVGILTNRDVRFASDPAQKVYELMTRENLITVKENVDQDEAKRLLHQHRIEKLVVVDKQGNCVGLITVKDIEKSQLNPHATKDAQGRLRAAAATSVGDDGFERAERLIDAGVDLLVIDTAHGHSQRVLDAVTRAKKLSNSVRILAGNVATAEGTQALIDAGADAVKVGIGPGSICTTRIVAGVGVPQLSAIMSAVETAHKSGVSVIADGGIKYSGDLAKALAAGASAAMIGSLLAGTDESPGEVYLHQGRSFKAYRGMGSVGAMARGSADRYFQAEVRDTLKLVPEGIEGQVPYKGPVSGVLHQLAGGLKAAMGYVGGRDLADFRERATFVRISNAGLRESHAHDVTITRESPNYPGGA

SEQ ID NO: 8580 - protein, 591 aa, Mesorhizobium loti
MPAFFCYQLDAGHTVCCPSAIAVRRCLDATPTIAHGSPNSRNRAMQAAIFVLVVLVFVAVSGALVRLVRVPLPVLQIAIGAALAWPVRGIHVEIDPELFLLVFIPPLLFSDAFGAPKRELMALRGPILDLAIGLVFFTIVGFGYALHWLVPSIPLVVAFALAAVLSPTDAVAVSSIVDRNVVPARLMHILEGESLLNDASGLVMFRFAVAAALTGSFSFAAASLSFLYAVAAGIVAGVAALFVAAKALQLLNRIGGVPAEPQVLITILLPFVAYLGAENFGASGILAAVTAGLLTGSTGIFRFLGVSARMQTISLWTTFSFVFNGALFIVLGLQLPEIIRKVPPELSSRHWLLEPVLTVLLLTLCLIALRFVWIWIGDITAGFAARLGKRKAEPFGLRVRLAGSVAGVRGAITLAGILSLPLALQDGSPFPARDLVIFLAAGVIICSLLIASLALPVIARGLVEPGEDAGAAEERMARVGAAKAAIAHLESLAQTDEEEGDVPGLKLAAANGIVAAYRRRIAASDEADEARAEMREAGRLETDLRLAGIAAERDALRAMLRRGEINDHTARALFTEITLSEALLNGRQTRK

SEQ ID NO: 8581 - protein, 279 aa, Rattus norvegicus
MLLLVTLALLAGPTCRAQNILGNNVGTYFYVAGEEHGQLRGIRIFLTVIDLIKGIQLRFGGNWSDVYGSRSLKYKEFLLEDGEHVTQVSGTRKLCLTSLSFTTNKGRVVTFGVRRGLSFNESGGSDKYLVTVNGLYAPGLCLNGMGFKWKNIHDDFDDNDDDKEDDDDEHDDDNEEDHGDKDNDNDHDDDHDDDDDDKEDDNEEDVDDERDDKDDDEEDDDNDKENDKDDGEGSGDDDDNDDEDDDKDDDGGSGDDGDDGDDDEDDDGGDDDNGDEEEE

SEQ ID NO: 8582 - protein, 356 aa, Oryza sativa (japonica cultivar-group); identical to SEQ ID NO: 1192

SEQ ID NO: 8583 - protein, 225 aa, Oryza sativa (japonica cultivar-group); identical to SEQ ID NO: 4089

SEQ ID NO: 8584 - protein, 597 aa, Arabidopsis thaliana
MEWDSDSDLSGGDEVAEDGWFGGDNGAIPFPVGSLPGTAPCGFVVSDALEPDNPIIYVNTVFEIVTGYRAEEVIGPFTKRRHPMVDSTIVAKMRQCLENGIEFQGELLNFRKDGSPLMNKLRLVPIREEDEITHFIGVLLFTDAKIDLGPSPDLSAKEIPRISRSFTSALPIGERNVSRGLCGIFELSDEVIAIKILSQLTPGDIASVGCVCRRLNELTKNDDVWRMVCQNTWGTEATRVLESVPGAKRIGWVRLAREFTTHEATAWRKFSVGGTVEPSRCNFSACAVGNRIVIFGGEGVNMQPMNDTFVLDLGSSSPEWKSVLVSSPPPGRWGHTLSCVNGSRLVVFGGYGSHGLLNDVFLLDLDADPPSWREVSGLAPPIPRSWHSSCTLDGTKLIVSGGCADSGALLSDTFLLDLSMDIPAWREIPVPWTPPSRLGHTLTVYGDRKILMFGGLAKNGTLRFRSNDVYTMDLSEDEPSWRPVIGYGSSLPGGMAAPPPRLDHVAISLPGGRILIFGGSVAGLDSASQLYLLDPNEEKPAWRILNVQGGPPRFAWGHTTCVVGGTRLVVLGGQTGEEWMLNEAHELLLATSTTAST

SEQ ID NO: 8585 - protein, 708 aa, Aspergillus fumigatus
MALDKELLHLHLGDGQQRPYKLSTVATPPDEEQLNLQRSDKDTAEPSQTPRCDTPREAHTEIVQNDTSSLNRIFRFTPVPTLILDSSLRVIEVSESHLAFCGKSRDFVLGASIYELPLATIPAPDIATLNGALHVAITTRAVQVVETIHLPRISSYFSLKITPIFQGSTLLNLVLEAHNVTRTHTESLHNAYINETYKILVDTIRDYAIFMLDARGNIVTWNSGAAIIKGYKADEIIGRHFSVFYGPEDRLADKPGKELELCLRDGKVEDEGWRYRQDGLRFWANVMITPIFSFGRHVGFVKITRDLTERKAAEARMVAAFEESSKMKSDFLANMSHEIRTPMNGMHLALTMLGSTELDTQQREYTSIIEDSMSILLQVINDVLDYSKLSSGTFSLNTDVLSVENIVGAVVRNCKALNPAVEISCSMPPGFPKLLRGDPLRYRQVIQNLVGNAMKFTEKGHVKVTHRFAVEEHDANRYIITTEVTDTGIGVPEDAINTLFTPFTRFADSATKRYQGTGLGLSICKSLAELMDGSVGYKPNPEGKGSCFWLNVRMQAVDIPAPSKDTPAATAENTYEPIEEVKEIAPHMHILLVEDNMVNQIVMLKLLKSLGFERVDTAWDGADAVRQVKQTPLSYNVILMDINMPVMNGLEATTKIREVNSEVPIIALTGNALKGDAETYLARGMNDYVAKPVHRKRLVQLLWKWLGS

SEQ ID NO: 8586 - protein, 245 aa, Rattus norvegicus
MDKNELVQKAKLAEQAERYDDMAACMKSVTEQGAELSNEERNLLSVAYKNVVGARRSSWRVVSSIEQKTEGAEKKQQMAREYREKIEMELRDICNDVLSLLEKFLIPNASQPESKVFYLKMKGDYYRYLAEVAAGDDKKGIVDQSQQAYQEAFEISKKEMQPTHPIRLGLALNFSVFYYEILNSPEKACSLAKTAFDEAIAELDTLSEESYKDSTLIMQLLRDNLTLWTSDTQGDEAEAGEGGEN

SEQ ID NO: 8587 - protein, 325 aa, Mesorhizobium loti
MVISPMTGSSREKLAIVCGFAAIYLIWGSTYLALAVAVQTIPPFALMGTRSIVGGVILLAYSKAKADDGGSIRSWIRASLCGVLFFVGCHGVLAYAEQRMPSGLAALLLATIPFWIIVGRSILGRSDKPLVRTILLLLPGLLGVVLVAWRSVAGPAALHLSDILLLLMASASWALGTLIAEGHNNKGSSVALAGRELITGGAALMFLSLARGEPIGAVEQISLSSFLGWSYLTLAGTVVAFGSYIWLLKKISPALVATYTFVNPVIAMFLGWAFLGEEVSVTTVIGGFLVVASVACLLVANRNSTHKEAASWSTPPKTAAAIAKG

SEQ ID NO: 8588 - protein, 527 aa, Oryza sativa (japonica cultivar-group); identical to SEQ ID NO: 3971

SEQ ID NO: 8589 - protein, 591 aa, Mus musculus
MSVSLVVIRLELAGHSPVPTDFGFSAAAGEMSDEEIKKKTLASAVACLEGKSAGEKAAIIHQHLGRREMTDVIIETMKARADEVRDTVEEKKPSAAPVSAQRSREQSESVNTAPESPSKQLPDQISFFSGNPSVEIVHGIMHLYKTNKMTSLKEDVRRSAMLCVLTVPATMTSHDLMKFVAPFNDVIEQMKIIRDSTPNQYMVLIKFSAQADADSFYMACNGRQFNSIEDDVCQLVYVERAEVLKSEDGASLPVMDLTELPKCTVCLERMDESVNGILTTLCNHSFHSQCLQRWDDTTCPVCRYCQTPEPVEENKCFECGVQENLWICLICGHIGCGRYVSRHAYKHFEETQHTYAMQLTNHRVWDYAGDNYVHRLVASKTDGKIVQYECEGDTCQEEKIDALQLEYSYLLTSQLESQRIYWENKIVRIEKDTAEEINNMKTKFKETIEKCDSLELRLSDLLKEKQSVERKCTQLNTRVAKLSTELQEEQELNKCLRANQLVLQNQLKEEEKLLKETCAQKDLQITEIQEQLRDVMFYLETQQQISHLPAETRQEIQEGQINIAMASAPNPPSSGAGGKLQSRKGRSKRGK

SEQ ID NO: 8590 - protein, 561 aa, Mus musculus
MSDEEIKKKTLASAVACLEGKSAGEKAAIIHQHLGRREMTDVIIETMKARADEVRDTVEEKKPSAAPVSAQRSREQSESVNTAPESPSKQLPDQISFFSGNPSVEIVHGIMHLYKTNKMTSLKEDVRRSAMLCVLTVPATMTSHDLMKFVAPFNDVIEQMKIIRDSTPNQYMVLIKFSAQADADSFYMACNGRQFNSIEDDVCQLVYVERAEVLKSEDGASLPVMDLTELPKCTVCLERMDESVNGILTTLCNHSFHSQCLQRWDDTTCPVCRYCQTPEPVEENKCFECGVQENLWICLICGHIGCGRYVSRHAYKHFEETQHTYAMQLTNHRVWDYAGDNYVHRLVASKTDGKIVQYECEGDTCQEEKIDALQLEYSYLLTSQLESQRIYWENKIVRIEKDTAEEINNMKTKFKETIEKCDSLELRLSDLLKEKQSVERKCTQLNTRVAKLSTELQEEQELNKCLRANQLVLQNQLKEEEKLLKETCAQKDLQITEIQEQLRDVMFYLETQQQISHLPAETRQEIQEGQINIAMASAPNPPSSGAGGKLQSRKGRSKRGK

SEQ ID NO: 8591 - protein, 485 aa, Volvox carteri
MSKLLLVALFGAIAVVATSAEVLNLNGRSLLNNDDPNAFPYCKCTYRQRRSPYRLKYVGAENNYKGNDWLCYSIVLDTTGTVCQTVPLTEPCCSADLYKIEFDVKPSCKGTVTRAMVFKGIDRTVGGVRVLESISTVGIDDVTGVPGAAILRIVKDLALPYSVVASFLPNGLPVCINRVPGSCTFPELFMDVNGTASYSVFNSDKDCCPTGLSGPNVNPIGPAPNNSPLPPSPQPTASSRPPSPPPSPRPPSPPPPSPSPPPPPPPPPPPPPPPPPSPPPPPPPPPPPPPPPPPPSPSPPRKPPSPSPPVPPPPSPPSVLPAATGFPFCECVSRSPSSYPWRVTVANVSAVTISGGAGERVCLKISVDNAAAATCNNGLGGCCSDGLEKVELFANGKCKGSILPFTLSNTAEIRSSFSWDSTRPVLKFTRLGLTYAQGVAGGSLCFNIKGAGCTKFADLCPGRGCTVAVFNNPDNTCCPRVGTIA

SEQ ID NO: 8592 - protein, 96 aa, Zea diploperennis
MGRRACCEKEGVKRGAWTTKEDDALAAYVKAHGEGKWREVPQKAGLRRCGKSCRLRWLNYLRPNIRRGNISYDEEDLIIRLHKLLGNRWSLIAGRL

SEQ ID NO: 8593 - protein, 96 aa, Zea diploperennis
MGRRACCEKEGVKRGAWTTKEDDALAAYVKAHGEGKWREVPQKAGLRRCGKSCRLRWLNYLRPNIRRGNISYDEEDLIIRLHRLLGNRWSLIAGRL

SEQ ID NO: 8594 - protein, 96 aa, Zea diploperennis
MGRRACCEKEGVKRGAWTTKEDDALAAYVKAHGEGKWREVPQKAGLRRCGKSCRLRWLNYLRPNIRRGNISCDEEDLIIRLHKLLGNRWSLIAGRL

SEQ ID NO: 8595 - protein, 96 aa, Zea diploperennis
MRRRACCEKEGVKRGAWTTKEDDALAAYVKAHGEGKWREVPQKAGLRRCGKSCRLRWLNYLRPNIRRGNISYDEEDLIIRLHKLLGNRWSLIAGRL

SEQ ID NO: 8596 - protein, 96 aa, Zea diploperennis
MGRRACCEKEGVKRGAWTTKEDDALAAYVKAHGECKWREVPQKAGLRRCGKSCRLRWLNYLRPNIRRGNISYDEEDLIIRLHRLLGNRWSLIAGRL

SEQ ID NO: 8597 - protein, 172 aa, Drosophila melanogaster
MSSSQNNNSSWIDWFLGIKGNQFLCRVPTDYVQDTFNQMGLEYFSEILDVILKPVIDSSSGLLYGDEKKWYGMIHARYIRSERGLIAMHRKYLRGDFGSCPNISCDRQNTLPVGLSAVWGKSTVKIHCPRCKSNFHPKSDTQLDGAMFGPSFPDIFFSLLPNLTSPLDDPRT

SEQ ID NO: 8598 - protein, 802 aa, Zea mays; identical to SEQ ID NO: 6465

SEQ ID NO: 8599 - protein, 805 aa, Solanum tuberosum
MAERVLTRVHSLRERVDATLAAHRNEILLFLSRIESHGKGILKPHELLAEFDAIRQDDKNKLNEHAFEELLKSTQEAIVLPPWVALAIRLRPGVWEYIRVNVNALVVEELSVPEYLQFKEELVDGASNGNFVLELDFEPFTASFPKPTLTKSIGNGVEFLNRHLSAKMFHDKESMTPLLEFLRAHHYKGKTMMLNDRIQNSNTLQNVLRKAEEYLIMLPPETPYFEFEHKFQEIGLEKGWGDTAERVLEMVCMLLDLLEAPDSCTLEKFLGRIPMVFNVVILSPHGYFAQENVLGYPDTGGQVVYILDQVPALEREMLKRIKEQGLDIIPRILIVTRLLPDAVGTTCGQRIEKVYGAEHSHILRVPFRTEKGIVRKWISRFEVWPYMETFIEDVAKEISAELQAKPDLIIGNYSEGNLAASLLAHKLGVTQCTIAHALEKTKYPDSDIYWKKFDEKYHFSSQFTADLIAMNHTDFIITSTFQEIAGSKDTVGQYESHMAFTMPGLYRVVHGINVFDPKFNIVSPGADINLYFSYSETEKRLTAFHPEIDELLYSDVENDEHLCVLKDRTKPILFTMARLDRVKNLTGLVEWYAKNPRLRGLVNLVVVGGDRRKESKDLEEQAEMKKMYELIETHNLNGQFRWISSQMNRVRNGELYRYIADTKGAFVQPAFYEAFGLTVVEAMTCGLPTFATNHGGPAEIIVHGKSGFHIDPYHGEQAADLLADFFEKCKKDPSHWETISMGGLKRIEEKYTWQIYSESLLTLAAVYGFWKHVSKLDRLEIRRYLEMFYALKYRKMAEAVPLAAE

SEQ ID NO: 8600 - protein, 310 aa, Arabidopsis thaliana
MDGSSFLDISLDLNTNPFSAKLPKKEVSVLASTHLKRKWLEQDESASELREELNRVNSENKKLTEMLARVCESYNELHNHLEKLQSRQSPEIEQTDIPIKKRKQDPDEFLGFPIGLSSGKTENSSSNEDHHHHHQQHEQKNQLLSCKRPVTDSFNKAKVSTVYVPTETSDTSLTVKDGFQWRKYGQKVTRDNPSPRAYFRCSFAPSCPVKKKVQRSAEDPSLLVATYEGTHNHLGPNASEGDATSQGGSSTVTLDLVNGCHRLALEKNERNNTMQEVLIQQMASSLTKDSKFTAALAAAISGRLMEQSRT

SEQ ID NO: 8601 - protein, 303 aa, Mus musculus
MGSWKTGQSYLAAGLLKNQVAVVTGGGTGIGKAVSRELLHLGCNVVIASRKLDRLTAAVDELRASLPPSSSAEVSAIQCNIRKEEEVSNLVKSTLAKYGKINFLVNNGGGQFMAPVEDITAKGWHAVIETNLTGTFYMCKEVYNSWMREHGGSIVNIIVLLNNGFPTAAHTGAAREGVYNLTKSMALAWASSGVRINCVAPGTIYSQTAVDNYGEMGQTLFEMAFDSIPAKRLGVPEEISPLVCFLLSPAASYITGQLINVDGGQALYTHAFSIPDHDNWPVGAGDLSIVKRIKESFKKKAKL

SEQ ID NO: 8602 - protein, 161 aa, Trypanosoma cruzi
LLGGKGANLAEMVNLGIPVPPGFTITTEVCGIYQRTKGLPQEVVEQVKANVRRVEADMGTNFGDVENPLLFSVRSGAAASMPGMMDTVLNLGMNKATAEAWIRRAPHLERFVYDSYRRFITMYADIVMQVGREDFEEAIGHMKEKRGAKFDTDLTAMDLKE

SEQ ID NO: 8603 - protein, 335 aa, Agrobacterium tumefaciens
MAMTRAVTRERQANATRLIVSLSDAALLCGMVVFWGLSWPVMKLSVEHAPPLWLAVLRFSTSSICLFVFGLFRRDIRFPTNRDLPIIASIGLLQMAAFTALGMVAMTFIDAGKASLLAYSTPLWSVLIAYLMFRERPTRVQLVAVAVGVGGIAVMSSPLSIDWSNAGSPIGAGLLVIAAICWSVVILHVRRHTWSATPLQLAPWEMALASIILVPIAWAIDGPPTTIDWTPELVLLILYFGPVATSFCFVVSAEVGRRISVFAMSNLTLGVPIIGTAASIAFFGERLSLVSLSGFVLIVSGIAIAVCAVRRKAQTEDRTRERNNRQRQYFPTDRV

SEQ ID NO: 8604 - protein, 316 aa, Gallus gallus
MPREDRATWKSNYFMKIIQLLDDYPKCFVVGADNVGSKQMQQIRMSLRGKAVVLMGKNTMMRKAIRGHLENNPALEKLLPHIRGNVGFVFTKEDLTEIRDMLLANKVPAAARAGAIAPCDVTVPAQNTGLGPEKTSFFQALGITTKISRGTIEILSDVQLIKTGDKVGASEATLLNMLNISPFSFGLVIQQVFDNGSIYNPEVLDITEETLHKRFLEGVRNVASVCLQIGYPTIASVPHSIVNGYKRVLAVAVETDYTFPLAEKVKAFLADPSAFVAAAPVVVETAAPAAAAAPAKEAPKEESEESDEDMGFGLFD

SEQ ID NO: 8605 - protein, 499 aa, Mycoplasma pneumoniae
MSSPKKNFKKPQPKTENQKQALNEERIAELKKSRILGKNRPFKKMIYVDTKAQRKQKHENVAFLKTLQENKESDVPKKRRGRKPKHAPLKEKNNLKLFDILEGSLKSHTENDDTNKVISLLVEVWEKKNKKKDNNSLSNKDIVNVLSKFELPDDEIIFVLDELRDKGIELPHDVEEHIHEFRANQDLSIIDEDIEELTTKNISNRDKVDDNVRFFLGSLDSSKMLDFESEQRIAKVLNSTDEESRKYAINQLVTSNLRLVVSIAKKHLERGLDFNDLIQEGNLGLLKAISKFNWSLGNKFSTYATWWIKQAITRAIADQARTVRIPVHMVETINRLAKAERALNQELGREPTAEELAEKMGGQAEGFTVKKIAEIKRLSLDPVSLDKTVGHDEESQFGDFVRDTDAQMPDEFTESRSNYEKIDELLNNCLSEQEELIVRMRIGMPPYNETKTLDEVSQKIKIPREKIRQIETKAIRKLRQAVRNNHMSLSFMRGNEKKD

SEQ ID NO: 8606 - protein, 279 aa, Nicotiana plumbaginifolia
MASSASSLHFLSLTPQTLLLPKPTSQTTSLSFFSLPPSSLNLSLSSPSSCFSSRFVRKVTLPDFDQIEDVEDGDEGVEEERNFSPDLKIFVGNLLFSADSAALAELFERAGNVEMVEVIYDKLTGRSRGFGFVTMSSKEEVEAACQQFNGYELDGRALRVNSGPPPEKRENSSFRENSSFRGGSRGGGSFDSSNRVYVGNLAWGVDQDALETLFSEQGKVVDAKVVYDRDSGRSRGFGFVTYSSAEEVNNAIESLDGVDLNGRAIRVSPAEARPPRRQF

SEQ ID NO: 8607 - protein, 292 aa, Nicotiana plumbaginifolia
MASSSVSSLQFLFVTSQTPSSLKPNSTLSFFSLPSSSLNLSLSSSSIGHSASIKPFESSFSTRVALSDFDQLEDDVEVAEQPRFSEDLKLFVGNLPFSVDSAALAGLFERAGNVEIVEVIYDKLSGRSRGFGFVTMSTKEEVEAAEQQFNGYEIDGRAIRVNAGPAPAKRENSSFGGGRGGNSSYGGGRDGNSSFGGARGGRSVDSSNRVYVGNLSWGVDDLALKELFSEQGNVVDAKVVYDRDSGRSRGFGFVTYSSAKEVNDAIDSLNGIDLDGRSIRVSAAEERPRRQF

SEQ ID NO: 8608 - protein, 456 aa, Mycoplasma pneumoniae [sequence omitted]

SEQ ID NO: 8609 - protein, 572 aa, Mycoplasma pneumoniae
MKKLSGIGVSDGMALAKAFLVKTPEFAVNKYLKHQLTKAQAKRLLDSAFKKAVKDLEEIKEITVNNINTEAGMIFDAHIQMLNDPTITEQLEQQLAQNVHPVIAVDTVFSQTATMFSQMQDKYFQERAADILDLRQRLLAYLTGQKPHDLVKIKSDVIIVAHDLTPSQTATLNKKYVKGFLTEIGGRTSHAAIMARSLEIPAVVGIKGITTKVKDGQIVGVDGRKGIAGLDLNSKDTTEWKKQKALEEKYQQELKQYTNKETVTLDGHAVVVAANIGNVKDMELACQYNTNGVGLFRTEFLYMNSQEWPDEETQYQAYKAVLEQAHGDLVIIRTLDIGGDKKLNYYEFPHEDNPFLGYRALRLTLDKQDIFKTQLRALLRAADHGQLGIMFPMVATLDELLQAKQLLNQVHQELGGNKQFKLGIMIEIPAAVLAANTLSHHVDFFSIGTNDLIQYSFAADRMNKNVSYLYQPLNPALLKLIYLTIEGGKVNDIWTGMCGEMAGEPLAIPLLLGLGLKEFSMSASSMFKARMIIAKLNYTECQTLAQKALTLANAKEVEKLVEKFFKKKDIFI

SEQ ID NO: 8610 - protein, 331 aa, Yersinia enterocolitica
MSQNTLKVNELHEDADFDENSTETEIFDEKALVEDEPTESELAEDELLAQGVTSGADATQLYLGEIGYSPLLTAEEEVYFARRALRGDVPSRRRMIESNLRLVVKIARRYSNRGLALLDLIEEGNLGLIRAVEKFDPERGFRFSTYATWWIRQTIERAIMNQTRTIRLPIHIVKELNVYLRTARELSHKLDHEPSAEEIAEQLDKPVDDVSRMLRLNERITSVDTPLGGDSEKALLDILSDENENGPEDTTQDDDMKQSIVKWLFELNAKQREVLARRFGLLGYEAATLEDVGREIGLTRERVRQIQVEGLRRLREILQAQGLSIEALFRE

SEQ ID NO: 8611 - protein, 1045 aa, Beta vulgaris
MAGNDWINSYLEAILDVGPGLDDAKSSLLLRERGRFSPTRYFVEEVITGFDETDLHRSWVRAQATRSPQERNTRLENMCWRIWNLARQKKQLENEEAQRKTKRRMELERGRREATADMSEDLSEGEKDISAHGDSTRPRLPRINSLDAMETWISQQKEKKLYLVLISLHGLIRGENMELGRDSDTGGQVKYVVELARALGSMPGVYRVDLLTRQVSSPDVDWSYGEPTEMLNPRDSNGFDDDDDEMGESSGAYIVRIPFGPRDKYIAKEELWPYIPEFVDGALNHIVQMSKVLGEQIGSGETVWPVAIHGHYADAGDSAALLSGGLNVPMLLTGHSLGRDKLEQLLKQGRMSKDDINNTYKIMRRIEAEELSLDASEIVITSTRQEIEEQWHLYDGFDPVLERKLRARMKRGVSCYGRFMPRMVVIPPGMEFNHIVPHEGDMDGETEETEEHPTSPDPPIWAEIMRFFSKPRKPMILALARPDPKKNITTLVKAFGECRPLRELANLTLIMGNRDGIDEMSSTSSSVLLSVLKLIDQYDLYGQVAYPKHHKQADVPEIYRLAAKTKGVFINPAFIEPFGLTLIEAAAHGLPMVATKNGGPVDIQRVLDNGLLVDPHEQQSIATALLKLVADKQLWTKCQQNGLKNIHLYSWPEHSKTYLSRIASSRQRQPQWQRSSDEGLDNQEPESPSDSLRDIKDISLNLEVLVRPEKRVKTLKILGLMTKANSRMLLCSWSNGVHKMLRKARFSDKVDQASSKYPAFRRRKLIYVIAVDGDYEDGLFDIVRRIFDAAGKEKIEGSIGFILSTSYSMPEIQNYLLSKGFNLHDFDAYICNSGSELYYSSLNSEESNIIADSDYHSHIEYRWGGEGLRRTLLRWAASITEKNGENEEQVITEDEEVSTGYCFAFKIKNQNKVPPTKELRKSMRIQALRCHVIYCQNGSKMNVIPVLASRSQALRYLYVRWGVELSKMVVFVGECGDTDYEGLLGGVHKTVILKGVSNTALRSLHANRSYPLSHVVSLDSPNIGEVSKGCSSSEIQSIVTKLSKA

SEQ ID NO: 8612 - protein, 345 aa, Drosophila melanogaster
MAENKQVDTEINGEDFTKDVTADGPGSENGDAGAAGSTNGSSDNQSAASGQRDDDRKLFVGGLSWETTEKELRDHFGKYGEIESINVKTDPQTGRSRGFAFIVFTNTEAIDKVSAADEHIINSKKVDPKKAKARHGKIFVGGLTTEISDEEIKTYFGQFGNIVEVEMPLDKQKSQRKGFCFITFDSEQVVTDLLKTPKQKIAGKEVDVKRATPKPENQMMGGMRGGPRGGMRGGRGGYGGRGGYNNQWDGQGSYGGYGGGYGGYGAGGYGDYYAGGYYNGYDYGYDGYGYGGGFEGNGYGGGGGGGNMGGGRGGPRGGGGPKGGGGFNGGKQRGGGGRQQRHQPY

SEQ ID NO: 8613 - protein, 816 aa, Zea mays; identical to SEQ ID NO: 6910

SEQ ID NO: 8614 - protein, 805 aa, Solanum tuberosum
MAERVLTRVHSLRERLDATLAAHRNEILLFLSRIESHGKGILKPHQLLAEFESIHKEDKDKLNDHAFEEVLKSTQEAIVLPPWVALAIRLRPGVWEYVRVNVNALIVEELTVPEFLQFKEELVNGTSNDNFVLELDFEPFTASFPKPTLTKSIGNGVEFLNRHLSAKMFHDKESMTPLLEFLRVHHYKGKTMMLNDRIQNLYTLQKVLRKAEEYLTTLSPETSYSAFEHKFQEIGLERGWGDTAERVLEMICMLLDLLEAPDSCTLEKFLGRIPMVFNVVILSPHGYFAQENVLGYPDTGGQVVYILDQVPALEREMLKRIKEQGLDIKPRILIVTRLLPDAVGTTCGQRLEKVFGTEHSHILRVPFRTEKGIVRKWISRFEVWPYMETFIEDVGKEITAELQAKPDLIIGNYSEGNLAASLLAHKLGVTQCTIAHALEKTKYPDSDIYLNKFDEKYHFSAQFTADLIAMNHTDFIITSTFQEIAGSKDTVGQYESHMAFTMPGLYRVVHGIDVFDPKFNIVSPGADVNLYFPYSEKEKRLTTFHPEIEDLLFSDVENEEHLCVLKDRNKPIIFTMARLDRVKNLTGLVEWYAKNPRLRELVNLVVVGGDRRKESKDLEEQAEMKKMYELIKTHNLNGQFRWISSQMNRVRNGELYRYIADTRGAFVQPAFYEAFGLTVVEAMSCGLPTFATNQGGPAEIIVHGKSGFQIDPYHGEQAADLLADFFEKCKVDPSHWEAISEGGLKRIQEKYTWQIYSDRLLTLAAVYGFWKHVSKLDRLEIRRYLEMFYALKFRKLAQLVPLAVE

SEQ ID NO: 8615 - protein, 803 aa, Alnus glutinosa
MAERVLTRVHSLRERLDETLVANRNEIVALLSRIIGKGKGICRNHQLIAEVEAIPEATRKKLLDGAFGEVLRSAQEAIVLPPWVALAVRPRPGVWEYIRVNVHALVVEELRVPEYLHFKEELVDGSTNGNFVLELDFDPFNASFPRPTLSKSIGNGVEFLNRHLSAKLFHDKESMHPLLEFLRVHCYKGKNMMLNDRIQNVNALQYVLRKAEEYLTTIAPETPYVKFEHKFQEIGLVRGWGDTAEGVLEMIQLLLVLLEAPVPCTLEKFLGKSLWLNVVIMSPHGYFAQDNVGYPDTGGQVVYILDQVRALESEMLLRIKQQGLDITPRILIVTRLLPDAVGTTCGQRLERVYGSEHADILRVPFRTEKGIVRQWISRFEVWPYLETYTEDVGVELIKELQGKPDLIIGNYSDGNIVASLLAHKFGVTQCTHAHALEKTKYPESDIYWKKMDEKYHFSSQFTADLIAMNHTDFIITSTFQEIAGSKDTVGQYESHTAFTLPGLYRVVHELCIDPKFNIVSPGADMSIYFPYTEKEKRLTSFHPEIEELLYSPVENEEHLCVLKDRNKPIIFTMARLDRVKNITGLVEWYGKNTRLRELVNLVVVAGNLEKESKDNEEKAEMTKMHGLIETYKLNGQFRWISSQMNRVRNGELYRYIADTKGGLCAGPAIYEAFGLTVVESMTCGLPTFATCKGGPAEIIVHGKSGFHIDPYHGEQAAQLLVDFFEKTKADPSHWAKISLGGLQRIHEKYTWKIYSERLLTLTGVTAFWKHVSNLDRLESRRYIEMFYALKYRKLAESVPLAVE

SEQ ID NO: 8616 - protein, 808 aa, Daucus carota
MGEPVLTRVHSLRERMDSTLANHRNEILMFLSRIESHGKGILKPHQLLAEYEAISKEDKLKLDDGHGAFAEVIKSTQEAIVSPPWVALAIRLRPGVWEYVRVNVHHLVVEELSVPQYLQFKEELVIGSSDANFVLELDFAPFTASFPRPTLTKSIGNGVEFLNRHLSAKMFHGKDSMHPLLEFLRLHNYNGKTLMLNNRVQNVNGLQSMLRKAGDYLSTLPSDTPYSEFEHKFQEIGFERGWGDTAERVTEMFHMLLDLLEAPDASTLETFLGKIPMVFNVVILSPHGYFAQENVLGYPDTGGQVVYILDQVPALEREMIKRIKEQGLDIKPRILIVTRLLPDAVGTTCNQRLEKVFGAEHAHILRVPFRTEKGILRKWISRFEVWPYIETFTEDVAKEIALELQAKPDLIIGNYSEGNLVASLLAHKLGVTQCTIAHALEKTKYPDSDIYWEKFDKKYHFSSQFTADLIAMNHTDFIITSTFQEIAGSKDTVGQYESHTAFTMPGLYRVVHGIDVFDPKFNIVSPGADTSVYFSYKEKEKRLTTLHPEIEELLYSSVENEEHLCIIKDKNKPILFTMARLDNVKNLTGFVEWYAKSPKLRELVNLVVVGGDRRKESKDLEEQAQMKKMYELIDTYKLNGQFRWISSQMNRVRNGELYRYIADTKGAFVQPAFYEAFGLTVVEAMTCGLPTFATLHGGPAEIIVHGKSGFHIDPYHGEQVAELLVNFFEKCKTDPSQWDAISAGGLKRIQEKYTWQIYSERLLTLAGVYGFWKHVSKLDRLEIRRYLEMFYALKYRKLAESVPLAKDE

SEQ ID NO: 8617 - protein, 805 aa, Lycopersicon esculentum
MAERVLTRVHRLRERVDATLCAHRNEILLFLSRIESHGKGILKPHELLAEFDAIRQDDKDKLNEHAFEELLKSTQEAIVLPPWVALAIRLRPGVWEYVRVNVNALVVEELSVPEYLQFKEELVDGASNGNFVLELDFEPFTASFPKPTLTKSIGNGVEFLNRHLSAKMFHDKESMAPLLEFLRAHHYKGKTMMLNDRIHNSNTLQNVLRKAEEYLIMLPPETPFFEFEHKFQEIGLEKGWGDTAERVLEMVCMLLDLLEAPDSCTLEKFLGRIPMVFNVVILSPHGYFAQENVLGYPDTGGQVVYILDQVPALEREMLKRIKEQGLDIIPRILIVTRLLPDAVGTTCGQRLEKVYGTEHSHILRVPFGTEKGIVRKWISRFEVWPYMETFIEDVAKEISAELQAKPDLIIGNYSEGNLAASLLAHKLGVTQCTIAHALEKTKYPDSDIYWKKFDEKYHFSSQFTADLIAMNHTDFIITSTFQEIAGSKDTVGQYESHMAFTMPGLYRVVHGINVFDPKFNIVSPGADINLYFPYSESEKRLTAFHPEIDELLYSDVENDEHLCVLKDRTKPILFTMARLDRVKNLTGLVEWYAKNPRLRGLVNLVVVGGDRRKESKDLEEQAEMKKMYELIETHNLNGQFRWISSQMNRVRNGELYRYIADTKGAFVQPAFYEAFGLTVVEAMTCGLPTFATNHGGPAEIIVHGKSGFHIDPYHGEQAADLLADFFEKCKKEPSHWETISTGGLKRIQEKYTWQIYSERLLTLAAVYGFWKHVSKLDRLEIRRYLEMFYALKYRKMAEAVPLAAE

SEQ ID NO: 8618 - protein, 329 aa, Kluyveromyces lactis
MTYLAETVTLNNGEKMPLVGLGCWKMPNDVCADQIYEAIKIGYRLFDGAQDYANEKEVGQGVNRAIKEGLVKREDLVVVSKLWNSFHHPDNVPRALERTLSDLQLDYVDIFYIHFPLAFKPVPFDEKYPPGFYTGKEDEAKGHIEEEQVPLLDTWRALEKLVDQGKIKSLGISNFSGALIQDLLRGARIKPVALQIEHHPYLTQERLIKYVKNAGIQVVAYSSFGPVSFLELENKKALNTPTLFEHDTIKSIASKHKVTPQQVLLRWATQNGIAIIPKSSKKERLLDNLRINDALTLTDDELKQISGLNQNIRFNDPWEWLDNEFPTFI

SEQ ID NO: 8619 - protein, 184 aa, Trypanosoma brucei brucei
EERNLLSVAYKNVIGARRACWRSISALEQKEDLKKEKNVTLIKAFKRQIEKELSDICIDILELIEKHLLPNAETDETKVYYLKMKGDYHRYYAEIETNTEEQKDKALEAYTQAMQYNASLKPTSPIRLGLALNFSVFYYEILKSPDRGCQLAREAFEEALSDPDVLDEEQHKEAALIMQLLRDN

SEQ ID NO: 8620 - protein, 856 aa, Brassica rapa
MKCVRNIYYQSYTFSFVLAFVVLILFHPAISMHFNTLLSTESLTISGNRTLVSPGHVFELGFFKNTLNSRWYLGIWYKNLSDRTYVWVANRDSSLSNAIGTLKFSGSNLVLRGRSNKFVWSTNLTRGNERSPVVAELLANGNFVIRYSYNNDASGFLWQSFDFPTDTLLPEMKLGYYLKTGLNRFLTSWRNFDDPSSGEFSYKLETRRLPEFYLLKNGSPGQRSGPWNGVQFSGIPEDQTLSYMVYNFTENSEEVAYTFRMTDNSIYSRIQLSPEGLLERLTWTPTSGTWNLFWSAPVDIQCDVYMTCGPYAYCDVNTSPVCNCIQGFMPFDMQQWALRDGTGGCIRRTRLSCSSDGFTRMKNMKLPDTKMAIVDRSIDVKECEKRCLSDCNCTAFANADIRNGGTGCVTWTGELEDIRNYIGNGQDLYVRLAAADLVKKRKANGKIISLIVGVSVLLLLIMFCLWKRKKNRAKASATSIDNQQRNQNVLMNGMTQSNKRQLSRENKTEEFELPLIELEAVVKATENFSNCNELGQGGFGIVYKGMLDGQEVAVKRLSKTSLQGIDEFMNEVRLIARLQHINLVRILGCCIEADEKILIYEYLENSSLDYFLFGKKRSSNLNWKDRFAITNGVARGLLYLHQDSRFRIIHRDLKPGNILLDKYMIPKISDFGMARIFARDEIQARTDNAVGTYGYMSPEYAMDGVISEKTDVFSFGVIVLEIVSGKRNRGFYQVNPENNLPSYVWTHWAEGRALEIVDPVILDSLSSLPSTFKPKEVLKCIQIGLLCIQERAEHRPTMSSVVWMLGSEATEIPQPKPPVYCLIASYYANNPSSSRQFDDDESWTVNKYTCSVIDAR

SEQ ID NO: 8621 - protein, 501 aa, Asparagus officinalis
MTVSITAAVQLFLLLLLLLPLLFVHHKTKPKTKCRSPPGPPPLPVIGNLHQLSLLLHQSLYRLSKIHGPIFKLSLGRVPVLVISSPSLAKQVLKTHDLACCSRASTVSFKEYTYDGCDVAGAPYGDSWRNLRKIFVLKLLSSKKLTSFRLVQEEEIEGMISSIRTRSDTNATVNITEFVVRLANNITFRVAFGYRSEGEYGEKSRFQRLLESGNDTVASFYVGDYFPGLGWLDKMTGKLGKMKRNARDLDEFYQEVIDAHMKDGRKEDGKEDIVDVLLRLREEGQLTMDHIKGALMNIFVGGTDTSAASIAWAMAELARKPKVMKKAQEEVRKAASKKGKVEENDLAQLQYIKCVVNETLRLHLPLPLLVPRETIQHCEINGYDVSAKTRVLVNAWAIGRDEDAWENPEEFNPDRFVGSSLDYKGQDFQFIPFGAGRRICPGIQFGVETVELALANLLYAFNWELPPGVERENIDMHEAPGLVTRRATDLRLVATNYEEAN

SEQ ID NO: 8622 - protein, 501 aa, Asparagus officinalis
MTVSITAAVQLFLLLLLLLQLLFVHHKTKPKTKCRSPPGPPPLPVIGNLHQLSLLLHQSLYRLSKIHGPIFKLSLGRVPVLVISSPSLAKQVLKTHDLAFCSRASTVSFKEYTYDGCDVAGAPYGDSWRNLRKIFVLNLLSSKKLTSFRLVQEEEIEGMISSIRTRSDTNATVNITEFVVRLANNITFRVAFGYRSEGEYGEKSRFQRLLESGNDTVASFYVGDYFPGLGWLDKITGKLGKMKRNARDLDEFYQEVIDAHMKDGRKEDGKEDIVDVLLRLREEGQLTMDHIKGALMNIFVGGTDTSAASIAWAMAELARKPKVMKKAQEEVRKAASKKGKVEENDLAQLQYIKCVVNETLRLHLPLPLLVPRETIQHCEINGYDVSAKTRVLVNAWAIGRDEDAWENPEEFNPDRFVGSSLDYKGQDFQFIPFGAGRRICPGIQFGVETVELALANLLYAFNWELPPGVERENIDMHEAPGLVTRRATDLRLVATNYEEAN

SEQ ID NO: 8623 - protein, 191 aa, Rattus norvegicus
MEHQLLCCEVETIRRAYPDTNLLNDRVLRAMLKTEETCAPSVSYFKCVQREIVPSMRKIVATWMLEVCEEQKCEEEVFPLAMNYLDRFLSLEPLKKSRLQLLGATCMFVASKMKETIPLTAEKLCIYTDNSIRPEELLQMELLLVNKLKWNLAAMTPHDFIEHFLSKMPEADENKQIIRKHAQTFVALCAT

SEQ ID NO: 8624 - protein, 375 aa, Apteryx australis
MSTAGKVIKCKAAVLWEPKKPFSIEEVEVAPPKAHEVRIKILATGICRSDDHVITGALVRPFPIILGHEAAGVVESVGEGVTSVKPGDKVIPLFVPQCGECSACLSTKGNLCSKNDIGSASGLMPDGTTRFTCKGKAIHHFIGTSTFTEYTVVHETAVAKIAAAAPLEKVCLIGCGFSTGYGAAVQTAKVEPGSTCAVFGLGGVGLSVVMGCKAAGASRIIAIDINKDKFAKAKELGATDCVNPKDFTKPIHEVLMEMTGLGVDYSFEVIGHTETMAAALASCHFNYGVSVILGVPPAAEKISFDPMLLFSGRTWKGSVFGGWKSKDAVPKLVADYMEKKFVLEPLITHTLPFIKINEGFDLLRKGKSIRSVLVF

SEQ ID NO: 8625 - protein, 375 aa, Naja naja
STAGKVIKCKAAIAWELNKPLSIEQIEVAPPKAHEVRIKILATGVCRSDEHVISGAFRMPLPMVLGHEAAGVVESVGEGVTCVKPGDKVIPLFAPQCGKCRACQSPKGNLCTSNDLNSGSGLMPDGTSRFTCKGKSIHHFISTSTFTEYTVVHENSVVKIDPSAPLEKVCLIGCGFSTGYGAAMQTAKVEPGSICAVFGLGGVGLSVVMGCKAAGASRIIGVDINKDKFAKAKEMGATECINPLDFKKPINEVLFDLTGGEGVDYSFEVIGRTETMISAFTSCHQNLGTSVVVGVPPNASMITYNPLMLFTGRTWKGCVFGGWKSKDSVPKLVSDFMQKKFVLDPLITHTLPFEKINEGFDLLRSGKSIRTVLIF

SEQ ID NO: 8626 - protein, 293 aa, Zea luxurians
IIESVGEGVTDVAPGDHVLPVFTGECKECAHCKSAESNMCDLLRINTDRGVMIGDGKSRFSINGKPIYHFVGTSTFSEYTVMHVGCVAKINPQAPLDKVCVLSCGISTGLGASINVAKPPKGSTVAVFGLGAVGLAAAEGARIAGASRIIGVDLNPSRFEEARKFGCTEFVNPKDHNKPVQEVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFAEINKAFDLMA

SEQ ID NO: 8627 - protein, 379 aa, Struthio camelus
TTEGKVIKCKAAIAWEAGKPLSVEEIEVSPPKDHEVRVKIVATGVCRTDEHAINPSFKEGVFPVILGHEGAGIVESIGQGVSKFKPGDKVIPLYMPQCGHCKFCLNPKTNLCEKISKIKTPISDQEVMSDGTSRFTCKGKPIYHFMGTSTFSEYTVVSESSLAKIDAAAPLDKVCLIGCGFSTGYGAAINTAQVEPGSTCAVFGLGGVGLSAVMGCKAAGASKIFGIDINKDKFPLAKKLGATDCLNPQDIRKPVQEIIAEMTNGGVDFAIECIGNPDVMKAAFESTTVGWGTCVIVGVAVGEQSIPFSPMQLIMGRKIKATFFGGWKSVKSVPKLVSDYMAKKFDLDALVSHTLPLDKINDAFDLMNAGKSNRTILVF

SEQ ID NO: 8628 - protein, 375 aa, Uromastyx hardwickii
GTAGKVIKCKAAIAWEIKKPLSIEQIEVAPPKAHEVRIKILATGICRSDDHVISGAFKMPLPMVLGHEAAGVVESVGEGVTCVKPGDKVIPLFVPQCGKCSSCRSTRGNLCTSNDLSAATGLMPDGTSRFTCKGKSLHHFISTSSFTEYTVVHENSVVKIDAAAPLEKVCLIGCGFSTGYGAAVETAKVEPGSTCAVFGLGGVGLSAVMGCKAAGASRIIGVDINKDKFPKAKEMGATECVNPLDYKKPINEVLFDLTGGEGVDYSFEVIGRTDTMTAALASCHMDYGTSIIVGLPPSASEITFSPGLIFTGRTWKGSVFGGWKSKDSVPRLVSDFMQKKFSLDPLITHTMPFDKINEGFELLRAGKSIRSVLLF

SEQ ID NO: 8629 - protein, 375 aa, Uromastyx hardwickii
STAGKVIKCKAAVVWEPKKPFSIVEIEVAPPKAHEVRIKILASGICRSDDHVLSGALKVNFPIILGHEAAGVVESVGEGVTSMKPGDKVIPIFLPQCGECNSCRHPRGNVCKKSELGPFTGLLYDGTSRFTYQGKPVYHFVRTGTFTEYTVAPEDSVVKIDASAPLEKVCLIGCGFSTGYGAAINSAKVQPGSTCAVFGLGGVGLSAVMGCKAAGASRIIGIDINKEKFPKAKELGATECVNPLDYKKPINEVLFDMTDGEGVEYSFEVIGRTDTMTAALASCHNNYGTSVIVGVPPSASQIAFDPLLLFTGRTWKGSVFGGWKSKDAVPRLVSDFMGKKFILDPLITHTMPFEKINEGFELLRSGKSIRTVLTF

SEQ ID NO: 8630 - protein, 373 aa, Uromastyx hardwickii
ASGVIKCKAAVAWEAGKPLSIEEIEVAPPKAHEVRVKIIATAVCHTDAYTLSGADPEGSFPVILGHEGAGIVESVGEGVTKFKPGDTVIPLYIPQCGECKFCLNPKTNLCQKIRVTQGKGVMPDGTSRFTCKGKQVLHFMGTSTFSEYTVVADISLTKINASAPLDKVCLLGCGVSTGYGAALNTAKVEPGSTCAVFGLGGVGLAVIMGCKVAGASRIIGIDLNKDKFAKAKEFGATECISPADFKKPIQEVLIEMTDGGVDYSFECIGNVGVMRAALEACHKGWGVSVIVGVAAAGQEIATRPFQLVTGRTWKGTAFGGWKSVESVPKLVDEYMSKKMKVDEFVTHTLPFEQINEAFELMHAGKSIRSVLKF

SEQ ID NO: 8631 - protein, 380 aa, Malus x domestica
MSNTAGQVIRCRAAVAWEAGKPLVIEEVEVAPPQANEVRIKILFTSLCHTDVYFWEAKGQNPLFPRIYGHEAGGIVESVGEGVTDLKAGDHVLPVFTGECKDCAHCKSEESNMCDLLRINTDRGVMLSDGKSRFSIKGKPIYHFVGTSTFSEYTVVHVGCLAKINPSAPLDKVCLLSCGISTGLGATLNVAKPKKGSTVAVFGLGAVGLAAAEGARLSGASRIIGVDLHSDRFEEAKKFGVTEFVNPKAHEKPVQEVIAELTNRGVDRSIECTGSTEAMISAFECVHDGWGVAVLVGVPHKDAVFKTHPVNFLNERTLKGTFFGNYKTRTDIPSVVEKYMNKELELEKFITHKVPFSEINKAFEYMLKGEGLRCIIRMEE

SEQ ID NO: 8632 - protein, 305 aa, Kluyveromyces lactis
MSTDKKQSNFAIDFLMGGVSAAVSKTAAAPIERVKLLIQNQDEMIKQGSLDRRYTGIVECFKRTAADEGVASFWRGNTANVIRYFPTQALNFAFKDKIKAMFGFKKEEGYAKWFAGNLASGGLAGGLSLLFVYSLDYARTRLAADSKSAKKGGERQFNGLVDVYKKTLASDGVAGLYRGFLPSVVGIVVYRGLYFGLYDSLKPLLLTGSLENSFLASFLLGWAVTTGASTASYPLDTVRRRMMMTSGQAVKYDGAFDAFRKIVAAEGIKSLFKGCGANILRGVAGAGVISMYDQLQVILFGKTFK

SEQ ID NO: 8633 - protein, 316 aa, Mus musculus
MASHLELNNGTKMPTLGLGTWKSPPGQVTEAVKVAIDLGYRHIDCAQVYQNEKEVGVALQEKLKEQVVKRQDLFIVSKLWCTFHDKSMVKGAFQKTLSDLQLDYLDLYLIHWPTGFKPGPDYFPLDASGNVIPSDTDFVDTWTAMEQLVDEGLVKTIGVSNFNPLQIERILNKPGLKYKPAVNQIECHPYLTQEKLIEYCHSKGIVVTAYSPLGSPDRPWAKPEDPSLLEDPRIKAIAAKYNKTTAQVLIRFPIQRNLVVIPKSVTPVRIAENLKVFDFEVSSEDMATLLSYNRNWRVCALMSCAKHKDYPFHAEV

SEQ ID NO: 8634 - protein, 189 aa, Pisum sativum
MEFKATELRLGLPGITEEEEKKIIHGSSVVKNNNKRQLPQTSEESVSISKVTNDEHIVESSSAAPPAKAKIVGWPPIRSYRKNSLHEADVGGIFVKVSMDGAPYLRKIDLRVYGGYSELLKALETMFKLTIGEYSEREGYKGSEYAPTYEDKDGDWMLVGDVPWDMFVTSCKRLRIMKGTEAKGLGCGV

SEQ ID NO: 8635 - protein, 179 aa, Pisum sativum
MAREGLGLEITELRLGLSCGEPKKNEKKRMFSEIDGGVEENGGSGDRKSVDKKNQVVGWPPVCSYRKKNMNEGSKMYMKVSMDGAPYLRKIDLCLHKGYLELALALEKLFDCCGIEEALKDAENCEHVPIYEDKDGDWMLVGDVPWEMFIESCKRLRIMKRSDAKGFDLQPKGSLKRFI

SEQ ID NO: 8636 - protein, 408 aa, Flaveria pringlei
MESRVLSSGATTISGIPRLTRPAGRTTTTTVVAVASPAKLNTNGGNLVWGRQLRPSLLNLDHSSPVSLVTKPVKRDVLKPCTATASDSAGDAAPVGFFAKYPFLVTGFFFFMWYFLNVIFNILNKKIYNYFPYPYFVSAIHLAVGVVYCLGGWAVGLPKRAPMDSNLLKLLIPVAFCHALGHVTSNVSFAAVAVSFTHTIKSLEPFFNAAASQFILGQSIPITLWLSLAPVVIGVSMASLTELSFNWLGFISAMISNISFTYRSIYSKKAMTDMDSTNLYAYISIISLLFCIPPAIILEGPQLLKHGFSDAIAKVGMTKFISDLFWVGMFYHLYNQLAINTLERVAPLTHAVGNVLKRVFVIGFSIIVFGNKISTQTAIGTSIAIAGVAVYSLIKAKIEEEKRGLKSA

SEQ ID NO: 8637 - protein, 407 aa, Flaveria trinervia
MESRVLSSGATAISGVPRLTKPAGRITTTTVAVAFPARLNATGGNVVWGRQLRPSLLNLDHSSPVSLVTKPVKRDVLKPCSATASDSAGDAAPVGFLAKYPFLVTGFFFFMWYFLNVIFNILNKKIYNYFPYPYFVSVIHLAVGVVYCLGSWTVGLPKRAPVDSNILKLLIPVGFCHALGHVTSNVSFAAVAVSFTHTIKALEPFFNAAASQFVLGQSIPISLWLSLAPVVIGVSMASLTELSFNWLGFISAMISNISFTYRSIYSKKAMTDMDSTNLYAYISIIALLFCIPPAVLFEGPQLLKHGFNDAIAKVGMIKFISDLFWVGMFYHLYNQIATNTLERVAPLTHAVGNVLKRVFVIGFSIIVFGNKISTQTAIGTSIAIAGVAIYSLIKARIEEEKRRMKSA

SEQ ID NO: 8638 - protein, 455 aa, Cricetulus griseus
MNSFNKDEFDCHILDEGFTAKDILDQKINEVSSDDKDAFYVADLGDVLKKHLRWLKALPVTPFYAVKCNDSRALVNTLAAITVDCASKTEIQLVQGLGVPPERVIYANPCKQVSQIKYAASNGVQMMTFDSEIELMKVARAHPKVTKLVLRIATDDSKAVCRLSVKFGATLRTSRLLLERAKELNIDVIGVSFHVGSGCTDPETFVQALSDARCVFDMGTEVGFSMYLLDIGGGFPGSEDTKLKFEEITSVINPALDKYFPPDSGVRVIAEPGRYYVASAFTLAVNIIAKKIVSKGSDDEDESSEQTFMYYVNDGVYGSFNCILYDHAHVKPLLPKRPKPDEKYYSSSIWGPTCDGLDRIVERCNLPEMHVGDWMLFENMGAYTVAAASTFNGFQRPSIYYVMSRPMWQLMKQIQNHGFPPEVEEQDVGTLPISCAQESGMDRHPAACASASINV

SEQ ID NO: 8639 - protein, 361 aa, Xenopus laevis
MAAAAASSNPGGGPEMVRGQAFDVGPRYTNLSYIGEGAYGMVCSAHCNINKVRVAIKKISPFEHQTYCQRTLREIKILLRFKHENIIGINDIIRAPTIEQMKDVYIVQDLMETDLYKLLKTQHLSNDHICYFLYQILRGLKYIHSANVLHRDLKPSNLLLNTTCDLKICDFGLARVADPDHDHTGFLTEYVATRWYRAPEIMLNSKGYTKSIDIWSVGCILAEMLSNRPIFPGKHYLDQLNHILGILGSPSQEDLNCIINLKARNYLLSLPHKNKVPWNRLFPNADPKALDLLDKMLTFNPHKRIEVEAALAHPYLEQYYDPSDEPVAEAPFKFEMELDDLPKETLKELIFEETARFQPGY

SEQ ID NO: 8640 - protein, 338 aa, Homo sapiens
MADQAPFDTDVNTLTRFVMEEGRKARGTGELTQLLNSLCTAVKAISSAVRKAGIAHLYGIAGSTNVTGDQVKKLDVLSNDLVMNMLKSSFATCVLVSEEDKHAIIVEPEKRGKYVVCFDPLDGSSNIDCLVSVGTIFGIYRKKSTDEPSEKDALQPGRNLVAAGYALYGSATMLVLAMDCGVNCFMLDPAIGEFILVDKDVKIKKKGKIYSLNEGYAKDFDPAVTEYIQRKKFPPDNSAPYGARYVGSMVADVHRTLVYGGIFLYPANKKSPNGKLRLLYECNPMAYVMEKAGGMATTGKEAVLDVIPTDIHQRAPVILGSPDDVLEFLKVYEKHSAQ

SEQ ID NO: 8641 - protein, 349 aa, Nostoc punctiforme
MAKTPESLESSINEITDRALDRDCTTLSRHVLQQLQSFSPDAQDLSALMNRIALAGKLVARRMSRAGLMEGVLGFTGEVNVQGESVKKMDVYANDVFISVFKQSGLVCRLASEEMENPYYIPENCPIGRYTLLYDPIDGSSNTDNNLSLGSIFAIRQQEGTDSDGKATDLLANGRKQLAAGYILYGPCTMLVYTIGKGVHSFVLDPSLGEFILTEENIRIPNHGSVYSVNEGNFWQWEESIREYIRYVHRTEGYSARYSGAMVSDIHRILVQGGVFLYPGTIQNPEGKLRLLYETAPLAFLIEQAGGRATTGLVNILDVVPKKLHQRTPLIIGSKEDVAKVESFIQNGH

SEQ ID NO: 8642 - protein, 359 aa, Rattus norvegicus
MAGVAGLVRGLCGRLSGLLKRLFHCSAPAAVQLTVREAINQGMDEELERDEKVFLLGEEVAQYDGAYKVSRGLWKKYGDKRIIDTPISEMGFAGIAVGAAMAGLRPICEFMTFNFSMQAIDQVINSAAKTYYMSAGLQPVPIVFRGPNGASAGVAAQHSQCFAAWYGHCPGLKVVSPWNSEDAKGLIKSAIRDDNPVVMLENELMYGVAFELPTEAQSKDFLIPIGKAKIERQGTHINVVCYSRPVGHCLEAAAVLSKGGIECEVINLRTIRPMDIEAIEASVMKTNHLVTVEGGWPQFGVGAEICARIMEGPAFNFLDAPAVRVTGADVPMPYAKILEDNSIPQVKDIIFAIKKTLNI

SEQ ID NO: 8643 - protein, 187 aa, Bos taurus
MPVDLSKWSGPLSLQEVDERPQHPLQVKYGGAEVDELGKVLTPTQVKNRPTSITWDGLDPGKLYTLVLTDPDAPSRKDPKYREWHHFLVVNMKGNNISSGTVLSDYVGSGPPKGTGLHRYVWLVYEQEGPLKCDEPILSNRSGDHRGKFKVASFRKKYELGAPVAGTCYQAEWDDYVPKLYEQLSGK

SEQ ID NO: 8644 - protein, 187 aa, Macaca fascicularis
MPVDLSKWSGPLSLQEVDEQPQHPLHVTYAGAALDELGKVLTPTQVKNRPTSISWDGLDSGKLYTLVLTDPDAPSRKDPKYREWHHFLVVNMKGNDISSGTVLSDYVGSGPPKGTGLHRYVWLVYEQARPLKCDEPILSNRSGDHRGKFKVASFRKKYELGAPVAGACYQAEWDDYVPKLYEQLSGK

SEQ ID NO: 8645 - protein, 323 aa, Oryctolagus cuniculus
MDPKFQRVALSDGHFIPVLGFGTYAPEEVPKSKAMEATKIAIDAGFRHIDSAYFYKNEKEVGLAIRSKIADGTVKREDIFYTSKLWCTFHRPELVRPSLEDSLKNLQLDYVDLYIIHFPTALKPGVEIIPTDEHGKAIFDTVDICATWEAMEKCKDAGLAKSIGVSNFNRRQLEMILNKPGLKYKPVCNQVECHPYLNQGKLLEFCKSKGIVLVAYSALGSHREPEWVDQSAPVLLEDPLIGALAKKHQQTPALIALRYQLQRGIVVLAKSFTEKRIKENIQVFEFQLPSEDMKVIDSLNRNFRYVTADFAIGHPNYPFSDEY

SEQ ID NO: 8646 - protein, 230 aa, Homo sapiens
MKQSSNVPAFLSKLWTLVEETHTNEFITWSQNGQSFLVLDEQRFAKEILPKYFKHNNMASFVRQLNMYGFRKVVHIDSGIVKQERDGPVEFQHPYFKQGQDDLLENIKRKVSSSKPEENKIRQEDLTKIISSAQKVQIKQETIESRLSELKSENESLWKEVSELRAKHAQQQQVIRKIVQFIVTLVQNNQLVSLKRKRPLLLNTNGAQKKNLFQHIVKEPTDNHHHKVIF

SEQ ID NO: 8647 - protein, 316 aa, Homo sapiens
MASRLLLNNGAKMPILGLGTWKSPPGQVTEAVKVAIDVGYRHIDCAHVYQNENEVGVAIQEKLREQVVKREELFIVSKLWCTYHEKGLVKGACQKTLSDLKLDYLDLYLIHWPTGFKPGKEFFPLDESGNVVPSDTNILDTRAAMEELVDEGLVKAIGISNFNHLQVEMILNKPGLKYKPAVNQIECHPYLTQEKLIQYCQSKGIVVTAYSPLGSPDRPWAKPEDPSLLEDPRIKAIAAKHNKTTAQVLIRFPMQRNLVVIPKSVTPERIAENFKVFDFELSSQDMTTLLSYNRNWRVCALLSCTSHKDYPFHEEF

SEQ ID NO: 8648 - protein, 983 aa, Caenorhabditis elegans
MRATFHLFTFIFLLLFSSVICISTPGFRNDHESIGDDEEKTSSTILVSTIDGRLRALDSETGEIKWTLQEEPVLRSPSAVKQGFTFLPNPLDGSLYVLKNSSLKKLPFNIPQLVHASPCKGNDGILYAGSKKDVWFGIDPKTGLKVEYILLNISDKILFLQVETLSSASADRICPANQKQTIFLGRTEYRVSMFDEKNRGKTWNATFNDYSAHLLPEVNTWPFKHYASSSHGYILTFDRETGEMRWEQDLKQPVVALYLLRDDGLHKLPFEVMGKETMENVAKNIFTVDQWPTVLGVNAADPQTTSLTNQFFPALFVGESSFGLYAIEALVDHQTITYSPKLLGPPLLEGPAPIALTEMEKEEYLPPRRPIIRNIPPSITHKTSDGEYLLLGYHDRPMMTMATIIPTRYPVPGPHKAIGSTIERPPPQLLGPVEPQKHEDTSFILLLLNNHPIPFYATLVTMFALLLTVIWQCGRQWDQQKSTSRMDSFEIVNNPGESRSAQTSKQSNRGSFGWANRKIEIPEGWMAVGSKLMYSPSDILGTGCEGTVVYRGTFDGREVAVKRVVSEFVKFAHREADLLRESDTHPHVIRYFCMESDSQFRYLALELCIASLNDYVEQKEVQQNVTIALRDIMKQATDGLAHLHASKIVHRDMKPQNVLITMASQRGEMRAVISDFGLCKRVQPGKNSISRGIASGLAGTDGWIAPEVLISASTSYPVDIFSLGCIFYYVLTSGTHPFGKSLHRQANIVNGEYTLNKLADLDDWSLADDLISSMLNVEPLHRLTADAVLNHPFFWTSEKRLAYFSDVSDRVEKEEDNSPVVRRIETDARIVVCGGWREKICDALKEDLRKFRTYKSFSVRDLLRAMRNKKHHYRELPEDVRQSLGDIPDQFLHYFTSRFPRLLLHVYKATEYCSGEAVFKRYYSDDVRARMYPIVEEEERVRKKIKEEMANEVWARAPKPVEQRTPLKLDKRNIKKKSNPNTD

SEQ ID NO: 8649 - protein, 194 aa, Mus musculus
QRLWKDSGIQACFDRASEYQLNDSAGYYLSDLERLVTPGYVPTEQDVLRSRVKTTGIIETQFSFKDLNFRMFDVGGQRSERKKWIHCFEGVTCIIFIAALSAYDMVLVEDDEVNRMHESLHLFNSICNHRYFATTSIVLFLNKKDVFSEKIKKAHLSICFPDYDGPNTYEDAGNYIKVQFLELNMRRDVKEIYS

SEQ ID NO: 8650 - protein, 518 aa, Medicago truncatula
MAGGGIPIGGGNKEYPGNLTPFVTITCIVAAMGGLIFGYDIGISGGVTSMDPFLKKFFPAVYRKKNKDKSTNQYCQYDSQTLTMFTSSLYLAALLSSLVASTITRRFGRKLSMLFGGLLFLVGALINGFANHVWMLIVGRILLGFGIGFANQPVPLYLSEMAPYKYRGALNIGFQLSITIGILVANVLNYFFAKIKGGWGWRLSLGGAMVPALIITIGSLVLPDTPNSMIERGDRDGAKAQLKRIRGIEDVDEEFNDLVAASEASMQVENPWRNLLQRKYRPQLTMAVLIPFFQQFTGINVIMFYAPVLFNSIGFKDDASLMSAVITGVVNVVATCVSIYGVDKWGRRALFLEGGAQMLICQVAVAAAIGAKFGTSGNPGNLPEWYAIVVVLFICIYVAGFAWSWGPLGWLVPSEIFPLEIRSAAQSVNVSVNMLFTFLVAQVFLIMLCHMKFGLFLFFAFFVLVMSIYVFFLLPETKGIPIEEMDRVWKSHPFWSRFVEHGDHGNGVEMGKGAPKNV

SEQ ID NO: 8651 - protein, 179 aa, Naegleria fowleri
NIIAAGYAMYGSCTMIVNATKRGVNGYTLDPVSGDFVLTHPEMKVPKKGSIYSVNEGNHRTWNESTKEYALLKKGSDEKKPYSLRYVGSMVADVHRTIIKGGIFMYPADKASPSGKLRLLYECNPMSYIIEKAGGKSIAGLKGSMLDIVPTKIHQREPIYLGSTADVEEVEQIMKRHGL

SEQ ID NO: 8652 - protein, 216 aa, Naegleria fowleri
MVLKLYGIYLSTCVQRVVTTLKEKNLDFELVPVDLSKGEHKQAAFLEKQPFGVIPVLEDDGFLIYESRAICRYLEAKFKSQGTQLIPTDLKALGLFEQGASIETSYFDPNVSGLAFELVFKGMFGGGAPDEARVKLLTQKLTQALDVYEKILAKQEYIGGNQFTLADLYHLPYGNYLFHEKVNLGHLINERPHVKAWWEKITKRDSWIQALKLASH

SEQ ID NO: 8653 - protein, 184 aa, Lilium hybrid division I
MDRKVGTNEDVEVRKGPWTMEEDLILINYIANHGDGVWNTLARSAGLKRTGKSCRLRWLNYLRPDVRRGNITPEEQLLIMELHDRWGNRWSKIAKELPGRTDNEIKNFWRTRVQKKSKNGESSEGQISMLSDETSAMQMEDVDVGVSQTSYDQGQTSNNLDAFEIPFEPGDNLLSVEELWAMQY

SEQ ID NO: 8654 - protein, 530 aa, Lotus japonicus
MVEIEGSPGTSMHGVTGREQTFISSVSSPMVPTDTTAKFDLPVDSQHKAKVFKLFSLANPHMTTFHLSWISFFTCFVSTFAAAPLVPIIRDNLNLTKSDIGNAGVASVSGSIFSRLTMGVICDLLGPRYGCAFLIMLSAPTVFCMSFVNDAAGYIVVRFMIGFSLATFVSCQYWMSTMFNSKIIGLVNGTAAGWGNMGGGATQLIMPIVYELIRRAGSTGFTAWRIAFFIPGFMHVFMGILVLTLGQDLPDGNLSALQKKGDVAKDKFSKVLWYAITNYRTWIFALLYGYSMGVELTTDNVIAEYFYDRFNLKLHTVGIIAASFGMANLVARPFGGYVSDVAARLFGMRGRLWTLWILQTLGGVFCIWLGRANSLPIAVLAMILFSVGAQAACGATFGIIPFISKRSLGIISGLTGAGGNFGSGLTQLVFFSTSRFSTGAGLSWMGVMIVGCTLPVTLVHFPQWGSMFLPPSKDINKSSEEHYYTAEWDEEERKKGLHSQSLKFAENSRSERGKRVSSAPTPPNTTPTHV

SEQ ID NO: 8655 - protein, 353 aa, Oculimacula yallundae
MGCGMSSEEKEGKQRNEEIENQLKRDKMLQRNEIKMLLLGAGESGKSTILKQMKLIHEGGYSRDERESFKEIIFSNTVQSMRVILEAMEQLELPLDDQRTEYHVQTIFMQPAQIEGDNLPPEVGNAISALWRDIGVQECFKRSREYQLNDSAEYYFNNIDRISLPDYMPDDQDVLRSRVKTTGITETAFIIGDLTYRMFDVGGQRSERKKWIHCFENVTTILFLVAISEYDQLLFEDETVNRMQEALTLFDSICNSRWFIKTSIILFLNKIDRFKEKLPISPMKNYFPDYEGGDDYSLACDYILNRFVSLNQHETKQIYTHFTCATDTTQIRFVMAAVNDIIIQENLRLCGLI

SEQ ID NO: 8656 - protein, 353 aa, Oculimacula yallundae
MCFGGRDDGEAKRSREIDALIHRDEKVMQKVVKLLLLGAGESGKSTILKQMRLIYTKDGFTKNEKEEWRVIIFNNILDGLRMTLDAMEEFGIPFEFKNTDVHLPVILADKDLRPYEPIPVEYLRAFKDMWKDQGIQKAIKRGNEFALHDNLSYFFQDLDRLFNKEFVPTDQDVLRARLRTTGITETVFDLGSLQYRMFDVGGQRSERKKWIHCFENVNALMFLVAISGYDQCLAEDKDGNQMQEALMLWESIANSHWFKNSALILFLNKMDLFKEKIAISPITKFGFSDFQGDPRDPQQASKYFMDKFVALNRSPVREVYSHFTNATDTDLLKVTMASVQDMIIQKNLQKLIL

SEQ ID NO: 8657 - protein, 418 aa, Solanum tuberosum subsp. andigena
MVRNRREELYVTVPSLFRCPISMDVMKSPVSLCTGVTYDRSSIQTWLSQGHNTCPATMQILPSTDFIPNLTLRRLINVWIQHQPSSSPGYTTPSSSSVTKSEVVEIVKNLNGEVDRLSSLAKIVEFVKCSGENRRFFVNSSDAIVSVVGVLVDCDVGEVCEAVVAVLDLVVSENGVKEQLNKEILKSDRKFLPKFLLILRKGKLSSRIQTARILEFIALDADSQRKMIEEQGLLYELHVFTSTETNRFAIEAGLSTLIAVSTTRPAKKELVRFGIVQTIGKILSGSETARAVVEKSLKLLETVATCTEGRAAIVKGEECMSAIVTRLMKSSKAATEHGVTVLWSVCCLFRDTAARDVVGKANGLTKVLLVMQSDCSAAVRQMCGELVKALRVVNNKHKNYSKSCLASYDTKTTHIMPY

SEQ ID NO: 8658 - protein, 256 aa, Pseudomonas putida
MTLKGKTALVTGSTSGIGLGIAQVLARAGANIVLNGFGDPAPALAEIARHGVKAVHHPADLSDVAQIEALFALAEREFGGVDILVNNAGIQHVAPVEQFPLESWDKIIALNLSAVFHGTRLALPGMRARNWGRIINIASVHGLVGSTGKAAYVAAKHGVVGLTKVVGLETATSNVTCNAICSGWVLTPLVQKQIDDRAANGGDSLQAQHDLLAEKQPSLAFVTPEHLGELVLFLCSEAGSQVRGAAWNVDGGWLAQ

SEQ ID NO: 8659 - protein, 407 aa, Rattus norvegicus [sequence omitted]

SEQ ID NO: 8660 - protein, 1253 aa, Rattus norvegicus
MKKTLQDEIEAILRKRIMVLDGGMGTMIQRYKLSEENFQGQEFKDHSRPLKGNNDILSITQPDVIYQIHKEYLLAGADIIETNTFSSTSIAQADYGLEHLAYRMNKCSADVARKAAEEITLQTGVKRFVAGSLGPTNKTLSVSPSVERPDYRNITFDELVEAYQEQAKGLLDGGVDILLIETIFDTANAKAALFALQKLFEENYASPRPIFISGTIVDKSGRTLSGQTGEAFVTSVSHSDPLCIGLNCALGAAEMRPFIETIGKCTTAYVLCYPNAGLPNTFGDYDETPAMMAMHLKDFAVDGLVNVVGGCCGSTPDHIREIAEAVKNCKPRVPPDSVFEGHMLLSGLEPFRIGPYTNFVNIGERCNVAGSKKFAKLIMAGNYEEALSVAKVQVEMGAQVLDINMDDGMLDGPSAMTKFCNFIASEPDIAKVPLCIDSSNFAVIEAGLKCCQGKCIVNSISLKEGEEDFLEKARKIKKFGAAVVVMAFDEEGQATETDVKVSVCTRAYHLLVEKVGFNPNDIIFDPNILTIGTGMEEHNLYAINFIHATRVIKETLPGVRISGGLSNLSFAFRGMDAIREAMHGVFLYHAIKFGMDMGIVNAGSLPVYDDIHKDLLQLCEDLIWNRDAEATEKLLRYAQTHGKGGKKVIQTDEWRNGSIEERLEYALVKGIEKHIVEDTEEARLNREKYPRPLNIIEGPLMNGMKVVGDLFGAGKMFLPQVIKSARVMKKAVGHLIPFMEKEREEARVLNGSVEEEDPYQGTIVLATVKGDVHDIGKNIVGVVLGCNNFRVIDLGVMTPCDKILQAALDHKADIIGLSGLITPSLDEMIFVAKEMERLAIKIPLLIGGATTSRTHTAVKIAPRYSAPVIHVLDASKSVVVCSQLLDENLKDDYFEEILEEYEDIRQDHYESLKERKYLPLSQARKHSFHIDWLSEPHPVKPTFIGTQVFEDYNLQKLVDYIDWKPFFDVWQLRGKYPNRGFPKIFNDKAVGEEARKVYEDAQNMLSILISRKKLRARGVVGFWPAQSVQDDIHLYAEGAVPQAAEPIATFYGLRQQAEKDSSSTDPYHCLSDFVAPLHSGVRDYLGLFAVACFGVEELSKAYEDDGDDYSSIMVKALGDRLAEAFAEELHERVRRELWAYCGSEQLGVTDLRKLRYEGIRPAPGYPSQPDHTEKLTMWRLANIEQATGIRLTESLAMAPASAVSGLYFSNVKSKYFAVGKISKDQIEDYALRKNMSVAEVEKWLGPILGYDTD

SEQ ID NO: 8661 - protein, 261 aa, Thermoplasma volcanium
MEEFTDKVAIVTGGSSGIGLAVVDALVRYGAKVVSVSLDEKSDVNVSDHFKIDVTNEEEVKEAVEKTTKKYGRIDILVNNAGIEQYSPLHLTPTEIWRRIIDVNVNGSYLMAKYTIPVMLAIGHGSIINIASVQSYAATKNAAAYVTSKHALLGLTRSVAIDYAPKIRCNAVCPGTIMTPMVIKAAKMEVGEDENAVERKIEEWGRQHPMGRIGRPEEVAEVVAFLASDRSSFITGACLTVDGGLLSKLPISTPNADNSHH

SEQ ID NO: 8662 - protein, 304 aa, Thermoplasma volcanium
MDIKIPELIIEGVYTSDGAGVKLERIFGSPRTVQITDPFLLLDFFGSSKLSDYENGFPWHPHRGIETITLQLRGKTYHEDSEGHKGIILPGELQWMTAGSGIFHQEMPKPIYYGDKVPSIKDDANAGIQLWLNMPAANKMDEPAYRSIREEQVPVEEDDYGNKIGVISGNFKKVAGALNESFQYELAEKINPYYLRIKTIAKGKFETNIPEGHRAIIFVIGGLISVNDKELVSEGRAVILSTKGKLLSFYADQPSDVIIIAGRPLNEPISWYGPIVMNTREEIAQAIKELNDGTFIKENNPLWQ

SEQ ID NO: 8663 - protein, 160 aa, Thermoplasma volcanium
MAFKRKVLGKTDYGRRLRLLKSKDRRFIVRITNKGIIAQIAEYSVNGDRILATITDKALSKYGIELRGNNLQICYLVGYAAGVEAQKAGVETAVLDIGRKKFRKGGRIAACLKGITDSGVDIPHGEDVFPDKKRLNGSHLKNPVKLNEAVKNFKKLEEKA

SEQ ID NO: 8664 - protein, 498 aa, Thermoplasma volcanium
MINTENFGNIINGTEEMVGDESIVKSPVDGSPIASVYFADRDAVSKAIDSSYDSYYKVWSKFTLSERKKLLAKLADRIQEKSERYATLESLNTGKTLRQSMLMDIPLGIEHLRYFATETEFKMERQITHPEYPDSHGIVQYVPMGVVGAITPWNVPFLMAVWKAAPALLAGNTVVIKPSSFTPLTTIEMARDAISVGFPPGVLNVVNGRGETVGEELARNKKVRMLSFTGSTYTGKRITEITGIKKVTLELGGKSPNIVFDDADLERAALGVMFGIYLNSGQLCESGSRLLVQSSIKDKFLNLLKSKIEKMRPGNPMSMETDISAITTKNQRDKIEKMVNSGLKDGSVIFYQKSIDGSVPKGGLYFPPTILDKVSEDMEVAKEEIFGPVLSVMEFDDEADAIDKANMTDYGLAAGVWTQDSEKATRVASSIEAGTVWINEYHLLSAAAPRGGFKNSGVGRELGLDGIMEFTQTRHLFVSHGSTDQDTVAYGLVLADLS

SEQ ID NO: 8665 - protein, 314 aa, Thermoplasma volcanium
MRKINPKKKEIVSELAQDITKSKAVAIVDIKGVRTRQMQDIRAKNRDKVKIKVVKKTLLFKALDSINDEKLTKLKDATTGQIAVLTSQLDPTEIYQMVQATLTKASPRGGEVAPADITVEPMVTGFPPGPMMTEFQKVGLQTGVEKGKIAIKKEAVLVKKGEVIPKDKAKIMAMLDIKPLEVGLELLGLYSDGVLYSADVLSLTPEKIAEQMAIGYAQALQISKASMFFVAEVLKDLIAEAKVKADAFAVAAQFITEENLKEFLAIANRNAIILNNELNKGNTTEKESEKVEEPKEAEKSVDESISEGLGSLFQ

SEQ ID NO: 8666 - protein, 316 aa, Thermoplasma volcanium
MKTESLRDTYGKELVELGRKDPDIVVLDADLSSSTKTGYFAKEFPERFFNMGISEQSMVTTAAGLAISGKKPFVSTFAIFLMRTYEQIRQSICYNDVPVRFVVTHGGITVGEDGATHQIVEDVGIMSGLPNMSVIVPSDSVETKSVIDYLENIKHPHYVRLSREKFPVINDLSYEFKIGRGYVVKDGSDATVIANGIMVSKALEAANALKDKGIDLRIINMPSVKPIDKDIIIKAARETGRIITAEEHSIYNGLGSRVSEVVSENYPVIVKRIGMRDTFGKSGKAMELFSYFHMDVKDIIDYVIQSLEEKSYENIS

SEQ ID NO: 8667 - protein, 409 aa, Thermoplasma volcanium
MENDNPFVWNGDDMLVEGYSVKAIVETFGTPVIIYSAPRIVKNVSSLFGAMPKVTKCFYSVKANSNPNLVRLIGRQGCGSEVTSLGEIQIAMISSIDPDDILFTPNNVSKEEMDFALDRGIKITFNSPGQFELVSNRVEEATFRINPGIGHGEHPGTTTGGHGSKFGIDPETALKLYTRAKELGIRKFGIHMMVGSNNTDADLMLTFYKKFFDMASEIEKTAHLQFSYIDIGGGFGVPYNDEQRSLDIKKLGSGLKELVDQYGIERLFIEPGRYIVADAGILVGKVYDVYNGFVGTDIGMNINIRHALYGAEHRFYALTGRSDEAEYIVTGQICENTDVTGRLTGKVQIGDLVAMYDAGAYIYSMSSNYNGRFRPTEVIVDHDGVYRIRRRETVNDILATVTGMEKVNV

SEQ ID NO: 8668 - protein, 886 aa, Thermoplasma volcanium
MAQTKKYIYLFEEGGKELVDLLGGKGAGLAEMTKIGLNVPPGFTITTEACIDFLRDGNFPKGMMEQTMDALHMIEEKVSRKFGNPENPLLVSVRSGAPVSMPGMMDTVLNVGLNDETVKGLAFMTDNERFALDAYRRLIQMFGEIVYGLPHEEFRGLIEKVKREKGYDEDKFTTSDITEIIKGENEIYRKHKKSFPQDPQEQLVESIKAVFNSWNSRRAKTYREINHIPENMGTAVSIVTMVFGNMGSDSATGVAFTRDPNTGEKRIFAEYLTNAQGEDVVAGIRTPKYIDDMKMEMPQAYSDLIRMCDILEHHYRDMQDIEFTIERGKLYMLQTRTGKRSAKAAIRIAVEMYEEGIISEEEAIMRVTPEIFDRILHPQVKTNGKETPLGKGLAASPGAAIGSIVFSSERAIELGKSKKMILVRPETTADDVRGMAVCEGFLTQKGGMTSHAAVVARAMGKPAVVGVETMHVDTTNNTLTINGKTLHEGDVVTIDGTSGLFYLGELPVEKPEIDKFSKKLLELADKNRKLGVRANANTPEEAHLARENGAEGIGLARTERMFLGNERIPIMRSMIMSESKEERQKYLEQLLPMQISDFVEFFKTMEGYPVIIRLLDPPLHEFLPDKETILNKIYEIKSGKNGSDELQYYEKLLKTVRDLEEFNPMLGFRGCRVGLVYPEIYDMQVRAIMEAAVRVQKEGRRIMPEIMIPLVGHHNELKILMERLEKTAKSVKDSDQVDYKFGTMIEIPRACVTADKIAKYADFFSFGTNDLTQMTFGYSRDDAEGKFMFFYLENGILEKDPFSSVDEDGVGELMRMAVEKGRKSNEKLEVGICGEQGGDPDTIYFCHKIGLDYVSASPYRIPIARLAAARANISEMKPELASTYRY

SEQ ID NO: 8669 - protein, 401 aa, Thermoplasma volcanium
MELPIEDVRVRKVLDSRGNFTVEADVYIPGGFGRTSAPAGASTGETEVIAFSKKGIDESIKFFETNVRRSIIGFNALDQKGFDALITDLDGSGNFSNLGGNLSTALSMSVAKAVSAHLGIPLYRYVGGINHSMPRPIGNVIGGGKHARNGTSIQEFLVSAQGKTFMESAYVNVLVHRKIGDILSEKMKDISIGVGDERAWSVNISDEEAFEVLNQAVNEVSSETKVKIYTGLDFAADSLYENGKYVYKHTVRSRDEQIDYAISINKDFGVYYIEDPMFDTDFEGFAEITKKIGDKAMIVGDDLYTTNPDRIRKGIELGSTNAVLIKVNQIGTLTKAQEAASLASSAGLKNVVSHRSGETTDDFLAHLSVAFSSTFVKTGTIGGERIAKLNELMRIEECLTS

SEQ ID NO: 8670 - protein, 410 aa, Thermoplasma volcanium
MAEGKGFLRLEWARDHMPVIAEIRKRFLDEKPFKGINIAMALHVEAKTGIFSLLLKEGGANVRMASCNPLSSDDSVVESLKTDYGMPVFARKGETQEEYYENLQRTLEKPPDIIIDDGGDLTKLVHTERKDLSKNIMGGNEETTTGVVRLKAMEKAGVLLFPMFDVNDANMKHLFDNRYGTGQSTLDGIMNSTNLLIAGRNVVVAGYGYCGRGIAMRLKGMGANVIVTEIDPIKANEAIMDGFQVRRMNDAIRYADMVITATGMKDVVKYEDALVAKKNIVLANAGHFDNEVAVKEIEKHSLEKREVREFVKRYRLENGNTVDVIADGRLVNLAAGQGHPVEIMDLSFALQALTAEYLVKNHQNLEKKVYPVPPEIDRYVAEIRLKQFGGELDTLTEDQIKYLNSWDEGT

SEQ ID NO: 8671 - protein, 493 aa, Thermoplasma volcanium
MDGKLYIDGQWVDSSNGDTLTKYNPVTGEVIGKFAAASRDDVDRAFDAAEDAFQKWMDLGSVERSKIIYKAKELIEENRKELENIIIQENGKPVKEAAEEVDGVLDQMQYYAEWARKLNGEVVEGTTNHRKIFQYKVPYGTVVALTPWNFPAGMVARKLAPALLTGNTVILKPSSDTPGSAEWIVKKFIQAGVPKGALNYITGRGSVIGDYIVEHKKVALITMTGSTSTGQRIMQKASANMAKLMLELGGKAPFMVWKDADINNALKTLLWAKYWNAGQSCIAAERLYVHEDIYDTFINKFVELSKKIVVGDPSRADMGPLINTTALKGTEEVVEEAKESGARILYGGSKPDLSGPYKNGYFFLPTIIDNVDQKSKIFQEEIFAPVIGARKVSDVEEMYSLANDSKYGLASYLFTKDPNLIFEAAERIRFGELYINMPGPEASQGYHTGFRLTGQAGEGSRYGILEYLKIKNIYVDYSGKPLQINTVRDDLFQ

SEQ ID NO: 8672 - protein, 288 aa, Thermoplasma volcanium
MDCLITEMEYKEFGNTGVKVSSVGIGTYYDPGWMALSRFNVKRDAEKKIQAIRTAIDAGVTLIDTAEIYGSEDLVAKAIEGHNREELFIATKVWINHLRYDKVIKACKASLSRLNTKYVDLYQIHFPSPTANLQETFKAMEKLVDDGLVKFIGVSNFSRGKLEKSMEYVKKYEIVSNQIHYSLKKRDAEEDIVKFCENNGMAVLAWYPLEHGSLVRESDYPSEILARIKAKHPSITPAQIALSYLIYGNKLVFPIPRASNPEHVKENIASVEQKLDQEEIEELRKYFN

SEQ ID NO: 8673 - protein, 436 aa, Thermoplasma volcanium
MIKTLNPYTGEVIASYNEEDKEQVIRKIKDLREYQAKWRKNIGERIEVIKAAKKNFETQIDDLSKLMSLEMGKPISQSISEVKKSIWLMDYVIENAEKFLAIEDVKTEARKSYVRFDPIGVILIIMPWNFPVWQVMRAAIPALAAGNTVILKHASIVSGTSLKIQDLLNTDAFRSVITSGETASSVIPEVDGVSFTGSTSTGSRIAEIAGKNIKKFVMELGGSDPFIVLDDYNLEDTVKNAVFGRLQNNGQSCIASKRFIVNRKIGEKFVEMLKDEFSRVKIGDPLNSDTFLGPLSSQDQKETVLRQVSDLKGKSELVIGGDYQGNIVMPTIIKTDVRYNEEIFGPVAVVKYFDKPEEAVEISNETPFGLGASIWGNPDEAEKLIPEIQAGMVFVNKIVASDPRLPFGGVKKSGVGRELSRYGMLEFTNIKTVWIN

SEQ ID NO: 8674 - protein, 271 aa, Thermoplasma volcanium
MPASKIYLLDYGWLGGDIGWFLPGQLGGAMTNSERNPRRDWVEIPITGALIDHPDARILFDTGIAPDAMKTHERGLMEAFPITKMDDQNHIENQLKLIGLKPEDIDFVVISHLHLDHIGQAAVFKDSHVPIIVQKKELESALSLIWQGKSGAYDYSDLLPLKGAAWMPLDDPVFEIVDGVYAEFTGGHTAGHQVLTVKTEKGSMYTLTGDFLHLPKEYDVEAKGWLLSNATEWNSYIKKMKIREKARKQKLIISHDPGIWDKYPHAPKFVE

SEQ ID NO: 8675 - protein, 480 aa, Thermoplasma volcanium
MEYHEVIEKLDFSKVTRFYWLLTLLATIGGFLFGYDTSNIGTALVFIPYPVQGFIEGYLVAGASLGAAVGALIAAGLTDRYGRKYLLIADAAIYAAGAILSAFTIDLAMLLLSRTLIGLAVGADSGIATAYISEYAPKDRRGSLGILQQWMITIGILGAYIVGMATLYAAPGLASVLDWRIMLGVAAIPALIGLGFRFMMPESPRWLMINGKYKEASEAFKKLGLNLSVDELKEVKFRQRAKITNGVKRAFLVVALFFVFQQITGINIPFYYGPIVIEKLHLFGSATQSLVFTQIYAVAAATILAVINVAATYIGFRYIDTVGRRKLALLGYSGMTFFGLLGGLLLYLKFDVGLLIAFAGFIIFFAFGVGGTGWMIQGEYFPTNMRGLYASLGAFVDWIANFAIIEIFPVLEALITIKNVMFVFGILSLIAVLIFYYIMPETKELSVEQISDLFENNGLSSLRKASMSYNKSSSGSSGKK

SEQ ID NO: 8676 - protein, 255 aa, Thermoplasma volcanium
MSGKLEGKTALITGASKGLGRAIAEEFAKEGARVAINYAHDEKSALEVKKITGGEIFKADVSNRDQVKEMARQIHEKLGKIDILVNNSGIWYLMPFENYDEEKVRRMLDVNLMGAIYTTLEFLPDLKEKKGTIINIGSNAGIGTAAKNTTFYSLTKAAIIMLTKRLAFDLSEYSIRVNAIAPGWIETDLTIGGKTDEEIRKLEEDFKSRTTLKMFGKPEYIGKAALFLASSDSVYMNGQVIVIDGGRIDNLTHSI

SEQ ID NO: 8677 - protein, 285 aa, Thermoplasma volcanium
MDRATEPVLFFFMAFFWALNYVMVKFAYAYDLSSSILLMRVLYASIFSSLIFIRQIKLPKSPLEHLKVFILANLNITGFFSLWFFGETGVSAAVTSIVIYSYPILATAFSYLFLGDRFGAMKTLGLILGFAGLVIIFIRSINVENLVDLIMLLVAAISWAIGTVFYRKYLLGYDSAGLNTLQLLYALPVVLLISLFTGGINIGLLQLKFNLIMIYMGSFGTAIAYFIYLYLYRKYKVSSISAYFFLVPAISVVLAAVLLKEPISALTIAGFAVMSAGIFLSGSFK

SEQ ID NO: 8678 - protein, 485 aa, Thermoplasma volcanium
MYRDKFSNITEGYTFDDVLILPMKTGVEPKNVDVSSRLSRRINVKVPIVSSPMDTVTEEAMAIAMARYGAFGIIHRNQPREKEVEMVRRVKREETIIIRDVYTVSPETPIEVARTIMKTKNIAGLPVLKEEKLVGILTKRDLEFAKQGSTVSDVMVKNVITAPENVDLEDAINILHKNRIEKLPLVDKDNHLVGLITAKDIITRQRFPDATRDDEGQLMVGAAVGPFDLDRAIELERAGADLIVVDTAHADNENVLSSIKRMRKEISVDIVAGNIATAGAAEDLISCEVDGLRVGIGPGSICTTRIVAGVGVPQLTAISEVAEVAKEYGIPVIADGGIRYSGDIVKAIAAGADSVMLGSMLAGTEESPGQEMIINGRKYKAYRGMGSIGALSTGISDRYSKLGNGFIAEGVEGAVPYRGRVDEVLFQLVGGLRTGMGYVGAENIGKLKERARFVRISSNGLRESHPHDIRLISEPPNYQISNYNL

SEQ ID NO: 8679 - protein, 247 aa, Thermoplasma volcanium
MDLKDKVAVVTGSGRGIGRAISVALAKNRCKVIINVKKRLEEGQETLRMVEEYSQGILVKADVSTREGCASIINEARKNFDSIDILVNNAGLGIAMPFMNSDDSLIQKLIDTNIMSVIRCSQEIGRVMEDGGTIINVSSVAGLKPMPLLPIYGMTKAAIINLTQYMAYDFAQRRIRVNAVAPSVVSTKMGNSLVDISGLKEDKFAKEYTLTGKIIDPDEVADAVIFLAKSDSITGQTLVIDSGWLLK

SEQ ID NO: 8680 - protein, 285 aa, Thermoplasma volcanium
MNSREVLSISTLVFVTFIWGVTFPIIKDVFLYLSPVNFLALRFAVSTLLFLPVVIKKIKHVKSEEWKAGLIAGTLLFIAYYLQTIGLLYTQPALSGTITGIYVVFVPIISYLYLRRRIAHVEVYSSAFAFIGLVLMSYSGLSNVSIELGDFMTLAAAVFYAMQLVYVSKHASHIDTFVFSFIQIAVAAFFSAVFIPTFPEPFKITIYSAFVVLFTAVFATFLATYVYVSALSKMNVTKVGVILIGEPIFADLTSVILYGEKIGPIALIGIIIMIASIGTISYFAD

SEQ ID NO: 8681 - protein, 295 aa, Mus musculus
DYIKIEKIGEGTYGVVYKGRHRVTGQIVAMKKIRLESEEEGVPSTAIREVSLLKELRHPNIVSLQDVLMQDSRLYLIFEFLSMDLKKYLDSIPPGQFMDSSLVKSYLHQILQGIVFCHSRRVLHRDLKPQNLLIDDKGTIKLADFGLARAFGIPIRVYTHEVVTLWYRSPEVLLGSARYSTPVDIWSIGTIFAELATKKPLFHGDSEIDQLFRIFRALGTPNNEVWPEVESLQDYKNTFPKWKPGSLASHVKNLDENGLDLLSKMLVYDPAKRISGKMALKHPYFDDLDNQIKKM

SEQ ID NO: 8682 - protein, 486 aa, Cycloclasticus oligotrophus
MQHINHFINGEFVSAVDGKSFEKRSPVDRRLIAQVSEGGKVDVDRAVHAARAALNGEWGAFTMEQRVEILYGVADEITRRFDDFVEAEMADTGQPKSIMTHAFIPRGAANFKIFADVIKNVPNESFQTTTPDGLGALNYAIRVPKGVVGVVSPWNAPFLLMTWKVGPALACGNTVVVKPSEETPLTTTLLGEVMNKVGVPKGVFNVVHGFGPDSAGEYLTHHPKVDAITFTGETTTGAAIMKAASEGMRDVSFELGGKNAGIVFADSDFDKAVDGIYKSSFLNSGQVCLGTERVYVERPIFDKFVEALKKKVEKVRHGRPDDENCNFGPMISHEHQAKVLSYYAKAVEEGATVVTGGGVPSIPEELKEGAWVEPTIWTGLAEDATVMKEEIFGPCCHIAPFDDEQQVINWANDTEYGLSTTVWTRDLSRAHRVAAKINVGITWINSWFLRDLRTAFGGSKQSGIGREGGVHSLEFYTETRNVCVKL

SEQ ID NO: 8683 - protein, 532 aa, Mus musculus
MLLLWLLLLLLLLVPLLAILWQQRARGARPCWLISLQHRVAWGMLGWAAAWQQWRLDRSTLNVGQSQQQALMWCLKKAQGSCCLPREDTDMRTFRNHLPLTQTSHTQEQESEETLPSPASPQYHGDASLQATLLGLITLNKAYPEALAPGSTACVTPTSPWPCSVPWLGHALGRVSPDGAKDPRTLLLEALISPGLRVLEARTAVELLDVFVGLEADGEELAEAIAAGILGTLLPKRAAELKEALEQGPRGLARRLWPKLQVVVTLDSGGQAEAVAALRVLWCQGLAFFSPAYAASGGVVALNLWPERPQGSYLLPPGVPFIELLPIKEGTQEEAASTLLLTDAQREKEYELVLTNHTSLTRCRLGDVVQVVGTYNQCPVVRFTCRLGQTLNVRGEVTDETVFSVALAQAVGQWPGAKLLDHVCVESRVLDSCEGSAPHYEVFVELRGLRNLSEENRDKLDNCLQEASAQYKSLRFRGSVGPAKVHLVRPGSFRVLREALAAFSSSSCRPPEMPRVIRLRHLAQLLQKRVIS

SEQ ID NO: 8684 - protein, 221 aa, Homo sapiens
MEAGGFLDSLIYGACVVFTLGMFSAGLSDLRHMRMTRSVDNVQFLPFLTTEVNNLGWLSYGALKGDGILIVVNTVGAALQTLYILAYLHYCPRKRVVLLQTATLLGVLLLGYGYFWLLVPNPEARLQQLGLFCSVFTISMYLSPLADLAKVIQTKSTQCLSYPLTIATLLTSASWCLYGFRLRDPYIMVSNFPGIVTSFIRFWLFWKYPQEQDRNYWLLQT

SEQ ID NO: 8685 - protein, 262 aa, Pinus pinaster
HADFIITSTYQEIAGSKDTVGQHESHTAFTLPGLYRVVHRIDVFDPKSNIVSPGADMQIYFPYTEKQHRLTALHGAIEELLFNPEQTDEHMCVLNDPKKPIIFSMARLDRVKNMTGLVEWFAKNKRLRELVNLVVVAGDIDPSKSMDREEVAEIEKMHELIKKYNLNGQFRWICAQKNRVRNGELYRYICDTKGAFVQPAIYEAFGLTVVEAMTCGLPTFATCNGWSGGNNVNGVRIPNDPYHGICKSPHCLTFSRDAGRFP

SEQ ID NO: 8686 - protein, 116 aa, Nicotiana suaveolens x Nicotiana tabacum
MAKSSATKDAQALLHSLRSAHASTPTNLKIIDIYVLFAIFTAVIQVGYMAIVGSFPFNSFLSGVLSCVGTAVLAVCLRIQVNKENKEFKDLPPERAYADFVLCNLVLHLVIMNFLG

SEQ ID NO: 8687 - protein, 116 aa, Nicotiana suaveolens x Nicotiana tabacum
MAKSSATKDAQAPLHSLRSAYASTPTNLKIIDIYALFAIFTAVIQVGYMAIVGSFPFNSFLSGVLSCVGTAVLAVCLRIQVNKENKEFKDLPPERAYADFVLCNLVLHLVIMNFLG

SEQ ID NO: 8688 - protein, 251 aa, Limulus polyphemus
  unsure (1)..(251): unsure at all Xaa locations
GSHAGNKLAMQEFMILPTGASSFTEAMKIGSEVYHHLKNVIKKRFGLQATAVGDEGGFAPDIQNNKEALELIKEAIDIAGYTGRIDIGMDVAASEFYKEGKYDLDFKNPNSDPAQWLTPDALASMYQEFIKDYPIVSIEDPFDQDDWDAWSSFQAAVZIQVVGDDLTVTNPKRIQQAVDKKSCNCLLLKVNQIGSVTEAIKAHQLAKCNNWGTMVSHRSGETEDTTIADLVVGLCTGQIKTGAPXRSEXLA

SEQ ID NO: 8689 - protein, 1120 aa, Homo sapiens
TSIKEGQLLKQTSSFQRWKKRYFKLRGRTLYYAKDSKSLIFDEVDLSDASVAEASTKNANNSFTIITPFRRLMLCAENRKEMEDWISSLKSVQTREPYEVAQFNVEHFSGMHNWYACSHARPTFCNVCRESLSGVTSHGLSCEVCKFKAHKRCAVRATNNCKWTTLASIGKDIIEDEDGVAMPHQWLEGNLPVSAKCAVCDKTCGSVLRLQDWKCLWCKTMVHTACKDLYHPICPLGQCKVSIIPPIALNSTDSDGFCRATFSFCVSPLLVFVNSKSGDNQGVKFLRRFKQLLNPAQVFDLMNGGPHLGLRLFQKFDNFRILVCGGDGSVGWVLSEIDKLNLNKQCQLGVLPLGTGNDLARVLGWGGSYDDDTQLPQILEKLERASTKMLDRWSIMTYELKLPPKASLLPGPPEASEEFYMTIYEDSVATHLTKILNSDEHAVVISSAKTLCETVKDFVAKVEKTYDKTLENAVVADAVASKCSVLNEKLEQLLQALHTDSQAAPVLPGLSPLIVEEDAVESSSEESLGESKEQLGDDVTKPSSQKAVKPREIMLRANSLKKAVRQVIEEAGKVMDDPTVHPCEPANQSSDYDSTETDESKEEAKDDVKTAPRSPDARASYGHSQTDSVPGPAVAASKENLPVLNTRIICPGLRAGLAASIAGSSIINKMLLANIDPFGATPFIDPDLDSVDGYSEKCVMNNYFGIGLDAKISLEFNNKREEHPEKCRSRTKNLMWYGVLGTRELLQRSYKNLEQRVQLECDGQYIPLPSLQGIAVLNIPSYAGGTNFWGGTKEDDIFAAPSFDDKILEVVAIFDSMQMAVSRVIKLQHHRIAQCRTVKITIFGDEGVPVQVDGEAWVQPPGIIKIVHKNRAQMLTRDRAFESTLKSWEDKQKCDSGKPVLRTHLYIHHAIDLATEEVSQMQLCSQAAEELITRICDAATIHCLLEQELAHAVNACSHALNKANPRCPESLTRDTATEIAINVKALYNETESLLVGRVPLQLESPHEERVSNALHSVEVELQKLTEIPWLYYILHPNEDEEPPMDCTKRNNRSTVFRIVPKFKKEKVQKQKTSSQPVQKWGTEEVAAWLDLLNLGEYKDIFIRHDIRGAELLHLERRDLK

SEQ ID NO: 8690 - protein, 265 aa, Homo sapiens
PGNLAGVRHIILVLSGKGGVGKSTISTELALALRHAGKKVGILDVDLCGPSIPRMLGAQGRAVHQCDRGWAPVFLDREQSISLMSVGFLLEKPDEAVVWRGPKKNALIKQFVSDVAWGELDYLVVDTPPGTSDEHMATIEALRPYQPLGALVVTTPQAVSVGDVRRELTFCRKTGLRVMGIVENMSGFTCPHCTECTSVFSRGGGEELAQLAGVPFLGSVPLDPALMRTLEEGHDFIQEFPGSPAFAALTSIAQKILDATPACLP

SEQ ID NO: 8691 - protein, 164 aa, Phycomyces blakesleeanus
CKQASYIRYAAQQNVAKMTFDNADELYKIKKFYPNAELVLRILTDDSKSLCQLGIKFGAPLDTVDHLLQTAKDLDLNVIGVSFHVGSGCYDQYAFSEAVNLARGVFDKAEAMGFNFSLLDVGGGFPSADVTDGVTFEKIAAVLGPTVDALFPPNIRVIAEPGRY

SEQ ID NO: 8692 - protein, 457 aa, Oryza sativa
MEKGPREKLLYVTCVYNGTGINKPDYLGTVDVDPNSPTYSQVIHRLPVTHVGDELHHSGWNACSSCHGDPSASRRFLILPSLLSGRVYVVDTLKDPRAPALHKVVEAEDIAEKTGLGFPHTSHCLASGEIMISCLGDKEGNAAGNGFLLLDSEFNVKGRWEKPGHSPLFGYDYWYQPRHKTMISSSWGAPAAFRTGFDLQHVQDGLYGRHLHVYDWPGGELKQTLDLGSTGLLPLEVRFLHDPSKDTGYVGCALTSNMVRFFKTADGSWSHEVAISIKPLKVRNWILPEMPGLITDFVISLDDRYLYLVNWLHGDIRQYNIEDPAKPVLAGQVWAGGLLQKGSEVVYVTEDDKEEQYSVPQVKGHRLRGGPQMIQLSLDGKRIYVTNSLFSRWDEQFYGQDLVKKGSHMLQIDVDTEKGGLSINPNFFVDFGAEPEGPSLAHEMRYPGGDCTSDIWI

SEQ ID NO: 8693 - protein, 319 aa, Gibberella moniliformis
MSANYWHSTQCRFWSFTKEQLVTMRQKLEEDNAELVRMFPLPQQRRLYIYFNQQLIRLAKRLTIRQQSMATAQVYMKRFYSKVEIRRTNPYLVIATAIYLACKIEESPQHIRLIVTEARQMWGDLVAIDTSKLGECEFFMISEMRSQLIVFQPYRTITALRNELSLVDDEVQLARSVINDHFMTDLPLLYPPHIIAMVAILLALVLRPNNSGPGQSTSGAAAAAGLAAAQQALMRAQGQQAQGGMPEPAAAEPKEKRQQDRVSRVQKFAKWLVDSNVEIASMVDATQEIISFYECYEHYNDKLTREQINRFVKARGLDK

SEQ ID NO: 8694 - protein, 182 aa, Dictyostelium discoideum
MSSICPTCTKRVYAAEAVKACEKQYHKLCLQCFHCHKILQLGQYSERDGQPYCKTDYDRLFRQAGYRGGGVVADSFEPAPKVETTTPVEPTPPPTFLTPTEEVKVQLFPTNCPKCGKKAYFNELKVYNSRDWHKTCFACFSCNKNLVSGQYSEKEGLIYCPRCYQSKFGPSGYTNTGALVLH

SEQ ID NO: 8695 - protein, 748 aa, Xenopus laevis
MGQTGKKSEKGPVCWRKRVKSEYMALRQLKKFRRADEVKSMFNTNRQKIMERTEILNQEWKQRRIQPVHIMTTVSSLRGTRECSVTSDLDFPKQVIPLKTLTAVASVPIMYSWSPLQQNFMVEDETVLHNIPYMGDEVLDQDGTFIEELIKNYDGKVHGDRECGFINDEIFVELVNALAQYSDYEDDEDGDDNQDDEQDDTAKDQDDNMEDKETQPLRKFPSDKIFEAISSMFPDKGTSEELKEKYKELTEQQLPGALPPECTPNIDGPNAKSVQREQSLHSFHTLFCRPCFKYDCFLHPFHATPNTYKRKNNEAANDGKPCGPHCYQLLEGAREFAAALTAERIKTPPKRPSGRRRGRLPNNTSRPSTPTVNVSEAKDTDSDREAGTETGGESNDKEEEEKKDETSSSSEANSRCQTPIKMKPNIEPPENVEWSGAEASLFRVLIGTYYDNFCAIARLIGTKTCRQVYEFRVKESSIISPVIAEDVDTPPRKKKRKHRLWAAHCRKIQLKKDGSSNHVYNYQPCDHPRQPCDSSCPCVIAQNFCEKFCQCSSECQNRFPGCRCKAQCNTKQCPCYLAVRECDPDLCLTCGAADHWDSKNVSCKNCSIQRGSKKHLLLAPSDVAGWGIFINDTVQKNEFISEYCGEIISQDEADRRGKVYDKYMCSFLFNLNNDFVVDATRKGNKIRFANHSVNPNCYAKVMMVNGDHRIGIFAKRAIQTGEELFFDYRYSQADALKYVGIEREMEIP

SEQ ID NO: 8696 - protein, 341 aa, Leishmania major
MNHTRAVMEAILAVITYSFCSVSMILVNKLIMNTYDMNFPFGILVLQTGGALVIVALAKAARFVEYPAFSFDVAKKWLPLTLLFVAMLFTSMKSLATMSVAAQTILKNLAVILIALGDKFLYGKAQTPMVYFSFALMILGSFLGAKGDKWVTAWGLIWTLLNIVSTVSYTLYMKAVLGSVSNSIGRYGPVFYNNLLSLPFFLIMGVGEIMPFSAAIGETTTLGKLVLTFSVLVSSVMTFSVFWCMSITSPTTMSVVGSLNKIPLTFLGMLAFHQFPTATGYLGIMVALSAGFLYTHLNIRANRAKASSDLEHQMQQTGKTTTESIVLVRTDENSSDNFKSE

SEQ ID NO: 8697 - protein, 542 aa, Medicago sativa
MGCLLSKDKDSEQEHNNGGYRYAESSGMHNHRNNHEQVNTSRTAPTSSYQPQIPTKPSSISAPSPKPLIKQDTNTILGKGLEDVKQFYTLGKELGRGQFGVTFLCTENSTGLLYACKSISKRKLVSKSDREDIKREIQIMQHLSGQPNIVEFKGAYEDRNSVHVVMELCAGGELFDRIIAKGHYSEKAAASICRQIVNVVNICHFMGVMHRDLKPENFLLASKDENALLKATDFGLSVFIEEGRVYRDIVGSAYYVAPEVLRPRCGKEIDIWSAGVILYILLSGVPPFWAETEKGIFDAILEGHIDFESEPWPKISDSAKDLVRKMLIQEPKKRITAAQVLEHPWIKGGNASDKPIDSAVLSRMKQFRAMNKLKKLALKVIAENMSEEEIRGLKAMFTNMDTDNSGTITYEELKAGLQRLGSKLSEAEVKQLMEAADVDGNGTIDCIEFITATMHRHKLERDDHLYKAFQYFDKDSSGFITRDELETAMKEYGMGDDATIKEIISEVDTIISEVDTDHDGRINYEEFCAMMRSGNQQQVKLF

SEQ ID NO: 8698 - protein, 313 aa, Drosophila melanogaster
MSVEEEVFRIQKKMSKMASDGTGQDQALDLLKALQTLNINLDILTKTRIGMTVNELRKSSKDDEVIALAKTLIKNWKRFLASPAPTTPNNSSAKEGSSNNSSASKSTSAAKSSSSISGKDKSSSSSSSKDKEKKGSTSSSQTSFPSGGMTDAVRIKCREMLATALKIGEVPEGCGEPEEMAAELEDAIYSEFNNTDMKYKNRIRSRVANLKDPKNPGLRGNFMCGAVTAKQLAKMTPEEMASDEMKKLREKFVKEAINDAQLATVQGTKTDLLKCAKCKKRNCTYNQLQTRSADEPMTTFVMCNECGNRWKFC

SEQ ID NO: 8699 - protein, 628 aa, Homo sapiens
MESLVFARRSGPTPSAAELARPLAEGLIKSPKPLMKKQAVKRHHHKHNLRHRYEFLETLGKGTYGKVKKARESSGRLVAIKSIRKDKIKDEQDLMHIRREIEIMSSLNHPHIIAIHEVFENSSKIVIVMEYASRGDLYDYISERQQLSEREARHFFRQIVSAVHYCHQNRVVHRDLKLENILLDANGNIKIADFGLSNLYHQGKFLQTFCGSPLYASPEIVNGKPYTGPEVDSWSLGVLLYILVHGTMPFDGHDHKILVKQISNGAYREPPKPSDACGLIRWLLMVNPTRRATLEDVASHWWVNWGYATRVGEQEAPHEGGHPGSDSARASMADWLRRSSRPLLENGAKVCSFFKQHAPGGGSTTPGLERQHSLKKSRKENDMAQSLHSDTADDTAHRPGKSNLKLPKGILKKKVSASAEGVQEDPPELSPIPASPGQAAPLLPKKGILKKPRQRESGYYSSPEPSESGELLDAGDVFVSGDPKEQKPPQASGLLLHRKGILKLNGKFSQTALELAAPTTFGSLDELAPPRPLARASRPSGAVSEDSILSSESFDQLDLPERLPEPPLRGCVSVDNLTGLEEPPSEGPGSCLRRWRQDPLGDSCFSLTDCQEVTATYRQALRVCSKLT

SEQ ID NO: 8700 - protein, 311 aa, Oryza sativa (japonica cultivar-group)
MEMMVHGRRDEQYGGLRLGLGLGLSLGVAGGAADDEQPPPRRGAAPPPQQQLCGWNGGGLFSSSSSDHRGRSAMMACHDVIEMPFLRGIDVNRAPAAETTTTTARGPSCSEEDEEPGASSPNSTLSSLSGKRGAPSAATAAAAAASDDEDSGGGSRKKLRLSKDQAAVLEDTFKEHNTLNPKQKAALARQLNLKPRQVEVWFQNRRARTKLKQTEVDCELLKRCCETLTDENRRLHRELQELRALKLATAAAAPHHLYGARVPPPTTLTMCPSCERVASAATTTRNNSGAAPARPVPTRPWPPAAAQRSSA

SEQ ID NO: 8701 - protein, 1307 aa, Magnaporthe grisea
MADAATLAAVAAIVENIATNSGAPGKNASFRSSTYVQLPGPESDEKKQLERELAALVIRVQQLETRANAAPATIFPDTPNETAHSLFGDDSSSPTSSSSGREPKRLKSASSTTRNGFTTDGRPSKLNAITDEELEGLREHVDGQSRLLDSQRAELDGVNAQLLEQKQLQERALAIIEQERVATLERELWKHQKANEAFQKALREIGSIVTAAARGDLSKRVKINPIEMDPEITTFKRTMNAMMDQLGVFSSEVSRVAREVGTEGILGGQAQIEGVDGTWKELTDNVNVMAQNLTDQVREIASVTTAVAHGDLTQKIESAAKGEILQLQQTINTMVDQLRTFASEVTRVARDVGTEGMLGGQADVEGVKGMWNELTVNVNAMANNLTTQVRDIINVTTAVAKGDLTQKVQAECRGEIFELKNTINSMVDQLQQFAREVTKIAREVGTEGRLGGQATVHDVQGTWRDLTENVNGMAMNLTTQVREIANVTSAVAAGDLSKKIRVEVKGEILDLKNTINTMVDRLGTFAFEVSKVARAVGTDGTLGGQAQVENVEGKWKDLTENVNTMASNLTSQVRGISTVTQAIANGDMSRKIDVEAKGEILILKETINNMVDRLSIFCNEVQRVAKDVGVDGIMGGQADVAGLKGRWKEITTDVNTMANNLTAQVRAFGDITNAATDGDFTKLVEVEASGEMDELKRKINQMVYNLRDSIQRNTQAREAAELANKTKSEFLANMSHEIRTPMNGIIGMTQLTLDTDLTQYQREMLNIVNNLAMSLLTIIDDILDLSKIEAKRMVIEEIPYTLRGTVFNALKTLAVKANDKFLDLTYRVDSSVPDHVIGDSFRLRQIILNLVGNAIKFTEHGEVSLTIQKGNDVTCLPNEYMIEFVVSDTGIGIPTDKLGLIFDTFQQADGSMTRKFGGTGLGLSISKRLVNLMGGDVWVKSQYGKGSSFYFTCRVRLADVDISLIRKQLKPYKGHQVLFIDKGKTGHGPEVGQMLGQLGLVPIVLESEQNHTLTRVRGKECPYDVIVVDSIDTARRLRGIDDFKYLPIVLLAPTVHVSLKSCLDLGITSYMTMPCKLIDLGNGMVPALENRATPSLSDNTKSFEILLAEDNTVNQRLAVKILEKYNHVVTVVSNGAEALEAVKDNKYDVILMDVQMPVMGGFEATAKIREYERSLGTQRTPIIALTAHAMMGDREKCIEAQMDEYLSKPLQQNHLIQTILKCATLGGALLEQNRERELELARHAEHKGGLSTDPARASSVMRPPLHHRPVTTAESLSGGAESPSLMANDGEDPIQRARSSLSEPGCL

SEQ ID NO: 8702 - protein, 325 aa, Rattus norvegicus
MTASSVLLHTGQKMPLIGLGTWKSEPGQVKAAIKYALSVGYRHIDCASVYGNETEIGEALKESVGAGKAVPREELFVTSKLWNTKHHPEDVEPAVRKTLADLQLEYLDLYLMHWPYAFERGDNPFPKNADGTVKYDSTHYKETWKALEALVAKGLVKALGLSNFSSRQIDDVLSVASVRPAVLQVECHPYLAQNELIAHCQARGLEVTAYSPLGSSDRAWRHPDEPVLLEEPVVLALAEKHGRSPAQILLRWQVQRKVICIPKSITPSRILQNIQVFDFTFSPEEMKQLDALNKNWRYIVPMITVDGKRVPRDAGHPLYPFNDPY

SEQ ID NO: 8703 - protein, 360 aa, Rattus norvegicus
MSQERPTFYRQELNKTVWEVPERYQNLSPVGSGAYGSVCAAFDTKTGHRVAVKKLSRPFQSIIHAKRTYRELRLLKHMKHENVIGLLDVFTPARSLEEFNDVYLVTHLMGADLNNIVKCQKLTDDHVQFLIYQILRGLKYIHSADIIHRDLKPSNLAVNEDCELKILDFGLARHTDDEMTGYVATRWYRAPEIMLNWMHYNQTVDIWSVGCIMAELLTGRTLFPGTDHIDQLKLILRLVGTPGAELLKKISSESARNYIQSLAQMPKMNFANVFIGANPLAVDLLEKMLVLDSDKRITAAQALAHAYFAQYHDPDDEPVAEPYDQSFESRDFLIDEWKSLTYDEVISFVPPPLDQEEMES

SEQ ID NO: 8704 - protein, 359 aa, Rattus norvegicus
MTLESMIACCLSDEVKESKRINAEIEKQLRRDKRDARRELKLLLLGTGESGKSTFIKQMRIIHGAGYSEEDKRGFTKLVYQNIFTAMQAVVRAMDTLKIRYKYEQNKANALLIREVDVEKVTTFEHQYVNAIKTLWSDPGVQECYDRRREFQLSDSAKYYLTDVDRIATVGYLPTQQDVLRVRVPTTGIIEYPFDLENIIFRMVDVGGQRSERRKWIHCFENVTSIMFLVALSEYDQVLVESDNENRMEESKALFRTIITYPWFQHSSVILFLNKKDLLEDKILHSHLVDYFPEFDGPQRDAQAAREFILKMFVDLNPDSDKIIYSHFTCATDTENIRFVFAAVKDTILQLNLKEYNLV

SEQ ID NO: 8705 - protein, 379 aa, Rattus norvegicus
MSGVVRTLSRCLLPAEAGARERRAGAARDAEREARRRSRDIDALLARERRAVRRLVKILLLGAGESGKSTFLKQMRIIHGREFDQKALLEFRDTIFDNILKGSRVLVDARDKLGIPWQHSENEKHGMFLMAFENKAGLPVEPATFQLYVPALSALWRDSGIREAFSRRSEFQLGESVKYFLDNLDRIGQLNYFPSKQDILLARKATKGIVEHDFVIKKIPFKMVDVGGQRSQRQKWFQCFDGITSILFMVSSSEYDQVLMEDRRTNRLVESMNIFETIVNNKLFFNVSIILFLNKMDLLVEKVKSVSIKKHFPDFKGDPHRLEDVQRYLVQCFDRKRRNRGKPLFHHFTTAIDTENIRFVFHAVKDTILQENLKDIMLQ

SEQ ID NO: 8706 - protein, 355 aa, Rattus norvegicus
MGCTVSAEDKAAAERSKMIDKNLREDGEKAAREVKLLLLGAGESGKSTIVKQMKIIHEDGYSEEECRQYRAVVYSNTIQSIMAIVKAMGNLQIDFADPQRADDARQLFALSCAAEEQGMLPEDLSGVIRRLWADHGVQACFGRSREYQLNDSAAYYLNDLERIAQSDYIPTQQDVLRTRVKTTGIVETHFTFKDLHFKMFDVGGQRSERKKWIHCFEGVTAIIFCVALSAYDLVLAEDEEMNRMHESMKLFDSICNNKWFTDTSIILFLNKKDLFEEKITQSPLTICFPEYTGANKYDEAASYIQSKFEDLNKRKDTKEIYTHFTCATDTKNVQFVFDAVTDVIIKNNLKDCGLF

SEQ ID NO: 8707 - protein, 359 aa, Rattus norvegicus
MTLESIMACCLSEEAKEARRINDEIERQLRRDKRDARRELKLLLLGTGESGKSTFIKQMRIIHGSGYSDEDKRGFTKLVYQNIFTAMQAMVRAMDTLKIPYKYEHNKAHAQLVREVDVEKVSAFENPYVDAIKSLWNDPGIQECYDRRREYQLSDSTKYYLNDLDRVADPSYLPTQQDVLRVRVPTTGIIEYPFDLQSVIFRMVDVGGQRSERRKWIHCFENVTSIMFLVALSEYDQVLVESDNENRMEESKALFRTIITYPWFQNSSVILFLNKKDLLEEKIMYSHLVDYFPEYDGPQRDAQAAREFILKMFVDLNPDSDKIIYSHFTCATDTENIRFVFAAVKDTILQLNLKEYNLV

SEQ ID NO: 8708 - protein, 297 aa, Rattus norvegicus
MGFVKVVKNKAYFKRYQVRFRRRREGKTDYYARKRLVIQDKNKYNTPKYRMIVRVTNRDIICQIAYARIEGDMIVCAAYAHELPKYGVKVGLTNYAAAYCTGLLLARRLLNRFGMDKIYEGQVEVNGDEYNVESIDGQPGAFTCYLDAGLARTTTGNKVFGALKGAVDGGLSIPHSTKRFPGYDSESKEFNAEVHRKHIMGQNVADYMRYLMEEDEDAYKKQFSQYIKNNVTPDMMEEMYKKAHAAIRENPVYEKKPKREVKKKRWNRPKMSLAQKKDRVAQKKASFLRAQERAAES

SEQ ID NO: 8709 - protein, 929 aa, Rattus norvegicus
MEPRDPSPEARSSDSESASASSSGSERDADPEPDKAPRRLTKRRFPGLRLFGHRKAITKSGLQHLAPPPPTPGAPCGESERQIRSTVDWSESAAYGEHIWFETNVSGDFCYVGEQYCVAKMLPKSAPRRKCAACKIVVHTPCIGQLEKINFRCKPSFRESGSRNVREPTFVRHHWVHRRRQDGKCRHCGKGFQQKFTFHSKEIVAISCSWCKQAYHSKVSCFMLQQIEEPCSLGVHAAVVIPPTWILRARRPQNTLKASKKKKRASFKRRSSKKGPEEGRWRPFIIRPTPSPLMKPLLVFVNPKSGGNQGAKIIQSFLWYLNPRQVFDLSQGGPREALEMYRKVHNLRILACGGDGTVGWILSTLDQLRLKPPPPVAILPLGTGNDLARTLNWGGGYTDEPVSKILSHVEEGNVVQLDRWDLRAEPNPEAGPEERDDGATDRLPLDVFNNYFSLGFDAHVTLEFHESREANPEKFNSRFRNKMFYAGTAFSDFLMGSSKDLAKHIRVVCDGMDLTPKIQDLKPQCIVFLNIPRYCAGTMPWGHPGEHHDFEPQRHDDGYLEVIGFTMTSLAALQVGGHGERLTQCREVLLTTAKAIPVQVDGEPCKLAASRIRIALRNQATMVQKAKRRSTAPLHSDQQPVPEQLRIQVSRVSMHDYEALHYDKEQLKEASVPLGTVVVPGDSDLELCRAHIERLQQEPDGAGAKSPMCHPLSSKWCFLDATTASRFYRIDRAQEHLNYVTEIAQDEIYILDPELLGASARPDLPTPTSPLPASPCSPTPGSLQGDAALPQGEELIEAAKRNDFCKLQELHRAGGDLMHRDHQSRTLLHHAVSTGSKEVVRYLLDHAPPEILDAVEENGETCLHQAAALGQRTICHYIVEAGASLMKTDQQGDTPRQRAEKAQDTELAAYLENRQHYQMIQREDQETAV

SEQ ID NO: 8710 - protein, 826 aa, Plasmodium falciparum
MPKEDCKTEKSIDSIDENVLKKYDILKKVGKGAYGVVFKGRCKKNKNIVAVKKIFGAFQNCTDAQRTFREIIFLYELNGHDNIIKLMDVIKAKNDNDIYLIFDFMETDLHEVIKADLLEEIHKKYIIYQLLRALKYIHSGGLLHRDIKPSNILVNSECHIKVADFGLARSISTHVNENKVPILTDYVATRWYRAPEILLGSTHYTEDVDMWSLGCIMGELLCGKPLFTGNSTMNQLEKIIQVIGKPNKKDIEDIRSPFAEKIISSFVDLKKKNLKDICYKASNESLDLLEKLLQFNPSKRISAENALKHKYVEEFHSIIDEPTCRHIITIPINDNTKYRVNFYRNVVYFVIMRRNKFHSNVLNQGESKKEEKKDRYYRRDKDKKKCICENNKVHMEDKEYKNKIIFSQGDKPEDIKEDHKKCKICDEIHVDTSKQIDSINLEHVVLNNNDVSYVDKKKKTKYEPVYKERGKMKKDKMGNVYCKDRERRVFYEARKKESITNFTTATTISKSDDTEVEMSQMEINEIESNEMKGKIKEQIKEQIKEQIKEQIKEQIKKTQNNISKISIGSNTMSSTISKTEPNSRNYFINKKRVESFYTKERKNNDILFHANNKKVIFFKDKNKIKNHSSEKKKIKYKVFYGFKKSYENEQNVPHYLETKCSNTPLGKNYYYKKYVDGSNKKYVDGGNKKYVDGGNKKYVDGSNKKYVDGSNRKYVDGGNKKYVDGSSKKYVDGGNKKYVDGSSKKYVDEGNKKYVDGGNKKYVDGGNKKYVDGLNKKYNHNYNHFNNNYYYYSRRGSLKSVNKEEENCPQRTWKNTPKFTFTPCSK

SEQ ID NO: 8711 - protein, 328 aa, Saccharomyces cerevisiae
MTEILPHVNDEVLPAEYELNQPEPEHCPGPESDMAGKSDACGGCANKEICESLPKGPSPDIPLITDNLSGIEHKILVLSGKGGVGKSTFAAMLSWALSADEDLQVGAMDLDICGPSLPHMLGCIKETVHESNSGWTPVYVTDNLATMSIQYMLPEDDSAIIWRGSKKNLLIKKFLKDVDWDKLDYLVIDTPPGTSDEHISINKYMRESGIDGALVVTTPQEVALLDVRKEIDFCKKAGINILGLVENMSGFVCPNCKGESQIFKATTGGGEALCKELGIKFLGSVPLDPRIGKSCDMGESFLDNYPDSPASSAVLNVVEALRDAVGDV

SEQ ID NO: 8712 - protein, 644 aa, Oryza sativa (japonica cultivar-group); identical to SEQ ID NO: 772

SEQ ID NO: 8713 - protein, 469 aa, Arabidopsis thaliana
MAATTENLPQLKSAVDGLTEMSESEKSGFISLVSRYLSGEAQHIEWSKIQTPTDEIVVPYEKMTPVSQDVAETKNLLDKLVVLKLNGGLGTTMGCTGPKSVIEVRDGLTFLDLIVIQIENLNNKYGCKVPLVLMNSFNTHDDTHKIVEKYTNSNVDIHTFNQSKYPRVVADEFVPWPSKGKTDKEGRYPPGHGDVFPALMNSGKLDTFLSQGKEYVFVANSDNLGAIVDLTILKHLIQNKNEYCMEVTPKTLADVKGGTLISYEGKVQLLEIAQVPDEHVNEFKSIEKFKIFNTNNLWVNLKAIKKLVEADALKMEIIPNPKEVDGVKVLQLETAAGAAIRFFDNAIGVNVPRSRFLPVKASSDLLLVQSDLYTLVDGFVTRNKARTNPSNPSIELGPEFKKVATFLSRFKSIPSIVELDSLKVSGDVWFGSSIVLKGKVTVAAKSGVKLEIPDRAVVENKNINGPEDL

SEQ ID NO: 8714 - protein, 399 aa, Rana dybowskii
MSLRITRNMLSNAENNVKSGVVGKIAAKPVLRSRAALGDIGNKAETKMPLKKELKPAVKLVKKVKPAEKVPEPKKVKEEAVCIKPQPVPIEVPSSPSPMETSGCHPDELCQAFSDVLIQVKDVDIDDDGNPMLCSEYVKDIYCYLRSLEEALAVRPHYLQGQEVTGNMRAILVDWLVQVQMKFRLLQETMFMTVGIIDRFLQDNPVPKNQLQLVGVSAMFLAAKYEEMYPPEIGDFTFVTDHTYTKAQIREMEMKILRALNFSMGRPLPLHFLRRASKIGEVTAEQHSLAKYLIELVMVDYEMVHYPPSQIAAAASCLSMKVLNSGDWTPTLQHYTLYAEDSLLPIMQHMAKNVVKVNKGLTKQLTVKNKYGSSKQMKISTIPQLRSEVLASLARAVMP

SEQ ID NO: 8715 - protein, 394 aa, Rana dybowskii
MATRRAAISREVDNAVGAMRSKAQLNSRRAALGEIGNKVTVRAVKQPAKTSNATSKTTRPVAKVSNVSVKPKAVAVTVIEAPSQAKEASPVPMDVSMKEEEELCQAFSEVLNHVVDIDAEDGGNPQLCSEYVVDIYNYLREREVQQSIKQRYLDGMEINERMRAILVDWLIQVNSRFQFLQETLYMGIAIMDRFLQVQPISRGKLQLVGVTSLLLASKYEEMYSPEVADFAYITDNAYTTSQIREMEMIILRELKFDLGRPLPLHFLRRASKACSADAEQHTLAKYLMELTLVDYEMVHFHPSEIAAAALCLAQKVLGVGSWGSTQHHYTGYTEEDLTPIIKHIAKNVTKVNQNRTKHVAVRNKYASSKLMKISTHPQLMSLVITELAASLTSQ

SEQ ID NO: 8716 - protein, 733 aa, Rana dybowskii
MPLAQLAELWPNNVELVPEDTENGHVTSEDAGKCTTKDEMVVKEIAITHHVKEGSEKADQSHFVLLKVLGQGSFGKVFLVRKITPPDNNQLYAMKVLKKATLKVRDRVRTKMERDILAEVHHPFVVRLHYAFQTEGKLYLILDFLRGGDLFTRLSKEVMFTEEDVKFYLAELALGLDHLHSLGIIYRDLKPENILLDEEGHIKLTDFGLSKESIDHEKKAYSFCGTVEYMAPEVVNRQGHSHSADWWSYGVLMFEMLTGSLPFQGKDRKETMTLILKAKLGMPQFLSSEAQGLLRSLFKRNPANRLGSGIDGAEELKRHSFFSTIDWNKLYRREISPPFKPAVSQPEDTYYFDTEFTSRTPKDSPGIPPSAGAHQLFRGFSFVAPPFGGEDRPSSTSPSLSVPKMLNKNVAFTDVYTLRESIGVGSYSVCKRCVHKGTNMEYAVKIIDKSKKDPSEEIEILRRYGQHPNIIALKDVYEEGNSVYLVTDLMRGGELLDRILRQKFFSEREACAVLLTMCKTVEYLHSQGVVNRDLKPSNILYVDESGNPESIRICDFGFAKQLRAENGLLMTPCYTANFVAPEVLKRQGYDEGCDIWSLGILLYTMLAGYTPFANGPEDTPDEILARIGSGKFTLKGGNWNTVSDSAKDLVSRMLHVDPHRRLTARQVMHHEWITKRDLLPQSHLNRQDAQLVKGAMVATYSALNSSKPTPQLQPIKSSILAQRRVKKLPSTTL

SEQ ID NO: 8717 - protein, 487 aa, Arabidopsis thaliana
MVTETVLATAVSNGKSKGCCKSGPGYATPLAAMAGPREKLIYVTALYSGTGRDKPDYLATVDVDPSSPTFSSVIHRLKMPYIGDELHHTGWNSCSSCHGDASADRRYLVLPGLISGRIYAIDTKTDPKAPSLYKVVEPKEIAEKTGLAFPHTSHCLASGDMLVSCLGDKEGNAKGNGFLLLDSDFNVKSRWDKPGHGPLFGYDFWYQPRFKTMISTSWGAPKAFSKGFNLQHVADGLYGSHLHIYQWPEGEMKQIIDLGNTGLLPLEIRFLHDPSKDTGYVGSALSSNMIRFFKNSDDTWSHEVVISVKPLKVENWILPEMPGLITDFLISLDDRFFYFVNWLHGDIRQYNIEDPKNPVLTGQIWVGGLLQKGSPYKAVGEDGNTYQFDVPQIKGKSLRAGPQMIQLSLDGKRLYATNSLFSAWDRQFYPEIMEKGSHIIQIDVDTDKGGLTLNPDFFVDFGDEPDGPALAHEMRYPGGDCTSDIWI

SEQ ID NO: 8718 - protein, 34 aa, Trichomonas vaginalis
MSGRGKGGKGLGKGGAKRHRKVMRENIQGITKPA

SEQ ID NO: 8719 - protein, 101 aa, Trichomonas vaginalis
MSGRGKGGKGLGKGGAKRHRKVMRENIQGITKPAIRRLARRGGVKRISGDIYEEVRGVLRHFLENVIRDSVTYTEHARRKTVTAMDVVYALKRQGKTLYGF

SEQ ID NO: 8720 - protein, 676 aa, Xanthomonas oryzae
MATWLILVGELVVSLALMVAILLRPQVSHRRRLIAMLLDYTCTGAIMAIQGEPASPLYAVCMWVTIGNGLRYGSNYLRAATAMASLSVLSAILISPYWKANPYLSWGLLLGLIAVPLYFDSLLRAMTRAVREARHANQAKSRFLANMSHEFRTPLNGLSGMTEVLATTRLDVEQKECLNTIQASARSLLSLVEEVLDISAIEAGKIRIDRRDFSLRDLIGSVNMILQPQAKTRGLDYGTEVATDVPDLLKGDTGHLRQVLLNLLGNAVKFTDHGHVLLRVARLAGNGADTVRLRFDVEDSGIGVPMDMRPRMFEAFEQADMGLSRRYEGTGLGTTIAKGLIEAMGGAIGYTPNRPSGSVFWFELQLEIGILEKAAPTRTPVGVLETPDELEPSNVIAFSNPFLRHRARVRSMRMLVADDHEANRMVLQRLLEKAGHRVMCVNGAEQVLDAMADEDFDAVIVDLHMPGMSGLDMLKQLRVMQASGMRYTPVVVLSADVTPEAIRACEQAGARAFLAKPVVAAKLLDTVAELAVSTRPLATQAPVVQAPTSFEGVLDASVLDELAALGVGEEFERQFIRQCLDDAHNCVGAIERDGSRSDWEQLREGAHALRGVASNLGLAQLASSGGELMRMADWQLQAEWRQLLSALREQLQTGREVLDARLQGVKDDERSPRSSE

SEQ ID NO: 8721 - protein, 369 aa, Escherichia coli
MKSRAAVAFAPGKPLEIVEIDVEPPRKGEVLVKITHTGVCHTDAFTLSGDDPEGVFPAVLGHEGAGVVVEVGEGVTSVKPGDHVIPLYTAECGECLFCKSGKTNLCVSVRATQGKGLMPDGTTRFSYKGQPLFHYMGCSTFSEYTVVAEVSLAKINPQANHEHVCLLGCGVTTGIGAVHNTAKVQPGDTVAIFGLGGIGLAAVQGARQAKAGRIFAIDTNPEKFDLARSFGATDCINPKDYDKPIQDVLIELTGWGVDHTFECIGNVNVMRSALEAAHRGWGQSVVIGVAGAGKEISTRPFQLVTGRVWKGSAFGGVKGRTQLPGMVEDAMKGEIDLAPFVTHTMGLEEINDAFDLMHEGKSIRTVIHY

SEQ ID NO: 8722 - protein, 294 aa, Citrullus lanatus
MPVGELRFSSQSSTTVVESTTNNDETWLWGQIKAEARRDAESEPALASYLYSTILSHSSLERSLSFHLGNKLCSSTLLSTLLYDLFLNAFSTDYCLRSAVVADLQAARERDPACVSFSHCLLNYKGFLACQAHRVAHKLWNQSRRPLALALQSRIADVFAVDIHPAARIGKGILFDHATGVVVGETAVIGNNVSILHHVTLGGTGKMCGDRHPKIGDGVLIGAGATILGNVKIGEGAKIGAGSVVLIDVPPRTTAVGNPARLVGGKEKPSQLEDIPGESMDHTSFISEWSDYII

SEQ ID NO: 8723 - protein, 262 aa, Arabidopsis thaliana
MTSARDEFVYMAKLAEQAERYEEMVEFMEKVAKAVDKDELTVEERNLLSVAYKNVIGARRASWRIISSIEQKEESRGNDDHVSLIRDYRSKIETELSDICDGILKLLDTILVPAAASGDSKVFYLKMKGDYHRYLAEFKSGQERKDAAEHTLTAYKAAQDIANSELAPTHPIRLGLALNFSVFYYEILNSPDRACNLAKQAFDEAIAELDTLGEESYKDSTLIMQLLRDNLTLWASDMQDDVADDIKEAAPAAAKPADEQQS

SEQ ID NO: 8724 - protein, 447 aa, Capsella rubella
MLTSFKSSSSSSEDATTETPPPPFCQLASSSSSSAATSASHHLRRLLFTAADFVSQSNFTAARNLLSILSLNSSPYGDSTQRLAHLFTKALSLRINRLQQEQDPTVATCTTNEMTMSTNSTVFTSSVCKEQFLFRTKNNNSDFESCYYLWLNQLTPFIRFGHLTANQAILDATETNDNGALHILDLDISQGLQWPPLMQALAERSSSPNSPPPSLRITGCGRDVTGLNRTGDRLTRFANSLGLQFQFHKLVIVDEDLPGLLLQIRLLALSAVQGETIAVNCVHFLYKFFNDDADLIGHFLTVIKSLNPRIVTMAEREANHGDHSFLIRFSEALDHYVAIFDSLEATLPPNSRERLTLEQRWFGKEIMDVVAAEATERKQRHRRFEIWGEMMKRFGFVNVPIGSFALSQAKLLLRLHYPSEGYNLQFLNDSLFLGWQNRLLFSVSSWK

SEQ ID NO: 8725 - protein, 513 aa, Capsella rubella
MSDFDGNFNESTSCWAPPFSPSPRAILAMIDQAEDDGLDLISEMFPHTNLPRDHSAQSSEQRSGLGQRLAARVGFSPPPLDTENISPSAASLRSSTTVPPPVSAIPPGFIPSTLLQSPNMVTDSSQMIPAPSSDTNYGPQGMVETSGEGNAPTLIFNNDHPYQPVNADLPLLDVFDDVPTEESVYLPTYETDHVEPIGDSLVPNSFEHEFVGDANVNFISNEGTESVKDSESDDELDFDFEFEDEDEAEAEAEDNDEDKAEDEDEDNDEDGNEDEDEDDEEDENDEEEADHDDEADFDDAEPSSPKRRKFEASSNMIGATRTNKAQRVILQMESDEDNPEDGFRWRKYGQKVVKGNPNPRSYFKCTNNDCNVKKHVERGADNFKILVTSYDGIHNHPPPPARCRINSGPRNRSGTTTTTQNQSYRTDRLGRFPAPSSVITPMEMMPLSSFTPPLDMSKVYMTGLNKLPNFSVFQNPGYMYRNDEPMMNVVPNGSGIYGGIRHRLFAEFGVNLM

SEQ ID NO: 8726 - protein, 1166 aa, Capsella rubella
MKQKWLFVLILCFFTALGIHGKRLINSDFDETALLMAFKQFSVKSDPNNVLGNWIYESGRGSCSWRGVSCSDDGRIVGLDLRNGGVTGTLNLANLTALPNLQNLYLQGNYFSSSSGGDSSSGSYCYLQVLDLSSNLISDYSLVDYVFSKCSNLVSVNFSNNKLVGKLGFAPSSLKSLTTVDFSYNILSEKIPESFISEFPASLKYLDLTHNNFSGDFSDLSFGMCGNLSFFSLSQNNISGVKFPISLPNCRFLETLNISRNNLAGKIPGGEYWGSFQNLKQLSLAHNRFSGEIPPELSLLCKTLETLDLSGNALSGELPSQFTACVWLQNLNIGNNYLSGDFLSTVVSKITRITYLYVAFNNISGSVPISLTNCTNLRVLDLSSNGFTGNVPSGLCSQQSSPVLEKLLIANNYLSGTVPVELGKCKSLKTIDLSFNELTGPIPKDVWMLPNLSDLVMWANNLTGSIPEGVCVKGGKLETIILNNNLLTGSIPQSISRCTNMIWISLSSNRLTGKIPTGIGNLSKLAILQLGNNSLSGNVPRQLGNCKSLIWLDLNSNNLTGDLPGELASQAGLVMPGSVSGKQFAFVRNEGGTDCRGAGGLVEFEGIRAERLERFPMVHSCPATRIYSGMTMYTFSANGSMIYFDISYNAVSGLIPPGYGNMGYLQVLNLGHNRITGNIPDSLGGLKAIGVLDLSHNDLQGYLPGSLGSLSFLSDLDVSNNNLTGPIPFGGQLTTFPVSRYANNSGLCGVPLRPCGSAPRRPITSSVHAKKQTLATAVIAGIAFSFMCLVMLFMALYRVRKVQKKELKREKYIESLPTSGSCSWKLSSVPEPLSINVATFEKPLRKLTFAHLLEATNGFSAETMVGSGGFGEVYKAQLRDGSVVAIKKLIRITGQGDREFMAEMETIGKIKHRNLVPLLGYCKVGEERLLVYEYMKWGSLETVLHEKSSKKGGIFLNWTARKKIAIGAARGLAFLHHSCIPHIIHRDMKSSNVLLDEDFEARVSDFGMARLVSALDTHLSVSTLAGTPGYVPPEYYQSFRCTAKGDVYSYGVILLELLSGKKPIDPGEFGEDNNLVGWAKQLYREKSGTEILDPELVTEKSGDAELFHYLKIASQCLDDRPFKRPTMIQVMAMFKELKADTEEDESLDEFSLKETPLVEESRDKEP

SEQ ID NO: 8727 - protein, 355 aa, Gibberella fujikuroi
MSRSNPPNAAGSRKISFNVSEQYDIQDVVGEGAYGVVCSAIHKPSGQKVAIKKITPFDHSMFCLRTLREMKLLRYFNHENIISILDIQKPRNYESFNEVYLIQELMETDMHRVIRTQDLSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFRTLFPQDLGSALDLLEKLLAFNPVKRITVEEALKHPYLEPYHDPEDEPTAPPIPEEFFDFDKHKDNLSKEQLKQLIYQEIMR

SEQ ID NO: 8728 - protein, 231 aa, Lycopersicon esculentum
EFMEKVSNSLGSEELTVEERNLLSVAYKNVIGARRASWRIISSVEQKEESRGNEEHVNSIREYRSKIENELSKICDGILKLLDSKLIPSATSGDSKVFYLKMKGDYHRYLAEFKTGAERKEAAESTLTGYKAAQDIASAELAPTHPIRLGLALNFSVFYYEILNSPDRACNLAKQAFDEAIAELDTLGEESYKDSTLIMQLLRDNLTLWTSDMQDDGADEIKEDPKPEEKN

SEQ ID NO: 8729 - protein, 847 aa, Arabidopsis lyrata
PNKHHYYSFSFVFLFFFLILFPDFSISTNTLSATESLTISSNKTIVSLGDVFELGFFTILGDSWYLGIWYKKIPEKTYVWVANRDNPISTSTGILKISNANLVLLNHFDTPVWSTNLTAEVKSPVVAELLDNGNFVLRDSKTNGSDEFLWQSFDFPTDTLLPQMKLGLDHKKRLNKFLRSWKSSFDMSSGDYLFKIETLGLPEFFIWMSDFRVFRSGPWNGIRFSGMLEMQKWDDIIYNLTENKEEVAFTFRPTDHNLYSRLTINYAGLLQQFTWDPIYKEWNMLWSTSTDNACETYNPCGPYAYCDMSTSPMCNCVEGFKPRNPQEWALGDVRGRCQRTTPLNCGRDGFTQLRKIKLPDTTAAILDKRIGFKDCKERCAKTCNCTAFANTDIRNGGSGCVIWIGRFVDIRNYAADGQDLYVRVAAANIGDRKHISGQIIGLIVGVSLLLLVSFIMYWFWKKKQKQARATAAPNVYRERTQHLTNGVVISSGRHLFGENKTEELELPLTEFEAVVMATDNFSDSNILGQGGFGVVYMGRLPDGQEIAVKRLSMVSLQGVNEFKNEVKLIARLQHINLVRLFSCCIYADEKILIYEYLENGSLDSHLFKKVQSSKLNWQKRFNIINGIARGLLYLHQDSRFKIIHRDLKASNVLLDKDMTPKISDFGMARIFEREETEASTKKVVGTYGYMSPEYAMDGIFSVKSDVFSFGVLVLEIVSGKRNRGFYNSNQDNNLLSYTWDHWKEGKWLEIADPIIVGTSSSSSTFRPHEVLRCLQIGLLCVQERAEDRPKMSSVVFMLGNEKGEIPQPKPPGYCIGRSFLETDSSSSTQRNESSTINQFTVSVINAR

SEQ ID NO: 8730 - protein, 853 aa, Arabidopsis lyrata
MRVVVPNCHHFYIFFVVLILIRSVFSSYVHTLSSTESLTISSKQTIVSPGEVFELGFFNPAATSRDGDRWYLGIWFKTNLERTYVWVANRDNPLYNSTGTLKISDTNLVLLDQFDTLVWSTNLTGVLRSPVVAELLSNGNLVLKDSKTNDKDGILWQSFDYPTDTLLPQMKMGWDVKKGLNRFLRSWKSQYDPSSGDFSYKLETRGFPEFFLLWRNSRVFRSGPWDGLRFSGIPEMQQWEYMVSNFTENREEVAYTFQITNHNIYSRFTMSSTGALKRFRWISSSEEWNQLWNKPNDHCDMYKRCGPYSYCDMNTSPICNCIGGFKPRNLHEWTLRNGSIGCVRKTRLNCGGDGFLCLRKMKLPDSSAAIVDRTIDLGECKKRCLNDCNCTAYASTDIQNGGLGCVIWIEELLDIRNYASGGQDLYVRLADVDIGDERNIRGKIIGLAVGASVILFLSSIMFCVWRRKQKLLRATEAPIVYPTINQGLLMNRLEISSGRHLSEDNQTEDLELPLVEFEAVVMATENFSNSNKLGEGGFGVVYKGRLLDGQEIAVKRLSTTSIQGICEFRNEVKLISKLQHINLVRLFGCCVDENEKMLIYEYLENLSLDSHLFNKSLSCKLNWQMRFDITNGIARGLLYLHQDSRFRIIHRDLKASNVLLDKDMTPKISDFGMARIFGRDETEANTRKVVGTYGYMSPEYAMDGIFSVKSDVFSFGVLVLEIVSGKKNRGFYNSNQDNNLLGYAWRNWKEGKGLEILDPFIVDSSSSPSAFRPHEVLRCIQIGLLCVQERAEDRPVMSSVVVMLRSETETIPQPKPPGYCVGRSPFETDSSTHEQRDESCTVNQITISAIDPR

SEQ ID NO: 8731 - protein, 379 aa, Nicotiana tabacum
RPPAGQVIRCKAAVAWEAGKPLEIEEVEVAPPQKSEVRLKILFTSLCHTDVYFWEAKGQTPLFPRIFGHEAGGIVESVGEGVTDLKPGDHVLPVFTGECQQCRHCKSEESNMCDLLRINTDRGVMIHDGQTRFSKDGKPIYHFVGTSTFSEYTVVHSGCVAKIDPQAPLDKVCVLSCGISTGLGATLNVAKPTKGSTVAIFGLGAVGLAAAEGSRIAGASRVIGIDLNPSRFNDAKKFGVTEFVNPKDYDKPVQQVIAEMTDGGVDRSVECTGNVNAMISAFECVHDGWGVAVLVGVPNKAMRFKTHPMNLLNERTLKGTFFGNYKPKTDLPSVVGKYMNKELELEKFITHQVPFSEINKAFEYMLKGEGLRCMITMEH

SEQ ID NO: 8732 - protein, 369 aa, Avena sativa
MDGAPVAEFRPTMTHGGRFLLYNIFGNQFEITSKYQPPIMPIGRGAYGIVCSVMNFETREMVAIKKIANAFDNNMDAKRTLREIKLLRHLDHENIVGLRDVIPPSIPQSFNDVYIATELMDTDLHHIIRSNQELSEEHCQYFLYQLLRGLKYIHSANVIHRDLKPSNLLLNANCDLKICDFGLARPSSESDMMTEYVVTRWYRAPELLLNSTDYSAAIDVWSVGCIFMELINRAPLFPGRDHMHQMRLITEVIGTPTDDDLGFIRNEDARRYMRHLPQFPRRPFPGQFPKVQPAALDLIERMLTFNPLQRITVEEALEHPYLERLHDVADEPICTDPFSFDFEQHPLTEDQMKQLIFNEALELNPNFRY

SEQ ID NO: 8733 - protein, 480 aa, Avena sativa
MVSSEIPSVTTTHTHGPKLFRGMILLPKGPPDVILPENVEFDFNDVFGPVAVHTPTEASIVTPDSPAPLAESGEEVYNDPVVITKRSHSLVGPTLLVSQSLPLSKLTLHESESSSDLLECLSKEKQSNQEALSDEELSNTKENEAVGLDNFEVLKLVGQGAFGKVYQVRMKGTSEIYAMKVMRKDKILEKNHAEYMKAERDILTKVDHPFVVQLRYSFQTKYRLYLVLDFVNGGHLFFQLYQQGLFREELARIYTAEIVSAVAHLHANGIMHRDLKPENILLDARGHAMLTDFGLAKEFDENTRSNSMCGTVEYMAPEIVQGRGHDKAADWWSVGILLFEMLTGKPPFFGGNRDKIQQKIVREKMKLPSYLSSEVHSLLKGLLHKEAGKRLGSGLGGSDEIKNHKWFKAVNWKRLEARQIQPSFCPNVAGQTCIANFDECWTSMPVLDSPVASPVAADSNFVGFSYVRPAPFFQKPSPLG

SEQ ID NO: 8734 - protein, 177 aa, Hordeum vulgare
MSSWLQEKSGEVVETTQVKAGEATKMASETGQSIQDRAVEAKDQTGSFLGEKSEAVTKSASETTEAAKKMGGEAMGKVSETVQAGQDRAVEGKDQTASFLGEKTEAVKKTATETADAAKEKSTEAAQHVQDTAAEYTKDTPVAPKENVFQKAGGNIVGAATDAKDAVMNTLGMGGDK

SEQ ID NO: 8735 - protein, 415 aa, Dictyostelium discoideum
MPPPPTSDTSNFNDNISYFVYGSQFTVPRRYSIVKCIGHGAYGVACSAKDNLTGEKVAIKKISKAFDNLKDTKRTLREIHLLRHFKHENLISIKDILKPNSKEQFEDYYIVSELMDTDLHQIITSPQPLSDDHCQYFVYQMLRGLKHIHSANVLHRDLKPSNLLINEDCLLKICDLGLARVEDATHQGFMTEYVATRWYRAPEVILSWNKYTKAIDIWSVGCIFAELLGRKPLFQGKDYIHQITLIIETIGSPSEEDICNIANEQARQFIRSLNMGNQPKVNFANMFPKANPDAIDLLERMLYFDPSKRLTVEEALAHPYFQSLHDPSDEPICLHKFSLNFEAWDLNRDLLKELIYNEMLAYHPEDPQAPYYTDLNNPNFNLSRIQSSSELFNLLQQQKQPIHQQVNQQSIKINN

SEQ ID NO: 8736 - protein, 369 aa, Dictyostelium discoideum
MSSEDIDKHVLRKYEVFHKIGKGAYGIVWEAIDKKPHHTVALKKIFDAFQNATDAQRTFREIMFLQELHGHENIIKLLNVIKADNDRDIYLVFEHMETDLHAVIRAKILEEIHKQYTIYQLLKALKYMHSANVLHRDIKPSNLLLNSECLVKVADFGLARSITSLESIAEANPVLTEYVATRWYRAPEILLGSTKYTKGVDMWSIGCILGELLGEKAMFPGNSTMNQLDLIIEVTGRPSAEDIEAIKSPFAGTMLESLPPSNPRSLSDMYPSASVDALDLLKKLSQFNPDKRITAEEALAHPFVTQFHNPAEEPHFDRIIKISIDDGQKFPIAEYRNRLYNDIIKKKKEERKKQTNPTKPDTTAPTLST

SEQ ID NO: 8737 - protein, 122 aa, Xenopus laevis
IDCLASIGTIFAIYKKTSEGEPAEKDALQPGRNIVAAGYALYGSATMLVLATEFGVNCFMLDPAIGEFILVNQDVKIKKKGNIYSLNEGYAKYSDEAVTEYLQKKKFPEDGSSPYGARYVGS

SEQ ID NO: 8738 - protein, 523 aa, Aspergillus phoenicis
MRITSAIASLLLVGTATSLQNPHRRAVPAPLTHRSVASRAVPVERRSNDFEYLTNKTARFLVNGTSIPEVDFDVGESYAGLLPNTPTGNSSLFFWFFPSQNPDASDEITIWLNGGPGCSSLDGLLQENGPFLWQPGTYKPVPNPYSWTNLTNVVYIDQPAGTGFSPGPSTVNDEEDVAAQFNSWFKHFVDTFDLHGRKVYITGESYAGMYVPYIADAMLNEEDTTYFNLKGIQINDPSINSDSVMMYSPAVRHLNHYNNIFRLNSTFLSYINGKADKCGYNAFLDKAITYPPPTPFPTAPEITEDCQVWDEVVMAAYDINPCFNYYHLIDFCPYLWDVLGFPSLGFGPDNYFNRSDVQKILHVPPTDYSVCSETVIFANGDGSDPSSWGPLPSVIERTNNTIIGHGWLDYLLFLNGSLATIQNMTWNGKQGFQSPPVEPLFVPYHYGLAELYWGDEPDPYNLDAGAGYLGTAHTERGLTFSSVYLSGHEIPQYVPGALTASWSSCLVELIVFPRRGTTPLNFS

SEQ ID NO: 8739 - protein, 312 aa, Leishmania donovani
MNYEGHLRGHRGWVTSLACPEQAESYIKVVSTSRDGTAIAWKANADRHSVDSDYGLPSHRLEGHTGFVSCVSLAHATDYALTASWDRSIRMWDLRNGQSQRKFLKHTKDVLAVAFSPDDRLIVSAGRDNVVRVWNVAGDCMHEFLRDGHKDWVSSICFSPSLEHPIVVSGSWDNTIKVWNVNGGKCERTLKGHSNYVSTVTVSPDGSLCASGGKDGVALLWDLSTGEQLFKINVESPINQIAFSPNRFWMCVATEKSLSVYDLESKTVIAELTPDGAKPSECISIAWSADGNTLYSGHKDNLIRVWSISDAE

SEQ ID NO: 8740 - protein, 308 aa, Paramecium tetraurelia
MKSNKLEKYEKKEKLGEGTYGIVYKALDRNTNEYVAIKKIRLESEEEGIPSTAIREISLLKELNHPNIVKLMEVVHSNKKLVLVFEYFEMDLKKFLAQFPKEKGMEPVIVKSFLYQLLRGIQACHQQKILHRDLKPQNLLGSKDGILKLADFGLARASGIPVKSFTHEVVTLWYRPPDVLLGSKNYNTSIDIWSVGCIFGEMSNLKPLFAGSNETDQLKKIFRVLGTPSPIEYPKLNDLPSWKPENFEQYQPDNLAKFCPRLDPDGLDLLVKMLKINPDQRITAKAACEHPFFKELPEQVKKLYVNVK

SEQ ID NO: 8741 - protein, 575 aa, Lactococcus lactis subsp. lactis
MTTMLKGIAASSGVAVAKAYLLVQPDLSFETKTIADTANEEARLDAALATSQSELQLIKDKAVTTLGEEAASVFDAHMMVLADPDMTAQIKAVINDKKVNAESALKEVTDMFIGIFEGMTDNAYMQERAADIKDVTKRVLAHLLGVKLPSPALIDEEVIIVAEDLTPSDTAQLDKKFVKAFVTNIGGRTSHSAIMARTLEIPAVLGTNNITELVSEGQLLAVSGLTGEVILDPSTDQQSEFHKAGEAYAAQKAEWAALKDAETVTADGRHYELAANIGTPKDVEGVNDNGAEAIGLYRTEFLYMDAQDFPTEDDQYEAYKAVLEGMNGKPVVVRTMDIGGDKTLPYFDLPKEMNPFLGWRALRISLSTAGDGMFRTQLRALLRASVHGQLRIMFPMVALVTEFRAAKKIYDEEKAKLIAEGVPVADGIEVGIMIEIPAAAMLADQFAKEVDFFSIGTNDLIQYTMAADRMNEQVSYLYQPYNPSILRLINNVIKAAHAEGKWAGMCGEMAGDQTAVPLLMGMGLDEFSMSATSVLQTRSLMKRLDSKKMEELSSKALSECATMEEVIALVEEYTK

SEQ ID NO: 8742 - protein, 477 aa, Drosophila melanogaster
MSVSMSLVQGGAAGGAPQGASAILAAAAPYYQPPAVPQDVQPDRPIGYGAFGVVWAVTDPRDGRRVALKKLPNVFQSLVSSKRVFRELKMLCFFKHENVLSALDILQPPHLDFFQEIYVITELLQSDLHKIIVSPQHLSADHIKVFLYQILRGLKYLHSARILHRDIKPGNLLVNSNCVLKICDFGLARVEEPDQAKHMTQEVVTQYYRAPEILMGARHYSSAVDVWSVGCIFGELLGRRILFQAQNPVQQLELITELLGTPTMEDMRHACEGARTHMLRRAPKPPSFSVLYTLSSHATHEAVHLLCQMLVFDPDKRISVTDALAHPYLDEGRLRYHSCMCKCCFTTSAGMRQYTADFEPSAGQPFDDLWERKLTSVQQVKEEMHKFIAEQLQTGRVPLCINPQSAAFKSFGQPMRMRKSTTTTTTTTTTTTCTAAPAAAPIRRRLLLRCPREPIQVQIEILGARSPLTRTTRYRHA

SEQ ID NO: 8743 - protein, 434 aa, Drosophila melanogaster
MSVSMSLVQGGAAGGAPQGASAILAAAAPYYQPPAVPQDVQPDRPIGYGAFGVVWAVTDPRDGRRVALKKLPNVFQSLVSSKRVFRELKMLCFFKHENVLSALDILQPPHLDFFQEIYVITELLQSDLHKIIVSPQHLSADHIKVFLYQILRGLKYLHSARILHRDIKPGNLLVNSNCVLKICDFGLARVEEPDQAKHMTQEVVTQYYRAPEILMGARHYSSAVDVWSVGCIFGELLGRRILFQAQNPVQQLELITELLGTPTMEDMRHACEGARTHMLRRAPKPPSFSVLYTLSSHATHEAVHLLCQMLVFDPDKRISVTDALAHPYLDEGRLRYHSCMCKCCFTTSAGMRQYTADFEPSAGQPFDDLWERKLTSVQQVKEEMHKFIAEQLQTGRVPLCINPQSAAFKSFGSSTVAHPSELPAVASPMGMTAK

SEQ ID NO: 8744 - protein, 1099 aa, Drosophila melanogaster
MHPAGEKRGGRPNDKYTAEALESIKQDLTRFEVQNNHRNNQNYTPLRYTATNGRNDALTPDYHHAKQPMEPPPSASPAPDVVIPPPPAIVGQPGAGSISVSGVGVGVVGVANGRVPKMMTALMPNKLIRKPSIERDTASSHYLRCSPALDSGAGSSRSDSPHSHHTHQPSSRTVGNPGGNGGFSPSPSGFSEVAPPAPPPRNPTASSAATPPPPVPPTSQAYVKRRSPALNNRPPAIAPPTQRGNSPVITQNGLKNPQQQLTQQLKSLNLYPGGGSGAVVEPPPPYLIQGGAGGAAPPPPPPSYTASMQSRQSPTQSQQSDYRKSPSSGIYSATSAGSPSPITVSLPPAPLAKPQPRVYQARSQQPIIMQSVKSTQVQKPVLQTAVAPQSPSSASASNSPVHVLAAPPSYPQKSAAVVQQQQQAAAAAHQQQHQHQQSKPATPTTPPLVGLNSKPNCLEPPSYAKSMQAKAATVVQQQQQQQQQQQVQQQQVQQQQQQQQQQLQALRVLQAQAQRERDQRERERDQQKLANGNPGRQMLPPPPYQSNNNNNSEIKPPSCNNNNIQISNSNLATTPPIPPAKYNNNSSNTGANSSGGSNGSTGTTASSSTSCKKIKHASPIPERKKISKEKEEERKEFRIRQYSPQAFKFFMEQHIENVIKSYRQRTYRKNQLEKEMHKVGLPDQTQIEMRKMLNQKESNYIRLKRAKMDKSMFVKLKPIGVGAFGEVTLVSKIDTSNHLYAMKTLRKADVLKRNQVAHVKAERDILAEADNNWVVKLYYSFQDKDNLYFVMDYIPGGDLMSLLIKLGIFEEELARFYIAEVTCAVDSVHKMGFIHRDIKPDNILIDRDGHIKLTDFGLCTGFRWTHNSKYYQENGNHSRQDSMEPWEEYSENGPKPTVLERRRMRDHQRVLAHSLVGTPNYIAPEVLERSGYTQLCDYWSVGVILYEMLVGQPPFLANSPLETQQKVINWEKTLHIPPQAELSREATDLIRRLCASADKRLGKSVDEVKSHDFFKGIDFADMRKQKAPYIPEIKHPTDTSNFDPVDPEKLRSNDSTMSSGDDVDQNDRTFHGFFEFTFRRFFDDKQPPDMTDDQAPVYV

SEQ ID NO: 8745 - protein, 353 aa, Spodoptera frugiperda
MTMAVPSRARVYADVNSQRPREYWDYESYVVDWGNQEDYQLVRKLGRGKYSEVFEAINITNNEKCVVKILKPVKKKKIKREIKILENLRGGTNIITLQAVVKDPVSRTPALIFEHVNNTDFKQLYQTLSDYDIRYYLYELLKALDYCHSMGIMHRDVKPHNVMIDHDHRKLRLIDWGLAEFYHPGQDYNVRVASRYFKGPELLVDYQMYDYSLDMWSLGCMLASMIFRKEPFFHGHDNYDQLVRIAKVLGTEELFEYLDKYHIELDPRFNDILGRHSRKRWERFVHSENQHLVSPEALDFLDRLLRYDHYERYTAREAMDHPYFYPIVKEQGRMVSSNSPTPNALQGPISTTE

SEQ ID NO: 8746 - protein, 605 aa, Escherichia coli
MLLKTSRRTFLKGLTLSGVAGSLGVWSFNARSSLSLPVAASLQGTQFDLTIGETAVNITGSERQAKTINGGLPGPVLRWKEGDTITLKVKNRLNEQTSIHWHGIILPANMDGVPGLSFMGIEPDDTYVYTFKVKQNGTYWYHSHSGLQEQEGVYGAIIIDAREPEPFAYDREHVVMLSDWTDENPHSLLKKLKKQSDYYNFNKPTVGSFFRDVNTRGLSATIADRKMWAEMKMNPTDLADVSGYTYTYLMNGQAPLKNWTGLFRPGEKIRLRFINGSAMTYFDIRIPGLKMTVVAADGQYVNPVTVDEFRIAVAETYDVIVEPQGEAYTIFAQSMDRTGYARGTLATREGLSAAVPPLDPRPLLTMEDMGMGGMGHDMAGMDHSQMGGMDNSGEMMSMDGADLPDSGTSSAPMDHSSMAGMDHSRMAGMPGMQSHPASETDNPLVDMQAMSVSPKLNDPGIGLRNNGRKVLTYADLKSRFEDPDGREPGRTIELHLTGHMEKFAWSFNGIKFSDAAPVLLKYGERLRITLINDTMMTHPIHLHGMWSDLEDENGNFMVRKHTIDVPPGTKRSYRVTADALGRWAYHCHLLYHMEMGMFREVRVEE

SEQ ID NO: 8747 - protein, 380 aa, Lactuca sativa
MSSTTNQVIRCKAAVAWEAGKPLVIEEVEVAPPQKMEVRIKILFTSLCHTDVYFWEAKGQNPVFPRILGHEAGGVVESVGEGVTELQPGDHVLPVFTGECKECAHCKSEESNMCDLLRINTDRGVMIHDQKSRFSINGKPIFHFVGTSTFSEYTVVHVGCLAKINPLAPLDKVCVLSCGISTGLGATLNVAKPKKGSSVAIFGLGAVGLAAAEGARIAGASRIIGVDLNANRFELAKKFGVTEFVNPKDYKKPVQEVIAEMTNGGVDRSVECTGHIDAMISAFECVHDGWGVAVLVGVPHKDAVFKTSPLNLLNERTLKGTFFGNYKPRSDIPSVVEKYMNKELELEKFITHELPFSEINKAFDLMLKGEGLRCIIRMGE

SEQ ID NO: 8748 - protein, 333 aa, Arabidopsis thaliana
MSKARVYTDVNVIRPKDYWDYESLNVQWGEQDDYEVVRKVGRGKYSEVFEGINMNNNEKCIIKILKPVKKKKIRREIKILQNLCGGPNIVKLLDVVRDQHSKTPSLIFEYVNSTDFKVLYPTLTDYDIRYYIYELLKALDFCHSQGIMHRDVKPHNVMIDHELRKLRLIDWGLAEFYHPGKEYNVRVASRYFKGPELLVDLQDYDYSLDMWSLGCMFAGMIFRKEPFFYGHDNQDQLVKIAKVLGTDELNAYLNKYQLELDTQLEALVGRHSRKPWSKFINADNRHLVSPEAIDYLDKLLRYDHQDRLTAKEAMAHPYFAQVRAAESSRMRTQ

SEQ ID NO: 8749 - protein, 333 aa, Arabidopsis thaliana
MSKARVYTEVNVIRPKDYWDYESLIVQWGEQDDYEVVRKVGRGKYSEVFEGINVNSKEKCIIKILKPVKKKKIRREIKILQNLCGGPNIVKLLDVVRDQHSKTPSLIFEYVNSTDFKVLYPTLTDYDIRYYIYELLKALDFCHSQGIMHRDVKPHNVMIDHELRKLRLIDWGLAEFYHPGKEYNVRVASRYFKGPELLVDLQDYDYSLDMWSLGCMFAGMIFRKEPFFYGHDNQDQLVKIAKVLGTDELNAYLNKYQLELDPQLEALVGRHSRKPWSKFINADNQHLVSPEAIDFLDKLLRYDHQDRLTAKEAMAHAYFAQVRAAETSRMRSQ

SEQ ID NO: 8750 - protein, 833 aa, Escherichia coli
MALIVEFICELPNGVHARPASHVETLCNTFSSQIEWHNLRTDRKGNAKSALALIGTDTLAGDNCQLLISGADEQEAHQRLSQWLRDEFPHCDAPLAEVKSDELEPLPVSLTNLNPQIIRARTVCSGSAGGILTPISSLDLNALGNLPAAKGVDAEQSALENGLTLVLKNIEFRLLDSDGATSAILEAHRSLAGDTSLREHLLAGVSAGLSCAEAIVASANHFCEEFSRSSSSYLQERALDVRDVCFQLLQQIYGEQRFPAPGKLTQPAICMADELTPSQFLELDKNHLKGLLLKSGGTTSHTVILARSFNIPTLVGVDIDALTPWQQQTIYIDGNAGAIVVEPGEAVARYYQQEARVQDALREQQRVWLTQQARTADGIRIEIAANIAHSVEAQAAFGNGAEGVGLFRTEMLYMDRTSAPGESELYNIFCQALESANGRSIIVRTMDIGGDKPVDYLNIPAEANPFLGYRAVRIYEEYASLFTTQLRSILRASAHGSLKIMIPMISSMEEILWVKEKLAEAKQQLRNEHIPFDEKIQLGIMLEVPSVMFIIDQCCEEIDFFSIGSNDLTQYLLAVDRDNAKVTRHYNSLNPAFLRALDYAVQAVHRQGKWIGLCGELGAKGSVLPLLVGLGLDELSMSAPSIPAAKARMAQLDSRECRKLLNQAMACRTSLEVEHLLAQFRMTQQDAPLVTAECITLESDWRSKEEVLKGMTDNLLLAGRCRYPRKLEADLWAREAVFSTGLGFSFAIPHSKSEHIEQSTISVARLQAPVRWGDDEAQFIIMLTLNKHAAGDQHMRIFSRLARRIMHEEFRNALVNAASADAIASLLQHELEL

SEQ ID NO: 8751 - protein, 295 aa, Caulobacter vibrioides
MAVNSLSVMSPDGGLSRYLTEIRKFPMLSKDEEFMLAQRWKEHQDPQAAHKMVTSHLRLVAKIAMGYRGYGLPIGEVISEGNVGLMQAVKKFEPEKGFRLATYAMWWIRASIQEYILRSWSLVKMGTTAAQKKLFFNLRKAKSQIAAFQEGDLHPDQVSQIATKLGVLDSEVISMNRRLSGPDASLNAPLRADGESEWQDWLADEEQVSQETRVAEDEEKSLRMSLLEEAMVELTDRERHILTERRLKDDPTTLEELAAQYGVSRERVRQIEVRAFEKLQKTMREAAIAKNMVDA

SEQ ID NO: 8752 - protein, 530 aa, Aspergillus niger
MLFRSLLSTAVLAVSLCTDNASAAKHGRFGQKARDAMNIANGSANAVKHSLKIPVEDYQFLNNKTKPYRVESLPDVHFDLGEMYSGLVPIEKGNVSRSLFFVFQPTIGEPVDETTIWLNGGPGCSSLEALSPGECRFVWQPGTYQPVENPYSWVNLTNVLWVDQPVGTGFSLGVPTATSEEEIAEDFVKFFKNWQQIFGIKNFKIYVTGESYAGRYVPYISAAFLDQNDTEHFNLKGALAYDPCIGQFDYVQEEAPVVPFVQKNNALFNFNASFLAELESIHEQCGYKDFIDQYLVFPASGVQPPKAMNWSDPTCDVYDIVNNAVLDPNPCFNPYEINEMCPILWDVLGFPTEVDYLPAAPASTLTALIKRAMHAPNITWSECSVESVFVGGDGGPEQEGDYSANPIEHVLPQVIEGTNRVLIGNGDYDMVILTNGTLLSIQNMTWNGKLGFDTAPSTPINIDIPDLMYNEVFIENGYDPQGGQGVMGIQHYERGLMWAETFQSGHMQPQFQPRVSYRHLEWLLGRRDTL

SEQ ID NO: 8753 - protein, 481 aa, Penicillium janthinellum
STKNYRFLNEKTKANLVHHLPDVPYDIGEMYSGLMPIDMHNESRALFYIFQPTIGEPVDEVTIWMNGGPGCSSMESFLQETGRFLWQPGTYAPVENPYSWVVLTNVLWVDQPVGTGYSIGTPTATSQEETAQDFVKFFKNFQKTYGIKNFKIYVTGESYAGRYVPYISAAMLDEKDKEYFDLQGALAYDPCIGQFDYVQEEIPVVPFVKENANLFNFNETFMAELEHLHKSCGYADFIDKYLTFPPPKEQPPLFFNYTSMANEDVFDMVYNEVFKINPCFDLYEVNLMCPLQWDVLAFPTSLVYQPAGATVYFDRADVKKALHAPNVTWAECSNNPVFVGGSSGPEQEGDTSANPIEHVLPQVIEATNRVLISNGDFDMVILTNGTLLAIQNMTWNGHLGFQKKPSAPIDIKIPDLQYKEVFAENGASSLDGAQGIMGVQHYERGLMKAQTYQSGHMQPQYQPRVAYRHLEWLLKRTDELQ

SEQ ID NO: 8754 - protein, 324 aa, Rana catesbeiana
MTLTKETRVTLNDGNMMPILGLGTYAAPDVPKSLAEEAVKTAIDVGYRHIDCAFITGNEMHIGNGIRSKISDGTVEREDIFYTGKLWCTYFSPDMVRKGLERSLRDVGMDYLDLFLMHWPVSLKPSGASDPSDKDKPFIYDNVDLCATWEALEACKDAGLVRSLGVSNFNRRQLERILNKPGLKYKPVCNQVECHVYLNQNKLHAYCKSKDIVLVAYSVLGSHRDRNWVDLSLAVLLDDPILNKIAAKYNRSSAEVAMRFILQKGIVVLAKSFTPARIKQNLGVFEFELKPEDMKTLESLDRNLHYGPFREVKQHPEYPFHDEY

SEQ ID NO: 8755 - protein, 253 aa, Rumex acetosa
MEFSNELSRDMEDGSPQRKMGRGKIEIKRIENVTNRQVTFCKRRNGLLKKAYELSVLCDAEVALIVFSSRGRLYEYANHSVKATIERYKKTCSDSTGVTSVEEANAQQEAAKLRNQIRTLQNQTRNTSRNLMGEGLTSMNMKDLKNLETRLEKGISRVRAKKNELLFGEIEFMQKKEIELHNNNQFLRAKIAESERSQQSMNLMPGSSSGEQHYELMPQSQAGPFDSRNFFQVSDLQPDERYSCQNQTPLQLV

SEQ ID NO: 8756 - protein, 848 aa, Pseudomonas synxantha
  unsure (1)..(848): unsure at all Xaa locations
MLNPPPTGNSSRLLQRTGNDATRYLLPVFGRHRNFAGDVIPDEADRLLGWVEVELSHNGMLLRGYRSMFASLLLIAIGLMFTAALALRISRTINSPIGQIKQAVAQLKDGNLETRLPPLGSQELDQLASGINRMAETLQNAQEEMQHSIDQATEEVRQNLETIEIQNIELDLARKEALEASRIKSEFLANMSHEIRTPLNGILGFTHLLQKSELSPRQLDYLGTIEKSADNLXGIINEIXDFSKIEAGKLVLDSVPFNLRDLLQDTLTIFAPAAHAKQLELVSLVYRDTPLALVGDPLRLKQILTNLISNAIKFTREGTSSPGDGRDEQEDSVQLRISVQDTGIGLSNQDVRALFQAFSQADNSLSRQPGGTGLGLVISKRLIEQMGGEIGVDSTPGEGSEFWISLNLPKTRDDVEDLPAPPLLGRRVAVLENHELARQALQHQLEDCGLEVTPFNTLESLTNGITSAHQTEQAISLAVLGVTANDIPPERLNQHLWDLEHLGCKVLVLCPTTEQMLFNQSVPNPNSQLQAKPACTRKLRRSLADLISPRPSRSEPGEPLSSRAPRVLCVDDNPANLLLVQTLLEDMGAKVQAVESGYAAIDAVKQETFDLVLMDVQMPGMDGRQSTEAIRQWESERHGTPLPVVALTAHAMANEKRALLQSGMDDYLTKPISERQLAQVVLKWTGLALRNQGPERVNDGLAQGVQLLVLDHEEGLRLAANKADLAADMLAMLLASLEADRLAITVAREANDNHALIERVHRLHGATRYCGVPQLRAACQRAETLLKQDDAKAMAALDELDMAIARLASVSQSQRLTQFYGQHQSKCGGKPPPTFSQHFHRVNCREPS

SEQ ID NO: 8757 - protein, 422 aa, Triticum aestivum; identical to SEQ ID NO: 4648

SEQ ID NO: 8758 - protein, 523 aa, Mus musculus
MSEDKITGTLAFTVFTAVLSSFQFGYDIGVINAPQEVIISHYRHVLGVPLDDRKAAINYDVNGTDTPLTVTPAYTTPAPWDEEETEGSAHIVTMLWSLSVSSFAVDGMVASFFGGWLGDKLGRIKAMLAANSLSLTGALLMGCSKFGPAHALIIAGRSVSGLYCGLISGLVPMYIGEIAPTTLRGALGTLHQLALVTGILISQIAGLSFILGNQDHWHILLGLSAVPALLQCLLLLFCPESPRYLYIKLEEEVRAKKSLKRLRGTEDVTKDINEMKKEKEEASTEQKVSVIQLFTDANYRQPILVALMLHMAQQFSGINGIFYYSTTIFQTAGISQPVYATIGVGAINMIFTAVSVLLVEKAGRRTLFLTGMIGMFFCTIFMSVGLVLLDKFAWMSYVSMTAIFLFVSFFEIGPGPIPWFMVAEFFSQGPRPTALALAAFSNWVCNFVIALCFQYIADFLGPYVFFLFAGVVLVFTLFTFFKVPETKGKSFEEIAAEFRKKSGSAPPRKAAVQMEFLASSESV

SEQ ID NO: 8759 - protein, 257 aa, Schizophyllum commune
MPESREDSVYLAKLAEQAERYEEMVENMKRVASSDQELTVEERNLLSVAYKNVIGARRASWRIVSSIEQKEESKGNEAQVSMIKGYREKIEGELAKICEDILDVLEKHLIPSAASGESKVFYHKMMGDYHRYLAEFATGDKRKDSADKSLEAYKAASDVAVTELPPTHPIRLGLALNFSVFYYEILNSPDRACHLAKQAFDDAIAELDTLSEESYKDSTLIMQLLRDNLTLWTSDMQDSGEKPADSKDEAPEAPGDE

SEQ ID NO: 8760 - protein, 586 aa, Pinus taeda
MMMAMARAEYGRKLIIQLLFVLLLVQFVSGKMTRHYSFHVRMKNVTRLCHTKPLITVNGKSPGPKIVVREDDRVIIKVHNHVKDNVSIHWHGIRQLRSGWADGPAYITQCPIQTGQTYTYNFTVTGQRGTLWWHAHISWLRASVHGAFIIYPKRNVPYPFPKPYKEVTMVLGEWWNTDTEKVINQSMITGAGPNVSDCYSINGHPGPLYNCTAFNDTFILNVVPGKTYLLRIINAALNDELFIAIANHTMTVVEADAVYTKPVTTNTIMIAPGQTTNVLLTASASDYKGKQFFILASPYATGQGTFDNSTLAGILSYSSHTEFNTSHLNSTTNFTNAIMPKLPVFNDTAFATNFTLKLKSLANAQYPALVPQTVDKKFYFTVSLGFNPCPKGQKCQGVNGTKFTASINNISFVMPTVALLQSHYTGKMKGVYKTNFPDNPPFPFNYTGNPPKNVTTPMNGTRVKVLPFNTTVQLVLQDTNIAGAESHPVHLHGFNFFIVGQGFGNYNETRDSPNFNLVDPVERNTAGVPSGGWVALRFRADNPGVWFMHCHLEVHTSWGLKMAWIVKNGKGPSQSLLPPPPDLPLC

SEQ ID NO: 8761 - protein, 576 aa, Pinus taeda
MEAFNQHLSAQPFAARFVEMVICLTLFTAMVSAKLHTHIFVLRSTPVKRLCGTHNIITVNGQFPGPTLHVRNGDKLKVKVHNQAQYNATIHWHGVRQFRTGWSDGPEFITQCPIRPGRSYTYKFTITGQEGTLWWHAHSSWLRATVYGALIILPRLDTTYPFTFTRPHRQIPILLGEWWNRNPMDVVNQATQTGAAPNVSDAFTINGQPGDLYKCSTSDTFSVSMKGGETNLLRVINAALNSDLFFSIGSHTMTVVAVDALYTKPFQTNVLMLGPGQTTDILLTANQATGRYYMAARAYSSGQGVPFDNTTTTAILEYEGSSKTSTPVMPNLPFYNDTNSATSFANGLRSLGSHDHPVFVPQSVEENLFYTIGLGLIKCPGQSCGGPNGSRFAASMNNISFVPPTTSSILQAQHFGMKGVFSADFPDNPSVGFDYTAQNISRDLWSPVKATRVKVLKYNSTVQLILQGTNIFAGESHPIHLHGYDFYIVGAGFGNYNAQTDPHKFNLVDPPMRNTVNVPVNGWAAIRFVADNPGAWVMHCHLDVHITWGLAMVFVVNNGPDALLSLQSPPRDLPLC

SEQ ID NO: 8762 - protein, 574 aa, Pinus taeda
MVIRTSKIWKGVLFQLLAFSFLAHYVSGETRHYHFHIRLNNITRLCHTKPLITVNGEYPGPAIIAREGDRVVINVTNHVKDNVTIHWHGIRQIRSAWADGPAYVTQCPIQTGQSYIYNFTITGQRGTLWWHAHISWLRATLYGPIIIHPKKQATYPFTKPHQESPILFGEWWNANTENVINEAMQNGGGPNVSDAYTINGLPGPFYNCSTKDTFKLKVIPGKTYLLRIINAALNDELFFAIANHTVTVVEIDALYVKPFQTKAVLISPGQTTNVLLKAKSIPPPLNARFLMAARPYVTGSGTFDNSTTAGILEYAQVSNSSSPALTFKPTLPALNDTSFATKFSQKLRSLATPQFPAAVPQSVDKHFFFTVGLGLNPCPKGQKCQGPNGTKFAASMNNISFVLPSTALLQAHYFGKSKGVYKLNFPDNPPFSFNYTGTPPNNTRTLNDTRLKVVPFNATIQVVLQDTSLVGPESHPLHLHGYDFFVVGQGTGNYNPRSDPKHFNLVDPPQRNTVGVPSGGWVAIRFRADNPGVWFMHCHLEVHTSWGLKMAWVVLDGNAPNHSLPPPPSDLPAC

SEQ ID NO: 8763 - protein, 570 aa, Pinus taeda
MEVFNQHVCARLVLMAIWLTLLTAMASAKLRTETFVLQSTSVKRLCGTHNIITVNGQFPGPTLHVRNGDTLVVKVYNNAQYNATIHWHGVRQFRTGWSDGPEYITQCPIRPGGSYTYRFTITGQEGTLWWHAHSSWLRATVYGALVISPSPGATYPFTRPHGQVPILLGEWWSRNPIDVVDQATRTGAAPNVSDAFTINGQPGDLYQCSSSDTIRVSINNGETKLLRVINAALNTDLFFTVGGHTMTVVAVDALYTKPFQTNLLMLGPGQTTDVLVTADQTTGRYYMAARAYSSGQGVPFDNTTTVAILEYKGSSSSTSVPTVPNLPAYNDTQTATRFANALRSLASHDHPVFVPQSVDQNLFYTIGLGLINCPGQSCGGPNGSRFAASMNNASFVLPTTSSILEAQHFGMKGVFSGDFPDNPPVQFDYTAQNVSRGLWSPVKSTRVKILNYNTTVQVILQGTNIFAGESHPIHLHGYDFYIVGSGFGNYNPKTDPQKFNLVDPPMRNTVNVPVNGWAAIRFVADNPGAWVMHCHLDVHITWGLAMVFVVSNGPSSLLSIESPPLDLPQC

SEQ ID NO: 8764 - protein, 591 aa, Pinus taeda
MLNSKTLLRLCPCPSRAAVKYLLIVILLVIIQYLDTAAGKHWQTTRHYKFNVRQSNVTRLCNTKPLITVNGQYPGPTIFAQEGDQVIIKLVNHVKDNVTIHWHGIRQLRSGWADGPGYITQCPLQTGMSYVYNFTITGQRGTLWWHAHISWLRASVHGAIIIYPKPHVPYPFPKPYKEVPIILGEWWNADTEKVIQQALQTGGGPNVSDAYTINGLPGPLYNCSNDTFVLNVNPRKTYLLRIINAALNDELFLAIANHSMTVVEVDAVYVKPFQTNTLVITPGQTTNVLFTTNATINVGGVNQFYIAARPFVTGGGTFDNSTVAGIVSYNISNSNTSSTIMMPKLPALNDTSFAANFSAKLRSLATSQFPALVPQTVDKKLFFTVGLGLNPCPKGMGNATCQAPNGTRFTASVNNISFVLPNTALLQSHYFKQMKGVYKTNFPDNPPFPFNYTGTPPNNTQAVNGTRVKVLPFNTTVQLILQDTSIFSTDSHPVHLHGFNFFVVGQGVGNYNESTDAPNFNLIDPVERNTVGVPKGGWAAIRFRADNPGVWFMHCHLEVHTSWGLKMAWVVKNGKGPLQTLPPPPSDLPPC

SEQ ID NO: 8765 - protein, 578 aa, Pinus taeda
MLLCACPGVKYWLIVILLMVIQYLDIAAGKHESTTRHYKFNVRLKNVTRLCHSKPLVTVNGRYPGPTIFARGDRVIIKLVNHVKDNVTIHWHGVRQLRSGWADGPGYVTQCPIQTGKSYVYNFTITGQRGTLWWHAHISWLRVSVHGAIIIYPNLHLPYPFPKPHKEVPVILGEWWNANTEKVIQQALQTGGGPNVSDAYTINGLPGPLYNCSNETFVLKVHPGQTYLLRIINPALNDELFLAIANHSLTVVEVDAVYVKPFQTDTLLITPGQTTNVLLTANATSGKNKQFVIAASPFVTGSGTFDNSTVAGIVSYNSHKFKNSSTIILPKFPSFNDTNFAANFSAKLKSLANSQFPALVPQKVDRKFLFTVGLGLNPCPVGVGNTTCQGPNGTKFTASVNNISFVLPSTALLQSHYFNQIKGVYKTNFPDNPPFPFNYTGTPPNNTKPMNGTRVKVIPFNTTVQLVLQDTSIAGTVSHPFHLHGFNFFVVGQGVGNYNESKDAPNFNLVDPVERNTAGVPKGGWMAIRFRADNPGVWFMHCHLEIHKSWGLKMAWIVKDGKGPLQSLPPPPSDLPPC

SEQ ID NO: 8766 - protein, 555 aa, Pinus taeda
MVISKYAAAMSCLLIAVVALNVEAETRHYKFDIKFKNVTRLCHTEPIVTANGKFPGPTIHAREGDTVTVKVTNHVTYNVSIHWHGIRQLRTGWADGPAYITQCPIQTGQTFVYNFTITGQRGTLFWHAHILWLRATLYGPIVILPPKGPYPFPKPHKEVILILGEWWNSDTETVINQAMNSGLAPNSSDSHTINGKAGPLFYCPTKDTFALSVEPDKTYLLRIIKALNQEVFFGVANHHLTVVEVDAVYTKPFETKAIVSAPGQTTNALLHTDKKAGRYFMAARVFMDAPIAVDNKTATAILQYTGSSNSLNPVMPLIPALNDTAFSSNFSNALKSLNSPQYPAKVPQSIDRNLFFTVGLALNACPTCINGARPAASVNNISFTMPTIALLQSHYFNISGVFTTDFPDNPPATFNYTGTPPKNLQSSNGTRLSRIPFNSTVQLVLQDTSALTVENHPVHLHGFNFFIVGRGFGNYNPKKDPAKFNLVDPPERNTVGVPTGGWTVIRFRADNPGVWFMHCHLEVHTTWGLKMAFLVENGHGPEQSILPPGKDLPQC

SEQ ID NO: 8767 - protein, 577 aa, Pinus taeda
MKIHLPAEEMVLSMAACRNIVVKTMLIAMFLLPAAVQGETRHYKFNIQLKNVTRICRTKPIVTVNGEFPGPTIEAREGDTLLIKVTNHVKYNVSIHWHGVRQLRTGWADGPAYITQCPIQTGQTYVYNFTVTGQRGTLWWHAHILWLRATLYGAIVILPPPNVPYPFEPKPHKEITLVLGEWWNADVEAVINEALQTGAAPNISDAHTINGKPGEIFKCPVKDTFTLPVEHGKVYLLRIVNAALNDELFFEVANHLVKVVEVDAVYTKPFDTKAIVIAPGQTTNVLLEANKRSGSYFVAARPFMDAPVTVNNKTATAILHYISRNSESDIPAVNPLMPRLPLLNDTAFATSFTSKLRSLNSVQFPAKVPQTIDRNLFFAVGLATESCQTCNGGLRASASINNISFVMPSISLLDAHIFNISGVFTADFPDKPPTPFNYTGTPPKNLITSKGTRLSRLPFNSTVQLVLQDTSVLTVENHPIHLHGFNFFIVGRGFGNYDPNTDPASFNLVDPPERNTVGVPTGGWTVIRFRADNPGVWFMHCHLEVHTTWGLKMAFLVENGDGPDQSMLPPPSDFPKC

SEQ ID NO: 8768 - protein, 477 aa, Comamonas testosteroni
MSTVLYRCPELLIGGEWRPGRHEQRLVVRNPATGEPLDELRLASADDLQLALQTTQQAFEHWRQVPAHERCARLERGVARLRENTERIAHLLTLEQGKTLAEARMECAMAADLIKWYAEEARRVYGRVIPARLPNSRMEVFKFPVGPVAAFSPWNFPLVLSARKLGGAIAAGCSIVLKAAEETPASVAAMVDCLNQELPPGVVQLLYGVPAEVSQALIASPVVRKVTFTGSVPVGRHLAELSARHLKRITLELGGHAPVIVCGDADIARTVNLMVQHKFRNAGQACLAPTRFFVDRRIYGDFVDAFGAATQALRVGAGMAAETQMGPVASARRQAAVQDLIARSVAAGARPVASAVPEAGYFVAPTLLADVPLDAPVMSEEPFGPVACAVPFDSLDQAIAQANHNPYGLAGYLFTDSAKAILAVSERLEVGSLAVNGMGVSVPEAPFGGVKDSGYGSESGTEGMEAFLDTKFMHYVA

SEQ ID NO: 8769 - protein, 346 aa, Comamonas testosteroni
MLVKNTWYVAGMATDCSRKPLARTFLNEKVVLFRTHDGHAVALEDRCCHRLAPLSLGDVEDAGIRCRYHGMVFNASGACVEIPGQEQIPPGMCVRRFPLVERHGLLWIWMGDPARANPDDIVDELWNGAPEWRTDSGYIHYQANYQLIVDNLLDFTHLAWVHPTTLGTDSAASLKPVIERDTTGTGKLTITRWYLNDDMSNLHKGVAKFEGKADRWQIYQWSPPALLRMDTGSAPTGTGAPEGRRVPEAVQFRHTSIQTPETETTSHYWFCQARNFDLDDEALTEKIYQGVVVAFEEDRTMIEAQQKILSQVPDRPMVPIAADAGLNQGRWLLDRLLKAENGGTAP

SEQ ID NO: 8770 - protein, 816 aa, Toxoplasma gondii
MGGRRRSFFLSTAGALAPAVATTTVSLIVLSSSFPLLSSSSPESEGDRFQVTAATRDVPEEASVAASRELSEEDATLRIDKATTCLLLLPSIIGLFWAVYEAWKVSKIQMDGPLGDDNKRLTDPLYLEMSGNIQQQLNMMKSISRCIADGAVTFLTQEFKYMAVYIVVFSSILGIFVGIRTMAAFVLGALTSILCGFVGMKIAVYSNVRTCHEAWMELGRGFQVALTAGSVMGFALVSLGCLTLVAIILLYRLPSLFGTNPEDQRALFEAVAGYGLGGSSIALFARVGGGIYTKAADVGADLSGKNEYGMSEDDPRNPACIADNVGDNVGDVAGMGADLFGSLAEASCAGLVIAGASIATSASGGPQGLAHSWSGLMFPVLISSTGIFTGIFTVVLVRACFSVRCYDDIEKALKWVMFISTGLEMPVLILLSYFFLPSEFLLDGCQGTTAWWHAAVCVVLGLWAGLAIGYVTEYYTSHSYFPVREISQTQIVSAATGIIYGLALGYSSTVVPIICLGVTILVSHTLCGMYGIALAALGMLSTLTMGLMIDGYGPISDNAGGIAEMAGLGPEVRSRTDALDAAGNTTAAVGKGYAIGSAALVSLALFGAFTVRAHITAVDVLDPWTFTGLLFGAMMPYAFSAMTMKSVGIAASDMVQECLQQFPLIIQGNIEPQYKRCIEISTRASLHEMIAPGALVICAPVAAGMMFGKNCTAGLLAGALVSGIQLAISASTSGSAWDNAKKYIESGALGADHGKGSQAHKNAVTGDTVGDPLKDTSGPSLNILIKLSAIISLVFGAFIAEHFSNAQGGPAWVRVL

SEQ ID NO: 8771 - protein, 816 aa, Toxoplasma gondii
MGGRRRSFFLSTAGALAPAVATTTVSLIVLSSSFPLLSSSSPESEGDRFQVTAATRDVPEEASVAASRELSEEDATLRIDKATTCLLLLPSIIGLFWAVYEAWKVSKIQMDGPLGDDNKRLTDPLYLEMSGNIQQQLNMMKSISRCIADGAVTFLTQEFKYMAVYIVVFSSILGIFVGIPTMAAFVLGALTSILCGFVGMKIAVYSNVRTCHEAWMELGRGFQVALTAGSVMGFALVSLGCLTLVAIILLYRLPSLFGTNPEDQRALFEAVAGYGLGGSSIALFARVGGGIYTKAADVGADLSGKNEYGMSEDDPRNPACIADNVGDNVGDVAGMGADLFGSLAEASCAGLVIAGASIATSASGGPQGLAHSWSGLMFPVLISSTGIFTGIFTVVLVRACFSVRCYDDIEKALKWVMFISTGLEMPVLILLSYFFLPSEFLLDGCQGTTAWWHAAVCVVLGLWAGLAIGYVTEYYTSHSYFPVREISQTQIVSAATGIIYGLALGYSSTVVPIICLGVTILVSHTLCGMYGIALAALGMLSTLTMGLMIDGYGPISDNAGGIAEMAGLGPEVRSRTDALDAAGNTTAAVGKGYAIGSAALVSLALFGAFTVRAHITAVDVLDPWTFTGLLFGAMMPYAFSAMTMKSVGIAASDMVQECLQQFPLIIQGNIEPQYKRCIEISTRASLHEMIAPGALVICAPVAAGMMFGKNCTAGLLAGALVSGIQLAISASTSGSAWDNAKKYIESGALGADHGKGSQAHKNAVTGDTVGDPLKDTSGPSLNILIKLSAIISLVFGAFIAEHFSNAQGGPAWVRVL

SEQ ID NO: 8772 - protein, 517 aa, Lolium rigidum
MDKAYIAILSSAFLFLVHYVLGKVSDGRRGKKGAVQLPPSPPAVPFLGHLHLVEKPIHATMCRLAARLGPVFSLRLGSRRAVVVSSSECARECFTEHDVTFANRPKFPSQLLVSFNGTALVTSSYGPHWRNLRRVATVQLLSAHRVTCMSGVIAAEVRAMARRLFHAAEASPDGAARVQLKRRLFELSLSVLMETIAQTKATRSEADADTDMSLEAQEFKEVVDKLIPHLGAANMWDYLPVMRWFDVFGVRSKILHAVSRRDAFLRRLINAERRRLADGGSDGDKKSMIAVLLTLQKTEPKVYTDTMITALCANLFGAGTETTSTTTEWAMSLLLNHPAALKKAQAEIDASVGTSRLVSVDDVPSLAYLQCIVSETLRLYPAAPLLLPHESSADCKVGGYNVPADTMLIVNAYAIHRDPAAWEDPLEFKPERFEDGKAEGLFMIPFGMGRRRCPGETLALRTIGMVLATLVQCFDWEPVDGVKVDMTEGGGFTIPKAVPLEAVCRPRVVMRDVLQNL

SEQ ID NO: 8773 - protein, 517 aa, Lolium rigidum
MDKAYIAILSCAFLFLVHYVLGKVSDGRRGKKGAVQLPPSPPAVPFLGHLHLVDKPIHATMCRLAARLGPVFSLRLGSRRAVVVSSSECARECFTEHDVTFANRPKFPSQLLVSFNGTALVTSSYGPHWRNLRRVATVQLLSAHRVACMSGVIAAEVRAMARRLFHATEASPDGAARVQLKRRLFELSLSVLMETIAQTKATRSEADADTDMSVEAQEFKEVVDKLIPHLGAANMWDYLPVMRWFDVFGVRNKILHAVSRRDAFLRRLIDAERRRLADGGSDGDKKSMIAVLLTLQKTEPKVYTDTMITALCANLFGAGTETTSTTTEWAMSLLLNHPAALKKAQAEIDASVGTSRLVSVDDVPSLAYLQCIVSETLRLYPAAPLLLPHESSADCKVGGYNVPADTMLIVNAYAIHRDPAAWEDPLEFRPERFEDGKAEGLFMIPFGMGRRRCPGETLALRTIGMVLATLVQCFDWEPVDGVKVDMTEGGGFTIPKAVPLEAVCRPRAVMRDVLQNL

SEQ ID NO: 8774 - protein, 517 aa, Lolium rigidum
MDKAYIAILSCAFLFLVHYVLGKVSDGRRGKKGAVQLPPSPPAVPFLGHLHLVDKPIHATMCRLAARLGPVFSLRLGSRRAVVVSSSECARECFTEHDVTFANRPKFPSQLLVSFNGTALVTSSYGPHWRNLRRVATVQLLSAHRVACMSGVIAAEVRAMARRLFHAAEASPDGAARVQLKRRLFELSLSVLMETIAQTKATRSEADADTDMSVEAQEFKEVVDKLIPHLGAANMWDYLPVMRWFDVFGVRNKILHAVSRRDAFLRRLIDAERRRLADGGSDGDKKSMIAVLLTLQKTEPKVYTDTMITALCANLFGAGTETTSTTTEWAMSLLLNHPAALKKAQAEIDASVGTSRLVSVDDVPSLAYLQCIVNETLRLYPAAPLLLPHESSADCKVGGYNVPADTMLIVNAYAIHRDPAAWEHPLVFRPERFEDGKAEGLFMIPFGMGRRRCPGETLALRTIGMVLATLVQCFDWEPVDGVNVDMTEGGGFTIPKAVPLEAVCRPRAVMRDVLQSI

SEQ ID NO: 8775 - protein, 507 aa, Lolium rigidum
MNLEVAFLHEYASPRALVVAVVLVLVAVHLARSTSRAERLRRKLPCPRFTLPVIGHLHLIGSLPHVGLRDLARKHGPDVMLLRLGAVPTLIVSSPSAARAVLRTHDHVFASRPDTVVGDILFVGSTNVGHSPYGEYWRQVRKIITTHVLTAKKIRANLPYREQEARLALASVREAAAAGTAVDLTHLFSHFAHDMVSQAVAGRIHREDRWGKLFHDLFVGNGQLLGGFNLDDCFPSLARLGIGSANIAKQRKRWDDLLDEVIDRHTSTPMEKGDEPDFIDVMLSVQDEYKLTRNNIKSILMDMFQAGTDTTFIWLDYAMAELARAPQVMAKLQAEVRRCSTTNQLLTQEDLSSMSYLKAVMKETMRLHPPGPLLLPHASIADCEVEGYVVPAGTRVIINVWAIGRHASSWERAEEFVPERFLEGSVDANSDFYGNDFRLLPFGSGRRMCPGINFATLTFEIILANLIYHFDWELPEGSPGVDMTEAFGMDVHRKENLLLVPRVAKIV

SEQ ID NO: 8776 - protein, 510 aa, Lolium rigidum
MDELFLLSVLLAAAAVALLQVLKVALNPVSDRAPPGPWKLPVIGSMHHLVNVLPHRALKDLADVHGPLMMLQMGQTPLVVASSKETARLVLKTHDTNFATRPKLLAGEIVGYEWSDIVFSPSGDYWRKLRQLCVAEILSPKRVLSFCHIREEEVGIRVEQIRAAGPSTPVNLSVMFHSITNSIVARATFGKKRKNAAEFMAAIKSGVGLASGFNIPDLFPTLTTVLATITGMKRSLHGIHTSHTTVDTILEEIINERNIARAEKIKAGATENVDENLTDVLIGLQGKGGFGFHLDNSKIKAIILDMFAGGTGTSASAMEWGMSELMRNPAVMEKLQGQIREAFKGKTVVTEANLQASGLRYLKLVIKEALRLHPPAPLLVPRESIDVCELEGYTIPAKSRVVINAWAIGRDPRYWDDAEEFQPERFEDGTVDFTGSNYEFLPFGAGRRMCPGFNYGLASMELALVTLLYHFDWSLPEGVAEVDMEEAPGLGVRRRTPLMLLATPFVPVVA

SEQ ID NO: 8777 - protein, 507 aa, Lolium rigidum
MDELFLLSVLLAAAAVALLQVLKVALNPVSDRAPPGPWKLPVIGSMHHLVNVLPHRALKDLADVHGPLMMLQMGQTPLVVASSKETARLVLKTHDTNFATRPKLLAGEIVGYEWSDIVFSPSGDYWRKLRQLCVAEILSPKRVLSFCHIREEEVGIRVEQIRAAGLSTPVNLSVMFHSITNSIVARATFGKKRKNAAEFMAAIKSGVGLASGFNIPDLFPTLTTVLATITGMKRSLHGIHTTVDTILEEIINERNIARAEKIKAGATENVDENLTDVLIGLQGKGGFGFHLDNSKIKAIILDMFAGGTGTSASAMEWGMSELMRNPAVMEKLQGQIREAFKGKTVVTEANLQASELRYLKLVIKEALRLHPPAPLLVPRESIDMCELEGYTIPAKSRVVINAWAIGRDPRYWDDAEEFQPERFEDGTVDFTGSNYEFLPFGAGRRMCPGFNYGLASMELALVTLLYHFDWSLPEGVAEVDMEEAPGLGVRRRTPLMLLATPFVPVVA

SEQ ID NO: 8778 - protein, 506 aa, Lolium rigidum
MNDDLVYVCSALAVSILAIAVVQLLKARQRLPPGPLNLPVIGSAHRLVNALPHRAMRDLAGVHGPLMYLRVGQVPLVVVTSKEVAREVLKTHDAIFATRPKLMAGDIVAYGSTDLLFCSTPGDYFRKLRRLCVQEILSNDRIRSYQDIREDEVRSLVEDIRAAGPSAPVDLSRKIYKLTNGIVSRAAFGMKSSKAEDFVAAIKHSFVYSTGFSIADLFPGFTGILSFLTGQRRTLEGVRDTIDGILEEIINEREQILKSGRSTASEKNLVEVLLGLQGNEDFGFPITRSTVKAVILDIFAGGTETSGTSMEWAMSELMANPKVMGKLQGEIRAAFGDKEFISEADLRASGGVMKYLGLVIKETFRLHPPAPILVPRESTEACEINGYVIPAKTRVVINSWAIMRDPRYWEDAEEFRPERFEGGRMDFLGGNFEYTPFGSGRRMCPGYNYGMASMELTLVQLLHSFDWSLPDGVDQLDMTEIVSLSLTRKTHLMLRAAPHRAPLPSS

SEQ ID NO: 8779 - protein, 484 aa, Rhodococcus erythropolis
MQALTSSVPLVIGDQLTPSSTGATFDSINPADGSHLASVAEATAADVARAVEAAKAAARTWQRMRPAQRTRLMFRYAALIEEHKTELAQLQSRDMGKPIRESLGIDLPIMIETLEYFAGLVTKIEGRTTPAPGRFLNYTLREPIGVVGAITPWNFPAVQAVWKIAPALAMGNAIVLKPAQLAPLVPVALGELALEAGLPPGLVNVLPGRGSVAGNALVQHPSVGKVTFTGSTEVGQQIGRMAADRLITASLELGGKSALVAFGDSSPKAVAAVVFQAMYSNQGETCTAPSRLLVERPIYDEVVELVQARVEAARVGDPLDPDTEIGPLISAEQRESVHSYVVSGTEEGATLISGGDQSPTGAPEQGFYYRPTLFSGVTADMRIAREEIFGPVLSVLPFEGEEEAITLANDTVFGLAAGVFTRDVGRALRFAQTLDAGNVWINSWGVLNPASPYRGFGQSGYGSDLGQAAIESFTKEKSIWARLD

SEQ ID NO: 8780 - protein, 589 aa, Leishmania major
MFSVSEHRLPCDALYSRISASRSKPLVGFGGRDASIHVYPFMGYTRSAWLQGLSEPITALGFDPDQTSVVGGSDAGKLQMWDIGSEEVVRVFTRGHASTVTDIDVFRSGQFFATVSTDRILRIWDVRKSSGRQSYKDATAPLCAVQFSPNGRWVATGCARGIVRLYDLVAGKIVHKFELHTGAITSLHFHPDLYYLVVGSGDGTVSVWDLDSFETRFHSSSQHTPIDAVHFSGTRLLATSDHNLRIFDTSNLSDRTAVSLEAPWIMMGDVAYASATDEAWFVETAGATAMKCKLSLRDIRRPGEEAPRVAAAPPASALAPASPSQRVPVATLNSNSSIFADARKKPANGSRPSPMDSPAKTTENDVAEKELRAETSAPTSATLPRPAFSSGGPSFPSTSTPPSNAGESELQMVQQLRHEHGTVSTTLQRRLNTLCTVRTLWMQNQPEAMAHVRQLYNEGQEFGPLFDLLTVLQQSRMKEKLLTESITTFLDLVEIALKTDYEPLILLGLRTLRSICTKFRARMEEAQRRARASQSTGYNDPLGTSQHQHITQKLLNCCPVVFALAERCDGVGEEARAVLPDMPLPPRTQ

SEQ ID NO: 8781 - protein, 677 aa, Xenopus laevis
MNGAAGGVTQAKMTAPKDQDPWSQDEMLTLIQTMKTLLPSQDNSKFKTTESHLDWNKLAFKNYSGSMCRQKWMEISNEVRKFRTLSELILDAEEHVRHPYKGKKLKKHPEFPKKPLTPYFRFFMEKRAKYAKLHPEMSNLDLTKILSKKYKELPEKKKMKYIQDFQREKLEFERNLARFREEHPDLMQNPKKSDVPEKPKTPQQLWYNHERKVYLKLHADASTKDVKDALGKQWSQLTDKKRLKWIHKALEQRKQYEGIMREYMQKHPELNIAEEGITRSTLTKAERQLKDKFDGRPTKPPPNSYSMYCAELMANMKDVPSTERMVLCSQRWKLLSQKEKDAYNKKCEQRKKDYEVELMRFLESLPEEEQQRVLAEEKMVRSRSGQADKKKAADERAKLPETPKTAEEIWQQSVIGDYLARFKNDRAKALKSMEGTWLNMEKKEKIMWIKKAAEDQKRYERELSDMRATPTPTTAGKKVKFLGEPKKAPMNGYQKFSQELLSNGELNHLPLKERMVEIGSRWHRISPSQKDYYKKLAEDQQRVYRTQFDTWMKGLSSQDRAAYKEQNSNKRKSTAKIQVPVAKPKLVAQSKSDDDDEDDDDDEDEDDDDDEDEDKEDSSEDGDSSESSSDEDSEDGEENEDEEGEEDEDEEEDDDDNESGSSSSSSSSADSSDSDSN

SEQ ID NO: 8782 - protein, 701 aa, Xenopus laevis
MNGAAGGDTQGKMTAPKDQDQWSQEDMLTLLQTMKTLLPGQDNSKFKTTESHLDWNKLAFKHYSGSMCRQKWMEISNEVRKFRTLTELILDADEHVRHPYKGKKLKKHPEFPKKPLTPYFRFFMEKRAKYAKLHPEMSNLDLTKILSKKYKELPEKKKMKYIQDFQREKQDFERNMAKFREEHPDLMQNPKKSDVPEKPKTPQQLWYNHERKVYLKLHADASTKDIKDALGKQWSQLPDKKRLKWIHKALEQRKQYEGVMREYMQKHPELNITEEGITRSTLTKAERQLKDKFDGRPTKPPPNSYSMYCAELMANMKDVPSTERMVLCSQRWKLLSQKEKDAYHKKCEQRKKDYEVELMRFLENLPEEEQQRVLAEEKMVGMKRKRTNTPASKMATEDAAKVKSRSGQADKKKAAEERAKLPETPKTAEEIWQQSVIGDYLARFKNDRAKALKVMEATWLNMEKKEKIMWIKKAAEDQKRYERELSDMRSTPAPTTAGKKVKFLGEPKKAPMNGYQKFSQELLSNGELNHLPLKERMVEIGSRWHRISPTQKDYYKKLAEDQQRLYRTQFDTWMKGLSTQDRAAYKEQNTNKRKSTTKIQAPSSKSKLVIQSKSDDDEDDEDDEDEEDDDDDDDEDKEDSSEDGDSSDSSSDEDSEEGEENEDEEDEEDDDEDNEEDDDDNESGSSSSSSSSADSSDSDSN

SEQ ID NO: 8783 - protein, 511 aa, Dictyostelium discoideum
MTDTATSKATVERPKLQSTGSLHSLFKDVDLFSENDEELYPPLQHGARFAAPIEDSTLLALGMKPDELKAFQKQRHAYINKDQIYTDEIKIPNKTEMVDYHQLHLVSPIDQSNASRLLNKLVVIKLNGGLGNSMGCKTAKSTMEIAPGVTFLDMAVAHIEQINQDYNVDVPLVIMNSYKTHNETNKVIEKYKTHKVSIKTFQQSMFPKMYKDTLNLVPKPNTPMNPKEWYPPGSGDIFRSLQRSGLIDEFLAAGKEYIFISNVENLGSIIDLQVLNHIHLQKIEFGLEVTNRINTDSTGGILMSYKDKLHLLELSQVKPEKLKIFKDFKLWNTNNIWVNLKSVSNLIKEDKLDLDWIVNYPLENHKAMVQLETPAGMGIQNFKNSVAIFVPRDRYRPIKSTSQLLVAQSNIFQFDHGQVKLNSKREGQDVPLVKLGEEFSTVSDYEKRFKSIPDLLELDHLTVSGDVYFGSRITLKGTVIIVANHGERVDIPDGVVLENKVLSGTLRILDH

SEQ ID NO: 8784 - protein, 477 aa, Solanum tuberosum
MATATTLSPADAEKLNNLKSAVAGLNQISENEKSGFINLVGRYLSGEAQHIDWSKIQTPTDEVVVPYDKLAPLSEDPAETKKLLDKLVVLKLNGGLGTTMGCTGPKSVIEVRNGLTFLDLIVKQIEALNAKFGCSVPLLLMNSFNTHDDTLKIVEKYANSNIDIHTFNQSQYPRLVTEDFAPLPCKGNSGKDGWYPPGHGDVFPSLMNSGKLDALLAKGKEYVFVANSDNLGAIVDLKILNHLILNKNEYCMEVTPKTLADVKGGTLISYEGKVQLLEIAQVPDEHVNEFKSIEKFKIFNTNNLWVNLSAIKRLVEADALKMEIIPNPKEVDGVKVLQLETAAGAAIKFFDRAIGANVPRSRFLPVKATSDLLLVQSDLYTLTDEGYVIRNPARSNPSNPSIELGPEFKKVANFLGRFKSIPSIIDLDSLKVTGDVWFGSGVTLKGKVTVAAKSGVKLEIPDGAVIANKDINGPEDI

SEQ ID NO: 8785 - protein, 758 aa, Macaca fascicularis
MPIAQLLELWKKIEVEPMGIETTEEDLNVDAEPATEDTAEEGKSDSAASKTKVAGSAEEEGIVKEIDISHHVKEGFEKADPSQFELLKVLGQGSYGKVFLVRKVKGSDAGQLYAMKVLKKATLKVRDRVRSKMERDILAEVNHPFIVKLHYAFQTEGKLYLILDFLRGGDLFTRLSKEVMFTEEDVKFYLAELALALDHLHGLGIIYRDLKPENILLDEEGHIKITDFGLSKEAIDHDKRAYSFCGTIEYMAPEVVNRRGHTQSADWWSFGVLMFEMLTGSLPFQGKDRKETMALILKAKLGMPQFLSGEAQSLLRALFKRNPCNRLGAGIDGVEEIKRHPFFVTIDWNKLFRKEIKPPFKPAVGRPEDTFHFDPEFTARTPTDSPGVPPSANAHHLFRGFSFVASSLIQEPSQQDLHKVAVHPIVQQLHGNNIHFTDGYEIKEDIGVGSYSVCKRCVHKATDTEYAVKIIDKSKRDPSEEIEILLRYGQHPNIITLKDVYDDGKFVYLVMELMRGGELLDRILQQRYFSEREASDVLCTITKTMDYLHSQGVVHRDLKPSNILYRDESGSPESIRVCDFGFAKQLRAGNGLLMTPCYTANFVAPEVLKRQGYDAACDIWSLGILLYTMLAGFTPFANGPDDTPEEILARIGSGKYALSGGNWDSISDAAKDVVSKMLHVDPHQRLTAMQVLKHPWVVNREYLSQNQLSRQDVHLVKCAMAATYFALNRAPQAPRLEPVLSSNLAQRRGMKRLTSTRL

SEQ ID NO: 8786 - protein, 454 aa, Triticum aestivum
MLPRQCFKHVFPAEGSSSSILHGPGSRGAGSRGRTTLNFHRCCVRASLWRTDHLHISTARSSEIKVHTLLQVPDVFNTIKSWSKLQLVTVTGLAACVVLLVPSAGATDALKTCTCLLKECRIELAKCIANPSCAANVACLNTCNNRPDETECQIKCGDLFENSVVDEFNECAVSRKKCVPKKSDVGEFPVPDPSALVKNFNMADFRGKWYISSGLNPTFDTFDCQLHEFRLEGDRLVANLAWRIPTPDTGFFTRGAVQRFVQDSSQPAILYNHDNEYLHYQDDWYILSSKIENKDDDYIFVYYRGRNDAWDGYGGAVVYTRSKELPETIVPELERATKSVGRDFSTFIRTDNTCGAEPPLADRIERTVEKGEKLIVDEVKEIEGEIEGEVKELEREEETLVKRLADGIMEVKQDVMNFFQGLSKEEMEILDQLNLEATEVEELFSRSLPIRKLR

SEQ ID NO: 8787 - protein, 336 aa, Arabidopsis thaliana
MAACIDTCRTGKPQISPRDSSKHHDDESGFRYMNYFRYPDRSSFNGTQTKTLHTRPLLEDLDRDAEVDDVWAKIREEAKSDIAKEPIVSAYYHASIVSQRSLEAALANTLSVKLSNLNLPSNTLFDLFSGGLQGNPDIVESVKLDLLAVKERDPACISYVHCFLHFKGFLACQAHRIAHELWTQDRKILALLIQNRVSEAFAVDFHPGAKIGTGILLDHATAIVIGETAVVGNNVSILHNVTLGGTGKQCGDRHPKIGDGVLIGAGTCILGNITIGEGAKIGAGSVVLKDVPPRTTAVGNPARLLGGKDNPKTHDKIPGLTMDQTSHISEWSDYVI

SEQ ID NO: 8788 - protein, 354 aa, Oryza sativa; identical to SEQ ID NO: 3682

SEQ ID NO: 8789 - protein, 227 aa, Nicotiana tabacum
MARGKIQIKRIENQTNRQVTYSKRRNGLFKKANELTVLCDAKVSIIMISSTGKLHEFISPSVTTKQLFDLYQKTVGVDLWNSHYEKMQEQLRKLKDVNRNLRREIRQRMGESLNDLNYEQLEELNENVDNSLKLIRERKYKVIGNQIDTYKKKVRNVEEIHRNLLLEFDARQEDPYGLVEQEGDYNSVLGFPNGGPRILALRLQPNHQPNHHLHSGGGSDITTFALA

SEQ ID NO: 8790 - protein, 260 aa, Oryza sativa (japonica cultivar-group); identical to SEQ ID NO: 3123

SEQ ID NO: 8791 - protein, 334 aa, Rattus norvegicus
MGNPLLDISAVVDKDFLDKYSLKPNDQILAEDKHKELFDELVKKFKVEYHAGGSTQNSMKVAQWMIQEPHRAATFFGCIGIDKFGEILKSKAANAHVDAHYYEQNEQPTGTCAACISGGNRSLVANLRAANCYKKEKHLDLENNWMLVEKARVYYIAGFFLTVSPESVLKMARYAAENNRTFTLNLSAPFISQFFKEALMAVMPYVDILFGNETEAATFAREQGFETKDIKEIARKTQALPKVNSKRQRTVIFTQGRDDTIVATGNDVTAFPVLDQNQEEIVDTNGAGDAFVGGFLSQLVSNKPLTECIRAGHYAASVIIRRTGCTFPEKPDFH

SEQ ID NO: 8792 - protein, 292 aa, Xenopus laevis
MAAKGVEVARIAKKLDKMVAKKNTGGALDLLRELKNMPITLELLQSTHVGMSVNALRKQSNDNEIITLSKSLIKSWKKLLDGSEQPGKEKLQVKPTCSKELGSSKKIEVPKTTAPSKMTRFPPLPVTSDSVRTKCREMLIAVLQTDGDHVAIGADCELLAAQIEEVVFRELQNTDMKYKNRIRSRISNLKDSKNPDLRKNVLCGIITPEQIAIMSCEEMASNELKEMRKEITKASIQEHQMGKTGGTQSDLFTCGKCKKKNCTYTQVQTRSADEPMTTFVVCNECGNRWKFC

SEQ ID NO: 8793 - protein, 329 aa, Pseudomonas sp. ATCC19151
MICNERMVIYRGAGQRVAALEDFCPHRGAPLSLGSIQDGKLVCGYHGLVMDCDGRTASMPAQRVQAFPCIRAFPAQERHGFIWVWPGDAALADPALIPHLEWAENPAWAYGGGLYHIACDYRLMIDNLMDLTHETYVHASSIGQKEIDEAPVSTRVEGDRLITGRFMEGILAPPFWRAALRGNGLADDVPVDRWQICRFTPPSHVLIEVGVAHAGRGGYDAPADCKASSIVVDFITPETDTSIWYFWGMARSFRPEDNELTARIREGQGTIFAEDLEMLEQQQRNLLAWPERPLLKLNIDAGGVQSRRIIERLVSAERAAEAQLIGRQA

SEQ ID NO: 8794 - protein, 120 aa, Fusobacterium nucleatum
SMLKARKGSIITLSSVVGLHGNAGQTNYAATKGGVVAMSKTWAKEFGGRNVRANCVAPGFIQTPMTDVLSEDTIKGMLDATPLGRLGQVEDIANGVLFLASDESSFITGEVISVSGGLML

SEQ ID NO: 8795 - protein, 923 aa, Xenopus laevis
VEMIASKVSNEFNHLCSDTNKQQSDLNSNGTEQDKSLVVHKKRKSQQAGTSYAQSCEVKEYQRLLRLQPKSDEDNDSSFSDCISSPSSSSHFGDSDTMTSDEDKDNPLSSVNSTPRTQSARAQKWPRPHTDSVSSLLMKRPCYQVSSLRRPLHRKRFVKNVSSQRTQKQKERIMLQRKKREVLARQKYALLPSSSSSSENDLSSESSSSSSTEGEEDLFVSPGENHQDGTTLPSGGMDEDVVVIEASSTPQVTANEEINVTSTDSEVEIVTVGETYRSRATLGHPRSHWGQNSQSGRTQEQRTRNRVSTIIQPLRQNTTEVVDLTVDEDDPTVVPTTSGRVESQPVSIVSSLTSTSEPASDSMSGLMGSAVPEIPAIPPNTVGTIADDSRTCTSGANADGGPPAMPRLPSCCPQHSPCGGSSQNHVLGHPHSSCFPPHSHHFPHHHHHHHHSSHPGVPLSPSFRDSHCTVERNAAVPPPCGVSSSSGSTYHDPQALPVDLSNNGIRSHGSVGFHSTSAFDPCCPGSSSRSTVYGHQATTSTAQTMAIDGYGSSMVAQAQPPPPLSSCRHYMHASYTSLPRPLHHQTSSCPHSNSASQPPPPPPPPPPPPMDYVIAHQVPFISPLPSLTSTHAVPPPPPSHHLSAAAAPLPQHLSTSHQSMSHHISATAPATQRLHAHEVIQRMEVQRRRMMQHPTRAHERPPPHPHRMHPNYGHGHHIHVPQTMSSHPRQGPERSAWEIAIETGVTAAPYQTGPLHTHLAPYHPPPRLHHLQIGALPLMVPDMAGYPHIRYISSGLDGRSFRVPFRGNFEELIHLEERLGNVNRGASQGTIERCTYPHKYKKVSTDWFSQRKLHSKQDGEEAPEEDTEEKCTICLSILEEGEDVRRLPCMHLFHQVCVDQWLITNKKCPICRVDIDTQLPTES

SEQ ID NO: 8796 - protein, 491 aa, Nicotiana tabacum
MVLSKTSSESDVSVHSTFASRYVRTSLPRFEMAENSIPKEAAFQIINDELMLDGNPRLNLASFVTTWMEPECDKLMMDSINKNYVDMDEYPVTTELQNRCVNMIARLFNAPLEEKETAVGVGTVGSSEAIMLAGLAFKRNWQNKRKAEGKPYNKPNIVTGANVQVCWEKFANYFEVELKEVKLREGYYVMDPVQAVEMVDENTICVAAILGSTLNGEFEDVKLLNDLLIEKNKQTGWNTPIHVDAASGGFIAPFLYPELEWDFRLPLVKSINVSGHKYGLVYAGIGWVIWRTKQDLPEELIFHINYLGADQPTFTLNFSKGSSQVIAQYYQLIRLGYEGYRNVMENCRENAIVLREGLEKTGRFNIVSKDEGVPLVAFSLKDNSRHNEFEVSETLRRFGWIVPAYTMPADAQHVTVLRVVIREDFSRTLAERLVLDIVKVLHELDTLPARLSAKLEEVKLVKNGKKFELEVQREVTNYWKKFVLARKAPVC

SEQ ID NO: 8797 - protein, 347 aa, Psophocarpus tetragonolobus
GGELFDRIVQKGHYSERQAATLIKTIVEVVEACHSLGVMHRDLKPENFLFDTLHEDAKLKATDFGLSVFYKPGESFCDVVGSPYYVAPEVLRKLYGPESDVWSAGVILYILLSGVPPFWAETEPGIFRQILLGKIDFQSEPWHSISDSAKDLIRRMLDQNPKTRLTAHEVLRHPWIVDDNLAPDKPLDSAVLSRLKQFSAMNKLKKMALRVIAERLSEEEIGGLKELFKMIDTDNSGTITFDELKDGLKRVGSELMESEIKDLMDAADIDKSGTIDYGEFIAATVHLNKLEREENLVSAFSYFDKDGSGYITLDEIQQACKDFGLDDVHIDDMIKEIDQDNDGQIDY

SEQ ID NO: 8798 - protein, 448 aa, Oculimacula yallundae
MSPSAITTLETQTSLTNIHSYYENPKSSFVEPEVNNHGVNNPKKLIGDALKERIENIDQDACEPGDEDAFFVADLGEVYRQHMRWKLNLPRVKPFYAVKCNPDNRVIQLLAALGTGFDCASKAEIEQVIKADVDPSRIIYAQPCKTNSYVRYAANHNVKQMTFDNADELHKVKKLFPGAELFLRISTDDSSSLCRLSLKFGAAMDTTDGLLALAKELDLNVVGVSFHVGSGASDPLAYMRAVQDARLVFDQAAAHGFSLHTLDIGGGFVSESFEAMASVLCEALDTYMPSHINIIGEPGRYYVSSAFSVACHIIARRTIVEPASSEKSYMIYLNDGLYGNFSSIMFDHQNPIAQVLRTGDRTYFNNIAAQDSVDGTEYSIWGPTCDGIDRISESIRFDHTLDVGDWLYFEEMGAYTKCSATRFNGFSDAHEVIYVASEPGARALLGMN

SEQ ID NO: 8799 - protein, 151 aa, Catharanthus roseus
MEVGQLQRSFVEFTESLFREGFLDAQFCQLQQLQDENNPDFVIEVVSLFFEDSEKLLNDLTRALDQQDVDFKKVDACVHQLKGSSSSIGAERVKNACIAFRNFCDELNIDACLRCLQHVKQEYLLVKNKLETLFRLEQQILAAGGAIPMVE

SEQ ID NO: 8800 - protein, 445 aa, Eimeria tenella
MVAIVEVKAREILDSRGNPTVEVDLKTEQGCFRAAVPSGASTGIYEALELRDGDKTRYNGKGVLKAVENVNKVLAPALVGKDCREQAALDRLMVEELDGSKNEWGWSKSVLGANAILAVSMALCRAGAAAKGIPLYKYVAQLAGHEAPEFVLPVPCFNVLNGGKHAGNSLAMQEFMVAPVGARSFGEALRMGAEVYQALQRLLKAKFGLAATNVGDEGGFAPDIKDPREALGLLVEAIRAAGHEGKVKIMADVAASEFYSKEAKSYDLDFKSPAADAHRLLTGDQLKDLFKEWSEEFPIVSIEDPFDQDDFSSYAALTAEIGSKVQVVGDDLLVTNPARIRKALQHKACNALLLKVNQIGSITEAIEACKLAQASGWGVMVSHRSGETEDSFIADLVVGLRTGQIKTGAPCRSERLCKYNQLLRIEEQLQGRCTYAGENFRNPSN

SEQ ID NO: 8801 - protein, 267 aa, Mus musculus
MVVVAAAPSAATAAPKVLLLSGQPASGGRALPLMVPGPRAAGSEASGTPQARKRQRLTHLSPEEKALRRKLKNRVAAQTARDRKKARMSELEQQVVDLEEENHKLQLENQLLREKTHGLVVENQELRTRLGMDTLDPDEVPEVEAKGSGVRLVAGSAESAALRLCAPLQQVQAQLSPPQNIFPWTLTLLPLQILSLISFWAFWTSWTLSCFSNVLPQSLLVWRNSQRSTQKDLVPYQPPFLCQWGPHQPSWKPLMNSFVLTMYTPSL

SEQ ID NO: 8802 - protein, 315 aa, Homo sapiens
MHREPAKKKAEKRLFDASSFGKDLLAGGVAAAVSKTAVAPIERVKLLLQVQASSKQISPEARYKGMVDCLVRIPREQGFFSFWRGNLANVIRYFPTQALNFAFKDKYKQLFMSGVNKEKQFWRWFLANLASGGAAGATSLCVVYPLDFARTRLGVDIGKGPEERQFKGLGDCIMKIAKSDGIAGLYQGFGVSVQGIIVYRASYFGAYDTVKGLLPKPKKTPFLVSFFIAQVVTTCSGILSYPFDTVRRRMMMQSGEAKRQYKGTLDCFVKIYQHEGISSFFRGAFSNVLRGTGGALVLVLYDKIKEFFHIDIGGR

SEQ ID NO: 8803 - protein, 294 aa, Nicotiana tabacum
MDQYEKVEKIGEGTYGVVYKARDRVTNETIALKKIRLEQEDEGVPSTAIREISLLKEMQHANIVRLQDVVHSEKRLYLVFEYLDLDLKKHMDSSPEFSKDPRLVKMFLYQILRGIAYCHSHRVLHRDLKPQNLLIDRRTNALKLADFGLARAFGIPVRTFTHEVVTLWYRAPEILLGTRHYSTPVDVWSVGCIFAEMVTQRPLFPGDSEIDELFKIFRVMGTPNEDTWPGVTTLPDFKSAFPKWPSKDLATIVPNLDGAGLDLLDKTSRLDPSKRITARNALEHEYFKDIGYVP

SEQ ID NO: 8804 - protein, 127 aa, Rattus norvegicus
MSSEEGKLFVGGLNFNTDEQALEDHFSSFGPISEVVVVKDRETQRSRGFGFITFTNPEHASDAMRAMNGESLDGRQIRVDHAGKSARGTRGGAFGAHGRGRSYSRGGGDQGYGSGRYDSRPGGYGYG

SEQ ID NO: 8805 - protein, 321 aa, Rattus norvegicus
DLQEDEDGVYFSSYGHYGIHEEMLKDKVRTESYRDFIYQNPHIFKDKVVLDVGCGTGILSMFAAKAGAKKVIAVDQSEILYQAMDIIRLNKLEDTIVLIKGKIEEVSLPVEKVDVIISEWMGYFLLFESMLDSVLYAKSKYLAKGGSVYPDICTISLVAVSDVSKHADRIAFWDDVYGFNMSCMKKAVIPEAVVEVVDHKTLISDPCDIKHIDCHTTSISDLEFSSDFTLRTTKTAMCTAVAGYFDIYFEKNCHNRVVFSTGPQSTKTHWKQTIFLLEKPFPVKAGEALKGKITVHKNKKDPRSLIVTLTLNSSTQTYSLQ

SEQ ID NO: 8806 - protein, 780 aa, Caenorhabditis elegans
MSGRSGNGGQQKMRIRPFMATIDEQYVTQTWELLKRAIQEIQRKNNSGLSFEELYRNAYTMVLHKHGERLYNGLKDVIQDHMASVRIRIIESMNSGSFLETVAESWADHTVAMVMIRDILMYMDRIYVAQNNHVLPVYNLGLDAYRTEILRQNGIGDRIRDALLELIKLDRKSNQINWHGIKNACDMLISLGIDSRTVYEDEFERPLLKETSDYYRDVCKNWLSGDNDACFYLAQVEIAMHDEASRASRYLDKMTEAKILQVMDDVMVAEHIQTIVYMQNGGVKFMLEHKKIEDLTRIFRIFKRIGDSVTVPGGGLKALLKAVSEYLNETGSNIVKNEDLLKNPVNFVNELLQLKDYFSSLLTTAFADDRDFKNRFQHDFETFLNSNRQSPEFVALYMDDMLRSGLKCVSDAEMDNKLDNVMILFRYLQEKDVFEKYFKQYLAKRLLLDKSCSDDVEKALLAKLKTECGCQFTQKLENMFRDKELWLTLATSFRDWREAQPTKMSIDISLRVLTAGVWPTVQCNPVVLPQELSVAYEMFTQYYTEKHTGRKLTINTLLGNADVKATFYPPPKASMSNEENGPGPSGSGESMKERKPEHKILQVNTHQMIILLQLNHHNRISCQHEQQLMDELKIPERELKRNLQSLALGKASQRILVRKNKGKDAIDMSDEFAVNDNFQSKLTRVKVQMVTGKVESEPEIRETRQKVEDDRKLEVEAAIVRIMKARKKLNHNNLVAEVTQQLRHRFMPSPIIIKQRIETLIEREYLARDEHDHRAYQYIA

SEQ ID NO: 8807 - protein, 752 aa, Homo sapiens
MSSTRSQNPHGLKQIGLDQIWDDLRAGIQQVYTRQSMAKSRYMELYTHVYNYCTSVHQFVGLELYKRLKEFLKNYLTNLLKDGEDLMDESVLKFYTQQWEDYRFSSKVLNGICAYLNRHWVRRECDEGRKGIYEIYSLALVTWRDCLFRPLNKQVTNAVLKLIEKERNGETINTRLISGVVQSYVELGLNEDDAFAKGPTLTVYKESFESQFLADTERFYTRESTEFLQQNPVTEYMKKAEARLLEEQRRVQVYLHESTQDELARKCEQVLIEKHLEIFHTEFQNLLDADKNEDLGRMYNLVSRIQDGLGELKKLLETHIHNQGLAAIEKCGEAALNDPKMYVQTVLDVHKKYNALVMSAFNNDAGFVAALDKACGRFINNNAVTKMAQSSSKSPELLARYCDSLLKKSSKNPEEAELEDTLNQVMVVFKYIEDKDVFQKFYAKMLAKRLVHQNSASDDAEASMISKLKQACGFEYTSKLQRMFQDIGVSKDLNEQFKKHLTNSEPLDLDFSIQVLSSGSWPFQQSCTFALPSELERSYQRFTAFYASRHSGRKLTWLYQLSKGELVTNCFKNRYTLQASTFQMAILLQYNTEDAYTVQQLTDSTQIKMDILAQVLQILLKSKLLVLEDENANVDEVELKPDTLIKLYLGYKNKKLRVNINVPMKTEQKQEQETTHKNIEEDRKLLIQAAIVRIMKMRKVLKHQQLLGEVLTQLSSRFKPRVPVIKKCIDILIEKEYLERVDGEKDTYSYLA

SEQ ID NO: 8808 - protein, 297 aa, Guillardia theta
MKLNCSQSKSLVFKKFNFLFSKFSRLIVVKIENLNSEQIKKCKRLLNNTSILITGKNTLIKKVLRDRLKNSTLSNEILTKINGNVSFIFTNEDPFFIQEILKNNSLPTAAKIGQVAQSDVYLSQGLTNISPDGIGIFQSLNIPTKILKGQIEIITNFKVLEKGKKINEAEATLLQKLNILPFYNEIKIISFYENGKSYDPSVLNFNESMFDKSFKDCLSSIESLLEKICFLHEDVIKRFILNTKRNIKLIYNYTKFPLFDNQIMENNRFQNNIVLDKITEKNEEKSSSSELVLDLFN

SEQ ID NO: 8809 - protein, 303 aa, Guillardia theta
MDNYKRIEILGQGAYGKVYKAQDLRNGNLVALKKALSSSDEEGIPPTTLREISILKSVSECEFIVKLLDVVNTKSKNGKISIYIVFQYLDSDLKSYMISNYGKGRGMDENSAKKFCFQLLIGMYHCHKLGIIHRDLKPQNILIEKGEKLKIADFGLSRNFSIPVGKYTHEVVTLWYRAPEILLGARTYSSPVDIWSIGCIFAEMLTGNPLFCGESEIEQLLSIFKTIGTPTSQTWPEVLNFKDWHEFPIWPQINLKYSFENISEETLEFIQVFLRLNPNKRISILGAITNTYFEHFFKDYNLY

SEQ ID NO: 8810 - protein, 460 aa, Guillardia theta
MFFNLLIDSKFTISNNSIPFFFGNNSKHRCIHKNLVIYKKNIHISLLKIETKQLDEELTYMTSKKNFHELTEGEMFEVIKSFGIQGSASIENTEEDDFYQNNGLSKNIQKADDSVRWYLQLIGRVRLLRPDEEIQLAREISQLLHWEHVKISLRDKLRREPTNSEWTAACKVSDVRKFRSILHNARRAKERMVAANLRLVVSIAKRYVNRGMSLQDLIQEGSLGLIRAAEKFDSEKGFKFSTYATWWVKQAVTRAIADHSRTIRLPVHLYDTISAIRKTTRNLNIEIGRSPTEEEIAKRMDMSVEKLRNVLQSAQPTLSLERPLKNDDDTSQLSDFIEADQESPEEHVEKSMLRDDLENVINSLSPRERDVVRMRYGLDDGRIKTLEEIGQIFSVTRERVRQIEAKAIRKLRQPYRSSILRDYVASNSNEKSSAINTSYMTNSKQIIKGINNTRVLKKKF

SEQ ID NO: 8811 - protein, 104 aa, Guillardia theta
MTVGKGKVGKGLGKRGTKRHKKVLRDSIQGITKPAIRRLARRGGVKRISGLIYEETKIVLKLFLENVVKDAVTYTEHARRKTVTAMDVIYALKRQGRTIYGFGY

SEQ ID NO: 8812 - protein, 347 aa, Guillardia theta
MKLLLYDDLKTLFNYKIKKKNNTIVHFLYLLYENVHESLNINNTRNFLWCFMIKFSVEIKKRIKFDYKSCHINFYSFFDNLLEAGNVLNFEKLILNILFNFRKIQFLYIPFTNVMKVQTEINKNMRKILIDWIIDVHHKFKLLSKTLFLTINIIDRFLCLKKIGKQKLQLLGITSMFIASKYEEIYAPEIRDFIYICDNAYSKEDIIKMEQLICFVLRFKFNLPSPQSFLSLWMKILCLKLDSIFFSNKCLELCLIEINTLRYNFEIISLSCIFLSLKFSGNISLKILMNIFRIDSKKNFSLVKSCGLIGSLLLLYQSSYCGQNHLHFKYSSNKHKEFMSRRFHIYF

SEQ ID NO: 8813 - protein, 185 aa, Guillardia theta
MSEKSNLAPFIKKLYQLVNDPMTNDYICWEKNETCFIVNKPTELSVYILPRYFKHNNFSSFVRQLNQYGFHKLEPNEWVFGHPYFKGGDKLKLSSIKRKKQWSSQKNVSVDFYNNEIFKKLIYELDTLKKYKQVLTKDILDVCRRQERFLIKQQSIETKIKKIEEELNNLKYLVFGYFGKILKSN

SEQ ID NO: 8814 - protein, 97 aa, Guillardia theta
MKLSKTIYVGSLSKKLKENFLWYFFSRLGKIKRLIIGINNKTLLPCGFCFVEYFFDFNFELSFKVLSGFRIFNHFIKLDKDNGFKDNRQLSRKIVLE

SEQ ID NO: 8815 - protein, 232 aa, Guillardia theta
MIQYALKSNASYHSRFKLKKRRRRIGKTDYKKRMKLIRQDKKKFENKKKRIIIRFSKRNLSLQMVNSNVDGDFILLSSYLKNLSKLEYKNLTNNYPFSYLLGYYFGKDLIEKVKQSETYNKKNYSSKITAIIDIGLKRATIGNKSFASMKGSVDSGINIPHNYNKIFKVKNNEIDSKELFNERSKGIHIIKYIDLLKNEDEEKLKKQFSNIFLSRDSLSTIKKNYLIKNKNK

SEQ ID NO: 8816 - protein, 311 aa, Guillardia theta
MDFSFKCIWNEKYHSDAITSISNCKNNKSLFASSSRDKTILIWKVEDEESDKMVIALKRLKGHSHFVSCVKLSNNGDFCISSSWDNSLRLWDLMSAKTLRTLNGHKKSVLSVSFSEDERQIISCSRDCTIRIWNTVGECKKTLIDKGSSSWICNVILITNRNDEIISSNWDGEINLWNLRESKIQKKLIGHKNYVKELAISPDGSLCASGGGDKSIILWDLNEGKHLYSLEINDRIVSITFSPNHYWLTIGSYTKIMIWDLETKKMIFEYSLNDTVHDKIKAGKIYSLFWDNAGSKVIIGTIDGLIKILKY

SEQ ID NO: 8817 - protein, 232 aa, Arabidopsis thaliana
MARGKIQIKRIENQTNRQVTYSKRRNGLFKKAHELTVLCDARVSIIMFSSSNKLHEYISPNTTTKEIVDLYQTISDVDVWATQYERMQETKRKLLETNRNLRTQIKQRLGECLDELDIQELRRLEDEMENTFKLVRERKFKSLGNQIETTKKKNKSQQDIQKNLIHELELRAEDPHYGLVDNGGDYDSVLGYQIEGSRRYALRFHQNHHHYYPNHGLHAPSASDIITFHLLE

SEQ ID NO: 8818 - protein, 366 aa, Escherichia coli
MLPLHLLPVNRWKSLKLTLHHRKKGEVLIKVTHTGVCHTDAFTLSGDDPEGVFPVVLGHEGAGVVVEVGEGVTSVKPGDHVIPLYTAECGECEFCRSGKTNLCVAVRETQGKGLMPDGTTRFSYNGQPLYHYMGCSTFSEYTVVAEVSLAKINPEANHEHVCLLGCGVTTGIGAVHNTAKVQPGDSVAVFGLGAIGLAVVQGARQAKAGRIIAIDTNPKKFDLARRFGATDCINPNDYDKPIKDVLLDINKWGIDHTFECIGNVNVMRAALESAHRGWGQSVIIGVAVAGQEISTRPFQLVTGRVWKGSAFGGVKGRSQLPGMVEDAMKGDIDLEPFVTHTMSLDEINDAFDLMHEGKSIRTVIRY

SEQ ID NO: 8819 - protein, 379 aa, Pennisetum glaucum
MATAGKVIKCKAAVAWEAGKPLSIEEVEVAPPQAMEVRVKILYTSLCHTDVYFWEAKGQTPVFPRIFGHEAGGIIESVGEGVTDVAPGDHVLPVFTGECKECPHSKSAESNMCDLLRINTDRGVMIGDGKSRFSINGKPIYHFVGTSTFSEYTVMHVGCVAKINPEAPLDKVCVLSCGISSGLGASINVAKPPKGSTVAIFGLGAVGLAAAEGARIAGASRIIGVDLNPSRFEEAKKFGCTEFVNPKDHNKPVQEVLADMTNGGVDRSVECTGNINAMIQAFECVHDGWGVAVLVGVPHKDAEFKTHPMNFLNERTLKGTFFGNFKPRTDLPNVVELYMKKELEVEKFITHSVPFSEINKAFDLMAKGEGIRCIIRMEH

SEQ ID NO: 8820 - protein, 379 aa, Pennisetum glaucum
MATAGKVIKCKAAVAWEAGKPLSIEEVEVAPPQAMEVRVNILYTSLCHTDVYFWEAKGQTPVFPRIFGHEAGGIIESVGEGVTDVAPGDHVLPVFTGECKECPHCKSAESNMCDLLRINTDRGVMIGDGKSRFSINGKPIYHFVGTSTFSEYTVMHVGCVAKINPEAPLDKVCVLSCGISTGLGASINVAKPPKGSTVAIFGLGAVGLAAAEGARIAGASRIIGVDLNPSRFEEAKKFGCTEFVNPKDHNKPVQEVLADMTNGGVDRSVECTGNINAMIQAFECVHDGWGVAVLVGVPHKDAEFKTHPMNFLNERTLKGTFFGNFKPRTDLPNVVELYMKKELEVEKFITHSVPFSEINKAFDLMAKGEGIRCIIRMEH

SEQ ID NO: 8821 - protein, 516 aa, Oryza sativa (japonica cultivar-group); identical to SEQ ID NO: 1208

SEQ ID NO: 8822 - protein, 215 aa, Oryza sativa (japonica cultivar-group); identical to SEQ ID NO: 734

SEQ ID NO: 8823 - protein, 159 aa, Oryza sativa (japonica cultivar-group); identical to SEQ ID NO: 3227

SEQ ID NO: 8824 - protein, 553 aa, Macaca fascicularis
MVQRLWVSRLLRHRKAQLLLINLLTFGLEVCLAAGITYVPPLLLEVGVEEKFMTMVLGIGPVLGLVSVPLLGSASDHWRGRYGRRRPFIWALSLGILLSLFLIPRAGWLAGLLCPDPRPLELALLILGVGLLDFCGQVCFTPLEALLSDLFRDPDHCRQAYSVYAFMISLGGCLGYLLPAIDWDTSALAPYLGTQEECLFGLLTLIFLTCVAATLLVAEEAALGPAEPAEGLSAPSLPSHCCPCWARLAFRNLGALLPRLHQLCCRMPRTLRRLFVAELCSWMALMTFTLFYTDFVGEGLYQGVPRAELGTEARRHYDEGVRMGSLGLFLQCAISLVFSLVMDRLVQRFGTRAVYLASVAAFPVAAGATCLSHSVAVVTASAALTGFTFSALQILPYTLASLYHRERQVFLPKYRGDAGGTSSEDSLMTSFLPGPKPGAPFPNGHVGAGGSGLLPPPPALCGASACDVSVRVVVGEPTEARVVPGRGICLDLAILDSAFLLSQVAPSLFMGSIVQLSQSVTAYMVSAAGLGLVAIYFATQVVFDKSDLAKYSV

SEQ ID NO: 8825 - protein, 333 aa, Arabidopsis thaliana
MAMGFDFNEMNKTKKTLIGLGLGQILSLLCTSNAFTSSELARKGINAPTSQTFLSYTLLAVVYGGIMLYRRPTIKGKWYHYFLLALVDVEGNFLVVKANQYSSITSIMLLDCWAIPCVLVLTWMFLKTKYRLMKISGVFICIAGVVMVLFSDVHAGSRAGGSNPVKGDFLVLAGATLYAVSNTTEEFLVKNADTVELMTFMGLFGAIISAIQVAIFEQGELKAIHWSADAVFPFLRFAITMFLFYSLLPILLRTNGSTMFTLSLLTSDMWAVLIRIFAYHEKVDWLYYLAFATTAIGLIIYSMKEKDEEEEREEQRKKLLDEEEGQSLPDTSL

SEQ ID NO: 8826 - protein, 366 aa, Arabidopsis thaliana
MENQEEDEVVLAKVTSEVEDNFEDEGLVSNSTLEKVAAAKKYIENHYNRRMRHIQQRKERRWVLEQKIASLDVSEKEQLELLEDLQRKETEYTRLMRNRLCVDDFDLLSIIGRGAFGEARLCREKKTGNIYAMKKLKKSEMLSRGQVEHVRAERNLLAEVASDCIVKLYYSFQDPEYLYLIMEYLSGGDVMTLLMREETLTETVARFYIAQSVLAIESIHKHNYVHRDIKPDNLLLDKYGHMKLSDFGLCKPLDCRNISAMNVNEPLNDENINESIDGDENCSIGRRGRRWKSPLEQLQHWQINRRKLAYSTVGTPDYIAPEVLLKKGYGVECDWWSLGAIMYEMLVGYPPFYSDDPVTTCRKVYL

SEQ ID NO: 8827 - protein, 172 aa, Arabidopsis thaliana
MRKSFKDSLKALEADIQFANTLASEYPEEYDGGYVQMRLSYSPAAHLFLFLLQWTDCHFAGALGLLRILIYKAYVDGKTTMSLHERKTSIREFYDVLFPSLLQLHGGITDVEERKQKEICDKRYRKKDRTDKGKMSEIDLEREEECGICLEIRNKVVLPTCNHSMCINCYRN

SEQ ID NO: 8828 - protein, 465 aa, Arabidopsis thaliana
MARTHFIFLLLVALLSTTFPSSSSSREQEKDRIKALPGQPKVAFSQYSGYVNVNQSHGRALFYWLTESSSPSPHTKPLLLWLNGGPGCSSIAYGASEEIGPFRINKNGSNLYLNKFAWNKDANLLFLESPAGVGYSYTNTSSDLKDSGDERTAQDNLIFLIKWLSRFPQYKYRDFYIAGESYAGHYVPQLAKKINDYNKAFSKPIINLKGFLVGNAVTDNQYDSIGTVTYWWTHAIISDKSYKSILKYCNFTVERVSDDCDNAVNYAMNHEFGDIDQYSIYTPTCVAAQQKKNTTGFFVRMKNTLLRRRLVSGYDPCTESYAEKYFNRPDVQRAMHANVTGIRYKWTACSDVLIKTWKDSDKTMLPIYKELAASGLRIWIFSGDTDSVVPVTATRFSLSHLNLPVKTRWYPWYTDNQVGGWTEVYKGLTFATVRGAGHEVPLFEPKRALILFRSFLAGKELPRSY

SEQ ID NO: 8829 - protein, 595 aa, Mus musculus
MSEAEASSGMAHNAGPDEKTLQVLRDMANRLRIRSIRATNSSTTSYLIPCSNAEIMSVLFFYTMRYKQEDPENPDNDRCILSKGLPFVNVATGWPGQGLGAACGMAYTGKYFDQASYRVFCLLGDEESTEGSVWEAFAFASYYNLDNLMAIFDVNRIGHSSSMSVEHCIAIYQKRCEAFGWNTYVVDGRDVKTLCHVFSQAAQVRGKPTAVVAKTFKARGMPNVEDAESWYGRPMPKERADAIVKLIESQIQTNKILVPSPPIEDSPQINIMNICMTSPPVYVADDKVSTQRACGLALAKLGHENDRVIVLGSDTKNCNFSDIFKKEHPERFIQCCIAEQNMVNVALGCSTRDRTIVFAYSFAAFFTRAFDQIRLGAISQININLIGCHCGVSTGDDNPYHMALEDLAMFRAIPNCVVFYPSDAVSTEHAVYLAANTKEMCFIRTSQAETAIIYTTQETFQIGQAKVVRHSDNDKVIVIGAGVTLHEALVAAAELSKEDISIRVIDLFTIKPLDIATIISNAKATGGRIITVEDHYPEGGIGGAVCAAVSMEPNIVVHNLAVMDVPRSGRCNEALDFSGISSRHIIVAVKCILMT

SEQ ID NO: 8830 - protein, 104 aa, Vernicia fordii
MAMIKAQELVSSNSVVVFSKTFCPYCTSVKQLLNQLGAQFKVIELDSESDGSDLQNALAEWTGQRTVPNVFIGGKHIGGCDKTTGMHQEGKLIPLLTEAGAVKA

SEQ ID NO: 8831 - protein, 108 aa, Lycopersicon esculentum
MSLAKAKEIVSGNPVAVFSKTYCPFCVSVKDLLSKLGATFKAVELDSEKDGSEIQAALAEWTGQRTVPNVFIGRKHIGGCDATTALHREGKLLPLLTEAGAIAKTSTA

SEQ ID NO: 8832 - protein, 477 aa, Solanum tuberosum
MVTATTLSPADAEKLNNLKSAVAGLNQISENEKSGFINLVGRYLSGEAQHIDWSKIQTPTDEVVVPYDKLAPLSEDPAETKKLLDKLVVLKLNGGLGTTMGCTGPKSVIEVRNGLTFLDLIVKQIEALNAKFGCSVPLLLMNSFNTHDDTLKIVEKYANSNIDIHTFNQSQYPRLVTEDFAPLPCKGNSGKDGWYPPGHGDVFPSLMNSGKLDALLAKGKEYVFVANSDNLGAIVDLKILNHLILNKNEYCMEVTPKTLADVKGGTLISYEGKVQLLEIAQVPDEHVNEFKSIEKFKIFNTNNLWVNLSAIKRLVEADALKMEIIPNPKEVDGVKVLQLETAAGAAIKFFDRAIGANVPRSRFLPVKATSDLLLVQSDLYTLTDEGYVIRNPARSNPSNPSIELGPEFKKVANFLGRFKSIPSIIDLDSLKVTGDVWFGSGVTLKGKVTVAAKSGVKLEIPDGAVIANKDINGPEDI

SEQ ID NO: 8833 - protein, 688 aa, Homo sapiens
MSSRTVLAPGNDRNSDTHGTLGSGRSSDKGPSWSSRSLGARCRNSIASCPEEQPHVGNYRLLRTIGKGNSAKVKLARHILTGREVAIKIIDKTQLNPSSLQKLFREVRIMKGLNHPNIVKLFEVIETEKTLYLVMEYASAGEVFDYLVSHGRMKEKEARAKFRQIVSAVHYCHQKNIVHRDLKAENLLLDAEANIKIADFGFSNEFTLGSKLDTFCGSPPYAAPELFQGKKYDGPEVDIWSLGVILYTLVSGSLPFDGHNLKELRERVLRGKYRVPFYMSTDCESILRRFLVLNPAKRCTLEQIMKDKWINIGYEGEELKPYTEPEEDFGDTKRIEVMVGMGYTREEIKESLTSQKYNEVTATYLLLGRKTEEGGDRGAPGLALARVRAPSDTTNGTSSSKGTSHSKGQRSSSSTYHRQRRHSDFCGPSPAPLHPKRSPTSTGEAELKEERLPGRKASCSTAGSGSRGLPPSSPMVSSAHNPNKAEIPERRKDSTSTPNNLPPSMMTRRNTYVCTERPGAERPSLLPNGKENSSGTPRVPPASPSSHSLAPPSGERSRLARGSTIRSTFHGGQVRDRRAGGGGGGGVQNGPPASPTLAHEAAPLPAGRPRPTTNLFTKLTSKLTRRVTLDPSKRQNSNRCVSGASLPQGSKIRSQTNLRESGDLRSQVAIYLGIKRKPPPGCSDSPGV

SEQ ID NO: 8834 - protein, 307 aa, Homo sapiens
MGDIPAVGLSSWKASPGKVTEAVKEAIDAGYRHFDCAYFYHNEREVGAGIRCKIKEGAVRREDLFIATKLWCTCHKKSLVETACRKSLKALKLNYLDLYLIHWPMGFKPPHPEWIMSCSELSFCLSHPRVQDLPLDESNMVIPSDTDFLDTWEAMEDLVITGLVKNIGVSNFNHEQLERLLNKPGLRFKPLTNQIECHPYLTQKNLISFCQSRDVSVTAYRPLGGSCEGVDLIDNPVIKRIAKEHGKSPAQILIRFQIQRNVIVIPGSITPSHIKENIQVFDFELTQHDMDNILSLNRNLRLAMFPM

SEQ ID NO: 8835 - protein, 714 aa, Gallus gallus
MAAKSKSKGRSVPNCFGYPLSIFFIVINEFCERFSYYGMRAVLVLYFKYFLRWDDNFSTAIYHTFVALCYLTPILGALIADSWLGKFKTIVSLSIVYTIGQAVMAVSSINDMTDQNRDGNPDNIAVHIALSMTGLILIALGTGGIKPCVSAFGGDQFEEHQEKQRSRFFSIFYLSINAGSLISTIITPILRAQECGIHSRQQCYPLAFGVPAALMAVSLVVFIAGSGMYKKVQPQGNIMVRVCKCIGFAIKNRFRHRSKEYPKREHWLDWASEKYDKRLIAQTKMVLKVLFLYIPLPMFWALFDQQGSRWTLQATTMDGDFGAMQIQPDQMQTVNPILIIIMVPVVDAVIYPLIQKCKINFTPLRRITVGMFLAGLAFVAAALLQVQIDKTLPVFPAAGQAQIKIINLGDSNANVTFLPNLQNVTVLPMESTGYRMFESSQLKSVMVNFGSESRSENIDSISSNTHTVTIKNAAAGIVSSLRSDNFTSKPEEGKNLVRFVNNLPQTVNITMGDTTFGILEETSISNYSPFSGGRTYDIVITAGSTNCKPTSEKLGYGGAYTIVINECSGDVTQLRYIEDIQPNTVHMAWQIPQYFILTCGEVVFSVTGLEFSYSQAPSNMKSVLQAGWLLTVAVGNIIVLIVAGASKLSEQWAEYVLFAALLFAVCIIFAVMAYFYTYTDPNEVEAQLDEEEKKKQIKQDPDLHGKESEAVSQM

SEQ ID NO: 8836 - protein, 146 aa, Brassica rapa
DIFIFIKDEQGNPLLTADEIKPTIKELVMAAPDNPSNAVEWAMAEMVNKPEILHKAMEEIDRVVGKERLVQESDIPKLNYVKAILREAFRLHPVAAFNLPHVALSDATVAGYHIPKGSQVLLSRYGLGRNPKVWADPLSFKPERHL

SEQ ID NO: 8837 - protein, 155 aa, Coccidioides posadasii
FDVGGQRSERKKWIHCFENVTTILFLVAISEYDQLLFEDETVNRMQEALTLFDSICNSRWFTKTSIILFLNKIDRFKEKLPVSPMKNYFPDYEGGADYAAACDYILNRFVSLNQAEQKQIYTHFTCATDTTQIRFVMAAVNDIIIQENLRLCGLI

SEQ ID NO: 8838 - protein, 379 aa, Hordeum vulgare subsp. vulgare
MATAGKVIKCKAAVAWEAGKPLTMEEVEVAPPQAMEVRVKILFTSLCHTDVYFWEAKGQTPMFPRIFGHEAGGIVESVGEGVTDVAPGDHVLPVFTGECKECPHCKSAESNMCDLLRINTDRGVMIGDGKSRFSIGGKPIYHFVGTSTFSEYTVMHVGCVAKINPEAPLDKVCVLSCGICTGLGASINVAKPPKGSTVAIFGLGAVGLAAAEGARIAGASRIIGVDLNASRFEEARKFGCTEFVNPKDHTKPVQQVLADMTNGGVDRSVECTGNVNAMIQAFECVHDGWGVAVLVGVPHKDAEFKTHPMNFLNERTLKGTFFGNFKPRTDLPNVVEMYMKKELEVEKFITHSVPFSEINKAFDLMAKGEGIRCIIRMDN

SEQ ID NO: 8839 - protein, 157 aa, Coccidioides posadasii
FMHWPAAFAPGDDMFPKDSQGNSKTVDIDYVDTYKAMEKLVKSGKTKAIGISNFSKGEMERLLESCSIVPAVMQMELHPWLQQNDFVEWLKSKGIHVTQYSSLGNQNEVYSGRERYGRLIEDPALAAIGTKYGKTGAQVALAWGINKGHSVFVKSKT

SEQ ID NO: 8840 - protein, 264 aa, Danio rerio
MAATKVGCEHYVRSCLLKAPCCGKFYVCRLCHDAEETHQMDRFKVQEVKCAVCNTIQEAQQICKECEVKFGEYYCDICHLFDKDKKQYHCQPCGICRIGPREKYFHCTKCNLCLGTELKDKHKCVENVSRQNCPVCMEDIHTFRVGAHVLPCGHLLHGTCFDDMLKTGAYRCPLCMHSAFNMKEYWKQMDEEISQTPMPTEYQDSTVKIICNDCQARSTVSFHVLGMKCSSCGSYNTAQDGGLMGTPAANTQTLPEEPDAEQHH

SEQ ID NO: 8841 - protein, 519 aa, Oryza sativa (indica cultivar-group)
ESETNMQILLVFLHCLRKQKLEELNEIQTDLQYIKEDISAVERHRLELYRTKERYSMKLRMLLDEPAASKMWPSPMDKPSGLFPPNSRGPLSTSNPGGLQNKKLDLKGQISHQGFQRRDVLTCSDPPSAPIQSGNVIARKRRVQAQFNELQEYYLQRRRTGAQSRRLEERDIVTINKEGYHAGLEDFQSVLTTFTRYSRLRVIAELRHGDLFHSANIVSSIEFDRDDELFATAGVSKRIKVFEFSTVVNEPSDVHCPVVEMATRSKLSCLSWNKYSKNVIASSDYEGIVTVWDVQTRQSVMEYEEHEKRAWSVDFSRTEPSMLVSGSDDCKVKVWCTKQEASAINIDMKANICSVKYNPGSSHYVAVGSADHHIHYFDLRNPSAPVHVFGGHKKAVSYVKFLSTNELASASTDSTLRLWDVKENCPVRTFRGHKNEKNFVGLSVNNEYIACGSETNEVFVYHKAISKPAANHRFVSSDLDDADDDPGSYFISAVCWKSDSPTMLTANSQGTIKVLVLAP

SEQ ID NO: 8842 - protein, 438 aa, Aspergillus fumigatus
MPISKIHARSVYDSRGNPTVEVDVATETGLHRAIVPSGASTGQHEAHELRDGDKTQWGGKGVLKAVKNVNETIGPALIKENIDVKDQSKVDEFLNKLDGTANKSNLGANAILGVSLAVAKAGAAEKGVPLYAHISDLAGTKKPYVLPVPFQNVLNGGSHAGGRLAFQEFMIVPDSAPSFSEALRQGAEVYQKLKALAKKKYGQSAGNVGDEGGVAPDIQTAEEALDLITEAIEQAGYTGKIKIAMDVASSEFYKADVKKYDLDFKNPESDPSKWLTYEQLADLYKSLAAKYPIVSIEDPFAEDDWEAWSYFYKTSDFQIVGDDLTVTNPGRIKKAIELKSCNALLLKVNQIGTLTESIQAAKDSYADNWGVMVSHRSGETEDVTIADIAVGLRSGQIKTGAPCRSERLAKLNQILRIEEELGENTVYAGSKFRTAVNL

SEQ ID NO: 8843 - protein, 1091 aa, Nicotiana alata
MDTKGRLVAGSHNRNEFVVINADDVGRVTSVKELSGQICQICGDEIEVTVDGEPFIACNECAFPVCRQCYEYERREGNQACPQCKTRFKRIKGSPRVDGDDEDDEFDDLDHEFDYHGNPRYMSEAAFSSRLGRGTNHNASGLTTPSEVDPAALNSEIPLLTYGQEDDTISADKHALIIPPFMGRGKKVHPVPYSDSMSLPPRPMDPKKDLAVYGYGTVAWKERMEDWKKKQNDKLQVVKHGGGKGGGNDGDELDDPDLPKMDEGRQPLSRKLPISSSRLSPYRLLILVRLAVVGLFFHYRITHPVNDAYALWLISIICEIWFAVSWIFDQFPKWFPIVRETYLDRLSLRYEKEGKPSGLAPIDIFVSTVDPLKEPPLITANTVLSILAVDYPEDKVSCYVSDDGAAMLTFEALSETSEFARKWVPFCKKFNIEPRAPEWYFSQKVDYLKNKVHPSFVRERRAMKRDYEEFKVRINGLVATAQKVPEDGWTMQDGTPWPGNLVRDHPGMIQVFLGNDGVRDIEGNVLPRLIYVSREKRPGFDHHKKAGAMNALMRVSAVISNAPYLLNVDCDHYINNSKALREAMCFMMDPTSGKKICYVQFPQRFDGIDRHDRYSNRNVVFFDINMKGLDGIQGPIYVGTGCVFRRQALYGYDAPKKTKPPGKTCNCWPKWCCCCFGSRKKHKKGKTTKDNKKKTKTKEASPQIHALENIEEGIEGIDSEKATLMPQIKLEKKFGQSPVFVASTLLEDGGIPPGATSASLLKEAIHVISCGYEDKTEWGREVGWIYGSVTEDILTGFKMHCHGWRSVYCMPKRPAFKGSAPINLSDRLHQVLRWALGSVEILLSKHCPIWYGYGCGLKPLERFSYINSVVYPLTSLPLIAYCALPAVCLLTGKFIVPEISNYASILFMGLFIMIAATSVLEMQWGGVTIDDWWRNEQFWVIGGASSHLFALFQGLLKVLAGVSTSFTVTSKAADDGEFSELYLFKWTSLLIPPMTLLIINIIGVIVGISDAINNGYDSWGPLFGRLFFALWVIVHLYPFLKGVMGRQNKVPTIIVVWSILLASIFSLLWVRVNPFTARGGLVLEVCGLDCE

SEQ ID NO: 8844 - protein, 437 aa, Trypanosoma brucei
MSDVPKSQVGTDAKVAVAKKYTGEYYVKGMVGDKKSFAIEHSRGRQKKHTVNEFCVGDAIGRGAFAEVFQCWRPEEPHIVYAMKKIRKDLIVKRKQSLNVHTERDLLSDAKLRQKRVSCPWITDLVVAFQDQDFLYIVTEYCSGGDLISWLIRYDVFPEETARFYFVELVLALNALHKMGYVRRDVKPDNVLIDREGHVKLADFGLSKRDPDQAESTSVADDSYLTEDVTVDDDVKKRFRDKKERKVMFFSTVGSPAYIAPEVLIGRGYDYSCDWWSAGVILYEMIFGYPPFFNDNNTATAKKIIQFKEHLEFPKDQTTVSKEAIDLISHLIADSKERYGFEEIIRHPFCKGVPLTDSIRNEEAPFSVVLNDPKDLQYFEPAPDNADIQKQPMTAVSREDQSVFVGFTSKLCDRNQSTTCSRALGRFHELQNFSDDD

SEQ ID NO: 8845 - protein, 248 aa, Vigna angularis
MAEGLNREQYVYLAKLSEQADGYEEMVEFMQKVVVGWTPATELSVEERNLLSVAYKNVIGSLRAAWRIVSSIEQKEEGRKNEEHVALVKQYRSKVETELSNVCASILNLLDSNLVASASNTESKVFYLKMKGDYHRYLAEFKVGDERKAAAEDTMLSYKAAQDVAYADLPPTHPIRLGLALNFSVFYYEILNQSDKACGMAKQAFEEAIAELDTLGEESYKDSTLIMQLLRDNLTLWTSDVQDQLDEP

SEQ ID NO: 8846 - protein, 259 aa, Vigna angularis
MAAAPTPREENVYMAKLAEQAERYEEMVEFMEKVSAAADNEELNVEERNLLSVAYKNVIGARRASWRIISSIEQKEESRGNEDHVTVIRDYRSKIESELSNICDGILKLLDSRLIPSASSGDSKVFYLKMKGDYHRYLAEFKTGAERKEAAESTLAAYKSAQDIANAELPPTHPIRLGLALNFSVFYYEILNSPDRACNLAKQAFDEAIAELDTLGEESYKDSTLIMQLLRDNLTLWTSDMQDDGADEIKEAAPKQDDQ

SEQ ID NO: 8847 - protein, 388 aa, Rattus norvegicus
MTRDEALPDSHSAQNFYENYEPKEILGRGVSSVVRRCIHKPTCQEYAVKIIDITGGGSFSSEEVQELREATLKEVDILQKVSGHPNIIQLKDTYETNTFFFLVFDLMKRGELFDYLTEKVTLTEKETRKIMRALLEVVCTLHKLNIVHRDLKPENILLDDNMNIKLTDFGFSCQLQPGEKLREVCGTPSYLAPEIIQCSMDEGHPGYGKEVDMWSTGVIMYTLLAGSPPFWHRKQMLMLRMIMDGKYQFGSPEWDDYSDTVKDLVSRFLVVQPQDRCSAEEALAHPFFQEYVVEEVRHFSPRGKFKVICLTVLASVRIYYQYRRVKPVTREIVIRDPYALRPLRRLIDAYAFRIYGHWVKKGQQQNRAALFENTPKAVLLSLAEEEDF

SEQ ID NO: 8848 - protein, 255 aa, Rattus norvegicus
MDDREDLVYQAKLAEQAERYDEMVESMKKVAGMDVELTVEERNLLSVAYKNVIGARRASWRIISSIEQKEENTGGEDKLKMIREYRQMVETELKLICCDILDVLDKHLIPAANTGESKVSYYYMKGDYHRYLAEFATGNDRKEAAENSLVAYKAASDIAMTELPPTHPIRLGLALNFSVFYYEILNSPDRACRLAKAAFDDAIAELDTLSEESYKDSTLIMQLLRDNLTLWTSDMQGDGEEQNKEALQDVEDENQ

SEQ ID NO: 8849 - protein, 543 aa, Rattus norvegicus
MAEKFESLMNIHGFDLGSRYMDLKPLGCGGNGLVFSAVDNDCDKRVAIKKIVLTDPQSVKHALREIKIIRRLDHDNIVKVFEILGPSGSQLTDDVGSLTELNSVYIVQEYMETDLANVLEQGPLLEEHARLFMYQLLRGLKYIHSANVLHRDLKPANLFINTEDLVLKIGDFGLARIMDPHYSHKGHLSEGLVTKWYRSPRLLLSPNNYTKAIDMWAAGCIFAEMLTGKTLFAGAHELEQMQLILESIPVVHEEDRQELLSVIPVYIRNDMTEPHKPLTQLLPGISREALDFLEQILTFSPMDRLTAEEALSHPYMSIYSFPTDEPISSHPFHIEDEVDDILLMDETHSHIYNWERYHDCQFSEHDWPIHNNFDIDEVQLDPRALSDVTDEEEVQVDPRKYLDGDREKYLEDPAFDTSYSAEPCWQYPDHHENKYCDLECSHTCNYKTRSPSYLDNLVWRESEVNHYYEPKLIIDLSNWKEQSKDKSDKRGKSKCERNGLVKRRLRLRKRPSSWLRGRGAKALTLMPSSQAPFSSVPSVSLLT

SEQ ID NO: 8850 - protein, 729 aa, Rattus norvegicus
MNPFQKNESKETLFSPVSTEEMLPRPPSPPKKSPPKIFGSSYPVSIAFIVVNEFCERFSYYGMKAVLTLYFLYFLHWNEDTSTSVYHAFSSLCYFTPILGAAIADSWLGKFKTIIYLSLVYVLGHVFKSLGAIPILGGKMLHTILSLVGLSLIALGTGGIKPCVAAFGGDQFEEEHAEARTRYFSVFYLAINAGSLISTFITPMLRGDVKCFGQDCYALAFGVPGLLMVLALVVFAMGSKMYRKPPPEGNIVAQVIKCIWFALCNRFRNRSGDLPKRQHWLDWAAEKYPKHLIADVKALTRVLFLYIPLPMFWALLDQQGSRWTLQANKMNGDLGFFVLQPDQMQVLNPFLVLIFIPLFDLVIYRLISKCRINFSSLRKMAVGMILACLAFAVAALVETKINGMIHPQPASQEIFLQVLNLADGDVKVTVLGSRNNSLLVESVSSFQNTTHYSKLHLEAKSQDLHFHLKYNSLSVHNDHSVEEKNCYQLLIHQDGESISSMLVKDTGIKPANGMAAIRFINTLHKDLNISLDTDAPLSVGKDYGVSAYRTVLRGKYPAVHCETEDKVFSLDLGQLDFGTTYLFVITNITSQGLQAWKAEDIPVNKLSIAWQLPQYVLVTAAEVMFSVTGLEFSYSQAPSSMKSVLQAAWLLTVAVGNIIVLVVAQFSGLAQWAEFVLFSCLLLVVCLIFSVMAYYYVPLKSEDTREATDKQIPAVQGNMINLETKNTRL

SEQ ID NO: 8851 - protein, 513 aa, Rattus norvegicus
MKQSSNVPAFLSKLWTLVEETHTNEFITWSQNGQSFLVLDEQRFAKEILPKYFKHNNMASFVRQLNMYGFRKVVHIESGIVKQERDGPVEFQHPHFKQGQDDLLENIKRKVSSSKPEENKIRQEDLTKIISSAQKVQIKQETIESRLSELKSENESLWKEVSELRAKHAQQQQVIRKIVQFIVTLVQNNQLVSLKRKRPLLLNTNGAPKKNLFQHIVKEPTDNHHHKVPHSRTEGLKSRERISDDIIIYDVTEDNVDEENIPVIPETNEDVVVDPSSQYPDIVIVEDDNEDEYAPVIQSGEQSEPARVGSASSSSPLMSSAVQLNGSSNLTSEDPVTMMDSILNDNINLLGKVELLDYLDSIDCSLEDFQAMLSGRQFSIDPDLLVDSENKGLEATKNSVVQQVSEEGRKSKSKPDKQLIQYTAFPLLAFLDGNPASAVEQGTTTASSEVVPSVDKPIEVDELLDSNLDQEPTQSKLVRLEPLTEAEASEATLFYLCELAPAPLDSDMPLLDS

SEQ ID NO: 8852 - protein, 502 aa, Rattus norvegicus
MEKEDQEKTGKLTLVLALATFLAAFGSSFQYGYNVAAVNSPSEFMQQFYNDTYYDRNKENIESFTLTLLWSLTVSMFPFGGFIGSLMVGFLVNNLGRKGALLFNNIFSILPAILMGCSKIAKSFEIIIASRLLVGICAGISSNVVPMYLGELAPKNLRGALGVVPQLFITVGILVAQLFGLRSVLASEEGWPILLGLTGVPAGLQLLLLPFFPESPRYLLIQKKNESAAEKALQTLRGWKDVDMEMEEIRKEDEAEKAAGFISVWKLFRMQSLRWQLISTIVLMTGQQLSGVNAIYYYADQIYLSAGVKSNDVQYVTAGTGAVNVFMTMVTVFVVELWGRRNLLLIGFSTCLTACIVLTVALALQNTISWMPYVSIVCVIVYVIGHAVGPSPIPALFITEIFLQSSRPSAYMIGGSVHWLSNFIVGLIFPFIQVGLGPYSFIIFAIICLLTSIYIFMVVPETKGRTFVEINQIFAKKNKVSDVYPEKEEKELNDLPPATREQ

SEQ ID NO: 8853 - protein, 548 aa, Homo sapiens
MRNCSMRRYGSTRRVGGRLGAAASASGRPSRGTRLWWRVMAKTQVWPRLTRSGRENSGTGARLAGSSAMIRAAPPPLFLLLLLLLLLVSWASRGEAAPDQDEIQRLPGLAKQPSFRQYSGYLKGSGSKHLHYWFVESQKDPENSPVVLWLNGGPGCSSLDGLLTEHGPFLVQPDGVTLEYNPYSWNLIANVLYLESPAGVGFSYSDDKFYATNDTEVAQSNFEALQDFFRLFPEYKNNKLFLTGESYAGIYIPTLAVLVMQDPSMNLQGLAVGNGLSSYEQNDNSLVYFAYYHGLLGNRLWSSLQTHCCSQNKCNFYDNKDLECVTNLQEVARIVGNSGLNIYNLYAPCAGGVPSHFRYEKDTVVVQDLGNIFTRLPLKRMWHQALLRSGDKVRMDPPCTNTTAASTYLNNPYVRKALNIPEQLPQWDMCNFLVNLQYRRLYRSMNSQYLKLLSSQKYQILLYNGDVDMACNFMGDEWFVDSLNQKMEVQRRPWLVKYGDSGEQIAGFVKEFSHIAFLTIKGAGHMVPTDKPLAAFTMFSRFLNKQPY

SEQ ID NO: 8854 - protein, 173 aa, Bos taurus
DLSGVIRRLWADHGVQACFGRSREYQLNDSAAYYLNDLERIAQSDYIPTQQDVLRTRVKTTGIVETHFTFKDLHFKMFDVGGQRSERKKWIHCFEGVTAIIFCVALSAYDLVLAEDEEMNRMHESMKLFDSICNNKWFTDTSIILFLNKKDLFEEKIIHSPLTICFPEYTGAN

SEQ ID NO: 8855 - protein, 215 aa, Ciona intestinalis
MSSSEEVSWISWFCGLRGNEFFCEVDEDYIQDKFNLTGLGEQVPHYRQALDMILDLEPDDDLEDNTNQSDLIEQAAEMLYGLIHARYTLTNRGIAQMLEKYQQGDFGHCSRVYCENQPMLPIGLSDVPGEAMVKLYCPKCQDVYTPKSSRHHHTDGAYFGTGFPHMLFMVHPEYRPKRPTNQFVSRLFGFKIHPMAYQLQYQASQKLKNPSKLRH

SEQ ID NO: 8856 - protein, 1225 aa, Dictyostelium discoideum
MIVEVELGFLLSTLFFTIISIILFYFFINNKNNLIDQCQEVTKLNNKDNKIVNNNNNNYNNNNFNKIEEINDDKNKEIIKLINNSNNKNLKIKIQEIDSGNNNNNNNNNNNNNNNNLNKNSNEIFRNFKIFSGSLLVIDQDLNIISSSESVRDIFSNINDINGVNQQVIGSLQNYSFINLVHQKDKDRVSTFLKLKFKNNNNIKHQQFSEDIINEKDELKEIQIEDNKELIIINNNNNNNNDNVLKFGNNNSNNSSIILFQGVYHLNNTDLSKPFNLQVSILPFISENYIVLSLKDLSPPPLRLLLNKTSSALSPRSLSSSSSSSPSSSNNNGNTNNSGSLSPRSSNSNGSAVSPRNVSSNSMSPRGQNSDRSISSPRGSSSSSSSSSNELAISPRNSNGTISSPRTSNLSIESVLNNKSIDMISHLSHELRTPIHSVIASIQLFRSTILTVTQNEYLSIIDTSANTLLELVSNVLDYKRIRSGKLTLNNVDFNLCHVIEDVCAMVSPQAQAKSLQIASFIFIHCPLSFYGDPIRLRQVLLNLIGNGLKYTNKGQVCISVEPEQVNEHCMYLHFQVKDSGIGIKEENMSKLFAGFSQVNNGGTTQEALGSGLGLAISKDLVELMGGKIWCSSNATQNNGEAGCTFHFVIPLETNPKQLPCPIQNFNGLSVLVVDKNPYIQTVLCQYLEGWNCQVIKSSDIKEASNKLKDLRREQIEVVMIDIDNIDFRDFIQFKDAFNRLEFGRIGLITMSSDRSMVNEMGFGTSKLTKPFRQSHLVACLLASMPEHSSSTTNCFSNIVGMNSNINNNNNINNNSNNNNNNMQTHNSNSVYGNGNYGNCTPFSNNNNRIHMMSSGDKPSINNRRMSISLGKIPTFNSGGSNSPRSKKLFEEVLQQQQLQQQLQQQLQQQQQLQQQQQQQQQQQQQQQQQLQQQQQQLNTIDDDSNNYCNTTGTMDSIDEINKNNYSDSESDELNDDQAPIIAPVQQLSFGRVTRRHSIDIIMFENSRELSELRNLEDSTRYLSPRSMNNNNGNNDNGINGGSGNSLFGSSIKEEIGGTSDTSSLAQSPNSLSPRAPTKIMILDDNPVSLKLMQRILESRGFECYPFDCSEKAVAQLDQVNPAIIFMDCEMPKMNGFECTQLIRKREQESLCLLKDRKIIIALTAHINPEIQVKCFDAGMNDFISKPFKPQCLELILRKWEDCISNNQLNYNNSLINNQTTIQEQV

SEQ ID NO: 8857 - protein, 586 aa, Oryza sativa (japonica cultivar-group)
MASSTAANLWVLLGLGIAGVLLAAKRLRRPARPDNGAFIARLELLPPPQPPPPQARHPLTGLCFAIADAFHVTGYITSFGSLEWAKTHDAATQTSLVVSSLVDGGAMCVGKTVIDEMAFSIHGENKHFGTPTNPAAPDRVPGGCSSGSAVAVAAGIVDFSLGIDTIGGVRVPGSYCGVLAFRPSHAVVPNNGVIPVAPSLDAIGWFARDPSVLRRVGHLLLRLPYADIRQPRHFYIADDCFEMSKVHARRLTQVVTKSVEKLFGRQVLGHVNLENYLASRIPSLRNNSNGHGDSKFSSLLALSRAMQFLHKHEFKDQHMEWINSVKPAVDACIVGNLSDDGESTINNSQDARKEVRAALGALLKDDGILVIPTVLGCPPKLNARELSSQDYNVQTSCLTSLASMSGCCQVTVPLGTHDKCPVSVSLIARHGGDRFLLDTIQTIYATIQEQVDALAKSNVSSKQAMSEEAAEAAKEKGNIAFKEKQWQKAINFYTEAIKLNNKVATYYSNRAAAFLELASYRQAEADCTSAIDIDPKIVKAYLRRGTAREMLGYYKEAVDDFSHALVLEPMNKTAGVAINRLKKLFP

SEQ ID NO: 8858 - protein, 454 aa, Oryza sativa (japonica cultivar-group); identical to SEQ ID NO: 4016

SEQ ID NO: 8859 - protein, 207 aa, Homo sapiens
MTMDGDSSTTDASQLGISADYIGGSHYVMQPHDDTEDSMNDHEDTNGSKESFREQDIYLPIANVARIMKNAIPQTGKIAKDAKECVQECVSEFISFITSEASERCHQEKRKTINGEDILFAMSTLGFDSYVEPLKLYLQKFREAMKGEKGIGGAVTATDGLSEELTEEAFTNQLPAGLITTDGQQQNVMVYTTSYQQISGVQQIQFS

SEQ ID NO: 8860 - protein, 247 aa, Hordeum vulgare subsp. vulgare
MDAFYSTSSAAASGWGHDSLKNFRQISPAVQSHLKLVYLTLCFALASSAVGAYLHIALNIGGMLTMLACVGTIAWMFSVPVYEERKRFGLLMGAALLEGASVGPLIELAIDFDPSILVTGFVGTAIAFGCFSGAAIIAKRREYLYLGGLLSSGLSILLWLQFVTSIFGHSSGSFMFEVYFGLLIFLGYMVYDTQEIIERAHHGDMDYIKHALTLFTDFVAVLVRVLIIMLKNAGDKSEDKKKRKRGS

SEQ ID NO: 8861 - protein, 330 aa, Paramecium tetraurelia
MNQILQIPPKYYANFNKSQPKEYWDYDNFENEWGDSDQYEVIRKIGRGKYSDVYEGIKYPQGTRVVIKVLKPVKKQKIKRETKILLTIRGHPNVIELSDIVRDPSSKTPCLIFDYIDHVDFRSLFPKLTDYEIRFYLFELIKALDYCHSKGIMHRDVKPQNIIVDPKKKLLKLLDFGLAEYYHPGQDYNVRVASRYFKGPELLVDNVYYDYSLDIWSTGAMMASMIFKKEPFFQGQDNYDQLVVISKVLGTEELQAYIKKYRIRLDPVLESKLGNYPKKEWVKFINAENKHLCSEEAIDILSRMLVYDHALRITPKDAMDHPYFLPVKGK

SEQ ID NO: 8862 - protein, 164 aa, Paramecium tetraurelia
MNQILQIPPKYYANYNKSQPKEYWDYDNFENEWGDSDQYEVIRKIGRGKYSDVYEGIKYPQGTRVVIKVLKPVKKQKIKRETKILLTIRGHPNVIELSDIVRDPSSKTPCLIFDYIDHVDFRSLFPKLTDIDIRFYLFELIKALDYCHSKGIMHRDVKPQNIIV

SEQ ID NO: 8863 - protein, 332 aa, Paramecium tetraurelia
MNQIVQAKPKLYADYNKNQPKEYWDYDNFENEWGDNDQYEIIRKIGRGKYSDVYEGIRYPQNQRVVIKVLKPVKKRKIKRETKILLSLKGHPNIIELSDIVRDPASKTPCLVFDYIDHVDFRSIFPKLTDIEIRFYLYELMKALDFCHSRGIMHRDVKPQNIIVNPQKKLLKLLDFGLAEYYHMGQDYNVRVASRYFKGPELLVDNVYYDYSLDIWSSGAMLASMIFKKEPFFQGNDNYDQLVVIAKVLGTEDLLAYVKKYRLKLDPVFDNKLGNYPKREWSKFINQENKHLCTEEAIDLLSKMLLYDHALRITPKEALDHPYFLPVRDQKK

SEQ ID NO: 8864 - protein, 332 aa, Paramecium tetraurelia
MSQIVQAKPKFYADFNKNQPKEYWDYDNFENEWGDNDQYEIARKIGRGKYSDVYEGIRYPQNQRVVIKVLKPVKKRKIKRETKILLSLKLHPNIIELSDIVKDPASKTPCLVFDYIDHVDFRSIFPKLTDIEIRFYLYELMKALDFCHSRGIMHRDVKPQNIIVNPQKKLLKLLDFGLAEYYHMGQDYNVRVASRYFKGPELLVDNVYYDYSLDIWSSGAMLASMIFKKEPFFQGNDNYDQLVVIAKVLGTEDLLAYVKKYRLKLDPVFDNKLGNYPKREWSKFINQDNKHLCSEEAIDLLSRMLLYDHALRITPKEALDHPYFLPVRDQKK

SEQ ID NO: 8865 - protein, 259 aa, Poa annua
MGRGRVELKRIENKINRQVTFSKRRNGLLKKAYELSVLCDAEVALIIFSSRGKLYEFGSAGTTKTLERYQHCCYNAQDSNSALSETQSWYQEMSKLKAKFEALQRTQRHLLGEDLGPLSVKELQQLEKQLECSLSQARQRKTQLMVEQVEELRRKERQLGEINRQLKHKLDAEGSSSNNYRAMQQLTWAAGTVVDEGAAAYHMQHQQQQQPNHSAAMDCEPTLQIGYPHQFAAPEQAANNIPRSSGQGGENNFMLGWVL

SEQ ID NO: 8866 - protein, 214 aa, Paeonia cambessedesii
  unsure (1)..(214): unsure at all Xaa locations
IVESVGEGVTDLKPGDHVLPVFTGECKECRHCKSEESNMCDLLRINTDRGVMLNDGKSRFSINGQPIFHFVGTSTFSEYTVVHVGCVAKINPEAPLDKVCVLSCGISTGLGATLNVAKPKKGSSVAIFGLGAVGLAAAEGARIAGXSRIXGVDLNPKRFEEAKKFGVTEFVNPKDYNKPVQEVIAEMTGGGVDRSVECTGSIMAMISAFECVHD

SEQ ID NO: 8867 - protein, 214 aa, Paeonia mlokosewitschi
IVESVGEGVTDLKPGDHVLPVFTGECKECRHCKSEESNMCDLLRINTDRGVMLNDGKSRFSINGQPIFHFVGTSTFSEYTVVHVGCVAKINPEAPLDKVCVLSCGISTGLGATLNVAKPKKGSSVAIFGLGAVGLAAAEGARIAGASRIIGVDLNPKRFEEAKKFGVTEFVNPKDYNKPVQEVIAEMTGGGVDRSVECTGSIMAMISAFECVHD

SEQ ID NO: 8868 - protein, 214 aa, Paeonia peregrina
  unsure (1)..(214): unsure at all Xaa locations
IVESVGEGVTDLKPGDHVLPVFTGECKECRHCKSEESNMCDLLRINTDRGVMLNDGKSRFSINGQPIFHFVGTSTFSEYTVVHVGCVAKINPEAPLDKVCVLSCGISTGLGATLNVAKPKKGSSVTIFGLGAVGLAAAEGARIAGASRIIXVDLNPKRFEEAKKFGVTEFVNPKDYNKPVQEVIAEMTGGGVDRSVECTGSIMAMISAFECVHD

SEQ ID NO: 8869 - protein, 214 aa, Paeonia peregrina
  unsure (1)..(214): unsure at all Xaa locations
IVESVGEGVTDLKPGDHVLPVFTGECKECRHCKSEESNMCDLLRINTDRGVMLNDGKSRFSINGQPIFHFVGTSTFSEYTVVHVGCVAKINPEAPLDKVCVLSCGISTGLGATLNVAKPKKGSSIAIFGLGAVGLAAAEGPRIAXASRIIGVDLNPKRFEEAKKFGVTEFVNPKDYNKPVQEVIAEMTGGGVDRSVECTGSIMAMISAFECVHD

SEQ ID NO: 8870 - protein, 214 aa, Paeonia peregrina
IVESVGEGVTDLKPGDHVLPVFTGECKECRHCKSEESNMCDLLRINTDRGVMLNDGKSRFSINGQPIFHFVGTSTFSEYTVVHVGCVAKINPEAPLDKVCVLSCGISTGLGATLNVAKPKKGSSVAIFGLGAVGLAAAEGARIAGASRIIGVDLNPKRFEEAKKFGVTEFVNPKDYNTPVQEVIAEMTGGGVDRSVECTGSIMAMISAFECVHD

SEQ ID NO: 8871 - protein, 214 aa, Paeonia officinalis
  unsure (1)..(214): unsure at all Xaa locations
IVESVGEGVTDLKPGDHVLPVFTGECKECRHCKSEESNMCDLLRINTDRGVMLNDGKSRFSINGQPIFHFVGTSTFSEYTVVHVGCVAKINPEAPLDKVCVLSCGISTGLGATLNVAKPKKGSSVAIFGLGAVGLAAAEGPRIAXASRIIGVDLNPKXFEEAKKFGVTEFVNPKDYNKPVQEVIAEMTDGGVDRSVECTGSIMAMISAFECVHD

SEQ ID NO: 8872 - protein, 214 aa, Paeonia officinalis
IVESVGEGVTDVKPGDHVLPIFTGECKECRHCKSEESNLCDLLRINTDRGVMLNDGKSRFSFNGQPIFHFVGTSTFSEYTVLHVGCLAKINPEAPLDKVCVLSCGISTGLGATLNVAKPKKGSTVAIFGLGAVGLAAAEGARIAGASRIIGVDLNPKRFDEARKFGVTEFVNPKDYNKPVQEVIAEMTGGGVDRSVECTGSIMAMMSAFECVHD

SEQ ID NO: 8873 - protein, 214 aa, Paeonia officinalis
IVESVGEDVTDVKPGDHVLPIFTGECKECRHCKSEESNLCDLLRINTDRGVMLNDGKSRFSINGQPIFHFVGTSTFSEYTVLHVGCLAKINPEAPLDKVCVLSCGISTGLGATLNVAKPKKGSTVAIFGLGAVGLAAAEGARIAGASRIIGVDLNPKRFDEARKFGVTEFVNPKDYNKPVQEVIAEMTDGGVDRSVECTGSIMAMMSAFECVHD

SEQ ID NO: 8874 - protein, 214 aa, Paeonia officinalis
  unsure (1)..(214): unsure at all Xaa locations
IVESVGEGVTDVKPGDHVLPIFTGECKECRHCKSEESNMCDLLRINTDRGVMLNDGKSRFSINGQPIFHFVGTSTFSEYTVLHVGCLAKINPEAPLDKVCVLSCGISTGLGATLSVAKPKKGSTVAIFGLGAVGLAAAEGARIAXASRIIGVDLNPKRFDEARKFGVTEFVNPKDYNKPVQEVIAEMTGGGVDRSVECTGSIMAMMSAFECVHD

SEQ ID NO: 8875 - protein, 214 aa, Paeonia officinalis
IVESVGEGVTDVKPGDHVLPIFTGECKECRHCKSEESNMCDLLRINTDRGVMLNDGQSRFSINGQPIFHFVGTSTFSEYTVLHVGCLAKINPEAPLDKVCVLSCGISTGLGATLNVAKPKKGSTVAIFGLGAVGLAAAEGARIAGASRIIGVDLNPKRFDEARKFGVTEFVNPKDYNKPVQEVIAEMTGGGVDRSVECTGSIMAMMSAFECVHD

SEQ ID NO: 8876 - protein, 214 aa, Paeonia cambessedesii
IVESVGEGVTDVKPGDHVLPIFTGECKECRHCKSEESNMCDLLRINTDRGVMLNDGKSRFSINGQPIFHFVGTSTFSEYTVLHVGCLAKINPEAPLDKVCVLSCGISTGLGATLNVAKPKKGSTVAIFGLGAVGLAAAEGARIAGASRIIGVDLNPKRFDEARKFGVTEFVNPKNYNKPVQEVIAEMTGGGVDRSVECTGSIMAMMSAFGCIHD

SEQ ID NO: 8877 - protein, 214 aa, Paeonia mlokosewitschi
IVESVGEGVTDVKPGDHVFPIFTGECKECRHCKSEESNMCDLLRINTDRGVMLNDGQSRFSINGQPIFHFVGTSTFSEYTVLHVGCLAKINEEAPLDKVCVLSCGISTGLGATLNVAKPKKGSTVAIFGLGAVGLAAAEGARIAGASRIIGVDLNPKRFDEARKFGVTEFVNPKDYNKPVQEVIAEMTGGGVDRSVECTGSIMAMMSAFECVHD

SEQ ID NO: 8878 - protein, 214 aa, Paeonia mlokosewitschi
IVESVGEGVTDVKPGDHVLPIFTGECKECRHCKSEESNMCDLLRINTDRGVMLNDGKSRFSINGQPIFHFVGTSTFSEYTVLHVGCLAKINEEAPPDKVCVLSCGISTGLGATLNVAKPKKGSTVAIFGLGAVGLAAAEGARIAGASRIIGVDLNPKRFDEARKFGVTEFVNPKDYNKPVQEVIAEMTGGGVDRSVECTGSIMAMMSAFECVHD

SEQ ID NO: 8879 - protein, 214 aa, Paeonia peregrina
  unsure (1)..(214): unsure at all Xaa locations
IVESVGEGVTDVKPGDHVLPIFTGECKECRHCKSEESNLCDLLRINTDRGVMLNDGKSRFSINGQPIFHFVGTSTFSEYTVLHVGCLAKINTEAPLDKVCVLSCGISTGLGATLNVAKPKKGSTVAIFGLGAVGLAAAEGARIAXASRIIXVDLNPKRFDEARKFGVTEFVNPKDYNKPVQEVIAEMTGGGVDRSVKCTGSIMAMMSTFECVHD

SEQ ID NO: 8880 - protein, 214 aa, Paeonia peregrina
IVESVGEDVTDVKPGDHVLPIFTGECKECRHCKSEESNLCDLLRINTDRGVMLNDGKSRFSINGQPIFHFVGTSTFSEYTVLHVGCLAKINPEAPLDKVCVLSCGISTGLGATFNVAKPKKGSTVAIFGLGAVGLAAAEGARIAGASRIIGVDLNPKRFDEARKFGVTEFVNPKDYNKPVQEVIAEMTGGGVDRSVECTGSIMAMMSAFECVHD

SEQ ID NO: 8881 - protein, 214 aa, Paeonia peregrina
IVESVGKGVTDVKPGDHVLPIFTGECKECRHCKSEESNMCDLLRINTDRGVMLNDDKSRFSINGQPIFHFVGTSTFSEYTVLHFGCLAKINPEAPLDKVCVLSRGISTGLGATLNVAKPKKGSIVAIFGLGAVGLAAAEGARIAGASRIIGVDLNPKRFDEARKFGVTEFVNPKDYNKPIQEVIAEMTGGGVDRSVECTGSIMAMMSAFECVHD

SEQ ID NO: 8882 - protein, 214 aa, Paeonia peregrina
IVESVGKGVTDVKPGDHVLPIFTGEYKECRHCKSEESNMCDLLRINTDRGVMLNDGKSRFSINGQPIFHFVGTSTFSEYTVLHFGCLAKINPEAPLDKVCVLSRGISTGLGATLNVAKPKKGSIVAIFGLGAVGLAAAEGARIAGASRIIGVDLNPKRFDEARKFGVTEFVNPKDYNKPVQEVIAEMTGGGVDRSVECTGSIMAMMSAFECVHD

SEQ ID NO: 8883 - protein, 174 aa, Paeonia peregrina
  unsure (1)..(174): unsure at all Xaa locations
DLLRINTDRGVMLNDGKSRFSINGQPIFHFVGTSTFSEYTVLHVGCLAKINEEAPLDKVCVLSCGISTGLGATLNVXKPKKGSTVAIFGLGAVGLAAAEGARIAGASRIIGVDLNPKRFDEARKFGVTEFVNPKDYNKPVQEVIAEMTGGGVDRSVECTGSIMAMMSAFECVHD

SEQ ID NO: 8884 - protein, 174 aa, Paeonia peregrina
DLLRINTDRGVMLNDGKSRFSINGQPIFHFVGTSTFSEYTVLHVGCLAKINEEAPLDKVCVLSCGISTGLGATLNVAKPKKGSTVAIFGLGAVGLAAAEGARIAGASRIIGVDLNPKRFDEARKFGVTEFVNPKDYNKPVQEVIAEMTGGGVDRSVECTGSIMAMMSAFECVHD

SEQ ID NO: 8885 - protein, 186 aa, Synechocystis sp.
RGLSFQDLIQEGSLGLIRAAEKFDHEKGYKFSTYATWWIRQAITRAIADQSRTIRLPVHLYETISRIKKTTKLLSQEMRRKPTEEEIAEKMEMTIEKLRFIAKSAQLPISLETPIGKEEDSRLGDFIEADGETPEDEVSKNLLREDLENVLDTLSPRERDVLRLRYGLDDGRMKTLEEIGQIFNVT

SEQ ID NO: 8886 - protein, 438 aa, Penicillium citrinum
MPIAKVHARSVYVSRGNPTVEVDVVTETGLHRAIVPSGASTGQHEAVELRDGDKAKWGGKGVLKAVKNVNETIGPALIKENIDVKDQAKVDEFLNKLDGTANKGNLGANAILGVSLAIAKAAAAEKGVPLYVHISDLAGTKKPYVLPVPFQNVLNGGSHAGGRLAFQEFMIVPDTAESFSEGLRQGAEVYQKLKALAKKKYGQSAGNVGDEGGVAPDIQTAEEALDLITEAIEQAGYTGKISIAMDVASSEFYKTDAKKYDLDFKNPDSDPTKWLTYEQLADLYKSLAAKYPIVSIEDPFAEDDWEAWSYFYKTSDFQIVGDDLTVTNPLRIKKAIELKSCNALLLKVNQIGTLTESIQAAKDSYADNWGVMVSHRSGETEDVTIADIAVGLRSGQIKTGAPARSERLAKLNQILRIEEELGENAIYAGKNFRTSVNL

SEQ ID NO: 8887 - protein, 312 aa, Leishmania mexicana amazonensis
MNYEGHLKGHRGWVTSLACPQQAGSYIKVVSTSRDGTAISWKANPDRHSVDSDYGLPSHRLEGHTGFVSCVSLAHATDYALTASWDRSIRMWDLRNGQCQRKFLKHTKDVLAVAFSPDDRLIVSAGRDNVIRVWNVAGECMHEFLRDSHEDWVSSICFSPSLEHPIVVSGSWDNTIKVWNVNGGKCERTLKGHSNYVSTVTVSPDGSLCASGGKDGAALLWDLSTGEQLFKINVESPINQIAFSPNRFWMCVATERSLSVYDLESKAVIAELTPDGAKPSECISIAWSADGNTLYSGHKDNLIRVWSISDAE

SEQ ID NO: 8888 - protein, 319 aa, Heliothis virescens
  unsure (1)..(319): unsure at all Xaa locations
MTETLKLRGTLCGHNGWVTQIATNPKYPDMILSSSRDKTLIVWKLTRDETNYGVPQKRLYGHSHFISDVVLSSDGNYALSGSWDKTLRLWDLAAGKTTRRFEDHTKDVLSVAFSVDNRQIVSGSRDKTIKLWNTLAECKYTIQDDGHSDWVSXVRFSPNHANPIIVSAGWDRTVKVWHLTNCKLKINHLGHSCYLNTVTVFSDGSLCASGGKDMKAMLWDLNDGKHLHTLDHNDIITSLCFSPNRYWLCAAFGPSIKIWDLESKEMVEELRPEIINQTQTSKSDPPQCLSLAWSTDGQTLFAGYSDNIIRVWQVSVSAR

SEQ ID NO: 8889 - protein, 717 aa, Arabidopsis thaliana
MASSAFAFPSYIITKGGLSTDSCKSTSLSSSRSLVTDLPSPCLKPNNNSHSNRRAKVCASLAEKGEYYSNRPPTPLLDTINYPIHMKNLSVKELKQLSDELRSDVIFNVSKTGGHLGSSLGVVELTVALHYIFNTPQDKILWDVGHQSYPHKILTGRRGKMPTMRQTNGLSGFTKRGESEHDCFGTGHSSTTISAGLGMAVGRDLKGKNNNVVAVIGDGAMTAGQAYEAMNNAGYLDSDMIVILNDNKQVSLPTATLDGPSPPVGALSSALSRLQSNPALRELREVAKGMTKQIGGPMHQLAAKVDVYARGMISGTGSSLFEELGLYYIGPVDGHNIDDLVAILKEVKSTRTTGPVLIHVVTEKGRGYPYAERADDKYHGVVKFDPATGRQFKTTNETQSYTTYFAEALVAEAEVDKDVVAIHAAMGGGTGLNLFQRRFPTRCFDVGIAEQHAVTFAAGLACEGLKPFCAIYSSFMQRAYDQVVHDVDLQKLPVRFAMDRAGLVGADGPTHCGAFDVTFMACLPNMIVMAPSDEADLFNMVATAVAIDDRPSCFRYPRGNGIGVALPPGNKGVPIEIGKGRILKEGERVALLGYGSAVQSCLGAAVMLEERGLNVTVADARFCKPLDRALIRSLAKSHEVLITVEEGSIGGFGSHVVQFLALDGLLDGKLKWRPMVLPDRYIDHGAPADQLAEAGLMPSHIAATALNLIGAPREALF

SEQ ID NO: 8890 - protein, 366 aa, Mus musculus
MSLTRKRGFYKQDINKTAWELPKTYLAPAHVGSGAYGAVCSAIDRRTGEKVAIKKLSRPFQSEIFAKRAYRELLLLKHMHHENVIGLLDVFTPASSLRSFHDFYLVMPFMQTDLQKIMGMEFSEDKVQYLVYQMLKGLKYIHSAGIVHRDLKPGNLAVNEDCELKILDFGLARHTDTEMTGYVVTRWYRAPEVILSWMHYNQTVDIWSVGCIMAEMLTGKTLFKGKDYLDQLTQILKVTGVPGAEFVQKLKDKAAKSYIQSLPQSPKKDFTQLFPRASPQAADLLDKMLELDVDKRLTAAQALAHPFFEPFRDPEEETEAQQPFDDALEHEKLSVDEWKQHIYKEISNFSPIARKDSRRRSGMKLQ

SEQ ID NO: 8891 - protein, 532 aa, Mus musculus
MLLLWLLLLLLLLVPLLAILWQQRSRGARPCWLISLQHRVAWGMLGWAAAWQQWRLDRSTLNVGQSQQQALMWCLKKAQGSCCLPREDTDMRTFRNHLPLTQTSHTQEQESEETLPSPASPQYHGDASLQATLLGLITLNKAYPEALAPGSTACVTPTSPWPCSVPWLGHALGRVSPDGAKDPRTLLLEALISPGLRVLEARTAVELLDVFVGLEADGEELAEAIAAGILGTLLPKRAAELKEALEQGPRGLARRLWPKLQVVVTLDSGGQAEAVAALRVLWCQGLAFFSPAYAASGGVVALNLWPERPQGSYLLPPGVPFIELLPIKEGTQEEAASTLLLTDAQREKEYELVLTNHTSLTRCRLGDVVQVVGTYNQCPVVRFTCRLGQTLNVRGEVTDETVFSVALAQAVGQWPGAKLLDHVCVESRVLDSCEGSAPHYEVFVELRGLRNLSEENRDKLDNCLQEASAQYKSLRFRGSVGPAKVHLVRPGSFRVLREALAAFSSSSCRPPEMPRVIRLRHLAQLLQKRVIS

SEQ ID NO: 8892 - protein, 324 aa, Candida glabrata
MSELKSRIGNSGSIANSGPVSILCYCASSILMTVTNKFVVNTDGFNMFFVMLFAQSLVCTMCLMVLKMFGYAKYRPLNLIDVKNWLPISFLLVFMIFTSAKALKYMPVPIYTIFKNLTIILIAYGEVLFFGGSVTPMELSSFILMVLSSVVASLGDQQAAKIAQPLANNSILSPEYYWMFLNCICSASFVLIMRKRIKLTNFKDYDTMFYNNALALPILLGFSFLSEDWSSENLAQNFSGESLSAMIISGMTSVGISYCSGWCVRATSSTTYSMVGALNKLPIALAGLIFFDAPRNFLSIMSIFIGFASGLLYAVAKQKKVQKN

SEQ ID NO: 8893 - protein, 245 aa, Nicotiana tabacum
GTRCPMGPKYGALPEEVDPLLRAAQAARLTVSGVSFHIGSGDADSNAYLGAIAAAKEVFETAAKLGMSKMTVLDVGGGFTSGHQFTTAAVAVKSALKQHFDDEPELTIIAEPGRFFAETAFTLATTIIGKRVRGELREYWINDGLYGSMNCVLYDHATVNATPLAVLSNRSNVTCGGSKTFPTTVFGPTCDALDTVLRDYQLPELQVNDWLVFPNMGAYTKAAGSNFNGFNTSAIVTHLAYSYPS

SEQ ID NO: 8894 - protein, 715 aa, Homo sapiens
IVNREKLSESVLMKVEREIAILKLIEHPHVLKLHDVYENKKYLYLVLEHVSGGELFDYLVKKGRLTPKEARKFFRQIVSALDFCHSYSICHRDLKPENLLLDEKNNIRIADFGMASLQVGDSLLETSCGSPHYACPEVIKGEKYDGRRADMWSCGVILFALLVGALPFDDDNLRQLLEKVKRGVFHMPHFIPPDCQSLLRGMIEVEPEKRLSLEQIQKHPWYLGGKHEPDPCLEPAPGRRVAMRSLPSNGELDPDVLESMASLGCFRDRERLHRELRSEEENQEKMIYYLLLDRKERYPSCEDQDLPPRNDVDPPRKRVDSPMLSRHGKRRPERKSMEVLSITDAGGGGSPVPTRRALEMAQHSQRSRSVSGASTGLSSSPLSSPRSPVFSFSPEPGAGDEARGGGSPTSKTQTLPSRGPRGGGAGEQPPPPSARSTPLPGPPGSPRSSGGTPLHSPLHTPRASPTGTPGTTPPPSPGGGVGGAAWRSRLNSIRNSFLGSPRFHRRKMQVPTAEEMSSLTPESSPELAKRSWFGNFISLDKEEQIFLVLKDKPLSSIKADIVHAFLSIPSLSHSVLSQTSFRAEYKASGGPSVFQKPVRFQVDISSSEGPEPSPRRDGSGGGGIYSVTFTLISGPSRRFKRVVETIQAQLLSTHDQPSVQALADEKNGAQTRPAGAPPRSLQPPPGRPDPELSSSPRRGPPKDKKLLATNGTPLP

SEQ ID NO: 8895 - protein, 689 aa, Homo sapiens
KMSSRTVLAPGNDRNSDTHGTLGSGRSSDKGPSWSSRSLGARCRNSIASCPEEQPHVGNYRLLRTIGKGNFAKVKLARHILTGREVAIKIIDKTQLNPSSLQKLFREVRIMKGLNHPNIVKLFEVIETEKTLYLVMEYASAGEVFDYLVSHGRMKEKEARAKFRQIVSAVHYCHQKNIVHRDLKAENLLLDAEANIKIADFGFSNEFTLGSKLDTFCGSPPYAAPELFQGKKYDGPEVDIWSLGVILYTLVSGSLPFDGHNLKELRERVLRGKYRVPFYMSTDCESILRRFLVLNPAKRCTLEQIMKDKWINIGYEGEELKPYTEPEEDFGDTKRIEVMVGMGYTREEIKESLTSQKYNEVTATYLLLGRKTEEGGDRGAPGLALARVRAPSDTTNGTSSSKGTSHSKGQRSSSSTYHRQRRHSDFCGPSPAPLHPKRSPTSTGEAELKEERLPGRKASCSTAGSGSRGLPPSSPMVSSAHNPNKAEIPERRKDSTSTPNNLPPSMMTRRNTYVCTERPGAERPSLLPNGKENSSGTPRVPPASPSSHSLAPPSGERSRLARGSTIRSTFHGGQVRDRRAGGGGGGGVQNGPPASPTLAHEAAPLPAGRPRPTTNLFTKLTSKLTRRVTLDPSKRQNSNRCVSGASLPQGSKIRSQTNLRESGDLRSQVAIYLGIKRKPPPGCSDSPGV

SEQ ID NO: 8896 - protein, 839 aa, Brassica rapa
GVRNIYHHSYTFLLVFFVMILFRPAFSLSTLSSTESLTISSNRTLVSPGNIFELGFFRTNSRWYLGMWYKKLSGRTYVWVANRDNPLSNSIGTLKISNMNLVLLDHSNKSVWSTNLTRENVRSPVVAELLANGNFVVRDPSGFLWQSFDYPTDTLLPEMKLGYDLKTGLNRFLVSWRSSDDPSSGDFSYKLDIQRGLPEFYTFKDNTLVHRTGPWNGIRFSGIPEEQQLSYMVYNFTENSEEVAYTFLVTNNSIYSRLTINFSGFFERLTWTPSLVIWNPIWSSPASFQCDPYMICGPGSYCDVNTLPLCNCIQGFKPLNVQEWDMRDHTRGCIRRTRLSCRGDGFTRMKNMKLPETTMATVDRSIGVKECEKKCLSDCNCTAFANADIRDGGTGCVIWTGRLDDMRNYAVSGQDLYVRLAAADVVEKRTANGKIVSLIVGVCVLLLLIFFCLWKRKQRRAKAMATSIVHRQRKQILLMNGMTLSNNRQLSRENKTGEFELPLIELEAVVKSTENFSNCNKLGQGGFGIVYKGTLDGQEIAVKRLSKTSVQGADEFMNEVTLIARLQHINLVQILGCCIDADEKMLIYEYLENLSLDSYLFGKTRSSKLNWKERFDITNGIARGLLYLHQDSRFRIIHRDLKVSNILLDKNMIPKISDFGMARIFARDETEANTMRVVGTYGYMSPEYAMEGIFSEKSDVFSFGVIVLEIVTGKRNREFNNENNLLSYAWSNWKEGRALEIVDPDIVDSLSPLSSTFQPQEVLKCIQIGLLCVQELAEHRPTMSSVVWMLGSEATEIPQPKPPGYWVRRSSYELDPSSSKCDDDSWTVNQYTCSVIDAR

SEQ ID NO: 8897 - protein, 195 aa, Zea mays subsp. mexicana
APLDKVCVLSCGISTGLGASINVAKPPKGSTVAVFGLGAVGLAAAEGARIAGASRIIGVDLNPSRFEEARKFGCTEFVNPKDHNKPVQEVLAEMTNGGVDRSVECTGNINAMIQAFECVHDGWGVAVLVGVPHKDAEFKTHPMNFLNERTLKGTFFGNHKPRTDLPNVVELYMKKELEVEKFITHSVPFAEINKA

SEQ ID NO: 8898 - protein, 355 aa, Homo sapiens
MAEVHRRQHARVKGEAPAKSSTLRDEEELGMASAETLTVFLKLLAAGFYGVSSFLIVVVNKSVLTNYRFPSSLCVGLGQMVATVAVLWVGKALRVVKFPDLDRNVPRKTFPLPLLYFGNQITGLFSTKKLNLPMFTVLRRFSILFTMFAEGVLLKKTFSWGIKMTVFAMIIGAFVAASSDLAFDLEGYAFILINDVLTAANGAYVKQKLDSKELGKYGLLYYNALFMILPTLAIAYFTGDAQKAVEFEGWADTLFLLQFTLSCVMGFILMYATVLCTQYNSALTTTIVGCIKNILITYIGMVFGGDYIFTWTNFIGLNISIAGSLVYSYITFTEEQLSKQSEANNKLDIKGKGAV

SEQ ID NO: 8899 - protein, 353 aa, Ambystoma tigrinum
MATEGLHENETLTSLKNEADSLKGKLEEERAKLHDVELHQVADRVESLGQFVMKTRRTLKGHGNKVLCMDWCKDKRRIVSSSQDGKVIVWDAFTTNKEHAVTMPCTWVMACAYAPSGCAIACGGLDNKCSVYPLTFDKNENMASKKKSVAMHTNYLSACSFTNSDMQILTASGDGTCALWDVESGQLLQSFHGHGADVLCLDLAPSETGNTFVSGGCDKKAMVWDMRSGQCIQSFETHESDINSVRYYPSGDAFASGSDDATCRLFDLRADREVAIYTKESIIFGASSVDFSLSGRLLFAGYNDYTINVWDVLKGTRVSILFGHENRVSTLRVSPDGTAFCSGSWDHTLRIWA

SEQ ID NO: 8900 - protein, 352 aa, Pyrenophora teres
MPPAGSGSSRKISFNVSEQYDIQDVVGEGAYGVVCSALHKPSGQKVAIKKITPFDHSMFCLRTLREMKLLRYFNHENIISILDIQKPRNYETFTEVYLIQELMETDMHRVIRTQELSDDHCQYFIYQTLRALKAMHSANVLHRDLKPSNLLLNANCDLKVCDFGLARSAASTEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKIPWKAMFPKTNDLALDLLERLLAFNPVKRITVEEALKHPYLEPYHDPDDEPTADPIPEEFFDFDKNKDNLTKEQLKLLIYQEIMR

SEQ ID NO: 8901 - protein, 268 aa, Pneumocystis carinii
MTSRENLVYLAKLAEQAERYEEMVESMKKVASSDQELTVEERNLLSVAYKNVIGARRASWRIVSSIEQKEENKGNLSQAGLIKEYRSKIESELTSICNDILAVLDAHLIASASTGESKVFYYKMKGDYYRYLAEFAVGDKRKAPSDASLAAYKEASDIAGTDLPPTHPIRLGLALNFSVFYYEILNSPDCACHLAKQAFDDAIAELDTLSEESYKDSTLIMQLLRDNLTLWTSDMQDSNEKNDSKEAVSEVPDPGKPSETEASKTDDI

SEQ ID NO: 8902 - protein, 556 aa, Suaeda maritima subsp. salsa
MLSQLSSFFASKMDMVSTSDHASVVSMNLFVALLRGCIVIGHLLEENRWMNESITALLIGLSTGIIILLISGGKSSHLLVFSEDLFFIYLLPPIIFNAGFQVKKKQFFRNFITIILFGAVGTLVSFIIISLGSIAIFQKMDIGSLELGDLLAIGAIFAATDSVCTLQVLNQDETPLLYSLVFGEGVVNDATSVVLFNAIQNFDLTHIDHRIAFQFGGNFLYLFFASTLLGAVTGLLSAYVIKKLYFGRHSTDREVALMMLMAYLSYMLAELFYLSGILTVFFCGIVMSHYTWHNVTESSRVTTKHAFATLSFVAEIFIFLYVGMDALDIEKWRFVSDSPGTSVAVSSILLGLHMVGRAAFVFPFAFLMNLSKKSNSEKVTFNQQIVIWWAGLMKSAVSVALAYNQFSRSGHTQLRGNAIMITSTITVVLFSTMVFGLLTKPLILFMLPQPKHFTSASTVSDLGSPKSFSLPLLEDRQDSEADLGNDDEEAYPRGTIARPTSLRMLLNAPTHTVHHYWRRFDDYFMRPVFGGRGFVPFVPGSPTEQSITNFVTENIS

SEQ ID NO: 8903 - protein, 109 aa, Entamoeba histolytica
TRVMKNSVSMPNGSAVRISKDAQEYMTEVATEFLSFIASEAADVPKGSVKPKHTLTGTDIIDALDRLGFEDYCLSLQKHLKHFHHMNAQDEGYEAKKGFYESHISMNEE

SEQ ID NO: 8904 - protein, 205 aa, Juglans regia
KRRNGLLKKAYELSVLCDAEVALIVFSSRGRLYEYANNSVKSTIDRYKKARADSSNTGSVSEANTQFYQREAATLRQQINSVQESNRKMLGESLSGMAFRDLKSLESKLESGIRRIRSKKNELLFAEIEYMQKREVDLHNNNQLLRAKIAENERNQQNLNVMPGGGNLELMHSQPFDSRNYFQVDALQPNHDQYPRQDQMALQLV

SEQ ID NO: 8905 - protein, 215 aa, Juglans regia
IENETNRQVTYSKRRKGLFKKAHELTVLCDAKVSLIMISSNKKLRDYVSPSTTTKQIFDQYQHTMGVDLWSSHYERMQEELKKLNDVNRSLRREIRHRRGESLIDLNLEELYHLEQNVESAVKVIRDRKYHVIGKKTDILKKKKKRAESIHKVLLHELVARDEDPYGLVDNGGGDYCDPDIIGCSNTDSCMFALRLQPNFHMGEGSDLTTYTLLE

SEQ ID NO: 8906 - protein, 303 aa, Homo sapiens
MKGKEEKEGGARLGAGGGSPEKSPSAQELKEQGNRLFVGRKYPEAAACYGRAITRNPLVAVYYTNRALCYLKMQQHEQALADCRRALELDGQSVKAHFFLGQCQLEMESYDEAIANLQRAYSLAKEQRLNFGDDIPSALRIAKKKRWNSIEERRIHQESELHSYLSRLIAAERERELEECQRNHEGDEDDSHVRAQQACIEAKHDKYMADMDELFSQVDEKRKKRDIPDYLCGKISFELMREPCITPSGITYDRKDIEEHLQRVGHFDPVTRSPLTQEQLIPNLAMKEVIDAFISENGWVEDY

SEQ ID NO: 8907 - protein, 156 aa, Fagus sylvatica
MNSRAFIFLALLFASVLLISSAVATKTSKDEEKPEESNPVDDTKYGGYGGHYGGGHGGGYGGGHGGGYGGGHGGRGGGGGGRGGGGGYGGRREHVAEESIGRDTKYGGYGGGHGGHGGHGGGHGGGHGGGGGGPSRKLKAKLYNSLKSFASSYVPK

SEQ ID NO: 8908 - protein, 643 aa, Mus musculus
MKDYDELLKYYELYETIGTGGFAKVKLACHVLTGEMVAIKIMDKNALGSDLPRVKTEIDALKSLRHQHICQLYHVLETKNKIFMVLEYCPGGELFDYIISQDRLSEEETRVVFRQILSAVAYVHSQGYAHRDLKPENLLFDENHKLKLIDFGLCAKPKGNKDYHLQTCCGSLAYAAPELIQGKSYLGSEADVWSMGILLYVLMCGFLPFDDDNVMALYKKIMRGKYEVPKWLSPSSILLLQQMLQVDPKKRISMRNLLNHPWVMQDYSCPVEWQSKTPLTHLDEDCVTELSVHHRSSRQTMEDLISSWQYDHLTATYLLLLAKKARGKPARLQLPSFSCGTASTTPKSKNLSLEDMSTSDDNCVAGLIDYELCEDKLLAPKTPQVTKHLAESNHAASKSPAPGVRRAVANKLMDKENVCTPKSSVKNEEQFVFSEPKIPVSKNQYKREIPASPTRFPTPAKARAQCLREAPVRTPGNSAGADTLTTGVISPERRCRSMDVDLNQAHMEDTPKKKGTNVFGSLERGLDKVLTALTRNKKKGSARDGPRKRKLHYNVTTTRLVNPDQLLSEIMAILPKKNVDFVQKGYTLKCQTQSDFGKVTMQFELEVCQLQRPDVVGIRRQRLKGDAWVYKRLVEDILSGCKM

SEQ ID NO: 8909 - protein, 484 aa, Acinetobacter calcoaceticus
MSIFTKELWDKKLFNGSWQSAQDTYSVIEVATGQVLGEIGYATAADVVSAAQQAKAAQQQWWALNYQERQAVFERAAALLTENQAEVIEWLVKESGSLQLKAGFEVSIAIQVLKHCIASPTNEQGTLLPTQNGKLSIAKRLPLGVVGVISPFNFPLYLALRAVAPALAFGNAVVLKPDERTAVCSGYVIARIFELAGLPKGLLHVLPGGVEVGEALTLDQNIASIQFTGSTQVGRIVGANAAKTLKKVSLELGGKNSLIILDDADIELAAENIAWGAFLHSGQICMTSGKILIHQKIYQQVKQRVIEKVQNFVVGNPCDKNVTIGPLINAKQAQRVEQLVSAAVNEGATLEIGGHADGVFFQPTVLTDVTANNSIFSEEIFGPVAVLIPFSSDEQAIELANDGDYGLSAGIITSNVGRGMQLGAQLKVGLLHINDQTVNDETVNPFGGFGSSGNGTRIGGPANADEFTQWQWITVQAQAPHYPF

SEQ ID NO: 8910 - protein, 371 aa, Acinetobacter calcoaceticus
MSELKDIIAAVTPCKGADFELQALKIRQPQGDEVLVKVVATGMCHTDLIVRDQYYPVPLPAVLGHEGSGIIEAIGPNVTELQVGDHVVLSYGYCGKCTQCNTGNPAYCSEFFGRNFSGADSEGNHALCTHDQGVVNDHFFAQSSFATYALSRENNTVKVTKDVPIELLGPLGCGIQTGAGACINALKVTPASSLVTWGAGAVGLSALLAAKVCGASIIIAVDIVESRLELAKQLGATHVINSKTQDPVAAIKEITDGGVNFALESTGRPEILKQGVDALGILGKIAVVGAPQLGTTAQFDVNDLLLGGKTILGVVEGSGSPKKFIPELVRLYQQGKFPFDQLVKFYAFDEINQAAIDSHKGITLKPIIKIA

SEQ ID NO: 8911 - protein, 309 aa, Xanthomonas campestris pv. campestris
MSHFVHPNALCESDTIGEGTRVWAFAHVLPGARLGRDCNICDGVFVESDVIVGDRVTVKCGVQLWDGVRLGDDVFVGPNATFTNDLFPRSRVYPEKFLGTVVESGASIGANATILAGTTIGSGAMIGAGAVVTRSVPPNAIVVGNPARIVGYVSDKDANQPAALPVDQGITDTAVPGVKLYRMPSFADMRGSLSVGNFDSFLPFNARRYFLVYGVPTQETRGEHAHKRCHQFLICVSGSVRVLADDGTRRIDVELNSPNQGIHLPPMIWGTQYKYSKDAVLLVFASEPYDSDEYIRDYADFKSLANAAG

SEQ ID NO: 8912 - protein, 750 aa, Oryza sativa; identical to SEQ ID NO: 3485

SEQ ID NO: 8913 - protein, 746 aa, Oryza sativa; identical to SEQ ID NO: 3173

SEQ ID NO: 8914 - protein, 641 aa, Rhodobacter capsulatus
MSATPSRTPHLDRVTGPADLKAMSIADLTALASEVRREIVEVVSQTGGHLGSSLGVVELTVALHAVFNSPGDKLIWDVGHQCYPHKILTGRRSRMLTLRQAGGISGFPKRSESPHDAFGAGHSSTSISAALGFAVGRELGQPVGDTIAIIGDGSITAGMAYEALNHAGHLKSRMFVILNDNDMSIAPPVGALQHYLNTIARQAPFAALKAAAEGIEMHLPGPVRDGARRARQMVTAMPGGATLFEELGFDYIGPVDGHDMAELVETLRVTRARASGPVLIHVCTTKGKGYAPAEGAEDKLHGVSKFDIETGKQKKSIPNAPNYTAVFGERLTEEAARDQAIVAVTAAMPTGTGLDIMQKRFPRRVFDVGIAEQHAVTFAAGMAAAGLKPFLALYSSFVQRGYDQLVHDVALQNLPVRLMIDRAGLVGQDGATHAGAFDVSMLANLPNFTVMAAADEAELCHMVVTAAAHDSGPIALRYPRGEGRGVEMPERGEVLEIGKGRVMTEGTEVAILSFGAHLAQALKAAEMLEAEGVSTTVADARFCRPLDTDLIDRLIEGHAALITLEQGAMGGFGAMVLHYLARTGQLEKGRAIRTMTLPDCYIDHGSPEEMYAWAGLTANDIRDTALAAARPSKSVRIVHSA

SEQ ID NO: 8915 - protein, 253 aa, Pseudomonas putida
MNDRFRDKVALVSGAAQGIGLGVARRLLEEGARVVAVDRSELVHELAGDACLCLTADLERYAECQRALERTLERFGRLDILVNNVGGTLWAKPYQHYAEDEIEAELRRSLLPTLWCCRAALPAMLGQGSGAIVNVSSVATRGVNRVPYGAAKGGVNALTACLAFETADQGIRVNAVAPGGTDAPPRRIPRNAAAQSEEERRWYRQIVEQTLDSSLMKRYGSIDEQVAAILFLASDEASYITGVTLPVAGGDLG

SEQ ID NO: 8916 - protein, 1371 aa, Homo sapiens
AQGWQAVGTGARASAVAAVPSVSLLSGASSSSLAWCGLATGALGAGARGIPELRGAAGAGGAAGAGTGGAGPAGRLLPPPAPGSPAAPAAVSPAAGQPRPPAPASRGPMPARIGYYEIDRTIGKGNFAVVKRATHLVTKAKVAIKIIDKTQLDEENLKKIFREVQIMKMLCHPHIIRLYQVMETERMIYLVTEYASGGEIFDHLVAHGRMAEKEARRKFKQIVTAVYFCHCRNIVHRDLKAENLLLDANLNIKIADFGFSNLFTPGQLLKTWCGSPPYAAPELFEGKEYDGPKVDIWSLGVVLYVLVCGALPFDGSTLQNLRARVLSGKFRIPFFMSTECEHLIRHMLVLDPNKRLSMEQICKHKWMKLGDADPNFDRLIAECQQLKEERQVDPLNEDVLLAMEDMGLDKEQTLQSLRSDAYDHYSAIYSLLCDRHKRHKTLRLGALPSMPRALAFQAPVNIQAEQAGTAMNISVPQVQLINPENQIVEPDGTLNLDSDEGEEPSPEALVRYLSMRRHTVGVADPRTEVMEDLQKLLPGFPGVNPQAPFLQVAPNVNFMHNLLPMQNLQPTGQLEYKEQSLLQPPTLQLLNGMGPLGRRASDGGANIQLHAQQLLKRPRGPSPLVTMTPAVPAVTPVDEESSDGEPDQEAVQSSTYKDSNTLHLPTERFSPVRRFSDGAASIQAFKAHLEKMGNNSSIKQLQQECEQLQKMYGGQIDERTLEKTQQQHMLYQQEQHHQILQQQIQDSICPPQPSPPLQAACENQPALLTHQLQRLRIQPSSPPPNHPNNHLFRQPSNSPPPMSSAMIQPHGAASSSQFQGLPSRSAIFQQQPENCSSPPNVALTCLGMQQPAQSQQVTIQVQEPVDMLSNMPGTAAGSSGRGISISPSAGQMQMQHRTNLMATLSYGHRPLSKQLSADSAEAHSLNVNRFSPANYDQAHLHPHLFSDQSRGSPSSYSPSTGVGFSPTQALKVPPLDQFPTFPPSAHQQPPHYTTSALQQALLSPTPPDYTRHQQVPHILQGLLSPRHSLTGHSDIRLPPTEFAQLIKRQQQQRQQQQQQQQQQEYQELFRHMNQGDAGSLAPSLGGQSMTERQALSYQNADSYHHHTSPQHLLQIRAQECVSQASSPTPPHGYAHQPALMHSESMEEDCSCEGAKDGFQDSKSSSTLTKGCHDSPLLLSTGGPGDPESLLGTVSHAQELGIHPYGHQPTAAFSKNKVPSREPVIGNCMDRSSPGQAVELPDHNGLGYPARPSVHEHHRPRALQRHHTIQNSDDAYVQLDNLPGMSLVAGKALSSARMSDAVLSQSSLMGSQQFQDGENEECGASLGGHEHPDLSDGSQHLNSSCYPSTCITDILLSYKHPEVSFSMEQAGV

SEQ ID NO: 8917 - protein, 355 aa, Strongyloides stercoralis
MGICHSEEEKEQGMVNKEIDKKLKESKMLGEKTIKLLLLGAGECGKSTIMKQMKILHSNGFTDDELNQQKSVVYSNTINSMVLLIKAMNTYKVGYSNIQCEAEARVILDVVKRNEESEPFTKEVYNALKILWNDTSINTIVYEKRKEYHLQDSAKYFLDSLDRIADSSYKPTETDILLTRIKTTGIVEVIFKIKSVNFRVFDVGGQRSERKKWIHCFENVNAIIFVTAVSEYDEVLFEDETTNRMTESMRLFESICNSRWFITTSMILFLNKKDLFAEKIKKISIKILFPEYSGEQNYDESISYIKGKFEELNSNPKKTIYVHQTCATDTNQVQLILDSVVSMVIQANLHKSGLY

SEQ ID NO: 8918 - protein, 355 aa, Strongyloides stercoralis
MGVCQSSKEKEMQNKTKAIDKELMQGHLNQQKIVKLLLLGAGECGKSTVLKQMRILHDHGFSDEEMTDQKGVIYNNTVQAIACIIRGMGTLQINYENPEREADARIVLDTIKRGEESEPLTAELANAIERLWADKGVNTIAYSRGNEYQLPESANYFLDNVKRISQPDYKPTEQDILLSRIKTTGIVEVKFKMKNVDFRVFDVGGQRSERKKWIHCFEDVNAIIFIAAISEYDQVLFEDETTNRMLESMRLFESICNSRWFINTSMILFLNKKDLFLEKIKKTSIKVAFPEYKGGNTYEEQVKFIEDTFEGLNANPDKTLYMHQTCATDTNQVQMILDSVIDMIIQANLQGCGLY

SEQ ID NO: 8919 - protein, 575 aa, Lactobacillus brevis
MLKGIAASDGVVCGHVFRYSEPDLSITKRSITNLDHELNRFHQALEAAVSEVEMIKTRATKNLGADSAQVFSAHIAMLQDPEFIKSVEDEIARQRCNAEAALATVVTDYGASLAKLTDNPYMQERITDLHDISKRVTAHLLGIKLPDLALLDRPVIVVTHDLIPSDTVSVDAKYILGFVTDLGGRTSHSSILARSLNIPAVVGTQTATADLATDEMVIINGTTGSVISEPTAAEIATAKQAMADRQANRVRLAKLRHHQTVTKDGIGVTLAANMGTANDIPSVLDNGAEAVGLMRTEFLYMDAERVPTEDEQFAIYRQVVSALAPRPVVIRTLDIGGDKPLPYLHQAPEANPFMGERAIRQSLAHQPLFRSQLRALIRASAYGHLRIMFPMIATLDEFRQAKAIYDDERSKLTTAQVPMGKIDVGMMVEVPAAAMLADRFAQEVDFMSIGTNDLIGYAMADDRTNQDVAYLYQPYHPAVLRLVDRIVRAGHAAGIPVAMCGEMAGDPIAVPILLGIGLDEFSMGAGSILKTRQLMGTLNVHELQSLADTVLNSTSTSQEVITMVQAAVPGILDVR

SEQ ID NO: 8920 - protein, 1213 aa, Dictyostelium discoideum
MIELNNHSKINKNENNTNTRNNSSNNNNNNNNINKTNTNKYFEYNQNSIIYSSIPNSFLSHHPNSVGSQCLSLNSFLPPKPPILLSIFNSDTIGNNNNNNYSSSSSRNNSSGCSSSNNNNNNNNNNNNNNNNNNNNNNNNCNIEQYKNNQKQPKQQQQQKDQTIATQHRISLSSSSSSSSLSSSSSSSSVKQSFQIVKRLFGSLSEYMFPQKDEILYETDPYYLYQDDTQSNDSNEFYDDTDIGSDIDEANLTNTYNIQNCNKTLYNKQQQQAHFVNMNKNVNSNNGTGNSNQSNNVNKNQQNNNNNNNNNSHNNNNGNQNSSSSSSNSGASGSGGNGNNNNNNNNNNNNNNNNNNNSNSNSNNNSKSNNNNKKEGKDGATMNGSHPLIPFRKKPAQVPSPCFRMNSPNSDNDQYLDQLALENSSKKSLVAYNTDNLDQWKHFHLNENFDILQNDLFDIQQQQQQQQQQDNTLQYSSPINKRQEQEQQHIPFQFTTEQQQQLQQQQQQHLQNKTKQHPILLQRQQQQKQKQQQQQQIQQEQIGNNNSNNNNNINNNNNINNNYNNVNDLMNKFEIDQKQHDSQQNLVEEKRTPSFHEHNIIFNSFNFICSIVLDGSNIKSTEKYKAKLIIGFCFTILSFIPSWIIFFWVSGINKPAVMAIIAMPMSISSLVILKRTGSIHYPCHILCFTLCFALTINSYYTGGHQSTIRLLMSPVPPISALVLGRKASIQWSLMVLSIYLLFFVANLYGHEYVQGIPSIIIRSHMNFIIDVTIIIMTLIFTLCYQYFIDEAHRETKLKNAQLTIAKDAAIEAYQARQEFLATMSHEIRTPLNGLIGMATLLRDSHNLPPEEKTMAKAVKSCGDILLRLVNDILDLSKLEANQMGLEHIPFRMRELTQQICHVLSGQANEKNIHLSCEVSDKIPSILLGDSGRILQILMNLTGNALKFTQSGYVKIIIDLIEEESELVSLKKGEYNISFRVKDTGIGVPVESHQKIFEAFVQADPSDSRKYGGSGLGLYLCAKLVRLMKGEIGVYNNPDCDGSTFWFILPLEEGTDQSMQQMNNGARHKAFPQDCVKVLIAEDNIINQRVAVKFLEKIGIKAEVAGNGNEVLEILERQHYDLIFMDFQMPILDGLRCSKTIREFEQNHKWNRICPSIFICGLTANTMSTDKKRCFDHGMNHFISKPFQLEQLRSAIEMAIEHKQRNLMNLNIRN

SEQ ID NO: 8921 - protein, 597 aa, Oryza sativa; identical to SEQ ID NO: 3643

SEQ ID NO: 8922 - protein, 303 aa, Oryza sativa
MLLNPASREVAALDSIRHHLLEEEEETPATAPAPTRRPVYCRSSSFGSLVADQWSESLPFRPNDAEDMVVYGALRDAFSSGWLPDGSFAAVKPESQDSYDGSSIGSFLASSSSEAGTPGEVTSTEATVTPGIREGEGEAVAVASRGKHYRGVRQRPWGKFAAEIRDPAKNGARVWLGTFDSAEEAAVAYDRAAYRMRGSRALLNFPLRIGSEIAAAAAAAAAGNKRPYPDPASSGSSSPSSSSSSSSSSSSGSPKRRKRGEAAPASMAMALVPPPPPPAQAPVQLALPAQPWFAAGPIQQLVS

SEQ ID NO: 8923 - protein, 109 aa, Corylus avellana
MSNIQENLKAGESQVQGKAEDMMQSTKDTANAAKNKTADTAQSAKDKTADATQSAKDKTADATQSTKESAQQGKDQSAGFLQQTGEQVKNMAQGAVGNVKSTLGMGDKK

SEQ ID NO: 8924 - protein, 356 aa, Lycopersicon esculentum
  unsure (1)..(356): unsure at all Xaa locations
GLWAGLIIGFVTEYYTSNAYSPVQDVADSCRTGAATNVIFGLALGYKSVIIPIFAIAISIFVSFSFAAMYGIAVAALGMLSTIATGLAIDAYGPISDNAGGIAEMAGMSHRIRERTDALDAAGNTTAAIGKGFAIGSAALVSLALFGAFVSRAAISTVDVLTPKVFIGLLVGAMLPYWFSAMTMKSVGSAALKMVEEVRXQFNTIPGLMERTAKPDYATCVKIFTDASIKEMIPPGALVMLTPLIVGILFGVETLSGVLAGSLVSGVQIAISASNTGGAWDNAKKYIEAGASEHARTLGPKGSDAHKAAVIGDTVGDPLKDTSGPSLNILIKLMAVESLVFAPFFATHGGLLFKLF

SEQ ID NO: 8925 - protein, 140 aa, Lycopersicon pimpinellifolium
ALFGAFVSRAAISTVDVLTPKVFIGLLVGAMLPYWFSAMTMKSVGSAALKMVEEVRRQFNTIPGLMEGTAKPDYATCVKISTDASIKEMIPPGALVMLTPLIVGILFGVETLSGVLAGSLVSGVQIAISASNTGGAWDNA

SEQ ID NO: 8926 - protein, 756 aa, Bruguiera gymnorrhiza
MGTDAGEVVETLPHCYSCKVHQSICRELRKVVDRIERLFPNIEASRPRCRLGIEVLCLLNDALDRAKQVLQYCSESSKLYLALNGDVIVSRCQKSRNLLEQSLDQIQTMVPVILAAEISQVIDDLRVAKFVLDHSDEEAGKAVRELLQQHTSMSDAVESEIKVLRFAASRLCITTPKDLLIEKRSIKKLVNKVRDNDPTKKKILIYLLHLLKKYGNSILGEQGENLNSQQEELFADGSSVSSQAAEVGPCTACKQIVAEAEMSNIPPAPPEEYKCPLSKRLMYDPVVIASGQTFERIWIQKWFDEGNDTCPKTLVKLDHQSLMPNTALKDLISKWCEKYGVTILDPNSQAFQSLDTSSTSVASFGISMNDLHLPLDISNVSLGSSDASYCSDSPRTKIAERSNLMSMQRNNGYSAFQSRANTNKTCLDFLSRLAKLGWESKCEMIEDVKSHLEDNVQPFHHISFENFVEPLIKFLRDAKYQHDVRAQRAGSKLLLAFVSKKRSGISWLHEDTFDLLASMLDSELVEEALAILEVLSSDKDSRSKITASGALVYILRILDSEREEFQEGAVRILHNLSSNNEVCSQILSLNCIPKLVPFINQGQLASHCMGLLKNLCDIEDARVSVAETNGCVAAIAKLLERESCEEQDHAVAILLSLCSQRVQYCNLVMDEGVIPSLFVISINGSEKGKASALELLRQLRDVDFDNEQKCSGYDVGVTEDSHQCKEKKISSRKTRFLGISLFSNWKSSSVASKKKR

SEQ ID NO: 8927 - protein, 350 aa, Homo sapiens [sequence omitted]

SEQ ID NO: 8928 - protein, 571 aa, Arabidopsis thaliana
MEAKIVKVLDSSRCEDGFGKKRKRAAASYAAYVTGVSCAKLQNVPPPNGQCQIPDKRRRLEGENKLSAYRNRSGKALVRYYTYFKKTGIAKRVMMYGNGEWNDAAIEFKLCGHSFILGFSHMQRLDMETGAKTPLAWIDNAGKCFFPEIYESDERTNYCHHKCVEDPKQNAPHDIKLRLEIDVNGGETPRLNLEECSDESGDNMMDDVPLDQRSSNEHYDEATEDSCSRKLEAAVSKWDETDAIVVSGAKLTGSEVLDKDAVKKMFAVGTASLGHVPVLDVGRFSSEIAEARLALFQKQVEITKKHRGDANVRYAWLPAKREVLSAVMMQGLGVGGAFIRKSIYGVGIHLTAADCPYFSARYCDVDENGVRYMVLCRVIMGNMELLRGDKAQFFSGGEEYDNGVDDIESQKNYIVWNINMNTHIFPEFVVRFKLSNLPNAEGNLIAKRDNSGVTLEGPKDLPPQLESNGARGSGSANSVGSSTTRPKSPWMPFPTLFAAISHKVAENDMLLINADYQQLRDKKMTRAEFVRKLRVIVGDDLLRSTITTLQNQPKSKEIPGSIRDHEGAGGL

SEQ ID NO: 8929 - protein, 333 aa, Nicotiana tabacum
MSKARVYTDVNVLRPREYWDYEALTVQWGDQDDYEVVRKVGRGKYSEVFEGINVNSHEKCIIKILKPVKKKKIKREIKILQNLCGGPTIVKLLDIVRDQHSKTPSLIFEYVNSTDFKVLYPTLTDYDIRYYIYELLKALDYCHSQGIMHRDVKPHNVMIDHELRKLRLIDWGLAEFYHPGKEYNVRVASRYFKGPELLVDLQDYDYSLDMWSLGCMFAGMIFRKEPFFYGHDNQDQLVKIAKVLGTDELNAYLHKYQLELDPQLEAMVGRHSRKPWSKFINADNQHLVSPEAIDFLDKLLRYDHQDRLTAREAMAHPYFLQVRAAENSRMRTQ

SEQ ID NO: 8930 - protein, 715 aa, Rattus norvegicus
MPTDLPPASEDAGPDVRAEPDGGTAPATPAESEDNREPAAAAAAEPAAEPAAEPAAEPAAEPAAEPAAEAVPDTEAESASGAVPDTQEEPAAAAASATPAEPAARAAPVTPTEPATRAVPSARAHPAAGAVPGASAMSAAARAAAARAAYAGPLVWGARSLSATPAARASLPARAAAAARAASAARAVAAGRSASAAPSRAHLRPPSPEIQVADPPTPRPAPRPSAWPDKYERGRSCCRYEAASGICEIESSSDESEEGATGCFQWLLRRNRRPGQPRSHTVGSNPVRNFFARAFGSCFGLSECTRSRSLSPGKAKDPMEERRKQMRKEAMEMREQKRADKKRSKLIDKQLEEEKMDYMCTHRLLLLGAGESGKSTIVKQMRILHVNGFNGEGGEEDPQAARSNSDGEKATKVQDIKNNLKEAIETIVAAMSNLVPPVELANPENQFRVDYILSVMNVPNFDFPPEFYEHAKALWEDEGVRACYERSNEYQLIDCAQYFLDKIDVIKQADYVPSDQDLPRCRVLTSGIFETKFQVDKVNFHMFDVGGQRDERRKWIQCFNDVTAIIFVVASSSYNMVIREDNQTNRLQEALNLFKSIWNNRWLRTISVILFLNKQDLLAEKVLAGKSKIEDYFPEFARYTTPEDATPEPGEDPRVTRAKYFIRDEFLRISTASGDGRHYCYPHFTCAVDTENIRRVFNDCRDIIQRMHLRQYELL

SEQ ID NO: 8931 - protein, 105 aa, Homo sapiens
MTDPDVPGPSDPYMKEHLHWMVTDIPGTTDSTFGKELTSYEKPKPNIGIHRYVFVLFKQKRGNKYSITCPFSRDYFNTRNYQNDLGVPVAAAYFNARRATAPRRR

SEQ ID NO: 8932 - protein, 150 aa, Cryphalus abietis
  unsure (1)..(150): unsure at all Xaa locations
ENXSKLGANAILGVSLAVAKAGAAKKGLPLYKHLAELAGNTNIILPVPAFNVINGGSHAGNKLAMQEFMILPTGAKSFTEAMRMGSEVYHHLKKVINAKFGLDATAVGDEGGFAPNILNNKEALDLINEAISKAGYSGKIDIGMDVAASG

SEQ ID NO: 8933 - protein, 137 aa, Ernoporus caucasicus
  unsure (1)..(137): unsure at all Xaa locations
LXGTXNKSKLGANAILGVSLAVAKAGAAKKGVPLYKHLAXLAGNTDIILPVPAFNVINGGSHAGNKLAMQXFMILPTGAASFTEXMRMGXEVYHHLXKVIXNXFGLDATXVGXXGGAPPHILNNKDALXLXXQAIPK

SEQ ID NO: 8934 - protein, 113 aa, Ernoporus fagi
  unsure (1)..(113): unsure at all Xaa locations
VPAFNVINGGSHAGNKLAMQEFMILPTGAASFTEAMRMGSEVYHHXKKVIHNKFGLDATAVGDEGGFAPNILNNKDALXLISEAIAKAXXTGKIDIGMDVAASXFYXEGSXXL

SEQ ID NO: 8935 - protein, 371 aa, Hypocryphalus mangiferae
  unsure (1)..(371): unsure at all Xaa locations
SGASTGVHEALELRDNYETRYHGKGVQKAIDNINKIIAPELIKANLEVTQQTEIDEFMIKLDGTDNXSKLGANAILGVSLAVAKAGAAKERLPLYRHIAELAGNSNIILPVPAFNVINGGSHAGNKLAMQEFMILPTGATSFTEAMRMGSEVYHHLKKVINAKFGLDATAVGDEGGFAPNILNNKEALDLINEAIAKAGYTGKIDIGMDVAASEFFKDGSYDLDFKNPNSDKSQWLSPEKLQALYQEFIKDFPIVSIEDPFDQDDWNAWSSITGATTIQIVGDDLTVTNPKRIQDAVNKKACNCLLLKVNQIGSVTESIRAHLLAKQNGWGTMVSHRSGETEDTFIADLVVGLSTGQIKTGAPCRSERLAN

SEQ ID NO: 8936 - protein, 269 aa, Coccotrypes dactyliperda
  unsure (1)..(269): unsure at all Xaa locations
DLGLFRAAVPSGASTGIYEALELRDNDKSRYHGKSVQKAIDNINKIVAPELIKTGLEVTQPTEIDEFMIKLDGAENKSKFGANAILGVSLAVAKAGAAKKGIPLYKHLADLAGNANIILPVPAFNVINGGSHAGNKLAMQEFMILPTGAANFTEAMRMGSEVYHHLKKVIKDKFGLDATAVGDEGGFAPNILNNKDALDLINEAIAKAGYTGKIEIGMDVAASEFYREGQYDXDFKNPNSDKSKWISSEKLQGLYQEFXKDFPIVWLRR

SEQ ID NO: 8937 - protein, 239 aa, Araptus sp. SCH05
  unsure (1)..(239): unsure at all Xaa locations
CLVQIGIFXAAVPSGASTGVHEALELRDNDKSRYHGKSVQKAIDNVNKIIAPELLKAGLEVXQQTEIDXFMIKLDGTENKSXLGANAILGVSLAVAKAGAAKKGIPLYKHLADLAGNSNIILPVPAFNVINGGSHAGNKLAMQEFMILPTGAANFTEAMRMGSEVYHHLKKVIHSKFGLDATAVGDEGGFAPNILNNKDALDLINEAIAKAGYTGKIDIGMDVAASEFYKDGQYDLDFK

SEQ ID NO: 8938 - protein, 151 aa, Pityophthorus sp. SCH07
NKSKFGANAILGVSLAVAKAGAAKKGVPLYKHIADLAGNSDIILPVPAFNVINGGSHAGNKLAMQEFMILPTGAANFTEAMKMGSEVYHHLKKGIKDKFGLDATAVGDEGGFAPNILNNKDALDLINDAIATAGYTGKIEIGMDVAASDSL

SEQ ID NO: 8939 - protein, 217 aa, Pityokteines minutus
GASTRIYEALELRDNDKSRYHGKSVQKAIDNINKTIAPELLKAGLEVTQQTEIDEFMIKLDGTENKSKFGANAILGVSLAVAKAGAAKKGVPLYKHLADLAGNTNIILPVPAFNVINGGSHAGNKLAMQEFMILPTGAANFTEAMRMGTEVYHHLKKGIKDKFGLDATAVGDEGGFAPNILNNKDALDLINEAIATAGYTGKIEIGMDVAASEFYKD

SEQ ID NO: 8940 - protein, 156 aa, Ips perturbatus
  unsure (1)..(156): unsure at all Xaa locations
TEKXSKFGANAIXGVSLAVAKAGAAKKGVPLYRHLADLAGNTNIILPVPAFNVINGGSHAGNKLAMQEFMILPTGAANFTEAMRMGSEVYHHLKKGIKDKFGLDATAVGDEGGFAPNILNNKDALDLINDAIATAGYTGKIEXGMXVAASEFYKDG

SEQ ID NO: 8941 - protein, 92 aa, Pityogenes hopkinsi
  unsure (1)..(92): unsure at all Xaa locations
EFMILPTGAPNFTEAMRMGSEVYHHLKKGIKDKFGLDATAVGDEGGFAPNILNNKDALXLINEAIATAGYTGKIEXGMDVXASEFYKDGXYY

SEQ ID NO: 8942 - protein, 141 aa, Micracis carinulatus
  unsure (1)..(141): unsure at all Xaa locations
VSLAVAKXGAAKKGVPLYKHLADXSGNXNIILPVPAFNVINGGSHAGNKXAMQEFMILPTGASNFTEAMRMGSEVYHHLKKVINAKFGLDATAVGDEGGFAPNILNNKDALDLINEAIAKAGYTGKIEIGMDVAASEFYKD

SEQ ID NO: 8943 - protein, 224 aa, Xylosandrus sp. SCY05
  unsure (1)..(224): unsure at all Xaa locations
FRAAVPSGATTGIYEALELRDNDKSAYHGKSVQKAIDNINKIIAPDLIKTGLEVTQQTEIXEFMIKLDGTENKEKLGANAILGVSLAVAKAGAAKKGIPLYKHLADLAGNTNIILPVPAFNVINGGSHAGNKLAMQEFMILPTGAVNFTEAMRMGSEVYHHLKKVIKDKFGLDATAVGDEGGFAPNILNNKDALDLINEAIAKAGYTGKIEIGMDVAASEFYRE

SEQ ID NO: 8944 - protein, 376 aa, Dryocoetoides cristatus
  unsure (1)..(376): unsure at all Xaa locations
GLFXAAXPTGAXTGIYEALELRDNDKTRYHGKSVQKAIDNINXIIAPGVIKSGLEVTQQTEIDEFXIKLDGTENKSKIGANAILGVSLAVAKAGAAKKGIPLYKHLADLAGNTNIILPVPAFNVINGGSHAGNKLAMQEFMILPTGATNFTEAMRMGTEVYHHLKKVIKDKFGLDATAVGDEGGFAPNILNNKDALDLINEAIAKAGYTGNIEIGMDVAASEFYREGQYDLDFKNPNSDKSKWISSEKLQGLYQEFIKDFPIVSIEDPXDQDEWNAXTLVTGATYIHIVGXDLTVTNPKRIQTAVEKKACNCXLLKVNQXGSVTEXXRAHQLAKQXGWGTMVSHRSGXTEDTFIADLVAGXXTGQIKTGAPXSVGA

SEQ ID NO: 8945 - protein, 149 aa, Premnobius cavipennis
FGANAILGVSLAVAKAGAAKKGVPLYKHLADLAGNSNIILPVPAFNVINGGSHAGNKLAMQEFMILPTGAANFTEAMRMGSEVYHHLKKVIKDKFGLDATAVGDRGGFAPNILNNKDALDLINEAIAKAGYTGKIDIGMDVAASEFFKD

SEQ ID NO: 8946 - protein, 188 aa, Chaetastus montanus
  unsure (1)..(188): unsure at all Xaa locations
EFGANAILGVPXAVAKAGAAKKGLPLYNXLANLAGNNNIXXPVPAXNVXNGGSHAGNKLAXXEFXXLPXGAXXFTEPMXXGTEVXHHLKNVIKAKFGLDATAVGDEGGLALQIQNDAVALILVTDAIAGAGDTGQVRXGMDVSASELDGERLYDLDFKNPDSCKSKWVNPQKLLELYQEFIKXSHRIN

SEQ ID NO: 8947 - protein, 216 aa, Aphanarthrum sp. SCR03
  unsure (1)..(216): unsure at all Xaa locations
LSTAAVPSGASTGVHEALELRDDIPDQYMGKGVSKAXDHVNNSIGPEXVKQDFDVTSQQEIDEFMIKLDGTDNKSKFGATAILGVSLAVCKAGAAQSGLTLYRHIADLAGNKNIILPVPAFNVINGGSHAGNKLAMQEFMILPTGACSFTEAMKMGSETYHTLKKIINDKYGLDATAVGDEGGFAPNIGNPKDALTIXNDAIAKAXYTXXXEIGID

SEQ ID NO: 8948 - protein, 223 aa, Coleobothrus germeauxi
LITELGLFTAAVPSGASTGVHEALELRDDIADQYMGKGVSKAVDNVNNSIGPELVKQDFDVTQQEEIDEFMIKLDGTENKSKFGANAILGVSLAVCKAGAAKRGLPLYRHIADLAGNKNIILPVPAFNVINGGSHAGNKLAMQEFMILPTGACSFTEAMKMGSETYHTLKKFIKDKYGLDATAVGDEGGFAPNIGNPKDALAILNDAIAKAGYTRNIDIGIDV

SEQ ID NO: 8949 - protein, 236 aa, Stenancylus sp. COR01
LITDLGLFRAAVPSGASTGVHEALELRDEVPDQYMGKGVSKAVENVNVSIGPELVKQDFDVTQQEEIDEFMIKLDGTENKANFGANAILGVSLAVCKAGAAKRGLPLYRHIADLACNKNIILPVPAFNVINGGSHAANKLAMQEFMILPTGAFSFTEAMKMGSETYHNLKKIIKDKYGLDATAVGDEGGFAPNITNNKDALLIISDAIAKAGYTGRIEIGMDVAASEFYKDGLCDL

SEQ ID NO: 8950 - protein, 238 aa, Araucarius minor
LITDLGLFRAAVPSGASTGVHEALELRDEVPDQYMGKGVSKAVENVNVSIGPELVKQDFDVTQQEEIDDFMIKLDGTENKSKFGANAILGVSLAVCKAGAAKRGVPLYRHIADLAGNKNLILPVPAFNVINGGSHAANKLAMQEFMILPTGAFSFTEAMKMGSETYHNLKKIIKDKYGLDATAVGDEGGFAPNITNNKDALLIISDAIAKAGYTGRIEIGMDVAASEFYKDGLCDLDF

SEQ ID NO: 8951 - protein, 146 aa, Xylechinosomus valdivianus
EIDEFMIKLDGTENKANFGANAILGVSLAVCKAGAAKRGLPLYRHIADLACNKNIILPVPAFNVINGGSHAGNKLAMQEFMILPTGANTFTEAMKMGSETYHTLKKIIKDKYGLDATAVGDEGGFAPNIGNPKDALTILNDAIAKA

SEQ ID NO: 8952 - protein, 132 aa, Hylurgonotus tuberculatus
  unsure (1)..(132): unsure at all Xaa locations
EIDXXMXKLDGTENKSNFGANAILGVSLAVCKAGAAKRGLPLYRHIADLAGNKNIILPVPAFNVINGGSHAGNKLAMQXFMILPTGACSFTEAXKMGSETYHTLKKIIKDXYGIDATXVGDKGGFAPNIGYP

SEQ ID NO: 8953 - protein, 149 aa, Dendroctonus terebrans
  unsure (1)..(149): unsure at all Xaa locations
XDXFMINLDGTDNKSKFGANAILGVSLAVCKAGAAKRGLPLYRHIADLAGNKNLILPVPAFNVINGGSHAGNXLAMQEFMILPTGACSFTEAMKMGSETYHTLKKIIKDKYGLDATAVGDEGGFAPNIANPKDALIILNDAIAKAGYTG

SEQ ID NO: 8954 - protein, 148 aa, Pseudohylesinus nebulosus
  unsure (1)..(148): unsure at all Xaa locations
EXXEXMIKLDGTENKSKFGANAILGVSLAVCKAGAAKRGLPLYRHIADLAGNKNIILPVPAFNVINGGSHAGNKLAMQEFMIFPTGACSFTEAMKMGSETYHTLKKIIKDKYGLDATAVGDEGGFAPNIGNPKDALAILNDAIGKPGY

SEQ ID NO: 8955 - protein, 164 aa, Ctonoxylon flavescens
  unsure (1)..(164): unsure at all Xaa locations
DGTDNKSKFGANAILGVSLAVCKAGAAKRGVPLYRHIADLAGNKHLVLPVPAFNVINGGSHAGNKLAMQEFMILPTGACSFTEAMKMGSETYHTLKKIIKDKYGLDATAVGDEGGFAPNIGNPKDALTILKDAINKAGYTGKVEIGMDVAASEFFKQGLYDXDF

SEQ ID NO: 8956 - protein, 216 aa, Dendroctonus pseudotsugae
  unsure (1)..(216): unsure at all Xaa locations
FITELGLFRAAVPSGASTGXHEALELRDEIAXQYLGKSVFKAVENVNNSIGPELVKQDFDVTQQEEIDEFMINLDGTDNKSKFGANAILGVSLAVCKAGAAKRGLPLYRHIADLAGNKNLILPVPAFNVINGGSHAGNKXAMQEFMILPTGACSFTEAMKMGSETYHTLKKIIKDKYGLDATAVGDEGGFAPNIANPKDALTILNDAIAKAGYSGK

SEQ ID NO: 8957 - protein, 161 aa, Hypothenemus eruditus
  unsure (1)..(161): unsure at all Xaa locations
VCTDNKSNLGANAILGVSLAVCKAGAAKRGVPLYRHIADLAGNKTLILPVPAFNVINGGSHAGNKLAMQEFMILPTGASSFTEAMKMGSETYHTFKKIIKDKYGLDATSVGDEGGFAPNIGNPKDVLAILNEAIAKAGYTGKIEIGMDVAASEFFKDSLXD

SEQ ID NO: 8958 - protein, 204 aa, Pityogenes hopkinsi
  unsure (1)..(204): unsure at all Xaa locations
AMKMGSETYHTLQNIIKDKYGLDATAVRDEGGFAPNIGNPKDALAILKDAIAKAGYTGKIEIGMDVAASEFFKQGLYDMDFKNPKSDKKNWLKPDKLLALYQDFIKTYPIVSIEXPFDQDDFDAWNMMKSATDIQIVGDDLTVTNPXRIQMAIDKDACNCLLLKVNQIGTISEAIRAHLLANXNGWXTMXSHSPAXLXILXSQT

SEQ ID NO: 8959 - protein, 158 aa, Pityokteines minutus
TENKSNFGANAILGVSLAVCKAGAAKRGLPLYKHIADLAGNKNLILPVPAFNVINGGEHAGNKLAMQEFMILPTGANTFTEAMKMGSETYHTLKKIIKDKYGLDATAVGDEGGFAPNIGNPKDALAILTDAIAKAGYTGKIEIGMDVAASEFFKDGLY

SEQ ID NO: 8960 - protein, 158 aa, Pityophthorus sp. SCH07
GTENKSNFGANAILGVSLAVCKAGAAKRGVPLYRHIADLAGNKNIILPVPAFNVINGGSHAGNKLAMQEFMILPTGACSFTEAMKMGAETYHTLKKSIKDKYGLDATAVGDEGGFAPNIGNPKDALSIINDAIAKAGYTGKIEIGMDIAASEFFKSGF

SEQ ID NO: 8961 - protein, 133 aa, Scolytus unispinosus
  unsure (1)..(133): unsure at all Xaa locations
ANAILGVSLAVCKAGAAKXGVPLYRHIADLAGNKNIVLPVPAFNVINGGSHAGNKLAMQEFMILPTGACSFAEAMKMGCETYHNLKKIIKDKYGLDATAVGDEGGFAPNITNNKDALQIINDAIXKAGYTGRI

SEQ ID NO: 8962 - protein, 287 aa, Taphrorychus bicolor
  unsure (1)..(287): unsure at all Xaa locations
DGTENKSNFGANAILGVSLAVCKAGAAKRGVPLYKHIADLCGNKNIILPVPAFNVINGGEHAGNKLAMQEFMILPTGACSFSEAMKMGSETYHTLKKIIKDKYGLDATAVGDEGGFAPNIGNPKDALLILNDAIAKAGYTGKVEIGMDVAASEFFKDGLYDLDFKNPKSDKKNWMKGDKLLALYQDFIKSYPIISMEDPFDQDDWDXWHLMKGXTNIQIVGDDLTVTNPKRIQTAIEKDACNCLLLKVNQIGTVTESIRAXLLAKQNGWGTMVSHRSGETEDTFIAD

SEQ ID NO: 8963 - protein, 153 aa, Oryza sativa
IDCGVSIGTIFGIYMIKDKDNVTLDDVLQPGTDMLAAGYCMYGSSCTLVLSTGNGVNGFTLDPSLGEFILTHPNIKIPNRGKIYSVNEGSAKNWDAPTAKFVEKCKFPQDGSPSKSLRYIGSMVADVHRTLLYGGIFLYPADQKSPNGKLRVL

SEQ ID NO: 8964 - protein, 168 aa, Oryza sativa (indica cultivar-group)
SSNIDCGVSIGTIFGIYMIKDKENVTLEDVLQPGKNMVAAGYCMYGSSCTLVLSTGNGVNGFTLDPSLGEFILTHPDIKIPKKGKIYSVNEGNAKNWDEPTAKFVEKCKFPKDGSSPKSLRYIGSMVADVHRTLLYGGVFLYPADKKSPNGKLRVLYEVFPMSFLMEQ

SEQ ID NO: 8965 - protein, 136 aa, Oryza sativa
TSFMWLCGPIAGMVVQPCVGLYSDRCTSKWGRRRPYILTGCVLICLAVVVIGFSADIGYAMGDTKEDCSVYHGSRWHAAIVYVLGFWLLDFSNNTVQGPARALMADLSGRHGPGTANSIFCSWMAMGNILGYSSGS

SEQ ID NO: 8966 - protein, 135 aa, Oryza sativa (indica cultivar-group)
TSFMWLCGPIAGMVVQPCVGLYSDRCTSKWGRRRPYILTGCVLICLAVVVIGFSADIGYAMGDTKEDCSVYHGSRWHAAIVYVLGFWLLDFSNNTVQGPARALMADLSGRHGPGTANSIFCSWMAMGNILGYSSG

SEQ ID NO: 8967 - protein, 358 aa, Oryza sativa (japonica cultivar-group); identical to SEQ ID NO: 3702

SEQ ID NO: 8968 - protein, 380 aa, Oryza sativa (japonica cultivar-group); identical to SEQ ID NO: 3771

SEQ ID NO: 8969 - protein, 496 aa, Avicennia marina
MPTRQLFIDGEWREPVQRKRIPIINPANEQTIGDIPAATAEEMDIAVEAARKAFFRNSGKDWSSTTGAHRAKYLRAIAAKIKDRKVELVELEAIDSGKPLEEASLDMDNVIGCFEYFAGIAERLDSEQRTPVSLPMETFKCHLLKEPIGVVGLISPWNYPLLMAIWKVAPALASGCTAILKPSELASVTCLELAEVCMEVGLPPGVLNILTGLGPEAGAPLVTHPHVAKISFTGSDTTGVKIMTAAAQLVKPVTLELGGKSPIVVFEDVDLDTAAEWTLFGCFWTNGQICSATSRLLVHESIATTFLEKLVKWCEKIKISDPLEEGCRLGPIVSRRQYEKVMKYISTAKEEGATILCGGARPEHLEKGYFVQPTIITDVKTSMQIWIEEVFGPVLCVKTFATEDEAVELANDTHYGLAAAVISKDLDRCERMAKAFQVGAVWVNCSQPCFYQAPWGGKKRSGFGRELGERGLDIYLNVKQVTRYVSSEPWGWYKSP

SEQ ID NO: 8970 - protein, 408 aa, Oryza sativa (japonica cultivar-group); identical to SEQ ID NO: 3677

SEQ ID NO: 8971 - protein, 764 aa, Legionella pneumophila
MLKILKRIVQDVTAASDLKEALGILVQRINTAINAEAVSVYLIDNKNAEYVLIATEGLNKQAEFRVRIALDCGLIGLIGRREEPINIENAPSHPDFYHNPLIGEDHLNAFLGVPIIQHRKLYGVLVVQQLEQRHFDDAEESFLITLAAQLGGIIAHAEATGELAELTQPKKGIGVDKVEAAYTALTGIGSVPGIGIGTAVVVYPPADIDAVPRNPVEELEDEINAFYEALETTRDDIRRLSKRMKETVAEEEHALFDVYLRILDRDSLGAEVEHVIREEKISAQAALATVIKKHVQQFESMGDDYLRERASDFRDLGRRVLAELQRTQREEIVYPKRTILIGEEITAAALAEVPEGQLAGVVSAKGSNNSHVAILARALGVPTVMGLRGLKVELVSRRALIVDGYYGHVYISPSKSLLAEFKQLAQEEQELNQSLVSLRDKPAETTDNYRVSLQVNTGLAMDAGLSMSVGAEGVGLYRSEVPFMSRDRFPSEDEQTIIYRQTLKAFAPRLVTMRTLDIGGDKILPYFPVEEENPYLGWRGIRITLDHPDVFLIQVRAMMRASEELDNLRIMLPMVTTLSEVEEAVYLIEQAFEELVEEGCEIVKPKIGVMIEVPAAAYLAREMAKRVDFISVGSNDLTQYLLAVDRNNARVAALYDPLHPAMLRTLLKIVEGGHAAGVEVSICGEMASDPLAVILLIAMGFDTLSMNSASLPRVKWVIRNFAIANARKILAEVLEFEHPAEIRFHLQKALEEEGLGGLIRAGKS

SEQ ID NO: 8972 - protein, 56 aa, Pan troglodytes
SPPGQVTEAVKVAIDVGYRHIDCAHVYQNENEVGVAIQEKLREQVVKREELFIVSK

SEQ ID NO: 8973 - protein, 148 aa, Mesembryanthemum crystallinum
GTAPFYLRHLPSSNIAEVPDLDDEYRSVMKEFALRLEKLAEEILDLFCENLGLEKGYLKKVFYGDKAPNFGTKVSNYPPCPKPDLIKGLRAHTDAGGVILLFQDDRVSGLQLLKDGEWIDVPPMRHSIVVNLGDQLEVITNGKYKSVM

SEQ ID NO: 8974 - protein, 206 aa, Ralstonia eutropha
LQPGSAQVAAGYALYGPTTMLVLTVGNGVNGFTLDPNLGEFFLTHPHLRVPPDTQEFAINASNSRFWEAPVQRYIGECMAGKSGPRGKDFNMRWIASMVAEAHRILMRGGVFMYPRDTKDPAKPGRLRLLYEANPIAFLMEQAGGRASTGRQTLMSVAPGALHQRIGVIFGSRNEVERIEGYHTNQTDPDLPSPLFNERSLFRASA

SEQ ID NO: 8975 - protein, 159 aa, Ralstonia eutropha
LQVPADTQEFAINASNSRFWEAPVQRYIAECMAGKSGPRGKDFNMRWIASMVAEAHRILMRGGVFMYPRDSKDPAKPGRLRLLYEANPIAFLMEQAGGRASTGRQTLMSVAPGALHQRIGVIFGSRNEVERIEGYHTDQTDPDLPSPLFNERSLFRASA

SEQ ID NO: 8976 - protein, 298 aa, Theileria annulata
MRRYHKMEKIGEGTYGVVYKAQNNHGEICALKKIRVEEEDEGIPSTAIREISLLKELHHPNIVWLRDVIHSEKCLTLVFEYLDQDLKKLLDACDGGLEPTTAKSFLYQILRGISYCHDHRILHRDLKPQNLLINREGVLKLADFGLARAFAIPVRSYTHEVVTLWYRAPDVLMGSKKYSTAVDIWSVGCIFAEMINGVPLFPGISEQDQLKRIFKILGTPNVDSWPQVVNLPAYNPDFCYYEKQAWSSIVPKLNESGIDLISRMLQLDPVQRISAKEALKHDYFKDLHRPSEFLNGVH

SEQ ID NO: 8977 - protein, 177 aa, Cricetulus griseus
FDELVRKFKVEYHAGGSTQNSIKVAQWMIQKPHKAATFFGCIGIDKFGEILKSKAAEAHVDAHYYEQNEQPTGTCAACITGDNRSLVANLAAANCYKKEKHLDLENNWVLVEKARVYYIAGFFLTVSPESVLKVARYAAENNRIFTLNLSAPFISQFFKESLMEVMPYVDILFGNET

SEQ ID NO: 8978 - protein, 40 aa, Cricetulus griseus
FLSQLVYNKPLTECIRAGHYAASVIIRRTGCTFPEKPDFH

SEQ ID NO: 8979 - protein, 498 aa, Rhizobium tropici
  unsure (1)..(498): unsure at all Xaa locations
MARIIETSTGLDALTFDDVLLQPGHSEVMPGQTNIATRIAQDIELNVPILSAAMDTVTESRLAIAMAQAGGMGVIHRNLTPVQQAEEVRQVKKFESGMVVNPVTIGPDATLAEALSLDEGPRHFRASPVVEKSHRLVGILTNRDVRFASDPEQKIYELMTRENLVTVKDGVQQHEAKRLLHTHRIEKXLVVDADSRFVGLITVKDIEKSQLNPHASKDAQGRLRAAAAISVGDDGYERAERLIDAGVDLLVVDTAHGHSQRVLDAVTRVKKLSNSVRIMAGNVATYDGTRALIDAGADAVKVGIGPGSICTTRIVAGVGVPQLAAIMSAVQAAQDQNIPIIADGGIKFSGDLAKAIAAGASAAMIGSLLAGTDESPGEVYLYQGRSFKAYRGMGSVGAMARGSADRYFQAEVRDTLKLVPEGIEGXVPYKGPVSGVLHQLAGGLKAAMGYVGGADLKDFQERATFVRISGAGLRESHAHDVTITPRKARIIPAQAADR

SEQ ID NO: 8980 - protein, 291 aa, Lycopersicon esculentum
MSMSSIFSRPRLVVKKVLARAQNEGDGAIVRRSIGRPELQNLDPFLMLDEFSVSQPAGFPDHPHRGFETVTYMLQGAFTHQDFAGHKGTIRTGDVQWMTAGRGIVHSEMPAGPGTQKGLQLWINLSSKDKMIEPRYQELLHQDIPKAEKDGVSVTILAGESMGKKSQVFTRTPTMYLDFTLKPGSEHHQPIPETWNAFLYIVEGEGAFGSSDSTTTPAHHCLVLGPGEGLSVWNKSSKPLRFVLIGGQPINEPVVQYGPFVMNTKSEIMQAYQDYQLGKNGFERSRQWYSK

SEQ ID NO: 8981 - protein, 270 aa, Arabidopsis thaliana
MSSSTSQDFVSRPVIKKVFAKLQKEGDGAVVRRGISRSEQKLLDPFLMLDEFSVSPPAGFPDHPHRGITHQDFKGHKGTIYAGDVQWMTAGRGIIHSEMPEEEVNKEPNYQELSHSDIPKAEQNGVEVKVIAGESMGIQSPVYTRTPTMFLDFTLQPGAQIHQNVPESWNAFAYILESGEGGGVFSSSNSSPIPAHSVVVFGPGNDGVSVWNKSSSKQLRFVLIAGEPIGEPVVQYGPFVMNTQAEIDMTIEDYHYGKNGFEMAKYWRSQ

SEQ ID NO: 8982 - protein, 261 aa, Thermoplasma acidophilum
MFGSDNRADYDNGFPWHPHRGIETITYQIKGKTFHEDSEGHRGIIAPGEIQWMTAGSGIFHEEMPKPIYYGEENKYRERNDSNAGIQLWLNMPASSKMADPAYRSIRSDQIPQISDDYGNRIRIVAGTVNRVSGALNENFQYDLMQRIDPYYVEILMEPDTRTSLSVPEGHRAIMAIVEGSIRVNGSTFNEKNVAVLSKEGTDIFIDSQANSRLIFLAGKPLNEPIAWYGPIVMNTRDQLIQAFNELQEGKFVKNRNPVWQ

SEQ ID NO: 8983 - protein, 476 aa, Homo sapiens [sequence omitted]

SEQ ID NO: 8984 - protein, 256 aa, Mus musculus
TAAPKVLLLSGQPASGGRALPLMVPGPRAAGSEASGTPQARKRQRLTHLSPEEKALRRKLKNRVAAQTARDRKKARMSELEQQVVDLEEENHKLQLENQLLREKTHGLVVENQELRTRLGMDTLDPDEVPEVEAKGSGVRLVAGSAESAALRLCAPLQQVQAQLSPPQNIFPWTLTLLPLQILSLISFWAFWTSWTLSCFSNVLPQSLLVWRNSQRSTQKDLVPYQPPFLCQWGPHQPSWKPLMNSFVLTMYTPSL

SEQ ID NO: 8985 - protein, 398 aa, Mus musculus
MALLRRPTVSSDLKNIDTEVIPKAKSHVTIRRAVLEEIGNKVRNRTTQVAKKPQNTKVPALPTKVTNVNKQPKPTASVKPVQMEALAPKDRPPAPEDVSMKEESLCQAFSDALLCKIEDIDNEDRENPQLCSDYVKDIYQYLRQLEVLQSINPHFLDGRDINGRMRAILVDWLVQVHSKFRLLQETLYMCIAIMDRFLQAQLVCRKKLQLVGITALLLASKYEEMFSPNIEDFVYITDNAYTSSQIREMETLILKELKFELGRPLPLHFLRRASKAGEVDVEQHTLAKYLMELTLVDYDMVHYHPSQVAAAASCLSQKVLGQGKWNLKQQYYTGYMESEVLEVMQHMAKNVVKVNDNRTKFIAVKNKYASSRLLKISTIPQLNSKIIKDLASPLLGSP

SEQ ID NO: 8986 - protein, 298 aa, Theileria parva
MRRYHKMEKIGEGTYGVVYKAQNNHGEICALKKIRVEEEDEGIPSTAIREISLLKELHHPNIVWLRDVIHSEKCLTLVFEYLDQDLKKLLDACDGGLEPTTAKSFLYQILRGISYCHDHRILHRDLKPQNLLINREGVLKLADFGLARAFAIPVRSYTHEVVTLWYRAPDVLMGSKKYSTAVDIWSVGCIFAEMINGVPLFPGISEQDQLKRIFKILGTPSVDSWPQVVNLPAYNPDFSYYEKQSWSSIVPKLNESGIDLISRMLQLDPVQRISAKEALKHDYFKDLHRPPEFLNGVH

SEQ ID NO: 8987 - protein, 271 aa, Oryza sativa (japonica cultivar-group)
MSIKSKLVAKMDALEKTSGKGHAKLPTYLDRLTDNAGWAGAISMTPSAGPRTFTNLQAKSCDTSSARETTTTSREAAKLTAREVAETRCSDFDLLPESSLKAKPPSPAASRRPPPRAGLIAVAPPASMGDCVVVENGHPVPKEEDAPVVAVERLPEGAGKPREEGSRGQRKQGGIRREPSFSRWCKDCSAMSNAPPGGASPASAASDDDSEEFELPLLPSDSGGGGGSHLPMDIEAGAAARSDDLPISPWLIAKVIALIASWYTLSTCLTL

SEQ ID NO: 8988 - protein, 530 aa, Homo sapiens
MLLWPLLLLLLLLPTLALLRQQRSQDARLSWLAGLQHRVAWGALVWAATWQRRRLEQSTLHVHQSQQQALRWCLQGAQRPHCSLRRSTDISTFRNHLPLTKASQTQQEDSGEQPLPPTSNQDLGEASLQATLLGLAALNKAYPEVLAQGRTARVTLTSPWPRPLPWPGNTLGQVGTPGTKDPRALLLDALRSPGLRALEAGTAVELLDVFLGLETDGEELAGAIAAGNPGAPLRERAAELREALEQGPRGLALRLWPKLQVVVTLDAGGQAEAVAALGALWCQGLAFFSPAYAASGGVLGLNLQPEQPHGLYLLPPGAPFIELLPVKEGTQEEAASTLLLAEAQQGKEYELVLTDRASLTRCRLGDVVRVVGAYNQCPVVRFICRLDQTLSVRGEDIGEDLFSEALGRAVGQWAGAKLLDHGCVESSILDSSAGSAPHYEVFVALRGLRNLSEENRDKLDHCLQEASPRYKSLRFWGSVGPARVHLVGQGAFRALRAALAACPSSPFPPAMPRVLRHRHLAQCLQERVVS

SEQ ID NO: 8989 - protein, 254 aa, Aedes aegypti
MDFTGKVVLITGASSGIGAATAKHLTHLGATVVMTGRNAESLKKCGAECVGKQKPLILVADVTKQEDNVRVIEETIKKFGKLDVLVNNAGRGVFGSIETTSLDQLDDMLNTNLRGAYHLTILAVPHLIKSKGNIVNVSSITGLKPFPNSLAYCISKAALDQFTRVIALELAPKQVRVNSVNPAVIATDFQNREGMSPAQYAAFVKHSEKTHALGRIGQPREVAEAIAFLATDSASFITGTCLSVDGGRTIMGPI

SEQ ID NO: 8990 - protein, 254 aa, Aedes aegypti
MDFTGKVVLITGASSGIGAATAKHLTHLGATVVMTGRNAESLKKCGAECVGKQKPLILVADVTKPEDNVRVIEETIKKFGKLDVLVNNAGRGVFGSIETTSLDQLDDMLNTNLRGAYHLTILAVPHLIKSKGNIVNVSSITGLKPFPNSLAYCISKAALDQFTRVIALELAPKQVRVNSVNPAVIATDFQNREGMSPAQYAAFVKHSEKTHALGRIGQPREVAEAIAFLATDSASFITGTCLSVDGGRTIMGPI

SEQ ID NO: 8991 - protein, 540 aa, Petunia x hybrida
MAFDFGTLLGNVDRLSTSDHQSVVSINLFVALICACIVIGHLLEENRWMNESITALVIGSCTGIVILLISGGKNSHILVFSEDLFFIYLLPPIIFNAGFQVKKKSFFRNFSTIMLFGALGTLISFIIISLGAIGIFKKMNIGSLEIGDYLAIGAIFSATDSVCTLQVLNQDETPLLYSLVFGEGVVNDATSVVLFNAIQNFDLSHIDTGKAMELVGNFLYLFASSTALGVAAGLLSAYIIKKLYFGRHSTDREVAIMILMAYLSYMLAELFYLSAILTVFFSGIVMSHYTWHNVTESSRVTTKHTFATLSFIAEIFIFLYVGMDALDIEKWKFVSDSPGISVQVSSILLGLVLVGRAAFVFPLSFLSNLTKKTPEAKISFNQQVTIWWAGLMRGAVSMALAYNQFTRGGHTQLRANAIMITSTITVVLFSTVVFGLMTKPLIRILLPSHKHLSRMISSEPTTPKSFIVPLLDSTQDSEADLERHVPRPHSLRMLLSTPSHTVHYYWRKFDNAFMRPVFGGRGFVPFAPGSPTDPVGGNLQ

SEQ ID NO: 8992 - protein, 553 aa, Nierembergia caerulea
MAFDFGTLLGKMNNLTTSDHQSVVSVNLFVALICACIVIGHLLEENRWMNESITALVIGSCTGVIILLISGGKNSHILVFSEDLFFIYLLPPIIFNAGFQVKKKSFFRNFSTIMLFGAVGTLISFIIISAGAIGIFKKMDIGHLEIGDYLAIGAIFAATDSVCTLQVLNQEETPLLYSLVFGEGVVNDATSVVLFNAVQNFDLSHISTGKALQLIGNFLYLFASSTFLGVAVGLLSAFIIKKLYFGRHSTDREVAIMILMAYLSYMLAELFYLSGILTVFFCGIVMSHYTWHNVTESSRVTTKHTFATLSFIAEIFIFLYVGMDALDIEKWKFVSDSPGTSIKVSSILLGLVLVGRGAFVFPLSFLSNLTKKNPEDKISFNQQVTIWWAGLMRGAVSMALAYNQFTRGGHTQLRANAIMITSTITVVLFSTVVFGLMTKPLILLLLPSQKHLIRMISSEPMTPKSFIVPLLDSTQDSEADLGRHVPRPHSLRMLLSTPSHTVHYYWRKFDNAFMRPVFGGRGFVPFVPGSPTEPVEPTEPRPAESRPTEPTDE

SEQ ID NO: 8993 - protein, 555 aa, Torenia hybrida
MGFESVIKLAASETDNLWSSGHGSVVAITLFVTLLCTCIVIGHLLEENRWMNESIIALIIGLATGVIILLISGGKSSHLLVFSEDLFFIYALPPIIFNAGFQVKKKSFFRNFATIMMFGAVGTLISFIIISLGTIAFFPKMNMRLGVGDYLAIGAIFAATDSVCTLQVLSQDETPLLYSLVFGEGVVNDATSVVLFNAVQNFDLPHMSTAKAFELVGNFFYLFATSTVLGVLTGLLSAYIIKKLYFGRHSTDREVAIMILMAYLSYMLAELFDLSGILTVFFCGIVMSHYTWHNVTENSRVTTKHTFATLSFVAEIFIFLYVGMDALDIEKWRFVSGSMTTSAAVSATLLGLVLLSRAAFVFPLSFLSNLAKKSPLEKISLRQQIIIWWAGLMRGAVSMALAYKQFTREGLTVERENAIFITSTITIVLFSTVVFGLMTKPLINLLIPSPKLNRSVSSEPLTPNSITIPLLGESQDSVAELFSIRGQTSQGGEPVARPSSLRMLLTKPTHTVHYYWRKFDNAFMRPVFGGRGFVPYVPGSPTERSVRNWEEETKQ

SEQ ID NO: 8994 - protein, 193 aa, Kokia drynarioides
HVGLNVNGEPFVACHECNLPICKSCFEYDLKEGRKACLRCGSTYDENLLDDVEKATGDQSTMPAQLSKSQDVGIHARHISSVSTLDSEMTEDNGNPIWKNRVESWKEKKNKKKKPAPTKVEREAEIPPEQQMEDKPVPDASQPLSTIIPIPKSRLAPYRTVIILRLIILGLFFNYRVTNPVDSAFGLWLTSVI

SEQ ID NO: 8995 - protein, 192 aa, Hampea appendiculata
HVGLNVNGEPFVACHECNFPICKSCFEYDLKEGRKACLRCGSPYDENLLDDVEKATGDQSTMAEHLSKSQDVGIHARHISSVSTLDSEMTEDNGNPIWKNRVESWKEKKNKKKPATTKVERKAEIPPEQQMEDKPALDASQPLSTIIPIPKSRLAPYRTVIIMRLIILGLFFHYRVTNPVDSAFGLWLTSVI

SEQ ID NO: 8996 - protein, 192 aa, Thespesia lampas
HVGLNVNGEPFVACHECNFPICKSCFEYDLKEGRKACLRCGSPYDENLLDDVEKATSYQSTMAEHLSKSQDVGIHARHISSVSTLDSEMTEDNGNPIWKNRVESWKEKKNKKKPATTKVEREAEIPPEQQMEDKPALDASQPLSTIIPIPKSRLAPYRTVIIMRLIILGLFFHYRVTNPVDSAFGLWLTSVI

SEQ ID NO: 8997 - protein, 193 aa, Thespesia populnea
HVGLNVNGDPFVACHECNFPICKSCFEYDLKEGRKACLRCGSPYDENLLDDVEKATGDQSTTAENLSKSQDAGIHARHISSVSTLDSEMTEDNGNPIWKNRVESWKEKKNKKKKPATTKVEREAEIPPEQQMEDKPALDASQPLSTIIPIPKNRLAPYRTVIIMRLIILGLFFHYRVTNPVDSAFGLWLTSVI

SEQ ID NO: 8998 - protein, 192 aa, Lebronnecia kokioides
HVGLNVNGEPFAACHECNFPICKSCFEYDLKEGRKACLRCGSPYDENLLDDVEKATGDQSTMAEHLSKSQDVGIHARHISSVSTLDSEMTEDNGNPIWKNRVESWKEKKNKKKPATTKVEREAEIPPEQQMEDKPAPDASQPLSTIIPIPKSRLAPYRTVIIMRLIILGLFFHYRVTNPVDSAFGLWLTSVI

SEQ ID NO: 8999 - protein, 193 aa, Cienfuegosia tripartita
HVGLNVNGEPFVACHECNFPVCKSCFEYDLKEGRKACLRCGSPYDENLLDDVEKATGDHSAVAANMSKSQDLGVHARHISSVSTLDSEMTEDNGNPIWKNRVESWKEKKNKKKKPATTKVEREAEIPPEQQMEDKPATDASQPLSTIIPIPKSRLAPYRTVIIMRLIILGLFFHYRVTNPVDSAFGLWLTSVI

SEQ ID NO: 9000 - protein, 194 aa, Malva sylvestris
HVGLNANGEPFVSCHECNFPICKTCFEYDIKEGRKACLRCASPYDENLLDDVEKASGEQSMMAAQSNKSQDVGVHARHISSVSTLDSEMTEDNGNPIWKNRVESWKEKKNKKKKPTATTKADIEAEVPPEQQMEDKPAPDASQPLSTIIPIPKSKLAPYRTVIIMRLIILGLFFHYRVTNPVDSAFGLWLTSVI

SEQ ID NO: 9001 - protein, 725 aa, Homo sapiens
MEPGDAARPGSGRATGAPPPRLLLLPLLLGWGLRVAAAASASSSGAAAEDSSAMEELATEKEAEESHRQDSVSLLTFILLLTLTILTIWLFKHRRVRFLHETGLAMIYGLIVGVILRYGTPATSGRDKSLSCTQEDRAFSTLLVNVSGKFFEYTLKGEISPGKINSVEQNDMLRKVTFDPEVFFNILLPPIIFHAGYSLKKRHFFRNLGSILAYAFLGTAVSCFIIGNLMYGVVKLMKIMGQLSDKFYYTDCLFFGAIISATDPVTVLAIFNELHADVDLYALLFGESVLNDAVAIVLSSSIVAYQPAGLNTHAFDAAAFFKSVGIFLGIFSGSFTMGAVTGVNANVTKFTKLHCFPLLETALFFLMSWSTFLLAEACGFTGVVAVLFCGITQAHYTYNNLSVESRSRTKQLFEVLHFLAENFIFSYMGLALFTFQKHVFSPIFIIGAFVAIFLGRAAHIYPLSFFLNLGRRHKIGWNFQHMMMFSGLRGAMAFALAIRDTASYARQMMFTTTLLIVFFTVWIIGGGTTPMLSWLNIRVGVEEPSEEDQNEHHWQYFRVGVDPDQDPPPNNDSFQVLQGDGPDSARGNRTKQESAWIFRLWYSFDHNYLKPILTHSGPPLTTTLPAWCGLLARCLTSPQVYDNQEPLREEDSDFILTEGDLTLTYGDSTVTANGSSSSHTASTSLEGSRRTKSSSEEVLERDLGMGDQKVSSRGTRLVFPLEDNA

SEQ ID NO: 9002 - protein, 374 aa, Gadus callarias
ATVGKVIKCKAAVAWEANKPLVIEEIEVDVPHANEIRIKIIATGVCHTDLYHLFEGKHKDGFPVVLGHEGAGIVESVGPGVTEFQPGEKVIPLFISQCGECRFCQSPKTNQCVKGWANESPDVMSPKETRFTCKGRKVLQFLGTSTFSQYTVVNQIAVAKIDPSAPLDTVCLLGCGVSTGFGAAVNTAKVEPGSTCAVFGLGAVGLAAVMGCHSAGAKRIIAVDLNPDKFEKAKVFGATDFVNPNDHSEPISQVLSKMTNGGVDFSLECVGNVGVMRNALESCLKGWGVSVLVGWTDLHDVATRPIQLIAGRTWKGSMFGGFKGKDGVPKMVKAYLDKKVKLDEFITHRMPLESVNDAIDLMKHGKCIRTVLSL

SEQ ID NO: 9003 - protein, 114 aa, Sinorhizobium meliloti
EKITGRVFGDTIRPLLLSVRSGARASMPGMMDTVLNLGLNDQSVHALGHDADDARFAWDSYRRFIQMYGDVVMGVDHEVFEEVLEDEKARLGHEQDTELSAVEWQHVISRYKEA

SEQ ID NO: 9004 - protein, 65 aa, Sinorhizobium meliloti
DPEVQLWGAIGAVFSSWMNPRAITYRHLHGIPAGWGTAVNVQAMVFGNLGNSSATGVAFTRNPST

SEQ ID NO: 9005 - protein, 265 aa, Azotobacter vinelandii
MSLLTQWRDDIRCVFERDPAARTTFEVLTTYPGVHAIIGYRLANRLWRAAWRYPARLLSFVARMLSNVDIHPGATIGERFFIDHGACVVIGETAEIGNDVTLYHGVTLGGTSWNKGKRHPTLRDGVLVGAGAKILGPITVGAGARVGANSVVVQDVPDGCTVVGIPGKVVKVREAGRPNPYGIDLDHHLIPDPVGKAIACLLERIDALEKQVEAGGLVTVGSQQQFYQVCNSDNSICESDCAGGTTAQAQQSAGRRRAVPTPVAE

SEQ ID NO: 9006 - protein, 762 aa, Homo sapiens
MASLLQDQLTTDQDLLLMQEGMPMRKVRSKSWKKLRYFRLQNDGMTVWHARQARGSAKPSFSISDVETIRNGHDSELLRSLAEELPLEQGFTIVFHGRRSNLDLMANSVEEAQIWMRGLQLLVDLVTSMDHQERLDQWLSDWFQRGDKNQDGKMSFQEVQRLLHLMNVEMDQEYAFSLFQAADTSQSGTLEGEEFVQFYKALTKRAEVQELFESFSADGQKLTLLEFLDFLQEEQKERDCTSELALELIDRYEPSDSGKLRHVLSMDGFLSYLCSKDGDIFNPACLPIYQDMTQPLNHYFICSSHNTYLVGDQLCGQSSVEGYIRALKRGCRCVEVDVWDGPSGEPVVYHGHTLTSRILFKDVVATVAQYAFQTSDYPVILSLETHCSWEQQQTMARHLTEILGEQLLSTTLDGVLPTQLPSPEELRRKILVKGKKLTLEEDLEYEEEEAEPELEESELALESQFETEPEPQEQNLQNKDKKKKSKPILCPALSSLVIYLKSVSFRSFTHSKEHYHFYEISSFSETKAKRLIKEAGNEFVQHNTWQLSRVYPSGLRTDSSNYNPQELWNAGCQMVAMNMQTAGLEMDICDGHFRQNGGCGYVLKPDFLRDIQSSFHPEKPISPFKAQTLLIQVISGQQLPKVDKTKEGSIVDPLVKVQIFGVRLDTARQETNYVENNGFNPYWGQTLCFRVLVPELAMLRFVVMDYDWKSRNDFIGQYTLPWTCMQQGYRHIHLLSKDGISLRPASIFVYICIQEGLEGDES

SEQ ID NO: 9007 - protein, 710 aa, Homo sapiens
MGGKQRDEDDEAYGKPVKYDPSFRGPIKNRSCTDVICCVLFLLFILGYIVVGIVAWLYGDPRQVLYPRNSTGAYCGMGENKDKPYLLYFNIFSCILSSNIISVAENGLQCPTPQVCVSSCPEDPWTVGKNEFSQTVGEVFYTKSSNFCLPGVPWNMTVITSLQQELCPSFLLPSAPALGRCFPWTNITPPALPGITNDTTIQQGISGLIDSLNARDISVKIFEDFAQSWYWILVALGVALVLSLLFILLLRLVAGPLVLVLILGVLGVLAYGIYYCWEEYRVLRDKGASISQLGFTTNLSAYQSVQETWLAALIVLAVLEAILLLVLIFLRQRIRIAIALLKEASKAVGQMMSTMFYPLVTFVLLLICIAYWAMTALYLATSGQPQYVLWASNISSPGCEKVPINTSCNPTAHLVNSSCPGLMCVFQGYSSKGLIQRSVFNLQIYGVLGLFWTLNWVLALGQCVLAGAFASFYWAFHKPQDIPTFPLISAFIRTLRYHTGSLAFGALILTLVQIARVILEYIDHKLRGVQNPVARCIMCCFKCCLWCLEKFIKFLNRNAYIMIAIYGKNFCVSAKNAFMLLMRNIVRVVVLDKVTDLLLFFGKLLVVGGVGVLSFFFFSGRIPGLGKDFKSPHLNYYWLPIMTSILGAYVIASGFFSVFGMCVDTLFLCFLEDLERNNGSLDRPYYMSKSLLKILGKKNEAPPDNKKRKK

SEQ ID NO: 9008 - protein, 330 aa, Homo sapiens
MPASREEGGGRGEGGAYHHRQPHHHFHHGGHRGGSLLQHVGGDHRGHSEEGGDEQPGTPAPALSELKAVICWLQKGLPFILILLAKLCFQHKLGIAVCIGMASTFAYANSTLREQVSLKEKRSVLVILWILAFLAGNTLYVLYTFSSQQLYNSLIFLKPNLEMLDFFDLLWIVGIADFVLKYITIALKCLIVALPKIILAVKSKGKFYLVIEELSQLFRSLVPIQLWYKYIMGDDSSNSYFLGGVLIVLYSLCKSFDICGRVGGVRKALKLLCTSQNYGVRATGQQCTEAGDICAICQAEFREPLILLCQMLLKGHKKLELEKIDESAGV

SEQ ID NO: 9009 - protein, 256 aa, Mus musculus
EKPLVSPPPAELQSHMGTEVMVETADNFQEVLSLTESPVPQRTEKFGKKNRKRLDSRAEEGSVQAITEGKVKKDARTLSDFNSLISSPRLGREKKKVKSQKDQLKSKKLNKTNEFQDSSESEPELFISGDELMNQSQGSKKGWKSKRSLRTASELEEFKCRKASEKEDGRLGSQGFVYVMANKQPLWNEATQVYQLDFGGRVTQESAKNFQIELEGRQVMQFGRIDGNAYILDFQYPFSAVQAFAVALANVTQRLK

SEQ ID NO: 9010 - protein, 395 aa, Homo sapiens
GQAKHQPTAIIAKTFKGRGITGVEDKESWHGKPLPKNMAEQIIQEIYSQIQSKKKILATPPQEDAPSVDIANIRMPSLPSYKVGDKIATRKAYGQALAKLGHASDRIIALDGDTKNSTFSEIFKKEHPDRFIECYIAEQNMVSIAVGCATRNRTVPFCSTFAAFFTRAFDQIRMAAISESNINLCGSHCGVSIGEDGPSQMALEDLAMFRSVPTSTVFYPSDGVATEKAVELAANTKGICFIRTSRPENAIIYNNNEDFQVGQAKVVLKSKDDQVTVIGAGVTLHEALAAAELLKKEKINIRVLDPFTIKPLDRKLILDSARATKGRILTVEDHYYEGGIGEAVSSAVVGEPGITVTHLAVNRVPRSGKPAELLKMFGIDRDAIAQAVRGLITKA

SEQ ID NO: 9011 - protein, 755 aa, Homo sapiens
MIRGRNSATSADEQPHIGNYRLLKTIGKGNFAKVKLARHILTGKEVAVKIIDKTQLNSSSLQKLFREVRIMKVLNHPNIVKLFEVIETEKTLYLVMEYASGGEVFDYLVAHGRMKEKEARAKFRQIVSAVQYCHQKFIVHRDLKAENLLLDADMNIKIADFGFSNEFTFGNKLDTFCGSPPYAAPELFQGKKYDGPEVDVWSLGVILYTLVSGSLPFDGQNLKELRERVLRGKYRIPFYMSTDCENLLKKFLILNPSKRGTLEQIMKDRWMNVGHEDDELKPYVEPLPDYKDPRRTELMVSMGYTREEIQDSLVGQRYNEVMATYLLLGYKSSELEGDTITLKPRPSADLTNSSAPSPSHKVQRSVSANPKQRRFSDQAAGPAIPTSNSYSKKTQSNNAENKRPEEDRESGRKASSTAKVPASPLPGLERKKTTPTPSTNSVLSTSTNRSRNSPLLERASLGQASIQNGKDSLTMPGSRASTASASAAVSAARPRQHQKSMSASVHPNKASGLPPTESNCEVPRPSTAPQRVPVASPSAHNISSSGGAPDRTNFPRGVSSRSTFHAGQLRQVRDQQNLPYGVTPASPSGHSQGRRGASGSIFSKFTSKFVRRNLSFRFARRNLNEPESKDRVETLRPHVVGSGGNDKEKEEFREAKPRSLRFTWSMKTTSSMEPNEMMREIRKVLDANSCQSELHEKYMLLCMHGTPGHEDFVQWEMEVCKLPRLSLNGVRFKRISGTSMAFKNIASKIANELKL

SEQ ID NO: 9012 - protein, 373 aa, Homo sapiens
MTSKPHSDWIPYSVLDDEGRNLRQQKLDRQRALLEQKQKKKRQEPLMVQANADGRPRSRRARQSEEQAPLVESYLSSSGSTSYQVQEADSLASVQLGATRPTAPASAKRTKAAATAGGQGGAARKEKKGKHKGTSGPAALAEDKSEAQGPVQILTVGQSDHAQDAGETAAGGGERPSGQDLRATMQRKGISSSMSFDEDEEDEEENSSSSSQLNSNTRPSSATSRKSVREAASAPSPTAPEQPVDVEVQDLEEFALRPAPQGITIKCRITRDKKGMDRGMYPTYFLHLDREDGKKVFLLAGRKRKKSKTSNYLISVDPTDLSRGGDSYIGKLRSNLMGTKFTVYDNGVNPQKASSSTLESGTLRQELAAVCYV

SEQ ID NO: 9013 - protein, 179 aa, Gossypium herbaceum
GAWTAEEDRKLAEVITVHGAKRWKTIPSIAGLNRCGKSCRLRWMNYLRPNIKRGNISDQEEDLILRLHKLLGNRWSLIAGRLPGRTDNEIKNYWNSHLSKKVNQKEKHRGASARQGCKFAQQRLVENAKEQVREENTSTGFGESNISFDVDDFFDFSNVDTRNFEWVNRFLEVDDGFKF

SEQ ID NO: 9014 - protein, 193 aa, synthetic construct
MEQNLSLKRFDVNKGAWTAEEDRKLAEVIAVHGAKRWKTIPTIAGLNRCGKSCRLRWMNYLRPNIKRGNISDQEEDLILRLHKLLGNRWSLIAGRLPGRTDNEIKNYWNSHLSKKVNQKEKHSGASARQGCKFAQQRLVENAKEQVREENTSTGFGESNISFDVDDFFDFSNVDTRNFEWVNRFLEVDDGFKF

SEQ ID NO: 9015 - protein, 193 aa, synthetic construct
  unsure (1)..(193): unsure at all Xaa locations
MEQNLSLKRFDVNKGAWTAEEDRKLAEVIAVHGAKRWKTIPTIAGLNRCGKSCRLRWMNYLRPNIKRGNISDQEEDLILRLHKLLGNRWSLIAGRLPGRTDNEIKNYWNSHLSKKVNQKEKHRGASARQGCKFAQQRLVENAKEQVREENTSTGFGESNISFDVDDFFDFSNVDTRXFEWVNRFLEVDDGFKF

SEQ ID NO: 9016 - protein, 193 aa, synthetic construct
  unsure (1)..(193): unsure at all Xaa locations
MEQNLSLKRFDVNKGAWTAEEDRKLAEVIAVHGAKRWKTIPTIAGLNRCGKSCRLRWMNYLRPNIKRGNISDQEEDLILRLHKLLGNRWSLIAXRLPGRTDNEIKNYWNSHLSKKVNQKEKHRGASARQGCKXAQQRLVENAKEQVREENTSTGFGESNISFDVDDFFDFSNVDTRNFEWVNRFLEVDDGFKF

SEQ ID NO: 9017 - protein, 193 aa, synthetic construct
  unsure (1)..(193): unsure at all Xaa locations
MEQNLSLKRFDVNKGAWTAEEDRKLAEVIAVHGAKRWKTIPTIAGLNRCGKSCRLRWMNYLRPNIKRGNISDQEEDLILRLHKLLGNRWSLIAGRLPGRTDXEIKNYWNSHLSKKVNQKEKHSGASARQGCKFAQQRLVENAKEQVRQENTSTGFEESNISFDVDDFFDFSKVDTRNFEWVNRFLEVDDGFKF

SEQ ID NO: 9018 - protein, 193 aa, synthetic construct
MEQNLSLKRFDVNKGAWTAEEDRKLAEVITVHGAKRWKTIPSIAGLNRCGKSCRLRWMNYLRPNIKRGNISDQEEDLILRLHKLLGNRWSLIAGRLPGRTDNEIKNYWNSHLSKKVNQKEKHSGASARQGCKFAQQRLVENAKEQVRQENTSTGFEESNISFDVDDFFDFSKVDTRNFEWVNRFLEVDDGFKF

SEQ ID NO: 9019 - protein, 193 aa, synthetic construct
MEQNLSLKRFDVNKGAWTAEEDRKLAEVIAVHGAKRWKTIPTIAGLNRCGKSCRLRWMNYLRPNIKRGNISDQEEDLILRLHKLLGNRWSLIAGRLPGRTDNEIKNYWNSHLSKKVNQKEKHRGASARQGCKFAQQRLVENAKEQVREENTSTGFGESNISFDVDDFFDFSNVDTRNFEWVNRFLEVDDGFKF

SEQ ID NO: 9020 - protein, 333 aa, Perilla frutescens
MENSTQESHPRPENVVTYDSPYPIYAMAISAVNRRRVAVGSFVEELKNHVDILSFSEDSSSLKPVPSLSFDHPYPPTKLLFHPSVSAPSNLLASSGDFLRLWEVKDSSIVAVSTLNNSKTSEYSAPLTSFDWNEVEPRRIGTSSIDTTCTIWDIEKGAVETQLIAHDKEVYDIAWGEAGVFASVSADGSVRIFDLRDKEHSTIIYESPMPDTPLLRLAWNKQDLRYMATILMDSNKIVILDIRSPTMPVAELERHSASVNAIAWAPQSCKHICSAGDDGQSLLWELPTVAGPNGIDPMTMYSAGAEINQLQWSAAQPDWIAIAFANKMQMLKV

SEQ ID NO: 9021 - protein, 347 aa, Schizosaccharomyces pombe
YDPIHEYVNHELRKRENEFSEHKNVKIFVASYNLNGCSATTKLENWLFPENTPLADIYVVGFQEIVQLTPQQVISADPAKRREWESCVKRLLNGKCTSGPGYVQLRSGQLVGTALMIFCKESCLPSIKNVEGTVKKTGLGGVSGNKGAVAIRFDYEDTGLCFITSHLAAGYTNYDERDHDYRTIASGLRFRRGRSIFNHDYVVWFGDFNYRISLTYEEVVPCIAQGKLSYLFEYDQLNKQMLTGKVFPFFSELPITFPPTYKFDIGTDIYDTSDKHRVPAWTDRILYRGELVPHSYQSVPLYYSDHRPIYATYEANIVKVDREKKKILFEELYNQRKQEVRDASQTS

SEQ ID NO: 9022 - protein, 237 aa, Pyrococcus furiosus
MGRIISIVSGKGGTGKTTVTANLSVALGDRGRKVLAVDGDLTMANLSLVLGVDDPDVTLHDVLAGEANVEDAIYMTQFDNVYVLPGAVDWEHVLKADPRKLPEVIKSLKDKFDFILIDCPAGLQLDAMSAMLSGEEALLVTNPEISCLTDTMKVGIVLKKAGLAILGFVLNRYGRSDRDIPPEAAEDVMEVPLLAVIPEDPAIREGTLEGIPAVKYKPESKGAKAFVKLAEEIEKLA

SEQ ID NO: 9023 - protein, 427 aa, Vibrio parahaemolyticus
MFSSRSLVDVLMLGQLGEAEIAAVGVAARATFVTTIMLVGVTTGGALLTAQYWGAGDKIGVRQSTSLTWMIAMVFAALAVCLFVFFPQPIMGLTTDSQEVIELGSSYLVISSASMFAVACVASMAVGLRAMHQPGLSTFFSGIGILSNVFLNWVLIFGHLGFPALGITGAAIATVISGAIEVGCLFGYLWLKKHIIAFGWGDIRASLVLDKITRFLSLSLPTTFNFLAWAGGLFAYHAIMGQAGVQGLAALSVMTPVESIALAMMIGLSNAAAVLVGNQLGAKNFEPVYYQAWATVILNVLIAFGVAVLLFFTNQLILDAFSALSAETRHLAEQFMVILALGVILRSVPMMVIVGVLRAGGDVKFCLYQDVFAQWIIGIPLAAFAAIYLGWEPQWVYLLFLTEEVVKWCICLPRMKSKKWMKNLIEK

SEQ ID NO: 9024 - protein, 274 aa, Trypanosoma cruzi
MNCNYSCVTLHNSVRMPQLGLGVWRAQDGAETANAVRWAIEAGYRHIDTAYIYSNERGVGQGIRESGVPREEVWVTTKVWNSDQGYEKTLAAFERSRELLGLEYIDLYLIHWPGKKKFVDTWKALEKLYEEKKVRAIGVSNFEPHHLTELFQSCKIRPMVNQVELHPLFQQRTLREFCKQHNIAITAWSPLGSGDRTGFLKNHVLGEIAKKHNKSPAQVVIRWDIQHGIVTIPKSANKGRIQENFNVWDFKLTEEDMRQIDELNEDNALRRTPW

SEQ ID NO: 9025 - protein, 320 aa, Homo sapiens [sequence omitted]

SEQ ID NO: 9026 - protein, 302 aa, Strongylocentrotus purpuratus
MDNLLCFEQEYFDHAKSPMSYVDQVLLRDKNLDNLLAVEEQYVLSADYFGNHFQRELRPSMRKLVVDWMFEVCEEQQREEDVFPLSVNYLDRFLSIERISRDKFQLLGATCMFLASKLLETIPLTSEKLIIYTDNSITLEQLLKFEQLVLTKLKWDLMAITPNAFLEHIFHRLPVDKEQAALLRKHAQTFIVLCATDYNFAMQPPSLIAASGVAAAANGLRMHIPKVIDLLHRITKIETDYLILVRDRMENLLSKNLVPGSPTKTAGHTTVQKTRSMDESDKPCTPTGVDEVEIITMPSGLC

SEQ ID NO: 9027 - protein, 261 aa, Streptomyces sp. PGA64
MSQQDKRVALVTGGTSGIGLAVARLLATQNHQVFIGARNAENVAETVKQLQGEGLDVDGSTLDVRSTDDARAFVQAAVDRFGTVDVLVNNAGRSGGGVTADITDELWSDVIDTNLNSVFRLTREVLTTGGLRHKGRGRIINIASTAGKQGVVLGAPYSASKHGVVGFTKALGNELAPTGITVNAVCPGYVETPMAQRVRQGYAAAYDATEEAILEKFQAKIPLGRYSTPEEVAGLVGYLASDTAASITSQALNVCGGLGNF

SEQ ID NO: 9028 - protein, 462 aa, Burkholderia vietnamiensis
MSHSGLTRTAAAPPSLSRHAVDTARLAAPLAIAQLSQMAMSVTDTVLLGSLGPDSLAAGGLGANFFFVIVTVLQGVLSSVSVSVAHARGAQAEHRVPHIYWTGFVLSVLLAIPAVVALSLSEPLLLMFHEPPTLAQHVGEYTGILRFAALGSLIGVGLMRAFLPAIGAARRLLWVSIGGIGVNAVLNYGLIHGAYGLPRLGFLGSAVATTITIWLTAFALIWLLHGRARFRHFVSAARPKLPMMGELIGIGWPVAITYGVESTLFLATGLTVGVLGATALAAHQIALNVASVAFMVPLAIGQAANVRVGYWIGAGDPVAARHAGFVALGLGVAFMSLSGLVLILAPHAIVGLYLHLDDPANAATVSLAASLLGIAAVFQIVDGMQTVGSGALRGLRDTRIPMLAATFGYWGIGFPTGYWLAFHAGLGARGLWWGLAAGLASVAVLMAWRFHLKTSSLIAAPR

SEQ ID NO: 9029 - protein, 657 aa, Drosophila melanogaster
MASASTENGEELMNYGSNSDSEESEYSENEDTQVCDKDSQQNSNADSGYPLDSPELQDSKTTGQKGQNKSGKTSIGAVHPNYGFGKRWSKSEDVLLKQLVETHGENWEIIGPHFKDRLEQQVQQRWAKVLNPELIKGPWTRDEDDMVIKLVRNFGPKKWTLIARYLNGRIGKQCRERWHNHLNPNIKKTAWTEKEDEIIYQAHLELGNQWAKIAKRLPGRTDNAIKNHWNSTMRRKYDVERRSVNASGSDLKSSRTHLITLIKSGGISKCMNNMQHNKESGGEAVNKSENADGASVTAVKGGDLAQESQDDHQKGSNLAHLSMQHLIKLTMPRQTPIILKRTRKHIPETHHQAGCSSSETFNQEEAAGNARSRPPSSPVISPIKSLPFSPSHFLKSPCLTTFEDMDLRASTPVTKVYNRVGMEIKKEMETSSIETPHKSQLGPRTPTPFKKALAAIGKKRDGRRYEPSSPSSLVEDLAEIIHEEHLSNSLTANNSKMMGAADQNSTLSTEYNAQSPPHMKRARKSLLSTWSSNHPYNAGSAKRIQPFETETPSKFLTSPGDILKDTLCSEQDLPFDEGRKENRPFHNRRINKYRGGLTYDHVIDPKWARVACGKSRDQMFMEEQAYACLKNLSCISRSLNFEKQKCLVNSFDRFGSL

SEQ ID NO: 9030 - protein, 1312 aa, Drosophila melanogaster
MMSAGGTYISTASVEVPQALQDGEKFIRWDDDSGTGTPVTMRVDAKGFFLYWVDQNNELDILDIATIRDVRTGQYAKRPKDNKLRQIVTLGPQDTLEEKTVTVCHGSDFVNMTFVNFCCTRRDIAQLWTDGLIKLAYSLAQLNGSAIMFLQKAHTKLCLQVDKSGRIPVKNIIKLFAQNKEDRKRVEKALDVTGLPSGKVDSISVSKFQFEDFYNLYKYLTQRSEVERLFDSIVGNSKRKCMSIAQLVEFLNKTQRDPRLNEILYPYANPARAKELIQQYEPNKFNAQKGQLSLDGFLRYLMGDDNPIMAPSKLDLCDDMDQPMSHYFINSSHNTYLTGHQLTGKSSVEIYRQCLLAGCRCVELDFWNGRTEEPVIVHGYTFVPEIFAKDVLEAIAESAFKTSEYPVILSFENHCNPRQQAKIANYCREIFGDMLLDKPLDSHPLEPNMDLPPPAMLRRKIIIKNKKKHHHHHHHHHHKKPAQVGTPAANNKLTTANSVDAKAAQQVGLSASHEDGGVTRSTANGDVATGTGTGSAAGTAGHAPPLQQIRQSSKDSTGSSDSDSSSEDESLPNTTPNLPSGNEPPPEKAQKETEAGAEISALVNYVQPIHFSSFENAEKKNRCYEMSSFDEKQATTLLKERPIEFVNYNKHQLSRVYPAGTRFDSSNFMPQLFWNAGCQLVALNFQTLDLAMQLNLGIFEYNARSGYLLKPEFMRRSDRRLDPFAESTVDGIIAGTVSITVLSGQFLTDKRANTFVEVDMYGLPADTVRKKFRTKTVRDNGMNPLYDEEPFVFKKVVLPELASIRIAAYEEGGKLIGHRVLPVIGLCPGYRHVNLRSEVGQPIALASLFLCVVVKDYVPDDLSNFAEALANPIKYQSELEKRDIQLSVLTDEAEALGSADEDLSKSCGQKKELRPVESLATSPKHRPSISAAAAMSVDVTVDRTDGGRGEDSISIVAPSIQHQHSLDQSVSTSIRQVESSQFDVDLVLAEPLEKILDHKSVKEKRLEMEKKLESLRKKHDKEKIKIAGQKSSPLEGKKPKFAITNKLVKRLSNKSLNCLSPHSEPGVEIPACPLDLGDSSEESAAADAGEDLAGGSSSLDGRTQESRLRSACREYTSQYRELQEKYHEAIYSAAEKVLKTSQTGQTKQLKASLDKVTGEVMHQLQEARRNEVKNLATVHRDRDELIRMKREVASSVVERGVAERVRLKQTFDRRTDELQKQHDSVRNALAEHRSKARQILDKEAESRSCVSSNGFLVLFHGPHHHGCTGSGSSALSGNNLTLNLDAGAAGSHSAISPAKSHNSIAAAAEMKT

SEQ ID NO: 9031 - protein, 536 aa, Rhodococcus sp. 19070
MSFQVALSFEDGVTRFIKCGPNETVADASYKARINIPLDCRDGACGTCKALCESGNYDGGDYIEEALTDDEAEQGFCLPCQMVPESDLVLQIATTSDVAKTAAATYTATITDLQRFSPSTVGFTVEIPNRDDLVFLPGQYVNITVPGTEQTRSYSFSTGPNDPQLSFLVKITEGGLMSEYLSDRAQVGDTLQFTGPFGSFFLRERKRPALLLAGGTGLAPLLAILSKMQEEGSDLPVHLVYGVSFDQDLVELDKLEAYTRSLPNFTFDYCVSDPESTAPNKGYVTGLFEPKHLNDGDVDVYLCGPPPMVEAVRTHLSDEGISVTNFYFEKFNNSATPGAAEPAPRPTERELEAATRAAEETGLPVSLGAAEQVPVGNYEIGEEHPPVTESDAQFDARMALELGALELTIGRLTDAQLVEFRILAEASTASIDHDRFTDAGAFTDTNAAFHEFLFRCCGNPVLLEAYNRLEVTQLMRKVLRTAQWVDEQIPHDHLQIVRAFERKDRAAARDLIVSHAEHAKATMRRAIEESAKVELA

SEQ ID NO: 9032 - protein, 260 aa, Rhodococcus sp. 19070
MYPGRFDGRVVTVTGAAQGIGLVVASRIAAEGGSVILVDRSELVHEVAKELREKGFQAHSVTADLETFAGAQSAIDEARQQHGRIDVLVNNVGGTIWAKPYEHYTPEQIQAEVQRSLFPTLWTCRAVLPYLIEQRSGTIVNVSSVATRGVNRVPYAAAKGGVNAITAALALEAAPYGIRVVATAPGGTDAPVRRVARGPAAQSEQEKGWYQQIVDQTVDSSLLKRYGTLDEQAAAITFLASEEASYITGTVLPVAGGDLG

SEQ ID NO: 9033 - protein, 260 aa, Bacillus subtilis
MYPDLKGKVVAITGAASGLGKAMAIRFGKEQAKVVINYYSNKQDPNEVKEEVIKAGGEAVVVQGDVTKEEDVKNIVQTAIKEFGTLDIMINNAGLENPVPSHEMPLKDWDKVIGTNLTGAFLGSREAIKYFVENDIKGNVINMSSVHAFPWPLFVHYAASKGGIKLMTETLALEYAPKGIRVNNIGPGAINTPINAEKFADPKQKADVESMIPMGYIGEPEEIAAVAAWLASKEASYVTGITLFADGGMTQYPSFQAGRG

SEQ ID NO: 9034 - protein, 341 aa, Trifolium repens
QTISYMAERVVGHGSFGVVFQAKCLETGETVAIKKVLQDKRYKNRELQTMRLLDHPNVVSLKHCFFSTTEKDELYLNLVLEYVPETVHRVIKHYNKLNQRMPMIYVKLYTYQIFRALSYIHRCIGVCHRDIKPQNLLVNPHTHQVKLCDFGSAKVLVKGEPNISYICSRYYRAPELIFGATEYTTAIDVWSVGCVLAELLLGQPLFPGESGVDQLVEIIKVLGTPTREEIKCMNPNYTEFKFPQIKAHPWHKIFHKRMPPEAVDLVSRLLQYSPNLRCQALDALTHPFFDELRDPNARLPTGRFLPPLFNFKPHELKGIPVETLVKLVPEHARKQCPFLGL

SEQ ID NO: 9035 - protein, 333 aa, Triticum aestivum; identical to SEQ ID NO: 4746

SEQ ID NO: 9036 - protein, 266 aa, Zea mays subsp. mays
PSADPSTDSAREPKRMRTGGGSTSSSSSSSSSMDGGRTRSSVVEAAPPATQASAAANGPAVPVVVVDTQEAGIRLVHALLACAEAVQQENFSAAEALVKQIPMLASSQGGAMRKVAAYFGEALARRVYRFRPPPDSSLLDAAFADLLHAHFYESCPYLKFAHFTANQAILEAFAGCRRVHVVDFGIKQGMQWPALLQALALRPGGPPSFRLTGVGPPQPDETDALQQVGWKLAQFAHTIRVDFQYRGLVAATLADLEPFMLQPEGD

SEQ ID NO: 9037 - protein, 266 aa, Tripsacum dactyloides
ASADPSTDSAREPKRMRTGGGSTSSSSSSSSSMDGGRTRSSVVEAAPPATQASAAANGPAVPVVVVDTQEAGIRLVHALLACAEAVQQENFSAAEVLVKQIPMLASSQGGAMRKVAAYFGEALARRVYRFRPPPDSSLLDAAFADLLHAHFYESCPYLKFAHFTANQAILEAFAGCRRVHVADFGIKQGMQWPALLQALALRPGGPPSFRLTGVGPPQPDETDALQQVGWKLAQFAHTIRVDFQYRGLVAATLADLEPFMLQPEGD

SEQ ID NO: 9038 - protein, 407 aa, Pisum sativum
MAAATASSQLIFSKPYSPSRLCPFQLCVFDAKSVLSSSRRKHVNGSGVRCMAVKEATSETKKRSGYEIITLTSWLLQQEQKGIIDAELTIVLSSISMACKQIASLVQRANISNLTGTQGAVNIQGEDQKKLDVISNEVFSNCLRSSGRTGIIASEEEDVPVAVEESYSGNYIVVFDPLDGSSNLDAAVSTGSIFGIYSPNDECLPDFGDDSDDNTLGTEEQRCIVNVCQPGSNLLAAGYCMYSSSVIFVLTIGKGVFVFTLDPLYGEFVLTQENLQIPKSGKIYSFNEGNYKLWDENLKKYIDDLKEPGPSGKPYSARYIGSLVGDFHRTLLYGGIYGYPRDKKSKNGKLRLLYECAPMSFIVEQAGGKGSDGHQRVLDIQPTEIHQRVPLYIGSTEEVEKVEKYLA

SEQ ID NO: 9039 - protein, 622 aa, Saccharomyces cerevisiae
MLFYSFVWSVLAASVALAKTHKLNYTASWVTANPDGLHEKRMIGFNGEWPLPDIHVEKGDRVELYLTNGFQDNTATSLHFHGLFQNTSLGNQLQMDGPSMVTQCPIVPGQTYLYNFTVPEQVGTFWYHAHMGAQYGDGMRGAFIIHDPEEPFEYDHERVITLSDHYHENYKTVTKEFLSRYNPTGAEPIPQNILFNNTMNVTLDFTPGETYLFRFLNVGLFVSQYIILEDHEMSIVEVDGVYVKPNFTDSIYLSAGQRMSVLIKAKDKMPTRNYAMMQIMDETMLDVVPPELQLNQTIQMRYGHSLPEARALNIEDCDLDRATNDFYLEPLIERDLLAHYDHQIVMDVRMVNLGDGVKYAFFNNITYVTPKVPTLTTLLTSGKLASDPRIYGDNINAQLLKHNDIIEVVLNNYDSGRHPFHLHGHNFQIVQKSPGFHVDEAYDESEQDEMTVPYNESAPLQPFPERPMVRDTVVLEPSGHVVLRFRADNPGVWYFHCHVDWHLQQGLASVFIEAPVLLQEREKLNENYLDICKAADIPVVGNAAGHSNDWFDLKGLPRQPEPLPKGFTTEGYLALIISTIIGVWGLYSIAQYGIGEVIPNDEKVYHTLREILAENEIEVSRG

SEQ ID NO: 9040 - protein, 274 aa, Saccharomyces cerevisiae; identical to SEQ ID NO: 1197

SEQ ID NO: 9041 - protein, 348 aa, Physcomitrella patens subsp. patens
MVDDCPVHNMAQFDIVQAEPTALLYKRPDGVALVGRENRRLKELFKDFGVQPSTVAVMGQMGFTLSTLINMKDEEVDFVIKSMIEEYHLDLLMGEQFGIKAAVRAKRRLVEEEMEQQRMDLAARSNEKKRRLEESSDGLLLKDGNGSLEALGLLGLTDPDSDSEGKKVAKRRQRKRRSKEVGEDGEERPREHPFIVTEPGEPAKGKKNGLDYLFDLYEQCGKFLEEVQHIAKEKGEKCPSKVTNEVFRHAKLTGAGYINKPKMRDYVHCYALHCLDVETSNNLRKEYKERGENVGAWCQACYFPLVKLARQNEWDIDDLFNRNDKLRIWYVPTKLRQLCHIERMKHGE

SEQ ID NO: 9042 - protein, 349 aa, Physcomitrella patens subsp. patens
MVDDCPVHNMQAHFDMVQAEPTALLYKRPDGTALAGRESRRLKELFKDFGVQPSTVTVMGQMGFTLSTLINMKDEEVDFVIKSMIEEYHLDLLMGEQFGIKAAVRAKRRLVVEELEQQRMDMAALSNEKKRRLEEPSDGLLLKDGNGSLEALGLLGLTDPDSDSEGKKAAKRRQRKRRSKEVGDDGEERPREHPFIVTEPGEPAKGKKNGLDYLFDLYEQCGKFLEEVQHIAKEKGEKCPSKVTNEVFRHAKLTGAGYINKPKMRDYVHCYALHCLDVETSNNLRKEFKERGENVGAWCQACYFPLVTLARQNEWDIDDLFNQNDKLRIWYVPTKLRQLCHIERMKHGE

SEQ ID NO: 9043 - protein, 500 aa, Thermoplasma volcanium
MDIFHIFSDKRLNTVYLSKNMEYHEVIEKLDFSKVTRFYWLLTLLATIGGFLFGYDTSNIGTALVFIPYPVQGFIEGYLVAGASLGAAVGALIAAGLTDRYGRKYLLIADAAIYAAGAILSAFTIDLAMLLLSRTLIGLAVGADSGIATAYISEYAPKDRRGSLGILQQWMITIGILGAYIVGMATLYAAPGLASVLDWRIMLGVAAIPALIGLGFRFMMPESPRWLMINGKYKEASEAFKKLGLNLSVDELKEVKFRQRAKITNGVKRAFLVVALFFVFQQITGINIPFYYGPIVIEKLHLFGSATQSLVFTQIYAVAAATILAVINVAATYIGFRYIDTVGRRKLALLGYSGMTFFGLLGGLLLYLKFDVGLLIAFAGFIIFFAFGVGGTGWMIQGEYFPTNMRGLYASLGAFVDWIANFAIIEIFPVLEALITIKNVMFVFGILSLIAVLIFYYIMPETKELSVEQISDLFENNGLSSLRKASMSYNKSSSGSSGKK

SEQ ID NO: 9044 - protein, 273 aa, Thermoplasma volcanium
MAFFWALNYVMVKFAYAYDLSSSILLMRVLYASIFSSLIFIRQIKLPKSPLEHLKVFILANLNITGFFSLWFFGETGVSAAVTSIVIYSYPILATAFSYLFLGDRFGAMKTLGLILGFAGLVIIFIRSINVENLVDLIMLLVAAISWAIGTVFYRKYLLGYDSAGLNTLQLLYALPVVLLISLFTGGINIGLLQLKFNLIMIYMGSFGTAIAYFIYLYLYRKYKVSSISAYFFLVPAISVVLAAVLLKEPISALTIAGFAVMSAGIFLSGSFK

SEQ ID NO: 9045 - protein, 280 aa, Thermoplasma volcanium
MLSISTLVFVTFIWGVTFPIIKDVFLYLSPVNFLALRFAVSTLLFLPVVIKKIKHVKSEEWKAGLIAGTLLFIAYYLQTIGLLYTQPALSGTITGIYVVFVPIISYLYLRRRIAHVEVYSSAFAFIGLVLMSYSGLSNVSIELGDFMTLAAAVFYAMQLVYVSKHASHIDTFVFSFIQIAVAAFFSAVFIPTFPEPFKITIYSAFVVLFTAVFATFLATYVYVSALSKMNVTKVGVILIGEPIFADLTSVILYGEKIGPIALIGIIIMIASIGTISYFAD

SEQ ID NO: 9046 - protein, 939 aa, Arabidopsis thaliana
MIKTKKVILSCWLQLKTCWFWQKLAKTTSKEFWLQCEGIVQDLDDRRQELPPGVLKQLHTRMLFILTRCTRLLQFHKESWGQEEDAVQLRQSGVLHSADKRDPTGEVRDGKGSSTANALKVPSTKKAYSQEQRGLNWIEGFFVRPAPLSSPYNETSKDSESPANIDKMSSWKRLPSPASKGVQEAAVSKEQNDRKVEPPQVVKKLVAISDDMAVAKLPEVSSAKASQEHMSKNRHNISWGYWGHQSCISEESSIICRICEEEIPTTHVEDHSRICALADKYDQKGVGVDERLMAVAVTLEKITDNVIQKDSLAAVESPEGMKISNASLTEELDVLSPKLSDWSRRGSEDMLDCFPETDNSVFMDDMGCLPSMSCRTRFGPKSDQGMATSSAGSMTPRSPIPTPRPDPIELLLEGKGTFHDQDDFPQMSELADIARCAANAIPVDDQSIQLLLSCLEDLRVVIDRRKFDALIVETFGTRIEKLIQEKYLQLCELMDDEKGTIIDEDAPLEDDVVRSLRTSPVHLRDRISIDDFEVMKSISRGAFGHVILARKNTTGDLFAIKVLRKADMIRKNAVESILAERDILINARNPFVVRFFYSFTCSENLYLVMEYLNGGDFYSMLRKIGCLDEANARVYIAEVVLALEYLHSEGVVHRDLKPDNLLIAHDGHVKLTDFGLSKVGLINNTDDLSGPVSSATSLLVEEKPKLPTLDHKRSAVGTPDYLAPEILLGTGHGATADWWSVGIILYEFLVGIPPFNADHPQQIFDNILNRNIQWPPVPEDMSHEARDLIDRLLTEDPHQRLGARGAAEVKQHSFFKDIDWNTLAQQKAAFVPDSENAFDTSYFQSRYSWNYSGERCFPTNENKDSSEGDSLCGSSGRLSNHHDEGVDIPCGPAEFETSVSENYPFDNFSFKNLSQLAYINYNLMSKGHKDETQPSLQRR

SEQ ID NO: 9047 - protein, 433 aa, Homo sapiens
MALRVTRNSKINAENKAKINMAGAKRVPTAPAATSKPGLRPRTALGDIGNKVSEQLQAKMPMKKEAKPSATGKVIDKKLPKPLEKVPMLVPVPVSEPVPEPEPEPEPEPVKEEKLSPEPILVDTASPSPMETSGCAPAEEDLCQAFSDVILAVNDVDAEDGADPNLCSEYVKDIYAYLRQLEEEQAVRPKYLLGREVTGNMRAILIDWLVQVQMKFRLLQETMYMTVSIIDRFMQNNCVPKKMLQLVGVTAMFIASKYEEMYPPEIGDFAFVTDNTYTKHQIRQMEMKILRALNFGLGRPLPLHFLRRASKIGEVDVEQHTLAKYLMELTMLDYDMVHFPPSQIAAGAFCLALKILDNGEWTPTLQHYLSYTEESLLPVMQHLAKNVVMVNQGLTKHMTVKNKYATSKHAKISTLPQLNSALVQDLAKAVAKV

SEQ ID NO: 9048 - protein, 651 aa, Xenopus laevis
MAVDDYEELLKYYELHETVGTGGFAKVKLASHLITGEKVAIKIMDKESLGDDLPRVKTEIDAMKNLSHQHVCRLYHVIETPKKIFMVLEYCPGGELFDYIIAKDRLTEEEARVFFRQIVSAVAYIHSQGYAHRDLKPENLLIDEDQNLKLIDFGLCAKPKGGLDYHLMTCCGSPAYAAPELIQGKAYIGSEADIWSMGVLMYALMCGYLPFDDDNVMVLYKKIMRGKYEIPKWLSPGSVLLLSQMMQVDPKKRITVKHLLNHPWLMHGYSCPVEWQSKYPLGYIDEDCVTELSVFYKYSRTSTTRLISEWSYDHITASYLLLHSKKSHGKAVRLKHPLAVGDQAVTSFKELRPKSKLDFEEPNGEIAYVFGSMDFSDEELFSEDFTYSSFEPHTPKEYVKGRLEFNSVDSAPATPVVQRNARHKNEDKENSNTAVARDENVFLHPAPWTPTPRRKQNEKKGILTTPNKNTQTKEKNQSKETPTKKPIGTGEEFANVISPERRCRSVELDLNQAHIDSAQKKKGAKVFGSLERGLDKMITMLTPSKRKGYTREGPRKLRAHYNVTTTNIVNPEQLLNQIVRVLPSKNVDYVQKGYTLKCKTQSDFGKVTMQFELEVCQLSKSEVVGIRRQRLKGDAWVYKRLVEDILSSCKV

SEQ ID NO: 9049 - protein, 317 aa, Gallus gallus
MAVPCMELNNKMKMPVLGLGTWQAPPGKVEEVVKHAIDAGYRHIDCAYFYQNEHEIGNAIKQKIKEGAVKREDLFVVTKLWNTFHEKSLVKEGCKRSLTALQLDYVDLYLMHYPMGFKAGEELLPEDDKGMIIPSDTDFLDTWEAMEELVDCGKVKAIGISNFNHEQIERLLNKPGLKYKPVVNQIECHPYLTQEKLIKYCHSKGIAVTAYSPLGSPNRPWAKPGEPMLLEDPKIKEIAARYHKTPAQVLIRFIIQRNLAVIPKSDKQQRIKENMQVFDFELSKKEMDVILSFNRNWRAIPVPQSANHKDYPFNAEY

SEQ ID NO: 9050 - protein, 267 aa, Schedonorus pratensis
MTALFSKAVALAALSSLLLVSYAAGTRPGNFNASDFTADPNWEAARATWYGAPTGAGPMDDGGACGFKNTNQYPFSSMTSCGNEPIFKDGKGCGSCYQIRCTNDPACSGKPETVVITDMNYYPVSKYHFDLSGTAFGAMAKPGLNDKLRHSGIIDIQFKRVPCEFPGLKVTFHVEHGSNAVCFAVLVEYEDGDGDVVQVDLMEANARNWTPMRESWGSIWRMDSNHRLQAPFSMRITNESGKQLVADKIIPANWAPSASYRSIVQFS

SEQ ID NO: 9051 - protein, 536 aa, Gossypium arboreum
MLQIAFSSYSWLLTASNQKDGMLFPVALSFLVAILGISLWHVWTIRKPKKDIAPLPPGPRGLPIVGYLPYLGTDNLHLVFTDLAAAYGPIYKLWLGNKLCVVISSAPLAKEVVRDNDITFSERDPPVCAKIITFGLNDIVFDSYSSPDWRMKRKVLVREMLSHSSIKACYGLRREQVLKGVQNVAQSAGKPIDFGETAFLTSINAMMSMLWGGKQGGERKGADVWGQFRDLITELMVILGKPNVSDIFPVLARFDIQGLEKEMTKIVNSFDKLFNSMIEERENFSNKLSKEDGNTETKDFLQLLLDLKQKNDSGISITMNQVKALLMDIVVGGTDTTSTMMEWTMAELIANPEAMKKVKQEIDDVVGSDGAVDETHLPKLRYLDAAVKETFRLHPPMPLLVPRCPGDSSNVGGYSVPKGTRVFLNIWCIQRDPQLWENPLEFKPERFLTDHEKLDYLGNDSRYMPFGSGRRMCAGVSLGEKMLYSSLAAMIHAYDWNLADGEENDLIGLFGIIMKKKKPLILVPTPRPSNLQHYMK

SEQ ID NO: 9052 - protein, 406 aa, Arabidopsis thaliana
MISGTGSSLFEELGLYYIGPVDGHNIDDLVAILKEVKSTRTTGPVLIHVVTEKGRGYPYAERADDKYHGVVKFDPATGRQFKTTNKTQSYTTYFAEALVAEAEVDKDVVAIHAAMGGGTGLNLFQRRFPTRCFDVGIAEQHAVTFAAGLACEGLKPFCAIYSSFMQRAYDQVVHDVDLQKLPVRFAMDRAGLVGADGPTHCGAFDVTFMACLPNMIVMAPSDEADLFNMVATAVAIDDRPSCFRYPRGNGIGVALPPGNKGVPIEIGKGRILKEGERVALLGYGSAVQSCLGAAVMLEERGLNVTVADARFCKPLDRALIRSLAKSHEVLITVEEGSIGGFGSHVVQFLALDGLLDGKLKWRPMVLPDRYIDHGAPADQLAEAGLMPSHIAATALNLIGAPREALF

SEQ ID NO: 9053 - protein, 532 aa, Arabidopsis thaliana
MVFNVVILSPHGYFAQDNVLGYPDTGGQVVYILDQVRALETEMLQRIKQQGLNITPRILIITRLLPDAAGTTCGQRLEKVYGSQYCDILRVPFRTEKGIVRKWISRFEVWPYLETFTEDVAAEISKELQGKPDLIIGNYSDGNLVASLLAHKLGVTQCTIAHALEKTKYPDSDIYWKKLDEKYHFSCQFTADLIAMNHTDFIITSTFQEIAGSKDTVGQYESHRSFTLPGLYRVVHGIDVFDPKFNIVSPGADMSIYFAYTEEKRRLTAFHLEIEELLYSDVENEEHLCVLKDKKKPIIFTMARLDRVKNLSGLVEWYGKNTRLRELVNLVVVGGDRRKESQDNEEKAEMKKMYELIEEYKLNGQFRWISSQMNRVRNGELYRYICDTKGAFVQPALYEAFGLTVVEAMTCGLPTFATCNGGPAEIIVHGKSGFHIDPYHGDKAAESLADFFTKCKHDPSHWDQISLGGLERIQEKYTWQIYSQRLLTLTGVYGFWKHVSNLDRLESRRYLEMFYALKYRPLAQAVPLAHEE

SEQ ID NO: 9054 - protein, 654 aa, Arabidopsis thaliana
MAKSEKHKLAQTLIDSINEIASISDSVTPMKKHCANLSRRLSLLLPMLEEIRDNQESSSEVVNALLSVKQSLLHAKDLLSFVSHVSKIYLVLERDQVMVKFQKVTSLLEQALSIIPYENLEISDELKEQVELVLVQLRRSLGKRGGDVYDDELYKDVLSLYSGRGSVMESDMVRRVAEKLQLMTITDLTQESLALLDMVSSSGGDDPGESFEKMSMVLKKIKDFVQTYNPNLDDAPLRLKSSLPKSRDDDRDMLIPPEEFRCPISLELMTDPVIVSSGQTYERECIKKWLEGGHLTCPKTQETLTSDIMTPNYVLRSLIAQWCESNGIEPPKRPNISQPSSKASSSSSAPDDEHNKIEELLLKLTSQQPEDRKSAAGEIRLLAKQNNHNRVAIAASGAIPLLVNLLTISNDSRTQEHAVTSILNLSICQENKGKIVYSSGAVPGIVHVLQKGSMEARENAAATLFSLSVIDENKVTIGAAGAIPPLVTLLSEGSQRGKKDAATALFNLCIFQGNKGKAVRAGLVPVLMRLLTEPESGMVDESLSILAILSSHPDGKSEVGAADAVPVLVDFIRSGSPRNKENSAAVLVHLCSWNQQHLIEAQKLGIMDLLIEMAENGTDRGKRKAAQLLNRFSRFNDQQKQHSGLGLEDQISLI

SEQ ID NO: 9055 - protein, 90 aa, Arabidopsis thaliana
MAATLGRDQYVYMAKLAEQAERYEEMVQFMEQLVTGATPAEELTVEERNLLSVAYKNVIGSLRAAWRIVSSIEQKEESRKNDEHVSLVKD

SEQ ID NO: 9056 - protein, 261 aa, Streptomyces aureofaciens
MSDQDKRVAVVTGATSGIGLAVARLLAAQDHRVFIGARSAENVAQTVKELQDEGLEVDGAVVDVRSTDGVRAWIQAAVDRFGSVDVVVNNAGRSGGGVTADIAEELWHDVIDTNLNSVFRVTREALTTGGLRAKDRGRIINIASTAGKQGVVLGAPYSASKHGVVGFTKALGNELAPTGITVNAVCPGYVETPMAQRVRQGYAAAYDATEEAILEKFQAKIPLGRYSTPEEVAGLVGYLASDAAASITLQALNVCGGLGNF

SEQ ID NO: 9057 - protein, 145 aa, Corynebacterium ammoniagenes
ITRGMADQSRTIRLPVHLVEQVNKLSRIKREMYQSLGREATNEELAEESGIEENKIEMLLRQSRDPVSLDMPVGADEEAPLGDFIEDAEATDAETAVVASMRHSDIRDVIGTLEQREQDVIRLRYGLDDGVPRTLDQIGRKFGLS

SEQ ID NO: 9058 - protein, 905 aa, Paracoccus pantotrophus
MPDPSSFSPMQQQKALWLSTTAFTLCFAVWTIFSIIGITIKEELGLTEFEYGVLIATPILTGSLVRLILGVWTERYGGRLVFSLQMLFTGLATWALTWADSYAGFLLAALGVGMAGGSFIIGVAYVSKWFPAQRQGTALGIFGMGNVGAAVTKFIAPFILVAWGWQAVAQIWAVGIALMGVVFLLVARDDPDFEARRAQGIAGPTLAEQFAPLKKLQVWRFALYYFFVFGGFVALALWLPHYLTQVYGVDLRVAGMAAAAFSLSASIFRAYGGILSDRFGARTVMYWTFGFSALFLFMLSYPPTDYTIRGKDGLISFSTEMGLWPFVVTLFALGFFMSLGKAAIFKHIPVYYPNHVGAVGGLVGMIGGLGGFVLPIVFGAALDLTGIWTSCFALLLLIVVVSMAWMHLSIRAMERRAQGRALDRLPNFPELAEVHDPERTVMPRVLDDWRPENPTFWAEQGRRIARRNLWISIPALTLAFAVWMVWSVVVAKLPLIGFGFTQDQLFWLAALPALSGATVRIFYSFMVPIFGGRLWTTLSTASLLIPAMGIGYAVQDPATPYVIFVALALLCGLGGANFASSMANISFFFPKSEKGNALGLNAGLGNLGVSLMQFLVPIVITMGVFGAMGGAAQELSDGSRLWMQNAGFIWVPFIIASTIAAWLGMNDITDARASFREQAVIFTRLHNWVMCLLYIGTFGSFIGYSAGFPLLIKLAFPDVNALQFVFLGPLVGALSRAGTGWLSDRVGGGRVTFWVFAGMIASVGLVIVSLQALSFWGFFAGFMALFFFTGVGNSSTFQMIPVIMRKEVARLEPQLSPEDRRRQSDRESAAIIAFTSAIGAYGGFFIPKAYGSSIALTGSAIGALWAFLGFYVLCLAVTWVFYTRPGGLLHDIERGRASAGAASPA

SEQ ID NO: 9059 - protein, 522 aa, Uromyces viciae-fabae
MPAVMAGPVSFAPPEGKSSKVAIVIAVFAAFGGFLYGYDTGYIAGVKAMPFWLRSAGQRGPDGKYMITTSQDSMVTSILSVGTFVGALLAYPIGDRFGRRIGIMIACAIFSVGVALQTASTKIPMFVVGRVFAGLGVGVASCLVPMYQSECAPKWIRGGIVACYQWAITIGLLVASITVNATKDFDSANSYRIPIGIQFIWAAILTIGLLVLPESPRYLLLKGREDEAWKSLSRLYSAPYDDPDVQAEFSEIMASLEKERSFGKTTLLDCFKTDKRKNLQRTLTGLGVQGWQQASGINFFFYYGTTFFKNAGIENAFLVTVATNVVNVVMTIPGIWAVDKVGRRTMMICGAAMMFTCELILACVGTFTATSNLASQKVLVAFSCIFIGLFAATWGPIPWVVTSEIYPLATRGKQMAMSTASNWAVNFFIGFITPYLVDSGAGQAGLGVKVFWLWAALCFGAMVFSFLLIPETKGLSLEQVDLLYTNSTVLKSNTYRSQLIANNLHEGMTPAEKAYQEKLEHI

SEQ ID NO: 9060 - protein, 195 aa, Bacillus subtilis
MDVEVKKNGKNAQLKDHEVKELIKQSQNGDQQARDLLIEKNMRLVWSVVQRFLNRGYEPDDLFQIGCIGLLKSVDKFDLTYDVRFSTYAVPMIIGEIQRFIRDDGTVKVSRSLKELGNKIRRAKDELSKTLGRVPTVQEIADHLEIEAEDVVLAQEAVRAPSSIHETVYENDGDPITLLIKSLTTQKKNGLTKLR

SEQ ID NO: 9061 - protein, 194 aa, Saccharomyces cerevisiae
MVTSNVVLVSGEGERFTVDKKIAERSLLLKNYLNDMHDSNLQNNSDSDSDSDSETNHKSKDNNNGDDDDEDDDEIVMPVPNVRSSVLQKVIEWAEHHRDSNFPDEDDDDSRKSAPVDSWDREFLKVDQEMLYEIILAANYLNIKPLLDAGCKVVAEMIRGRSPEEIRRTFNIVNDFTPEEEAAIRRENEWAEDR

SEQ ID NO: 9062 - protein, 501 aa, Macaca fascicularis
MTMVLGIGPVLGLVSVPLLGSASDHWRGRYGRRRPFIWALSLGILLSLFLIPRAGWLAGLLCPDPRPLELALLILGVGLLDFCGQVCFTPLEALLSDLFRDPDHCRQAYSVYTFMISLGGCLGYLLPAIDWDTSALAPYLGTQEECLFGLLTLIFLTCVAATLLVAEEAALGPAEPAEGLSAPSLPSHCCPCWARLAFRNLGALLPRLHQLCCRMPRTLRRLFVAELCSWMALMTFTLFYTDFVGEGLYQGVPRAELGTEARRHYDEGVRMGSLGLFLQCAISLVFSLVVDRLVQRFGTRAVYLASVAAFPVAAGATCLSHSVAVVTASAALTGFTFSALQILPYTLASLYHRERQVFLPKYRGDAGGTSSEDSLMTSFLPGPKPGAPFPNGHVGAGGSGLLPPPPALCGASACDVSVRVVVGEPTEARVVPGRGICLDLAILDSAFLLSQVAPSLFMGSIVQLSQSVTAYMVSAAGLGLVAIYFATQVVFDKSDLAKYSV

SEQ ID NO: 9063 - protein, 473 aa, Lactuca sativa
MALSLHTVFLCKEEALNLYARSPCNERFHRSGQPPTNIIMMKIRSNNGYFNSFRLFTSYKTSSFSDSSHCKDKSQICSIDTSFEEIQRFDLKRGMTLILEKQWRQFIQLAIVLVCTFVIVPRVDAVDALKTCACLLKECRIELAKCIANPSCAANVACLQTCNNRPDETECQIKCGDLFENSVVDQFNECAVSRKKCVPRKSDVGEFPVPDRNAVVQNFNMKDFSGKWYITSGLNPTFDAFDCQLHEFHMENDKLVGNLTWRIKTLDGGFFTRSAVQTFVQDPDLPGALYNHDNEFLHYQDDWYILSSQIENKPDDYIFVYYRGRNDAWDGYGGSVIYTRSPTLPESIIPNLQKAAKSVGRDFNNFITTDNSCGPEPPLVERLEKTAEEGEKLLIKEAVEIEEEVEKEVEKVRDTEMTLFQRLLEGFKELQQDEENFVRELSKEEKEILNELQMEATEVEKLFGRALPIRKLR

SEQ ID NO: 9064 - protein, 332 aa, Leishmania major
MITKAEASQWRLSDLEMRETVGTGTFGRVRLVKHKGTGQYAALKILKKQEILRMKQVDHVMAEASLLQEIDHPFIVSMLRGYMDKNRLYILLEYVVGGELFSHLRKAGKFPNDVSKFYCAEVILAFDYLHNKTIVYRDLKPENILLDQDGNIKITDFGFAKRVTERTFTLCGTPEYLAPEIIQSKGHNKAVDWWALGILLYEMLVGYPPFFDDSPMKIYEKILVGKVLFPRWVDSKARDFIKGLLSLDPTKRLGNLPNGTEDIKNHKYFAEVDWNVVLSKKIPAPIPVRQHKEGDTHYFDKYPDSPLNPLRTLTPAQQDCFANFCNGQYTDE

SEQ ID NO: 9065 - protein, 317 aa, Brassica napus
TTVAATKLTSLKATAGKLGYREICQVRQWAPLKSAMPHFGMLRCATSTVVKAQAQAQATATEQTTEEAVPKVESPVVVVTGASRGIGKAIALSLGKAGCKVLVNYARSAKEAEEVSKQIEEYGGEAITFGGDVSKEADVDSMMKTAVDKWGTIDVVVNNAGITRDTLLIRMKKSQWDEVIDLNLTGVFLCTQAATKIMMKKRKGRIINIASVVGLIGNIGQANYAAAKAGVIGFSKTAAREGASRNINVNVVCPGFIASDMTAKLGEDMEKKILGTIPLGRYGQPEYVAGLVEFLALSPASSYITGHTFSIHGGFAI

SEQ ID NO: 9066 - protein, 328 aa, Brassica napus
MATTSIAGPRLTSLKTAAGKLGYREICHVRQWAPVHSPMPHFGMLRCGSRRPFATSSSTVVQAQAQATAAEQSTGEEEAVPKVESPVVVVTGASRGIGKAIALSLGKAGCKVLVNYARSAKEAEQVSKQIEAYGGQAITFGGDVSKEADVDAMMKTAVDAWGTIDVVVNNAGITRDTLLIRMKKSQWDEVIDLNLTGVFLCTQAATKIMMKKRKGRIINIASVVGLIGNIGQANYAAAKAGVIGFSKTAAREGASRNINVNVVCPGFIASDMTAKLGEDMEKKILGTIPLGRYGQPEDVAGLVEFLALSPAASYITGQAFTIDGGIAI

SEQ ID NO: 9067 - protein, 315 aa, Brassica napus
MATTVAATKLTSLKAVKKLGFREIRQVRQWTPLQSSMPHFGSRQSFATSTVVKAQATAVEQSTGEAVPKVESPVVVVTGASRGIGKAIALSLGKAGCKVLVNYARSAKEAEEVSKQIEAYGGQAITFGGDVSKEADVEAMMKTAIDAWGTIDVVVNNAGITRDTLLIRMKKSQWDEVIDLNLTGVFLCTQAATKIMMKKRKGRIINIASVVGLIGNIGQANYAAAKAGVIGFSKTAAREGASRNINVNVVCPGFIASDMTAKLGEDMEKKILGTIPLGRYGQPEDVAGLVEFLALSPAASYITGQAFTIDGGIAI

SEQ ID NO: 9068 - protein, 254 aa, Brassica napus
TTTEEEEAVPKVESPVVVVTGASRGIGKAIALSLGKAGCKVLVNYARSAKEAEEVSKQIEEYGGQAITFGGDVSKEADVDAMMKTAVDKWGTIDVVVNNAGDTLLIRMKKSQWDEVMDLNLTGVFLCSQAATKIMMKKRKGRIINIASVVGLIGNIGQANYAAAKAGVIGFSKTAAREGASRNINVNVVCPGFIASDMTAKLGEDMEKKILGTIPLGRYGQPEDVAGLVEFLALSPAASYITGQTFTIDGGIAI

SEQ ID NO: 9069 - protein, 320 aa, Brassica napus
MATTVAATKLTSLKAVKKLGFREIRQVRQWSPLQSAMPHFGMLRCGSRQSFATSTVVKAQATAVEQSTGEAVPKVESPVVVVTGASRGIGKAIALSLGKAGCKVLVNYARSAKEAEEVSKQIEAYGGQAITFGGDVSKEADVEAMMKTAIDAWGTIDVVVNNAGITRDTLLIRMKKSQWDEVIDLNLTGVFLCTQAATKIMMKKRKGRIINIASVVGLIGNIGQANYAAAKAGVIGFSKTAAREGASRNINVNVVCPGFIASDMTAKLGEDMEKKILGTIPLGRYGQPEDVAGLVEFLALSPAASYITGQAFTIDGGIAI

SEQ ID NO: 9070 - protein, 509 aa, Nicotiana tabacum
MEGTNLTTYAAVFLGTLFLLLLSKFLRQRKLNLPPGPKPWPIIGNLNLIGNLPHRSIHELSLKYGPIMQLQFGTFPVVVGSSVEMAKVFLKSMDINFVGRPKTAAGKYTTYNYSDITWSPYGPYWRQARRMCLMELFSTKRLDSYEYIRAEELHSLLHNLNKISGKPIVLKDYLTTLSLNVISRMVLGKRYLDESENSIVTPEEFKKMLDELFLLNGVLNIGDSIPWIDFMDLQGYVKRMKFVSKKFDKFLEHVIDEHNVRRNGVENYIAKDMVDVLLQLADDPTLEVKLERHGVKAFTQDMLAGGTESSAVTVEWAISELLKKPEIFKKATEELDRVIGQNRWVQEKDIPNLPYIEAIVKETMRLHPVAPMLVPRECREDCKVAGYDVKKGTRVLVSVWTIGRDPTLWDEPEAFKPERFHEKSIDVKGHDFELLPFGAGRRMCPGYNLGLKVIQASLANLIHGFNWSLPDNMTPEDLDMDEIFGLSTPKKFPLATVIEPRLSPKLYSV

SEQ ID NO: 9071 - protein, 186 aa, Arabidopsis thaliana
MHRDVKPHNVMIDHELRKLRLIDWGLAEFYHPGKEYNVRVASRYFKGPELLVDLQDYDYSLDMWSLGCMFAGMIFRKEPFFYGHDNQDQLVKIAKVLGTDELNAYLNKYQLELDPQLEALVGRHSRKPWSKFINADNQHLVSPEAIDFLDKLLRYDHQDRLTAKEAMAHAYFAQVRAAETSRMRSQ

SEQ ID NO: 9072 - protein, 665 aa, Arabidopsis thaliana
MKREGEEEEDNNQLSLQEEEPDTEEEMSGRTIEPWTKQITVRGVFVSIVIGVVFSVIAQKLNLTTGIVPNLNSSAALLAFVFVQTWTKILKKSGFVAKPFTRQENTMIQTSAVACYGIAVGGGFASYLLGLNHKTYVLSGVNLEGNSPKSVKEPGLGWMTAYLFVVCFIGLFVLIPLRKVMIVDLKLTYPSGLATAVLINGFHTQGDAQAKKQVRGFMKYFSFSFLWGFFQWFFSGIEDCGFAQFPTFGLKAWKQTFFFDFSMTFVGAGMICSHLVNLSLLLGAILSYGLMWPLLDKLKGSWFPDNLDEHNMKSIYGYKVFLSVALILGDGLYTFVKILFVTIANVNARLKNKPNDLDDVGHKKQRKDLKEDENFLRDKIPMWFAVSGYLTFAAVSTVVVPLIFPQLKWYYVIVAYIFAPSLAFCNAYGAGLTDINMAYNYGKIGLFVIAAVTGRENGVVAGLAGCGLIKSVVSVSCILMQDFKTAHYTMTSPKAMFASQMIGTVVGCIVTPLSFFLFYKAFDIGNPNGEFKAPYALIYRNMAILGVRGFSALPLHCLQMCYGFFGFAVLVNVVRDLTPAKIGRFMPLPTAMAVPFLVGAYFAIDMCVGTLIVFVWEKMNRKKAEFMVPAVASGLICGEGLWTLPAAVLALAGVKPPICMKFLAS

SEQ ID NO: 9073 - protein, 438 aa, Alternaria alternata [sequence omitted]

SEQ ID NO: 9074 - protein, 445 aa, Hevea brasiliensis [sequence omitted]

SEQ ID NO: 9075 - protein, 397 aa, Oryctolagus cuniculus
MIPLEKPGSGGSPSAAASGSGPGGLLTEIRTAIRTEPFQDCYSLSPGRELGRGKFAVVRKCIQKDSGKEFAAKFMRKRRKGQDCRMEIIHEIAVLELAQDNPWVINLHEVYETSSEMILVLEYAAGGEISDQCVADRDEAFNEKDVQRLMRQILEGVHFLHTHDVVHLDLKPQNILLTSESPLGDIKIVDFGLSRIVKNSEELREIMGTPEYVAPEILSYDPISMATDMWSIGVLTYVMLTGISPFLGDNKQETFLNISQMNLSYSEEEFDTVSESAVDFIKKLLVKKPEDRATAEECLKHPWLTQSSIQDPVLRVKEALEEANALQKGDSVPEISSATEKPGTEESIVTEELIVVTSYTLGQCRQSEKEKMEQKAISKRFKFEEPLLQEIPGEFIY

SEQ ID NO: 9076 - protein, 518 aa, Funaria hygrometrica
RSSTKKSRKERRPNPFAQDGYHGNLQILKNQPKARILDKYVLGRELGRGEFGITYLCTDKETQEIFACKSISKKKLRTAVDVEDVRREVAIMKHLPEHPHVVTLKGAYEDDNAVHLVMELCEGGELFDRIIARGHYTERGAAQVTRTIVEVVQACHRQGVMHRDLKPENFLFANKNENSPLKAIDFGLSVFFKPGEKFSEIVGSPYYMAPEVLKRNYGPEVDVWSAGVILYILLCGVPPFWAETEQGVAQAILRGILDFKRDPWPKVSDSAKSLVRHMLEPDPKARYIAQQVLDHPWLQNAKKNPNVPLDAVRSRLKQFSAMNKLKKRALQVIAEHLGGEEIDGLKEMFEKLDSDNTGAITFEKLKMGLIEIGSQLTEHEVRLLMEAADVDGNGTLDYGEFVAATVHLQRLDDDEHLRRAFDVFDVNESGFIEVEELREAVGQSLMGSPSESDVVQAILSEVDLDKDGRISYEEFAVMMRRGTDWRKASRQYSRDRFNSLSMRLLRDGSLNPPSYSMR

SEQ ID NO: 9077 - protein, 301 aa, Solanum tuberosum
MNKGATGNQQLELPAGFRFHPTDDELVQHYLCRKCAGQPIAVSIITEIDLYKFDPWQLPEKALYGEKEWYFFSPRDRKYPNGSRPNRAAGTGYWKATGADKPVGKPKTLGIKKALVFYAGKAPRGIKTNWIMHEYRLANVDRSAGKNNNLRLDDWVLCRIYNKKGTLEKHYNVDNKETASFGEFDEEIKPKILPTQLAQMPPRPRSTPTNDYFHFESSESMTRMHTTNSSSGSEHVLSPCDKEVQSAPKWDEDHRNTLDFQLNYLDGLLNEPFETQMQQQSCNFDQFNNFQDMFFYMQKPY

SEQ ID NO: 9078 - protein, 261 aa, Streptomyces aureofaciens
MSDQGKRVAVVTGATSGIGLAVARLLAVQGHRVFIGARSAENVAETVKELQGEGLEVDGAVVDVRSTDGVRAWIQAAVDRFGSVDVVVNNAGRSGGGVTADIAEELWHDVIDTNLNSVFRVTREALTTGGLRAKDRGRIINIASTAGKQGVVLGAPYSASKHGVVGFTKALGNELAPTGITVNAVCPGYVETPMAQRVRQGYAAAYDATEEAILEKFQAKIPLGRYSTPEEVAGLVGYLASDAAASITSQALNVCGGLGNF

SEQ ID NO: 9079 - protein, 174 aa, Physcomitrella patens
GMSHEVRERTDALDAAGNTTAAIGKGFAIGSAALVSLALFGAYVSRAGIASVDVIQPKEFVGLIVGAMLPYWFSAMTMKSVGKAALAMVEEVRRQFRTIPGLMEGTTKPDYKRCVKISTDASLKEMIPPGALVMLTPLIVGTLFGVETLAGLLAGALVSGVQIAISASNTGGAW

SEQ ID NO: 9080 - protein, 542 aa, Ipomoea tricolor
MAFGLSSLLQNSELFTSDHASVVSMNLFVALLCACIVLGHLLEENRWVNESITALIIGLCTGVVILLLSRGKSSHLLVFSEDLFFIYLLPPIIFNAGFQVKKKQFFVNFMTIMLFGAIGTLISCSIISFGAVKIFKHLDIDFLDFGDYLAIGAIFAATDSVCTLQVLSQDETPLLYSLVFGEGVVNDATSVVLFNAIQSFDMTSFDPKIGLHFIGNFLYLFLSSTFLGVGIGLLCAYIIKKLYFGRHSTDREVALMMLMSYLSYIMAELFYLSGILTVFFCGIVMSHYTWHNVTESSRVTTRHSFATLSFVAETFIFLYVGMDALDIEKWKFVKNSQGLSVAVSSILVGLILVGRAAFVFPLSFLSNLAKKNSSDKISFRQQIIIWWAGLMRGAVSIALAYNKFTTSGHTSLHENAIMITSTVTVVLFSTVVFGLMTKPLINLLLPPHKQIASGHSSMTTSEPSSPKHFAVPLLDNQHDSESDMITGPEVARPTALRMLLRTPTHTVHRYWRKFDDSFMRPVFGGRGFVPFVAGSPAEQSPR

SEQ ID NO: 9081 - protein, 624 aa, Oryza sativa (japonica cultivar-group)
MERRRKAMWLYPKVVGFNPPERWGHSACFFEGVVYVFGGCCGGLHFSDVLTLNLETMAWSSLATTGARPGTRDSHGAALVGHRMMVFGGTNGSKKVNDLHVLDLRTKEWTKPPCKGTPPSPRESHTVTACGGCDRLVVFGGSGEGEGNYLNDVHVLDVATMTWSSPEVKGDVVPAPRDSHGAVAVGSRLVVYGGDCGDRYHGEVDVLDMDAMAWSRFAVKGASPGVRAGHAAVGVGSKVYVIGGVGDKQYYSDAWILDVANRSWTQLEICGQQPQGRFSHSAVVLNTDIAIYGGCGEDERPLNELLILQLGSEHPNGRYNISMCKVLSNHWSQERRKFLRTENQRDPNMSNGELGPRSREAEIEQRNPFLRGLENGHVKRRRTGDVRLKETESEQEEHSLSLSQHSSPSQSDQEQNGAQKLSASPNGSISALQPFVHLNTNGTLRAAGGVSPRTLKTDQFLRTIAPQQRHEVQFLAAEPKLHHRPPTPPLIGAEVHGTIDGAFDSGYLMTAVVNGQLFRGVLFAPGPGVTAPRPTLHHPILMSSAIPPQQQQQRPVLAHAIPVHARPVPQATGFVLPDCSNHARQAFPASAAAAAAKIIKSEPERGGSDLHDVVLTLGGPGAGK

SEQ ID NO: 9082 - protein, 1109 aa, Ipomoea nil
MKVAVNTFLLFLCSTSSIYAAFALNSDGAALLSLTRHWTSIPSDITQSWNASDSTPCSWLGVECDRRQFVDTLNLSSYGISGEFGPEISHLKHLKKVVLSGNGFFGSIPSQLGNCSLLEHIDLSSNSFTGNIPDTLGALQNLRNLSLFFNSLIGPFPESLLSIPHLETVYFTGNGLNGSIPSNIGNMSELTTLWLDDNQFSGPVPSSLGNITTLQELYLNDNNLVGTLPVTLNNLENLVYLDVRNNSLVGAIPLDFVSCKQIDTISLSNNQFTGGLPPGLGNCTSLREFGAFSCALSGPIPSCFGQLTKLDTLYLAGNHFSGRIPPELGKCKSMIDLQLQQNQLEGEIPGELGMLSQLQYLHLYTNNLSGEVPLSIWKIQSLQSLQLYQNNLSGELPVDMTELKQLVSLALYENHFTGVIPQDLGANSSLEVLDLTRNMFTGHIPPNLCSQKKLKRLLLGYNYLEGSVPSDLGGCSTLERLILEENNLRGGLPDFVEKQNLLFFDLSGNNFTGPIPPSLGNLKNVTAIYLSSNQLSGSIPPELGSLVKLEHLNLSHNILKGILPSELSNCHKLSELDASHNLLNGSIPSTLGSLTELTKLSLGENSFSGGIPTSLFQSNKLLNLQLGGNLLAGDIPPVGALQALRSLNLSSNKLNGQLPIDLGKLKMLEELDVSHNNLSGTLRVLSTIQSLTFINISHNLFSGPVPPSLTKFLNSSPTSFSGNSDLCINCPADGLACPESSILRPCNMQSNTGKGGLSTLGIAMIVLGALLFIICLFLFSAFLFLHCKKSVQEIAISAQEGDGSLLNKVLEATENLNDKYVIGKGAHGTIYKATLSPDKVYAVKKLVFTGIKNGSVSMVREIETIGKVRHRNLIKLEEFWLRKEYGLILYTYMENGSLHDILHETNPPKPLDWSTRHNIAVGTAHGLAYLHFDCDPAIVHRDIKPMNILLDSDLEPHISDFGIAKLLDQSATSIPSNTVQGTIGYMAPENAFTTVKSRESDVYSYGVVLLELITRKKALDPSFNGETDIVGWVRSVWTQTGEIQKIVDPSLLDELIDSSVMEQVTEALSLALRCAEKEVDKRPTMRDVVKQLTRWSIRSYSSSVRNKSK

SEQ ID NO: 9083 - protein, 504 aa, Homo sapiens
MSKAIAFEIIQKYEPIEEVRKAHQMSLEGFTRYMDSRECLLFKNECRKVYQDMTHPLNDYFISSSHNTYLVSDQLLGPSDLWGYVSALVKGCRCLEIDCWDGAQNEPVVYHGYTLTSKLLFKTVIQAIHKYAFMTSDYPVVLSLENHCSTAQQEVMADNLQATFGESLLSDMLDDFPDTLPSPEALKFKVLVKNKKIGTLKETHERKGSDKRGDNQDKETGVKKLPGVMLFKKKKTRKLKIALALSDLVIYTKAEKFKSFQHSRLYQQFNENNSIGETQARKLSKLRVHEFIFHTRKFITRIYPKATRADSSNFNPQEFWNIGCQMVALNFQTPGLPMDLQNGKFLDNGGSGYILKPHFLRESKSYFNPSNIKEGMPITLTIRLTSGIQLPLTHSSSNKGDSLVIIEVFGVPNDQMKQQTRVIKKNAFSPRWNETFTFIIHVPELALIRFVVEGQGLIAGNEFLGQYTLPLLCMNKGYRRIPLFSRMGESLEPASLFVYVWYVR

SEQ ID NO: 9084 - protein, 367 aa, Arabidopsis thaliana
MGKKKKRATEKVWCYYCDREFDDEKILVQHQKAKHFKCHVCHKKLSTASGMVIHVLQVHKENVTKVPNAKDGRDSTDIEIYGMQGIPPHVLTAHYGEEEDEPPAKVAKVEIPSAPLGGVVPRPYGMVYPPQQVPGAVPARPMYYPGPPMRHPAFVWQMPPPRPQQWYPQNPALSVPPAAHLGYRPQPLFPVQNMGMTPTPTSAPAIQPSPVTGVTPPGIPTSSPAMPVPQPLFPVVNNSIPSQAPPFSAPLPVGGAQQPSHADALGSADAYPPNNSIPGGTNAHSYASGPNTSGPSIGPPPVIANKAPSNQPNEVYLVWDDEAMSMEERRMSLPKYKVHDETSQMNSINAAIDRRISESRLAGRMAF

SEQ ID NO: 9085 - protein, 526 aa, Arabidopsis thaliana
MEATQKHMIQEGSSMFYHQPSSVKQMDLSVQTFDSYCTLESSSGTKSHPCLNNKNNSSSTTSFSSNESPISQANNNNLSRFNNHSPEENNNSPLSGSSATNTNETELSLMLKDLETAMMEPDVDNSYNNQGGFGQQHGVVSSAMYRSMEMISRGDLKGVLYECAKAVENYDLEMTDWLISQLQQMVSVSGEPVQRLGAYMLEGLVARLASSGSSIYKALRCKDPTGPELLTYMHILYEACPYFKFGYESANGAIAEAVKNESFVHIIDFQISQGGQWVSLIRALGARPGGPPNVRITGIDDPRSSFARQGGLELVGQRLGKLAEMCGVPFEFHGAALCCTEVEIEKLGVRNGEALAVNFPLVLHHMPDESVTVENHRDRLLRLVKHLSPNVVTLVEQEANTNTAPFLPRFVETMNHYLAVFESIDVKLARDHKERINVEQHCLAREVVNLIACEGVEREERHEPLGKWRSRFHMAGFKPYPLSSYVNATIEGLLESYSEKYTLEERDGALYLGWKNQPLITSCAWR

SEQ ID NO: 9086 - protein, 179 aa, Oryza sativa (indica cultivar-group)
MAGSGRDRDPLVVGRVVGDVLDAFVRSTNLKVTYGSKTVSNGCELKPSMVTHQPRVEVGGNDMRTFYTLVMVDPDAPSPSDPNLREYLHWLVTDIPGTTAASFGQEVMCYESPRPTMGIHRLVFVLFQQLGRQTVYAPGWRQNFNTKDFAELYNLGSPVAAVYFNCQREAGSGGRRVYN

SEQ ID NO: 9087 - protein, 179 aa, Oryza sativa (japonica cultivar-group)
MAGSGRDRDPLVVGRVVGDVLDAFVRSTNLKVTYGSKTVSNGCELKPSMVTHQPRVEVGGNDMRTFYTLVMVDPDAPSPSDPNLREYLHWLVTDIPGTTAASFGQEVMCYESPRPTMGIHRLVFVLFQQLGRQTVYAPGWRQNFNTKDFAELYNLGSPVAAVYFNCQREAGSGGRRVYP

SEQ ID NO: 9088 - protein, 858 aa, Trypanosoma brucei brucei
MLSKLFRYDTKLQGKQELSTADHRSLLELSMTDNITSVEIPQYRVRGTFVENVIECTKRNMTWQVFRRYQQFKALDQSLKQLCSRGSSRHCDYGVIPVLCGSHWTEVTNQSIDLVEKRRRHLEIYLRQLLVPGNVFYVAKTVIYDFLHDGAVPAQHQRRAIRPLIGFATPDSLADLHLENRNGEGSASRLGAASTLNDKSISMLGPSAVGESDRVDDGVGDEEEEPCKSPPGETVESGEECEDLPSADNSEAEDVRVPPPGSLCRQCNAEFSSVLYPHRCFFCRQQFCRDCLHPVELEEGEVARSCVQCYENFARKTCKPQYPPTPMASTPILQCAPAGGALDPLNLLGSTSHVRTDVTLSDFKLVTTVGRGTFGKVMKVIFREDGKVYAMKVLNKCVIHKRRMIEYIREEKNIMSSLPSHPYIVTCHFAFQTDYHLFFVLDYLPGGDMHSRVYPKLKLTESDVRLYIAELVLALQHLHRHDIAHRDVKLENIVLGEDGHLKLTDFGLARMNFSRQRRRSFVGSPEYLPPETIQGKYQTKAVDWWSAGVMLYEMLSGKTPFYSAYNCEIYNNVLKAELDLTAPCFTPEAASLIEQLLQSHPKARLQDAGAIKAHPYFASIDWAALEGKKISAPIQLDLMGNDMKYIKWKFTAEWAVIYKPPGVTRATIDLLINRFSNFAHVSEGTPPTPHLPIGQQQEEVSDGVTNPPDITGVWNVVKVEMQTEDGKITHPWGSAVCGVLAYFPEGQFSMQLTSYMRPHLRQQFVDRAVREDLVEMCNSYAGSFGKYQIKPGSNIITHRLHGCLCPNLTGSTQKYFFEVRERKENGAKVLKLFTACNALPGEDISAQTVLTWERTGSC

SEQ ID NO: 9089 - protein, 275 aa, Myxococcus xanthus
MLGGTAVVMTVDAYGPISDNAGGISEMSGLGPEVRAITDELDAVGNTTAAIGKGFAIGSATLTVIALFSAFNLEVNHTRIAAGLPEMSLQLTNPNVIVGLLLGSILPFLVGASTMLAVGRAAGAIVEEIGRQFREIPGLMELKADPDPKKIVDIATKSALQEMVFPGIIAVAAPPLVGYLLGPGALAGLLAGSLVVGATMALYMANAGGAWDNAKKFIEKGKLPGHAKGSAVHKAAVVGDMVGDPFKDTSGPGVAILIKVMSVVSLLVASLIALR

SEQ ID NO: 9090 - protein, 378 aa, Microscilla sp. PRE1
MKIKTRIMSLKSKAAIATGDGAFIIDTTEVSSPQPDEVLVRIRAAGLCHTDHDSLRWGKSIVMGHEGAGVVEQVGNQVDALAPGDKVILNWATPCMQCYQCQEGNQHICENHSPVAAGANGHTPGHAHLEGTQWQGKPIERSFNIGTLSEYTLVKASACVKMDGDIPMSSASIISCGVMTGYGSVVNSARLTAGSSSVVLGTGGVGLNVIQGCRISGASKIIAIDINPQRLEMAKVFGATHTILADKNDLGLMQASEEVKKLTSGRGADYAFECTAISALGAAPLAMIRNAGTAVQVSGIEEEITIDMRLFEWDKLYINPLYGKCRPQLDFPKLESLYHKGELKLDEMITRTYQLEDLQQAFDDMLSGKNAKGVIVFD

SEQ ID NO: 9091 - protein, 256 aa, Microscilla sp. PRE1
MSIIDKFQLKGKVALVTGCKRGIGKAMAIGLAEAGADIIGVSASLELEGSSVEQAIRATGRNFKAYQCDFSDRKSLYNFINSVKADYSRIDILVNNAGTILRTPAAEHPDEMWDKVIEVNQNAQFILTRELGKEMVSRGEGKVIFTASLLTFQGGITVPGYAASKGAIGQMTMAFANEWASKGVNVNAIAPGYISTDNTEALRNDPDRSASILSRIPAGRWGEAEDFAGPVVFLASEAAAYMHGSIMLVDGGWMGR

SEQ ID NO: 9092 - protein, 486 aa, Microscilla sp. PRE1
MIMSTVKNYKLYIDGEWIDATTGESQEILSPTDETVVGTVQMGVEADAQIALEAAERAQKQWKKVPARKRADLLRTFAAEIKANKNQLAELLVREQGKLLAVAKMEVEVTASFIEYACDGARSIEGDIIPSDNPAEHIMIHKIPRGVVVAITAWNFPLALAGRKLGPALVAGNSVVLKPTQETPIATLELGNIANKVGLPKGLINILTGQGSVLGNALVANPITKMVSMTGSTPAGQQIFRTAAENLIHVQLELGGKAPCIVFDDADLEQAVEGAFHSRFDNCGQVCTSNERLYVHESIYNEFMERFMEKVKGLKLGNPMDAATTIGPKVNAKEVAHMEHLVTKSVEEGATVAIGGKKPQGKAFEKGHWFEPTILTDVKQNMTIVHEESFGPILPVIKFSEFNEVIGYANDCEYGLAAMVFTNDMNKIMRLNDELEFGEIYINRGHGEQHQGFHNGYKLSGTGGEDSKYGFEQYMEKKTFYIKYKA

SEQ ID NO: 9093 - protein, 247 aa, Capsicum annuum
MGRGRVQLRRIENKINRQVTFSKRRSGLLKKAHEISVLCDAEVGLIVFSSKGKLFEYSTDSCMERILERYERYSYAERQLNATDVETPGSWTLEHAKLKARLEVLQRNQRHYAGEDLDSLSMKELQNLEQQLDSALKHIRSRKNQLMHESISELQKKDKALQEQNNNLSKQMKEREKQLAQQHTPWEQQNHDHLNSSSFGLPHPFNNNHLGEVYPTAGDNGEVEGSSRQQQQNAAVMPPWMLRHLNG

SEQ ID NO: 9094 - protein, 279 aa, Pyrococcus abyssi
MVWKMAKVSDFKRIGDDKVTAIGMGTWGIGGKEFPDYSKDRESIEALRYGLELGINLIDTAEFYGAGHSEELVGKAIEGFNREEIFIVSKVWPTHFGYESAKKAARASAKRLGTYIDLYLLHWPGDTWKKIEETLHALEELVDEGLIRYIGVSNFDLELLRRSQEAMRKYEIVVNQVKYSLMDRTPEETGLLDYMKREGITLMAYTPLEKGILARNKCLAEIGKRYGKTSAQVALNYLIWEENVVAIPKASNKDHIKENFGAMGWRLSREDRERAKLCV

SEQ ID NO: 9095 - protein, 819 aa, Pyrococcus abyssi
MAYRFIKWFEELRKEDVPLVGGKGANLGEMTNAGIPVPPGFCVTAEAYKYFVENVKISKEDVKRILGEKANKGTIAEVLAQAPDEPRPLQEWIMDIINRTNVDDSKQLQENTAVIRELIKSLDMPAEIADEIKQAYKELSQRFGKDEIYVAVRSSATAEDLPEASFAGQQETYLDVLGADDVIDKVKRCWASLWTARATFYRAKQGFDHSKVYLSAVVQKMVNSEKSGVMFTANPVTNNRNEIMINASWGLGEAVVSGAVTPDEYIVEKGTWKIKEKVIAKKEVMVIRNPETGKGTVTVKVAEYLGPEWVEKQVLTDEQIIEVAKMGQKIEEHYGWPQDIEWAYDKDDGKLYIVQSRPVTTLKETTTEEVEEVEEAEVILKGLGASPGIGAGRVVVIFDASEIDKVKEGDVLVTTMTNPDMVPAMKRAAAIITDEGGRTSHAAIVSRELGIPAVVGTKEATKKLKTGDYVTVDGTRGLVYKGIVKSLVEKKKKEEAAAAPGAAVAAAPLVTGTLVKVNVSMPEVAERAAATGADGVGLLRAEHMILSIGQHPVKFIKEGKEEELVEKLAEGIEKVAAAFYPRPVWYRTLDAPTNEFREMPGGEDEPEERNPMLGWRGIRRGLDQPELLRAEFKAIKKVVEKGYNNIGVMLPLVSHPEQIRKAKEIARSVGLEPHKDVAWGIMIEVPAAAIIIEDLIKEGIDFVSFGTNDLTQYTLAIDRDNERVAKLYDETHPAVLKLIKHVIKVCKRYGVETSICGQAGSDPKMARILVRLGIDSISANPDAVQLIRQVVAQEERKLMLEAARKRLFEEEEEEEEFLF

SEQ ID NO: 9096 - protein, 263 aa, Pyrococcus abyssi
MLKIDLSGKLAFTTASSKGIGFGVARVLAKAGADVIILSRNEENLKRAREKIKEESNVEVHYIVADLTKMDDLERTVKELKNIGEPDIFFFSTGGPKPGYFMEMSMEDWEEAVKLLLYPAIYLTKALVPAMERKGFGRIIYSTSVAIKEPIPNIALSNVVRIAMAGLVRTLAKELGPKGITVNGIMPGIIRTDRMIQLAQDRAKREGKTVEEALQEYAKPIPLGRLGEPEEIGYLVAFLASDLGSYINGAMIPVDGGRLNSVF

SEQ ID NO: 9097 - protein, 430 aa, Pyrococcus abyssi
MGRFSWKVVMGLAFLGFSRSVGWALNKGLSFPLLSSYTESAFIKGTILATEGIIGILIPPILGYYSDKLKSKHGRRRPFIMIGGTMAGLSALLIYLTYSMGVPLAGFAATLGIFYLSMHLYTAQFRALMPDTIESGERGKASGVITLLEWAGNLFLFGLTGYLIAKATELTGKEGSISVLAKTPYLKLPFIITSIFLIGAALFVYFVVKEPKAPDVKEDEGLVEYFASIVRNKDFLKFYAAQTLWWMSFEFIAIFLYGILAYILYGEATEENVKMVTSLGLFLMALFNVTVLIGALPGGILYDKVGRRLSIIIGGIIFALPQIWGITIRSRGEIIIALAIAGIGWGILVAASYPVIGDLLTRFKREAFTGRYYGFFEATRSLPVLLAGTIGGAIVDAFNGNYRILFPLGALMVLIAMPMIWKIEKLEVFS

SEQ ID NO: 9098 - protein, 203 aa, Pyrococcus abyssi
MAHGPRYRVPFRRRREGKTNYRKRLKLLKSGKPRLVVRKSLNHHIAQIIVYDPKGDRTLVSAHTRELIRDFGWKGHCGNTPSAYLLGLLIGYKAKKAGIEEAILDIGLHPPVRGSSVFAVLKGAVDAGLNVPHSPEIFPEDYRIRGEHIAEYARMLKEQDEEKFRRQFGGYLEKGLDPEKLPEHFDEVKARIIEKFESEGARE

SEQ ID NO: 9099 - protein, 282 aa, Pyrococcus abyssi
MKVKTIMTPNPVTITLPATRNYALDIFKKHKVRSFPVVNREGKLVGIISIKRVLTNPDEEQLAMLVKRDVPTVKENDDLKKAARLMLEHDYRRVVVVDNEGKPVGILTVGDIVRRYLAKTEKYKEVEIEPYYQRHVSIVWKGTPLKAALKALLLSNAMALPVVDDNGELIGIIDETDLLRDSEIVRIMKSTELAASSEEEWILESHPTLLFEKFELQLPNKPVEEIMTKDVIVATPHMTVYEVAKKMVKYRIEQLPVIKGEGDLVGLIRDFDLLKVLVKAKC

SEQ ID NO: 9100 - protein, 293 aa, Pyrococcus abyssi
MRFDVICMGNLNYDIVFLMEKFPGIHEKVNAKGVFTGLGGSAGNTATWLAKLGLKVGFIGAVGNDDFGRLHLEFFREIGVDTSGIKVVNDATGIAVTMVKGEDKRIVKYPGANRWKEVNTEYLKRARHLHLSSNPIELIREAVEKAKELGLTVSFDPGEMEVPRDVEKELDILMMNEDEFKAKYGSLDRIKDVKARIAIATLNGGGALVRDEKGEVHEVRGLSAKAIDTTGGGDAFNAGFLYGFLSGWDVVNSAKLGMLLAYLTVQEVGARSAVRPLDEIKKIAQELKLNLPI

SEQ ID NO: 9101 - protein, 287 aa, Pyrococcus abyssi
MSFALGVILALAAAFTWALSSVLSKVSMRRVSPFTLNSLRLFIASAFYIPLIIYLDLFPDKGLFWWIIVILSGIIGFLVADWLFLEGINIIGVSRANLLVTPHPILTMVLAHYFLDRPLNASIAFGAILIVLAVIILLSEGKDSSDISLRGVGLVIVAELMWTLAVLITDWLVSDESAVLITGLRIASGALGTTFLLPRISQEVKKLKMRDLGLIFVITLLGTILGQYFFVKSISIVSSSVATPVTESTPIMAALMAIIFLKERFTKKLGISLVLATLGILLIGLGC

SEQ ID NO: 9102 - protein, 317 aa, Pyrococcus abyssi
MIESFRESFGRTLVEIGRKNKDVIVVDADVKNSTKTVYFENQFPDRFIQVGISEQDMIGTAAGLAIAGKIPIVSAFAAFLMRAWEQIRNTIARDNLNVKIVATHSGFSDFLDGSSHQCLEDIALMRVLPNMKVVVPADAYATRALLYEIVEDHGPAYMRLGRDFAPRVYEDGDEIKLGKANILRDGSDILFVASGVMVSVALEVAENLKGVGIDAGVLDMHTVKPLDERTLINLARKVNLVITLEEHTIFGGLGGAVAEALSEKMPRRVIRIGSTTFGRSSRDYLSLLDRYGLSVNKVYSKVLEVVKNEDDEVLEGV

SEQ ID NO: 9103 - protein, 401 aa, Pyrococcus abyssi
MLSHIKLIYATKSRKLVGKKIVLAIPGSIAAVECVKLARELIRHGAEVHAVMSPSATKIIHPYAMEFATGNPVITEITGSIEHVELAGEHENKADLILVCPATANTISKIACGIDDTPVTTVVTTAFPHIPIMIAPAMHESMYKHPIVRENIEKLKKLGVEFIGPRIEEGKAKVATIDEIVYRVIKKLHPKTLEGKRVLITAGATREYIDPIRFITNASSGKMGVALAEEAEFRGAEVTLIRTRGSVKSFVENQIEVETVEEMLGAIEEELTKKKYDVVIMAAAVSDFKPKIKAKEKIKSDKSITLELVPNPKIIRKIKEIQSDVFLVGFKAETSMEKLISEAKKQIESAGSDLVIGNTLEAFGSEESKVVIVGKDFVKELPRMKKRELAERIWDEIEKKI

SEQ ID NO: 9104 - protein, 205 aa, Pyrococcus abyssi
MPDLKKYFVHPTAVVEEGAEIGEGTRIWHFAHIRSGAKVGKNCNIGKDVYIDVGVEIGNNVKIQNGVSVYRGVKIEDDVFLGPHMTFTNDLYPRSFNEDWEIVPTLVKKGASIGANATIVCGVTIGEYAMVGAGSVVTKDVPPFGLVYGNPARLRGFVCYCGRPLKDIVGEDEDHVIFKCSHCGREVKIKKKDYERYLKEKDLRC

SEQ ID NO: 9105 - protein, 384 aa, Pyrococcus abyssi
MSKFPEKGLPREEVLNLLEDKTKVDLTFSSGKILGSMCTMPHELAIEVFARYIDRNLGDPGLHPGTRKIEEEVIEMLSDLLHLEKGYGHIVSGGTEANILAVRAFRNISDAERPELILPKSAHFSFIKAGEMLGVKLVWAELKQDYAVDVKDVEAKISDNTIGIVGIAGTTGLGVVDDIPALSDLAREYGIPLHVDAAFGGFVIPFAKSLGYDLPDFDFKLKGVESITIDPHKMGMAPIPAGGIIFRRKKYLKAISVLAPYLAGGKVWQATITGTRPGASVLAVWALIKHLGFEGYREIVRKAMELSRWFAEEIKKLNNAWLVREPMLNIVSFQTKNLRKVERELKRRGWGISAHRGYIRIVFMPHVTKEMVEEFLRDLREVLK

SEQ ID NO: 9106 - protein, 443 aa, Pyrococcus abyssi
MIELSLAEALFLILFTGVISMLISRRTGISYVPIFILTGLVIGPLLKLIPRDLAHEIFDFVRVFGLVIILFTEGHNLSWRLLKKNMPTIVTLDTIGLILTALIAGFIFKVVFNSSFLLGFLFGAIIGATDPATLIPLFRQYRVKQDIETVIVTESIFNDPLGIVLTLIAISMLVPGYGGGIFSTLSEKLGIYAGGVIYFLYNVSVSISLGIFLGILGYKFIKRTGIFDFPEIEAFSLSLAFLGFFIGERLDASGYLVATVTGIVLGNYKLLKPRENIRILKRLQRAIEKEVHFNDTLAALATIFIFVLLGAEMNLEVIWSNLGKGLLVALGVMILARPLATLPLLKWWNFREYLFIALEGPRGVVPSALASLPLSLALKYKSPLLTVHWGEIIMATVVITVLTSVIVETLWIPILKDKLDVGETIKERIEEKEEEKERRKVRG

SEQ ID NO: 9107 - protein, 280 aa, Pyrococcus abyssi
MDETRKAELILILISAIWGSTFPVMKLGIEDYPPITFVAFRFLIASLLMLIFLRKDIKTSQALPGLLVGLSLFLGFSFQVVGLKYTTSSNSAFITSLYMVFTPFVAILLLKTRVKLIDWVALGLALLGTYLISNVGNFNYGDMLTVLAALSFAFQIVLVEYFGNLGIGLAFWQVFWNSMFSLAYAAIFEGLPMPREGSTLFAIIYTAIMATAIAFAVQVKYQPKIDSHRAAIIYSAEPVFGHFFSFLILGEVLSWKGYIGALLILIAVWLEISRENLISD

SEQ ID NO: 9108 - protein, 390 aa, Pyrococcus abyssi
MKLLMITPYFYPEGGGLEKYAYMIARGLVERGWEVKVITASRKGNSLENLEGIEVIRLAPHFIVSNTPISFNLPLKLIKVFKEEQFSVINAHTPVPYYADVSAWVNNVLKGSNKTPFVLTYHNDLVKEGFPLDKVAYLYNLSLQRGLLLLSDTIITPSPYCYYESKLLRRFKKKLIWIPPGVDTERYFPGKSYRLHSIYNLPRSAKIVMFIGTMNRGHAHKGVPYLLKAFKYVATQVKDSYLVLVGRGDMIPEYKKMCMSLGISKRVIFTGYVEEDILPEFYRSSDVIVLPSTTVQEGFGMVLIEAGASGKPVIGTNVGGIKHVIENGKTGILVPPKDPFRLAEAIVTLLTDDNLARKIGKTGRRLVEREYSWDKIVEKTEIALKAIVNH

SEQ ID NO: 9109 - protein, 422 aa, Pyrococcus abyssi
MVNCTSDYCVKDISLAPEGMKKIDWVSRFMPVLQHIRREFEEKKPFKGVRIAATLHLEMKTAFLLLTLKAGGAKVSAAASNPLSTQDDVVAALAKEGVKVYAIRGESKEEYYEFMNKALDIRPNIIIDDGADMVSLVHTERKELLDEIWGASEETTTGVIRLRAMERDKVLRFPVIAVNDSYMKYLFDNRYGTGQSTWDGIMRATNLLVAGKNVVVVGYGWCGRGIAMRARGLGATVIVVEVDPIKALEARMDGFLVMSMKEAAKIGDIFVTATGNIKCIRREHFELMKDGAIMANAGHFDVEIWKPDLEELAVEISNPRPNVTEYKLKDGRRLYLLADGRLVNLVAADGHPAEIMDMSFALQAKAAEYIKENHERLEPRVYVLPREIDEMVARIKLQSMGINIEELTEEQKKYLESWQHGT

SEQ ID NO: 9110 - protein, 240 aa, Pyrococcus abyssi
MELKGKVALITGASRGIGRAIAIELAKRGVNVVINYRSNEEEAKKTEELCRQYGVETLLVKADVSNREEVREMVKKVIDKFGRIDILINNAGILGKTKDPLEVTDEEWDRVISVNLKGAFIVTQEVLRYMKKGKIVNIASIAGKDGGTVGPHYAASKGGLIALTFNLARHLAPNILVNAVAPGPVDTDMLSSEMKEMLKKLSLTGDIAKPSEVAHAVIFLLENDHITGEVIDVNGGRLMD

SEQ ID NO: 9111 - protein, 485 aa, Pyrococcus abyssi
MGKFAKKLERAIRGYTFDDVLLIPQATEVEPKDVDVSTQITPNVKLNIPILSAAMDTVTEWEMAVAMAREGGLGVIHRNMSIEEQVEQVKRVKKAERFIVEDVITISPEETVDFALFLMEKHDIDGLPVVENEKVVGIISKKDIAAREGKLVKELMTKDVITVPENIEVEEALKIMIENRIDRLPVVDKEGRLIGLITMSDLVARKKYKNAVRDENGELLVAAAVSPFDIRRAIELDRAGADVIVVDTAHAHNLKAIKAMKEMRQKVDADFIVGNIANPKAVDDLTFADAVKVGIGPGSICTTRIVAGVGVPQITAIAMVADRAQEYGLYVIADGGIKYSGDIVKAIAAGADAVMLGNLLAGTKEAPGKEVIINGRKYKQYRGMGSLGAMMKGGAERYYQGGYMKTRKFVPEGVEGVVPYRGTVSEVLYQLVGGLKAGMGYVGARNIKELKEKGEFVIITSAGLRESHPHDIIITNEAPNYPLEK

SEQ ID NO: 9112 - protein, 430 aa, Pyrococcus abyssi
MTMENPYEIVAVIAREILDSRGNPTVEVDVHTPISMGRAAVPSGASTGTHEAVELRDGGKRYHGKGVRRAVENVNKIIAPELVGMDVRWQREIDRLLIELDGTENKSNLGANAILAVSLAVAKAAANALELPLYQYLGGVNAYVLPVPLSNVINGGVHAGNDLDFQEFMIMPIGANSFREAIRWVSETYHVLKKVIAEKYGKNAVNVGDEGGFAPPMKEVTEPLDVLIKAIEEAGYKPGEEIALALDAASSEFYKDGKYIVSGKEYTREELLELYKELTSTYPIVSIEDPFHEEDWEGFVMITRELGKKVQIVGDDLFVTNPKRLKKGIEMGAANALLLKVNQIGTLTEAMDAAYMAFRAGYGVVVSHRSGETEDATIADLAVALNAGQIKTGAPARSDRNAKYNQLIRIEEELEGVAVYAGKNFRKVFF

SEQ ID NO: 9113 - protein, 341 aa, Pyrococcus abyssi
MAHVAEWKKKEVEELANLIKSYPVIALVDVSSMPAYPLSQMRRLIRENGGLLRVSRNTLIELAIKKAAQELGKPELEKLAEYIDRGAGILVTNMNPFKLYKFLQQNRQPAPAKPGAVVPKDVVIPAGPTPLAPGPIVGQMQAMGIPARIERGKVTIQKDTTVLKAGEVITPELANILNALGIQPLEVGLDVLAVYEDGIVYTPDVLAIDEQEYIDMVQKAYMHAFNLAVNIAYPTPETIEAIIQKAFLNAKAVAVEAGYITKETIQDILGRAFRAMLLLAQQLPDELLDEKTKELLSAQAQVAVAPQEVEEEKKEEEEKKEEEEEEASEEEALAGLSALFG

SEQ ID NO: 9114 - protein, 495 aa, Escherichia coli
MNFHHLAYWQDKALSLAIENRLFINGEYTAAAENETFETVDPVTQAPLAKIARGKSVDIDRAMSAARGVFERGDWSLSSPAKRKAVLNKLADLMEAHAEELALLETLDTGKPIRHSLRDDIPGAARAIRWYAEAIDKVYGEVATTSSHELAMIVREPVGVIAAIVPWNFPLLLTCWKLGPALAAGNSVILKPSEKSPLSAIRLAGLAKEAGLPDGVLNVVTGFGHEAGQALSRHNDIDAIAFTGSTRTGKQLLKDAGDSNMKRVWLEAGGKSANIVFADCPDLQQAASATAAGIFYNQGQVCIAGTRLLLEERIADEFLALLKQQAQNWQPGHPLDPATTMGTLIDCAHADSVHSFIREGESKGQLLLDGRNAGLAAAIGPTIFVDVDPNASLSREEIFGPVLVVTRFTSEEQALQLANDSQYGLGAAVWTRDLSRAHRMSRRLKAGSVFVNNYNDGDMTVPFGGYKQSGNGRDKSLHALEKFTELKTIWISLEA

SEQ ID NO: 9115 - protein, 822 aa, Beta vulgaris
MAPKLTRIPSMRERVEDTLSVHRNELVSLLSKYVAQGKCLLQPHHLIDGLESVIGEDKGKQILSDGPFSEVLRSAQEAIVVPPFVAIAVRPRPGVWEYVRVNVSELNVEQLTVSEYLHFKEELVDGKADDHYVLELDFEPFNESVPRPTRSSSIGNGVQFLNRHLSSSMFCNKDCLEPLLDFLRVHKHKGVVMMLNDRIQTIQRLQSALSKAEDYLIKLPADTPYSEFEFVIQGMGFERGWGDTAERVLEMMHLLLDILQAPDPSTLETFLGRLPMVFNVVILSVHGYFGQAHVLGLPDTGGQIVYILDQVRSLEHEMLQRIKKQGLDVTPRILIVSRLIPDAKGTTCNQRMEKVSGTEHASILRVPFRSEKGILRKWISRFDVWPYLENFTEDAAGEIIGELQGRPDLIIGNYSDGNIVASLLSHKMGVTQCNIAHALEKTKYPDSDIYWKRFEDKYHFSCQFSADLMAMNHADFIITSTYQEIAGTKNTVGQYESHKAFTFPGLYRVVHGIDVFDPKFNIVSPGADMAIYFPFSEKDVTCLTSLHRLIEQLLFKPEQNEEHIGVLDDTSKPIIFSMARLDRVKNITGLVECYGKNAKLRELANLVVVAGYNDVKKSNDREEIAEIEKMHRLIQEYNLRGQFRWIASQTNRVRNGELYRYICDKGGIFAQPAFYEAFGLTVVEAMTCGLPTFATCHGGPAEIIEDGVSGFHIDPYHADQAEKMTEFFVKCREDPNYWTKISAGGLLRIKERYTWQKYSERLMTLAGVYGFWKYVSKLERRETRRYLEMFYILKFRDLANSVPLATDEEPSTTDAVATFRGP

SEQ ID NO: 9116 - protein, 895 aa, Homo sapiens
EIQATWYEKLHEWEDALVAYDKKMDTNKDDPELMLGRMRCLEALGEWGQLHQQCCEKWTLVNDETQAKMARMAAAAAWGLGQWDSMEEYTCMIPRDTHDGAFYRAVLALHQDLFSLAQQCIDKARDLLDAELTAMAGESYSRAYGAMVSCHMLSELEEVIQYKLVPERREIIRQIWWERLQGCQRIVEDWQKILMVRSLVVSPHEDMRTWLKYASLCGKSGRLALAHKTLVLLLGVDPSRQLDHPLPTVHPQVTYAYMKNMWKSARKIDAFQHMQHFVQTMQQQAQHAIATEDQQHKQELHKLMARCFLKLGEWQLNLQGINESTIPKVLQYYSAATEHDRSWYKAWHAWAVMNFEAVLHYKHQNQARDEKKKLRHASGANITNATTAATTAATATTTASTEGSNSESEAESTENSPTPSPLQKKVTEDLSKTLLMYTVPAVQGFFRSISLSRGNNLQDTLRVLTLWFDYGHWPDVNEALVEGVKAIQIDTWLQVIPQLIARIDTPRPLVGRLIHQLLTDIGRYHPQALIYPLTVASKSTTTARHNAANKILKNMCEHSNTLVQQAMMVSEELIRVAILWHEMWHEGLEEASRLYFGERNVKGMFEVLEPLHAMMERGPQTLKETSFNQAYGRDLMEAQEWCRKYMKSGNVKDLTQAWDLYYHVFRRISKQLPQLTSLELQYVSPKLLMCRDLELAVPGTYDPNQPIIRIQSIAPSLQVITSKQRPRKLTLMGSNGHEFVFLLKGHEDLRQDERVMQLFGLVNTLLANDPTSLRKNLSIQRYAVIPLSTNSGLIGWVPHCDTLHALIRDYREKKKILLNIEHRIMLRMAPDYDHLTLMQKVEVFEHAVNNTAGDDLAKLLWLKSPSSEVWFDRRTNYTRSLAVMSMVGYILGLGD

SEQ ID NO: 9117 - protein, 559 aa, Caenorhabditis elegans
MMNASTKFSDNYDVKEELGKGAFSVVRRCVHKTTGLEFAAKIINTKKLSARDFQKLEREARICRKLQHPNIVRLHDSIQEESFHYLVFDLVTGGELFEDIVAREFYSEADASHCIQQILESIAYCHSNGIVHRDLKPENLLLASKAKGAAVKLADFGLAIEVNDSEAWHGFAGTPGYLSPEVLKKDPYSKPVDIWACGVILYILLVGYPPFWDEDQHRLYAQIKAGAYDYPSPEWDTVTPEAKSLIDSMLTVNPKKRITADQALKVPWICNRERVASAIHRQDTVDCLKKFNARRKLKGAILTTMIATRNLSSKRSYRLTLGAEKLVISMKNIEYWQVLLNKIFATYKIKMKQCRNLLNKKEQGPPSTIKESSESSQTIDDNDSEKGGGQLKHENTVVRADGATGIVSSSNSSTASKSSSTNLSAQKQDIVRVTQTLLDAISCKDFETYTRLCDTSMTCFEPEALGNLIEGIEFHRFYFDGNRKNQVHTTMLNPNVHIIGEDAACVAYVKLTQFLDRNGEAHTRQSQESRVWSKKQGRWVCVHVHRSTQPSTNTTVSEF

SEQ ID NO: 9118 - protein, 720 aa, Caenorhabditis elegans
MMNASTKFSDNYDVKEELGKGAFSVVRRCVHKTTGLEFAAKIINTKKLSARDFQKLEREARICRKLQHPNIVRLHDSIQEESFHYLVFDLVTGGELFEDIVAREFYSEADASHCIQQILESIAYCHSNGIVHRDLKPENLLLASKAKGAAVKLADFGLAIEVNDSEAWHGFAGTPGYLSPEVLKKDPYSKPVDIWACGVILYILLVGYPPFWDEDQHRLYAQIKAGAYDYPSPEWDTVTPEAKSLIDSMLTVNPKKRITADQALKVPWICNRERVASAIHRQDTVDCLKKFNARRKLKAAISAVKMVTRMSGVLRTSDSTGSVASNGSTTHDASQVAGTSSQPTSPAAEVYPNVLLFNPQKFPRNCVHPFTTHPYYSPKESSKKKLFFTLLFEVCPHTSRSHILLRDNTKNIYHPYHCFTNKMSNYERAAPSSHGSSTTKKIANAIADLVIRRSSPSIRRKTEADVHNSNRNRKVSAPANLQHALVPVIDVVVATGALASSSVDNLSASTSSDLGRNLLNKKEQGPPSTIKESSESSQTIDDNDSEKGGGQLKHENTVVRADGATGIVSSSNSSTASKSSSTNLSAQKQDIVRVTQTLLDAISCKDFETYTRLCDTSMTCFEPEALGNLIEGIEFHRFYFDGNRKNQVHTTMLNPNVHIIGEDAACVAYVKLTQFLDRNGEAHTRQSQESRVWSKKQGRWVCVHVHRSTQPSTNTTVSEF

SEQ ID NO: 9119 - protein, 383 aa, Caenorhabditis elegans
MLRSQAKNVDLTSQDSRHQQKRKQAEQLDALKNPSEPAAKKQHSKGLTELRAHISGFKIDSAKRDPLGKSRTSRRDVENLPPQKSRYVDPCPHYDYDLEEAGNPDSISDYAQGIFDYYRHREVHFRVRKYLHKHPEVDVKTRAILIDWMVEIQETFELNHETLYNAVKLTDMYLCKTKNVDKNTIQKLACVAIFIAAKYDERSPPLVDDLIYLSGDRFSRDELLAMERELFATVGYDLGSPLSYRYLRRFGRVCRVDMKTLTMGRFILETSLMVYEYAMVSQSRLAAAAFVLAMRMLDKNNEYEWNPVLEKYSGFTGEEVMPLVEHMNHILHFSKDKWAQLTSVRQKYSHEVFFHVASIPMLPDTLKVVDSHTYAPVPMLSYP

SEQ ID NO: 9120 - protein, 187 aa, Ralstonia metallidurans
MSAIEHLLKPHVRDIGEFTVRRLLPAATTQTVGPFIFFDHMGAVEMEPGAGMDVRPHPHIGLATVTYLFEGEIMHRDSLGSEQVIRPGDVNWMTAGRGITHSERSPDGARSAGPHLHGIQTWVALPKAHENDPPSFHHHPGATLPKLELPGVRMTVIAGESSAPSRRSGSTAARSMWQSRWMPAQAL

SEQ ID NO: 9121 - protein, 331 aa, Populus euramericana
HELRTPMAAVIGLLDILICDDCLTNEQYANVTQIRKCSTALLRLLNNILDLSKVESGKLVLEDAEFDLGRELEGLIDMFSVQCTNHNVEAVLDLSDEMPKLLRGDSARVVQIFANLISNSIKFTTTGHIILRGWCENLNNTYNDTQFHLDQKKMRCAIKPKLRQQGNHLKKACKKENKMILWFEIDDTGCGIDPRKWESVFESFEQADPSTTRLHGGTGLGLCIVRTLVNKMGGEIKVVKKNGPGTLMRLYLLLKTPADGADLPCQVDFSSHNAVVLVALYGSMGRVIMSLWLREIGLTTLGVSEWNELTRVLRKLFHARRRENGFDVQCL

SEQ ID NO: 9122 - protein, 349 aa, Trypanosoma brucei
MSVSSQPNTDGAHRYARANVEKPREYWDYESARIQWSSPERYEIIEKIGRGKYSDVFLGWDTKVRRQVVIKVLKPVKKKKILRELKVLQNLQGGPNIVELYDVVRDPCSKTPSFIFEYVEASDFRTVFPTFSDYDVRYYIFGVLQALEYAHSMGIMHRDVKPNNIAIDHKKRDLILIDWGLAEFFHPLTPYNARVASRYFKGPELLVELPMYDYRLDMWSLGCMLAGMIFMREPFFHGKDNNDQLVRIAKVLGTDELFEYLHKYNLTLPQHLETAVGRHGKKPWTMFVTQENQHLCPKEALDFLDQLLQYDHVKRVQALEAMDHPYFDPVRAECTARIREKKRGNVVTE

SEQ ID NO: 9123 - protein, 267 aa, Arabidopsis thaliana
MAAPPASSSAREEFVYLAKLAEQAERYEEMVEFMEKVAEAVDKDELTVEERNLLSVAYKNVIGARRASWRIISSIEQKEESRGNDDHVTTIRDYRSKIESELSKICDGILKLLDTRLVPASANGDSKVFYLKMKGDYHRYLAEFKTGQERKDAAEHTLTAYKAAQDIANAELAPTHPIRLGLALNFSVFYYEILNSPDRACNLAKQAFDEAIAELDTLGEESYKDSTLIMQLLRDNLTLWTSDMQDESPEEIKEAAAPKPAEELKEI

SEQ ID NO: 9124 - protein, 609 aa, Arabidopsis thaliana
MEWDSGSDLSADDASSLADDEEGGLFPGGGPIPYPVGNLLHTAPCGFVVTDAVEPDQPIIYVNTVFEMVTGYRAEEVLGGNCRFLQCRGPFAKRRHPLVDSMVVSEIRKCIDEGIEFQGELLNFRKDGSPLMNRLRLTPIYGDDDTITHIIGIQFFIETDIDLGPVLGSSTKEKSIDGIYSALAAGERNVSRGMCGLFQLSDEVVSMKILSRLTPRDVASVSSVCRRLYVLTKNEDLWRRVCQNAWGSETTRVLETVPGAKRLGWGRLARELTTLEAAAWRKLSVGGSVEPSRCNFSACAVGNRVVLFGGEGVNMQPMNDTFVLDLNSDYPEWQHVKVSSPPPGRWGHTLTCVNGSNLVVFGGCGQQGLLNDVFVLNLDAKPPTWREISGLAPPLPRSWHSSCTLDGTKLIVSGGCADSGVLLSDTFLLDLSIEKPVWREIPAAWTPPSRLGHTLSVYGGRRNLDVGGLAKSGPLKFRSSDVFTMDLSEEEPCWRCVTGSGMPGAGNPGGVAPPPRLDHVAVNLPGGRILIFGGSVAGLHSASQLYLLDPTEDKPTWRILNIPGRPPRFAWGHGTCVVGGTRAIVLGGQTGEEWMLSELHELSLASYLT

SEQ ID NO: 9125 - protein, 491 aa, Escherichia coli
MMSRMAEQQLYIHGGYTSATSGRTFETINPANGNVLATVQAAGREDVDRAVKSAQQGQKIWASMTAMERSRILRRAVDILRERNDELAKLETLDTGKAYSETSTVDIVTGADVLEYYAGLIPALEGSQIPLRETSFVYTRREPLGVVAGIGAWNYPIQIALWKSAPALAAGNAMIFKPSEVTPLTALKLAEIYSEAGLPDGVFNVLPGVGAETGQYLTEHPGIAKVSFTGGVRSGKKVMANSAASSLKEVTMELGGKSPLIVFDDADLDLAADIAMMANFFSSGQVCTNGTRVFVPAKCKAAFEQKILARVEPIRAGDVFDPQTNFGPLVSFPHRDNVLRYIAKGKEEGARVLCGGDVLKGDGFDNGAWVAPTVFTDCSDDMTIVREEIFGPVMSILTYESEDEVIRRANDTDYGLAAGIVTADLNRAHRVIHQLEAGICWINTWGESPAEMPVGGYKHSGIGRENGVMTLQSYTQVKSIQVEMAKFQSIF

SEQ ID NO: 9126 - protein, 490 aa, Escherichia coli
MSRMAEQQLYIHGGYTSATSGRTFETINPANGNVLATVQAAGREDVDRAVKSAQQGQKIWASMTAMERSRILRRAVDILRERNDELAKLETLDTGKAYSETSTVDIVTGADVLEYYAGLIPALEGSQIPLRETSFVYTRREPLGVVAGIGAWNYPIQIALWKSAPALAAGNAMIFKPSEVTPLTALKLAEIYSEAGLPDGVFNVLPGVGAETGQYLTEHPGIAKVSFTGGVRSGKKVMANSAASSLKEVTMELGGKSPLIVFDDADLDLAADIAMMANFFSSGQVCTNGTRVFVPAKCKAAFEQKILARVEPIRAGDVFDPQTNFGPLVSFPHRDNVLRYIAKGKEEGARVLCGGDVLKGDGFDNGAWVAPTVFTDCSDDMTIVREEIFGPVMSILTYESEDEVIRRANDTDYGLAAGIVTADLNRAHRVIHQLEAGICWINTWGESPAEMPVGGYKHSGIGRENGVMTLQSYTQVKSIQVEMAKFQSIF

SEQ ID NO: 9127 - protein, 244 aa, Vibrio cholerae
MNLEGKVALVTGASRGIGKAIAELLAERGAKVIGTATSESGAQAISDYLGDNGKGMALNVTNPESIEAVLKAITDEFGGVDILVNNAGITRDNLLMRMKEEEWSDIMETNLTSIFRLSKAVLRGMMKKRQGRIINVGSVVGTMGNAGQANYAAAKAGVIGFTKSMAREVASRGVTVNTVAPGFIETDMTKALNDEQRTATLAQVPAGRLGDPREIASAVAFLASPEAAYITGETLHVNGGMYMI

SEQ ID NO: 9128 - protein, 130 aa, Bufo gargarizans
MSGRGKQGGKVRAKAKTRSSRAGLQFPVGRVHRLLRKGNYAQRVGAGAPVYLAAVLEYLTAEILELAGNAARDNKKTRIIPRHLQLAVRNDEELNKLLGGVTIAQGGVLPNIQAVLLPKKTESSKPAKSK

SEQ ID NO: 9129 - protein, 218 aa, Olea europaea
SGQLEWQDYFFHCIYPEEKRDIWPKTPTDYSPATSEYAKQLRGLTSKILSALSLGLGLEQERLEKEVGGMEELLLQFKINYYPKCPQPELALGVEAHTDVSALTFILHNMVPGLQLFCEGKWVTAKCVPNSIIMHIGDTIEILSNGKYKSALHRGLVNKEKVRISWAVFCEPPKEKIVLKPLPETVSEAEPPRFPPRTFSQHIMHKLFRKSEDSGEEK

SEQ ID NO: 9130 - protein, 266 aa, Cladosporium fulvum
MPQRIPEAEHLLDLLSLKGRVVVVTGASGPKGMGIEAARGCAEMGADLAITYASRAEGGLKNAEELSKQYGIKCKAYKCQVDKYESVEQLVKDVIQDFGKIDAFIANAGATANSGILDGSVEDWNHVVQVDLNGTFHCAKAVGHHFKERGTGSFVITSSMSGHIANYPQEQTSYNVAKAGCIHMARSLANEWRDFARVNSISPGYIDTGLSDFVAKDIQKLWHSMIPLGRDGLAKELKGAYVYLVSDASTYTTGADIVIDGGYTCR

SEQ ID NO: 9131 - protein, 570 aa, Malus x domestica
RTLALEECALWMPTRTGLELQLSYTLRQQNPVGYTVPIHLPVVNQVFSSNCAVKISPNSPVARLRQLAGKHIPGEVVAVRVPLLHLSNFQINDWPELSTKRYALMVLMLPSDSARQWHVHELELVEVVADQVAVALSHAAILEESMRARDLLMEQNIALDLARREAETAIRARNDFLAVMNHEMRTPMHAIIALSSLLQETELTAEQRLMVETILRSSNLLATLINDVLDLSRLEDGSLQLEIATFNLHSVFREVHNMIKPVASIKRLSVTLNIAADLPMYAIGDEKRLMQTILNVVGNAVKFSKEGSISITAFVAKSESLRDFRAPDFFPVQSDNHFYLRVQVKDSGSGINPQDIPKLFTKFAQTQALATRNSGGSGLGLAICKRFVNLMEGHIWIESEGLGKGCTATFIVKLEFPERSNESKLPFAPKLQANHVQTNFPGLKVLVMDDNGVSRSVTKGLLAHLGCDVTAVSLIDELLHVISQEHKVVFMDVSMPGIDGYELAVRIHEKFTKRHERPVLVALTGSIDKTTKENCMRVGVDGVILKPVSVDKMRSVLSELLEHRVLFEAM

SEQ ID NO: 9132 - protein, 92 aa, Mimulus guttatus
ARGKIQIKRIENQTNRQVTYSKRRNGLFKKAHELTVLCDAKVSILMISSTQKLHEHISPSITTKQMFDQYQKAVGVDVWNTHYERMQEHLRK

SEQ ID NO: 9133 - protein, 91 aa, Mimulus nasutus
  unsure (1)..(91): unsure at all Xaa locations
ARGKIQIKRIENQTXRQXTYSKRRNGLFKKAHELTVLCDAKVSILMISSTQKLHEYISPSITTKQMFDQYQKAVGVDVWNTHYERMQEHLR

SEQ ID NO: 9134 - protein, 77 aa, Mimulus guttatus
HPFIVTEPGEVARGKKNGLDYLFHLYEQCREFLIQVQNIAKERGEKCPTKVTNQVFRYAKKAGANYINKPKMRHYVH

SEQ ID NO: 9135 - protein, 204 aa, Hypocrea jecorina
MSDSPQSPPKDVDQGAQSPDEEGQMNDNQEPHSAGGTGYEFEGVKEQDRWLPIANVARIMKNALPDNAKIAKEAKECMQECVSEFISFITSEASEKCQQEKRKTVNGEDILFAMTSLGFENYAEALKVYLSKYREQQNQSNRDRVLENNTWGNAMIPGEKTEPGTTNPEYAPPEGANPPESGAEPNYMYTSHAGHNGAGAGENY

SEQ ID NO: 9136 - protein, 602 aa, Plasmodium vivax
MKNASLDAEEGTGGNESGNGSGGGNQIDTVGEHEREAKMLKKSLCLSKNMFVGNDILTPFNYSLLAYATNINDRIAKIEQDEDKAIKDLKEISTLAIAGGNTTKSHEEMYKENELKLRKQNLRENVIKKLTSIKVNINMKELDEYSSVKKLYLKKIEKDDSQRGKERKKKKKKSSIISSIVNDDTVTHDDIGHDLNYMNESLITNQMGEAGKNNNEKNSILPFINQPRNEVHSGPIIKKSDDSVLSSDALKNIKTLDIYKKIKKPKWHFPYKLYRVILGHSGWVNCVDVDISNEWFATGANDRLIKIWDLATCKLKLTLTGHINSIRDIKISKKNPYLFSCGEDNRVKCWDLEYNKVIRDYHGHLSGVYCLSLHPSLDILMSGGRDAVVRVWDIRTKSSIFVLSGHTGTVMSLCSQSVEPQVVSGSQDKMIRLWDLNNGKCRIALTHHKKSIRSLSIHPFEYSFCSCGTDNVKVWCGADAEFDRNITGFNSIINCSLIKQDSYFSDSSILILGSNNGQLHFYDWSSGYKFDTLSNKVVPGTVECENSTLAMAFDKSESRLITTHGDKSIKVAQKKGEIWRENEDATPENFPIKWNPYESFKF

SEQ ID NO: 9137 - protein, 314 aa, Toxoplasma gondii
MAGPKGKSDKRKTYFSRLFALLEKYPRVLVVEADHVGSKQMADIRLALRGKAVVLMGKNTMIRTALKQKMSEMPQLEKLLPLVRLNVGFIFCIEDPAEVRRIVAENKVPAPARQGVFAPIDVFIPAGPTGMDPGSTSFFQALGIATKIVKGIIEIQNEVHLIKEGDKVTASAATLLQKLNIKPFEYGLAIQHVYDDGSVYKASVLDITDEVILEKFRAGTMNVAALSREVGFPTTASAPHSILEAFKFCTSLVLESDYSFPQMQRIKDILENPEAFAAVAAAAAPAAGAAAAAEAPKEEEPEEEEDDMGFSLFD

SEQ ID NO: 9138 - protein, 423 aa, Fusarium proliferatum
LRQLETFEMDGVNGVTQCPIAPGDSYTYTFRAVQYGTSWYHSHYSLQYADGLAGPITIYGPSSAPFDEGRNPILITDWSHRSAFQSWQRELVPNPTRPMMNGVLINGVGNFAGSFPRERFNMTVTKGKKYVLRVINTSVDTTWIFSIDNHNFTVMSTDFVPIQPYSVSHLVLGIGQRYHIVLDANPTNTTKMPANPDGNYWVRTVGATGCKGFEPGNEPDERQGILRYNASSKLVPTTFRENYSLECRDEAYDRLSPVYEWNVDKVKINYTKSQFDIGLSKFAHRPELMDNFTWWAFGENPLWLNFSNPTILNLKNTTWNPDYAVDLVVPDEKKDKWVYIAITAPPAPMKTKPNRAFAPVAHPLHLHGHDFALLAQGTNFSDLDTGKVNLKFDNPPRRDVALLPAGGYLVVAFKADNPGSWLF

SEQ ID NO: 9139 - protein, 436 aa, Fusarium proliferatum
MSVHWHGLRQLETFEMDGVNGVTQCPIAPGDSYTYTFRAVQYGTSWYHSHYSLQYADGLAGPITIYGPSSAPFDEGRNPILITDWSHRSAFQSWQRELVPNPTRPMMNGVLINGVGNFAGSFPRERFNMTVTKGKKYVLRVINTSVDTTWIFSIDNHNFTVMSTDFVPIQPYSVSHLVLGIGQRYHIVLDANPTNTTKMPANPDGNYWVRTVGATGCKGFEPGNEPDERQGILRYNASSKLVPTTFRENYSLECRDEAYDRLSPVYEWNVDKVKINYTKSQFDIGLSKFAHRPELMDNFTWWAFGENPLWLNFSNPTILNLKNTTWNPDYAVDLVVPDEKKDKWVYIAITAPPAPMKTKPNRAFAPVAHPLHLHGHDFALLAQGTNFSDLDTGKVNLKFDNPPRRDVALLPAGGYLVVAFKADNPGSWLFHCHIES

SEQ ID NO: 9140 - protein, 437 aa, Fusarium proliferatum
VSIHWHGIRQNGTMEMDGVNGVTQCPIAPEDTFTYEFRALQYGSSWYHSHYSLQYADGLAGPITIFGPSSAHYDEAKDPILITDWNHRSAFQEWERELTGVPTRPEMNSILMNGIGNFAGSFPRERYNITVTKGKKYLLRIINTSVDTTFVFGIDNHYFEVMSSDFVPIHPYTVDHILVGIGQRYHVVLHAKPRNDTKFPASDNGNYWIRTVAADGCKGFEDGNEPDERQGILRYQPVSTEVPQTWRDNWTKDCTDEKYENLKPILPWSIPTVKLDERDRSKDLELGIEKVKDRPHAGDRFSWWAFGERPLWLDFSNPTITLLEERKEWPDDYVIVPAENRDGWVYLVITAPSLDRIGTNKTFRSLAHPLHLHGHDFALLAQGTNSSQINDPNNPVTLKFDNPPRRDVALIPAGGYLIVAFKADNPGSWLFHCHIAS

SEQ ID NO: 9141 - protein, 238 aa, Azotobacter vinelandii
LNEIGFSPLLTPAEEVHFARLAQRGDPAGRKRMIESNLRLVVKIARRYVNRGLSLLDLIEEGNLGLIRAVEKFDPERGFRFSTYATWWIRQTIERAIMNQTRTIRLPIHVVKELNVYLRAARELTQKLDHEPSAEEIANLLEKPVAEVKRMLGLNERVTSVDVSLGPDSDKTLLDVLTDDRPFDPCDLLQDDDLSQSIDQWLFDLTEKQREVVVRRFGLRGHESCTLEEVGQEIGLTR

SEQ ID NO: 9142 - protein, 230 aa, Petroselinum crispum
MISSWRKIRASRHANKRNGLDDLSNMEVSIPNHFRCPISLDLMKDPVTLSTGITYDRHSIETWIEAGNKTCPITKQMLSTLEPIPNHTIRKMIQDWCVDNSSYGIERIPTPRIPVSSHQVTEMLSKVVAACRREEASACRELVGKIKRLVKENERNKRCFVANGTVGVLASTFEAFSKLSFDKNVAVLEEILSCLSLMTPLDGEAKAFLGSNSSLNCMVWFLKSGDLSAR

SEQ ID NO: 9143 - protein, 442 aa, Petroselinum crispum
MISSWKKIRASRHANKRNGLDDLSNMEVSIPNHFRCPISLDLMKDPVTLSTGITYDRHSIETWIEAGNKTCPITKQMLSTLEPIPNHTIRKMIQDWCVDNSSYGIERIPTPRIPVSSHQVTEMLSKVVAACRREEASACQELVGKIKRLVKENERNKRCFVANGTVGVLASTFEAFSKLSFDKNVAVLEEILSCLSLMTPLDGEAKAFLGSNSSLNCMVWFLKSGDLSARANSVLVLKHVLSTDQKKMEEFSMIEGSLEALVKVIKEPVSPTTTKASLLIVYYMVSTSSSSRVDDKIIARFIDMGLIERLLEMLVDCDKSICEKALGVLDGLCLTNEGREKAYANALTMPVLVKKILRVSDLATEFSVSIVWKLSKNDKSEDGGVIVEALRVGAFQKLLLLLQFGCNEKIKDKATELLKLLNLHRDKLECIDSMDFKNLKRT

SEQ ID NO: 9144 - protein, 149 aa, Vitis vinifera
MSEEKHHHHLFHHKDKPVDDAVPYSDNAYSDTTYSDTSYATDGVSGYAAETTEVLADDPAPDYRKEEKHHKHLEHLGELGVAAAGAYALHEKHKSEKDPEHAHKHKIEEEIAAAAAVGAGGFAFHEHHEKKEAKEEDEEAHGKKHHHLF

SEQ ID NO: 9145 - protein, 440 aa, Cochliobolus lunatus
MAITKIHARSVYDSRGNPTVEVDIVTETGLHRAIVPSGASTGSHEACELRDGDKTKWGGKGVTKAVANVNDIIAPALIKEKLDVKDQSAVDAFLNKLDGTENKTKLGANAILGVSMAIAKAAAAEKGVPLYAHISDLAGTKKPYVFRFLSKNVLNGGSHAGGFLLFQEFMIAPAKTFAEALRIRQGAEVYQKLKALTKKTYGQSAGNYGDEGGVAPDIQTAEEALDLIVDAIEAAGHTGQIKIAMDVASSEFFKDDEKKYDLDFKNPDSDKSKWLTYPQLAEMYKSLAEKYPIVSIEDPFAEDDWEAWSHFYKDGDFQIVGDDLTVTNPEFIKTAIELKSCNALLLKVNQIGTISEAINAAKDAFGAGWGVMVSHRSGETEDVTIADIVVGLRSGQIKTNAPARSERLAKYNQILRIEEELGDKRLFAGNKFHTAINLYL

SEQ ID NO: 9146 - protein, 275 aa, uncultured bacterium
  unsure (1)..(275): unsure at all Xaa locations
MSAEQPRLILNSGQSMPQLGLGAYKVNQDIAXQLVQHALEIGYRRIDTAALYDNEAEVGAAVRKSGLAREEVFVTSKIWNDRHGYHEAKEAIQESIDRLNIDYVDMMLIHWPCPKQDKFVETWHAFEEVLETGLVKGIGVSNFNQPHLEKLLQHSNITPAINQVELHPQLAQNGLREFNERHGIRTEAWAPLGRARXMQHPLLVEIABSLGKSVAQVIIRWHLQIGNLVIPKSSNPXRLAXNFDVFDFELSHHNMSIIATLNTETRIATNPDDMN

SEQ ID NO: 9147 - protein, 273 aa, uncultured bacterium
MASPLVTLNDGRLMPQLGLGVYKVNQDIAVQLVQTAIEIGYRRVDTAALYDNEAEVGAAIRKSGLDREEIFVTSKIWNDRHGYHEAKDAIQESVDRLNIGYVDMMLIHWPCPKQDKFVETWHAFEEVLETGLVKSIGVSNFHQHHLEKLLAAANVVPAINQVELHPQLAQNSLRHFNKQHNIKTEAWAPLGRAKFLENPLLVEIAESLGKSVAQVIIRWHLQLQNLVIPKSSNPDRLAENFDVFDFELSQHQMGIIATLNTETRIATNPDDMN

SEQ ID NO: 9148 - protein, 275 aa, uncultured bacterium
MSAEQPRLILNSGQSMPQLGLGAYKVNQDITVQLVQHALEIGYRRIDTAAIYDNEAEVGAAVRKSGLAREEVFVTSKIWNDRHGYHEAKEAIQESIDRLNIDYVDMMLIHWPCPKQDKFVETWHAFEEVLETGLVKGIGVSNFNQPHLEKLLQHSNITPAINQVELHPQLAQNGLRELNERHGIRTEAWAPLGRARFMQHPLLIEIAESLGKSVAQVIIRWHLQIGNLVIPKSSNPDRLAENFDVFDFELSHHNMSIIATLNTETRIATNPDDMN

SEQ ID NO: 9149 - protein, 273 aa, uncultured bacterium
MASPLVTLNDGRLMPQLGLGVYKVNQDIAVQLVQTAIEIGYRRVDTAALYDNEAEVGAAIRKSGLEREEIFVTSKIWNDRHGYHEAKEAIQESVDRLNIGYVDMMLIHWPCPKQDKFVETWHAFEEVLETGLVKSIGVSNFHQHHLEKLLAAATVVPAINQVELHPQLAQNSLRHFNKQHNIKTEAWAPLGRAKFLENPLLVEIAESLGKSVAQVIIRWHLQLQNLVIPKSSNPDRLAENFDVFDFELSQHQMGIIATLNTETRIATNPDDMN

SEQ ID NO: 9150 - protein, 599 aa, Oryza sativa (japonica cultivar-group); identical to SEQ ID NO: 3577

SEQ ID NO: 9151 - protein, 423 aa, Oryza sativa (japonica cultivar-group); identical to SEQ ID NO: 3508

SEQ ID NO: 9152 - protein, 244 aa, Mesocricetus auratus
MDLGLAGRRALVTGAGKGIGRSTVLALQAAGAHVVAVSRTQADLDSLVSECPGVETVCVDLADWEATEQALSSVGPVDLLVNNAAVALLQPFLEVTKEAFDMSFNVNLRAVIQVSQIVARGMIARGAPGAIVNVSSQASQRALANHSVYCSTKGALDMLTKMMALELGPHKIRVNAVNPTVVMTSMGRTNWSDPHKAKVMLDRIPLGKFAEVENVVDAILFLLSHRSNMTTGSTLPVDGGFLVT

SEQ ID NO: 9153 - protein, 244 aa, Escherichia coli
MNFEGKIALVTGASRGIGRAIAETLAARGGKVIGTATSENGAQAISDYLGANGKGLMLNVTDPASIESVLEKIRAEFGEVDILVNNAGITRDNLLMRMKDEEWNDIIETNLSSVFRLSKAVMRAMMKKRHGRIITIGSVVGTMGNGGQANYAAAKAGLIGFSKSLAREVASRGITVNVVAPGFIETDMTRALSDDQRAGILAQVPAGRLGGAQEIANAVAFLASDEAAYITGETLHVNGGMYMV

SEQ ID NO: 9154 - protein, 273 aa, Pyrococcus horikoshii
MRDVKLIGSDEVTAIGMGTWGIGGYEVPDYSRDRESIEVLRYGLELGINLIDTAEFYGAGHSEELVGKAIEGFNREEIFIISKVWPSHFGYEKAKKAAKASAKRLGTYIDLYLLHWPGDSWGKIEETLHALEDLVDEGLIRYIGVSNFDLELLKRSQEAMRRYEIVANEVKYSIRDRWPETSGLLDYMKREKIALIAYTPLEKGTLARDPCLTEIGRAYGKTAAQVALNYLIWEDNVIAIPKAGRKDHVDENFGAMGWRLSREDREKARRCFS

SEQ ID NO: 9155 - protein, 821 aa, Pyrococcus horikoshii
MDKMAYKFIKWFEELRKDDVPLVGGKGANLGEMTNAGIPVPPGFCVTAEAYKYFVENVKVSKEDVKKILGEKANKGTIAEVLASAPDEPRTLQEWIMDIINRTNVDDSKQLQENTAIIRELIESLEMPNEIADEIKQAYKELSQRFGKDEIYVAVRSSATAEDLPEASFAGQQETYLDVLGADDVIDKVKKCWASLWTARATFYRAKQGFDHSKVYLSAVVQKMVNSEKSGVMFTANPVTNNRNEIMINASWGLGEAVVSGAVTPDEYIVEKGTWKIKEKVIAKKEVMVIRNPETGKGTVQVKVAEYLGPEWVEKQVLTDEQIIEVAKMGQKIEEHYGWPQDIEWAYDKDDGKLYIVQSRPITTLKETTTEEVEEVEEAEVILKGLGASPGIGAGRVVVIFDASEIDKVKEGDVLVTTMTNPDMVPAMKRASAIITDEGGRTSHAAIVSRELGIPAVVGTKEATKKLKTGDYVTVDGTRGLVYKGIVKSLVEKKKKEEAAAAPGAAVAAAPLVTGTLVKVNVSMPEVAERAAATGADGVGLLRAEHMILSIGQHPVKFIKEGKEDELVERLAEGIEKVAAAFYPRPVWYRTLDAPTNEFREMPGGEDEPEERNPMLGWRGIRRGLDQPELLRAEFKAIKKVVEKGYNNIGVMLPLVSHPEQIRKAKEIAREVGLEPHKDVAWGIMIEVPAAAIIIEDLIKEGIDFVSFGTNDLTQYTLAIDRDNERVAKLYDETHPAVLKLIKHVIKVCKKYGVETSICGQAGSDPKMARILVRLGIDSISANPDAVQLIRQVVAQEERKLMLEAARKKLLEEEEEEEDLF

SEQ ID NO: 9156 - protein, 227 aa, Pyrococcus horikoshii
MGFKEYYRVFPTYTDINSQEYRSRIETLEPLLMKYMKKRGKVLDLACGVGGFSFLLEDYGFEVVGVDISEDMIRKAREYAKSRESNVEFIVGDARKLSFEDKTFDYVIFIDSIVHFEPLELNQVFKEVRRVLKPSGKFIMYFTDLRELLPRLKESLVVGQKYWISKVIPDQEERTVVIEFKSEQDSFRVRFNVWGKTGVELLAKLYFTKEAEEKVGNYSYLTVYNPK

SEQ ID NO: 9157 - protein, 486 aa, Pyrococcus horikoshii
MGKFVEKLEKAIKGYTFDDVLLIPQATEVEPKDVDVSTRITPNVKLNIPILSAAMDTVTEWEMAVAMAREGGLGVIHRNMGIEEQVEQVKRVKRAERLIVEDVITIAPDETVDFALFLMEKHGIDGLPVVEDEKVVGIITKKDIAAREGKLVKELMTKEVITVPESIEVEEALKIMIENRIDRLPVVDERGKLVGLITMSDLVARKKYKNAVRDENGELLVAAAVSPFDIKRAIELDKAGVDVIVVDTAHAHNLKAIKSMKEMRQKVDADFIVGNIANPKAVDDLTFADAVKVGIGPGSICTTRIVAGVGVPQITAVAMVADRAQEYGLYVIADGGIRYSGDIVKAIAAGADAVMLGNLLAGTKEAPGKEVIINGRKYKQYRGMGSLGAMMKGGAERYYQGGYMKTRKFVPEGVEGVVPYRGTVSEVLYQLVGGLKAGMGYVGARNIRELKEKGEFVIITHAGIKESHPHDIIITNEAPNYPLEKF

SEQ ID NO: 9158 - protein, 626 aa, Pyrococcus horikoshii
MEFKPYVPPEKSLPEYTVKAFILGVLLSIIMGAANAYLGMYAGMTVSASIPAAVISMAVLMALRDRNILENNMVQTAASAGEALAAGVIFTFPALVVLNYYTEFPYYIVTVIAALGGSLGALFTVVLRRAFIVEEKLPYPEGTACAEVLIAGDKGGTHAKPIFYGGILGSIYKFFGSIGLWSGTLEAAKLVGRRVLYFGSDLSAALISVGYIVGLNIAFLVFLGGAIAWFIAIPIYAAKMGSPGNLSALDLAWTIWSTKIRYMGVGAMVVGGLWSLVKLRGPIARGIKAGLEAARRRQAGEAVLRTEEDLPLNYVLTLIAAFVIPLFLLYAHILHNIGMAIVMAVIMLILGFFGSAIAGYLAGIVGSSNNPVSGITIMSLLFTALILKGLGLSGTEGMVATILVAAVICTAAAIAGDTMQDLATGYLVGATPKRQQVFEVMGTFFAALVMAPVLNLLIKAYGIAGTPTAKGENALPAPQAFLMAKVTEGVFTGTLEWTMVFIGAGIAIALIIIDEILARRGSKFRTPVMPVAVGIYLPLSLGVPILLGGIARYLVSRGRKEGESFTDPGVLGAAGLIAGEALTGIVFAALIVGGIAPSVKTTLAGNILGVLFLLALLGWLTKLGRK

SEQ ID NO: 9159 - protein, 425 aa, Pyrococcus horikoshii
MVNSMDCGRDYCVKDLSLADEGWKKIDWVSRFMPVLQHIRREFEEKKPFKGVRIAATLHLEMKTAFLLLTLKAGGAEVSAAASNPLSTQDDVVAALAKAGVKVYAIRGESKEQYYEFMHKALDIRPNIIIDDGADMISLVHKERQELLDEIWGGSEETTTGVIRLRAMERDGVLRFSVIAVNDSYMKYLFDNRYGTGQSTWDGVMRATNLLIAGKNVVVVGYGWCGRGIAMRARGLGATVIVVEVDPIKALEARMDGFLVMNMKEAAKIGDIFITATGDIKCIRREHFELMKDGAIMANAGHFDVEIWKPDLEELAVEISNPRPNVTEYKLKDGRRLYLLADGRLVNLVAADGHPAEIMDMSFALQAKAAEYIKDNHGKLEPRVYILPREIDEMVARIKLASMGIEIEELTEEQKKYLESWEHGT

SEQ ID NO: 9160 - protein, 284 aa, Pyrococcus horikoshii
MKLMDETRKAELILLGLSAIWGTTFPVMKIGIKDFPPVSFIAFRFFLASIILAIVLKDKITKDQIFPGFLIGLSLFAGFGFQVVGLKYTTASNSAFITSLYMVFTPFVAFALLKSKITRVDALALAIAVLGTYLISGASLNLSYGDLLTILAALSFAFQIVLIEYYKDLGLGLAFWQIFWNFIFSLVYSIYFESLPLPKEGSTVFAILYTGIVATALAFLGQVKYQPKIESHRAAVLYSAEPVFGYFFSFLILGEILPFEGYVGAFLILVAIWLEISREKLIKE

SEQ ID NO: 9161 - protein, 401 aa, Pyrococcus horikoshii
MLNHVKRIYAKKSRKLVGKKIVLAIPGSIAAVECVKLARELIRHGAEVHAVMTPSATKIIHPYAMEFATGNPVITEITGFIEHVELAGEHENKADLILVCPATANTISKIACGIDDTPVTTVVTTAFPHIPIMIAPAMHESMYKHPIVRENIEKLKKLGVEFIGPRIEEGKAKVASIDEIVYRVIRKLHPKTLKGKRVLVTAGATREYIDPIRFITNASSGKMGVALAEEAEFRGAEVTLIKTKGSVNSFVENQIQVETVEEMLAAIEKELTEKKYDVVIMAAAVSDFKPKIKAEDKIKSNKSITIELVPNPKIIDRIKELQPDVFLVGFKAETTMEKLIQEAKKQIERAKSDIVIGNTLEAFGSDESKVIIIGRNFEKELPKMNKRELAERIWDEIEKRL

SEQ ID NO: 9162 - protein, 206 aa, Pyrococcus horikoshii
MRKMAHGPRYRVPFRRRREGKTNYRKRLKLLKSGKPRLVVRKSLNHHIAQIIVYDPKGDRTLVSAHTRELIRDFGWKGHCGNTPSAYLLGLLIGYKAKKAGIEEAILDIGLHPPVRGSSIFAVLKGAIDAGLNVPHSPEIFPEDYRIRGEHIAEYARMLKEQDEDRFRRQFGGYLEKGLDPEKLPEHFEEVKARIIEKFESEGARE

SEQ ID NO: 9163 - protein, 381 aa, Pyrococcus horikoshii
MVGMKIALVSDWYYPKIGGVATHMHNLAIKLRERGHEVGIVTNNRPTGKEEELKRYGIELIKIPGIISPFLDVNLTYGLKSSEELNEFLKDFDIIHSHHAFTPLSLKALKAGKNMEKGTLLTTHSISFAHESKLWDTLGFTIPLFKSYLKYSHRIIAVSKAAKSFIEHFTSVPVLIVPNGVDDERFFPARDKEKIKAKFGLEGNVVLYVSRMSYRKGPHVLLNAFSKIEDATLVMVGNGEMLPFLKAQTKFLGIENKVVFMGYVPDDILPEVFRMADVFVLPSISSEAFGIVILEAMASGVPIIATDVGGIPEVIKENSAGLLVPPGNELKLREAIEKLLKNEELRKWYGNNGRRSVEEKYSWNKIVVKIERIYNEVLQEV

SEQ ID NO: 9164 - protein, 428 aa, Pyrococcus horikoshii
MENPYEITAIVAREILDSRGNPTVEVDVHTPIAMGRAAVPSGASTGTHEAVELRDGGKRYHGKGVRRAVENVNKIIAPELIGMDVRWQREIDKLLIELDGTENKSNLGANAILAVSLAVAKAAANSLELPLYQYLGGVNAYVLPVPLSNVINGGVHAGNELDFQEFMIMPIGASSFREAIRWVSETYHVLKRVIMGKYGKNAVNVGDEGGFAPPMKEVTEPLDALIKAIEEAGYKPGDEIALAIDAASSEFFKDGKYIVGGKEYTREELLDLYKELVSTYPIVSIEDPFHEEDWEGFVMITNELGKKIQIVGDDLFVTNPRRLKKGIELGAANALLLKVNQIGTLTEAMDAAYTAFRAGYSVIVSHRSGETEDTTIADLAVALNAGQIKTGAPARSDRNAKYNQLIRIEEELEGIAVYAGKNFRKVFF

SEQ ID NO: 9165 - protein, 342 aa, Pyrococcus horikoshii
MAHVAEWKKKEVEELAKLIKSYPVIALVDVSSMPAYPLSQMRRLIRENGGLLRVSRNTLIELAIKKAAKELGKPELEKLVEYIDRGAGILVTNMNPFKLYKFLQQNRQPAPAKPGAVVPKDVVVPAGPTPLAPGPIVGQMQALGIPARIEKGKVTIQKDTTVLKAGEVITPELANILNALGIQPLEVGLDVLAVYEDGIVYTPDVLAIDEQEYIDMLQKAYMHAFNLAVNIAYPTPETIEAIIQKAFLNAKTVAIEAGYITKETIQDIIGRAFRAMLLLAQQLPEDVLDEKTKELLSAQAQVAVATQPSEEEKKEEEKTEEEEKEEEASEEEALAGLSALFG

SEQ ID NO: 9166 - protein, 297 aa, Homo sapiens [sequence omitted]

SEQ ID NO: 9167 - protein, 249 aa, Nostoc sp. PCC 7120; identical to SEQ ID NO: 656

SEQ ID NO: 9168 - protein, 439 aa, Oryza sativa
MGAREEVREEEGEEGEGVGGKEEEKAAAAAAAVSCSICLDAVVAAGGERSTARLQCGHEFHLDCIGSAFNAKGVMQCPNCRKIEKGNWLYANGSRPTQDVNMDEWAHDEDLYDVSYSEMPFRFHWCPFGRLAQLPSFFEEGESSPPVTFHDFMGQHMFTEHVAAVSSAPGAAHPCPYVAYLHPLPSLASSSSSHVPERTMDGPAYHDPWHPLAGPSDGRPLQSVQPADFHHNHWAHVPNSYPQPNNNNGVAEQQGVPFGTTRAARVDGDTQRRGSSISPSYFSNGSGSRSRAPNVPPMVPQFMRAHGSISEQYQQSSSSSLFAGAHRSGGMRTAPPPPLPENPAFCLFPPGSSGHNSMETDDAGGNRFYAWERDRFAPYPLMPVDCETNWWSSQQSHGTSEPAPAPRRLFGQWIGVGRSSPENRSPEGSSYRQMHTPRM

SEQ ID NO: 9169 - protein, 635 aa, Oryza sativa; identical to SEQ ID NO: 904

SEQ ID NO: 9170 - protein, 442 aa, Pneumocystis carinii
MSLLNDRQKEELYKALLFYFSKSDFPKTFSAFESELRNKGIIININEENEHKYDKLLEKKWTSVIRLQKKIMDLEARLCAAQTELSTIPSDKNHSIDMASWIPCAPAKHTLTGHRQPITSLAFHSVFTILASASEDSTIKIWDWETGDFERTLKGHTKAVLDIEFNTFSDSSCLVSCSSDLTIKLWDSKNEYKNIKTLYGHDHSISSIKFLPPNGDRIVSVSRDKNIKIWEISTGFCIKTISNAHIDWIRTICPSNDGKLLLSAGNDRIAKIFNTHNGECKLEFQGHEHVIECAIFAPNSAYKFLMQLSGVHLSKNSMGYVATGSRDKTIKLWGCQNGQIIKTLLGHDNWLRALVFHPSGRYLISASDDKTIRCWDLSQSGKCTRIIEEAHSHFINCLCWASESTESTTNGSNETSNNKSLNSKRLAIASGGVDLVIRIWMP

SEQ ID NO: 9171 - protein, 938 aa, Pneumocystis carinii
MILKILLTLTLYWIYLVRVRCETVPVDFENNDYYHFHFSEEVDIEDFSRALGFKYHEKLEYLDNQHIFSIEKGVLEDEIKEKIENYFGLEKGRNAIDGFNSDKLFYYEKQKLVKRENRGAIRDDIYFDNEGLYNRRVVKNVVKDPTVDQAKKSTEDLKKRLKEIKGELNIEDRYFDKQWYLFNTKDPGVDINVTGLWLEGITGKGVTVAIVDNGVDYTNLDLAPNFNAEASLNFATGTFDVKPEYTYNNHGTRCAGEVAAARNTLCGIGVAYESNISGLRYVPSAHSSWNEGDALIYKYDVNYIYSCSWGPADTGNLIQDISYTSYSAIIKGINEGRNGLGSIYVFGSGNGGYFDDCNYDGYANSPYTITIAAIDAEEKRFRFSEPCPCILASTYSGKSGAYIYTTDVGTTECTFLHTGTSASTPLAAGVIALLLSACPNLTWRDVQALIVETAVPFNLEYPGWEQVHSKRYYNNYFGYGKLDAYRMVERAKTFQKLNPQTMFSTQLIPLNKKFSENGGHITSSFYIHRGYPTHYNFKSLEYVGVSFRYKHQRRGHLEFNITSPSGVTSVLAHRRNPDKHGGSILWTFMTVKHWGEPIVGNWTIDVEDKKDQNLDGEVFYWQLHFFGESSKSEGVPPASYPFLSIYPTTMPPPEPTTTLPPTPSSTSSSRPPPPAPQPQPQPQPQPDPGSLPSSDPESPPSSEPGSQPPSKPGPQPPSDPQPPSKPGPQPPSEPAPPSKPAPPSKPAPPSKPDPNPSSDPSSQKDPDTSLSSNPTSTSSSEPPPPSPPPPPPPPPAPAPAPPPPPPPPPPRPELEPEPEPVPQPPQPQPPQPQPEPPAPPPKPQPPQPPPPPPPPEQKPTSITSSTSTTSSSKTKISTTRKASSTKTSSTTKTSTRPSPTEGTFTGSSASHLSFFEKRHLLLQMILLLLFFLFLGYSF

SEQ ID NO: 9172 - protein, 310 aa, Aeropyrum pernix
MLEHLVQAVAVGHALVDLRLYVERIPGVDEEAVIKDETRSVGGSAANVAVVLRRLGVQSGIIGKIGLDDFGRIAVDNLMREGVDISGLRVSLRDRTGFSVVVRDKEGSITIYSFKGAAEKLEPGEIDADAIGRSKHVHVASLRPDTTLKTVEIAKKRSITVSWDPGRVLSKMGAERLANIISKVDIIFVNRNEAKNLTGYHDYRQAARHLKKLGPKIVVIKLGASGSYILYSDGEVFVPAIKPERVVDTTGAGDSYAAGFIAGLLRGYTIEKASLYATIVASIKVSRLGSNAAPSHEEVVEKARELGVEI

SEQ ID NO: 9173 - protein, 214 aa, Aeropyrum pernix
MGRGPRYRVPLRRRREGKTNYYRRFRLVKSGKPRMAVRISNEYLWVQFLEARIEGDRVIAAAHSRELIKKFGWKGDGNNTCAAYLTGYLAGLRALEKGVREAVLDVGLHKPVKGSRVFAALKGALDAGVEIPHSEEILPGDERVRCEHIAQWAEALKEENAELYQRQFSRYLDRGLNPEELPGHVEEVKKAIEEAYKHVAEETAAEGEEVEVKA

SEQ ID NO: 9174 - protein, 362 aa, Aeropyrum pernix
MAIILGGMVPRPPWKYRLLAAIHAHRNAGDPGADPLVRRAVERLVAVTSRVVFGVEKPGWITSGASEGNLLALYTLREEGYRRVVAFDTSHYSIKKSALTLSMELDLLPTHGGRPRLDLLERRITPDSVVVATVGTTQEGLVDPVEEIAGVAESVGAAVHVDAAYGGYIARFLTGKARFRLEPPVMTVVVDAHKIPEAPPPAGVILASKQKLLDNLWFESPYIPTGRQFGILGTRPGGPIVAAWRRVEDLERNPGFPRLASILMRRLRKTLKALERLGYETPVTPDLPVACATHPRLGEVLERLKASGVRVYRCRSPKPCLHVTNYGRLCRARLGSSRSPRGCLRKPLGASLGNPGVTGLGL

SEQ ID NO: 9175 - protein, 322 aa, Aeropyrum pernix
MASAPALQMASYRKALGRLLARLASELEDLVVLDADTLRSTGAIEVYRSAPRRVLNMGISEQDLIGTAAGIALAGLRPVVTGFGAFLMRGWEQIRNTVDRDGLNVKIVATHTGLSPHVDGSSHQVLEDLALMRSLARTAVFSPADDVATVETVEWLVRRYRGPAYVRLGRDNAFRVYSEEEFTFRPGGGEVLVEPGEAVTLLATGPMVGVSLAAAALLRSEGLRVGVVDVYSIKPAPRRLVLEAAERSRLLVTVEEHRTVGGLGDVVSSILAEEGACARQARIGVPPGVYGSSSRDYMSLLRHLRLDPESVAARVRRLAAAL

SEQ ID NO: 9176 - protein, 399 aa, Aeropyrum pernix
MQIEWAERHMPVLMRLRSSMGGDKPLSGVRVAACLHVTKETAVLVETLRKWGAEVYLAPSNPLSTQDEVAAALAEAGIGVFAWRGMTPEEYKWALSTVAGREPDIVIDDGADLHVLLHEEMRSVGEKVWGGTEETTTGVIRLRALEREGRLLYPVIAVNDALTKFMFDNRYGTGQSTVDGVLRATNILIAGKTVVVAGYGWVGRGIAARFRGMGAKVVVTEVDPVRALEAAMDGFTVTTMDEAASLGDVFITATGNINVIDARHMEKMKDGAILANAGHFNVEINVAALEEMSVSKRRVRRYLDEYRLPDGRRLYLIGEGRLVNLVAAEGHPSEVMDMSFSNQALAVLKIAGERGRLEKRVHRVERIQDEMVARLKLETMGVRIDSLTEEQKLYLQKWK

SEQ ID NO: 9177 - protein, 845 aa, Aeropyrum pernix
MRISVLFKYFIHLPPGLTPFIWCLCVERRLILWLDEISKDLLPLVGGKAAGLGEMIKAGIPVPPGFVVTSEAYRRFVFETGIAGFIKHILEETIVSGRPEEYEKASELIRSKFVRTPMPPYLRRAIVDAYRKLGTLVGVEEPRVAVRSSATVEDLPEASFAGQQETYLNVKGEEEVVEKVKTAWASLWTARALSYRDSLNIDHETALMAVVVQKMVSSRSSGVMFTIHPVTGEEDKIVIESIWGLGEYIVGGKVTPDRFVVSKSDLEILEVRISRKDKALFYDPDLNENVEIKIPESGEELEDLRRKHPAVAEVVEKYGIRPDAPSLSEKEVKELARLAIKVENHFARPMDIEWAIDFELSPPENILLLQARPETVWSRKKEEAEAKPPEEEAVPEGEVLVRGVPASPGVASGRVKVALTVEEAAKKMEKGDVLVTKMTDPDWVPYMKMASAIVTDEGGMTAHAAIVARELGIPAVVGTGDATKKLKDGMLVTVDGSRGVVYAGAVKTEEAREEEARPELGAAVAEVLSEVYPVTATKIYMNLGHPEEIDRYKHLPFEGIGLMRIEFIISSWIGYHPMYLIEQGRGVYFIDKLAEGVAKVASAIYPRPVVVRFSDFKTNEYRRLKGGEKYETLDERNPMIGWRGVSRYIHPNYEPAFRLEVRAIKKVREEWGLKNVWVMFPFVRTTWELERALKIMEEEGLSRGRDFKVWIMVEVPSTVFLADEFAKMVDGFSIGSNDLTQLVLGVDRDSGFLAKMGYFDERDPAVLRSIEILIEKAHSQGATVSICGQGPSVYPELVEFLVRRGIDSISVNPDAVVRVRRQVASIERRIMLERLEELGSRLSRL

SEQ ID NO: 9178 - protein, 444 aa, Aeropyrum pernix
MPGVPYRVDSVLAGNSGHTIDTLLLTFDDVAILPGLSTVEPHDVELSSRVSRSIFVSTPLVSSPMDTVTEWRMAAALARLGAVGVIHRNMPREEQARHVSMVKSVSPSPWSEVPRIRLPDGLENYSLILEELDAGAAVVFGDDGIKGYLVLERPDAQLWLEKARYLSLYLTRIRPFPTIDGEGRLVVGAAVSPFDLDRARLLEKSGADFLVIDVAHLHNRNALSSLSRLVKEVSIDVVAGNLGTREGVLDTLARAEEVAGLRMGISSGSICSTGEVAGAAVPTLTAVMNAVLALEELGLAGRIPIIADGGVRNAGDAAKAIIAGASAVMGGRLFAGADESPGPRIRVGDKLYKPYRGMASRGAMERRFAVDRYSRQAKAVEEGVEGLVPYTGPVVKTLYELAEGLKAALGYAGAQDVTSAWKAKLARVTPTGSREIRPHDILLG

SEQ ID NO: 9179 - protein, 325 aa, Aeropyrum pernix
MPVMNMVQALNTALREEMRRDKSVVVLGEDVGRRGGVFLVTEGLIDEFGEERVIDTPLTEMGIVAFAIGMAMYGLRPVAEIQFIDFIYEAFDQIVNNAAWYRFRSGGMYNVPLVIRGPCCGGIRGGMHHSQSNEPYFIHTPGLYVVMPSTPYDAKGLLKSSIRSDDAVIFLEPKSIYRTIREEVPDNDYTIPLGQARLVQEGSDVTLVTWGAMVHLAKEAAELLREKRGWSIEIIDLRTLQPWDKDMVVKSLEKTGRLVIVHEARKILGPGAEIAAYISENYIDLLRGPVKRVASYDTPYPLAHEKLYLPNLAKIYRAVTEVMQW

SEQ ID NO: 9180 - protein, 272 aa, Aeropyrum pernix
MPLFPIDYNDFKPIGKTKERLSAVGLGTWAIRDYSSALESYVYAIERGINHIDTAEMYGAGEAERFVGKVLRSVGRDRVYVVTKLYPFRFRDPDEAVKAARASAERMGVSYVDIILIHWPDPQTPIKDQVKSLEAIAEAGLARYIGVSNFSKEQLEEALTATKKHEIVVNQVKYSVLDRRAEELIPLAVEKSILLEAYSPLERGHVAEVRLLAKIGRQYGKTPVQVALNFIVSRPNFIAIPKAERREHVDEILGSLGWRLKPEDIELIEEKL

SEQ ID NO: 9181 - protein, 392 aa, Aeropyrum pernix
MLGGLRRVEDLDSDPPPRGSRIVMVMDFHPSSVGGVQSHVRDLTRLLQDFGYDVVIVSRALGKGDVKDLEAEGHYIVKPLFPLEIIFVPPDPSDLRREIESLKPDVVHSHHIYTLTSLLALKAARDLGLPRIATNHSIFLAYDKVALWRIASIVLPTRYLLPNAQAVISVSTAADKMVEGIVGDSVDRYIIPNGVDVERFKPSTPKADYPLVLFLGRLVWRKGAHVLVRAFRHVVDEIRDAKLYIGGKGEFEPIIKLLIARYGLENNVKMLGVVPESEKPSLYSSAWVTAVPSIVNESFGIVALESLSSGTPVVASRQGGLKDVVKHGKTGLLVKPGSSKELAKALITLLQDSGLRKRMSEEARKIVLERYDWRKVVPQILKVYGHYMEARG

SEQ ID NO: 9182 - protein, 344 aa, Aeropyrum pernix
MSVVSLVGQMYKREKPIPEWKTLMLRELEELFSKHRVVLFADLTGTPTFVVQRVRKKLWKKYPMMVAKKRIILRAMKAAGLELDDNLLDDLVRGQMLLVFADGNPFKIVKEVEKEKVAMPVKPGDKAETEIRIPEGMTNLTPGPILSVFGKLRIQYQVRGGKIYIAKETVVAKPGDVISEDLAGLLMALGIRPIEKGVRVKFAIDGGVLITEDLLRPDIEAFRGDVIDAAKEALGLATEIVYMPVPEAVESAIVKAALAASALAAETGFIAPGTVEDVVRKAIAEEAAVVALLGDKARELGIEEAAPAAAPAAEEKAEEEKKEEEEEKKEDQELSGLDSIFGGF

SEQ ID NO: 9183 - protein, 480 aa, Aeropyrum pernix
MSWWKLDREALDRKRTWVTQGPIVKVILALATPIVAARLLAATQESVDAIFLGRVSTEDLAAPAAASPLLWLFAGLGIGINTTLSALVSQAIGARDYASAQRYASKLLGATLMLGAASALAIILTAETVFILQGFQGRSLEVALAYTLVEAVGMPFMLALFYFNAVMAASGDTRTPFKVSALSSILNVILDPILIFGLILLPPLGAVGAAVATVLARAAAVSIAFYLLLRGAPGFRVKPSMPDRQLIGHILRIGGPVSLQRLVVSMGFLVMMGIVARLGAPVVAAYNVSLVIIHIVQSATFGFNIATATVVGQNLGASNISRAVRAAYTGVALVFGLLSIGAVAIVGGRSMLVSLFTSIEEVQFYAERMISIVALGMPFLGAFFTAMGVARGSGRTAFISALGIARLWLLRIPAAYTLVYIYSLGDMGVWLAMTLSNIIAGTLAIAWVAGRTWAKPIVKRVPPEPLGEKPPAIPEPAINR

SEQ ID NO: 9184 - protein, 432 aa, Aeropyrum pernix [sequence omitted]

SEQ ID NO: 9185 - protein, 243 aa, Aeropyrum pernix
MTGGSRGIGRATVLRFAREGWSVVIAYKSRADLAEKTAEEARRLGSPEAYTVRVDVGDPDSVTEMSSRVGELIPHLNVLVNAAGVLQLGGIEETSISEWEETLRVNLTGVYLVTKLLLPLLRKAKWASIVNVASIAGETGNVVAGVAYSASKAGVIGLTKRLAVQLAGYGIRVNAVAPSFVETDMTRSFLDTPEKRERIASLHPLKIILKPEDVAEAILFLADPRRSRGITGHVLSINAGRRT

SEQ ID NO: 9186 - protein, 113 aa, Homo sapiens
MSASVVSVISRFLEEYLSSIPQRLKLLDAYLLYILLTGALQFGYCLLVGTFPFNSFLSGFISCVGSFILAVCLRIQINPQNKADFQGISPERAFADFLFASTILHLVVMNFVG

SEQ ID NO: 9187 - protein, 398 aa, Homo sapiens
ARGRNHPPRKISTEDINKRLSLPADIRLPEGYLEKLTLNSPIFDKPLSRRLRRVSLSEIGFGKLETYIKLDKLGEGTYATVYKGKSKLTDNLVALKEIRLEHEEGAPCTAIREVSLLKDLKHANIVTLHDIIHTEKSLTLVFEYLDKDLKQYLDDCGNIINMHNVKLFLFQLLRGLAYCHRQKVLHRDLKPQNLLINERGELKLADFGLARAKSIPTKTYSNEVVTLWYRPPDILLGSTDYSTQIDMWGVGCIFYEMATGRPLFPGSTVEEQLHFIFRILGTPTEETWPGILSNEEFKTYNYPKYRAEALLSHAPRLDSDGADLLTKLLQFEGRNRISAEDAMKHPFFLSLGERIHKLPDTTSIFALKEIQLQKEASLRSSSMPDSGRPAFRVVDTEF

SEQ ID NO: 9188 - protein, 352 aa, Homo sapiens
MESGGRPSLCQFILLGTTSVVTAALYSVYRQKARVSQELKGAKKVHLGEDLKSILSEAPGKCVPYAVIEGAVRSVKETLNSQFVENCKGVIQRLTLQEHKMVWNRTTHLWNDCSKIIHQRTNTVPFDLVPHEDGVDVAVRVLKPLDSVDLGLETVYEKFHPSIQSFTDVIGHYISGERPKGIQETEEMLKVGATLTGVGELVLDNNSVRLQPPKQGMQYYLSSQDFDSLLQRQESSVRLWKVLALVFGFATCATLFFILRKQYLQRQERLRLKQMQEEFQEHEAQLLSRAKPEDRESLKSACVVCLSSFKSCVFLECGHVCSCTECYRALPEPKKCPICRQAITRVIPLYNS

SEQ ID NO: 9189 - protein, 103 aa, Escherichia coli
MKKIDAIIKPFKLDDVRERLAEVGITGMTVTEVKGFGRQKGHTELYRGAEYMVDFLPKVKIEIVVPDDIVDTCVDTIIRTETGKIGDGKIFVFDVARVIRIVP

SEQ ID NO: 9190 - protein, 337 aa, Acrosiphonia duriuscula
MPRNRDDSPDGAYLIHGRYEKIEKLGEGTYGKVYKARDSKTDQVVALKKCRLQLDAEGVPPTTIREVSLLQVLSRSNHVVKLLGVEQIEEDGKVVLYLIFEYLQHDLKKFMDFKKKEKHNPLQPELVKPYLFQLIRGMAFMHQHGVMHRDLKPQNLLVDPKTNVLKIADLGLGRVFALPCKAYTHEIVTLWYRAPEVLLGTKIYSLPVDVWSIGCIFAEMVKGIPFFPADCEIAQLFMIFQVLGTPNEEVWPGVTSLRDWHMYPQWQPMDLHTHLEGLLDHQGCDLLKKMLVYNPNKRIPAKQAMKHPYFDDLDMEVMDALENPEVLNAGMEYQENA

SEQ ID NO: 9191 - protein, 229 aa, Oryza sativa (japonica cultivar-group)
MARPLYPMMLESPQLRWAFVRKVYAILSIQMLLTIAVASVVVFVRPVALFFVSTPAGFALYIFLIILPFIVLCPLYYYYQRHPVNLLLLALFTAAISFAVGLTCAFTKGEVILESAILTAAVVVSLTAYTFWAARRGHDFSFLGPFLFAAVMILMVFALIQVFFPLGRVSLMIYGGLAALVFCGYIVYDTDNLIKRYSYDEYVWAAVALYLDVINLFLSLLTLFRASDS

SEQ ID NO: 9192 - protein, 488 aa, Escherichia coli
MLRIAKEALTFDDVLLVPAHSTVLPNTADLSTQLTKTIRLNIPMLSAAMDTVTEARLAIALAQEGGIGFIHKNMSIERQAEEVRRVKKHESGVVTDPQTVLPTTTLREVKELTERNGFAGYPVVTEENELVGIITGRDVRFVTDLNQPVSVYMTPKERLVTVREGEAREVVLAKMHEKRVEKALVVDDEFHLIGMITVKDFQKAEAKPNACKDEQGRLRVGAAVGAGAGNEERVDALVAAGVDVLLIDSSHGHSEGVLQRIRETRAKYPDLQIIGGNVATAAGARALAEAGCSAVKVGIGPGSICTTRIVTGVGVPQITAVADAVEALEGTGIPVIADGGIRFSGDIAKAIAAGASAVMVGSMLAGTEESPGEIELYQGRSYKSYRGMGSLGAMSKGSSDRYFQSDNAADKLVPEGIEGRVAYKGRLKEIIHQQMGGLRSCMGLTGCGTIDELRTKAEFVRISGAGIQESHVHDVTITKESPNYRLGS

SEQ ID NO: 9193 - protein, 382 aa, Homo sapiens
MSDSKCDSQFYSVQVADSTFTVLKRYQQLKPIGSGAQGIVCAAFDTVLGISVAVKKLSRPFQNQTHAKRAYRELVLLKCVNHKNIISLLNVFTPQKTLEEFQDVYLVMELMDANLCQVIHMELDHERMSYLLYQMLCGIKHLHSAGIIHRDLKPSNIVVKSDCTLKILDFGLARTACTNFMMTPYVVTRYYRAPEVILGMGYKENVDIWSVGCIMGELVKGCVIFQGTDHIDQWNKVIEQLGTPSAEFMKKLQPTVRNYVENRPKYPGIKFEELFPDWIFPSESERDKIKTSQARDLLSKMLVIDPDKRISVDEALRHPYITVWYDPAEAEAPPPQIYDAQLEEREHAIEEWKELIYKEVMDWEERSKNGVVKDQPSAQMQQ

SEQ ID NO: 9194 - protein, 382 aa, Homo sapiens [sequence omitted]

SEQ ID NO: 9195 - protein, 424 aa, Homo sapiens
MSDSKCDSQFYSVQVADSTFTVLKRYQQLKPIGSGAQGIVCAAFDTVLGISVAVKKLSRPFQNQTHAKRAYRELVLLKCVNHKNIISLLNVFTPQKTLEEFQDVYLVMELMDANLCQVIHMELDHERMSYLLYQMLCGIKHLHSAGIIHRDLKPSNIVVKSDCTLKILDFGLARTACTNFMMTPYVVTRYYRAPEVILGMGYKENVDIWSVGCIMAEMVLHKVLFPGRDYIDQWNKVIEQLGTPSAEFMKKLQPTVRNYVENRPKYPGIKFEELFPDWIFPSESERDKIKTSQARDLLSKMLVIDPDKRISVDEALRHPYITVWYDPAEAEAPPPQIYDAQLEEREHAIEEWKELIYKEVMDWEERSKNGVVKDQPSDAAVSSNATPSQSSSINDISSMSTEQTLASDTDSSLDASTGPLEGCR

SEQ ID NO: 9196 - protein, 284 aa, Escherichia coli
MTDKMQSLALAPVGNLDSYIRAANAWPMLSADEERALAEKLHYHGDLEAAKTLILSHLRFVVHIARNYAGYGLPQADLIQEGNIGLMKAVRRFNPEVGVRLVSFAVHWIKAEIHEYVLRNWRIVKVATTKAQRKLFFNLRKTKQRLGWFNQDEVEMVARELGVTSKDVREMESRMAAQDMTFDLASDDDSDSHAMAPVLYLQDKSSNFADGIEDDNWEEQAANRLTDAMQGLDERSQDIIRARWLDEDNKSTLQELADRYGVSAERVRQLEKNAMKKLRAAIEA

SEQ ID NO: 9197 - protein, 303 aa, Bombyx mori
MANNDNFAQDITTDNQLNGNAENGGGDSQDHNSAEAPGRDDDRKLFVGGLSWETTDKELRDHFGAYREIESINVKTVPNTGRSRGFAFIVFKAPESIDKVMAAGEHTINNKKVDPKKAKARHGKIFVGGLSSEISDDEIRNFFSEFGTILEVEMPFDKTKNQRKGFCFITFESEQVVNDLLKTPKRTIGGKEVDVKRATPKPDGPGGIGTRGGRGGRGARGGRGGRGGYGGQPWGNQGYGGYGYGQGGYGGGYDSYGYGGYGYDGYGGYGGYDYSGYPNYGYQGGKTRGGGGGARTTQRHQPY

SEQ ID NO: 9198 - protein, 677 aa, Physcomitrella patens
MAHALGVIGLHGLQLSQTKQHYGQSLHVESYSGRFQYSQDTAGAACFRDKPSPPVVASSLTSSNEEQIAVKKEKTRGSLRKCKVAGRVELPSRDQQQSVARALTVLHEHISGVALQNIALSEDELSRYSSILPDASTLLRRSMLEAQWALTLKELMHEQKMEEQKNSRRAGKGKKSFSLEVTEDVSPGSTSTATGDLAVEDLTDEEKVTERKVTRRRGKGKLKQVERKQDTSLQETGNVHTEGSEEVVDYFRSGEQLKDLNTARRGGEGKLTKFERKLDSSLVEDACPESTSTMTTELVVKSGSPSARTRRLESRQRRVAIAGKPTSPDALTIHPLKKYQKGERVRRVKFDGVQDYLTTYLREITKINLLTKQEEVFLSKKLRIGLNLLEERKKLAAELGYVPSNEEWAPHMNLSVGDLVRKLGEAEWARDKMVMANLRLVVSVAKQYHSFGLEMADLIQEGSIGLLRGVEKFDHTRGYKLSTYVHWWIRQGVTRAIADHSRTVRLPVHVHDTLGRIRKAKSTLLSEGCTASVQEISEATNLTGTKIKNTLQVTKKLVSLDKEIGRNTLQSGDGETLHSLVADRDIENQPWTIVERMLMKDDVDKLLTSQLGPRERDIVRLHYGVGREDGSVMSLESISYRYGVSRERVRQLETAAMRKLQIKSREQGLDRYLHSMQ

SEQ ID NO: 9199 - protein, 370 aa, Homo sapiens
MFQASMRSPNMEPFKQQKVEDFYDIGEELGSGQFAIVKKCREKSTGLEYAAKFIKKRQSRASRRGVSREEIEREVSILRQVLHHNVITLHDVYENRTDVVLILELVSGGELFDFLAQKESLSEEEATSFIKQILDGVNYLHTKKIAHFDLKPENIMLLDKNIPIPHIKLIDFGLAHEIEDGVEFKNIFGTPEFVAPEIVNYEPLGLEADMWSIGVITYILLSGASPFLGDTKQETLANITAVSYDFDEEFFSQTSELAKDFIRKLLVKETRKRLTIQEALRHPWITPVDNQQAMVRRESVVNLENFRKQYVRRRWKLSFSIVSLCNHLTRSLMKKVHLRPDEDLRNCESDTEEDIARRKALHPRRRSSTS

SEQ ID NO: 9200 - protein, 793 aa, Escherichia coli
MSNNGSSPLVLWYNQLGMNDVDRVGGKNASLGEMITNLSGMGVSVPNGFATTADAFNQFLDQSGVNQRIYELLDKTDIDDVTQLAKAGAQIRQWIIDTPFQPELENAIREAYAQLSADDENASFAVRSSATAEDMPDASFAGQQETFLNVQGFDAVLVAVKHVFASLFNDRAISYRVHQGYDHRGVALSAGVQAGLVRSDLASSGVMFSIDTESGFDQVVFITSAWGLGEMVVQGAVNPDEFYVHKPTLAANRPAIVRRTMGSKKIRMVYAPTQEHGKQVKIEDVPQEQRDIFSLTNEEVQELAKQAVQIEKHYGRPMDIEWAKDGHTGKLFIVQARPETVAHAVRSWSVIRCIHRVRLSPEGRAIGHRIGAGPVKVIHDISEMNRIEPGDVLVTDMTDPDWEPIMKKASAIVTNRGGRTCHAAIIARELGIPAVVGCGDATERMKDGENVTVSCAEGDTGYVYAELLEFSVKSSSVETMPDLPLKVMMNVGNPDRAFDFACLPNEGVGLARLEFIINRMIGVHPRALLEFDDQEPQLQNEIREMMKGFDSPREFYVGRLTEGIATLGAAFYPKRVIVRLSDFKSNEYANLVGGERYEPDEENPMLGFRGAGRYVSDSFRDCFALECEAVKRVRNDMGLTNVEIMIPFVRTVDQAKAVVEELARQGLKRGENGLKIIMMCEIPSNALLAEQFLEYFDGFSIGSNDMTQLALGLDRDSGVVSELFDERNDAVKALLSMAIRAAKKQGKYVGICGQGPSDHEDFAAWLMEEGIDSLSLNPDTVVQTWLSLAELKK

SEQ ID NO: 9201 - protein, 255 aa, Medicago truncatula
MAMTRESWAFVFGIIGNIISFAVFLSPLPTFYVIFKKKSAEGFQALPYVVALFSAMLWIYYAFVKRESALLLITINTFGIVVESAYIIMFLIYAPKKQRLSTIKLLLLLNVFGFGAMLLSTLYLSKGAKRLAIIGWICLVFNISVFAAPLFVISKVIRSRSVEYMPFFLSFFLTINAVMWFFYGLLLRDYYVALPNTLGFVFGIIQMVVYLIYRNATPVVEAPMKGQELSGGHIIDVVKIGTDSNRAGGGAGSKV

SEQ ID NO: 9202 - protein, 264 aa, Pseudomonas putida
MDLQLSGKRALVTGSTAGIGFAIATELAREGVAVVLNGRSEERVAQAVQRLQAAVPQAQVRGVAADVATAVGCDLLAQASAGVDILVNNFGIFDPQPFGAIDDAQWQRFFDANVMSGVRLSRALLPAMQAAGWGRIVFINSESGVNPPTEMVHYGMSKAAQLSVSRGLAQHCAGTGVTVNAVLPGPTSTEGVGDFFAKLAADQGVDLAEAERRFFAQARPTSLLRRFIEPSEVAALVAYVCSPRSSATNGAALRVEGGILSSIC

SEQ ID NO: 9203 - protein, 93 aa, Oncorhynchus mykiss
DQLRSESSTEAYIRCLRLGCRCVELDCWEGPGEPIIYHGWTRTTKIKFEDVVKAINDHAFVTSEYPVVLSIEEHCPIEQQRQMARIFREVFQD

SEQ ID NO: 9204 - protein, 154 aa, Fragaria x ananassa
MGGACGYGNLYSQGYGTNTAALSTALFNNGLSCGACYELRCVNDPQWCLPGTIVVTATNFCPPGGWCDPPQQHFDLSQPVFLKIAQYRAGVVPVSYRRVRCRRAGGIRFTINGHSYFNLVLVTNVGGAGDVQSVAIKGSRTRWQMMSRNWGQNW

SEQ ID NO: 9205 - protein, 162 aa, Fragaria x ananassa
MGGACGYGNLYSQGYGTNTAALSTALFNNGLGCGSCYEIRCVNDPKWCLPGSIVVTATNFCPPNNALPNNAGGWCNPPQHHFDLSQPVFQHIAQYKAGVVPVSYRRVPCRRRGGIRFTINGHSYFNLVLITNVGGAGDVHSVSVKGSKTGWQAMSRNWGQNW

SEQ ID NO: 9206 - protein, 162 aa, Fragaria x ananassa
MGGACGYGNLYSQGYGTNTAALSTALFNNGLSCGACFEIKCVNDPKWCLPGSILVTATNFCPPNNALPNNNGGWCNPPQHHFDLAQPVFQHIAQYRAGIVPVSYRRVPCQKKGGIRFTINGHSYFNLVLITNVGGAGEVQSVSIKGSRTNWQPMSRNWGQNW

SEQ ID NO: 9207 - protein, 164 aa, Fragaria x ananassa
MGGACGYGNLYSQGYGVSTAALSTALFNNGLSCGACFEIKCANDPNWCHSGSPSIFITATNFCPPNFAQPSDNGGWCNPPRPHFDLAMPMFLKIAEYRAGIVPVSYRRVPCRKRGGIRFTINGFRYFNLVLVSNVAGAGDIVRVSVKGSRTGWMSLSRNWGQNW

SEQ ID NO: 9208 - protein, 162 aa, Fragaria x ananassa
MGGACGYGNLYSQGYGTNTAALSTALFNDGLSCGSCYEMRCDNDPRWCRPGSIIVTATNFCPPNFAQANDNGGWCNPPLQHFDLAEPAFLQIAQYRAGIVPVAFRRVPCVKKGGIRFTVNGHSYFNLVLITNVAGAGDVHSVSIKGSRTGWQSMSRNWGQNW

SEQ ID NO: 9209 - protein, 411 aa, Fusarium proliferatum
VHWHGILQKGMPWEDGVPGVTQCPIPPKKSFTYQFLADLYGTSWYHSHYSAQVAAGLFGPLVIYGPREKKDYDIDIGPVMLSDWYHKEYFDLVEEIMKPGGNGVVLSDSNLINGKMNFNCSSVAPGDKTPCKSNAGISKFRFKRGKVHRLRLINPSAEAIQRFSIDGHTMKVIANDFVPVQPYDTKVVTLGVGQRTDVLVRANGKLDSYWMRSNISAICSLGRAPAALAAIYYDNANQKKAPKSQAWDIPDPETCANDDLSITKPVMKLPLPPADKTIELDISSFKNASNVTLWTLGGVAARTNYNSPTLLLSKLGNHTFEPEWNVINTGKAKSVRVVVNNKTPVAHPMHLHGFNMYVLHEGPGSWDGTIINRHNPQRRDVVQIRGNGHLVIQFDAGENPGVWPFHCHIDS

SEQ ID NO: 9210 - protein, 247 aa, Brassica napus
MDSFSSFFDSQPGSRSWSYDSLKNLRQISPSVQNHLKRVYLTLCCALVASAFGAYLHVLWNIGGILTTIGCFGSMIWLLSCPPYEQQKRLSLLFLSAVLEGASVGPLIKVAVDFDPSILITAFVGTAIAFICFSGAAMLARRREYLYLGGLLSSGLSMLMWLQFASSIFGGSASIFKFELYFGLLIFVGYMVVDTQDIIEKAHLGDMDYVKHSLTLFTDFVAVFVRVLIIMLKNSADKEDKKKRRRN

SEQ ID NO: 9211 - protein, 249 aa, Nicotiana tabacum
MESCTSFFNSQSASSRNRWSYDSLKNFRQISPFVQTHLKKVYLSLCCALVASAAGAYLHILWNIGGLLTTLGCVGSIVWLMATPLYEEQKRIALLMAAALFKGASIGPLIELAIDFDPSIVIGAFVGCAVAFGCFSAAAMVARRREYLYLGGLLSSGLSILFWLHFASSIFGGSMALFKFEVYFGLLVFVGYIIFDTQDIIEKAHLGDLDYVKHALTLFTDFVAVFVRILIIMLKNASDKEEKKKKRRN

SEQ ID NO: 9212 - protein, 258 aa, Brevibacterium sp. HCU
MLPVTDSLGGDVFLVTGGAGGIGKATTTALAERGGRVVLTDVDEDAGSQVADEVRRNTNGEIRFEPLDVTNPAAVTECAQKLDDEGWPVYGLMANAGIAPSSSAVDYSDELWLRTVDINLNGVFWCCREFGKRMIARGRGSVVTTSSIAGFRTVSPERHAAYGATKAAVAHLVGLLGVEWAKTGVRVNAVAPGYTRTPILEALKAESPETISEWTERIPNGRLNDPSEIADGVVFLMSNAARGITGTVLHIDGGYAAR

SEQ ID NO: 9213 - protein, 256 aa, Brevibacterium sp. HCU
MNRLGGKVAVITGGAAGMGRIQSELYASEGAQVAVVDVNEQEGRATADAIRASGGVANYWKLDVSDESEVEIVVSDIAKRFGAINVLVNNAGVTGADKPTHEIDERDLDLVLSVDVKGVFFMTKHCIPYFKQAGGGAIVNFASIYGLVGSQELTPYHAAKGAVVALTKQDAVTYGPSNIRVNAVAPGTILTPLVKELGSRGPDGLDGYTKLMGAKHPLGRVGTPEEVAAATLFLASEEASFITGAVLPVDGGYTAQ

SEQ ID NO: 9214 - protein, 1395 aa, Homo sapiens
MLLPLPPQSSKPVPKKSQSSKIVPSHHDPSEKTGENCQTKISPSSLQESPSSLQGALKKRSAFEDLTNASQCQPVQPKKEANKEFVKVVSKKINRNTHALGLAKKNKRNLKWHKLEVTPVVASTTVVPNIMEKPLILDISTTSKTPNTEEASLFRKPLVLKEEPTIEDETLINKSLSLKKCSNHEEVSLLEKLQPLQEESDSDDAFVIEPMTFKKTHKTEEAAITKKTLSLKKKMCASQRKQSCQEESLAVQDVNMEEDSFFMESMSFKKKPKTEESIPTHKLSSLKKKCTIYGRICHFRKPPVLQTTICGAMSSIKKPTTEKETLFQELSVLQEKHTTEHEMSILKKSLALQKTNFKEDSLVKESLAFKKKPSTEEAIMMPVILKEQCMTEGKRPRLKPLVLQEITSGEKSLIMKPLSIKEKPSTEKESFSQEPSALQKKHTTQEEVSILKEPSSLLKSPTEESPFDEALAFTKKCTIEEAPPTKKPLILKKKHATQGTMSHLKKPLILQTTSGEKSLIKEPLPFKEEKVSLKKKCTTQEMMSICPELLDFQDMIGEDKNSFFMEPMSFRKSPTTEETVLTKTSLSLQEKKITQGEMSHLKKPLVLQKITSEEESFYKKLLPFKMKSTTEEKFLSQEPSALKEKHTTLQEVSLSKESLAIQEKATTEEEFSQELFSLHVKHTNKSGSLFQEALVLQEKTDAEEDSLKNLLALQEKSTMEEESLINKLLALKEELSAEAATNIQTQLSLKKKSTSHGKVFFLKKQLALNETINEEEFLNKQPLALEGYPSIAEGETLFKKLLAMQEEPSIEKEAVLKEPTIDTEAHFKEPLALQEEPSTEKEAVLKEPSVDTEAHFKETLALQEKPSIEQEALFKRHSALWEKPSTEKETIFKESLDLQEKPSIKKETLLKKPLALKMSTINEAVLFEDMIALNEKPTTGKELSFKEPLALQESPTYKEDTFLKTLLVPQVGTSPNVSSTAPESITSKSSIATMTSVGKSGTINEAFLFEDMITLNEKPTTGKELSFKEPLALQESPTCKEDTFLETFLIPQIGTSPYVFSTTPESITEKSSIATMTSVGKSRTTTESSACESASDKPVSPQAKGTPKEITPREDIDEDSSDPSFNPMYAKEIFSYMKEREEQFILTDYMNRQIEITSDMRAILVDWLVEVQVSFEMTHETLYLAVKLVDLYLMKAVCKKDKLQLLGATAFMIAAKFEEHNSPRVDDFVYICDDNYQRSEVLSMEINILNVLKCDINIPIAYHFLRRYARCIHTNMKTLTLSRYICEMTLQEYHYVQEKASKLAAASLLLALYMKKLGYWVPFLEHYSGYSISELHPLVRQLNKLLTFSSYDSLKAVYYKYSHPVFFEVAKIPALDMLKLEEILNCDCEAQGLVL

SEQ ID NO: 9215 - protein, 265 aa, Mus musculus
GSVDIEVQDLEEFALRPAPQGITIKCRITRDKKGMDRGMFPTYFLHLDREDGKKVFLLAGRKRKKSKTSNYLISVDPTDLSRGGDSYIGKLRSNLMGTKFTVYDNGVNPQKASSSTLESGTLRQELAAVCYETNVLGFKGPRKMSVIVPGMNMVHERVCIRPRNEHETLLARWQNKNTESIIELQNKTPVWNDDTESYVLNFHGRVTQASVKNFQIIHGNDPDYIVMQFGRVAEDVFTMDYNYPLCALQAFAIALSSFDSKLACE

SEQ ID NO: 9216 - protein, 265 aa, Agaricus bisporus
GSHMAPGFTISFVNKTIIVTGGNRGIGLAFTRAVAAAGANVAVIYRSAADAVEVTEKVGKEFGVKTKAYQCDVSNTDIVTKTIQQIDADLGPISGLIANAGVSVVKPATELTHEDFAFVYDVNVFGVFNTCRAVAKLWLQKQQKGSIVVTSSMSSQIINQSSLNGSLTQVFYNSSKAACSNLVKGLAAEWASAGIRVNALSPGYVNTDQTAHMDKKIRDHQASNIPLNRFAQPEEMTGQAILLLSDHATYMTGGEYFIDGGQLIW

SEQ ID NO: 9217 - protein, 128 aa, Dubautia laxa
QRNHRHYMGEEIESLSLKEIQNLEQQLDTGLKHIRTRKNQLLHESISELQKKGKAIQEHNTTLTKRIKEKEKDKTIPQSSHWEQYVDHDTTFLMPPPHPPLIIGGDYNQVGGGGGDGRSNELDLSLQP

SEQ ID NO: 9218 - protein, 576 aa, Homo sapiens
MRHQGKIPEELSLDDRARTQKKWGRGKWEPEPSSKPPREATLEERHARGEKHLGVEIEKTSGEIIRCEKCKRERELQQSLERERLSLGTSELDMGKGPMYDVEKLVRTRSCRRSPEANPASGEEGWKGDSHRSSPRNPTQELRRPSKSMDKKEDRGPEDQESHAQGAAKAKKDLVEVLPVTEEGLREVKKDTRPMSRSKHGGWLLREHQAGFEKLRRTRGEEKEAEKEKKPCMSGGRRMTLRDDQPAKLEKEPKTRPEENKPERPSGRKPRPMGIIAANVEKHYETGRVIGDGNFAVVKECRHRETRQAYAMKIIDKSRLKGKEDMVDSEILIIQSLSHPNIVKLHEVYETDMEIYLILEYVQGGDLFDAIIESVKFPEPDAALMIMDLCKALVHMHDKSIVHRDLKPENLLVQRNEDKSTTLKLADFGLAKHVVRPIFTVCGTPTYVAPEILSEKGYGLEVDMWAAGVILYILLCGFPPFRSPERDQDELFNIIQLGHFEFLPPYWDNISDAAKDLVSRLLVVDPKKRYTAHQVLQHPWIETAGKTNTVKRQKQVSPSSEGHFRSQHKRVVEQVS

SEQ ID NO: 9219 - protein, 159 aa, Homo sapiens [sequence omitted]

SEQ ID NO: 9220 - protein, 933 aa, Escherichia coli
MFRALALVLWLLIAFSSVFYIVNALHQRESEIRQEFNLSSDQAQRFIQRTSDVMKELKYIAENRLSAENGVLSPRGRETQADVPAFEPLFADSDCSAMSNTWRGSLESLAWFIGYWRDNFSAAYDLNRVFLIGSDNLCMANFGLRDMPVERDTALKALHERINKYRNAPQDDSGSNLYWISEGPRPGVGYFYALTPVYLANRLQALLGVEQTIRMENFFLPGTLPMGVTILDENGHTLISLTGPESKIKGDPRWMQERSWFGYTEGFRELVLKKNLPPSSLSIVYSVPVDKVLERIRMLILNAILLNVLAGAALFTLARMYERRIFIPAESDALRLEEHEQFNRKIVASAPVGICILRTADGVNILSNELAHTYLNMLTHEDRQRLTQIICGQQVNFVDVLTSNNTNLQISFVHSRYRNENVAICVLVDVSSRVKMEESLQEMAQAAEQASQSKSMFLATVSHELRTPLYGIIGNLDLLQTKELPKGVDRLVTAMNNSSSLLLKIISDILDFSKIESEQLKIEPREFSPREVMNHITANYLPLVVRKQLGLYCFIEPDVPVALNGDPMRLQQVISNLLSNAIKFTDTGCIVLHVRADGDYLSIRVRDTGVGIPAKEVVRLFDPFFQVGTGVQRNFQGTGLGLAICEKLISMMDGDISVDSEPGMGSQFTVRIPLYGAQYPQKKGVEGLSGKRCWLAVRNASLCQFLETSLQRSGIVVTTYEGQEPTPEDVLITDEVVSKKWQGRAVVTFCRRHIGIPLEKAPGEWVHSVAAPHELPALLARIYLIEMESDDPANALPSTDKAVSDNDDMMILVVDDHPINRRLLADQLGSLGYQCKTANDGVDALNVLSKNHIDIVLSDVNMPNMDGYRLTQRIRQLGLTLPVIGVTANALAEEKQRCLESGMDSCLSKPVTLDVIKQSLTLYAERVRKSRDS

SEQ ID NO: 9221 - protein, 933 aa, Escherichia coli
MFRALALVLWLLIAFSSVFYIVNALHQRESEIRQEFNLSSDQAQRFIQRTSDVMKELKYIAENRLSAENGVLSPRGRETQADVPAFEPLFADSDCSAMSNTWRGSLESLAWFIGYWRDNFSAAYDLNRVFLIGSDNLCMANFGLRDMPVERDTALKALHERINKYRNAPQDDSGSNLYWISEGPRPGVGYFYALTPVYLANRLQALLGVEQTIRMENFFLPGTLPMGVTILDENGHTLISLTGPESKIKGDPRWMQERSWFGYTEGFRELVLKKNLPPSSLSIVYSVPVDKVLERIRMVILNAILLNVLAGAALFTLARMYERRIFIPAESDALRLEEHEQFNRKIVASAPVGICILRTADGVNILSNELAHTYLNMLTHEDRQRLTQIICGQQVNFVDVLTSNNTNLQISFVHSRYRNENVAICVLVDVSSRVKMEESLQEMAQAAEQASQSKSMFLATVSHELRTPLYGIIGNLDLLQTKELPKGVDRLVTAMNNSSSLLLKIISDILDFSKIESEQLKIEPREFSPREVMNHITANYLPLVVRKQLGLYCFIEPDVPVALNGDPMRLQQVISNLLSNAIKFTDTGCIVLHVRADGDYLSIRVRDTGVGIPAKEVVRLFDPFFQVGTGVQRNFQGTGLGLAICEKLISMMDGDISVDSEPGMGSQFTVRIPLYGAQYPQKKGVEGLSGKRCWLAVRNASLCQFLETSLQRSGIVVTTYEGQEPTPEDVLITDEVVSKKWQGRAVVTFCRRHIGIPLEEAPGEWVHSVAAPHELPALLARIYLIEMESDDPANALPSTDKAVSDNDDMMILVVDDHPINRRLLADQLGSLGYQCKTANDGVDALNVLSKNHIDIVLSDVNMPNMDGYRLTQRTRQLGLTLPVIGVTANALAEEKQRCLESGMDSCLSKPVTLDVIKQTLTVYAERVRKSRES

SEQ ID NO: 9222 - protein, 926 aa, Homo sapiens
MVMADGPRHLQRGPVRVGFYDIEGTLGKGNFAVVKLGRHRITKTEVAIKIIDKSQLDAVNLEKIYREVQIMKMLDHPHIIKLYQVMETKSMLYLVTEYAKNGEIFDYLANHGRLNESEARRKFWQILSAVDYCHGRKIVHRDLKAENLLLDNNMNIKIADFGFGNFFKSGELLATWCGSPPYAAPEVFEGQQYEGPQLDIWSMGVVLYVLVCGALPFDGPTLPILRQRVLEGRFRIPYFMSEDCEHLIRRMLVLDPSKRLTIAQIKEHKWMLIEVPVQRPVLYPQEQENEPSIGEFNEQVLRLMHSLGIDQQKTIESLQNKSYNHFAAIYFLLVERLKSHRSSFPVEQRLDGRQRRPSTIAEQTVAKAQTVGLPVTMHSPNMRLLRSALLPQASNVEAFSFPASGCQAEAAFMEEECVDTPKVNGCLLDPVPPVLVRKGCQSLPSNMMETSIDEGLETEGEAEEDPAHAFEAFQSTRSGQRRHTLSEVTNQLVVMPGAGKIFSMNDSPSLDSVDSEYDMGSVQRDLNFLEDNPSLKDIMLANQPSPRMTSPFISLRPTNPAMQALSSQKREVHNRSPVSFREGRRASDTSLTQGIVAFRQHLQNLARTKGILELNKVQLLYEQIGPEADPNLAPAAPQLQDLASSCPQEEVSQQQESVSTLPASVHPQLSPRQSLETQYLQHRLQKPSLLSKAQNTCQLYCKEPPRSLEQQLQEHRLQQKRLFLQKQSQLQAYFNQMQIAESSYPQPSQQLPLPRQETPPPSQQAPPFSLTQPLSPVLEPSSEQMQYSPFLSQYQEMQLQPLPSTSGPRAAPPLPTQLQQQQPPPPPPPPPPRQPGAAPAPLQFSYQTCELPSAASPAPDYPTPCQYPVDGAQQSDLTGPDCPRSPGLQEAPSSYDPLALSELPGLFDCEMLDAVDPQHNGYVLVN

SEQ ID NO: 9223 - protein, 613 aa, Escherichia coli
MEQNPQSQLKLLVTRGKEQGYLTYAEVNDHLPEDIVDSDQIEDIIQMINDMGIQVMEEAPDADDLMLAENTADEDAAEAAAQVLSSVESEIGRTTDPVRMYMREMGTVELLTREGEIDIAKRIEDGINQVQCSVAEYPEAITYLLEQYNRVEAEEARLSDLITGFVDPNAEEDLAPTATHVGSELSQEDLDDDEDEDEEDGDDDSADDDNSIDPELAREKFAELRAQYVVTRDTIKAKGRSHATAQEEILKLSEVFKQFRLVPKQFDYLVNSMRVMMDRVRTQERLIMKLCVEQCKMPKKNFITLFTGNETSDTWFNAAIAMNKPWSEKLHDVSEEVHRALQKLQQIEEETGLTIEQVKDINRRMSIGEAKARRAKKEMVEANLRLVISIAKKYTNRGLQFLDLIQEGNIGLMKAVDKFEYRRGYKFSTYATWWIRQAITRSIADQARTIRIPVHMIETINKLNRISRQMLQEMGREPTPEELAERMLMPEDKIRKVLKIAKEPISMETPIGDDEDSHLGDFIEDTTLELPLDSATTESLRAATHDVLAGLTAREAKVLRMRFGIDMNTDYTLEEVGKQFDVTRERIRQIEAKALRKLRHPSRSEVLRSFLDD

SEQ ID NO: 9224 - protein, 795 aa, Homo sapiens
MDTKLNMLNEKVDQLLHFQEDVTEKLQSMCRDMGHLERGLHRLEASRAPGPGGADGVPHIDTQAGWPEVLELVRAMQQDAAQHGARLEALFRMVAAVDRAIALVGATFQKSKVADFLMQGRVPWRRGSPGDSPEENKERVEEEGGKPKHVLSTSGVQSDAREPGEESQKADVLEGTAERLPPIRASGLGADPAQAVVSPGQGDGVPGPAQAFPGHLPLPTKVEAKAPETPSENLRTGLELAPAPGRVNVVSPSLEVAPGAGQGASSSRPDPEPLEEGTRLTPGPGPQCPGPPGLPAQARATHSGGETPPRISIHIQEMDTPGEMLMTGRGSLGPTLTTEAPAAAQPGKQGPPGTGRCLQAPGTEPGEQTPEGARELSPLQESSSPGGVKAEEEQRAGAEPGTRPSLARSDDNDHEVGALGLQQGKSPGAGNPEPEQDCAARAPVRAEAVRRMPPGAEAGSVVLDDSPAPPAPFEHRVVSVKETSISAGYEVCQHEVLGGGRFGQVHRCTEKSTGLPLAAKIIKVKSAKDREDVKNEINIMNQLSHVNLIQLYDAFESKHSCTLVMEYVDGGELFDRITDEKYHLTELDVVLFTRQICEGVHYLHQHYILHLDLKPENILCVNQTGHQIKIIDFGLARRYKPREKLKVNFGTPEFLAPEVVNYEFVSFPTDMWSVGVITYMLLSGLSPFLGETDAETMNFIVNCSWDFDADTFEGLSEEAKDFVSRLLVKEKSCRMSATQCLKHEWLNNLPAKASRSKTRLKSQLLLQKYIAQRKWKKHFYVVTAANRLRKFPTSP

SEQ ID NO: 9225 - protein, 359 aa, Canis familiaris
MTLESIMACCLSEEAKEARRINDEIERQLRRDKRDARRELKLLLLGTGESGKSTFIKQMRIIHGSGYSDEDKRGFTKLVYQNIFTAMQAMIRAMDTLKIPYKYEHNKAHAQLVREVDVEKVSAFENPYVDAIKSLWNDPGIQECYDRRREYQLSDSTKYYLNDLDRVADPAYLPTQQDVLRVRVPTTGIIEYPFDLQSVIFRMVDVGGQRSERRKWIHCFENVTSIMFLVALSEYDQVLVESDNENRMEESKALFRTIITYPWFQNSSVILFLNKKDLLEEKIMYSHLVDYFPEYDGPQRDAQAAREFILKMFVDLNPDSDKIIYSHFTCATDTENIRFVFAAVKDTILQLNLKEYNLV

SEQ ID NO: 9226 - protein, 500 aa, Taenia solium
MVNFHYVFATVVIVFGSSFQFGFQTGVINSPLPLIEKYILSICEDRGSSPSPEFVQAMSSLVVAGFPIGGIFGALFGGSVSNKMGRKLSLFIFNIPMAVGSLLMMACQAAVSFEMIIVGRVLVGFACGAFTGIAPVYLAEIAPVRIRGMSGIMHQLAIVCAILISQILGLKELMGSAKLWPYLLGLTIIPSVVLLFLFWICPDSPRYILLNSQDLESAKSALFWLRGDTEVVEEEIGELLAEQENESENHTKFPLKDLFRVKALRLALFVAVVAHLAQQFSGINAALFYSTSLFESIGLTSQAVYATLGVGSMIVVITVASIFLIERVGRRILLIGGLSVMLFSAVIITIGLALRSHASGLVYLAITFVYIFVGGFAIGPGSIPWFVVAEMFVQETRDPAIVITVIVNWLAQIVISLGYPPLLKYLKDYSFMPFIGLLVIFIALLYFFLPETKGRAPCDVQDEFVRMTGGAEDDVTLGSYTRSLPSENGENMTKSDRVKF

SEQ ID NO: 9227 - protein, 243 aa, Betula pendula
MGRGRVQLKRIENKINRQVTFSKRRGGLLKKAHEISVLCDAEVAVIVFSHKGKLFEYATDSSMEKILERYERYSYAEAQLVAADSEGQGSWTMEFARLKGKVELLQRNHRHYLGDDLESLSHKELQNLEQQLDTALKHVRTRKNQLMYESISQLQKKEKAIQEQNTILAKKIKEKEKTVAQHVDWEQQNQGAPNGSSSFLLPQPLPCLNIGGNYQEEAPEVRRNELELTLEPIYSCHLGCFAT

SEQ ID NO: 9228 - protein, 260 aa, Betula pendula
MGRGRVQLKRIENKISRQVTFSKRRTGLLKKAHEISVLCDAEVALIVFSTKGKLFEFSSDSSMDRILERYERYSYADRHLMATESESQGSWSLEFPKLSARIEVLERNIRNLLGEDLDPLSLRELQNMEQQLDTGLKRLRTRKNQVMHESIMELQKKEKALQEQNNLLSKKIKENEKAVAEHAHLEQPSIGQNLSTFMLSLPQQPQPQPQLQPQPPTLPLPSLTIGGTFQAGAGDEDAGAQTRPSANRLMPPWMLSHING

SEQ ID NO: 9229 - protein, 244 aa, Betula pendula
MGRGRVQLKRIENKINRQVTFSKRRSGLLKKAHEISVLCDAEVALIVFSTKGKLFEYSTDSCMERILERYERYSYADRQLLANDLEQNGSWTLEHAKLKARIEVLQRNQKHFVGEDLDSLSLKELQNLEQQLDSALKHIRSRKNQLMYESISELQRKDKALQEQNNVLAKKVKEKEKELAQQAQWEQQSHTLDSVPSLLPQPLQSSLNIGGSQQARGNGRVDEGTPPHRANALLPPWMLRHLNQ

SEQ ID NO: 9230 - protein, 249 aa, Clostridium scindens
MKLVQDKITIITGGTRGIGFAAAKLFIENGAKVSIFGETQEEVDTALAQLKELYPEEEVLGFAPDLTSRDAVMAAVGTVAQKYGRLDVMINNAGITMNSVFSRVSEEDFKNIMDINVNGVFNGAWSAYQCMKDAKQGVIINTASVTGIYGSLSGIGYPYQQGGVIGLTHGLGREIIRKNIRVVGVAPGVVDTDMTKGLPPEILEDYLKTLPMKRMLKPEEIANVYLFLASDLASGITATTISVDGAYRP

SEQ ID NO: 9231 - protein, 531 aa, Lycopersicon esculentum
MGDIEGSPGSSMHGVTGREPVLAFSVASLIVPTDTSANFKVPVDSEHKAKVFKFYSFSKPHGLTFQLSWISFCTCFVSTFAAAPLVPIIRDNLNLTKMDVGNAGVASVSGSILSRLAMGAICDMLGPRYGCAFLIMLSAPTVLCMSFVSSAGGYVAVRFMIGFSLATFVSCQYWMSTMFNSQIIGLVNGTAAGWGNMGGGATQLIMPLLYDIIRRAGATPFTAWRIAFFIPGWLHVIMGILVLTLGQDLPDGNLASLQKKGDVSKDKFSKILWYAATNYRTWILVLLYGYSMGVELTTDNVIAEYFFDRFDLKLHTAGIIAATFGMANLLARPFGGWSSDVAAKHFGMRGRLWNSWILQTLGGVFCLLLGRATTLPLAITWMIIFSIGAQAACGVTFGIIPFISRRSLGIISGMTGAGGNFGSGLTQLLFFTSTKYSTGTGLTYMGMMIIACTLPVMLVRFPQWGSMFLPPSKDPIKGTEEHYFGSEYTEDEKQKGMHQNSIKFAENSRTERGKKRVGSAPTPPNVTPNRV

SEQ ID NO: 9232 - protein, 497 aa, Danio rerio
MEYHSVGPGGVVVTGNNVPAFLTKLWTLVEDPDTDPLICWSPNGTSFHVFDQGRFSKEVLPKYFKHNNMASFVRQLNMYGFRKVVHIEQGGLVKPEKDDTEFQHPYFIRGQEQLLENIKRKVTTVSNIKHEDYKFSTDDVSKMISDVQHMKGKQESMDSKISTLKHENEMLWREVATLRQKHSQQQKVVNKLIQFLITLARSNRVLGVKRKMPLMLNDSSSAHSMPKFSRQYSLESPAPSSTAFTGTGVFSSESPVKTGPIISDITELAQSSPVATDEWIEDRTSPLVHIKEEPSSPAHSPEVEEVCPVEVEVGAGSDLPVDTPLSPTTFINSILQESEPVFRPDSAPSEQKCLSVACLDKTELHDHLESIDSGLENLQQILNAQSINFDSSPLFDIFSSAASDVDLDSLASIQDLLSPDPVKETESGVDTDSGKQLVQYTSQPSFSPIPFSTDSSSTDLPMLLELQDDSYFSSEPTEDPTIALLNFQPVPEDPKLS

SEQ ID NO: 9233 - protein, 416 aa, Homo sapiens
MAEEQGRERDSVPKPSVLFLHPDLGVGGAERLVLDAALALQARGCSVKIWTAHYDPGHCFAESRELPVRCAGDWLPRGLGWGGRGAAVCAYVRMVFLALYVLFLADEEFDVVVCDQVSACIPVFRLARRRKKILFYCHFPDLLLTKRDSFLKRLYRAPIDWIEEYTTGMADCILVNSQFTAAVFKETFKSLSHIDPDVLYPSLNVTSFDSVVPEKLDDLVPKGKKFLLLSINRYERKKNLTLALEALVQLRGRLTSQDWERVHLIVAGGYDERVLENVEHYQELKKMVQQSDLGQYVTFLRSFSDKQKISLLHSCTCVLYTPSNEHFGIVPLEAMYMQCPVIAVNSGGPLESIDHSVTGFLCEPDPVHFSEAIEKFIREPSLKATMGLAGRARVKEKFSPEAFTEQLYRYVTKLLV

SEQ ID NO: 9234 - protein, 498 aa, Gluconobacter oxydans
MNVVSKTVSLPLKPREFGFFIDGEWRAGKDFFDRSSPAHDVPVTRIPRCTREDLDEAVAAARRAFENGSWAGLAAADRAAVLLKAAGLLRERRDDIAYWEVLENGKPISQAKGEIDHCIACFEMAAGAARMLHGDTFNNLGEGLFGMVLREPIGVVGLITPWNFPFMILCERAPFILASGCTLVVKPAEVTSATTLLLAEILADAGLPKGVFNVVTGTGRTVGQAMTEHQDIDMLSFTGSTGVGKSCIHAAADSNLKKLGLELGGKNPIVVFADSNLEDAADAVAFGISFNTGQCCVSSSRLIVERSVAEKFERLVVPKMEKIRVGDPFDPETQIGAITTEAQNKTILDYIAKGKAEGAKLLCGGGIVDFGKGQYIQPTLFTDVKPSMGIARDEIFGPVLASFHFDTVDEAIAIANDTVYGLAASVWSKDIDKALAVTRRVRAGRFWVNTIMSGGPETPLGGFKQSGWGREAGLYGVEEYTQIKSVHIETGKRSHWIS

SEQ ID NO: 9235 - protein, 367 aa, Homo sapiens [sequence omitted]

SEQ ID NO: 9236 - protein, 568 aa, Rhizobium sp.
MIRLRYPPIPRGRARGAKRRMDDRQVQPGRVIVVTGAAGGIGRALVDIFAANGDVVVAVDLPDSGVIELGQNLGEPHLGLEVDVSREDDVVALRALLEKRFSRIEVLVNNAGIGPTMAATADTALEDFQRALAINLVGAYSVACETAKLMKPGAAIVNVASLAGLLGNPKRSAYAASKAGLISITKSLACRWASRGIRVTAVAPGHVRTPMVAELERAGKLDVSAIRRRVPLGRIARPDEIARAVRFLASAQASYITGSTLVVDGGWMSVNQPGGAHQAQDRTPGAEFMRPVEDTDARTVIVMGGATGVGAAIARRFAENGDTVVIADGDGEEAVKLAGLLGDKHLSRRVDRTVETEVVSLFEELRERFGHLDVFVNGMNEILVPNTEESPEVLKRILDVNLTGAFTCVREAAISMRSGSVILNLGASLSLSPLAPSHAYGAYNAGIDMLTRCTAAELGPLGIRTATVAPGYIRTCAANRLAAVAGMDSASLRQRIPLGRVGDAEEVAEAAYFLASFDASYINGSILHVDGGLISSREAGWGSEVDGAISAEMRPQRRPAARWRLLSP

SEQ ID NO: 9237 - protein, 917 aa, Pseudomonas chlororaphis
MLKKLGIKGRVLLLTLLPTSLMALVLGGYFTWMQQSDLQTQLLQRGEMIAEQLAPLVAPALAHKNIALLERIATQSLEQQDVRAVTFLAPDRTPLAHAGPSMLNQAPTGNGSQMLQRTGSDATRYLLPVFGRHRNLAGDLIPDESDRLLGWVELELSHNSMLLRGYRSLFASLLLIIAGLICTGLLALRMGRTINNPLSQIKHAVTQLKDGNLETRLPLLGSQELDELASGINRMAGTLQNAQEELQHSIDQATEDVRQNLETIEIQNIELDLARKEALEASRIKSEFLANMSHEIRTPLNGILGFTHLLQKSELTPRQLDYLGTIEKSADSLLGIINEILDFSKIEAGKLVLDSIPFNLRDLLQDTLTILAPAAHAKQLELVSLVYRDTPLSLVGDPLRLKQILTNLVSNAIKFTREGTIVARAMLEEEHEDSVQLRISIQDTGIGLSNQDVRALFQAFSQADNSLSRQPGGTGLGLVISKRLIEQMGGEIGVDSTPGEGSEFWISLRLPKTRDDAEDLPAPPLLGRRIAVLENHELARQALQHQLEDCGLEVTPFNTLEALTNGVTGVHQTEQAIDLAVLGITSNDMPPERLNQHIWDLEHLGCKVLVLCPTTEQTLFHLSVPNPHSQLQAKPACTRKLRRALADLVNPKVVRNEPSEPIASRPPRVLCVDDNPANLLLVQTLLEDMGAKVLAVDSGYAAVKAVQNESFDLVMMDVQMPGMDGRQSTEAIRQWESERNCTPLPVIALTAHAMANEKRALLQSGMDDYLTKPISERQLAQVVLKWTGLALRNQGPERTGEPSGNGLELQVLDHDEGLRLAAGKADLAADMLAMLLASLEADREAIRAARAANDHNALIERVHRLHGATRYCGVPQLRAACQRSETLLKQEDVKAFAALDELERAINRLATEARINA

SEQ ID NO: 9238 - protein, 134 aa, Sorghum bicolor
MAAKMFALFALLALCASATSATHIPGHLPLVMPLGTMNPCTQYCMMQQRFARLLAWPIPMLQQLSLQPAYQTPMTMPNMMPPMTMMPSMMSLPQCHCDAISQIMQQQQLPFMFNPTAMAIPPMFLQQPFVSSAF

SEQ ID NO: 9239 - protein, 553 aa, Homo sapiens
MVQRLWVSRLLRHRKAQLLLVNLLTFGLEVCLAAGITYVPPLLLEVGVEEKFMTMVLGIGPVLGLVCVPLLGSASDHWRGRYGRRRPFIWALSLGILLSLFLIPRAGWLAGLLCPDPRPLELALLILGVGLLDFCGQVCFTPLEALLSDLFRDPDHCRQAYSVYAFMISLGGCLGYLLPAIDWDTSALAPYLGTQEECLFGLLTLIFLTCVAATLLVAEEAALGPTEPAEGLSAPSLSPHCCPCRARLAFRNLGALLPRLHQLCCRMPRTLRRLFVAELCSWMALMTFTLFYTDFVGEGLYQGVPRAEPGTEARRHYDEGVRMGSLGLFLQCAISLVFSLVMDRLVQRFGTRAVYLASVAAFPVAAGATCLSHSVAVVTASAALTGFTFSALQILPYTLASLYHREKQVFLPKYRGDTGGASSEDSLMTSFLPGPKPGAPFPNGHVGAGGSGLLPPPPALCGASACDVSVRVVVGEPTEARVVPGRGICLDLAILDSAFLLSQVAPSLFMGSIVQLSQSVTAYMVSAAGLGLVAIYFATQVVFDKSDLAKYSA

SEQ ID NO: 9240 - protein, 385 aa, Homo sapiens
MGCGASRKVVPGPPALAWAKHEGQNQAGVGGAGPGPEAAAQAAQRIQVARFRAKFDPRVLARYDIKALIGTGSFSRVVRVEQKTTKKPFAIKVMETREREGREACVSELSVLRRVSHRYIVQLMEIFETEDQVYMVMELATGGELFDRLIAQGSFTERDAVRILQMVADGIRYLHALQITHRNLKPENLLYYHPGEESKILITDFGLAYSGKKSGDWTMKTLCGTPEYIAPEVLLRKPYTSAVDMWALGVITYALLSGFLPFDDESQTRLYRKILKGKYNYTGEPWPSISHLAKDFIDKLLILEAGHRMSAGQALDHPWVITMAAGSSMKNLQRAISRNLMQRASPHSQSPGSAQSSKSHYSHKSRHMWSKRNLRIVESPLSALL

SEQ ID NO: 9241 - protein, 334 aa, Eustoma grandiflorum
MEVQRVQEIASLSKVIDTIPAEYIRSENEQPVISTVHGVVLEVPVIDLSDSDEKKIVGLVSEASKEWGIFQVVNHGIPNEVIRKLQEVGKHFFELPQEEKELIAKPEGSQSIEGYGTRLQKEVDGKKGWVDHLFHKIWPPSAINYQFWPKNPPAYREANEEYAKRLQLVVDNLFKYLSLGLDLEPNSFKDGAGGDDLVYLMKINYYPPCPRPDLALGVAHTDMSAITVLVPNEVPGLQVYKDGHWYDCKYIPNALIVHIGDQVEIMSNGKYKSVYHRTTVNKEKTRMSWPVFLEPPPDHEVGPIPKLVNEENPAKFKTKKYKDYAYCKLNKLPQ

SEQ ID NO: 9242 - protein, 335 aa, Citrus unshiu
MEVERVQAIASLSHSNGTIPAEFIRPEKEQPASTTYHGPAPEIPTIDLDDPVQDRLVRSIAEASREWGIFQVTNHGIPSDLICKLQAVGKEFFELPQEEKEVYSRPADAKDVQGYGTKLQKEVEGKKSWVDHLFHRVWPPSSINYRFWPKNPPSYRAVNEEYAKYMREVVDKLFTYLSLGLGVEGGVLKEAAGGDDIEYMLKINYYPPCPRPDLALGVVAHTDLSALTVLVPNEVPGLQVFKDDRWIDAKYIPNALVIHIGDQIEILSNGKYKAVLHRTTVNKDKTRMSWPVFLEPPADTVVGPLPQLVDDENPPKYKAKKFKDYSYCKLNKLPQ

SEQ ID NO: 9243 - protein, 263 aa, Escherichia coli
MGKLTGKTALITGALQGIGEGIARTFARHGANLILLDISPEIEKLADELCGRGHRCTAVVADVRDPASVAAAIKRAKEKEGRIDILVNNAGVCRLGSFLDMSDDDRDFHIDINIKGVWNVTKAVLPEMIARKDGRIVMMSSVTGDMVADPGETAYALTKAAIVGLTKSLAVEYAQSGIRVNAICPGYVRTPMAESIARQSNPEDPESVLTEMAKAIPMRRLADPLEVGELAAFLASDESSYLTGTQNVIDGGSTLPETVSVGI

SEQ ID NO: 9244 - protein, 1167 aa, Neurospora crassa
MNNNYYGSPLSPEELQHQMHQHQQQQQQQQQQQQQQQQQQQQQQQQQQQQHQHQQQQKTNQHRNAGMMNTPPTTNQGNSTIHASDVTMSGGSDSLDEIIQQNLDEMHRRRSVPQPYGGQTRRLSMFDYANPNDGFSDYQLDNMSGNYGDMTGGMGMSGHSSPYAGQNIMAMSDHSGGYSHMSPNVMGNMMTYPNLNMYHSPPIENPYSSAGLDTIRTDFSMDMNMDSGSVSAASVHPTPGLNKQDDEMMTMEQGFGGGDDANASHQAQQNMGGLTPAMTPAMTPAMTPGVSNFAQGMATPVSQDAASTPATTFQSPSLSATTQTIRIGPPPPPSVTNAPTPAPFTSTPSGGGASQTKSIYSKSGFDMLRALWYVASRKDPKLKLGAVDMSCAFVVCDVTLNDCPIIYVSDNFQNLTGYSRHEIVGRNCRFLQAPDGNVEAGTKREFVENNAVYTLKKTIAEGQEIQQSLINYRKGGKPFLNLLTMIPIPWDTEEIRYFIGFQIDLVECPDAIIGQEGNGPMQVNYTHSDIGQYIWTPPTQKQLEPADGQTLGVDDVSTLLQQCNSKGVASDWHKQSWDKMLLENADDVVHVLSLKGLFLYLSPACKKVLEYDASDLVGTSLSSICHPSDIVPVTRELKEAQQHTPVNIVFRIRRKNSGYTWFESHGTLFNEQGKGRKCIILVGRKRPVFALHRKDLELNGGIGDSEIWTKVSTSGMFLFVSSNVRSLLDLLPENLQGTSMQDLMRKESRAEFGRTIEKARKGKIASCKHEVQNKRGQVLQAYTTFYPGDGGEGQRPTFLLAQTKLLKASSRTLAPATVTVKNMSPGGVPLSPMKGIQTDSDSNTLMGGMSKSGSSDSTGAMVSARSSAGPGQDAALDADNIFDELKTTRCTSWQYELRQMEKVNRMLAEELAQLLSNKKKRKRRKGGGNMVRDCANCHTRNTPEWRRGPSGNRDLCNSCGLRWAKQTGRVSPRTSSRGGNGDSMSKKSNSPSHSSPLHREVGNDSPSTTTATKNSPSLRGSSTTAPGTITTDSGPAVASSASGTGSTTIATSANSAASTVNALGPPATGPSGGSPAQHLPPHLQGTHLNAQAMQRVHQHKQHQQHQQQHQQQHQQQHQQQHQQLQQHQFNPPQSQPLLEGGSGFRGSGMEMTSIREEMGEHQQGLSV

SEQ ID NO: 9245 - protein, 152 aa, Homo sapiens
PGAREQGGRGGGRTDFGSGLNTHTRNILKTIALGQMLSLCICGTAITSQYLAERYKVNTPMLQSFINYCLLFLIYTVMLAFRSGSDNLLVILKRKWWKYILLGLADVEANYVIVRAYQYTALTSVQLLDCFGIPVLMALSWFILHARYRVIH

SEQ ID NO: 9246 - protein, 318 aa, Homo sapiens [sequence omitted]

SEQ ID NO: 9247 - protein, 129 aa, Gallus gallus
MSGRGKQGGKVRAKAKSRSSRAGLQFPVGRVHRLLRKGNYAERVGAGAPVYMAAVLEYLTAEILELAGNAARDNKKTRIIPRHLQLAIRNDEELNKLLGKVTIAQGGVLPNIQAVLLPKKTESHKAKSK

SEQ ID NO: 9248 - protein, 332 aa, Erwinia chrysanthemi
MSQNTLKVNELHEDAEFDENGIDVFDDKALAEEETSDSDQLDEELLSQGTAQRVLDATQLYLGEIGYSPLLTAEEEVYFARRALRGDVSSRRRMIESNLRLVVKIARRYNNRGLALLDLIEEGNLGLIRAVEKFDPERGFRFSTYATWWIRQTIERAIMNQTRTIRLPIHIVKELNVYLRTARELSHKLDHEPSAEEIAERLDKPVDDVNRMLRLNERITSVDTPLGGDSEKALLDILADEKDNGPEDTTQDNDMKQNIVKWLFELNAKQREVLARRFGLLGYEAATLEDVGREIGLTRERVRQIQVQVEGLRRLREILQVQGLDIEELFRE

SEQ ID NO: 9249 - protein, 762 aa, Chlamydomonas reinhardtii
MAAPDALIAAFIPASAVVAILFAVFLWKRVAAIQMTGGRVLSSQNGREYLLEEEQRGGEEEIVAKAADIQKSISEGASSFLATEYYYLGIFMVIMSVVICSLLSIVTPEEGRTSADELRNGVFSTIAFALGGATSILSGYLGMQIATFANARTAVEARKGIAPAFMCAFRSGAVMGFLLSGFGLLNLFLAITIFSKFFGDDWKGLFEAIGYGLGGSSIALFGRVGGGIYTKAADVGADLVGKVEKDIPEDDPRNPAVIADNVGDNVGDIAGMGADLFGSFAESTCAALVISAVSSLGKEHDYAGMMFPLLISATGIFVCLITTFLATDLKPAKVIAEIEHTLKMQLIISTLLMTPVALGVALWSLPPEFTLSVPSSSPDKPFDEKVVKSWYMFVCISTGLWGGLLVGLQTEYFTSNRYKPVQDVADACRTGAATDIIFGLALGYKSCIIPTIVIGVAIYVGTSLAGMFGIACCALGMLSTLATGLAIDAYGPISDNAGGIAEMAGMGEDIRERTDALDAAGNTTAAIGKGFAIGSAALVSLALFGAYVTRAKIDMIHSSILDPRVFAGLLLGAMLPYWFSAMTMKSVGKAALAMVHEVRRQFNTIAGLMEGTARPDYKRCVAISTQAAISEMIAPGALVIFTPVVVGALFGTQCLAGVLAGSLVSGVQLAVSMSNTGGAWDNAKKYIEAGATEHARELGGKGSDCHKAAVIGDTVGDPLKDTNGPSLNILIKLMAVESLVFAPFFYNCAHGQGLIFSFFGIA

SEQ ID NO: 9250 - protein, 514 aa, Cucumis sativus
MGHPLDHSDAHHRPPSNGVIKVLPPDSDPSLPPPLPKQLPTSSAPPALGRVLARPFSDVRSFYSFRGELGRGQFGVTYLVTHKETKQDFACKSIATRKLIDQDDVEDVRREVQIMHHLTGHPHIVELKEVYEDRHYVNLIMELCAGGELFDRIIAKGHYSECTAASLCRQIVTVVHNCHSMGVMHRDLKPENFLFLSADENSPLKATDFGLSVFFKPGDVFKDLVGSAYYVAPEVLRRRYGPEAAVWSAGVILYILLSGVPPFWAENDQGIFDAVLRGHIDFSSDPWPSISSGAKDLIRKLLHSDPKERLSAIEALNHPWMKEDGEASDKPLDIAVLTRMKQFRAMNKLKKVALKVIAENLSEEEIVGLKEMFKSMDTDNSGTITFEELKAGLPKLGTKLSESEVRQLMEAADVDGNGSIDYIEFITAAMHMNRVEREDHLFKAFEYFDKDKSGYITMEELETALKKYNMGDETTIKEIIAEVDTDNDGRINYDEVVAMMRKGNQELTTTSRQK

SEQ ID NO: 9251 - protein, 256 aa, Arabis gemmifera
MEDYERNSNSPTHEEDSDVRKGPWTEDEDAILVNFVSIHGDARWNHIARSSGLKRTGKSCRLRWLNYLRPDVRRGNITLEEQFMILKLHSLWGNRWSKIAQYLPGRTDNEIKNYWRTRVQKQAKHLRCDVNSNLFKETMRNVWMPRLVERINAQSSPATCEPVESMITDPGQPIEEPIPVEPGFLQFNQQFVPASELSATSSNSPAETLSDVQGGVVNGSGSDPAGQTGFGEFNDWGCVGGDNIWTDEESFWFLQD

SEQ ID NO: 9252 - protein, 223 aa, Crucihimalaya himalaica
GDARWNHIARSSGLRRTGKSCRLRWLNYLRPDVRRGNITLQEQFMILKLHSLWGNRWSKIAQYLPGRTDNEIKNYWRTRVQKQAKHLRCDVNSNLFKETMRNVWMPRLVERINAQSSSATCEPLESMVTDPGQPIDEPSPVEPGFAQFNTNHYHQQQLVPATEISATSSNSPAETLSDVQNGVVNGSGYDLVGQTGFGEFNDWGCVGGDNMWTNDESLWFLQD

SEQ ID NO: 9253 - protein, 379 aa, Arabidopsis thaliana
MATQGQVITCKAAVAYEPNKPLVIEDVQVAPPQAGEVRIKILYTALCHTDAYTWSGKDPEGLFPCILGHEAAGIVESVGEGVTGVQAGDHVIPCYQAECRECKFCKSGKTNLCGKVRSATGVGIMMNDRKSRFSVNGKPIYHFMGTSTFSQYTVVHDVSVAKIDPTAPLDKVCLLGCGVPTGLGAVWNTAKVEPGSNVAIFGLGTVGLAVAEGAKTAGASRIIGIDIDSKKYETAKKFGVNEFVNPKDHDKPIQEVIVDLTDGGVDYSFECIGNVSVMRAALECCHKGWGTSVIVGVAASGQEISTRPFQLVTGRVWKGTAFGGFKSRTQVPWLVEKYMNKEIKVDEYITHNLTLGEINKAFDLLHEGTCLRCVLDTSK

SEQ ID NO: 9254 - protein, 823 aa, Salmonella typhimurium
MNLLNLKNTLQTSLVIRLTFLFLLTTIIIWLLSVLTAAYISMVQKRQHIIEDLSVLSEMNIVLSNQRFEEAERDAKNLMYQCSLATEIHHNDIFPEVSRHLSVGPSNCTPTLNGEKHRLFLQSSDIDENSFRRDSFILNHKNEISLLSTDNPSDYSTLQPLTRKSFPLYPTHAGFYWSEPEYINGKGWHASVAVADQQGVFFEVTVKLPDLITKSHLPLDDSIRVWLDQNNHLLPFSYIPQKIRTQLENVTLHDGWQQIPGFLILRTTLHGPGWSLVTLYPYGNLHNRILKIILQQIPFTLTALVLMTSAFCWLLHRSLAKPLWRFVDVINKTATAPLSTRLPAQRLDELDSIAGAFNQLLDTLQVQYDNLENKVAERTQALNEAKKRAERANKRKSIHLTVISHELRTPMNGVLGAIELLQTTPLNIEQQGLADTARNCTLSLLAIINNLLDFSRIESGHFTLHMEETALLPLLDQAMQTIQGPAQSKKLSLRTFVGQHVPLYFHTDSIRLRQILVNLLGNAVKFTETGGIRLTVKRHEEQLIFLVSDSGKGIEIQQQSQIFTAFYQADTNSQGTGIGLTIASSLAKMMGGNLTLKSVPGVGTCVSLVLPLQEYQPPQPIKGTLSAPFCLHRQLACWGIRGEPPHQQNALLNAELLYFSGKLYDLAQQLILCTPNMPVINNLLPPWQLQILLVDDADINRDIIGKMLVSLGQHVTIAASSNEALTLSQQQRFDLVLIDIRMPEIDGIECVRLWHDEPNNLDPDCMFVALSASVATEDIHRCKKNGIHHYITKPVTLATLARYISIAAEYQLLRNIELQEQDP

SEQ ID NO: 9255 - protein, 504 aa, Dictyostelium discoideum
MEYVYNSNNNPREFCLSVETENKNWIISTGSKAQQLEWIEAIKHAIESAVETDEIKLQKHKSIEKQLQLDGKNKNKIPVLKLLLLGTGESGKSTVVKQMKILHHKGFSKEEEEFYRNLIYINLLDGMALLIHVIKENNIEIPQETLSAIKNYSSWYRVYIEKRNKNGIRNNPIGSMIPISILNNNKDNNNSNSSSLKNNSGGSSSSELDKKMTHLSLDGSTCINSNSASPNGPSSSTTTSTINTHNRSNSDGSSNNIFNVQDFGIPPIITNYISTIWSDPVVQSEVMLQAQKYHINESTQYYLNEIKRIGKPTYQPVNLDILKSRATTNGVVETDFNVNGEVIFRIVDVAGQRGERKKWINFFDDVTAIVFVAAINEYDQKLVEDNCTNRLHESLNLFDSICNDSTFPKTSIILFLNKIDLFREKLKRTSINICFPDYNGDQSYEKSSNYIKNNFLSKKKGGNGINSQNFIYFHFTCATDTKSFETVFNSVRDIIISKTLEFYC

SEQ ID NO: 9256 - protein, 565 aa, Corynebacterium glutamicum
MADVNQDTVLKGTGVVGGVRYASAVWITPRPELPQAGEVVAEENREAEQERFDAAAATVSSRLLERSEAAEGPAAEVLKATAGMVNDRGWRKAVIKGVKGGHPAEYAVVAATTKFISMFEAAGGLIAERTTDLRDIRDRVIAELRGDEEPGLPAVSGQVILFADDLSPADTAALDTDLFVGLVTELGGPTSHTAIIARQLNVPCIVATGAGIKDIKSGEKVLIDGSLGTIDRNADEAEATKLVSESLERAARIAEWKGPAQTKDGYRVQLLANVQDGNSAQQAAQTEAEGIGLFRTELCFLSATEEPSVDEQAAVYSKVLEAFQESKVVVRSLDAGSDKPVPFASMADEMNPALGVRGLRIARGQVDLLTRQLDAIAKASEELGRGDDAPTLGMAPMVATAYEAKWFADMCRERGLIAGAMIEVPAASLMADKIMPHLDFVSIGTNDLTQYTMAADRMSPELAYLTDPWQPAVLRLIKHTCDEGARFNTPVGVCGEAAADPLLATVLTGLGVNSLSAASTALAAVGAKLSEVTLETCKKAAEAALDAEGATEARDAVRAVIDAAV

SEQ ID NO: 9257 - protein, 144 aa, Xylella fastidiosa
LQQFGREATPEELAKEMDMPEDKIRKVMKIAKEPISMETPIGDDEDSHLGDFIEDPNVESPVDTTTNVNLSETVREVLAGLTPREAKVLRMRFGIDMNTDHTLEEVGKQFDVTRERIRQIEAKALRKLRHPSRSEQLRSFLDID

SEQ ID NO: 9258 - protein, 446 aa, Mycobacterium tuberculosis
MNELLHLAPNVWPRNTTRDEVGVVCIAGIPLTQLAQEYGTPLFVIDEDDFRSRCRETAAAFGSGANVHYAAKAFLCSEVARWISEEGLCLDVCTGGELAVALHASFPPERITLHGNNKSVSELTAAVKAGVGHIVVDSMTEIERLDAIAGEAGIVQDVLVRLTVGVEAHTHEFISTAHEDQKFGLSVASGAAMAAVRRVFATDHLRLVGLHSHIGSQIFDVDGFELAAHRVIGLLRDVVGEFGPEKTAQIATVDLGGGLGISYLPSDDPPPIAELAAKLGTIVSDESTAVGLPTPKLVVEPGRAIAGPGTITLYEVGTVKDVDVSATAHRRYVSVDGGMSDNIRTGLYGAQYDVRLVSRVSDAPPVPARLVGKHCESGDIIVRDTWVPTIFGPAIWLRLPPPALLLFAVESLQHGRPSRCGSGARGNARLVLRRETVDDLLSLEVR

SEQ ID NO: 9259 - protein, 576 aa, Oryzias latipes
MTLLSEDQSARPQPCLLSEPDKHISTSLDQYRPDYTKEDYMDSVETSVFGTVEPPRRSRGRLILHSMVMFGREFCYAVEAAFVTPVLLSVGLPRSLYSLVWLISPILGFLLQPIIGSASDYCRSSWGRRRPYILVLGILMLVGLSMFLNGDAVVSELVSDRSSRSTWAIVVVMFGVVLFDFAADFIDGPIKAYLFDVCSYQDKERGLHYHALFTGLGGACGYLVGAMDWGHSVLGRLLGSEYQVIYFFSALTWGVFLIVHLFSIPEKPLAKVPSESSASSALRLLGPHSNGYGALGKEPVSPVIPTSSPEIRPRSYSALGERPRSFSALGEANSVTSSAKQPIKEDQKKMTFRSLMKAIFNMPNHYRFLCISHLLGWAAFLCNMLFFTDFMGQIVYRGNPYAEHNSTAYITYERGVEVGCWGLCINAVSSALYSYVQRFLLPYIGLKGLYFMGYFVFGMGTSLIGLFPEVIATLILCSVFGVMSSTLYTIPFNLIAEYQREEEEQVKLEGGNESPRGTGMDCAALTCMVQLAQIIVGAGLGALVNAAGSVIVVVLSASSISLIGCIFIALFIRYVE

SEQ ID NO: 9260 - protein, 132 aa, Oncorhynchus mykiss
PLDGSSNIDCLVSIGTIFAIYRKTTDDEPNERDALQSGRHIVAAGYALYGSATMMVLSTGQGVNCFMLDPSIGEFILTDKDVKIKKRGKIYSLNEGFAQHFYPDVTEYLKKKKYPEDGSAPYGGRYVGSMVA

SEQ ID NO: 9261 - protein, 555 aa, Aspergillus oryzae
MRGYEFLSVLPLVAASWALPGSTPASVGRRQLPKNPTGVKTLTTANNVTIRYKEPGAEGVCETTPGVKSYSGYVDTSPESHTFFWFFEARHNPETAPITLWLNGGPGSDSLIGLFEELGPCHVNSTFDDYINPHSWNEVSNLLFLSQPLGVGFSYNDTVDGSINPVTGVVENSSFAGVQGRYPTIDATLIDTTNLAAEAAWEILQGFLSGLPSLDSRVQSKDFSLWTESYGGHYGPAFFNHFYEQNERIANGSVNGVQLNFNSLGIINGIIDEAIQAPYYPEFAVNNTYGIKAVNETVYNYMKFANQMPNGCQDLISTCKQTNRTALADYALCAEATNMCRDNVEGPYYAFAGRGVYDIRHPYDDPTPPSYYNKFLAKDSVMDAIGVNINYTQSNNDVYYAFQQTGDFVWPNFIEDLEEILALPVRVSLIYGDADYICNWFGGQAVSLAANYSQAAQFRSAGYTPLKVNGVEYGETREYGNFSFTRVYEAGHEVPYYQPIASLQLFNRTIFGWDIAEGQKKIWPSYKTNGTATATHTQSSVPLPTATSMSSVGMA

SEQ ID NO: 9262 - protein, 586 aa, Clostridium acetobutylicum
MYLEKINSPEDVKKLSIDEMKDLSTEIREVLLKKLSEHGGHIGPNLGIVELTIALHYVFNSPKDKIVYDVSHQSYIHKMLTGRKEAFINSEKYDEVSGYSNPEESEHDFFNIGHTSTSISLACGLAKARDVKDETDNVIAIIGDGSLSGGEAYEGLNNAAETGTNMIIIVNDNDMSIAENHGGLYKNLKELRDTEGKSECNFFKAMGLDYHYVKDGHDLEQLIGVFNKVKDTKQPVVVHIHTVKGKGFKFAEKNKEQWHWGMPFVLETGASKVSMGSAENYGNLTGEYLLDYMKRDPKVVAITSGTPAVFGFWKERRNEAGRQFVDVGIAEEHAVALASGIAANGGNPVYGVYSTFLQRTYDQLSQDLCINNNPAVLLVFAASVYGMNDVTHLGLYDIGMMSNIPNMVYLAPTCKEEYFAMLKWAMIQKDHPVAIRVPAMGVIESGVVDNTDYSKLNKYEVTKAGKDVAVIALGDFYQLGQSVTEKLSQENGINATLINPKYITGIDEELLEGLKKEHKLVITLEDGILDGGFGEKIARYYGASDMKVLNYGIKKELLDRYVPDELMKKNRLTDVQIVEDIMNIIK

SEQ ID NO: 9263 - protein, 373 aa, Oryza sativa (indica cultivar-group)
MPTPSHLKNPLCFDFRAARRVPETHAWPGLDDHPVVDGGGGGGEDAVPVVDVRAGDAAARVARAAEQWGAFLLVGHGVPAALLSRVEERVARVFSLPASEKMRAVRGPGEPCGYGSPPISSFFSKLMWSEGYTFSPSSLRSELRRLWPKSGDDYLLFCDVMEEFHKEMRRLADELLRLFLRALGLTGEEVAGVEAERRIGERMTATVHLNWYPRCPEPRRALGLIAHTDSGFFTFVLQSLVPGLQLFRRGPDRWVAVPAVAGAFVVNVGDLFHILTNGRFHSVYHRAVVNRDRDRVSLGYFLGPPPDAEVAPLPEAVPAGRSPAYRAVTWPEYMAVRKKAFATGGSALKMVSTDAAAAADEHDDVAAAADVHA

SEQ ID NO: 9264 - protein, 1721 aa, Drosophila melanogaster
MNLIEMGDYEFRVFAVNSAGRSEPSLCTMPIKVCEVLGGKKPDWITRLQDKVAPFGKDYTLQCAASGKPSPTARWLRNGKEIQMNGGRMTCDSKDGVFRLHISNVQTGDDGDYTCEAMNSLGFVNTSGYLKIGSPPIINRCPSELKLPEGDNSKIKIFYSGDQPLTVILKKNNEVICDSNDDTHVKVNIFDDYVAIYIRNIVKSDGGPYQIEFTNESGSATGEFYVHITGMPSAPTGPMGISYINKNSCMLNWRPPSYDGGLKVSHYVIERKDVSSPHWITVSSTCKDTAFNVQGLIENQEYIFRVMAVNENGMGPPLEGLNPIRAKDPIDPPSPPGSPQITEIGGDFVHLEWEKPESDGGAHIQGYWIDKREVGSNTWQRVNATICAANQINCINLIEGRQYEFRIFAQNVAGLSTESSASQAVKIIDPQAASPPLIVKPLRDANCIQNHNAQFTCTINGVPKPTISWYKGAREISNGARYHMYSEGDNHFLNINDVFGEDADEYVCRAVNKAGAKSTRATLAIMTAPKLNVPPRFRDTAYFDKGENVVIKIPFTGFPKPRIHWVRDGENIESGGHYTVEVKERHAVLIIRDGSHLDSGPYRITAENELGSDTAIIQVQISDRPDPPRFPLIESIGTESLSLSWKAPVWDGCSDITNYYVERREHPLSSWIRVGNTRFTSMAVSGLTPGKEYDFRIFADNVYGRSDASDTSTLIKTKESVKKKPIERKWEIDANGRKLRGKADGPVKDYDSYVFDIYSKFVPQPVEISQQSVYDRYDILEEIGTGAFGVVHRCRERSTGNIFAAKFIPVSHSVEKDLIRREIDIMNQLHHQKLINLHDAFEDDDEMILILEFLSGGELFERITAEGYVMTEAEVINYMRQICEGIRHMHEQNIIHLDIKPENIMCQTRSSTNVKLIDFGLATRLDPNEVVKITTGTAEFAAPEIVNREPVGFYTDMWATGVLSYVLLSGLSPFAGDNDVQTLKNVKACDWDFDVESFKYISEEAKDFIRKLLVRNKEKRMTAHECLLHPWLTGDHSAMKQEINRDRYLAYREKLRRKYEDFERFLLPIGRLSEYSSLRKLLMEKYKIHDAVFDRRQAAPRFVIRPSSQFCYEGQSVKFYCRCIAIATPTLTWSHNNIELRQSVKFMKRYVGDDYYFIINRVKLDDRGEYIIRAENHYGSREEVVFLNVQPLPKEQPRYRTESTPVRRREPLPYTFWQEESETAPSFTFLLRPRVMQARDTCKLLCCLSGKPVPNVRWYKDGRELSKYEYAMTHSDGVVTMEIIDCKPSDSGKYSCKATNCHGTDETDCVVIVEGEWVTPEQAQLAHNFLYSGDRKYIEQPIKPAPLPIVTSRQYTSSSVQNTSEPQGDKVNVSNSNSSGISNKKKYASNSLQAPGSPSRSRSATKELILPPDDSLMCKPEFTKPLHDLTIHDGEQLILTCYVKGDPEPQISWSKNGKSLSSSDILDLRYKNGIATLTINEVFPEDEGVITCTATNSVGAVETKCKLTIQPLDKNINKRKVNAGDNAPKIVSHLESRFVRDGDAVNLACRIIGAQHFDVVWLHNNKEIKPSKDFQYTNEANIYRLQIAEIFPEDGGTYTCEAFNDIGESFSTCTINVTVPGDETKQPSFVKFPTSVSVLEGEGTTFECEIDSELLNLVWLKDGKPIDETLPRYSFTKDGHRYSFAVAKCNMDDVGQYQAKAVSGKAESICAFSMNVHTAES

SEQ ID NO: 9265 - protein, 428 aa, Homo sapiens
  unsure (1)..(428): unsure at all Xaa locations
MGPLPGAGVSCRGGCGFSRLLAWCFLLALSPQAPGSRGAEAVWTAYLNVSWRVPHTGVNRTVWELSEEGVYGQDSPLEPVAGVLVPPDGPGALNACNPHTNFTVPTVWGSTVQVSWLALIQRGGGCTFADKIHLAYERGASGAVIFNFPGTRNEVIPMSHPGAVDIVAIMIGNLKGTKILQSIQRGIQVTMVIEVGKKHGPWVNHYSIFFVSVPFFIITXATGGYFIFYSAXRLRNARXQSXKQRQLKADAKKAIGRLQLRTLKQGDKEIGPDGDSCAVCIELYKPNDLVRILTCNHIFHKTCVDPWLLEHRTCPMCKCDILKALGIEVDVEDGSVSLQVPVSNEISNSASSHEEDNRSETASSGYASVQGTDEPPLEEHVQSTNESLQLVNHEANSVAVDVIPHVDNPTFEEDETPNQETAVREIKS

SEQ ID NO: 9266 - protein, 448 aa, Homo sapiens
MDRMKKIKRQLSMTLSSAPEIVHEDLKMGSDGESDQASATSSDEVQSPVRVRMRNHPPRKISTEDINKRLSLPADIRLPEGYLEKLTLNSPIFDKPLSRRLRRVSLSEIGFGKLETYIKLDKLGEGTYATVYKGKSKLTDNLVALKEIRLEHEEGAPCTAIREVSLLKDLKHANIVTLHDIIHTEKSLTLVFEYLDKDLKQYLDDCGNIINMHNVKLFLFQLLRGLAYCHRQKVLHRDLKPQNLLINERGELKLADFGLARAKSIPTKTYSNEVVTLWYRPPDILLGSTDYSTQIDMWGVGCIFYEMATGRPLFPGSTVEEQLHFIFRILGTPTEETWPGILSNEEFKTYNYPKYRAEALLSHAPRLDSDGADLLTKLLQFEGRNRISAEDAMKHPFFLSLGERIHKLPDTTSIFALKEIQLQKEASLRSSSMPDSGRPAFRVVDTEF

SEQ ID NO: 9267 - protein, 429 aa, Takifugu rubripes
MYISVFALVFLIGPAAEALDNGLALTPTMGWLHWERFMCNTDCDQDPDNCISERLFMQVADVMVKEGWKEAGYEYVCIDDCWPYHQRDNQGRLQADPKRFPGGIKKLADYVHSRGLKLGIYADVGNKTCAGYPGSLGYYDTDAQTFAEWGVDLLKFDGCFMDWTLLGEGYMNMSRALNQTGRSIVYSCEWPLYEWRFQKPNYTAIRETCNHWRNSADVLDSWSSIKSISAWTADYQDTIVPAAGPGGWNDPDMLVIGNFGLSHDQQESQMALWAIMAAPLFMSNDLRNICPRSKELLQNEHVIGINQDPLGKQGYLSGKVDSFEVWERPLSKQRLAIAVLNKQEIGGPRGFVIRAAQGWRVCTPACNVTQILPHYKDMGVQPMFSKMVVRVNPSGTVLLTVVPVSGDFKEVYSMEWQDTSVRHHNNAFL

SEQ ID NO: 9268 - protein, 212 aa, Medicago sativa
MGRGKIEIKRIENSSNRQVTYSKRKSGILKKANEINVLCDAQVSTIIFAPSGKMHEYISPSTTLIDMLERYQKASGKRLWDAKHENLRNEIEKLKKENEDMEIKLRHLKGKDINTLNYKKLMSLEDVLENGLLTIRDKQMEVYQMVTRNDKILEEENRELNFILQQQHMAVEGGREMDYNDEFDESSGSDFNSQMPFSFRLQPMQLHSLLQL

SEQ ID NO: 9269 - protein, 296 aa, Leishmania major
MQTATAPFILRSLYKDAYISDMQIARPITELMMNTIGAQLTNKYDTHIPAIACSLYTLFSMSRVQTLGQEFCDLLPVVKAHPWQPVGPARVLLLAVLQLVEPTAVFVVARKLFPDLSTADVEEVLRKAVLCALFLFERFGTLPHRIARVRFLSLKPSRTLQDSDGAPGSYLVLGLVLLVELVVRLWRYSKERTSREAKRSTEAAVITSSDEDAEDARSGKCMLCLSNRKCPTATNCGHIFCWRCIAEWIQSNPQEAVCPFCRQHITTQSLVPLYFYVAKEPPRVGTATDAAAPPAA

SEQ ID NO: 9270 - protein, 155 aa, Treponema medium
MINKVTRESRQLMQKFGREPTDEEIAAQLGWNVERVKQVKNVAREPISLETPIGEEEDSSLGDFIEDKDVENPSNLTEYILLQEQLRGVLSCLPLREQEVLKMRFGLDEGYALTLEEVGLYFNVTRERIRQIEAKALRRLRHPKQSCKLKDYLDT

SEQ ID NO: 9271 - protein, 561 aa, Botryotinia fuckeliana
MKNSFFSSLAKFASLSLAFALPTAEVIPSALEERQSCANTATTRSCWGQYSASTNSYTTVPKTGYWLVVQNTTLSADGVSRPTLNFNGTIPGPQITADWGDDVIVHVTNKLTSNGTSIHWHGIRQLNNAQYDGVPGITQCPIAPGGTLTYKFHADNYGSSWYHSHFILQYGDGLFGPLVINGPATANYDVDLGMLFLNDWNHVPVQSLWDKAKTGAPPTLLTGLMNGTNTYNGAGKKFQTTFTPGLKYRIRVVNTAVDGHFQFSIDGHSFQVIAMDFVPIVPYNATSILVSIAQRYDIIVTANAAVGNYWIRAGWQTACSGNTNAANITGILRYTGSSSTADPTTTSTVTASTSCLDEPLASLVPFVPINPVASSIMKTTLTTGGGQWLFNGSSLLLNWTDPTLLTVLNSGNIWPTEYNVIPIESTTANKGWAVLAISGPNGPNHPIHLHGHDFWTLSQGTGAYTATTALNLVNPPRRDVMTLPTGGHLVIAFQIDNPGSWLMHCHIAWHASEGLALQFVESESSILPTIGTADVSTFQNTCAAWKAWTPTEPFPQDDSGI

SEQ ID NO: 9272 - protein, 581 aa, Botryotinia fuckeliana
MKYSTVFTALTALFAQASATAIPAVRSPLAPRQSTTASCANSATSRSCWGEYSIDTNWYDVTPNTGVTREYWLSVENSTITPDGYTRSAMTFNGTVPGPAITADWGDNLIIHVTNNLQHNGTSIHWHGIRQLGSLEYDGVPGVTQCPIAPGDTLTYKFQATQYGTTWYHSHFSLQYADGLFGPLIINGPATADYDEDVGAIFLQDWAHKSVFEIWDSARQGAPPALENTLMNGTNIYDCSASTDANCVGGGKKFELTFVEGTKYRLRLINVGIDSHFEFAIDNHTLTVIANDLVPIVPYTTDTLLIGIGQRYDVIVEANAAADNYWIRGNWGTTCSSNSEAANATGILRYDSSSTVDPTSVGVTPRGTCADEPVASLVPHLALDVGGYSLVDEQVSFAFTNYFTWTINSSSLLLDWSSPTTLKIFNNETIFPTDYNVVALNQTDANEEWVVYVIEDLTGFGIWHPIHLHGHDFYVVAQETDVFSATKSPANFNLVNPPRRDVAALPGNGYLAIAFKLDNPGSWLLHCHIAWHASEGLAMQFVESQSSIAIGMSDTDIFEDTCANWNAYTPTELFAEDDSGI

SEQ ID NO: 9273 - protein, 246 aa, Bacillus subtilis
MLNDKTAIVTGASRGIGRSIALALAKSGANVVVNYSGNEAKANEVVDEIKSMGRKAIAVKADVSNPEDVQNMIKETLSVFSTIDILVNNAGITRDNLIMRMKEDEWDDVININLKGVFNCTKAVTRQMMKQRSGRIINVSSIVGVSGNPGQANYVAAKAGVIGLTKSSAKELASRNITVNAIAPGFISTDMTDKLAKDVQDEMLKQIPLARFGEPSDVSSVVTFLASEGARYMTGQTLHIDGGMVM

SEQ ID NO: 9274 - protein, 159 aa, Rhodococcus equi
ASRQAPLLEQTQEMFDLSFGTGFYPTVHLMQACYPQLKESKGSIINFGSSSGLEGMPTQTSYAAAKEAIRGVSRVAANEWAADQIRVNVLCPFAATEGVVAWQEAFPERAAATIAKVPLQRIGDPETDIAPIALFLASDDSKYMTGQTVMADGGSLKLR

SEQ ID NO: 9275 - protein, 585 aa, Arabidopsis thaliana
MGLRFPPKVLEHILSFIDSNEDRNSVSLVCKSWFETERKTRKRVFVGNCYAVSPAAVTRRFPEMRSLTLKGKPHFADYNLVPDGWGGYAWPWIEAMAAKSSSLEEIRMKRIVVTDECLEKIAASFKDFKVLVLTSCEGFSTDGIAAIAATCRNLRVLELRECIVEDLGGDWLSYFPESSTSLVSLDFSCLDSEVKISDLERLVSRSPNLKSLKLNPAVTLDGLVSLLRCAPQLTELGTGSFAAQLKPEAFSKLSEAFSNCKQLQSLSGLWDVLPEYLPALYSVCPGLTSLNLSYATVRMPDLVELLRRCSKLQKLWVMDLIEDKGLEAVASYCKELRELRVFPSEPDLDATNIPLTEQGLVFVSKGCRKLESVLYFSVQFTNAALFTIARKRPNLKCFRLCVIEPFAPDYKTNEPLDKGFKAIAEGCRDLRRLSVSGLLSDKAFKYIGKHAKKVRMLSIAFAGDSDLMLHHLLSGCESLKKLEIRDCPFGDTALLEHAAKLETMRSLWMSSCFVSFGACKLLSQKMPRLNVEVIDEHPPESRPESSPVERIYIYRTVAGPRMDTPEFVWTIHKNPENGVSHLAMK

SEQ ID NO: 9276 - protein, 624 aa, Arabidopsis thaliana
MEAVIQTRGLLSLPTKPIGVRSQLQPSHGLKQRLFAAKPRNLHGLSLSFNGHKKFQTFEPTLHGISISHKERSTEFICKAEAAAAGDGAVFGEGDSAAVVASPKIFGVEVATLKKIIPLGLMFFCILFNYTILRDTKDVLVVTAKGSSAEIIPFLKTWVNLPMAIGFMLLYTKLSNVLSKKALFYTVIVPFIIYFGAFGFVMYPLSNYIHPEALADKLLTTLGPRFMGPIAILRIWSFCLFYVMAELWGSVVVSVLFWGFANQITTVDEAKKFYPLFGLGGNVALIFSGRTVKYFSNLRKNLGPGVDGWAVSLKAMMSIVVGMGLAICLLYWWVNRYVPLPTRSKNKKEKPKMGTMESLKFLVSSPYIRDLATLVVAYGISINLVEVTWKSKLKAQFPSPNEYSAFMGDFSTCTGVATFTMMLLSQYVFNKYGWGVAAKITPTVLLLTGVAFFSLILFGGPFAPLVAKLGMTPLLAAVYVGALQNIFSKSAKYSLFDPCKEMAYIPLDEDTKVKGKAAIDVVCNPLGKSGGALIQQFMILSFGSLANSTPYLGMILLVIVTAWLAAAKSLEGQFNSLRSEEELEKEMERASSVKIPVVSQDESGNGSLGESPSSSPEKSAPTNL

SEQ ID NO: 9277 - protein, 353 aa, Gibberella fujikuroi
MGCGMSTEEKEGKARNEEIENQLKRDKMMQRNEIKMLLLGAGESGKSTILKQMKLIHEGGYSRDERESFKEIIFSNTVQSMRVILEAMESLELPLEDQRMEYHVQTIFMQPAQIEGDVLPPEVGSAIEALWKDRGVQECFKRSREYQLNDSARYYFDNIARIAAPDYMPNDQDVLRSRVKTTGITETTFIIGDLTYRMFDVGGQRSERKKWIHCFENVTTILFLVAISEYDQLLFEDETVNRMQEALTLFDSICNSRWFIKTSIILFLNKIDRFKEKLPVSPMKNYFPDYEGGDDYAAACDYILNRFVSLNQHETKQIYTHFTCATDTTQIRFVMAAVNDIIIQENLRLCGLI

SEQ ID NO: 9278 - protein, 227 aa, Morus bombycis
MACKQRLRFGRFFYVSAVVMVIIAASFASTCGGSGVGHVPSTTEEGRDFEEVKERAQQTQNKAAETAKEANEASETWTDWAKEKISEGLGFNKDADAKDAPKKASDTVSDTAKKSEEVASETGEYSADKARSATERAAAETISGAKEKAYDTAKSAEEKAYETAQKAKEKVYDSTGTAKEVKDKEKADEGYDAAKHKGEETLESAKDKTQHLKDKVAGGGRGRDEEL

SEQ ID NO: 9279 - protein, 223 aa, Morus bombycis
MACKQRLRFGRFFYVSAVVMVIIAASFASTCGGSGVGHTTEEGRDFEEVKERAQQTQNKAAETAKEANEASETWTDWAKEKISEGLGFNKDADAKDAPKKASDTVSDTAKKSEEVAAETGEYSADKARSATERAAETVSGAKEKAYDTAKSAKEKAYETAQKAKEKVYDSTGTAKEVKDKEKADEGYDAAKHKGEETLESAKDKTQHLKDKVAGGGRGRDEEL

SEQ ID NO: 9280 - protein, 443 aa, Rosa hybrid cultivar
ETTLVELGRTLGLEECALWMPCRSGMNLQLSHTLNYEAQIGSTVPFSLPVVSEVFKSSQAMRIPYTCPLARVRPLVGRYVQPEVVALRVPLLNLSNFQINDWPDVSAKSYAIMVLILPTNSTRKWRDHELELVDVVADQVAVALSHAAILEESMRASDQLVEQNGALDLARREAELAIHARNDFLAVLNHEMRTPMHAIIALSSLLLETDLEDGSLDLDIGKFNLHGVFREAINLIKPIATVKKLSMTLILAPDVPVCAVGDENRLMQTILNVAGNAVKFTKEGYISVIASVAKPDSSRDWRPPEFYPASSDGHFYLRVQVKDSGSGILPQDIPHIFTKFAEPRNGSNRVKDGAGLGLAICKRFVNTMGGHIWIESEGIDKGTLVVFIVKLGICDNCGNTTIAHQKVPKGEANHGSADLIGYKPAFRDGYGLASTNPRYQRSL

SEQ ID NO: 9281 - protein, 307 aa, Sorghum bicolor
MSAELKRDYEIGAEIGRGRFGVVHRCTSRATGEAFAVKSVDRSQLADDLDRELAELEPKLAQLAGAGNPGVVQTHAVYEDETWTHTVMDLCAGPDLLEWVRLRRGAPVPEPLAAAIVAQVAQALALCHRRGVAHRDVKPDNILIDTAPAGSDDGEDEEEDSGEAEEAETAPRARLADFGSAAWVGAGGLGRAEGLVGTPHYVAPEVVGGGEYGAKADVWSAGVVMYALLSGGALPFGGETAAEVLAAVLRGSVRFPPRLFSGVSPAAKDLLRRMICRDEWRRFTAEQVLAHPWIVSGGGARAIERPT

SEQ ID NO: 9282 - protein, 359 aa, Mus musculus
MTLENLMACCLSDEVKESKRINAEIEKQLRRDKRDARRELKLLLLGTGESGKSTFIKQMRIIHGAGYSEEDKRGFTKLVYQNIFTAMQAMVRAMATLKILYKYEQNKANALLIREVDLEKVTTFEHQYVNAIKTLWSDPGVQECYDRRPEFQLSDSAKYYLTDVDRIATVGYLPTQQDVLRVRVPTTGIIEYPFDLENIIFRMVDVGGQRSERRKWIHCFENVTSIMFLVALSEYDQVLVESDNENRMEESKALFRTIITYPWFQNSSVILFLNKKDLLEDKILHSHLVDYFPEFDGPQRDAQAAREFILKMFVDLNPDSDKIIYSHFTCATDTENIRFVFAAVKDTILQLNLKEYNLV

SEQ ID NO: 9283 - protein, 301 aa, Homo sapiens
MTRHGKNCTAGAVYTYHEKKKDTAASGYGTQNIRLSRDAVKDFDCCCLSLQPCHDPVVTPDGYLYEREAILEYILHQKKEIARQMKAYEKQRGTRREEQKELQRAASQDHVRGFLEKESAIVSRPLNPFTAKALSGTSPDDVQPGPSVGPPSKDKDKVLPSFWIPSLMPEAKATKLEKPSRTVTCPMSGKPLRMSDLTPVHFTPLDSSVDRVGLITRSERYVCAVTRDSLSNATPCAVLRPSGAVVTLECVEKLIRKDMVDPVTGDKLTDRDIIVLQRGGTGFAGSGVKLQAEKSRPVMQA

SEQ ID NO: 9284 - protein, 113 aa, Zea mays subsp. parviglumis
MGRRACCAKEGVKRGAWTSKEDDALAAYVKAHGEGKWREVPQKAGLRRCGKSCRLRWLNYLRPNIRRGNISYDEEDLIIRLHRLLGNRWSLIAGRLPGRTDNEIKNYWNSTLV

SEQ ID NO: 9285 - protein, 113 aa, Zea mays subsp. parviglumis
MGRTACCAKEGVKRGAWTSKEDDALAAYVKAHGEGKWREVPQKAGLRRCGKSCRLRWLNYLRPNIRRGNISYDEEDLIIRLHRLLGNRWSLIAGRLPGRTDNEIKNYWNSTLV

SEQ ID NO: 9286 - protein, 113 aa, Zea luxurians
  unsure (1)..(113): unsure at all Xaa locations
MGRRACCAKEGVKRGAWTTKEDDALAAYVKAHGEGKWREVPXKAGLRRCGKSCRLRWLNYLRPNIRRGNISYDEEDLIIRLHKLLGNRWSLIAGRLPGRTDNEIKNYWNSTLV

SEQ ID NO: 9287 - protein, 113 aa, Zea luxurians
  unsure (1)..(113): unsure at all Xaa locations
MGRRACCAKEGVKRGAWTTKEDDALAAYVKAHGEGKWREVPQKAGLRRCGKSCRLRWLNYLRPNIRRGNISYDEEDLIIRLHKLLGNRWSLIAGRLPGRTDNEIKNYWXSTLV

SEQ ID NO: 9288 - protein, 113 aa, Zea luxurians
MGRRACCAKEGVKRGAWTSKEDDALAAYVKAHGEGKWREVPQKAGLRRCGKSCRLRWLNYLRPNIRRGNISYDEEDLIIRLHRILGNRWSLIAGRLPGRTDNEIKNYWNSTLV

SEQ ID NO: 9289 - protein, 96 aa, Tripsacum dactyloides
MGRRACCAKEGVKRGAWTSKEDDVLAAYVKAHGEGKWREVPQKASLRRCGKSCRLRWLNYLRPNIKRGNISYDEEDLIIRLHKLLGNRWSLIAGRL

SEQ ID NO: 9290 - protein, 832 aa, Drosophila melanogaster
MSTAMRTTLQSVPEALPADSVSNGTASNVAAPAAPVSSATNAVPPLAAVSSTTATYATNSISTSSHSVKDQQQQQQQQQHDSANANIVSLPPTTTPVANTNTMMPIVTSSNSATSNSTAATPTPASGAAATGGVGSVSQGPATVSASAANTNHSHQHSHQHHHHVANNMTTDGARLSSNNSAVVASSAINHHHHHTPGSGVAPTVNKNVLSTHSAHPSAIKQRTSSAKGSPNMQMRSSAPMRWRATEEHIGKYKLIKTIGKGNFAKVKLAKHLPTGKEVAIKIIDKTQLNPGSLQKLFREVRIMKMLDHPNIVKLFQVIETEKTLYLIMEYASGGEVFDYLVLHGRMKEKEARVKFRQIVSAVQYCHQKRIIHRDLKAENLLLDSELNIKIADFGFSNEFTPGSKLDTFCGSPPYAAPELFQGKKYDGPEVDVWSLGVILYTLVSGSLPFDGSTLRELRERVLRGKYRIPFYMSTDCENLLRKFLVLNPAKRASLETIMGDKWMNMGFEEDELKPYIEPKADLADPKRIEALVAMGYNRSEIEASLSQVRYDDVFATYLLLGRKSTDPESDGSRSGSSLSLRNISGNDAGANAGSASVQSPTHRGVHRSISASSTKPSRRASSGAETLRVGPTNAAATVAAATGAVGAVNPSNNYNAAGSAADRASVGSNFKRQNTIDSATIKENTARLAAQNQRPASATQKMLTTADTTLNSPAKPRTATKYDPTNGNRTVSGTSGIIPRRSTTLYEKTSSTEKTNVIPAETKMASAVKSSRHFPRNVPSRSTFHSGQTRARNNTALEYSGTSGASGDSSHPGRMSFFSKLSSRFSKRPNQ

SEQ ID NO: 9291 - protein, 1058 aa, Drosophila melanogaster
MEATTTTTPDLNRGDATRKSVRLYAARKGAAPAPPKLSVAPSSNQNSNHSSNNNNSSSNLPETEKEMELRQTHLANKDLDGATEDDSIVELRRRDAQATPLPRIAVSALPTLQPHPTPKERQKPPMPRLLSTEDDAGVSFALGSIEKHIHNVEESFKQQQQNQQSQSSMDVMKLEIKRKQSKRYGETENLLRPGISDMSSENDFQYLGGRRAGELDDSNELMLSEFQRGSDGRNSIGAYSKNSAAAANGANAVKAKLARTASDTKNNDTVLAMRATFKQKQHLQDEKQPAVWRPAGTGPTPAARSSSSTTSTSGSASRGGSSSSVVDGVAPSKLTATTISASKRREENLRQFEALLAQKSSHRHGASGASGTGSNAASSKRRSDRPIVAPIPPYNSSRAEHVTSSTRHSVDPRSHSGHESRSGTASTHPPVGHHPTSRVPSVVANRSNVYSNNAAQGSPNMQMRSSAPMRWRATEEHIGKYKLIKTIGKGNFAKVKLAKHLPTGKEVAIKIIDKTQLNPGSLQKLFREVRIMKMLDHPNIVKLFQVIETEKTLYLIMEYASGGEVFDYLVLHGRMKEKEARVKFRQIVSAVQYCHQKRIIHRDLKAENLLLDSELNIKIADFGFSNEFTPGSKLDTFCGSPPYAAPELFQGKKYDGPEVDVWSLGVILYTLVSGSLPFDGSTLRELRERVLRGKYRIPFYMSTDCENLLRKFLVLNPAKRASLETIMGDKWMNMGFEEDELKPYIEPKADLADPKRIGKTEALVAMGYNRSEIEASLSQVRYDDVFATYLLLGRKSTDPESDGSRSGSSLSLRNISGNDAGANAGSASVQSPTHRGVHRSISASSTKPSRRASSGVGPTNAAATVAAATGAVGAVNPSNNYNAAGSAADRASVGSNFKRQNTIDSATIKENTARLAAQNQRPASATQKMLTTADTTLNSPAKPRTATKYDPTNGNRTVSGTSGIIPRRSTTLYEKTSSTEKTNVIPAETKMASAVKSSRHFPRNVPSRSTFHSGQTRARNNTALEYSGTSGASGDSSHPGRMSFFSKLSSRFSKRPNQ

SEQ ID NO: 9292 - protein, 744 aa, Homo sapiens
MSTRTPLPTVNERDTENHTSHGDGRQEVTSRTSRSGARCRNSIASCADEQPHIGNYRLLKTIGKGNFAKVKLARHILTGREVAIKIIDKTQLNPTSLQKLFREVRIMKILNHPNIVKLFEVIETEKTLYLIMEYASGGEVFDYLVAHGRMKEKEARSKFRQIVSAVQYCHQKRIVHRDLKAENLLLDADMNIKIADFGFSNEFTVGGKLDTFCGSPPYAAPELFQGKKYDGPEVDVWSLGVILYTLVSGSLPFDGQNLKELRERVLRGKYRIPFYMSTDCENLLKRFLVLNPIKRGTLEQIMKDRWINAGHEEDELKPFVEPELDISDQKRIDIMVGMGYSQEEIQESLSKMKYDEITATYLLLGRKSSELDASDSSSSSNLSLAKVRPSSDLNNSTGQSPHHKVQRSVSSSQKQRRYSDHAGPAIPSVVAYPKRSQTSTADSDLKEDGISSRKSSGSAVGGKGIAPASPMLGNASNPNKADIPERKKSSTVPSSNTASGGMTRRNTYVCSERTTADRHSVIQNGKENSTIPDQRTPVASTHSISSAATPDRIRFPRGTASRSTFHGQPRERRTATYNGPPASPSLSHEATPLSQTRSRGSTNLFSKLTSKLTRRLPTEYERNGRYEGSSRNVSAEQKDENKEAKPRSLRFTWSMKTTSSMDPGDMMREIRKVLDANNCDYEQRERFLLFCVHGDGHAENLVQWEMEVCKLPRLSLNGVRFKRISGTSIAFKNIASKIANELKL

SEQ ID NO: 9293 - protein, 691 aa, Homo sapiens
MIRGRNSATSADEQPHIGNYRLLKTIGKGNFAKVKLARHILTGKEVAVKIIDKTQLNSSSLQKLFREVRIMKVLNHPNIVKLFEVIETEKTLYLVMEYASGGEVFDYLVAHGRMKEKEARAKFRQIVSAVQYCHQKFIVHRDLKAENLLLDADMNIKIADFGFSNEFTFGNKLDTFCGSPPYAAPELFQGKKYDGPEVDVWSLGVILYTLVSGSLPFDGQNLKELRERVLRGKYRIPFYMSTDCENLLKKFLILNPSKRGTLEQIMKDRWMNVGHEDDELKPYVEPLPDYKDPRRTELMVSMGYTREEIQDSLVGQRYNEVMATYLLLGYKSSELEGDTITLKPRPSADLTNSSAPSPSHKVQRSVSANPKQRRFSDQAGPAIPTSNSYSKKTQSNNAENKRPEEDRESGRKASSTAKVPASPLPGLERKKTTPTPSTNSVLSTSTNRSRNSPLLERASLGQASIQNGKDSTAPQRVPVASPSAHNISSSGGAPDRTNFPRGVSSRSTFHAGQLRQVRDQQNLPYGVTPASPSGHSQGRRGASGSIFSKFTSKFVRRNLNEPESKDRVETLRPHVVGSGGNDKEKEEFREAKPRSLRFTWSMKTTSSMEPNEMMREIRKVLDANSCQSELHEKYMLLCMHGTPGHEDFVQWEMEVCKLPRLSLNGVRFKRISGTSMAFKNIASKIANELKL

SEQ ID NO: 9294 - protein, 81 aa, Branchiostoma belcheri
YIMLTGIFQFGYCLLVGTFPFNSFLSGFISCVASFVLAVCLRVQVNPQNRKDFLHISPERAFADFVFAHIILHIVVMNFIG

SEQ ID NO: 9295 - protein, 368 aa, Oryza sativa (japonica cultivar-group)
MAARLLFDLRSDMVIKNADASVYKIIHGFLKQKNNSIIKVAANVARKAASNKLSRKTSDVFDSLIQKQQSKWGNKTGPLLSGICYCIASCSMILLNKVVLSNYNFNAGISLMLYQNLISVIILLVLELFGVISTEKLTWKLIKVWIPVNLIFVGMLVTGMYSLKYINVAMVTILKNMTNILTAVGEIYIFRKGQNKKVWAALCLMVISAVCGGITDLSFHPVGYMWQLFNCFLTAGYSLTLRRVMDVAKQSTKSGSLNEVSMVLLNNALSIPLALILIVIFDEWQYVYEVEVTRDPMFWAFATASGLLGLAISFSSVWFLHRTGPTTYSLVGSLNKIPISVAGILLFNVPVFLLGYSLQRQKCPNVYL

SEQ ID NO: 9296 - protein, 290 aa, Solanum berthaultii
LNSSYRVPFESFRVPFVDLQEATNNFDEKFHIGLGGFGKVYRGVLRDGTKVALKRCKRESSQGIEEFQTEIEILSFCSHPHLVSLIGYCDERNEMILVYDYIENGNLRSHLYGSDLPSMSWEQRLEICIGAARGLHYLHTSAVIHRDVKSINMLLDENFVAKITDFGLSKKGTELDQTHLSTLVQGTIGYLDPEYFIRGQLTEKSDVYSFGVVLFEVLCARPAIVQSLPREMVNLAEWAVDSHNKGQLEQIIDLNLAAKIRPESLRKFGETAVKCLALSSGDRPSMGDVL

SEQ ID NO: 9297 - protein, 292 aa, Solanum demissum
LNSSYRVPFESFRVPFVDLQEATNNFDEKFRIGVGIFGKVYRGVSRDGTKVALKRRNRESPQGIEEFQAEIEILSFCSHPHLVSLIGYCDERNEMILVYEYMENGNLSSHLYGSDLRLPTMSWEQRLEICIGAARGLHYLHNSAVIHRDVKSTNILLDENFVAKITDFGISKTMSELDQTHLSTTVKGSIGYIDPENFIRRQLTEKSDVYSFGVVLFEVLCARPAIVQSLPRETVCLAEWAVDSHNKGQLEQIIDPNLAAKIRPESLRKFGETAVKCLALSSEDRPSMGDVL

SEQ ID NO: 9298 - protein, 290 aa, Solanum sucrense
LNSSYRVPFESFRVPFVDLQEATNNFDEKFHIGLGGFGKVYRGVLRDGTKVALKRYTPESNQGLQEFQTEIEILSFCSHPHLVSLIGYCDERNEMILVYDYMENGNLRSHLYGSDLPSMSWEQRLEICIGAARGLHYLHTSAVIHRDVKPINILLDENFVAKITDFGLSKKRTELDQTHLSTLVQGTLGYLDPEYFNRGQLTEKSDVYSFGVVLFEVLCARPAIVQTPSRGMISLAEWVVESQKKGQLEQIIDPNIVAEIRPESLRIFGETAVKCLALSGEDRPSMGDVL

SEQ ID NO: 9299 - protein, 290 aa, Solanum sucrense
LNSSYRVPFESFRVPFVDLQEATNNFDEKFHIGLGGFGKVYRGVLRDGTKVALKRYTPESNQGLQEFQTEIEILSFCNHPHLVSLIGYCDERNEMILVYDYMENGNLRSHLYGSDLPSMSWEQRLEICIGAARGLHYLHTSAVIHRDVKPINILLDENFVAKITDFGLSKKRTELDQTHLSTFVQGTLGYLDPEYFNRGQLTEKSDVYSFGVVLFEVLCARPAIVQTPSRGMISLAEWVVESQKKGQLEQIIDPNIVAEIRPESLRIFGETAVECLALSGEDRPSMGDVL

SEQ ID NO: 9300 - protein, 290 aa, Solanum sucrense
LNSSYRVPFESFRVPFVDLQEATNNFDEKFHIGLGGFGKVYRGVLRDGTKVALKRYTPESNQGLQEFQTEIEILSFCSHPHLVSLIGYCDERNEMILVYDYMENGNLRSHLYGSDLPSMSWEQRLEICIGAARGLHYLHTSAVIHRDVKPINILLDENFGQKLLDFGLSKKRTELDQTHLSTLVQGTLGYLDPEYFNRGQLTEKSDVYSFGVVLFEVLCARPAIVQTPSRGMISLAEWVVESQKKGQLEQIIDPNIVAEIRPESLRIFGETAVKCLALSGEDRPSMGDVL

SEQ ID NO: 9301 - protein, 290 aa, Solanum tuberosum
LNSSYRVPFESFRVPFVDLQEATNNFDEKFHIGLGGFGKVYRGVLRDGTKVALKRCKRESSQGIEEFRTEIEILSFCSHPHLVSLIGYCDETNEMILVYDYIENGNLRSHLYGPDLPTMSWEQRLEICIGAARGLHYLHTSAVIHRDVKSINILLDENFVAKITDFGISKKGTELDQTHLSTLVQGTIGYLDPEYFIRGQLTEKSDVYSFGVVLFEVLCARPAIVQSLPREMVNLAEWAVDSHNKGHLEQIIDPDLAAKIRPESLRKFGETAVKCLALSSEDRPSMGDVL

SEQ ID NO: 9302 - protein, 290 aa, Solanum tuberosum
LNSSYRVPFESFRVPFVDLQEATNNFDEKFHIGLGGFGKVYRGVLRDGTKVALKRCKRESSQGIEEFRTEIEILSFCSHPHLVSLIGYCDETNVMILVYDYIENGNLRSHLYGPDLPTMSWEQGLEICIGAARGLHYLHTSAVIHRDVKSINILLDENFVAKITDFGISKKGTELDQTHLSTLVQGTIGYLDPEYFLRGQLTEKSDVYSFGVVLFEVLFARPAIVQSLPREMVSLAEWAVDSHNKGQLEQIVDPDLAAKIRPESLRKFGETAVKCLALSSEDRPSMGDVL

SEQ ID NO: 9303 - protein, 353 aa, Trichoderma atroviride
MGCGMSTEDKEGKARNEEIENQLKRDKMMQRNEIKMLLLGAGESGKSTILKQMKLIHEGGYSRDERESFKEIIFSNTVQSMRVILEAMESLELPLQDQRMEYHVQTIFIQPAQIEGDVLPPEVGGAIEALWKDHGVQECFKRSREYQLNDSARYYFDNIVRIAAPDYMPNDQDVLRSRVKTTGITETTFIIGDLTYRMFDVGGQRSERKKWIHCFENVTTILFLVAISEYDQLLFEDETVNRMQEALTLFDSICNSRWFIKTSIILFLNKIDRFKEKLPVSPMKNYFPDYEGGDDYAAACDYILNRFVSLNQHETKQIYTHFTCATDTTQIRFVMAAVNDIIIQENLRLCGLI

SEQ ID NO: 9304 - protein, 355 aa, Claviceps purpurea
MSRANPPNAGGSRKISFNVSEHYDIQDVVGEGAYGVVCSAVHKPSGQKVAIKKITPFDHSMFCLRTLREMKLLRYFNHENIISILDIQKPRGYDSFNEVYLIQELMETDMHRVIRTQDLSDDHCQYFIYQTLRALKAMHSANVLHRDLKPSNLLLNANCDLKVCDFGLARSAASQDDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPPRVLFPKTSDLALDLLEKLLAFNPVKRITVEEALKHPYLEPYHDPDDEPTAPPIPEAFFDFDKHKDNLSKEQLKLLIYEEIMR

SEQ ID NO: 9305 - protein, 184 aa, Trypanosoma cruzi
AGGIAEMAHMGHEIREITDALDAAGNTTAAIGKGFAIASAAFVALALYAAYVSRVGIPTINILDARVMSGLLVGAMLPYCFSAFTMKSVGLAAMNMVNEIRRQFQNPAIAEGTEEPDYESCVAISTQAALQQMVAPACLVMLTPIVVGVLFGRYTLAGLLPGAIVSGVQVAISASNNGGAWDNA

SEQ ID NO: 9306 - protein, 991 aa, Tuber magnatum
EFKLSVEKQYKEGIEKMIKLYQMEGDRKSRQDAESKHTDSGQKIQLLKQALKRYEDLHVDMDFGDEADDDSINSPNIRRPLTGRLAIRVLAVKDVDHATTSRFARGPETFVIIKVEDVARVRTKSTRNDKWLDEAHDIDVDKANEIEMTVYDKPGDNHMPIGLLWIRISDIAEELRRKKIEQDISSSGWVSADKMAHGGAGRPSEGTYNYNQGFGGPAAAGGGGTGMYVNNSGQTQASGGSAGIDAWFALEPVGQIHLNLNFVKYNRNKRPLDLGLGRKGAVRARKEEVHEMYGHKFVQQQFYNIMRCALCSDFLKYSAGMQCSDCKYTCHKKCYPKVVTKCISKSNAETDPEEEKLNHRIPHRFEPMTNMGANWCCHCGYMLPVGKKNARKCTECGLTCHSQCAHLVPDFCGMEVANQILGEIKKTKRRGPGMADRNLRTSGPPAPSSPLSGRPTSDPYVSHLDPRNSVQGEPTQLSQRTHPYSPSSPTAVNAANVAYGTASSPARPQQPAPYSPEQRPNRVPDPTAVAAAAHAGQRPPSVVQSQIGYPPRQSAELYRGAPASPTQTKHPTELPSSPSPYQQGQGYDNPYQQHRTSIPQQPPAAPPKAPPAPSGYGQPQAAQYDQKRSYGQPPPAPVKVAPPAHAYTAEKKPPPPPALEPQHAVSRPTKIGLDHFNFLAVLGKGNFGKVMLAETKACKKLYAIKVLKKEFIIENDEVESTRSEKRVFLIANKERHPFLLNLHACFQTETRVYFVMEYISGGDLMLHIQRGAFGSRRAQFYAAEVCLALKYFHENGVIYRDLKLDNILLTLDGHIKIADYGLCKEEMWYGSTTSTFCGTPEFMAPEILMDKRYGRAVDWWAFGVLIYQMLLQQSPFRGEDEDEIYDAILADEALYPIHMPRDSVSILQKVLTKEPELRLGSGPTDAQEIMSHPFFANINWGDIYHKRYPPPFKPSIQSATDTSNFDQEFTSVTPVLTPVQSVLTQAMQEEF

SEQ ID NO: 9307 - protein, 406 aa, Cyanidioschyzon merolae
MFSCLTSVAQGNGRLQRTSKQVPLVARRERRHRLAVRTLRPALESSLSRFTEQEQAFPTLKADAKPKTASNSRTAGVPNRLKEEEGACFVEFLRRAVEDCRRNVQAGGHGTEDLVWERVRLEAEAAAREEQLLASFLYATVLNHDTLEACLAFHLANKLASTTLPSTMLNEIIREALEKAPEARYAIRLDLLAVADRDPACTRVIDALLFFKGFHALQTHRVAHWLWSQNRQALAMYLHSQVCKVLQIDIHPAARIGYGVFIDHGTGVVIGETARVGNNVSLLHHVTLGGTGTKLGDRHPRIEDCVLIGAGATILGNITVGYGAMVGACTVLTSDLPPHSTAVGVPARVIGAPRTKAPAFDMDQDPTHCRKRRTAVEHPDGSSHSLPETGTVDVTSTSTNGHALDS

SEQ ID NO: 9308 - protein, 593 aa, Oryza sativa (japonica cultivar-group); identical to SEQ ID NO: 3878

SEQ ID NO: 9309 - protein, 506 aa, Halomonas salina
MIYANPGSPESVVSFDARYGNYIGGEFVPPVKGQYFDNVSPVNGKPFCEIPRSTAEDIDKALDAAHAAAPAWGKTSAAERGNILLRIADRIEQNLELLAVAETWDNGKAVRETLNADLPLAVDHFRYFAGCIRAQEGTAADIDANTVAYHFHEPLGVVGQIIPWNFPILMAVWKLAPALAAGNCVVLKPAEQTPASILKLMELVGDLLPPGVVNVVNGYGAEAGQALATSTRIAKIAFTGSTPVGSHILKCAAENIIPSTVELGGKSPNIYFADIMDAEPEFIDKAAEGLVLAFFNQGEVCTCPSRALIQEDIYDAFMAKVMEKVATITRGNPLDTDVKVGAQASQEQFDKIMSYMEVAREEGAEFLTGGDKEHFDPAYDSGYYIQPTLLKGHNKMRVFQEEIFGPVVAVTTFKDEEEALAIANDTEFGLGAGVWSRDINVAFRMGRGIQAGRVWTNCYHQYPAHAAFGGYKKSGVGRETHKVALEHYQQTKNLLVSYDTNPLGFF

SEQ ID NO: 9310 - protein, 374 aa, Salmonella enterica
MKILYVITGLTCGGAEHLMMQLADQMLLRGHDVNIICLSGISEIQPTQKHNIHYIRMEKNVRGFVKALFQVRKIITVIKPDIIHSHMFHANIFSRIIRILTPSVPLICTAHNKNEGGYARMLCYRLSDFLASITTNVSQEAVQEFIAKKAAPKNKIIEVPNFVNTTNFSFDLKARKERRNFFGIKDNTLLLLAVGRLVDAKDYPNLLNAINYLTLSESTGFDNFILFIAGDGVLKSKLVDLVNKLNLADKVFFLGRRSDIKELMCAADLFVLSSQWEGFGLVVAEAMACERLVVATDSGGVREVVGPHNDVIPVSNHILLAEKIAGVLKMDEKTKNMIALKNRQHIVSHFSIQNIVSNWECLYYKYSRCTDKAS

SEQ ID NO: 9311 - protein, 358 aa, Neurospora crassa
MAEFIRAQIFGTTFEITSRYSDLQPVGMGAFGLVCSAKDQLTNQNVAIKKIMKPFSTPVLAKRTYRELKLLKHLRHENVISLSDIFISPLEDIYFVTELLGTDLHRLLTSRPLEKQFIQYFLYQIMRGLKYVHSAGVVHRDLKPSNILVNENCDLKICDFGLARIQDPQMTGYVSTRYYRAPEIMLTWQKYDVEVDIWSAGCIFAEMLEGKPLFPGKDHVNQFSIITELLGTPPDDVINTIASENTLRFVKSLPKRERQPLKNKFKNADSSAVDLLERMLVFDPKKRITATEALSHEYLAPYHDPTDEPVAEEKFDWSFNDADLPVDTWKIMMYSEILDYHNVEASGQMMFQEDVPPQ

SEQ ID NO: 9312 - protein, 162 aa, Marchantia polymorpha
MDIQSEKLLKDTVRRILEHADLNIMNRLKVLLLAAEDSGLHSNLPGYENVVMTVIDDFFRKNGQVPPWSDMPTCVTKEDAGTSQEAETLTCSICLDVVLVQGGDRSITKLVCEHWFHFYCIVSAFIAKGTKQCPNCLACREGALVWCQRIVVRMTIHMLEYL

SEQ ID NO: 9313 - protein, 190 aa, Hylurgops rugipennis
MIKLDGTENKSKFGANAILGVSLAVCKAGAAKRGLPLYRHIADLAGNKNLILPVPAFNVINGGDHAGNKLAMQEFMILPTGACSFTEAMKMGSETYHTLKEIIKDKYGLDATAVGDEGGFAPNIGNPKDALTILNDAIAKAGYTGKIEIGMDVAASEFYKDGLYDLDFKNPKSDKKNWIKGEKLMSMFQN

SEQ ID NO: 9314 - protein, 148 aa, Hylastes porculus
NLDGTENKSKFGANAILGVSLAVCKAGAAKRGLPLYRHIADLAGNKNLILPVPAFNVINGGDHAGNNLAMQEFMILPTGACSFTEAMKMGSETYHTLKKIIKDKYGLDATAVGDEGGFAPNIGNPKDALTILNDAIAKAGYTGKIEIG

SEQ ID NO: 9315 - protein, 151 aa, Dendroctonus adjunctus
  unsure (1)..(151): unsure at all Xaa locations
EIXEFMINLDGTDNKSKFGANAILGVSLAVCKAGAAKRGLPLYRHIADLAGNKNLILPVPAFNVINGGSHAGNKLAMQEFMILPTGACSFTEAMKMGSETYHTLKKIIKDKYGLDATAVGDEGGFXPNIGNPKDALTILNDAIPXAGYTGK

SEQ ID NO: 9316 - protein, 152 aa, Dendroctonus frontalis
  unsure (1)..(152): unsure at all Xaa locations
EXMINLDGTDNKSKFGANAILGVSLAVCKAGAAKRGLPLYRHIADLAGNKNLILPVPAFNVINGGSHAGNKLAMQEFMILPTGACSFTEAMKMGSETYHTLKKIIKDKYGLDATAVGDEGGFAPNIGNPKDALTILNDAIAKAGYTGKIEIG

SEQ ID NO: 9317 - protein, 156 aa, Dendroctonus jeffreyi
  unsure (1)..(156): unsure at all Xaa locations
EIEEXMINLDGTENKSKFGANAILGVSLAVCKAGAAKRGLPLYRHIADLAGNKNLIXPVPAFNVINGGSHAGNKLAMQEFMILPTGACSFTEAMKMGSETYHTLKKIIKDKYGLDATAVGDEGGFAPNIANPKDALTILNDAIAKAGYTGKIEIGM

SEQ ID NO: 9318 - protein, 146 aa, Dendroctonus mexicanus
  unsure (1)..(146): unsure at all Xaa locations
NLDGTXNKSKFGANAILGVSLAVCKAGAAKRGLPLYRHIADLAGNKNLILPVPAFNVINGGSHAGNKLAMQEFMILPTGACSFTEAMKMGSETYHTLKKIIKDKYGLDATAVGDEGGFAPNIGNPKDALIILNDAIAXAGYTGKIE

SEQ ID NO: 9319 - protein, 156 aa, Dendroctonus murrayanae
  unsure (1)..(156): unsure at all Xaa locations
EIXEXMINLDGTDNKSKFGANAILGVSLAVCKAGAAKRGLPLYRHIADLAGNKNLILPVPAFNVINGGSHAGNKLAMQEFMILPTGACSFTEAMKMGSETYHTLKKIIKDKYGLDATAVGDEGGFAPNIGNPKDALTXLNDAIAKAGYXGKIEIGX

SEQ ID NO: 9320 - protein, 149 aa, Dendroctonus ponderosae
  unsure (1)..(149): unsure at all Xaa locations
EIXEXMINLDGTENKSKFGANAILGVSLAVCKAGAAKRGLPLYRHIADLAGNKNLILPVPAFNVINGGSHAGNKLAMQEFMILPTGACSFTEAMKMGSETYHTLKKIIKDKYGLDATAVGDEGGFAPNIANPKDALTILNDAIAKAGYT

SEQ ID NO: 9321 - protein, 153 aa, Hylurdrectonus araucariae
  unsure (1)..(153): unsure at all Xaa locations
EIDDFMIKLDGTENKSKFGANAILGVSLAVCKAGAAKRGVPLYRHIADLANNKNIILPVPAFNVINGGSHAGNKLAMQEFMILPTGANTFTEAMKMGSETYHTLKKIIKDKYGLDATAVGDEGGFAPNIGNPKDALAILNDAIAKAGYTGKXE

SEQ ID NO: 9322 - protein, 150 aa, Hylurdrectonus pinarius
  unsure (1)..(150): unsure at all Xaa locations
FMIKLDGTENKSKFGANAILGVSLAVCKAGAAKRGVPLYRHIADLANNKNIILPVPAFNVINGGSHAGNKLAMQEFMILPTGANTFTEAMKMGSETYHTLKKIIKDKYGLDATAVGDEGGFAPNIGNPKDALAILNDAIAKAGYTGKXEM

SEQ ID NO: 9323 - protein, 155 aa, Hylurgonotus antipodus
  unsure (1)..(155): unsure at all Xaa locations
EXDEXMXKLDGTENKSNFGANAILGVSLAVCKAGAAKRGLPLYRHIADLAGNKNLILPVPAFNVINGGSHAGNKLAMQEFMIFPTGACSFTEAMKMGSETYHTLKKIIKDKYGLDATAVGDEGGFAPNIGNPKDALAILNDAIAKAGYTGKIEIA

SEQ ID NO: 9324 - protein, 149 aa, Hylurgus micklitzi
  unsure (1)..(149): unsure at all Xaa locations
XMXNLDGTENKSKFGANAILGVSLAVCKAGAAKRGLPLYRHIADLAGNKNLILPVPAFNVINGGSHAGNKLAMQEFMILPTGACSFTEAMKMGSETYHTLKKIIKDKYGLDATAVGDEGGFAPNIANPKDALTILNDAIAKAGYTGKIE

SEQ ID NO: 9325 - protein, 183 aa, Pachycotes sp. hlt29
  unsure (1)..(183): unsure at all Xaa locations
DXKSXFGANAILGXSLAVAKAGAAKRGVPLYRHLADXAGNKNIILPVLXSNVIXGGXXAXNKLAMQEFMILPTGAXNFTEAMKMGXETYHHLKKVIKDKFGLDATAVGDEGGXAPNIGNNKDALDLINDAIAKAGYTGKIDIGMDVAASEFYKDGQYDLDFKNPNXDKSKWLSGEKLQGLYQE

SEQ ID NO: 9326 - protein, 179 aa, Sinophloeus porteri
  unsure (1)..(179): unsure at all Xaa locations
KLEGTENKANFGANAILGVSXAVCKAGAAKRGVPXYRHIADLACNKNIIFPVPAFNVINGGFHAGNKLAMQEXMIFPTGANSFTEAMKMGSETYHTLKKIIKDKYGLDATAVGDEGGFAPYISNPKDAXTIFNDAIGKXGYTGKIEIGMDIAASEFYKDGLYDLDFKNPKSDKKXWIKX

SEQ ID NO: 9327 - protein, 301 aa, Plasmodium falciparum
MSVLHRFYLFFLFTKFFHCYKISYVLKNAKLAPNHAIKNINSLNLLSENKKENYYYCGENKVALVTGAGRGIGREIAKMLAKSVSHVICISRTQKSCDSVVDEIKSFGYESSGYAGDVSKKEEISEVINKILTEHKNVDILVSNAGITRDNLFLRMKNDEWEDVLRTNLNSLFYITQPISKRMINNRYGRIINISSIVGLTGNVGQANYSSSKAGVIGFTKSLAKELASRNITVNAIAPGFISSDMTDKISEQIKKNIISNIPAGRMGTPEEVANLACFLSSDKSGYINGRVFVIDGGLSP

SEQ ID NO: 9328 - protein, 218 aa, Ipomoea batatas
MGRGKVEIRRIEKSTNRRVTFWKRRNGLLKKAMEMGILCDAEVGLMIFSSTGKLHEFATTSIRSVIERYNKTQGDSLQSPLDPTLELKFWQIEVAILRQQLHNMQEDHRKVMGEVYGLSVKDLQNLENQLEMSLSGIRMKKEQILIEQIQELTHKQGSFVHQENFELFNKFQAYGTSDPNAVNGDTISPYDFTISEESQGHIHFQLPQNFSDLARALY

SEQ ID NO: 9329 - protein, 501 aa, Arabidopsis thaliana
MNSESLENLHRPLIESSKSFVDYRLETVLTDRELPYFRRIYLAMMIEMKFLFHLAAPAIFVYVINNGMSILTRIFAGHVGSFELAAASLGNSGFNMFTYGLLLGMGSAVETLCGQAHGAHRYEMLGVYLQRSTVVLILTCLPMSFLFLFSNPILTALGEPEQVATLASVFVYGMIPVIFAYAVNFPIQKFLQSQSIVTPSAYISAATLVIHLILSWIAVYRLGYGLLALSLIHSFSWWIIVVAQIVYIKMSPRCRRTWEGFSWKAFEGLWDFFRLSAASAVMLCLESWYSQILVLLAGLLKNPELALDSLAICMSISAISFMVSVGFNAAASVRVSNELGAGNPRAAAFSTVVTTGVSFLLSVFEAIVVLSWRHVISYAFTDSPAVAEAVADLSPFLAITIVLNGIQPVLSGVAVGCGWQAFVAYVNIGCYYVVGIPVGFVLGFTYDMGAKGIWTGMIGGTLMQTIVLVIVTLRTDWDKEVEKASSRLDQWEESREPLLKQ

SEQ ID NO: 9330 - protein, 187 aa, Fragaria x ananassa
MRKPCCEKTETTKGAWSIQEDQKLIDYIQKHGEGCWNSLPKAAGLRRCGKSCRLRWINYLRPDLKRGSFGEDEEDLIIRLHKLLGNRWSLIAGRLPGRTDNEVKNYWNSHLKKKILKTGTTLRPNKPHENNHAPNNKLVKLFNKMDDEVVDEVSSADSAAGCLVPELNLDLTLSIKTSTGMADPQVA

SEQ ID NO: 9331 - protein, 555 aa, Homo sapiens
MVLRSGICGLSPHRIFPSLLVVVALVGLLPVLRSHGLQLSPTASTIRSSEPPRERSIGDVTTAPPEVTPESRPVNHSVTDHGMKPRKAFPVLGIDYTHVRTPFEISLWILLACLMKIGFHVIPTISSIVPESCLLIVVGLLVGGLIKGVGETPPFLQSDVFFLFLLPPIILDAGYFLPLRQFTENLGTILIFAVVGTLWNAFFLGGLMYAVCLVGGEQINNIGLLDNLLFGSIISAVDPVAVLAVFEEIHINELLHILVFGESLLNDAVTVVLYHLFEEFANYEHVGIVDIFLGFLSFFVVALGGVLVGVVYGVIAAFTSRFTSHIRVIEPLFVFLYSYMAYLSAELFHLSGIMALIASGVVMRPYVEANISHKSHTTIKYFLKMWSSVSETLIFIFLGVSTVAGSHHWNWTFVISTLLFCLIARVLGVLGLTWFINKFRIVKLTPKDQFIIAYGGLRGAIAFSLGYLLDKKHFPMCDLFLTAIITVIFFTVFVQVLGQGRAGPCLGDPHRLFPWKERKACDLKCDSSPSSTTNLLCDLGRATPPFWASVSSIVK

SEQ ID NO: 9332 - protein, 407 aa, Triticum monococcum
MAAVAMADGGGKKPYVVAVAIQAINTGTFVVSKAAFDSGMYTYIFVFYRLAAATALLVPIALINCACRRSQSTTSTPAQAMSCRLLFKLFLCAFLGSAGLTLQALTKFVKKSCQEVGGFTSLLSSSLLQGKAEHLHPQVYHASLKQTSATVASAATNSMPVVTFLLALVLRMETIKLRRRSGLGKLAGVALCLAGVLVIAFYVGPSIRPLAHHPVFAHKTQSVGNGAWIRGTFLLILSCTTWSLWITLQVPLLIEYPNKLMATAMQCLFSALQSFVVAVVVEKDFTKWKLGLDIGLLAAFLGTGALMYLQAWCAEMSGPVFVVMWSPLAFIFTIFSSSFFLGEVVHLGSILGGILLVGGLYSVLWGKSNERKNMILPVMPEKSQGQGDGDGATTQEKHGETNLTSQV

SEQ ID NO: 9333 - protein, 791 aa, Yersinia enterocolitica
MLMKFLYKIYLTWALTLLSSTAVYAAEAIVFSPQELDYIKTHPVVNYGIFPNSYPIEKFNSIGEHIGLTRDYIDIISTVTGIKFKPVFSNNDRESVTNLQSGKISLLTSTSISFAQTHGLISSVPIFTTWPLTVTRKATRHIATPDDLMEGYVSITDYSSLIEWFTKQFPGVNYKIVYSPEETIAEVINRQAEAAVVLSPTALYYMNVKYPGQLKISRPHSAKISLAMAAHPEDQILINIINKAIASISAKQQAELTAKWIISDTNIPLPKDYKLTFYVGGLATALLCLLLFVFYRYRRLKMELVRLGSKNNLELSVIAHELRTPLIGILTACEGLVDKIVSTSQRERLANVIHVTRELLDNLDLSLDNAKINAGSVTQNPQPQLLAELCDTTVKLFISFAETHGTTLQVRYQSKQFFLPHLFDGTLVSQALNNIVSNAIKHTHDGMVLIECSLLQVDGKNMFSIEVIDTGTGIPSKVLARLSEPFYQGKFSRTDSDTPHPKGTGLGLFVAKKNMHLTGGHLAIVSQPGVGSRVTIALPAIAAHYAIENPLPEGLHIIMPTEIPSSLSGEITQILDGCELPYYSAAEPLPAAARGPEIDLQLDVAQKHWQLHHKQGDSVIIPRPVYASALYLAITDLCNEEQPLESSSDSPELHLPTTIITESRRLLVVEDEPLLLEVQYELFSSMGFQVDAVANTQQAYQSWLQHHHTIIVTDCRLDESDGFELVRHLRKLMQDSPEPVLIIGQSASLKTEDAQRAREVGMDYLLQKPVAREQWQQLIRDYFASKEKEHD

SEQ ID NO: 9334 - protein, 168 aa, Tripsacum dactyloides
APLDKVCVLSCGISTGLGASINVAKPPKGSTVAVFGLGAVGLAAAEGARIAGASRIIGVDLNPSRFEEEFVNPKDHNKPVQEVLAEMTNGGVDRSVECTGNINAMIQAFECVHDGWGVAVLVGVPHKDAEFKTHPMNFLNERTLKGTFFGNYKPRTDLPNVVELYMKK

SEQ ID NO: 9335 - protein, 203 aa, Oryza sativa (japonica cultivar-group); identical to SEQ ID NO: 3528

SEQ ID NO: 9336 - protein, 741 aa, Fragaria x ananassa
MEACNCIEPQWPADELLIKYQYISDFFIALAYFSIPLELIYFVKKSAVFPYRWVLVQFGAFIVLCGATHLINLWTFNMHSRTVAIVMTTAKVLTAVVSCATALMLVHIIPDLLSVKTRELFLKNKAAELDREMGLIRTQEETGRHVRMLTHEIRSTLDRHTILKTTLVELGRTLALEECALWMPTRTALELQLSYTLRQQNPVGHTVPIHLPVINQVFSSNRAVKISPNSPVARLRPLVGKHMPGEVVAVRVPLLHLSNFQINDWPELSTKRYALMVLMLPCDSARQWHVHELELVEVVADQVAVALSHAAILEESRRARDLLMEQNIALDLARREAETAIRARNDFLAVMNHEMRTPMHAIIALSSLLQETELTPEQRLMVETILKSSNLLATLINDVLDLSRLEDGSLQLDIATFNLHSVFIEVHNLVKPVASVKKLSVTLNLAADLPVYAIGDERRLLQIILNVVGNAVKFSKEGSISITAFVAKSESLRDFRAADFFPVQSDNHFYLRVQVKDSGSGINPQDLPKLFTKFAQNQSLATRNSGGSGLGLAICKRFVNLMEGHIWIESDGLGKGCTTTFIVKLGYPERSNESKLPFVPKMHTTHVQTNFPGLKVLVMDDNGVSRSVTKGLLEHLGCDVTTVSSSDEFLQVISQEHKVVFMDVCMPGIDGFELAVQIHEKFTKRHERPVLVALTGNINKMTKESCMRVGMEGVILKPVSVDKMRSVLSELLEHRVLFEAM

SEQ ID NO: 9337 - protein, 633 aa, Fragaria x ananassa
MMESCDCVEAQWPPDELLVKYQYISDVFIALAYFSIPLELIYFVHKSAFFPYRWVLMQFGAFIVLCGATHFINVWTFSMHTKTVAIVMTIAKVSCAVVSCATALMLVHIIPDLLSVKTREIFLKNKAEELDREMGLILTQEETGRHVRMLTHEIRSTLDRHTILKTTLVELGRTLGLEECALWMPCRSGMNLQLSHTLNYDAQIGSTVPFSLPIVNEVFKSSQAMRIPYTCPLARIRPLVGRYMQPEIVALRVPLLNHSNFQMNDWPDVYAIMVLILPTDSTRKWRDHELELVDVVADQVAVALSHAAIVEESMRASDQLVEQNVALDLARREAELAIRARNDFLAVLNHEMRTPMHAIIALSSLLLETELTPDHRVMIESVLKNSNLLETLINDVLDLSRLEDGSLDLDIGKFNLHGVFREAIDLIKPIATVKKLSMTLILAPDVPVCAVGDENRLMQTILNVAGNAVKFTKEGYVSVIASIARPESSRDWRPPEFYPAPSDGHFYLRVQVKDSGSGILPQDIPRIFTKFTQPRNGSNRVNDGAGLGLAICKRFVNTMGGHIWIESEGIDKGTLVVFIVKLSICDSCSTTIAHQTVPKGEANHGSADLIGYKPALRDGYGLASTNARYQRSL

SEQ ID NO: 9338 - protein, 503 aa, Pisum sativum
MDIPIPTRQLFINGDWKAPVLNKRIPVINPATQNIIGDIPAATKEDVDVAVAAAKTALTRNKGADWATASGAVRARYLRAIAAKVTEKKPELAKLESIDCGKPLDEAAWDIDDVAGCFEYYADLAEKLDARQKAPVSLPMDTFKSHVLREPIGVVGLITPWNYPMLMATWKVAPALAAGCAAILKPSELASLTCLELGEICKEVGLPRSVLNIVTGLGHEAGAPLASHPDVDKISFTGSSATGSKIMTTAAQLVKPVSLELGGKSPLVVFEDVDLDKAAEWAIFGCFWTNGQICSATSRLILHESIATEFLNRIVKWIKNIKISDPLEEGCRLGPVVSEGQYEKILKFVSNAKSEGATILTGGSRPEHLKKGFFIEPTIITDVTTNMQIWREEVFGPVLCVKTFSTEEEAIDLANDTVYGLGAAVISNDLERCERVTKAFKAGIVWVNCSQPCFTQAPWGGVKRSGFGRELGEWGLDNYLSVKQVTQYISEEPWGWYQPPAKL

SEQ ID NO: 9339 - protein, 335 aa, Pseudomonas putida
MALSKEVPEFDIDDDVLLMETGIVLETDVVSDEPAVSSVRTRAKSGSSLKQHKYIDYSRALDATQLYLNEIGFSPLLSPEEEVHFAPLVQKGDPAGRKRMMQSNLRLVVKIARRYVNRGLSLLDLIEEGNLGLIRAVEKFDPERGFRFSTYATWWIRQTIERAIMNQTRTIRLPIHVVKELNVYLRAARELTQKLDHEPSPEEIATLLEKPVAEVKRMLGLNERVSSVDVSLGPDSDKTLLDTLTDDRPTDPCELLQDDDLSQSIDQWLGELTDKQREVVVRRFGLRGHESSTLEDVGLEIGLTRERVRQIQVEGLKRLREILEKNGHTSESLFQ

SEQ ID NO: 9340 - protein, 635 aa, Candida glabrata
MMVPLLLSTYFITAVYGATHTFHWTTGWGNRNVDGIKERPVITCNGEYPWPDVRVAKGDRIEVYLTNGFNNTNTSLHFHGMFQRGTNQMDGVPYLTQCPIGPGDTMLYNFTVDENVGTYWYHSHTDGQYEDGMRGLFVIEDGENNKNFPYEYDEDVMLSIGEWYDTTVDVLTRKFLNLNNPTGAEPIPQNLILNNTMNLTWEVQPDTTYLLRIVNVGGFVSQYFWIEDHEMEVVEVDGVYVEKNTTNMLYITVAQRYAVLVHTKNDTSKNFAIMQKFDDTMLDVIPKDLQLNATSYLVYDKSKPMPEQNYVDSIDDYLDDFYLVPMDKEELYPEADHVITIDVIMDNLINGVNYAFFNNITYTTPKVPTLLTVLSAGQDALNPFIYGTNTNTFVLKKGEVVDLIVNNQDTGKHPFHLHGHVFQTILRDREFDDAKGEKPHSFNDSDHAAYPSIPMKRDTVYLNPQSNMVLRFKADNPGVWFFHCHIEWHLLQGLAVVMVEDPISIQNTASQHLTANGLQVCGNVKVPTQGNAAANDSDFFNLEGQNVQHKSIPTGFTKKGIIAMTFSCLAGVLGITMIAIYGFSEIPEPEIKVMRNLHLNPEDVLEKTSSSSVISASNSSSLEDSRNQKKKFIFF

SEQ ID NO: 9341 - protein, 355 aa, Blumeria graminis
MSTRAPNATTGSRKISFNVSEQYDIQDVVGEGAYGVVCSALHKPTGQKVAIKKITPFDHSMFCLRTLREMKLLRYFNHENIISILDIQKPRSFDSFTEVYLIQELMETDMHRVIRTQDLSDDHCQYFIYQTLRALKAMHSANVLHRDLKPSNLLINANCDLKVCDFGLARSAASQEDCSGFMTEYVATRWYRAPEIMLTFKEYTKAIDVWSVGCILAEMLSGKPLFPGKDYHHQLTLILDVLGTPTMEDYYGIKSRRAREYIRSLPFKKKIPFKQMFPKTSDLALDLLEKLLAFNPVKRITVDEALQHPYLEPYHDPEDEPTADPIPEEFFDFDKNKDNLSKEQLKELIFQEIMR

SEQ ID NO: 9342 - protein, 503 aa, Hordeum vulgare subsp. vulgare
MVAPAKIPQRQLFIDGEWRAPALGRRLPVINPTTEVSIGEIPAGTSEDVDAAVAAARAALKRNRGRDWSRAPGAVRAKYLRAIAAKMIERKSDLARLEALDCGKPLDEAAWDMDDVAGCFEFFAGHAEALDKRQNAAVALPENFKCHLKKEPIGVVALITPWNYPLLMAVWKVAPALAAGCTAVLKPSELASVTCLELGDVCKEVGLPSGVLNIVTGLGNEAGAPLSSHPDVDKVAFTGSYATGQKIMVAAAPTVKPVTLELGGKSPIVVFDDVDIDKAVEWTLFGCFWTNGQICSATSRLLIHKNIAKEFVDRMVAWSKNIKVSDPLEEGCRLGPVVSEGQYEKIKKFVANAKTEGATILTGGVRPKHLEKGFFIEPTIITDINTSMEIWREEVFGPVLCVKEFSTEEEAIELANDTHYGLAGAVISGDRERCQRLAEEIEAGCIWVNCSQPCFCQAPWGGNKRSGFGRELGEGGIDNYLSIKQVTEYTSDAPWGWYKAPAN

SEQ ID NO: 9343 - protein, 506 aa, Hordeum vulgare subsp. vulgare
MAAPPAIPRRGLFIGGGWREPTLGRRIPVINPATEDTIGDIPAATAEDVELAVAAARSAFLLDGGSRWARASGATRAKYLNAIAAKIKEKISYLALLETVDSGKPKDEAVADMDDVAACFEYYAALAEALDGKQHAPISLPMEEFKTYVLKEPIGVVGLITPWNYPLLMATWKVAPALAAGCTAVLKPSELASLTCLELGAICEEIGLPSGVLNIITGLGPDAGAPIASHPHVDKIAFTGSTATGKTIMTAAAQMVKPVSLELGGKSPLVIFDDVADIDKAVEWAMFGCFFNGGQVCSATSRLLLHEKIAERFLDRLVEWAKNIKISDPLEEGCRLGSVISKGQYEKIKKFISTARSEGATILHGGDRPKNLGKGFFIEPTIITGVSTSMQIWREEVFGPVICVKVFKTESEAVELANDTHYGLAGGVISDDLERCERIAKVIHSGIVWINCSQPTLVQAPWGGNKRSGFGRELGEWGLENYLSVKQVTRYCKDELYGWYQRPSKL

SEQ ID NO: 9344 - protein, 256 aa, Phaseolus vulgaris
MDATTPSELPPGFRFHPTDEELIVYYLCNQATSKPCPASIIPEVDLYKFDPWELPDKTEFGENEWYFFSPRDRKYPNGVRPNRATVSGYWKATGTDKAIYSGSKLVGVKKSLVFYKGRPPKGDKTDWIMHEYRLAESKQPVNRKIGSMRLDDWVLCRIYKKKNTGKTLEHKETHPKVQMTNLIAANNDEQKMMNLPRTWSLTYLLDMNYLGPILSDGSYCSTFDFQISNANIGIDPFVNSQPVEMANNYVSDSGKY

SEQ ID NO: 9345 - protein, 259 aa, Phaseolus vulgaris
EGCVEEPGHHAEKKRRLSVDQVKALEKNFEVENKLEPDRKVKLAQELGLQPRQVAVWFQNRRARWKTKQLERDYGVLKANYDSLKLNYDTLQQDNEALLKEIKELKSRLLLQEESNTESDVSVKEEMITLQDSNPLCETAIPGSESKELSYECFNKSDEVLGFKDGSSDSDSSAILNEENANNNDNSPNNATISSSGAMQSQSFLSSSSPMNCFQFQKQFPTQYVKMEEHNFLSADEACNFFSDEQAPTLQWYCSEEWS

SEQ ID NO: 9346 - protein, 224 aa, Phaseolus vulgaris
EQMPEKKHRLSSEQVHLLEKSFEEENKLEPERKTQLAKKLGLQPRQVAVWFQNRRARWKTKQLERDFDVLKSSYDTLLSSYDSLMKDNEKLKSEVVSLNEKLQDQAKEVPEEPFYDKKVDPLPVEDIATIFSTRVEDHQSSGSVGSAVVDEGSPQLVVDSVDSYLPADNPGGCVGPVERIQSEEEDGSDDGRSYMDVFVVSETENQNHEEGEALVWWTNMYYVE

SEQ ID NO: 9347 - protein, 925 aa, Homo sapiens
MASAVRGSRPWPRLGLQLQFAALLLGTLSPQVHTLRPENLLLVSTLDGSLHALSKQTGDLKWTLRDDPVIEGPMYVTEMAFLSDPADGSLYILGTQKQLGLMKLPFTIPELVHASPCRSSDGVFYTGRKQDAWFVVDPESGETQMTLTTAGPSTPRLYIGRTQYTVTMHDPRAPALRWNTTYRRYSAPPMDGSPGKYMSHLASCGMGLLLTVDPESGAVLWTQDLGMPVMGVYTWHQDGLRQLPHLTLARDTLHFLALRWGHIRLPASGPQDTATLFSALDTQLLMTLYVGKDETGFYVSKALVHTGVALVPRGLTLAPTDGPTTDEVTLQVSGEREGSPSTAVRYPSGSVALPSQWLLIGHHELPPVLHTTMLRVHPTPGSGTAETRPPENTQAPAFFLELLSLSREKLWDSELHPEEKIPDSYLGLGPQDLLAASLTAVLLGGWILFVMRQQPQVVEKQQETPLVPADTADISQDAQSLHSGVTLRSKKRLQSPSKQAQPLDDPEAEQLTVVGKISFNPKDVLGHGAGGTFVFRGQFEGRAVAVKRLLRECFGLVRREVQLLQESDRHPNVLRYFCTERGPQFHYIALELCRASLQEYVENPDLDRGGLEPEVVLQQLMSGLAHLHSLHIVHRDLKPGNILITGPDTQGLGRVVLSDFGLCKKLPAGRCSFSLHSGIPGTEGWMAPELLQLLPPNSPTSAVDIFSAGCVFYYVLSGGSHPFGDSLYRQANILTGVPCLAHLEEEVHDKVVARDLVAAMLSLLPQARPSAPQVLAHPFFWSRAKQLQFFQDVSDWLEKESEQEPLMRALEAGGCTVVRDNWHEHISMPLQIDLRKFRSYKGTSVRDLLRAVRNKKHHYRELPVEVRQALGQVPDGFVQYFTNRFPQLLLHTHRVMRSCASESLFLPYYPPDSEARGPCPGAAGR

SEQ ID NO: 9348 - protein, 316 aa, Glycyrrhiza glabra
MAAAAIEIPTKVLPNSTCELRVPVIGMGSAPDFTCKKDTKEAIIEAIKQGYRHFDTAAAYGSETALGEALKEARDLGLVTREDLFVTSKLWVTENHPHLVVPALRKSLETLQLEYLDLYLIHWPLSSQPGKFSFPIQAEDLLPFDVKGVWESMEESLKLGLTKAIGVSNFSVKKLQNLLSVATIRPAVNQVEMNLAWQQKKLREFCNANGIVLTAFSPLRKGASRGPNEVMENDMLKGIAEAHGKSIAQVSLRWLYEQGVTFVAKSYDKERMNQNLQIFDWELTTEDHQKIDQIKQNRLIPGPTKPQLNDLWDDEI

SEQ ID NO: 9349 - protein, 315 aa, Glycyrrhiza glabra
MAAAIEIPTKVLPNSTCELRVPVIGMGSAPDFTCKKDTKEAIIEAIKQGYRHFDTAAAYGSETALGEALKEARDLGLVTREDLFVTSKLWVTENHPHLVVPALRKSLETLQLEYLDLYLIHWPLSSQPGKFSFPIQAEDLLPFDVKGVWESMEESLKLGLTKAIGVSNFSVKKLQNLLSVATIRPAVNQVEMNLAWQQKKLREFCNANGIVLTAFSPLRKGASRGPNEVMENDMLKGIAEAHGKSIAQVSLRWLYEQGVTFVAKSYDKERMNQNLQIFDWELTTEDHQKIDQIKQNRLIPGPTKPQLNDLWDDEI

SEQ ID NO: 9350 - protein, 368 aa, Pseudomonas putida
MEMEIKAAIVRQKNGPFLLEHVALNEPAEDQVLVRLVATGLCHTDLVCRDQHYPVPLPMVFGHEGAGVVERVGSAVKKVQPGDHVVLTFYTCGSCDACLSGDPTSCANSFGPNFMGRSVTGECTIHDHQGAEVGASFFGQSSFATYALSYERNTVKVTKDVPLELLGPLGCGIQTGAGSVLNALNPPAGSAIAIFGAGAVGLSAVMAAVVAGCTTIIAVDVKENRLELASELGATHIINPAANDPIEAIKEIFADGVPYVLETSGLPAVLTQAILSSAIGGEIGIVGAPPMGATVPVDINFLLFNRKLRGIVEGQSISDIFIPRLVELYRQGKFPFDKLIKFYPFDEINRAAEDSEKGVTLKPVLRIG

SEQ ID NO: 9351 - protein, 171 aa, Helicobacter pylori
MLDLFYSLERVLQEDPAARNKWEVLLLYPGIHALLCYRLAHALHKRRFYFIARALSQLARFITGIEIHPGAKIGRGLFIDHGMGVVIGETTEIGDDVTIYHGVTLGGTGRFKGKRHPTLGNRVVVGAGAKVLGAICVGDDVKIGANAVVLSDLPTGSTAVGTKAKTITKDR

SEQ ID NO: 9352 - protein, 366 aa, Clostridium perfringens
MKAKTTKAKKGEGKEKVDKMVLVKRLIDKGKKSGSLTYKEIMDELDEIELNPEQIEKIYEVLESMGIEVISEIEQEEEEEEELDLSVPEGIAIDDPVRMYLKEIGKVQLLSSEDEIELAKKIEEGSNYAKKKLAEANLRLVVSIAKRYVGRGMLFLDLIQEGNLGLIKAVEKFDYRKGYKFSTYATWWIRQAITRAIADQARTIRIPVHMVETINKLIRIQRQLVQELGRDPLPEELSKQMDMPVDKVREILKIAQEPVSLETPIGEEEDSHLGDFIPDDDAPAPAEAAAFTMLKEQLINVLDTLTPREEKVLRLRFGLDDGRARTLEEVGKEFNVTRERIRQIEAKALRKLRHPSRSKKLKDYLD

SEQ ID NO: 9353 - protein, 1571 aa, Drosophila melanogaster
MSNRRRVRTIDYLALQQSLRLQKTPAATTNAEEQVAREEENGNGHHSTVTAETPPTPPIPPIPPIRLRREQSVEEDVARVEYRVKQTPSRPVQMTRNRIGALEEDLPPEDELAAHYEAFGTTPPRTRLKIKNRDWERKQKVVNVTASADLPASVGGTPKKTRTARSRVLRRNTMDCALLNEMFVNDESKRTDKRLQSLLRDSEREMKNSLATTAVAAPRGNSFHETAHPLESLDQIMPLNSEAMAPIPLRIASKVVESCNRYRCVSSRPIGYRSSAPPLAFAAQLPAGMLRSDGRATPGLGKRKDFHETFANLIKLGSVDRQDAKLSQEEHTWQTELKDLIWLELQAWQADRTVEQQDKYLFEARQGVSDLLTHIINYKFQPRYRREPSLISLDSGTHSDSNSNASSPLPSKMCQGCMSLYCKDCMDHQKLALREVEGMLTRLEAAEALYPSSQAMGALHPIYKSQSFVGRIKSMCLWYNITKQNKLKLSILGKILARLQDEKFSWPVCTSSYIATDSGSSSASGVENDDSAVNSMDSSKPPSMAGSASRKGVTPCHKVQFMLNDATHVPGETSSSNESTSTEVSQWSSECSHSHMRKGSMHDINIFSVEPLGTCSSNGTGEQSTGLYRKFIENVLKSRGLAKSLAFLHKLHNVALYKAHIALEKPGAEDFDYESDAESIEEDVPRLDPEISREQVVELRTYGYWSEEAQSINLPSYIPTFVFLSGIPLQFMHEFLRMRLETRPVRPNPLSLEQLMKELREGLTLALTHRERYQRHITTALVENEAELGSYISILNHYDATVRKTFELYLEYIDQLVLVAVPEGNQKSVLEKEWMFTKLISPMIKGMHTLASQKFCGIISKLLRSISERLVKRTVELDQQIDGTADTDDNEEVKWQLLTICRETQSLLTVERERSIKVLFFAKTFCRDVETTDFHREHYEHDVANQQHDFICSDVKAAFKLLQQDVLQVRNKLTAIIEGVQKRCCLSNMRDLDEQDKQAVLSRTREILHQGYKFGFEYHKDVIRLFEQKIMDQKDSGAHTVDLALGIIAYAKMWMHFVMERCERGRGMRPRWASQGLEFLILACDPQITQHLDDDEFEALKQQMDRCISHVIGITSEPEKVAKKKASPRTRKTSSPATSRSRTPTRTPMSAGMVLNPNTPPLQSPPYNKLLHPQFSLKEDVSGTSYSPVDSSDYVDTPCQRSANGELRLLVPQTPPTPASPGKSSLESTPLALRQERVRDAVNRLDMDLEDGLRERRLIGQVKSLNSSDKVHIRARSVHFRWHRGIKIGQGRFGKVYTAVNNNTGELMAMKEIAIQPGETRALKNVAEELKILEGIKHKNLVRYYGIEVHREELLIFMELCSEGTLESLVELTGNLPEALTRRFTAQLLSGVSELHKHGIVHRDIKTANIFLVDGSNSLKLGDFGSAVKIQAHTTVPGELQGYVGTQAYMAPEVFTKTNSDGHGRAADIWSVGCVVVEMASGKRPWAQFDSNFQIMFKVGMGEKPQAPESLSQEGHDFIDHCLQHDPKRRLTAVELLEHNFCKYGRDECSSEQLQMQVRGSFRRNVATSSS

SEQ ID NO: 9354 - protein, 1497 aa, Drosophila melanogaster
MRRKKVEYRVKQTPSRPVQMTRNRIGALEEDLPPEDELAAHYEAFGTTPPRTRLKIKNRDWERKQKVVNVTASADLPASVGGTPKKTRTARSRVLRRNTMDCALLNEMFVNDESKRTDKRLQSLLRDSEREMKNSLATTAVAAPRGNSFHETAHPLESLDQIMPLNSEAMAPIPLRIASKVVESCNRYRCVSSRPIGYRSSAPPLAFAAQLPAGMLRSDGRATPGLGKRKDFHETFANLIKLGSVDRQDAKLSQEEHTWQTELKDLIWLELQAWQADRTVEQQDKYLFEARQGVSDLLTHIINYKFQPRYRREPSLISLDSGTHSDSNSNASSPLPSKMCQGCMSLYCKDCMDHQKLALREVEGMLTRLEAAEALYPSSQAMGALHPIYKSQSFVGRIKSMCLWYNITKQNKLKLSILGKILARLQDEKFSWPVCTSSYIATDSGSSSASGVENDDSAVNSMDSSKPPSMAGSASRKGVTPCHKVQFMLNDATHVPGETSSSNESTSTEVSQWSSECSHSHMRKGSMHDINIFSVEPLGTCSSNGTGEQSTGLYRKFIENVLKSRGLAKSLAFLHKLHNVALYKAHIALEKPGAEDFDYESDAESIEEDVPRLDPEISREQVVELRTYGYWSEEAQSINLPSYIPTFVFLSGIPLQFMHEFLRMRLETRPVRPNPLSLEQLMKELREGLTLALTHRERYQRHITTALVENEAELGSYISILNHYDATVRKTFELYLEYIDQLVLVAVPEGNQKSVLEKEWMFTKLISPMIKGMHTLASQKFCGIISKLLRSISERLVKRTVELDQQIDGTADTDDNEEVKWQLLTICRETQSLLTVERERSIKVLFFAKTFCRDVETTDFHREHYEHDVANQQHDFICSDVKAAFKLLQQDVLQVRNKLTAIIEGVQKRCCLSNMRDLDEQDKQAVLSRTREILHQGYKFGFEYHKDVIRLFEQKIMDQKDSGAHTVDLALGIIAYAKMWMHFVMERCERGRGMRPRWASQGLEFLILACDPQITQHLDDDEFEALKQQMDRCISHVIGITSEPEKVAKKKASPRTRKTSSPATSRSRTPTRTPMSAGMVLNPNTPPLQSPPYNKLLHPQFSLKEDVSGTSYSPVDSSDYVDTPCQRSANGELRLLVPQTPPTPASPGKSSLESTPLALRQERVRDAVNRLDMDLEDGLRERRLIGQVKSLNSSDKVHIRARSVHFRWHRGIKIGQGRFGKVYTAVNNNTGELMAMKEIAIQPGETRALKNVAEELKILEGIKHKNLVRYYGIEVHREELLIFMELCSEGTLESLVELTGNLPEALTRRFTAQLLSGVSELHKHGIVHRDIKTANIFLVDGSNSLKLGDFGSAVKIQAHTTVPGELQGYVGTQAYMAPEVFTKTNSDGHGRAADIWSVGCVVVEMASGKRPWAQFDSNFQIMFKVGMGEKPQAPESLSQEGHDFIDHCLQHDPKRRLTAVELLEHNFCKYGRDECSSEQLQMQVRGSFRRNVATSSS

SEQ ID NO: 9355 - protein, 330 aa, Pectobacterium carotovorum
MSQSTLKVNELHEDTDFEENGLDVFDDKALAEEDTNDNDSAEDELLSQGVPQRVLDATQLYLGEIGYSPLLTAEEEVYFARRALRGDVPSRRRMIESNLRLVVKIARRYNNRGLALLDLIEEGNLGLIRAVEKFDPERGFRFSTYATWWIRQTIERAIMNQTRTIRLPIHIVKELNVYLRTARELSHKLDHEPSAEEIAEQLDKPVDDVNRMLALNERITSVDTPLGGDSEKALLDILADEKDNGPEDTTQDNDMKQNIVKWLFELNAKQREVLARRFGLLGYEAATLEDVGREIGLTRERVRQIQVEGLRRLREILQVQGLSIEELFRE

SEQ ID NO: 9356 - protein, 333 aa, Heliobacillus mobilis
MTADQVDDVYEQLGNMGIDVVSEPAEAESMEKAEEPIIRESEEEEEEIEVDLSVPEGVGIDDPVRMYLKEIGRVPLLSAEEEIELAKRMEDGDEEAKRRLAEANLRLVVSIAKRYVGRGMLFLDLIQEGNLGLIKAVEKFDYTKGYKFSTYATWWIRQAITRAIADQARTIRIPVHMVETINKLIRVSRQLLQEFGREPNPEEIAKEMDIPVDRVREIMKIAQEPVSLETPIGEEEDSHLGDFIEDQDAPAPAEAASFILLKEQLEEVLETLTAREMKVLRLRFGLDDGRSRTLEEVGQEFGVTRERIRQIEAKALRKLRHPSRSKKLKDYVD

SEQ ID NO: 9357 - protein, 666 aa, Rhodobacter sphaeroides
MAVKDTDDGKPEDQDAETSLDMSQAAVKRMIAEAERGYITYDQLNTVLPQDQVSSEQIEDVMAMLSEMGINVIENEEAEEGEPAGELVEQGSGSREIAVAGTQGETLDRTDDPVRMYLREMGSVELLSREGEIAIAKRIEAGRNTMIAGLCESPLTFQAITIWRDELLSEDILLRDVIDLEATFGRSLDGDGDDEIDGPEIDEVEVAAARAAPRRSTSSEPELDADGNPISRAEEEDEDDEASAMSLAAMEAALKPRVLETLELIARDYGKLAEMQNRRMSATLNDHIRFTTEDEAAYQKLRSEIVLLVNELHLHNNRIEALIDQLYGINRKIMSINSAMVKLADAARINRREFIDEYQGYELDPMWAERMAAKVGRGWQTLMEKSRDRVEDLRGEMAQVGQYVGVDISEFRRIVNQVQKGEKEARQAKKEMVEANLRLVISIAKKYTNRGLQFLDLIQEGNIGLMKAVDKFEYRRGYKFSTYATWWIRQAITRSIADQARTIRIPVHMIETINKLVRTGRQMLHEIGREPTPEELAEKLQMPLEKVRKVMKIAKEPISLETPIGDEEDSQLGDFIEDKNAILPLDSAIQENLKETTTRVLASLTPREERVLRMRFGIGMNTDHTLEEVGQQFSVTRERLRQIEAKALRKLKHPSRSRKLRSFLDQ

SEQ ID NO: 9358 - protein, 343 aa, Chloroflexus aurantiacus
MLQAEGIKVIESSDELDGRPTDFEPDPDADLIADLPDLGDIAFDDPVRMYLQEIGQVPLLTAEQEVELAKAMEAGAAARQRLDREDTPRPRARFELERAVQQGQDARHHLIQANLRLVVSIAKKYTSYGLTMMDLVQEGNIGLMRAVEKFDYKKGHKFSTYATWWIRQAITRAIADQSRTIRLPVHMGEAISQVKRTSHRLQQTMQRDATPEEIADAMGISAGKVRRTLEASMHPLSLEMPVGQEGEGRMGDFIEDDRISTPAEAPAASLLREQLEEVLMKLPERERKIIQLRYGLKDGRYRTLEEVGIEFGITRERIRQIEAVALRKLRHPHLGKKLRAIWH

SEQ ID NO: 9359 - protein, 346 aa, Chloroflexus aurantiacus
MEPELSAEATELDAEWDGDVDPEPEDLEVAELEPLDDLESEGDFEPVEDSVQLYLQEIGQVPLLTAEEEVELARQYSRGKEARQRLRNEDSPTTANGCGWRWKWLAVKRRGGRIQANLRLVVSVAKKYIGSPMAFMDLVQEGNIGLMRAVEKFDYTKGNRFSTYATWWIRQAVTRAIAEQSRLIRLPVHLSESIVHLRRAIYRLEQELEREPTAEELAHALNMSVRKVKRLIRASTQPISLEQPLNNEQEGRVSETLADETVASPMEIAEQKMLHAELTAALNELPERERKILQLRYGLIDGQRRTLEEVGATFGITRERTRQIEAEALRRLRHPSVGQRLHSYLD

SEQ ID NO: 9360 - protein, 398 aa, Chloroflexus aurantiacus
MTQSQPETDRAAPAINPADLQALIAQGRQQGFVTFEDIQRLVPNPDESIELIDSIYAALAEAGVPVQEGDETALDDEPSSPATMDLDLDDELSDALLSDSVRLYLREIGQVPLLTAEQEKRLAQLIEQGQEAERKLATLPPDSPEAARLKQLKAKGEEARHEMAAANLRLVVSIAKRYRDRGLPLLDLIQEGSLGLLRAIEKFDYTKGYKFSTYATWWIKQALSRALADQSRLVRLPVHLGETLNRIQSARRQLTQSLGREPTDTELANHLGMSEEKLATVRRTAQDPVSLATPVGEEANSTLADFIPDPHALDADDAAASGIVRQQITAALDQLSERERRVLELRYGLVDGQPRTLEEVGKAFGVTRERVRQIEVKALRKLRHPRLGKLLKDYLDQI

SEQ ID NO: 9361 - protein, 299 aa, Chlorobium tepidum
MRQLKISKQITNRESLSLDRYLQEIGKYDLLTARRRGEAHEGHKEGYDMPVDTVEYKRAKRALDKLIKGNLRFVVSVAKQYQNQGLTLGDLINEGNLGLIKAAKRFDETRGFKFISYAVWWIRQSILQALAEQSRIVRLPLNRVGTLNKISKAYSQLEQEYERDPNTKELADLLDMDSQDVADTLKIAGRHVSVDAPFAQGDDNRLLDVLQNDGHMPDYTLNRDSLSLEVERSLSVLAPREADVIRSYFGIGMDNPLTLEEIGEKFKLTRERVRQIKEKAIRRLRQSAYNKVLKEYIGS

SEQ ID NO: 9362 - protein, 376 aa, Macaca fascicularis
MHLLKVGTWRNNTAFSWLIMFGVLWLVSQNCCRASVVWTAYMNISFHVGNHVLSELGETGVFGRSSTLKRVAGVIVPPEGKIQNACNPNTIFSRSKYSETWLALIERGGCTFTQKIKVAAEKGASGVIIYNFPGTGNQVFPMFHQAFEDVVVVMIGNLKGTEIFHLIKKGVLITAMVEVGRKHIIWMNHYLVSFVIVTTATLAYFIFYHIHRLCLARIQNRRWQRLTTDLQNAFGQLQLRVVKEGDEEINPNGDSCVICFEHYKPNDIVRILTCKHFFHKNCIDPWILSHGTCPICKCDILKVLGIQVDVENGTEPLQVLMSSELCETLSPSEEETNNEVSPAGTSDKVIHVEENPTSQNNDSQPHSVVEDVHPSP

SEQ ID NO: 9363 - protein, 468 aa, Macaca fascicularis
MIAMVLSWIFLILLRFIAGCLFWVFMIGVIGIIGYGIRHCYQQYTNLQEHPRSVLTVYDIGIQTNISMYFELQQTWFTLMIILCIIEVIVILMLIFLRNRIRVAIILLKEGSKAIGYVPSTLVYPALTFILLSICICYWVVTAVFLATSGVPVYKVIAPEGHCIHENQTCDPEIFNTTEIAKACPGALCNFAFYGGKSLYHQYIPTFHVYNLFVFLWLINFVIALGQCALAGAFATYYWAMKKPDDIPRYPLFTAFGRAIRYHTGSLAFGSLIIALIQMFKIVLEYLNHRLKRTENTLSKFLQCCLRCCFWCLENAIKFLNRNAYIMIAIYGRSFCRSAKDAFNLLMRNVLKVAVTDEVTYFVLFLGKILVAGSIGVLAFLFFTQRLPVIAQGPASLNYYWVPLLTVILGSYLIAHGFFSVYAMCVETIFICFLEDLERNDGSTARPYYVSQPLLKIFQEENLQTKQQ

SEQ ID NO: 9364 - protein, 376 aa, Macaca fascicularis
MHLLKVGTWRNNTAFSWLIMFGVLWLVSQNCCRASVVWTAYMNISFHVGNHVLSELGETGVFGRSSTLKRVAGVIVPPEGKIQNACNPNTIFSRSKYSETWLALIERGGCTFTQKIKVAAEKGASGVIIYNFPGTGNQVFPMFHQAFEDVVVVMIGNLKGTEIFHLIKKGVLITAMVEVGRKHIIWMNHYLVSFVIVTTATLAYFIFYHIHRLCLARIQNRRWQRLTTDLQNAFGQLQLRVVKEGDEEINPNGDSCVICFELYKPNDIVRILTCKHFFHKNCIDPWILSHGTCPICKCDILKVLGFQVDVENGTEPLQVLMSSELCETLSPSEEETNNEVSPAGTSDKVIHVEENPTSQNNDSQPHSVVEDVHPSP

SEQ ID NO: 9365 - protein, 717 aa, Macaca fascicularis
MNDTEKPADTASEEEDFGDPRTYDPDFKGPVSNRSCTDVLCCMIFLLCIVGYIVLGLVAWVHGDPRRAAYPTDSQGHFCGQKGTPNENKTILFYFNLLRCTSPSVLLNLQCPTTQICVSKCPEKFLTYVEMQLLYTKDKSHWEDYRQFCKTTAKPVKSLTQLLLDDDCPTAIFPSKPFLQRCFPDFSTKNGTLTIGSQIVFQDGNGGTRSVIELRDAANGINKLLDAKSLGLKVFEDYATTWYWILIGLMIAMVLSWIFLILLRFIAGCLFWVFMIGVIGIIGYGIWHCYQQYTNLQEHPRSVLTVYDIGIQTNISMYFELQQTWFTLMIILCIIEVIVILMLIFLRNRIRVAIILLKEGSKAIGYVPSTLVYPALTFILLSICICYWVVTAVFLATSGVPVYKVIAPEGHCIHENQTCDPEIFNTTEIAKACPGALCNFAFYGGKSLYHQYIPTFHVYNLFVFLWLINFVIALGQCALAGAFATYYWAMKKPDDIPRYPLFTAFGRAIRYHTGSLAFGSLIIALIQMFKIVLEYLNHRLKRTENTLSKFLQCCLRCCFWCLENAIKFLNRNAYIMIAIYGRNFCRSAKDAFNLLMRNVLKVAVTDEVTYFVLFLGKILVAGSIGVLAFLFFTQRLPVIAQGPASLNYYWVPLLTVILGSYLIAHGFFSVYAMCVETIFICFLEDLERNDGSTARPYYVSQPLLKIFQEENLQTKQQ

SEQ ID NO: 9366 - protein, 546 aa, Macaca fascicularis
MGKKIKKEVEPPPKDVFDPLMIESKKAATVVLMLRSPEEEILAKACEAIYKFALKGEENKATLLELGAVEPLTKLLTHEDKIVRRNATMIFGILASNNDVKKLLRELDVMNSVIAQLAPEEEVVIHEFASLCLANMSAEYPVIQLLALKTLGVITNDKESRTMLRDNQGLDHLIKILETKELNDLHIEALAVIANCLEDMDTMVQIQQTGGLKKLLSFAENSTIPDIQKNAAKAITKAAYDPENRKLFHEQEVEKCLVALLGSENDGTKIAASQAISAMCENSGSKDFFNNQGIPQLIQLLKSDNEEVREAAALALANLTTCNPANANAAAEADGIDPLINVLSSKRDGAIANAATVLTNMAMQEPLRLNIQNHDIMHAIISPLRSANTVVQSKAALAVAATACDVEARTELRNSGGLEPLVELLRSKNDEVRKHASWAVMVCAGDELTANELCRLGALDILEEVNLSGTRRNKFSEAAYNKLLNNNLSLKYSQTGYLSSSNIINDGFYDYGRINPGTKLLPLKELCLQEPSDLRAVLLINSKSDV

SEQ ID NO: 9367 - protein, 641 aa, Macaca fascicularis
MEMKWFLSKIQDDFRGGKINLEKTQRLLEKLDIRCSYIHVKRIFKDNDRLKQGRITIEEFRAIYRILTHREEIVEIFNAYSENRKILLENNLVQFLTQEQYTTEMSKTIAFEIIQKYEPIEEVRKARQMSLEGFTRYMDSRECQLFKNECRKVYQDMTHPLNDYFISSSHNTYLVSDQLVGPSDLWGYVSALVKGCRCLEIDCWDGAQNEPVVYHGYTLTSKLLFKTVIQAIHKYAFMTSDYPVVLSLENHCSPAQQEIMADNLQTTFGESLLSDMLADFPDTLPSPEALKFKVLVKNKKIGTLKETHERKGSDKRGKVEEWEEEVADLEEEEEEEEKFKESEIFESVLGENQDKETGVKKLSGVTLFKKKKTRKLKIALALSDLVIYTKAEKFKSFQHSRLYQQFNENNSIGETQARKLSKLRAHEFIFHTRKFITRIYPKATRADSSNFNPQEFWNIGCQMVALNFQTPGLPMDLQNGKFLDNGGSGYILKPHFLRESESYFNPSDIKDSMPITLTIRLISGIQLPLTHSSSNKGDTLVIIEVFGVPNDQMKQQTRVIKKNAFSPRWNETFTFIIHVPELALIRFVVESQGLIAGNEFLGQYTLPLLCMNKGYRRVPLFSRMGESLEPASLFVYVWYVR

SEQ ID NO: 9368 - protein, 640 aa, Macaca fascicularis
MEMKWFLSKIQDDFRGGKINLEKTQRLLEKLDIRCSYIHVKRIFKDNDRLKQGRITIEEFRAIYRILTHREEIVEIFNAYSENRKILLENNLVQFLTQEQYTTEMSKTIAFEIIQKYEPIEEVRKARQMSLEGFTRYMDSRECQLFKNECRKVYQDMTHPLNDYFISSSHNTYLVSDQLVGPSDLWGYVSALVKGCRCLEIDCWDGAQNEPVVYHGYTLTSKLLFKTVIQAIHKYAFMTSDYPVVLSLENHCSPAQQEIMADNLQTTFGESLLSDMLADFPDTLPSPEALKFKVLVKNKKIGTLKETHERKGSDKRGKVEEWEEEVADLEEEEEEERFKESEIFESVLGENQDKETGVKKLSGVTLFKKKKTRKLKIALALSDLVIYTKAEKFKSFQHSRLYQQFNENNSIGETQARKLSKLRAHEFIFHTRKFITRIYPKATRADSSNFNPQEFWNIGCQMVALNFQTPGLPMDLQNGKFLDNGGSGYILKPHFLRESESYFNPSDIKDSMPITLTIRLISGIQLPLTHSSSNKGDTLVIIEVFGVPNDQMKQQTRVIKKNAFSPRWNETFTFIIHVPELALIRFVVESQGLIAGNEFLGQYTLPLLCMNKGYRRVPLFSRMGESLEPASLFVYVWYVR

SEQ ID NO: 9369 - protein, 323 aa, Macaca fascicularis
MDSKHQCVKLNDGHFMPVLGFGTYAPAEVPKNKALEATKLAIEAGFRHIDSAHLYNNEEYVGLAIRSKIADGTVKREDIFYTSKLWCNSHRPEFVRPALERSLKNLQLDYVDLYLIHFPVSLKPGEELIPKDENGKLLFDTVDLCATWEAMEKCKDAGLAKSIGVSNFNRRQLEMILNKPGLKYKPVCNQVECHPYLNQRKLLDFCKSKDIVLVAFSALGSHREKPWVDQNSPVLLEDPVLCALAKKHKRTPALIALRYQLQRGVVVLAKSYNEQRIRENMKVFEFQLTSEDMKAIDGLDRNIRYLTLDIFAGPPNYPFSDEY

SEQ ID NO: 9370 - protein, 323 aa, Macaca fuscata
MDSKHQCVKLNDGHFMPVLGFGTYAPAEVPKNKAIEATKLAIEAGFRHIDSAHLYNNEEYVGLAIRSKIADGTVKREDIFYTSKLWCNSHRPEFVRPALERSLKNLQLDYVDLYLIHFPVSLKPGEELIPKDENGKLLFDTVDLCATWEAMEKCKDAGLAKSIGVSNFNRRQLEMILNKPGLKYKPVCNQVECHPYLNQRKLLDFCKSKDIVLVAYSALGSHREKPWVDQNSPVLLEDPVLCALAKKHKRTPALIALRYQLQRGVVVLAKSYNEQRIRENMKVFEFQLTSEDMKAIDGLDRNIRYLTLDIFAGPPNYPFSDEY

SEQ ID NO: 9371 - protein, 323 aa, Macaca fascicularis
MDPKYQRVALNDGHFMPVLGFGTYAPPEVPRNRVVEVTKLAIEAGFRHIDSAYLYNNEEQVGLAIRSKIADGSVKREDIFYTSKLWCTFFRPQLVQPALESSLKKLQLDYVDLYLIHFPMALKPGETPLPKDENGKVMFDTVDLCAIWEAMEKCKDAGLAKSIGVSNFNRRQLEMILNNPGLKYKPVCNQVECHPYLNQSKLLDFCKSKDIVLVAHSALGTQRHKLWVDQNSPALLEDPVLCALAKKHKRSPALIALRYQLQRGVVVLAKSYNEQRIRENVQVFEFQLTSEDMKVLDDLNRNFRYVVMDFLVDHPDYPFSDEY

SEQ ID NO: 9372 - protein, 139 aa, Cicer arietinum
MSSTATTKGGRGKPKASKSVSRSSKAGLQFPVGRIARFLKAGKYAERVGAGAPVYLSAVLEYLAAEVLELAGNAARDNKNNRIVPRHIQLAVRNDEELSKLLGSVTIANGGVLPNIHQTLLPKKVGKGKGEIGSASQEF

SEQ ID NO: 9373 - protein, 1790 aa, Emericella nidulans
MPTSDKSRQTSAGKSFFGRKLHKERPVEDRWDAHGSWESLAPPSSAAGSRSSRYSKRSSIQSVDFGADIDPSLLSTSAGPITSIPFESLSTDTQSPIPVDYLSKAETSPRKEPSPGHLAKGVGDFHQYPAWDPSAMRNHQQFSHPTGPRPPPHAAGVAMSSSATGDKGARYQQWGRPGSSAGNAGLSHHSSSTVDSSTNSRMSIDQASIHSSLSSNTRGSSYISTDGSSRTTLPSHSNDRSNYYAAMNSGRGSSAQGAIPPAQPRVQNTEQYLTRPRDDRVVDQLFLELMQKRGWQNLPEQARRQMMAYPASKKWTLVHQDRLTELQGEQKRKQKARETHGYDGPSGILERADEEGSPEWYVKKVMDDTITSKQLASLSVSLRTQPISWVKAFVEAQGQIALTNVLVKINRKKVTGPVPAPPSGDKDLDREYDIVKCLKALMNNKYGADDALAHQQIIVALISSLLSPRLNTRKLVSEVLTFLCHWAEGQGHERVLQAMDHVKNHQGETGRFDAWMRIVEVTIDGRGKMGSLVGASEEYRSGGIGMENLLMEYAVSTMILINMLVDAPENDLQLRCHIRAQFISCGIKRLLSKMEGFQYEVIDKQIEHFRENEAIDYEDLLQRESSSTKDSIEGEVKDMTDPLQITDAIASRLNGTRAHDYFLSALQHLLLIRENSGEDGLRMYQLVDAMLSYVAMDRRLPDLDLRQGLTFTVQSLLDRLHTDAEARRAYDESLEARQIAEAALAERDEMKAQVELGADGLVRKLQKQIEEQTGIIELQSRQNEMLKAELADVQRLRAQELQRNELETRELYLMLRDAQDIAASNAKKSNMGEAETDPAHMRGILDREKLLTRLEKQLERTKTQFKLEGKVWGQHDPSDRLRELREQMDGDAGPREAFEEQARLNLSLNPVGSVYRKKTYIQGMEDTATEELGQTDDEVVYAKARLVDLHRPRMDPEQATGLLGEIAAKVPKIDADDAKDEGKPTESEQPAEGAATKGDEQGVDDTVAVDKATAAPPPPPPPPPAHPGLSGAAPPPPPPPPPPPPGAGAAPPPPPPPPPPPPGGLGGPPPPPPPPPPGGFGGPPPPPPPPGGFGGPPPPPPPPPGGAFGVPPPPPPPGTVIGGWRANYLASQGAPSHAIPVMSSIRPKKKLKALHWDKVDTPQVTVWATHGTTPQEKEEKYVELAKRGVLDEVERLFMAKETRIFGGGVAAKQRKDKKQIISNDLSKNFQIALSKFSQFPAEEVVRRIIHCDAEILDNMVVMEFLQRDEMCTVPENVSKLMAPYSKDWTGPDAANTEREQDPSELTREDQIYLYTAFELNHYWKARMRALALTRSFEPDYEHISAKLREVVRVSESLRDSVSLMNVLGLILDIGNFMNDANKQAQGFKLSSLARLGMVKDDKNETTFADLVERIVRNQYPEWEDFTEQISGVIGLQKLNVDQLRTDAKKYIDNIKNVQASLDAGNLSDPKKFHPQDRVSQITQRSMKDARRKAEQMQLYLEEMVKTYDDIMVFYGEDNTDDGARRDFFAKLAAFLQEWKKSKEKNIALEEARRRTEASLARKRINVGLANGAGAAGDAPVSPATSGAMDSLLEKLRAAAPQAKDQRDRRRRARLKERHQVRVASGQKIPDLEGAEAPGSGGQNSGATDTNATDSSLLSPTIQEPEGGSSPIASQSEDVADRAASMLQDMLRNSPDPERTRRRRESAEEERRKRRLRRRNGATSGSKDSNDTTPLSPVTEPTSTQGESAEPENLSLSSPPNGEDPTLNPPTIVLSSDASDTPDDEHRPSTS

SEQ ID NO: 9374 - protein, 238 aa, Homo sapiens
MADPDPRYPRSSIEDDFNYGSSVASATVHIRMAFLRKVYSILSLQVLLTTVTSTVFLYFESVRTFVHESPALILLFALGSLGLIFALTLNRHKYPLNLYLLFGFTLLEALTVAVVVTFYDVYIILQAFILTTTVFFGLTVYTLQSKKDFSKFGAGLFALLWILCLSGFLKFFFYSEIMELVLAAAGALLFCGFIIYDTHSLMHKLSPEEYVLAAISLYLDIINLFLHLLRFLEAVNKK

SEQ ID NO: 9375 - protein, 339 aa, Mus musculus
MTDRSPFETDMLTLTRYVMEKGRQAKGTGELTQLLNSMLTAIKAISSAVRKAGLANLYGISGSVNVTGDEVKKLDVLSNSLVINMLQSSYSTCVLVSEENKEAVITAQERRGKYVVCFDPLDGSSNIDCLASIGTIFAIYRKTTEDEPSEKDALQPGRNIVAAGYALYGSATLVALSTGQGVDLFMLDPALGEFVLVEKDVRIKKKGKIFSLNEGYAKYFDAATAEYVQKKKFPEDGSAPYGARYVGSMVADVHRTLVYGGIFMYPANQKSPNGKLRLLYECNPVAYIIEQAGGMATTGTQPVLDVKPESIHQRVPLILGSPEDVQEYLSCVQRNQAGR

SEQ ID NO: 9376 - protein, 530 aa, Arabidopsis thaliana
MTVNGEFPGPTIKAFAGDTIVVNLTNKLTTEGLVIHWHGIRQFGSPWADGAAGVTQCAINPGETFTYNFTVEKPGTHFYHGHYGMQRSAGLYGSLIVDVAKGKSERLRYDGEFNLLLSDWWHEAIPSQELGLSSKPMRWIGEAQSILINGRGQFNCSLAAQFSNNTSLPMCTFKEGDQCAPQILHVEPNKTYRIRLSSTTALASLNLAVQGHKLVVVEADGNYITPFTTDDIDIYSGESYSVLLTTDQDPSQNYYISVGVRGRKPNTTQALTILNYVTAPASKLPSSPPPVTPRWDDFERSKNFSKKIFSAMGSPSPPKKYRKRLILLNTQNLIDGYTKWAINNVSLVTPATPYLGSVKYNLKLGFNRKSPPRSYRMDYDIMNPPPFPNTTTGNGIYVFPFNVTVDVIIQNANVLKGIVSEIHPWHLHGHDFWVLGYGDGKFKPGIDEKTYNLKNPPLRNTAILYPYGWTAIRFVTDNPGVWFFHCHIEPHLHMGMGVVFAEGLNRIGKVPDEALGCGLTKQFLMNRNRN

SEQ ID NO: 9377 - protein, 261 aa, Rosa rugosa
MGRGKIEIKLIENQTNRQVTYSKRRNGIFKKAQELTVLCDAQVSLIMQSSTDKIHEYISPTTTTKKMFDLYQKNLQIDLWSSHYEAMKENLWKLKEVNNKLRRDIRQRLGHDLNGLSYAELQDLEETMSQSVQIIRDRKYHVLKTQAETTRKKVKNLEERNSNLMHGYGAPGNEDPQYGYVDNEGDYESAVALANGASNLYFFNRVHNNHNLDHGHGGGSLVSSITHLQNPNNHGNHNLENGHGGGSLISSITHLHDLRLA

SEQ ID NO: 9378 - protein, 323 aa, Macaca fuscata
MDPKYQRVALNDGHFMPVLGFGSYAPPEVPRNRVVEVTKLAIEAGFRHIDSAYLYNNEEQVGLAIRSKIADGSVKREDIFYTSKLWCTFFRPQLVQPALESSLKKLQLDYVDLYLIHFPMALKPGETPLPKDENGKVMFDTVDLCAIWEAMEKCKDAGLAKSIGVSNFNRRQLEMILNNPGLKYKPVCNQVECHPYLNQSKLLDFCKSKDIVLVAHSALGTQRHKLWVDQNSPALLEDPVLCALAKKHKRSPALIALRYQLQRGVVVLAKSYNEQRIRENVQVFEFQLTSEDMKVLDDLNRNFRYVVMDFLVDHPDYPFSDEY

SEQ ID NO: 9379 - protein, 611 aa, Cavia porcellus
KFIVLSQEGSLCSVSIQKALPEDRGLYKCVAKNGAGQAECSCQVTVDDAPASENAKAPEMKSRRPKSSLPPVLGTESDATVKKKPISKTSPKAAMPPQIIQFPEDQKVRAGEPVELLGKVTGTQPITCTWMKFRKQIQDSEHIKVENGEGTSKLTILAARQEHCGCYTLLVENKLGSRQAQVNLTVVDKPDPPAGTPCASDIWSSSLTLSWYGSSYDGGSAVQSYSVEIWDSVDKMWKELATCRSTSFNVQDLLPDREYKFRVRAINVYGTSEPSQESELTMVGEKPEEPKDEVEVSDDDEKEPEVDYRTVTVNTEQKVSDLYDIEERLGSGKFGQVFRLVERKLEKIWAGKFFKAYSAKEKENIRMEIGIMNCLHHPKLVQCVDAFEEKANIVMVLEIVSGGELFERIIDEDFELTERECIQYMRQISEGVEYIHKQGIVHLDLKPENIMCVNKTGTRIKLIDFGLARRLENAGSLKVLFGTPEFVAPEVINYEPIGYATDMWSIGVICYILVSGLSPFMGDNDDETLANVTSATWDFDDEAFDEISEDAKDFISNMLKKDMKNRLNCTECLQHPWLMKDTKNMEAKKLSKDRMKKYMARRKWQKTGHAV

SEQ ID NO: 9380 - protein, 531 aa, Oryza sativa (japonica cultivar-group); identical to SEQ ID NO: 3338

SEQ ID NO: 9381 - protein, 320 aa, Arabidopsis thaliana
MGCQDEQLVQTICDLYEKISKLESLKPSEDVNILFKQLVSTCIPPNPNIDVTKMCDRVQEIRLNLIKICGLAEGHLENHFSSILTSYQDNPLHHLNIFPYYNNYLKLGKLEFDLLEQNLNGFVPKSVAFIGSGPLPLTSIVLASFHLKDTIFHNFDIDPSANSLASLLVSSDPDISQRMFFHTVDIMDVTESLKSFDVVFLAALVGMNKEEKVKVIEHLQKHMAPGAVLMLRSAHGPRAFLYPIVEPCDLQGFEVLSIYHPTDDVINSVVISKKHPVVSIGNVGGPNSCLLKPCNCSKTHAKMNKNMMIEEFGAREEQLS

SEQ ID NO: 9382 - protein, 374 aa, Arabidopsis thaliana
MAKSDMLPFLAMVLVQIGYAGMNITSKMAMEAGMKPLILVAYRQIFATIATFPVAFFLERKTRPKITLRILVQVFFCSITGATGNQVLYFVGLQNSSPTIACALTNLLPAVTFLLAAIFRQETVGIKKASGQAKVIGTLVCVIGAMVLSFYHGHTIGIGESKIHWAYAENITKHGSSSGHSNFFLGPFLIMAAAVSWAAWFIIQTKMSETFAAPYTSTLLMCLMGSIQCGAIALISDHTISDWSLSSPLRFISALYAGVVASALAFCLMSWAMQRKGPLYVSVFSPLLLVVVAIFSWALLEEKLYTGTFMGSALVVIGLYGVLWGKDREVSEKEEEREKVKQQNHKVKSESNEDIESRLPVASSGNGSTRSTSP

SEQ ID NO: 9383 - protein, 267 aa, Arabidopsis thaliana [sequence omitted]

SEQ ID NO: 9384 - protein, 380 aa, Arabidopsis thaliana
METQGKVITCKAAVAWGAGEPLVMEDVKVDPPQRLEVRIRILFTSICHTDLSAWKGENEAQRAYPRILGHEAAGIVESVGEGVEEMMAGDHVLPIFTGECGDCRVCKRDGANLCERFRVDPMKKVMVTDGKTRFFTSKDNKPIYHFLNTSTFSEYTVIDSACVLKVDPLFPLEKISLLSCGVSTGVGAAWNVADIQPASTVAIFGLGAVGLAVAEGARARGASKIIGIDINPDKFQLGREAGISEFINPKESDKAVHERVMEITEGGVEYSFECAGSIEALREAFLSTNSGVGVTVMLGVHASPQLLPIHPMELFQGRSITASVFGGFKPKTQLPFFITQCLQGLLNLDLFISHQLPFHDINEAMQLLHQGKALRCLLHL

SEQ ID NO: 9385 - protein, 2428 aa, Arabidopsis thaliana
MASPLESLLSISGSVSTSSTLIRLRIFRHDIPEILQNSDMTSDIAPVIVDMIFQTLAIYDDRASRKAVDDLIVKGLGNVTFMKTFAAMLVQVMEKQLKFCFDTSQAIYSLYMDEVKGSRIPYKDSPELLGLLLEFSCSSPALFEQSKAIFVDIYVKDVLNSREKQKPNLSNCFKPLLQRLSHEEFQTVILPAAVKMLKRNPEIVLESVGFLLANVNIDLSKYALELLPVILPQARHTDEDRRLGALSMVMCLSEKSSNPDTIEAMFASVKAIIGVQELASAPEGKYIGSLSRTICSFLIACYKDEASWASRSSVAIQPNLVSFIAAGLKEKEALRRGHLRCISDLLSPLIQLVKTGFTKAVQRLDGIYALLIVSKIAACDIKAEDTMVKEKLWTLISQNEPSLVQITLGFGSIFIEITITGSLSEFMFSEPFLPLLLFLLCHPSWNVRKTAYNSVTKIFLATSQLATTLLDEFSDFLSITGDQIVSSRTSDADNPADHQAPFVPSVEVLVKALIVISSAAVAGPPSSWIVRAIFCSHHPSIVGTGKRDAVWKSLLGPMGLTSAKTPEQQAAVYSLSTMMSLAPEDTFTVFKMHLQDLPDRLSHDMLSETDIKIFHTPEGMLLSEQGVYVAQTIGAKYTKQEPSSNHSLKKGLASRETANSGRRDTAKLTKKADKGKTAKEEARELMLKEEASTRENVHRIQKSLSLVLHALGEMGLANPVFCHSQLPFLATFLDPLLRSPIVSAAAFENLVKLARCTVQPLCNWALEISTALRLIAIDEVDTSFDFRPSVDKAGKTYEGLFERIVNGLSISCKSGPLPVDTFTFIFPVLYHVLGVVPAYQASVGPALNELCLGLQADDVANALYGVYSKDVHVRLACLNAVKCIPAVSKCSLPQNVKIATNIWIALHDPEKSVAESADDLWARYGHDLGTDYSGIFKALSHINLNVRLAAAEALADALHESPSSIQLSLSTLFSLYIRDATSGEDVFDAGWIGRQGIALALQSAADVLTTKDLPAVMTFLISRALADPNTDVRGKMINAGIMIIDKHGKENVSLLFPIFENYLNKEASDEEEYDLVREGVVIFTGALAKHLARDDPKVHNVVEKLLEVLNTPSESVQRAVSTCLSPLVLSKQEEAPALFLRLLDKLMKSDKYGERRGAAFGLAGVVMGFGISSLKKYGLIVTLQEALIDRNSAKRREGALLAFECLCEKLGKLFEPYVIKMLPLLLVSFSDQVGAVREAAECAARAMMSQLSAYGVKLVLPSLLKGLEDKAWRTKQSSVQLLGAMAFCAPQQLSQCLPRVVPKLTEVLTDTHPKVQSAGQLALQQVGSVIKNPEISSLVPTLLLALTDPNEYTRHALDTLLQTTFVNSVDAPSLALLVPIVHRGLRERSSETKKKASQIVGNMCSLVTEPKDMIPYIGLLLPEVKKVLVDPIPEVRSVAARAVGSLIRGMGEDNFPDLVPWLFETLKSDTSNVERYGAAQGLSEVIAALGTDYFENILPDLIRHCSHQKASVRDGYLTLFKFLPRSLGAQFQKYLQLVLPAILDGLADENESVRDAALGAGHVLVEHHATTSLPLLLPAVEDGIFNDNWRIRQSSVELLGDLLFKVAGTSGKALLEGGSDDEGASTEAQGRAIIDILGMDKRNEVLAALYMVRTDVSLSVRQAALHVWKTIVANTPKTLKEIMPILMSTLISSLASPSSERRQVAGRSLGELVRKLGERVLPLIIPILSKGLKDPDVDKRQGVCIGLNEVMASAGRSQLLSFMDQLIPTIRTALCDSALEVRESAGLAFSTLYKSAGLQAMDEIIPTLLEALEDDEMSTTALDGLKQIISVRTAAVLPHILPKLVHLPLSALNAHALGALAEVAGAGFNTHLGTILPALLSAMGGENKEVQELAQEAAERVVLVIDEEGVETLLSELLKGVSDSQASIRRSSAYLIGYFFKSSKLYLIDEAPNMISTLIVMLSDSDSTTVAVSWEALARVIGSVPKEVLPSYIKLVRDAVSTARDKERRKRKGGYVVIPGLCLPKSLKPLLPVFLQGLISGSAELREQAAIGLGELIEVTSEQALKEFVIPITGPLIRIIGDRFPWQVKSAILATLIILIQRGGMALKPFLPQLQTTFVKCLQDSTRTIRSSAAVALGKLSALSTRIDPLVGDLMTSFQAADSGVREAILSAMRGVIKHAGKSIGPAVRVRIFDLLKDLMHHEDDQVRISATSMLGVLSQYLEAAQLSVLLQEVNDLSASQNWGARHGSVLCISSLLKHNPSTIMTSSLFSSMLNSLKSSLKDEKFPLRESSTKALGRLLLKQLATDPSNTKVVIDVLSSIVSALHDDSSEVRRRALSSLKAFAKDNPSATMANISVIGPPLAECLKDGNTPVRLAAERCALHVFQLTKGAENVQAAQKYITGLDARRLSKFPEQSDDSESDDDNVSG

SEQ ID NO: 9386 - protein, 329 aa, Arabidopsis thaliana [sequence omitted]

SEQ ID NO: 9387 - protein, 502 aa, Arabidopsis thaliana
MATAAVIGLNTGKRLLSSSFYHSDVTEKFLSVNDHCSSQYHIASTKSGITAKKASNYSPSFPSSNRHTQSAKALKESVDVASTEKPWLPNGTDKELEEECYDDDDLISHSVEAILLLQKSMLEKSWNLSFEKAVSSEYPGKGTIRKKKIPVITCSGISARQRRIGAKKKTNMTHVKAVSDVSSGKQVRGYVKGVISEDVLSHVEVVRLSKKIKSGLRLDDHKSRLKDRLGCEPSDEQLAVSLKISRAELQAWLMECHLAREKLAMSNVRLVMSIAQRYDNLGAEMSDLVQGGLIGLLRGIEKFDSSKGFRISTYVYWWIRQGVSRALVDNSRTLRLPTHLHERLGLIRNAKLRLQEKGITPSIDRIAESLNMSQKKVRNATEAVSKVFSLDRDAFPSLNGLPGETHHSYIADTRLENNPWHGYDDLALKEEVSKLISATLGEREKEIIRLYYGLDKECLTWEDISKRIGLSRERVRQVGLVALEKLKHAARKRKMEAMILKN

SEQ ID NO: 9388 - protein, 433 aa, Arabidopsis thaliana
MSSSERVPCDFCGERTAVLFCRADTAKLCLPCDQQVHTANLLSRKHVRSQICDNCGNEPVSVRCFTDNLILCQECDWDVHGSCSVSDAHVRSAVEGFSGCPSALELAALWGLDLEQGRKDEENQVPMMAMMMDNFGMQLDSWVLGSNELIVPSDTTFKKRGSCGSSCGRYKQVLCKQLEELLKSGVVGGDGDDGDRDRDCDREGACDGDGDGEAGEGLMVPEMSERLKWSRDVEEINGGGGGGVNQQWNATTTNPSGGQSSQIWDFNLGQSRGPEDTSRVEAAYVGKGAASSFTINNFVDHMNETCSTNVKGVKEIKKDDYKRSTSGQVQPTKSESNNRPITFGSEKGSNSSSDLHFTEHIAGTSCKTTRLVATKADLERLAQNRGDAMQRYKEKRKTRRYDKTIRYESRKARADTRLRVRGRFVKASEAPYP

SEQ ID NO: 9389 - protein, 351 aa, Arabidopsis thaliana
MVKALVIINCIILAIGNCGGPLIMRLYFNNGGKRIWFSTFLETAGFPVIFIPLLFSYITRRRSNNVGDSTSFFLIKPRLLIAAVIVGILSGFDNYLYAYGIAYLPVSTAALIIASQLAFIAIFSFFMVKHKFTPFTINAVVLLTVGAAVLGMHTETDKPVHETHKQYITGFLITVAAAVMYAFILPLVELAYQKAKQTMSYTLVLEFQLILCLLASIVSVIGMFIAGDFKALPKEAREFKLGEALFYVVAVFSAIIWQGFFLGAIGLIFSTSSLVSGIMISVLLPITEVLAVIFYHEKFQAEKGLSLALSLWGFVSYFYGEIKSGEDKRRIQQEESQETEQSSLSRPISEC

SEQ ID NO: 9390 - protein, 356 aa, Arabidopsis thaliana
MKNGLIIINCIILTIGTCGGPLLTRLYFTNGGKRIWFMSFLSTAGFPIILIPLLVSFLSRRRSNRNPNNAENKRKTKLFLMETPLFIASIVIGLLTGLDNYLYSYGLAYLPVSTSSLIIGTQLAFNALFAFLLVKQKFTPFSINAVVLLTVGIGILALHSDGDKPAKESKKEYVVGFLMTVVAALLYAFILPLVELTYKKARQEITFPLVLEIQMVMCLAATFFCVIGMFIVGDFKVIAREAREFKIGGSVFYYALIVITGIIWQGFFLGAIGIVFCASSLASGVLISVLLPVTEVFAVVCFREKFQAEKGVSLLLSLWGFVSYFYGEFKSGKKVVDKPQPPETELPILPVSDYVA

SEQ ID NO: 9391 - protein, 189 aa, Arabidopsis thaliana
MASTTCAREVHYRGVRKRPWGRYAAEIRDPWKKTRVWLGTFDTPEEAALAYDGAARFLRGIKAKTNFPSPLSLDLNHLPSAPSAATAAANNQPHQHQQLWFAAPPPVPPSSDHHHQHHRIFLRTGVLNDKTSDYSSTEAPLYFTSSPNTATSSPGYQVVGFPMMNSSPSPVTVRRGLAIDLNEPPPLWL

SEQ ID NO: 9392 - protein, 597 aa, Arabidopsis thaliana
MAVDSLLQSGMASPTTSETEVKALKFIEEITRNPDSVQEKVLGEILSRNSNTEYLKRFDLNGAVDRKSFKSKVPVVIYEDLKTDIQRISNGDRSPILSSHPITEFLTSSGTSAGERKLMPTIEEDINRRQLLGNLLMPVMNLYVPGLDKGKGLYFLFVKSESTTSGGLPARPALTSYYKSDYFRTSDSDSVYTSPKEAILCCDSSQSMYTQMLCGLLMRHEVNRLGAVFPSGLLRAISFLQNNWKELSQDISTGTLSSKIFDHAIKTRMSNILNKPDQELAEFLIGVCSQENWEGIITKIWPNTKYLDVIVTGAMAEYIPMLEYYSGGLPMASMIYASSESYFGINLNPMCKPSEVSYTIFPNMAYFEFLPHNHDGDGGVEATSLVELADVEVGKEYELVITTYAGLYRYRVGDILRVTGFHNSAPQFKFIRRENVLLSIESDKTDEADLQKAVENASRLLAEQGTRVIEYTSYADTKTIPGHYVIYWELLSRDQSNALPSDEVMAKCCLEMEESLNAVYRQSRVSDKSIGPLEIRVVQNGTFEELMDFSISRGSSINQYKVPRCVSLTPIMKLLDSRVVSAHFSPSLPHWSPERRH

SEQ ID NO: 9393 - protein, 311 aa, Arabidopsis thaliana
MEGGYEQGGGASRYFHNLFRPEIHHQQLQPQGGINLIDQHHHQHQQHQQQQQPSDDSRESDHSNKDHHQQGRPDSDPNTSSSAPGKRPRGRPPGSKNKAKPPIIVTRDSPNALRSHVLEVSPGADIVESVSTYARRRGRGVSVLGGNGTVSNVTLRQPVTPGNGGGVSGGGGVVTLHGRFEILSLTGTVLPPPAPPGAGGLSIFLAGGQGQVVGGSVVAPLIASAPVILMAASFSNAVFERLPIEEEEEEGGGGGGGGGGGPPQMQQAPSASPPSGVTGQGQLGGNVGGYGFSGDPHLLGWGAGTPSRPPF

SEQ ID NO: 9394 - protein, 267 aa, Arabidopsis thaliana
MEGYSRNGEISPKLLDLMIPQERRNWFHDEKNSVFKTEEKKLELKLGPPGEEDDDESMIRHMKKEPKDKSILSLAGKYFSPSSTKTTSHKRTAPGPVVGWPPVRSFRKNLASGSSSKLGNDSTTSNGVTLKNQKCDAAAKTTEPKRQGGMFVKINMYGVPIGRKVDLSAHNSYEQLSFTVDKLFRGLLAAQRDFPSSIEDEKPITGLLDGNGEYTLTYEDNEGDKMLVGDVPWQMFVSSVKRLRVIKTSEISSALTYGNGKQEKMRR

SEQ ID NO: 9395 - protein, 618 aa, Arabidopsis thaliana
MEGLIQTRGILSLPAKPIGVRRLLQPSHGLKQRLFTTNLPALSLSSNGHKKFQAFQQIPLGISVSHKERSRGFICKAEAAAAGGGNVFDEGDTAAMAVSPKIFGVEVTTLKKIVPLGLMFFCILFNYTILRDTKDVLVVTAKGSSAEIIPFLKTWVNLPMAIGFMLLYTKLSNVLSKKALFYTVIVPFIVYFGAFGFVMYPLSNLIHPEALADKLLATLGPRFMGPLAIMRIWSFCLFYVMAELWGSVVVSVLFWGFANQITTVDEAKKFYPLFGLGANVALIFSGRTVKYFSNMRKNLGPGVDGWAVSLKAMMSIVVGMGLAICFLYWWVNRYVPLPTRSKKKKVKPQMGTMESLKFLVSSPYIRDLATLVVAYGISINLVEVTWKSKLKAQFPSPNEYSAFMGDFSTCTGIATFTMMLLSQYVFKKYGWGVAAKITPTVLLLTGVAFFSLILFGGPFAPLVAKLGMTPLLAAVYVGALQNIFSKSAKYSLFDPCKEMAYIPLDEDTKVKGKAAIDVVCNPLGKSGGALIQQFMILTFGSLANSTPYLGVILLGIVTAWLAAAKSLEGQFNTLMSEEELEREMERASSVKIPVVSQEDAPSGETTSQLSEKSTPTGI

SEQ ID NO: 9396 - protein, 711 aa, Arabidopsis thaliana
MKELILLEEGWSVMKTGVAKLQRILEDLSEPPFDPGQYINLYTIIYDMCLQQPPNDYSQELYNKYRGVVDHYNKETVLPSMRERHGEYMLRELVKRWANHKILVRWLSRFCFYLDRFYVARRGLPTLNDVGFTSFHDLVYQEIQSEAKDVLLALIHKEREGEQIDRTLVKNVIDVYCGNGVGQMVIYEEDFESFLLQDTASYYSRKASRWSQEDSCPDYMLKAEECLKLEKERVTNYLHSTTEPKLVEKVQNELLVVVAKQLIENEHSGCLALLRDDKMGDLSRMYRLYRLIPQGLEPIADLFKQHVTAEGNALIKQAADAATNQDASASQVLVRKEIELHDKYMVYVDECFQKHSLFHKLLKEAFEVFCNKTVAGASSAEILATYCDNILKTRGGSEKLSDEATEITLEKVVNLLVYISDKDLFAEFYRKKQARRLLFDRSGIMKEVTDITLARELQTNFVDYLSANMTTKLGIDFTVTVLTTGFWPSYKTTDLNLPTEMVNCVEAFKVFYGTKTNSRRLSWIYSLGTCHILGKFEKKTMELVVSTYQAAVLLLFNNAERLSYTEISEQLNLSHEDLVRLLHSLSCLKYKILIKEPMSRTISKTDTFEFNSKFTDKMRKIRVPLPPMDERKKVVEDVDKDRRYAIDAALVRIMKSRKVLAHQQLVSECVEHLSKMFKPDIKMIKKRIEDLINRDYLERDTENANTFKYVA

SEQ ID NO: 9397 - protein, 770 aa, Arabidopsis thaliana
MVAPALLPELWTEILVPICAVIGIAFSLFQWYVVSRVKLTSDLGASSSGGANNGKNGYGDYLIEEEEGVNDQSVVAKCAEIQTAISEGATSFLFTEYKYVGVFMIFFAAVIFVFLGSVEGFSTDNKPCTYDTTRTCKPALATAAFSTIAFVLGAVTSVLSGFLGMKIATYANARTTLEARKGVGKAFIVAFRSGAVMGFLLAASGLLVLYITINVFKIYYGDDWEGLFEAITGYGLGGSSMALFGRVGGGIYTKAADVGADLVGKIERNIPEDDPRNPAVIADNVGDNVGDIAGMGSDLFGSYAEASCAALVVASISSFGINHDFTAMCYPLLISSMGILVCLITTLFATDFFEIKLVKEIEPALKNQLIISTVIMTVGIAIVSWVGLPTSFTIFNFGTQKVVKNWQLFLCVCVGLWAGLIIGFVTEYYTSNAYSPVQDVADSCRTGAATNVIFGLALGYKSVIIPIFAIAISIFVSFSFAAMYGVAVAALGMLSTIATGLAIDAYGPISDNAGGIAEMAGMSHRIRERTDALDAAGNTTAAIGKGFAIGSAALVSLALFGAFVSRAGIHTVDVLTPKVIIGLLVGAMLPYWFSAMTMKSVGSAALKMVEEVRRQFNTIPGLMEGTAKPDYATCVKISTDASIKEMIPPGCLVMLTPLIVGFFFGVETLSGVLAGSLVSGVQIAISASNTGGAWDNAKKYIEAGVSEHAKSLGPKGSEPHKAAVIGDTIGDPLKDTSGPSLNILIKLMAVESLVFAPFFATHGGILFKYF

SEQ ID NO: 9398 - protein, 329 aa, Arabidopsis thaliana
MAVLSKPVAIPKSGFSLIPVIDMSDPESKHALVKACEDFGFFKVINHGVSAELVSVLEHETVDFFSLPKSEKTQVAGYPFGYGNSKIGRNGDVGWVEYLLMNANHDSGSGPLFPSLLKSPGTFRNALEEYTTSVRKMTFDVLEKITDGLGIKPRNTLSKLVSDQNTDSILRLNHYPPCPLSNKKTNGGKNVIGFGEHTDPQIISVLRSNNTSGLQINLNDGSWISVPPDHTSFFFNVGDSLQVMTNGRFKSVRHRVLANCKKSRVSMIYFAGPSLTQRIAPLTCLIDNEDERLYEEFTWSEYKNSTYNSRLSDNRLQQFERKTIKNLLN

SEQ ID NO: 9399 - protein, 341 aa, Arabidopsis thaliana
MDHAADAHRTDLMTITRFVLNEQSKYPESRGDFTILLSHIVLGCKFVCSAVNKAGLAKLIGLAGETNIQGEEQKKLDVLSNDVFVNALVSSGRTSVLVSEEDEEATFVEPSKRGKYCVVFDPLDGSSNIDCGVSIGTIFGIYTLDHTDEPTTADVLKPGNEMVAAGYCMYGSSCMLVLSTGTGVHGFTLDPSLGEFILTHPDIKIPNKGNIYSVNEGNAQNWDGPTTKYVEKCKFPKDGSPAKSLRYVGSMVADVHRTLLYGGIFLYPADKKSPNGKLRVLYEVFPMSFLMEQAGGQAFTGKKRALDLVPEKIHERSPIFLGSYDDVEEIKALYAEEEKKN

SEQ ID NO: 9400 - protein, 482 aa, Arabidopsis thaliana
MVGSLESDQTLSMATLIEKLDILSDDFDPTAVVTEPLPPPVTNGIGADKGGGGGEREMVLGRNIHTTSLAVTEPEVNDEFTGDKEAYMASVLARYRKTLVERTKNHLGYPYNLDFDYGALGQLQHFSINNLGDPFIESNYGVHSRPFEVGVLDWFARLWEIERDDYWGYITNCGTEGNLHGILVGREMFPDGILYASRESHYSVFKAARMYRMECEKVDTLMSGEIDCDDLRKKLLANKDKPAILNVNIGTTVKGAVDDLDLVIKTLEECGFSHDRFYIHCDGALFGLMMPFVKRAPKVTFNKPIGSVSVSGHKFVGCPMPCGVQITRMEHIKVLSSNVEYLASRDATIMGSRNGHAPLFLWYTLNRKGYKGFQKEVQKCLRNAHYLKDRLREAGISAMLNELSSTVVFERPKDEEFVRRWQLACQGDIAHVVVMPSVTIEKLDNFLKDLVKHRLIWYEDGSQPPCLASEVGTNNCICPAHK

SEQ ID NO: 9401 - protein, 370 aa, Arabidopsis thaliana
MATLVDPPNGIRNEGKHYFSMWQTLFEIDTKYMPIKPIGRGAYGVVCSSVNSDTNEKVAIKKIHNVYENRIDALRTLRELKLLRHLRHENVIALKDVMMPIHKMSFKDVYLVYELMDTDLHQIIKSSQVLSNDHCQYFLFQLLRGLKYIHSANILHRDLKPGNLLVNANCDLKICDFGLARASNTKGQFMTEYVVTRWYRAPELLLCCDNYGTSIDVWSVGCIFAELLGRKPIFQGTECLNQLKLIVNILGSQREEDLEFIDNPKAKRYIRSLPYSPGMSLSRLYPGAHVLAIDLLQKMLVFDPSKRISVSEALQHPYMAPLYDPNANPPAQVPIDLDVDEDLREEMIREMMWNEMLHYHPQASTLNTEL

SEQ ID NO: 9402 - protein, 425 aa, Arabidopsis thaliana
MKKWLGFSLTPPLRICNSEEEELRHDGSDGTLFFTHHPPVWRYDINFDHHHHDEDVPKVEDLLSNSHQTEYPINHNQTNVNCTTVVNRLNPPGYLLHDQTVVTPHYPNLDPNLSNDYGGFERVGSVSVFKSWLEQGTPAFPLSSHYVTEEAGTSNNISHFSNEETGYNTNGSMLSLALSHGACSDLINESNVSARVEEPVKVDEKRKRLVVKPQVKESVPRKSVDSYGQRTSQYRGVTRHRWTGRYEAHLWDNSCKKEGQTRRGRQAKIGGYDEEEKAARAYDLAALKYWGPTTHLNFPLSNYEKEIEELNNMNRQEFVAMLRRNSSGFSRGASVYRGVTRHHQHGRWQARIGRVAGNKDLYLGTFSTQEEAAEAYDIAAIKFRGLNAVTNFDINRYDVKRICSSSTIVDSDQAKHSPTSSGAGH

SEQ ID NO: 9403 - protein, 697 aa, Arabidopsis thaliana
MIHTKTGSGRRILTFPTVEPSESISIVTLLDSLIQLAGDILTFKSKHFSTNKQSFRETLRRIQNLLVVFEEIRIRIRNSRRYFHDSAAASSLKEIHVGFQKLKFLLEDCTRDGARLCMMMNSDQVSDHLRVLTRSISTSLSAFPVASVDLTTEVNELIDLVVRQARKYGVQPETNDKRAVSSINRILALFVNRVVPDPDEINRILDHVGIRKWGDCVKEINFLGEEIDAERLDEKKKKSSDQVELLSSLMGFICYCRCIILGRIERDDHHNHHEDGIKKDHDLIRGLKVEDLLCPISLEIMTDPVVIETGHTYDRSSITKWFGSGNITCPITGKILTSTELVDNVSVRQVIRKHCKTNGIVLAGISRRRKSHDDVVPESLAAKGAGKLIAKFLTSELINGGEEMIYRAVREIRVQTKTSSFNRSCLVKAGAVTPLLKLLSSVDIRIQENAMAGILNLSKHVTGKSKIAGEGLKILVEILNEGAKTETRLYSASALFYLSSVEDYSRLIGENPDAIPGLMNIVKGDDYGDSAKRSALLAVMGLLMQSDNHWRVLAAGAVPILLDLLRSGEISGGLTADCLATLAKLAEYPDGTIGVIRRGGLKLAVKILSSSEDSPVAVKQHCVGLILNLCLNGGRDVVGVLVKNSLVMGSLYTVLSNGEYGGSKKASALIRMIHEFQERKTGSVEPNLQRGRFVHAW

SEQ ID NO: 9404 - protein, 166 aa, Arabidopsis thaliana
MAPTVKTAAVKTNEGNGVRYRGVRKRPWGRYAAEIRDPFKKSRVWLGTFDTPEEAARAYDKRAIEFRGAKAKTNFPCYNINAHCLSLTQSLSQSSTVESSFPNLNLGSDSVSSRFPFPKIQVKAGMMVFDERSESDSSSVVMDVVRYEGRRVVLDLDLNFPPPPEN

SEQ ID NO: 9405 - protein, 175 aa, Arabidopsis thaliana
MSINIRDPLIVSRVVGDVLDPFNRSITLKVTYGQREVTNGLDLRPSQVQNKPRVEIGGEDLRNFYTLVMVDPDVPSPSNPHLREYLHWLVTDIPATTGTTFGNEIVCYENPSPTAGIHRVVFILFRQLGRQTVYAPGWRQNFNTREFAEIYNLGLPVAAVFYNCQRESGCGGRRL

SEQ ID NO: 9406 - protein, 797 aa, Arabidopsis thaliana
MVGFPANQAKTVEEELPLQVVADQDPKVKTFKDSFDFPSIDSFPDFDSITWSESNRNVEDFSIEDTDFDFFEYHMEIPQEDVVTVSDVMCPENQTTVNSESIEGKLEVFNDDMSGEVGVSSVRSESMVEVKPVLCDVMSEEVGVSSVEVEPNVCVEMSANGGDEPAVKDSEPVVSENSRSMEGETEPVVVSDASVACPTMDLDESGLKKTDEGLACSIEVGLEKVSLAVDDDEKSDEAKGEMDSAESESETSSSSASSSDSSSSEEEESDEDESDKEENKKEEKFEHMVVGKEDDLAGDLKRNLDEENGDDDIEDEDDDDDDDDDDDDDVNEMVAWSNDEDDDLGLQTKEPIRSKNELKELPPVPPVDVTLEPHHATLPVGVVLSVMSAQVIVEGMEKHSPLTEGSILWITEKRTPLGLVDEIFGPVKCPYYIVRFNSESEVPEGVCQGTPVSFVADFAQHILNIKELQKKGYDASGDNDEEIPDELEFSDDEKEAEYRRMQKLEKRGMMSDQKTGNTRNKKKKNRDPGRPTSSYSGEWTKNQGSSSLSSNRSDPQMGGPRPQMDGFPPNNAAWRPQSNQQNPYQLPPIPNQMGMQIPFMAMQNQNQMMFQPQFNGGQMPMPGGPGGLNFFPGQASAPWPAMVGQNCFNQQFGMGRGIQQQPLPNELSFNMFSQGLQMHPPQSQMHRPQSQMNPQFQMPPQFQPHQQSPMNPQYQMMHRPQSPANPQFQMQAQSDVRPLQSQIPQSPSDLQSPMEPQSQGFSSGQSSERGRGFHGRGRGRGRGRFGRGRGRGRQQSG

SEQ ID NO: 9407 - protein, 494 aa, Arabidopsis thaliana
MVLTKTATNDESVCTMFGSRYVRTTLPKYEIGENSIPKDAAYQIIKDELMLDGNPRLNLASFVTTWMEPECDKLIMDSINKNYVDMDEYPVTTELQNRCVNIIARLFNAPLEESETAVGVGTVGSSEAIMLAGLAFKRKWQNKRKAEGKPYDKPNIVTGANVQVCWEKFARYFEVELKEVNLSEGYYVMDPDKAAEMVDENTICVAAILGSTLNGEFEDVKRLNDLLVKKNEETGWNTPIHVDAASGGFIAPFIYPELEWDFRLPLVKSINVSGHKYGLVYAGIGWVVWRAAEDLPEELIFHINYLGADQPTFTLNFSKGSSQIIAQYYQLIRLGFEGYKNVMENCIENMVVLKEGIEKTERFNIVSKDQGVPVVAFSLKDHSFHNEFEISEMLRRFGWIVPAYTMPADAQHITVLRVVIREDFSRTLAERLVADISKVLHELDTLPSKISKKMGIEGIAENVKEKKMEKEILMEVIVGWRKFVKERKKMNGVC

SEQ ID NO: 9408 - protein, 317 aa, Arabidopsis thaliana
MPVFKAPFNGYSVKFSPFYESRLAVATAQNFGILGNGRIHVLELAPGAPGVTESVSYDTADAVYDVCWSESHDSVLIAAIGDGSVKIYDTALPPPSNPIRSFQEHAREVQSVDYNPTRRDSFLTSSWDDTVKLWAMDRPASVRTFKEHAYCVYQAVWNPKHGDVFASASGDCTLRIWDVREPGSTMIIPAHDFEILSCDWNKYDDCILATSSVDKTVKVWDVRSYRVPLAVLNGHGYAVRKVKFSPHRRSLIASCSYDMSVCLWDYMVEDALVGRYDHHTEFAVGIDMSVLVEGLMASTGWDELVYVWQQGMDPRAS

SEQ ID NO: 9409 - protein, 374 aa, Arabidopsis thaliana
MDSRRMSRPRQIKFEEGWSNIQKGITKLIRILEGEPEPTFYFSECFKLYTIIYDMCVQRSDYSQQLYEKYRKVIEDYTIQTVLPSLREKHDEDMLRELVKRWNNHKIMVKWLSKFFVYIDRHLVRRSKIPIPSLDEVGLTCFLDLVYCEMQSTAKEVVIALIHKEREGEQIDRALVKNVLDIYVENGMGTLEKYEEDFESFMLQDTASYYSRKASRWTEEDSCPDYMIKVEECLKMERERVTHYLHSITEPKLVEKIQNELLVMVTKNRLENEHSGFSALLRDDKKNDLSRIYRLYLPIPKRLGRVADLFKKHITEEGNALIKQADDKTTNQLLIELHNKFIVYVIECFQNHTLFHKVRVLFMCVYLFQQYYIE

SEQ ID NO: 9410 - protein, 255 aa, Arabidopsis thaliana
MVAPTEIKFEVEWSNIQQGFTKLIRMIEGESEPAFNQEIMMMMHTATYRICAYKNPQQLYDKYRELIENYAIQTVLPSLREKHDECMLRELAKRWNAHKLLVRLFSRRLVYLDDSFLSKKGLPSLREVGLNCFRDQVYREMQSMAAEAILALIHKEREGEQIDRELVRNVIDVFVENGMGTLKKYEEDFERLMLQDTASYYSSKASRWIQEESCLDYTLKPQQCLQRERERVTHYLHPTTEPKLFEVRYGIIIWN

SEQ ID NO: 9411 - protein, 686 aa, Arabidopsis thaliana
MIHTPTGSSRRILTFPAVNPCESISLTTLVDSLLQLAGEILSFKPKHFSTNKRSVKETLRHVQTLVIFFEELRIQIRVGSIPAGRSVILSLSELHVIFQKLKFLLDDCTRDGAKLYMLMNSGQVSAHFRDLTRSISTSLDTFPVRSVDLPGEVNELIYLVMRQTRKSEARPDRDDKRAIDSVYWFFNLFENRINPNSDEILRVLDHIGVRKWRDCVKEIDFLREEISVGKKSNIEIELLSNLMGFICYCRCVILRGIDVDDEEKDKEEDDLMMVRSLNVDDLRCPISLEIMSDPVVLESGHTYDRSSITKWFASGNITCPKTGKTLVSTVLVDNFSVKQVIQSYSKQNGVVMGQKGKKKVDVAESLAAEEAGKLTAEFLAGELIKGDEEEMVKALVEIRILTKTSTFYRSCLVEAGVVESLMKILRSDDPRIQENAMAGIMNLSKDIAGKTRIVGEDGGGLRLIVEVLNDGARRESRQYAAAALFYLSSLGDYSRLIGEISDAIPGLVRIVKSCDYGDSAKRNALIAIRSLLMNQPDNHWRILAAGIVPVLLDLVKSEEISDGVTADSMAILAKMAEYPDGMISVLRRGGLKLAVKILGSSEVSPATKQHCVALLLNLCHNGGSDVVGSLAKNPSIMGSLYTASSNGELGGGKKASALIKMIHEFQERKTGPGEPVLERERFVHAW

SEQ ID NO: 9412 - protein, 327 aa, Arabidopsis thaliana
MSLSQPITRTDSAPNGAFRTFGLYWCYHCDRMVRIASSNPSEIACPRCLRQFVVEIETRQRPRFTFNHATPPFDASPEARLLEALSLMFEPATIGRFGADPFLRARSRNILEPESRPRPQHRRRHSLDNVNNGGLPLPRRTYVILRPNNPTSPLGNIIAPPNQAPPRHVNSHDYFTGASSLEQLIEQLTQDDRPGPPPASEPTINSLPSVKITPQHLTNDMSQCTVCMEEFIVGGDATELPCKHIYHKDCIVPWLRLNNSCPICRRDLPLVNTVAESRERSNPIRQDMPERRRPRWMQLGNIWPFRARYQRVSPEETANQNPRDNRS

SEQ ID NO: 9413 - protein, 169 aa, Arabidopsis thaliana
MASHQEQSYKAGETRGKAQEKTGEAMGTMGDKTQAAKDKTQETAQSAQQKAHETAQSAKDKTSQAAQTTQERAQESKDKTGSYMSETGEAIKNKAHDAAEYTKETAEAGKEKTSGILGQTGEQVKQMAMGATDAVKHTLGLRTDEGNKEHVSSAPSTTTTTTTRETQRK

SEQ ID NO: 9414 - protein, 134 aa, Arabidopsis thaliana
MSGKGAKGLIMGKPSGSDKDKDKKKPITRSSRAGLQFPVGRVHRLLKTRSTAHGRVGATAAVYTAAILEYLTAEVLELAGNASKDLKVKRISPRHLQLAIRGDEELDTLIKGTIAGGGVIPHIHKSLINKSAKE

SEQ ID NO: 9415 - protein, 551 aa, Arabidopsis thaliana
MEVKSVNTTAMILGLFFLISFVAAEDPYKFFEWHVTYGNISPLKVAQQGILINGKFPGPDIAAVTNDNLIINVFNHLDEPFLISWSGIRNWRNSYQDGVYGTTCPIPPGKNYTYALQVKDQIGSFYYFPSLGFHKAAGGFGAIRISSRPRIPVPFPAPAGDYTVLIGDWYKTNHKDLRAQLDNGGKLPFPDGILINGRGSGATLNIEPGKTYRLRISNVGLQNSLNFRIQNHKMKLVEVEGTHTIQTPFSSLDVHVGQSYSVLITADQPAKDYYIVVSSRFTSKILITAGVLHYSNSAGPVSGPIPEAPIQLRWSFDQARAIKTNLAASGPRPNPQGTYHYGKIKVTRTIKLASSAGNINGKQRYAVNSASFYPTDTPLKLADYFKIAGVYNPGSIPDQPTHGAIYPVTSVMQTDYKAFVEIVFENWEDIVQTWHLDGYSFFVVGMELGKWSAASRKVYNLNDAVSRCTVQVYPRSWTAIYVSLDNVGMWNLRSELWERQYLGQQFYMRVYTPSTSLRDEYLIPKNALLCGRATGHHTTTPGPLSEGSERF

SEQ ID NO: 9416 - protein, 538 aa, Arabidopsis thaliana
MKVKSMNTRAMITTLLFLISLAFAEDPYRFFEWHVTYGNISPLGVAQQGILINGKFPGPDIISITNDNLIINVFNHLDEPFLLSWNGIRNWKNSFQDGVYGTMCPIPPGKNYTYALQVKDQIGSFYYFPSLGFHKAAGGFGGIRISSRALIPVPFPTPADDYTLLVGDWYKTNHKDLKAQLDNGGKLPLPDGILINGRSSGATLNIEPGKTYRLRISNVGLQNSLNFRIQNHTMKLVEVEGRYTIQNLFSSLDVHVGQSYSVLITADQPAKDYYVVVSSRFTSKILTTTGVLHYSNSVAPVSGPIPDGPIKLSWSFNQARAIRTNLTASGPRPNPQGSYRYGVINITRTIRLANNLGHIEGKQRYAVNSASFYPADTPLKLVDYFKIDGVYKPGSISDQPTNGAIFPTTSVMQADFRAFVEVIFENSEDIVQSWHLDGYSFYVVGMELGKWSPASRKVYNLNDAILRCTIQVYPRSWTAIYIALDNVGMWNMRSEIWERQYLGQQFYMRVYTTSTSLRDEYLIPKNALLCGRASSSHR

SEQ ID NO: 9417 - protein, 341 aa, Arabidopsis thaliana
MEEGSLWRQWTMFRSLLSILQWWGFNVTVIIMNKWIFQKLDFKFPLSVSCVHFICSSIGAYIVIKVLKLKPLIVVDPEDRWRRIFPMSFVFCINIVLGNISLRYIPVSFMQTIKSLTPATTVVLQWLVWRKYFDWRIWASLVPIVGGILLTSITELSFNVFGFCAALFGCLATSTKTILAESLLHGYKFDSINTVYYMAPFATMILGLPAFLLERNGILDWFEAHPSPWSALIILFNSGVLAFCLNFSIFYVIQSTTAVTFNVAGNLKVAVAVFVSWMIFRNPISPMNAVGCGITLVGCTFYGYVRHMLSQQQPGTPRTPRTPRNKMELIPLVNDKLESKI

SEQ ID NO: 9418 - protein, 389 aa, Arabidopsis thaliana
MGRGLMNSLKPYLAMISMQFGYAGMYIITMVSLKHGMNHYVLAVYRHAIATAVIAPFALFHERKIRPKMTFRIFLQIALLGFIEPVLDQNLYYVGMTYTSATFASATANVLPAITFVLAIIFRLESVNFKKVRSIAKVVGTVITVSGALLMTLYKGPIVDFIRFGGGGGGGSDGAGGSHGGAGAAAMDKHWIPGTLMLLGRTFGWAGFFILQSFTLKQYPAELSLTTLICLMGTLEGTAVSLVTVRDLSAWKIGFDSNLFAAAYSGVICSGVAYYVQGVVMRERGPVFVATFNPLCVVITAALGVVVLSESIHLGSVIGTLFIIVGLYTVVWGKGKDKRMTDDDEDCKGLPIKSPVKPVDTGKGLAAELEMKSKEGQEAKATTTTQVEI

SEQ ID NO: 9419 - protein, 794 aa, Arabidopsis thaliana
MKGSSESSSRGLNNTSGVSEFCTDGSKSLSHIDYVRSLLGSHKEANLGGLDDDSIVRALECEDVSLRQWLDNPDRSVDAFECFHVFRQIVEIVNAAHSQGIVVHNVRPSCFVMSSFNNVSFIESASCSDSGSDEDATTKSREIGSSRQEEILSERRSKQQEEVKKQPFPMKQILAMEMSWYTSHEEDNGSLCNCASDIYRLGVLLFELFCPVSSREEKSRTMSSLRHRVLPPQILLNWPKEASFCLWLLHPEPSCRPSMSELLQSEFINEPRENLEEREAAMELRDRIEEQELLLEFLFLIQQRKQEAADKLQDTISLLSSDIDQVVKRQLVLQQKGRDVRSFLASRKRIRQGAETTAAEEENDDNSIDEESKLDDTLESTLLESSRLMRNLKKLESVYFATRYRQIKAATAAEKPLARYYSALSCNGRSSEKSSMSQPSKDPINDSRQGGWIDPFLEGLCKYLSFSKLRVKADLKQGDLLNSSNLVCAIGFDRDGEFFATAGVNKKIKIFECESIIKDGRDIHYPVVELASRSKLSGICWNSYIKSQVASSNFEGVVQVWDVARNQLVTEMKEHEKRVWSIDYSSADPTLLASGSDDGSVKLWSINQGVSIGTIKTKANICCVQFPSETGRSLAFGSADHKVYYYDLRNPKLPLCTMIGHHKTVSYVRFVDSSTLVSSSTDNTLKLWDLSMSISGINETPLHSFMGHTNVKNFVGLSVSDGYIATGSETNEVFVYHKAFPMPVLSYKFKTIDPVSELEVDDASQFISSVCWRGQSSTLVAANSTGNIKILEMV

SEQ ID NO: 9420 - protein, 185 aa, Arabidopsis thaliana
MPNITMGLKPDPVAPTNPTHHESNAAKEIRYRGVRKRPWGRYAAEIRDPVKKTRVWLGTFDTAQQAARAYDAAARDFRGVKAKTNFGVIVGSSPTQSSTVVDSPTAARFITPPHLELSLGGGGACRRKIPLVHPVYYYNMATYPKMTTCGVQSESETSSVVDFEGGAGKISPPLDLDLNLAPPAE

SEQ ID NO: 9421 - protein, 502 aa, Arabidopsis thaliana
MSGFEDGFSAEKLFSQGYSYTYDDVIFLPHFIDFSTDAVSLSTRLSKRVPLSIPCVASPMDTVSESHMAAAMAALGGIGIVHYNCDIDTQASVIRHAKSLQVPIASDAVFKCPEHQIGSVDDFGPSSFVFVSQTGTLTPKLLGYVSKSEWSSMKDDQKEVKIYDYMKSCENKDYYVPWDIDLDKIEAVLEDKQKGFVVLEKEGETVNVVTKDDVERVKGYPKLGSGTVGADKKWMVGAAIGTRESDKERLEHLVKAGANVVVLDSSQGNSIYQLEMIKYVKNTYPELDVVGGNVVTMYQAENLIKAGVDGLRVGMGSGSICTTQEVCAVGRGQATAVYKVSTLAAQHGVPVIADGGISNSGHIVKALVLGASTVMMGSFLAGSTEAPGAYEYRNGRRVKKYRGMGSLEAMTKGSDQRYLGDTAKLKIAQGVVGAVADKGSVLKFIPYTMHAVKQGFQDLGASSLQSAHELLRDNTLRLEARTGAAQIEGGIHGLVSYEKKSF

SEQ ID NO: 9422 - protein, 381 aa, Arabidopsis thaliana
MAKKALLIGINYPGTAVELRGCVNDVHRMQKCLIELYGFANKDIVIMIDTDKSCIQPTGKNICDELDNLIASGQSGDFLVFHYSGHGTRIPPGIEDSEDPTGFDECITPCDMNLIKDQQFREMVSRVKEGCQLTIISDSCHSGGLIQEVKEQIGESHMKPVDKVKEQIEESHMKQPKLGIASYFLNIVMNLLATCGVSKSQRDRGGGEESFRGEIELEKDETLDIKTRYLPFESYLSLLKEQTGQTNIEPVRIRQTLLKLFGEDPSPNRQRGLSDLGNCEVDAGDSGASRLNAVTDNGILLSGCQTDQRSEDVYVTRTGKAYGAFSDAIQMILSAPRKDKKKITNKELVSEARVFLKKRGYSQRPGLYCHDRFVDKPFICY

SEQ ID NO: 9423 - protein, 388 aa, Arabidopsis thaliana
MAKRALLIGINYPGTTEELQGCVNDVHRMHKCLVDRFGFAEEDITVLIDTDESYTQPTGKNIRQALSELIKPAKSGDVLFVHYSGHGTRVPPETGEEDDTDDDFRDLVEQVPEGCQITIVSDSCHSGGLIDEAKEQIGESTTTKPNRESKVSSFEFEFKNCLHSIFVKLLAFCGIGSSHVETREIVEVGEGDEVVRSRYLPLERFIELLKQQTGQDNIEIGKIRPTLFDVFGEDSSPKIKKFMKVILTKLRKTNDQSTLLGKIEESARGYIEETLNDEHYMKPAMQAQVKSDREIYGGRSSNGLFPDRGILLSGCQTDETSADVKKKGEAFGAFSNAIQMVLSETDHKDKITNKEMVLRAREILKKQMFIQRPGLYCNDRFVNAPFIC

SEQ ID NO: 9424 - protein, 368 aa, Arabidopsis thaliana
MAKKALLIGINYVGTKAELRGCVNDVRRMRISLVERYGFSEENIKMLIDTDSSSIKPTGKNIRQALLDLVEPAKSGDVLFVHYSGHGTRLPAETGEDDDTGYDECIVPSDMNLITDDDFRDLVDMVPKDCPITIISDSCHSGGLIDEAKEQIGESTKKKKDSGDSSTINKETEAEIIEVGNRSLPLETLIDMLKQETGNDDIEVGKIRTTLFDMFGDDSSPKVKKFMNVILSNLQETTTTIQTVSDEVLGSVENLAQEFLEQKLSDDVKPAIQDVYAGAINGALPDNGILISGCQTDQTSSDASPPGHPELAYGALTNAIQIIIGETKGKISNKDLVLKARKLLRKQGFDQRPGLYCNDAYVNARFIC

SEQ ID NO: 9425 - protein, 410 aa, Arabidopsis thaliana
MAKKAVLIGINYPGTKAELRGCVNDVRRVHKSLVDRFGFSERNITELIDTDESSTKPTGKNIRRALLNLVESAKPGDVLVVHYSGHGTRLPAETGEDDDTGYDECIVPCDMNLITDDEFRDLVEKVPKEAHITIISDSCHSGGLIDEAKEQIGESTKKKPKKESGGSSGLGIKGFVREAVEEALESKGIAIPHHKDEKDENKTKELKLEDGAKVHVVNKSLPLQTLIDILKQNTGNNDIEVGKIRPTLFNVFGEDASPKVKKFMKVILTKLQEGKTEGGILGMIGKLAQEFLKHKLNDDEEYVKPAMKTHVGNKQEVYAGASNGSLADNGILISGCQTDQTSADASPQGHPEMAYGAFTNAVQIILEETKGMITYKELVLKARKLLKKQGFSQRPGLYCSDSFVNAPFIC

SEQ ID NO: 9426 - protein, 418 aa, Arabidopsis thaliana
MTKKAVLIGINYPGTKAELRGCVNDVRRMYKCLVERYGFSEENITVLIDTDESSTQPTGKNIRRALADLVESADSGDVLVVHYSGHGTRLPAETGEDDDTGFDECIVPCDMNLITDDDFRDLVDKVPPGCRMTIISDSCHSGGLIDEAKEQIGESTKKEAEDEDESEESSSRFGFRKFLRSKVEGAIESRGFHIGGNKKDEDEAEEIETKEIELEDGETIHAKDKSLPLQTLIDILKQQTGNDNIEVGKIRPSLFDAFGDDSSPKVKKFMKVILGKLQAGNGEEGGLMGMLGKLASGFLEGKLNDEDYVKPAMQTHVGSKEEVYAGGSRGSVPLPDSGILISGCQTDQTSADATPAGKPTEAYGAMSNSIQTILEETDGEISNREMVTRARKALKKQGFTQQPGLYCHDGYANAPFIC

SEQ ID NO: 9427 - protein, 503 aa, Arabidopsis thaliana
MSTLEDGFPADKLFAQGYSYTYDDVIFLPHFIDFSTDAVSLSTRLSRRVPLSIPCVSSPMDTVSESHMAAAMASLGGIGIVHYNCGIAAQASIIRQAKSLKHPIASDAGVKFPEYEITSLDAFGPSSFVFVEQTGTMTTPKLLGYVTKSQWKRMNYEQREMKIYDYMKSCDSSDYCVPWEIDFEKLEFVLEDKQKGFVVLERDGETVNVVTKDDIQRVKGYPKSGPGTVGPDGEWMVGAAIGTRESDKERLEHLVNVGVNAVVLDSSQGNSIYQLEMIKYVKKTYPELDVIGGNVVTMYQAQNLIQAGVDGLRVGMGSGSICTTQEVCAVGRGQATAVYKVCSIAAQSGIPVIADGGISNSGHIVKALVLGASTVMMGSFLAGSTEAPGGYEYTNGKRIKKYRGMGSLEAMTKGSDQRYLGDQTKLKIAQGVVGAVADKGSVLKLIPYTMHAVKQGFQDLGASSLQSAHGLLRSNILRLEARTGAAQVEGGVHGLVSYEKKSF

SEQ ID NO: 9428 - protein, 536 aa, Arabidopsis thaliana
MNAAVFSPSALSLPISFSKTRSSFLSRKKGVKGEFRVFAVFGDESGLVEKKSQWRPLFDVEDPRSKAPPYKGKFLDVNQAIEVARFDIQYLDWRARQDLLTIMILHDKVVDVLNPLAREYKSIGTVKKELAGLQEELSKAHQQVHISEARVSTALDKLAHMEELVNDRLLPGRVVTELDKPSSSTTASAVELDREKTNTGAKSLNVSGPVPPYSPHLKNFWYPVAFTADLKHDTMVPIECFEQPWVIFRGEDGKPGCVRNTCAHRACPLDLGTVNEGRIQCPYHGWEYSTDGECKKMPSTKLLKVKIKSLPCLEQEGMIWIWPGDEPPAPILPSLQPPSGFLIHAELVMDLPVEHGLLLDNLLDLAHAPFTHTSTFAKGWSVPSLVKFLTPTSGLQGYWDPYPIDMEFKPPCIVLSTIGISKPGKLEGKSTQQCATHLHQLHVCLPSSKNKTRLLYRMSLDFAPILKNLPFMEHLWRHFAEQVLNEDLRLVLGQQERMLNGANIWNLPVAYDKLGVRYRLWRNAVDRGDDKLPFSG

SEQ ID NO: 9429 - protein, 942 aa, Arabidopsis thaliana
MSSSSQAMLQKSDSIAEKMPDALKQSRYHMKRCFASFVGGGKKLMKREHLMNEIEKCIEDSRERSKILEGLFGYILTCTQEAAVVPPFVALAARPNPGFWEYVKVNSGDLTVDEITATDYLKLKESVFDESWSKDENALEIDFGAIDFTSPRLSLSSSIGKGADYISKFISSKLGGKSDKLEPLLNYLLRLNHHGENLMINDDLNTVAKLQKSLMLAVIVVSTYSKHTPYETFAQRLKEMGFEKGWGDTAERVKETMIILSEVLEAPDNGKLDLLFSRLPTVFNVVIFSVHGYFGQQDVLGLPDTGGQVVYILDQVRALEEELLIRINQQGLGFKPQILVVTRLIPEARGTKCDQELEAIEGTKHSHILRVPFVTNKGVLRQWVSRFDIYPYLERFTQDATSKILQRLDCKPDLIIGNYTDGNLVASLMATKLGVTQGTIAHALEKTKYEDSDAKWKELDPKYHFSCQFTADLIAMNVTDFIITSTYQEIAGSKDRPGQYESHTAFTMPGLCRVVSGIDVFDPKFNIAAPGADQSVYFPYTEKDKRFTKFHPSIQELLYNEKDNAEHMGYLADREKPIIFSMARLDTVKNITGLVEWYGKDKRLREMANLVVVAGFFDMSKSNDREEKAEIKKMHDLIEKYKLKGKFRWIAAQTDRYRNSELYRCIADTKGVFVQPALYEAFGLTVIEAMNCGLPTFATNQGGPAEIIVDGVSGFHIDPNNGDESVTKIGDFFSKCRSDGLYWDNISKGGLKRIYECYTWKIYAEKLLKMGSLYGFWRQVNEDQKKAKKRYIEMLYNLQFKQLTKKVTIPEDKPLPLRLASLRNLLPKKTTNLGAGSKQKEVTETEKTKQKSKDGQEQHDVKVGEREVREGLLAADASERVKKVLESSEEKQKLEKMKIAYGQQHSQGASPVRNLFWSVVVCLYICYILKQRFFGANSAQEY

SEQ ID NO: 9430 - protein, 555 aa, Arabidopsis thaliana
MVGEEDSERAQSSKMEIERESNLGSASVLMQSKVISVSNFFSIHRFHYPREKIVSFLFPSVFSRIMASYGEEREIQKNYWKEHSVGLSVEAMMLDSKASDLDKEERPEILAFLPPIEGTTVLEFGAGIGRFTTELAQKAGQVIAVDFIESVIKKNENINGHYKNVKFLCADVTSPNMNFPNESMDLIFSNWLLMYLSDQEVEDLAKKMLQWTKVGGYIFFRESCFHQSGDNKRKYNPTHYREPKFYTKLFKECHMNDEDGNSYELSLVSCKCIGAYVRNKKNQNQICWLWQKVSSDNDRGFQRFLDNVQYKSSGILRYERVFGEGFVSTGGLETTKEFVDMLDLKPGQKVLDVGCGIGGGDFYMAENFDVDVVGIDLSVNMISFALEHAIGLKCSVEFEVADCTKKEYPDNTFDVIYSRDTILHIQDKPALFRRFYKWLKPGGKVLITDYCRSPKTPSPDFAIYIKKRGYDLHDVQAYGQMLRDAGFEEVIAEDRTDQFMKVLKRELDAVEKEKEEFISDFSKEDYEDIIGGWKSKLLRSSSGEQKWGLFIAKRN

SEQ ID NO: 9431 - protein, 1067 aa, Arabidopsis thaliana
MAEENRKDRGVSSTVAIPSGLNRIKTRLASSGPRPEDSSDTVLKPPFNRNQKTIVPRGHGRTTGSSKQERKGTKLSRWLASYKPKYSCHPPKYACSSTTSSEEIKLRGKNSGKDEEKMIKISETNPPCSKSMGIKSFSHELGPRGGVQTPYPRPHSYNDLKELLGSLHSRFDVAKETVDKKLDVFVRDVKEAMEKMDPSCPEDREMAEQLLDVARACMEMTSAQLRATCESIVQDLTRKRKQCQAGLVKWLFSQLLFILTHCTRVVMFQKETEPIDESSFRKFKECLERIPALETDWGSTPRVDDSGSGYPEYQRNEAGQKFKRRDKESLESETALDYVVPNDHGNNAAREGYAAAKQEFPSHEPQFDSKVVEQRFYLSDEYEDKMSNEPGKELGGSDYVICRICEEEVPLFHLEPHSYICAYADKCEINCVDVDERLLKLEEILEQIIDSRSLNSFTQAGGLENSVLRKSGVASEGCSPKINEWRNKGLEGMFEDLHEMDTAFIDESYTYPIHLKSHVGAKFCHHATSSSTGSITSVSSTNTPRTSHFDSYWLERHCPEQEDLRLMMDLSDIARCGASTDFSKEGSCDYIMACMQDIQAVLKQGKLKALVIDTFGGRIEKLLCEKYLHARELTADKSSVGNIKESEDVLEHASATPQLLLKDRISIDDFEIIKPISRGAFGKVFLARKRTTGDFFAIKVLKKLDMIRKNDIERILQERNILITVRYPFLVRFFYSFTCRDNLYLVMEYLNGGDLYSLLQKVGCLDEEIARIYIAELVLALEYLHSLKIVHRDLKPDNLLIAYNGHIKLTDFGLSKIGLINNTIDLSGHESDVSPRTNSHHFQKNQEEERIRHSAVGTPDYLAPEILLGTEHGYAADWWSAGIVLFELLTGIPPFTASRPEKIFDNILNGKMPWPDVPGEMSYEAQDLINRLLVHEPEKRLGANGAAEVKSHPFFQGVDWENLALQKAAFVPQPESINDTSYFVSRFSESSCSDTETGNNSGSNPDSGDELDECTNLEKFDSPPYYLSLINFSFKNLSQLASINHDVLLQKDPAKGGGDSPFKSHGT

SEQ ID NO: 9432 - protein, 569 aa, Arabidopsis thaliana
MDSARSWFHKFQPRDKPRKKDMFSGSTYGGGVTETTVPDGGNDTETATKLPPLGGDGEALSNSTKQKVAAAKQYIENHYKEQMKNLNERKERRTTLEKKLADADVCEEDQTNLMKFLEKKETEYMRLQRHKMGADDFELLTMIGKGAFGEVRVVREINTGHVFAMKKLKKSEMLRRGQVEHVRAERNLLAEVDSNCIVKLYCSFQDNEYLYLIMEYLPGGDMMTLLMRKDTLSEDEAKFYIAESVLAIESIHNRNYIHRDIKPDNLLLDRYGHLRLSDFGLCKPLDCSVIDGEDFTVGNAGSGGGSESVSTTPKRSQQEQLEHWQKNRRMLAYSTVGTPDYIAPEVLLKKGYGMECDWWSLGAIMYEMLVGYPPFYADDPMSTCRKIVNWKTHLKFPEESRLSRGARDLIGKLLCSVNQRLGSTGASQIKAHPWFEGVQWEKIYQMEAAFIPEVNDDLDTQNFEKFDEEDNQTQAPSRTGPWRKMLSSKDINFVGYTYKNFEIVNDYQVPGIAELKKKESKSKRPSVKSLFESESDSSSSGSEQQTINRSYSNPTPRGMEPNLRRLDSE

SEQ ID NO: 9433 - protein, 279 aa, Arabidopsis thaliana
MFSAPVVRRSGEYGLLYAAEPLDACSYLTNMAEKGSKFRPSYVLIVRGGCSFEEKIRNAQEAGYKAAIVYNDRYEELLVRRNSSGVYIHGVLVTRTSGEVLKEYTSRAEMELLLIPGFGISSWSIMAITFVSLLVISAVLASYFSVRRHRIRQHVRDLHHGGQGHSRMPKDLLQSMPTEVYTGVLEEGSTSVTCAICIDDYRVGEILRILPCKHKYHAVCIDSWLGRCRSFCPVCKQNPRTGNDVPPASETTPLISPGPNSITSLQSFYDLPIVVRVYL

SEQ ID NO: 9434 - protein, 318 aa, Arabidopsis thaliana
MNYSWITIMSLLVICKLASAKVVLIGKNTILSFDDVEATFSKFSQNSGECGILYVAEPLEACSDITNMAEKRSKYRSSYVLIVLGGCSFEEKVRKAQKAGYKAAIVYNDGYDELLVPMAGNSSGVDIHGLLVTRASGEVLKGYADQDEMKLWLIPGFGISSWSIMGITFISLLAMSAILATCFVVRRHQIRQSVRDLPHGGQGLSCMPRDLLQSMPTEVYSGVLEESSTSVTCAICIDDYCVGEKLRILPCKHKYHAVCIDSWLGRCRSFCPVCKQNPRTGNDVPPASETTPLISPSPNSITSLQSFYDLPIVVRVYL

SEQ ID NO: 9435 - protein, 189 aa, Arabidopsis thaliana
MDEFVNLKETELRLGLPGTDNVCEAKERVSCCNNNNKRVLSTDTEKEIESSSRKTETSPPRKAQIVGWPPVRSYRKNNIQSKKNESEHEGQGIYVKVSMDGAPYLRKIDLSCYKGYSELLKALEVMFKFSVGEYFERDGYKGSDFVPTYEDKDGDWMLIGDVPWEMFICTCKRLRIMKGSEAKGLGCGV

SEQ ID NO: 9436 - protein, 229 aa, Arabidopsis thaliana
MMGSVELNLRETELCLGLPGGDTVAPVTGNKRGFSETVDLKLNLNNEPANKEGSTTHDVVTFDSKEKSACPKDPAKPPAKAQVVGWPPVRSYRKNVMVSCQKSSGGPEAAAFVKVSMDGAPYLRKIDLRMYKSYDELSNALSNMFSSFTMGKHGGEEGMIDFMNERKLMDLVNSWDYVPSYEDKDGDWMLVGDVPWPMFVDTCKRLRLMKGSDAIGLAPRAMEKCKSRA

SEQ ID NO: 9437 - protein, 133 aa, Arabidopsis thaliana
MDQGGRSSGSGGGGAEQGKYRGVRRRPWGKYAAEIRDSRKHGERVWLGTFDTAEDAARAYDRAAYSMRGKAAILNFPHEYNMGTGSSSTAANSSSSSQQVFEFEYLDDSVLDELLEYGENYNKTHNINMGKRQ

SEQ ID NO: 9438 - protein, 261 aa, Arabidopsis thaliana
MVHEQLNLIRKIVGILGNFISLCLFLSPTPTFIHIVKKKSVEKYSPLPYLATLLNCLVRALYGLPMVHPDSTLLVTISGIGITIEIVFLTIFFVFCGRQQHRLVISAVLTVQVVFVATLAVLVLTLEHTTDQRTISVGIVSCVFNAMMYASPLSVMKMVIKTKSLEFMPFLLSVVGFLNAGVWTIYGFVPFDPFLAIPNGIGCVFGLVQLILYGTYYKSTKGIMEERKNRLGYVGEVGLSNAIAQTEPENIPYLNKRVSGV

SEQ ID NO: 9439 - protein, 388 aa, Arabidopsis thaliana
MDKTFFSSNEGKPITCKAAICRKAGEALVIEDIHVDPPQAYEVRIKILCTSLCHTDLTFWKLSFGPISRFPRILGHEAVGVVESIGENVDGFKQGDVVLPVFHPYCEECKDCKSSKTNWCDRYAEDFISNTRRYGMASRFKDSSGEVIHHFLFVSSFSEYTVVDIAHLVKISPEIPVDKAALLSCGVSTGIGAAWKVANVEEGSTIAIFGLGAVGLAVAEGARLRGAAKIIGIDTNSDKFELGKKFGFTDFINPTLCGEKKISEVIKEMTEGGVDYSFECVGLASLLNEAFISTRTGTGKTVMLGMEKHAAPISLGSFDLLRGRVICGSLFGGLKSKLDIPILVDHYLKKELNLDSFITHELNFKEINKAFALLEEGKSLRCILWMDK

SEQ ID NO: 9440 - protein, 386 aa, Arabidopsis thaliana
MDKASITEGKPIRCKAAILRKAGEPLVIEEIQVDPPQAYEVRIKILCTSLCHTDVTFWKLDSGPLARFPRILGHEAVGVVESIGEKVDGFKQGDVVLPVFHPQCEECKECISPKSNWCTKYTNDYLSNTRRYGMTSRFKDSRGEDIHHFIFVSSFTEYTVVDIAHLVKISPEIPVDIAALLSCSVATGLGAAWKVADVEEGSTVVIFGLGAVGLAVAEGVRLRGAAKIIGVDLNPAKFEIGKRFGITDFVNPALCGEKTISEVIREMTDVGADYSFECIGLASLMEEAFKSTRPGSGKTIVLGMEQKALPISLGSYDLLRGRTVCGTLFGGLKPKLDIPILVDRYLKKELNLEDLITHELSFEEINKAFHLLAEGNSIRCIIWMDK

SEQ ID NO: 9441 - protein, 422 aa, Arabidopsis thaliana
MNLVVLLILTLLLFIVSYVVDAGQVILVDSNITRSFVDMEADFSPSVTTVETGVVYVAEPLNACRNLRNKPEQSPYGTSPLVLIIRGGCSFEYKVRNAQRSGFKAAIVYDNVDRNFLSAMGGDSDGIKIQAVFVMKRAGEMLKKYAGSEEMEVMLVPPNTEDSVWSLYASIALILSLAIFCVMVTCVFFYRYCSTIRNSTSQFNGMCRRTVKAMPSVTFTCAKIDNTTGFSCAICLEDYIVGDKLRVLPCSHKFHVACVDSWLISWRTFCPVCKRDARTTADEPLATESTPFLSSSIATSSLVCIDSPPLGSSVSFSPAHVSSSFIHQFVRSSPMNGSRISENLRRQASPLQSSSQRSHLSMKSSHSLGYSTMSPLNAMGMSPYRPYPSNASPGLFSSTNHLLSNYTANTFSHFASAHSLPD

SEQ ID NO: 9442 - protein, 645 aa, Arabidopsis thaliana
MQGERASLGSLSKALNFERGSTSSNAVVDQQIRWENLHNYGDNDLQDYMSSAADTNPTFANSVYHEKRGLQRFNIGEASSSGTKNEGASLTEQWKGIGRFEEQRNDKLELSPLFVQPSNGSRVVRDVNLNAEYNEHLEDMNPVTVHPGHFEVNGLRSEFLLDNSVRAGSSVDGRRASCKRKALDASGGQSSSTGGFREFQRGVSSSWISGPTYYSPAMTANDLNISLDHGRRGLVSSAVPNLSPPTITESSSRNYPVWVNPTYQQETVSNFAPSLNSPGLIPADHQQISMRYGHALGNFASQNPNAPATHMPPVSRNTFQWNTSPVAAVISSSSATPVDRNVIHRNATRQRSNTLEIPLFVPAPELRNVAHGHISRNASGARHVASSSSRTSVQPSPSSPALTPYQNNSLHNQRRLSENFRRSLLSSLVTQQRAARSLAHPASPNEHVLQSGGDNTSQVHNRASSRAGPRQGQDATGISHSLRGLASTSRGRTRMGASEIRNILEHMRRAGNLRLEDVMLLNQSIMLGAADIHDRYRDMRLDVDNMTYEELLSLEERIGDVCTGLNEETISNRLKQQKYKSSTRSSQEVEPCCVCQEEYKEEEEIGRLECGHDFHSQCIKEWLKQKNLCPICKTTGLNTANKPQR

SEQ ID NO: 9443 - protein, 325 aa, Arabidopsis thaliana
MALHPHLQDSKNFRDFCGIDGQISPELGFNRSENLHDQSQHPPYIPPFHVAGFAPGPVVQIDGSDGGNGADFEWNYGLGLEPRRERIKEQDFLENNSQISSIDFLQARSVSTGLGLSLDNARVASSDGSALLSLVGDDIDRELQRQDADIDRFLKIQGDQLRHAILDKIKRGQQKTVSLMEEKVVQKLREKDEELERINRKNKELEVRMEQLTMEAEAWQQRAKYNENMIAALNYNLDRAQGRPRDSIEGCGDSEVDDTASCFNGRDNSNNNTKTMMMCRFCGVREMCMLLLPCNHMCLCKECERKLSSCPLCQSSKFLGMEVYM

SEQ ID NO: 9444 - protein, 624 aa, Arabidopsis thaliana
MEAVIQTRGLLSLPTKPIGVRSQLQPSHGLKQRLFAAKPRNLHGLSLSFNGHKKFQTFEPTLHGISISHKERSTEFICKAEAAAAGDGAVFGEGDSAAVVASPKIFGVEVATLKKIIPLGLMFFCILFNYTILRDTKDVLVVTAKGSSAEIIPFLKTWVNLPMAIGFMLLYTKLSNVLSKKALFYTVIVPFIIYFGAFGFVMYPLSNYIHPEALADKLLTTLGPRFMGPIAILRIWSFCLFYVMAELWGSVVVSVLFWGFANQITTVDEAKKFYPLFGLGANVALIFSGRTVKYFSNLRKNLGPGVDGWAVSLKAMMSIVVGMGLAICLLYWWVNRYVPLPTRSKNKKEKPKMGTMESLKFLVSSPYIRDLATLVVAYGISINLVEVTWKSKLKAQFPSPNEYSAFMGDFSTCTGVATFTMMLLSQYVFNKYGWGVAAKITPTVLLLTGVAFFSLILFGGPFAPLVAKLGMTPLLAAVYVGALQNIFSKSAKYSLFDPCKEMAYIPLDEDTKVKGKAAIDVVCNPLGKSGGALIQQFMILSFGSLANSTPYLGMILLVIVTAWLAAAKSLEGQFNSLRSEEELEKEMERASSVKIPVVSQDESGNGSLGESPSSSPEKSAPTNL

SEQ ID NO: 9445 - protein, 461 aa, Arabidopsis thaliana
MGKENAVSGNSIPIHGRPVTRALASALRASSKLITSSEVAATTQNQGRVLRAKSKRTALDEKKANAPKKRAVLKDITNVTCENSYTSCFSVAVENIKQIKKGRQSSSSSKVASSSATSQVTDAKVEVVSNSAGASLSVFTDTSLGTNETSYSIIAKPSSRSPPRPFGTVERSCGGASSPKFVDIDSDDKDPLLCSLYAPDIYYNLRVAELKRRPFPDFMEKTQRDVTETMRGILVDWLVEVSEEYTLVPDTLYLTVYLIDWFLHGNYVERQRLQLLGITCMLIASKYEEIHAPRIEEFCFITDNTYTRDQVLEMESQVLKHFSFQIYTPTSKTFLRRFLRAAQVSFPNQSLEMEFLANYLTELTLMDYPFLKFLPSIIAASAVFLAKWTLNQSSHPWNPTLEHYTTYKASDLKASVHALQDLQLNTKGCSLNSIRMKYRQDKFKSVAVFSSGELPDKLFIS

SEQ ID NO: 9446 - protein, 419 aa, Arabidopsis thaliana
MDYLPVEVIGNILSRLGGARDVVIASATCRKWREACRKHLQTLSFNSADWPFYRDLTTNRLEILITQTIFQTMGLQGLSIMMDDANKFSAATVIAWLMYTRDTLRRLSYNVRTTPNVNILEICGRQKLEALVLAHNSITGVEPSFQRFPCLKSLSLSYVSISALDLNLLLSACPMIESLELVSLEIAMSDAQVTIELSSPTLKSVYFDGISLDKFILEADSIEFLHMKDCVLELFELIGNGTLKHFKLDDVSVIHLDIMETSESLEVVDVNHFTMVWPKFYQMISRSQKLKKLRLWDVVFDDDDEIIDVESIAAGFSHLTHLSLSYDLKDGAAHYSLQGTTQLENVTVLELGWTVINDVFSIWVEELLRRCPNLKKLIIYGVVSETKTQGDCQILATFTWSIVQLMRKYIHVEVQFEYE

SEQ ID NO: 9447 - protein, 337 aa, Arabidopsis thaliana
MGEDMRVVKVESKWPPIIVMVISQVAMGSVNALVKKALDVGVNHMIIGAYRIAISSFILAPIAYILEREIIPEITFRLMVDHFISGLLGASLMQFFYLLGLSYTSATVACALVSLMPAITFAFALILRTEKIKSLRTQAGMIKVMGTIICISGALFLTFYKGPHISNSHSHQEALPHNNNSDHNTKNWLLGCLYLTIGTVLISLWILFQGTLSIKYPCKFSSTCLMSIFAAFQCALLSLYKSRDVKDWIIDDRFVIGVIVYAGVIGQAMSTVSVTWGVKKLGAVFVSAIMPIALISASLFDFIILHTPLYLGSLIGSVGTITGLYVFLWGKNKDMEA

SEQ ID NO: 9448 - protein, 341 aa, Arabidopsis thaliana
MVVLPQPVTLDNHISLIPTYKPVPVLTSHSIPVVNLADPEAKTRIVKACEEFGFFKVVNHGVRPELMTRLEQEAIGFFGLPQSLKNRAGPPEPYGYGNKRIGPNGDVGWIEYLLLNANPQLSSPKTSAVFRQTPQIFRESVEEYMKEIKEVSYKVLEMVAEELGIEPRDTLSKMLRDEKSDSCLRLNHYPAAEEEAEKMVKVGFGEHTDPQIISVLRSNNTAGLQICVKDGSWVAVPPDHSSFFINVGDALQVMTNGRFKSVKHRVLADTRRSRISMIYFGGPPLSQKIAPLPCLVPEQDDWLYKEFTWSQYKSSAYKSKLGDYRLGLFEKQPLLNHKTLV

SEQ ID NO: 9449 - protein, 589 aa, Arabidopsis thaliana
MACSYILTPNPTKLNLSFAPSDLDAPSPSSSVSFTNTKPRRRKLSANSVSDTPNLLNFPNYPSPNPIIPEKDTSRWNPLQRAASAALDFAETALLRRERSKPLPKTVDPRHQISGNYAPVPEQSVKSSLSVDGKIPDCIDGVYLRNGANPLFEPVSGHHLFDGDGMVHAVKITNGDASYSCRFTETERLVQEKQLGSPIFPKAIGELHGHSGIARLMLFYARGLFGLLNHKNGTGVANAGLVYFHDRLLAMSEDDLPYQVRVTDNGDLETIGRFDFDGQLSSAMIAHPKIDPVTKELFALSYDVVKKPYLKYFKFSPEGEKSPDVEIPLASPTMMHDFAITENFVVIPDQQVVFKLSDMFLGKSPVKYDGEKISRFGILPRNAKDASEMVWVESPETFCFHLWNAWESPETDEVVVIGSCMTPADSIFNECDEQLNSVLSEIRLNLKTGKSTRRTIIPGSVQMNLEAGMVNRNLLGRKTRYAYLAIAEPWPKVSGFAKVDLSTGEVKNHFYGGKKYGGEPFFLPRGLESDGEDDGYIMSFVHDEESWESELHIVNAVTLELEATVKLPSRVPYGFHGTFVNSADMLNQA

SEQ ID NO: 9450 - protein, 769 aa, Arabidopsis thaliana
MATLADIGLAAAINILSALIFLLLFAILRIQPFNDRVYFPKWYLKGVRSSPVNSGAFVSKIMNLDFRSYVRFLNWMPDALKMPEPELIDHAGLDSAVYLRIYLIGLKIFGPIALLSWSILVPVNWTSDGLQLAKLRNVTSSNIDKLSISNVERGSDRFWAHLVMAYAFTFWTCYVLMKEYEKIAAMRLSFLQSEKRRADQFTVLVRNVPPDSDESISENVQHFFLVNHPDHYLTHQVVYNANELAKLVEDKKKMQNWLDYYQLKYTRNKEQRPRMGFLGLWGKKVDAMDHYTAEIEKLSEQIMEERKRIKKDDKSVMQAAFVSFKTRWGAAVCAQTQQTKNPTEWLTEWAPEAREMYWPNLAMPYVSLTVRRFVMHIAFFFLTFFFIIPIAFVQSLASIEGIEKSAPFLSPIVKNKLMKSLIQGFLPGIVLKLFLIFLPTILMIMSKFEGFISISSLERRAAFRYYIFNLVNVFLGSVITGSAFEQLDSFLKQSANDIPRTVGVAIPIKATFFITYIMVDGWAGVAGEIFRLKPLVIFHLKNFFFVKTEKDREEAMDPGQIDFYATEPRIQLYFLLGLVYAPVTPVLLPFIIFFFGFAYLVFRHQKYESAGAFWPDVHGRIISALIISQILLLGLMSTKGKVQSTPFLLVLAILTFGFHRFCKGRYESAFVINPLQEAMIKDTLERAREPNLNLKGFLQNAYVHPVFKDEEDSDEEGLIEDSDDEDCVVVQTKRQRSRRTTVASSNASRGSSQSTPFNQLDLGKGKPET

SEQ ID NO: 9451 - protein, 323 aa, Arabidopsis thaliana
MAAQVEIEDQTSVTNLDNGEIFDSISDDADSSVSHAGSSFSSSSLILLGEGNPEHDVIKTCLLSGMGVVSSDTTIVTISKNSSERGITTRAKFLAFRIFTDAVARKHGGDANVKYGWYAGSRDEIQRIISYGFSNRDVGKFENDGGSHGIGIHLVPSKCSLLAASATEQDEEGLRYLLLCRVILGKPEIIISGSKQSYPSSAEFDSGVDDLHNPRNYVIWSCNMNSCILPSYIVSFRSPRLRVSRGGFASRPSSPWVSFASLMSMLSTSMDPSRMNLIIRTYDDFRKRKIRRDQLVRKMREVAGDNLLAEIIKNHKNRNKVTN

SEQ ID NO: 9452 - protein, 302 aa, Arabidopsis thaliana
MDQYSSSLVDTSLDLTIGVTRMRVEEDPPTSALVEELNRVSAENKKLSEMLTLMCDNYNVLRKQLMEYVNKSNITERDQISPPKKRKSPAREDAFSCAVIGGVSESSSTDQDEYLCKKQREETVVKEKVSRVYYKTEASDTTLVVKDGYQWRKYGQKVTRDNPSPRAYFKCACAPSCSVKKKVQRSVEDQSVLVATYEGEHNHPMPSQIDSNNGLNRHISHGGSASTPVAANRRSSLTVPVTTVDMIESKKVTSPTSRIDFPQVQKLLVEQMASSLTKDPNFTAALAAAVTGKLYQQNHTEK

SEQ ID NO: 9453 - protein, 327 aa, Arabidopsis thaliana
MAEGLVLKGTMRAHTDMVTAIATPIDNADIIVSASRDKSIILWKLTKDDKAYGVAQRRLTGHSHFVEDVVLSSDGQFALSGSWDGELRLWDLAAGVSTRRFVGHTKDVLSVAFSLDNRQIVSASRDRTIKLWNTLGECKYTISEGGEGHRDWVSCVRFSPNTLQPTIVSASWDKTVKVWNLSNCKLRSTLAGHTGYVSTVAVSPDGSLCASGGKDGVVLLWDLAEGKKLYSLEANSVIHALCFSPNRYWLCAATEHGIKIWDLESKSIVEDLKVDLKAEAEKADNSGPAATKRKVIYCTSLNWSADGSTLFSGYTDGVIRVWGIGRY

SEQ ID NO: 9454 - protein, 358 aa, Arabidopsis thaliana
MCGGAIISDFIPPPRSRRVTSEFIWPDLKKNLKGSKKSSKNRSNFFDFDAEFEADFQGFKDDSSIDCDDDFDVGDVFADVKPFVFTSTPKPAVSAAAEGSVFGKKVTGLDGDAEKSANRKRKNQYRGIRQRPWGKWAAEIRDPREGARIWLGTFKTAEEAARAYDAAARRIRGSKAKVNFPEENMKANSQKRSVKANLQKPVAKPNPNPSPALVQNSNISFENMCFMEEKHQVSNNNNNQFGMTNSVDAGCNGYQYFSSDQGSNSFDCSEFGWSDQAPITPDISSAVINNNNSALFFEEANPAKKLKSMDFETPYNNTEWDASLDFLNEDAVTTQDNGANPMDLWSIDEIHSMIGGVF

SEQ ID NO: 9455 - protein, 589 aa, Arabidopsis thaliana
MGGGGNLVDGVRRWLFQRPSSSSSSSSSNNNNNNHEQPIFNSSSFSSSSNPNHSANSGELIIEEDLDFSGLTLINVPKRNHLPMDPHKKGETEFFTEYGEANRYQIQEVVGKGSYGVVASAVDSHTGERVAIKKINDVFEHVSDATRILREIKLLRLLRHPDVVEIKHIMLPPSRREFRDIYVVFELMESDLHQVIKANDDLTPEHYQFFLYQLLRGLKYVHAANVFHRDLKPKNILANADCKLKICDFGLARVSFNDAPTAIFWTDYVATRWYRAPELCGSFFSKYTPAIDIWSVGCIFAEMLLGKPLFPGKNVVHQLDLMTDFLGTPPPESISRIRNEKARRYLSSMRKKQPVPFSHKFPKADPLALRLLERLLAFDPKDRASAEDALADPYFSGLSNSEREPTTQPISKLEFDFERKKLVKDDVRELIYREILEYHPQMLEEYLRGGDQLSFMYPSGVDRFKRQFAHLEENQGKPGAAGGGRSTALHRHHASLPRERVPAPNGETAEESSDVERRAAAAVASTLESEEADNGGGYSARNLMKSASISGSKCIGVQSKTDKEDTIAEEEDNETVAELTDKVASLHNS

SEQ ID NO: 9456 - protein, 321 aa, Arabidopsis thaliana
MVKGSQKIVAVDQDIPIIDMSQERSQVSMQIVKACESLGFFKVINHGVDQTTISRMEQESINFFAKPAHEKKSVRPVNQPFRYGFRDIGLNGDSGEVEYLLFHTNDPAFRSQLSFSSAVNCYIEAVKQLAREILDLTAEGLHVPPHSFSRLISSVDSDSVLRVNHYPPSDQFFGEANLSDQSVSLTRVGFGEHTDPQILTVLRSNGVGGLQVSNSDGMWVSVSPDPSAFCVNVGDLLQVMTNGRFISVRHRALTYGEESRLSTAYFAGPPLQAKIGPLSAMVMTMNQPRLYQTFTWGEYKKRAYSLRLEDSRLDMFRTCKD

SEQ ID NO: 9457 - protein, 503 aa, Arabidopsis thaliana
MGSEATTAVNNLQQPLLESTKSEADFRMESVLTDTHLSYFRRIYLASLIEMKYLFHLAAPAIFVYVINNGMSMLTRIFAGRLGSMQLAAASLGNSGFNMFTLGLMLGMGSAVETLCGQAHGAHRYDMLGVYLQRSTIVLVITGLPMTLLFIFSKPLLISLGEPADVASVASVFVYGMIPMIFAYAVNFPIQKFLQSQSIVTPSAYISAATLVIHLILSWLSVFKFGWGLLGLSVVHSLSWWIIVLAQIIYIKISPRCRRTWDGFSWKAFDGLWDFFQLSAASAVMLCLESWYSQILVLLAGLLKDPELALDSLAICMSISAMSFMVSVGFNAAASVRVSNELGAGNPRSAAFSTAVTTGVSFLLSLFEAIVILSWRHVISYIFTDSPAVAEAVAELSPFLAITIVLNGVQPVLSGVAVGCGWQAYVAYVNIGCYYIVGIPIGYVLGFTYDMGARGIWTGMIGGTLMQTIILVIVTFRTDWDKEVEKASRRLDQWEDTSPLLKQ

SEQ ID NO: 9458 - protein, 367 aa, Arabidopsis thaliana
MAKMINKTLVLTYIYLLIYIILSSGVILYNKWVLSPKYFNFPLPITLTMIHMGFSGFVAFLLIRVFKVVSPVKMTFEIYVTCVVPISAFFASSLWFGNTAYLHISVAFIQMLKALMPVATFLMAVVCGTDKARCDVFMNMVLVSVGVVVSSYGEINFNVIGTVYQVMGIFAEALRLVLTQVLLQKKGLTLNPVTSLYYIAPCSFVFLSLPWYVLEKPNIDVSQIQFNFWIFFSNALCALALNFSIFLVIGRTGAVTIRVAGVLKDWILIALSTVIFPESTITGLNITGYAIALCGVVMYNYIKIKDVKAIQPTTDSLPDRITKDWKEKNSSDGGSPRGLELNDEEAPLITSRLSHIGRTQLGNHTAV

SEQ ID NO: 9459 - protein, 513 aa, Arabidopsis thaliana
MAMMRTSPRDSISNLPDEILGKILSLLPTKVAASTSVLSKRWRNLLGLVDNLCFDESMVVYPNEEEETSGSLRFCDFVDKTFALLSNSHIKKFSLSRVYKYNDDVDGMVRRWIRTVMERGLLEIHLHATPMSFVAIETKLLTSNTLVKLTLSARCFVEVERVFFPALKSLSLFSILGDYTNYIRLIDGCPVLEELYMRDGDYPFLRLTCGTNVESASLKRLVIFTHNPNEMIWHELIYFEAPSLVYLDYSSYVSAKYDVVDFDLLVEARLSLRLWVSTNDYDYSDDDDDDDDDDDDDDDDDDDDDDDDDDDDDDDDDDDDDDDDDGDYYIVEPKAPIFGDVTELLAAIRNITTLHLSPDSLEVFHFCCKSMPVFNNLLNLSIESNKDKGWQVMPLLLKSCPNLHTLVIKGLVHRVTSRCGDACACIPKKQRKIVQKEEALCCLRTCQVKVLQISEYGGYFQELKQMRHFLGKLECLETVKVGVHAENNNNSEFLRANVLTLPRVSAKCNVHFI

SEQ ID NO: 9460 - protein, 289 aa, Arabidopsis thaliana
MAFLSKVGRLFSQTSSHVTASSSMLQSIRCMSSSKIFVGGISYSTDEFGLREAFSKYGEVVDAKIIVDRETGRSRGFAFVTFTSTEEASNAMQLDGQDLHGRRIRVNYATERGSGFGGRGFGGPGGGYGASDGGYGAPAGGYGGGAGGYGGNSSYSGNAGGGGGYGGNSSYGGNAGGYGGNPPYSGNAVGGGGGYGSNFGGGGGYGVAGGVGGSENFAQGSSTNAGFDDKFESNQPLGNDTDHQTESGLGGDEQFGGSDNQFGDAENGNTENGPVGFDQTDDGDVAKRA

SEQ ID NO: 9461 - protein, 261 aa, Arabidopsis thaliana
MWNLASKSIREGFISKGEEAATKPRRATLDRSGDGRKTTKEEKLECPICWESFNVVENVPYVLWCGHTICKYCLLGLQRAIVIKSSALPFQLPFFVACPWCNILSLRLVCNGTIRFPSKNFYLLWMVESMNGSRSEAPSDNKRVASGQRDLRNRCDGVSNTALGDEGLLDNRSWWNGVTRGFFRTGRLHDSVRKSMALVAHLLAKFPLVVIFLLMALYAIPVSAAVLGVYFFVTFALAVPSFLVLYFAFPSLNWLIREIAT

SEQ ID NO: 9462 - protein, 356 aa, Arabidopsis thaliana
MLCIIIIENMERVCEFCKAYRAVVYCIADTANLCLTCDAKVHSANSLSGRHLRTVLCDSCKNQPCVVRCFDHKMFLCHGCNDKFHGGGSSEHRRRDLRCYTGCPPAKDFAVMWGFRVMDDDDDVSLEQSFRMVKPKVQREGGFILEQILELEKVQLREENGSSSLTERGDPSPLELPKKPEEQLIDLPQTGKELVVDFSHLSSSSTLGDSFWECKSPYNKNNQLWHQNIQDIGVCEDTICSDDDFQIPDIDLTFRNFEEQFGADPEPIADSNNVFFVSSLDKSHEMKTFSSSFNNPIFAPKPASSTISFSSSETDNPYSHSEEVISFCPSLSNNTRQKVITRLKEKKRARVEEKKA

SEQ ID NO: 9463 - protein, 248 aa, Arabidopsis thaliana; identical to SEQ ID NO: 812

SEQ ID NO: 9464 - protein, 361 aa, Arabidopsis thaliana
MVEAQSWTTRRMSNPRFDAAATAAPTIVDIPGTPPHSSASSPLKPFFLSSPTVSPTILTAAIIAAWFGSNIGVLLLNKYLLFYYGFRYPIFLTMTHMLSCAAYSSAVINIAGIVPRQHILSRRQFLKILSLSAIFCLSVVCGNTSLRYIPVSFNQAIGATTPFFTAVFSFLITCKTESTEVYLALLPVVSGIVLASNSEPSFHLFGFLICVASTAGRALKSVVQGIILTSESEKLHSMNLLLYMAPMAACILLPFTLYIEGNVLRVLIEKARTDPLIIFLLAGNATVAYLVNLTNFLVTKHTSALTLQVLGNGKAAVAAGVSVLIFRNPVTVMGIAGFGVTIMGVVLYSEARKRSKLLNQK

SEQ ID NO: 9465 - protein, 562 aa, Arabidopsis thaliana
MATEPTRSWFQIRQQKPDKSSPTKKGQEGNVKNLGRPPMNDAPSNATKQKVAAAKQYIENHYKIQKKSLQERKERRSILEQNLADADVTVEDKMDILKNFEKKEMEYMRLQRQKMGVDDFELLSIIGRGAFGEVRICKEKSTGSVYAMKKLKKSEMLRRGQVEHVKAERNVLAEVDSPFIVKLCYSFQDDEHLYLIMEYLPGGDMMTLLMRKDTLREDETRFYVAQTILAIESIHKHNYVHRDIKPDNLLITRNGHIKLSDFGLSKSLESKNFPDFKAELVDRSTKPAAEHDRLSKPPSAPRRTQQEQLLHWQQNRRTLAFSTVGTPDYIAPEVLLKKGYGMECDWWSLGAIMFEMLVGFPPFYSEEPLATCRKIVNWKTCLKFPDEAKLSIEVKDLIRRLLCNVEQRLGTKGVHEIKAHPWFRGVEWERLYESNAPYIPQVKHELDTQNFEKFDEVPSTCQTSSKSSPWRKMISSKDANFLGYTFKNLEIVDEHHIPGMAELKRKSKTANKPSLKTLFETPYPPSENQALKDLLDSPIYSEGSRGSSGSPFSRPNQSQARR

SEQ ID NO: 9466 - protein, 1307 aa, Arabidopsis thaliana
MFNTYTNSLQWPIRSRNQQDYCSLLPERSESYKLSKAYTSSRCYCVSSRSSCCCCCSTPSSSSFVKPKVLINPGFVLYGVRQSTLIQWPSFQRRLLVGGGRLMGCEVYSSCDGIRRKNRSFKLRCLEESDECCGGRSCSDDVEAMISFLSEELIDEERKWNLVSRVKEKKKVGNVRKVSVEGSNSYGNGRVSQRVKKPEGFGRRKEIKEDVKLNERYDCEHCGRRKKSSELESESRRGSKLVTGEYIGKSYRGDEEREVRPRRRKSSSCSSYYSLASSGEFESDTEDQEEDVEIYRENVRSSEKKVVDQSAKRLKSRKEASQMHSRKKRDESSTGVDSRYQKQIFEEGENSNQAVTLNQRRRKKFSQTENRVSESTGNYEEDMEIHEVHVNDAETSSQNQKLFNEREDYRVHSIRNDSGNENIESSQHQLKERLETRYSSEDRVSEMRRRTKYSSSQEEGINVLQNFPEVTNNQQPLVEERISKQAGTRRTTEHISESSEIHDIDIRNTYVSQREDQIRNQEVHAGLVSGLQSERKQQDYHIEHNPLQTTQSDRTSVSVSHTSDAVRYTEIQRKSEKRLIGQGSTTAVQSDSKVEKNGAQKEDSRLDHANSKKDGQTTLGLQSYQSKLSEEASSSQSSLMASRTKLQLVDLVSEEMQGSETTLIPPSSQLVSRRSGQSYRTGGVSIQEISHGTSESGYTTAFEHPRAGASVNSQSAGELMGFTSHEDAMGSAHRLEQASEKYVGEFVKKAKHGVINPETEEQRAESNQLKRRDSRRSSGGSGAKGPSDEMWVTDSAQGTPHPGATEGNAAVGNAIFKRNGRSLWNVIADIARLRWGSRAGSPDSSAKPAGRSSPNESVSSATWFSGREHDGSSDDNTKGDKVLPQEAPSLHQVEVGQTSPRSQSEYPGTTKLKQRSERHEGVVSSPSSTILEGGSVSNRMSSTSGNQIVGVDEEEGGNFEFRLPETALTEVPMKLPSRNLIRSPPIKESSESSLTEASSDQNFTVGEGRRYPRMDAGQNPLLFPGRNLRSPAVMEPPVPRPRMVSGSSSLREQVEQQQPLSAKSQEETGSVSADSALIQRKLQRNKQVVRDSFEEWEEAYKVEAERRTVDEIFMREALVEAKKAADTWEVPVGAVLVHDGKIIARGYNLVEELRDSTAHAEMICIREGSKALRSWRLADTTLYVTLEPCPMCAGAILQARVNTLVWGAPNKLLGADGSWIRLFPGGEGNGSEASEKPPPPVHPFHPKMTIRRGVLESECAQTMQQFFQLRRKKKDKNSDPPTPTDHHHHHLPKLLNKMHQVLPFFCL

SEQ ID NO: 9467 - protein, 307 aa, Arabidopsis thaliana
MSNHQTVRFLFSHLPFCPSTFLMIVCFFCGQKQVLKQLEPWCELKDKVVLVTGASSGIGREICLDLCKAGCKIVAAARRVDRLNSLCSEINSFGAIGVQAAALELDVSSDADTIRKAVKEAWEIFGTIDVLINNAGIRGNVKSSLDLSKEEWDKVFRTNLTGSWLISKYVCLLMRDAKRGGSVINVSSISGLHRGLLRGGLAYACSKGGVDTMTRMMAIELAVYKIRVNSIAPGIFRSEITQGLFQKEWLEKVTEKIVPLKMQQTVDPGLTSLVRYLIHDSSQYVTGNTYIVDSGATLPGVPIFSSL

SEQ ID NO: 9468 - protein, 289 aa, Arabidopsis thaliana
MGSGFSLFQKNLSSCYGDRDLLQPGLGDLPESCVALILQNLDPVEICRFSKLNTAFHGASWADFVWESKLPPDYKLILEKILGSFPDNLRKRDIFTFLSRVNSFDEGNKKAWVDKRTGGLCLCTSAKGLSITGIDDRRYWSHIPSDDSRFASVAYVQQIWWFQVDGEIDFPFPAGTYSVYFRLQLGKPGKRFGWKVVDTEQVHGWNIKPVRFQLSTEDGQHSSSQCMLTEAGNWSHYHAGDFVVGKSKSSSTKIKFSMTQIDCTHTKGGLCVDSVVVYPSSCKDRLMQI

SEQ ID NO: 9469 - protein, 475 aa, Arabidopsis thaliana
MEHSSDLTVEAMMLDSKASDLDKEERPEVLSLIPPYEGKSVLELGAGIGRFTGELAQKAGEVIALDFIESAIQKNESVNGHYKNIKFMCADVTSPDLKIKDGSIDLIFSNWLLMYLSDKEVELMAERMIGWVKPGGYIFFRESCFHQSGDSKRKSNPTHYREPRFYTKVFQECQTRDASGNSFELSMVGCKCIGAYVKNKKNQNQICWIWQKVSVENDKDFQRFLDNVQYKSSGILRYERVFGEGYVSTGGFETTKEFVAKMDLKPGQKVLDVGCGIGGGDFYMAENFDVHVVGIDLSVNMISFALERAIGLKCSVEFEVADCTTKTYPDNSFDVIYSRDTILHIQDKPALFRTFFKWLKPGGKVLITDYCRSAETPSPEFAEYIKQRGYDLHDVQAYGQMLKDAGFDDVIAEDRTDQFVQVLRRELEKVEKEKEEFISDFSEEDYNDIVGGWSAKLERTASGEQKWGLFIADKK

SEQ ID NO: 9470 - protein, 326 aa, Arabidopsis thaliana [sequence omitted]

SEQ ID NO: 9471 - protein, 485 aa, Arabidopsis thaliana
MSNFTKSSSFNRRALSSLAIESPRNSSSSVFTSPIGSAFASPRSQNFGGSPRPSTNRLKEISYLFQVLIIAGTIVSFLVIIAGGYLYVVPSLGQTFLGYNGALEFNSSVVGDTECDIFDGNWVVDDNYPLYNASECPFVEKGFNCLGNGRGHDEYLKWRWKPKHCTVPRFEVRDVLKRLRGKRIVFVGDSMSRTQWESLICMLMTGLEDKRSVYEVNGNNITKRIRFLGVRFSSYNFTVEFYRSVFLVQPGRLRWHAPKRVKSTLKLDVLDVINHEWSSADFLIFNTGQWWVPGKLFETGCYFQVGNSLRLGMSIPAAYRVALETWASWIESTVDPNKTRVLFRTFEPSHWSDHRSCNVTKYPAPDTEGRDKSIFSEMIKEVVKNMTIPVSILDVTSMSAFRSDGHVGLWSDNPLVPDCSHWCLPGVPDIWNEILLFFLFRQPVRSCSSSPLENSISILLCLKILLICRFSEVDNCNIEKKINDP

SEQ ID NO: 9472 - protein, 291 aa, Arabidopsis thaliana
MGVAHSDLHNDLSSSSCFGDRNILKPGLGDLPEACVAIIVENLDPVEICRFSKLNRAFRGASWADCVWESKLPQNYRDVLEKILGGFPENLQKRHLYAFLSRINSFDDATKKVWIDKRTSGVCLSISAKGLSITGIDDRRYWSHIPTDESRFSSVAYLQQIWWFEVDGEIDFPFPVGTYSIFFRLQLGRSGKWFGRRVCNTEQVHGWDIKPVRFQLWTEDGQYSSSQCMLTERGNWIHYHAGDVVVRESNRSSTKIKFSMTQIDCTHTKGGLSLDSVVVYPSSCKDQLKRF

SEQ ID NO: 9473 - protein, 346 aa, Arabidopsis thaliana
MGTSSDPIQDGSDEQQKRSEIYTYEAPWHIYAMNWSVRRDKKYRLAITSLLEQYPNRVEIVQLDESNGEIRSDPNLSFEHPYPPTKTIFIPDKECQRPDLLATSSDFLRLWRIADDHSRVELKSCLNSNKNSEFCGPLTSFDWNEAEPRRIGTSSTDTTCTIWDIEREAVDTQLIAHDKEVFDIAWGGVGVFASVSADGSVRVFDLRDKEHSTIIYESSEPDTPLVRLGWNKQDPRYMATIIMDSAKVVVLDIRFPALPVVELQRHQASVNAIAWAPHSSCHICTAGDDSQALIWDISSMGQHVEGGLDPILAYTAGAEIEQLQWSSSQPDWVAIAFSTKLQILRV

SEQ ID NO: 9474 - protein, 502 aa, Arabidopsis thaliana
MEVEGKGGEAGTTTTTAPRRFALPVDAENKATTFRLFSVAKPHMRAFHLSWFQFFCCFVSTFAAPPLLPVIRENLNLTATDIGNAGIASVSGAVFARIVMGTACDLFGPRLASAALTLSTAPAVYFTAGIKSPIGFIMVRFFAGFSLATFVSTQFWMSSMFSGPVVGSANGIAAGWGNLGGGATQLIMPIVFSLIRNMGATKFTAWRIAFFIPGLFQTLSAFAVLLFGQDLPDGDYWAMHKSGEREKDDVGKVISNGIKNYRGWITALAYGYCFGVELTIDNIIAEYFFDRFHLKLQTAGIIAASFGLANFFARPGGGIFSDFMSRRFGMRGRLWAWWIVQTSGGVLCACLGQISSLTVSIIVMLVFSVFVQAACGLTFGVVPFISRRSLGVVSGMTGAGGNVGAVLTQLIFFKGSTYTRETGITLMGVMSIACSLPICLIYFPQWGGMFCGPSSKKVTEEDYYLAEWNDEEKEKNLHIGSQKFAETSISERGRATTTHPQT

SEQ ID NO: 9475 - protein, 256 aa, Arabidopsis thaliana
MGRGRVQLKRIENKINRQVTFSKRRAGLLKKAHEISVLCDAEVALVVFSHKGKLFEYSTDSCMEKILERYERYSYAERQLIAPESDVNTNWSMEYNRLKAKIELLERNQRHYLGEDLQAMSPKELQNLEQQLDTALKHIRTRKNQLMYESINELQKKEKAIQEQNSMLSKQIKEREKILRAQQEQWDQQNQGHNMPPPLPPQQHQIQHPYMLSHQPSPFLNMGGLYQEDDPMAMRRNDLELTLEPVYNCNLGCFAA

SEQ ID NO: 9476 - protein, 499 aa, Arabidopsis thaliana
MEKQSIRNTCSSSLMLSSPSSFWVRGACIGRGCFGAVSTAISKTNGEVFAVKSVDLATSLPTQSESLENEISVFRSLKPHPYIVKFLGDGVSKEGTTTFRNLYLEYLPNGDVASHRAGGKIEDETLLQRYTACLVSALRHVHSQGFVHCDVKARNILVSQSSMVKLADFGSAFRIHTPRALITPRGSPLWMAPEVIRREYQGPESDVWSLGCTIIEMFTGKPAWEDHGIDSLSRISFSDELPVFPSKLSEIGRDFLEKCLKRDPNQRWSCDQLLQHPFLSQCHNSSPTESSPRCVLDWVNSGFDLEEEEEEVGRSEFEDAAKAIICNLATTGGVIWESDGWVEVRCHASEEEGTTMEYSGSTRVESEYNTSSDPNDDVAGDSAIIDVSMSQNLPPGNGGSAAALPYEFVVVLHLLMEIMVYTTCIFREIVLTMYLLYQYNQSNKLETLSFNHSLKFCLFAHVIRIGQNYLLRGEMRSSVLITSHCLILITLVYSQIVVF

SEQ ID NO: 9477 - protein, 266 aa, Arabidopsis thaliana
MAGAEQSQRWSLKAKTVLVTGGTKGIGHAIVEEFAGFGAVIHTCARNEYELNECLSKWQKKGFQVTGSVCDASLRPEREKLMQTVSSMFGGKLDILINNLGAIRSKPTLDYTAEDFSFHISTNLESAYHLSQLAHPLLKASGCGNIIFMSSIAGVVSASVGSIYSATKGALNQLARNLACEWASDGIRANAVAPAVIATPLAEAVYDDEFKKVVISRKPLGRFGEPEEVSSLVAFLCMPAASYITGQTICVDGGLTVNGFSYQPQG

SEQ ID NO: 9478 - protein, 260 aa, Arabidopsis thaliana
MDINRWSLQGMTALVTGGSKGIGYAIVEELVGFGARVHICDIDETLLNECLSGWHAKGFEVSGSICDVSSRPQRVQLMQTVSSLFGAKLNILINNVGKYILKPTLESTAEDFSSLMATNLESAYYISQLAHPLLKASGNGNIVFISSVTGVVSGTSTIYGVTKGALNQLARDLACEWASDNIRANSVAPWVTATSLVQKYLEDEIFAEAMFSRTPLGRACEPREVASLVTFLCLPAASYITGQTICIDGGFTVNGFSYKP

SEQ ID NO: 9479 - protein, 287 aa, Arabidopsis thaliana
MIVCFFCGQKQVLKQLEPWCELKDKVVLVTGASSGIGREICLDLCKAGCKIVAAARRVDRLNSLCSEINSFGAIGVQAVALELDVSSEADTIRKAVKEAWETFGKIDVLINNAGIRGNVKSSLDLSEEEWDKVFRTNLTGSWLISKYVCLLMRDAERGGSVINVSSISGLHRGLLRGGLAYACSKGGVDTMTRMMAIELAVYKIRVNSIAPGIFRSEITQGLFQKEWLKKVTEKVVPLKMQQTVDPGLTSLVRYLIHDSSQYVTGNTYIVDSGTTLPGVPIFSSLSP

SEQ ID NO: 9480 - protein, 848 aa, Arabidopsis thaliana [sequence omitted]

SEQ ID NO: 9481 - protein, 445 aa, Arabidopsis thaliana
MSFRGIVQDLRDGFGSLSRRSFDFRLSSLHKGKAQGSSFREYSSSRDLLSPVIVQTSRWANLPPELLFDVIKRLEESESNWPARKHVVACASVCRSWRAMCQEIVLGPEICGKLTFPVSLKQPGPRDAMIQCFIKRDKSKLTFHLFLCLSPALLVENGKFLLSAKRTRRTTRTEYIISMDADNISRSSNSYLGKLRSNFLGTKFLVYDTQPPPNTSSSALITDRTSRSRFHSRRVSPKVPSGSYNIAQITYELNVLGTRGPRRMHCIMNSIPISSLEPGGSVPNQPEKLVPAPYSLDDSFRSNISFSKSSFDHRSLDFSSSRFSEMGISCDDNEEEASFRPLILKNKQPRWHEQLQCWCLNFRGRVTVASVKNFQLVAARQPQPQGTGAAAAPTSAPAHPEQDKVILQFGKVGKDMFTMDYRYPLSAFQAFAICLSSFDTKLACE

SEQ ID NO: 9482 - protein, 166 aa, Arabidopsis thaliana
MGFPVGYSELLLPKIFFYLLSFLGLIRKLISTMFKIIGLPDFLEPEPVSTSWPDPPPTLTKPDSAAILAGEMLPVVRFSDINRPESECCAVCLYDFENDDEIRRLTNCRHIFHRGCLDRWMMGYNQMTCPLCRTQFIPDHLQLEFNQRLWSQSSAVSSQLLDESSS

SEQ ID NO: 9483 - protein, 806 aa, Arabidopsis thaliana
MATLQDIGVSALINLFGAFLFLIAFAVLRIQPINDRVYFPKWYLTGERNSPRRSDRTLVGKFVNLNYKTYFTFLNWMPQAMKMSESEIIRHAGLDSAIFLRIYTLGLKIFAPVMVLALVVLVPVNVSSGTLFFLKKELVVSNIDKLSISNVQPKSSKFFFHIAVEYIFTFWACFMLYREYNNVAIMRLQYLASQRRRPEQFTVVVRNVPDMPGHSVPDTVDQFFKTNHPEHYLCHQAVYNANTYAKLVKQRAKLQRWFDYYVLKHQRNPHKQPTCRTGFLGLWGKRVDSIEYYKQQIKEFDHNMSLERQKVLKDSKLMLPVAFVSFDSRWGAAVCAQTQQSKNPTLWLTSSAPEPRDIYWQNLAIPFISLTIRKLVIGVSVFALVFFYMIPIAFVQSLANLEGLDRVAPFLRPVTRLDFIKSFLQGFLPGLALKIFLWILPTVLLIMSKIEGYIALSTLERRAAAKYYYFMLVNVFLGSIIAGTAFEQLHSFLHQSPSQIPRTIGVSIPMKATFFITYIMVDGWAGIAGEILRLKPLVIFHLKNMFIVKTEEDRVRAMDPGFVDFKETIPSLQLYFLLGIVYTAVTPILLPFILIFFAFAYLVYRHQIINVYNQQYESCGAFWPHVHGRIIASLLISQLLLMGLLASKKAADSTPLLIILPILTLSFHKYCKHRFEPAFRQYPLEEAMAKDKLEKETEPELNMKADLADAYLHPIFHSFEKEVELSSSSSSEKETHQEETPEVRVDKHETQSSSPVTELGTSSHHHHVYNSTSPSSHYASAYEQSSSQYEYHYNTHQYEEHEYRYN

SEQ ID NO: 9484 - protein, 115 aa, Arabidopsis thaliana
MVKSTSKDAQDLFRSLRSAYSATPTNLKIIDLYVVFAVFTALIQVVYMALVGSFPFNSFLSGVLSCIGTAVLAVCLRIQVNKENKEFKDLAPERAFADFVLCNLVLHLVIINFLG

SEQ ID NO: 9485 - protein, 488 aa, Arabidopsis thaliana
MSDSTNSVSPSSDYASISSGDQSLQRSRRSGDGNRAVVRESRHWHDVFWSAIFVIHLICLGFVLAVLGLNRFRISDRLNIDRYTQGFLENHKGLTEDYWPLYAVAGGIGVFISWVWSLLLGSYANEMMKVSVHILTTYLAVVSVLCFWCRLFFWGGAFAVGSLLQFLYVISVIDRLPFTMLVLRKALKLVWGLPKVIMVAHAFTVVMLLWMSLWSFGAAGVVASSMGDEGRWWLLVVLSVSLFWTGAVLCNTVHVIVSGMVFHVLFHCGQEESSSLPPSSLVDSLRYAVTTSFGSICYGSLFTAAIRTLRWEIRGFRSKICGNECLLCCVDFLFHLVETLVRFFNKYAYVQIAVYGKGFNKSARDAWELFQSTGVEALVAYDCSGAVLLMGTIFGGLITGSCIGIWAWIKYSDRVIMVASTAMLMGMVLVGLGMVVVESAVTSIYICFAEDPLLIQRWDADFYTEMSEVLHRRLQHRSSRAREVLTTA

SEQ ID NO: 9486 - protein, 352 aa, Arabidopsis thaliana
MAALLGRSCRKLSFPSLSHGARRVSTETGKPLNLYSAINQALHIALDTDPRSYVFGEDVGFGGVFRCTTGLAERFGKNRVFNTPLCEQGIVGFGIGLAAMGNRAIVEIQFADYIYPAFDQIVNEAAKFRYRSGNQFNCGGLTIRAPYGAVGHGGHYHSQSPEAFFCHVPGIKVVIPRSPREAKGLLLSCIRDPNPVVFFEPKWLYRQAVEEVPEHDYMIPLSEAEVIREGNDITLVGWGAQLTVMEQACLDAEKEGISCELIDLKTLLPWDKETVEASVKKTGRLLISHEAPVTGGFGAEISATILERCFLKLEAPVSRVCGLDTPFPLVFEPFYMPTKNKILDAIKSTVNY

SEQ ID NO: 9487 - protein, 555 aa, Arabidopsis thaliana
MKGGVKLLAVCLCVATATVMMVQAEDPYFHHVWNVTYGTASPLGVPQQVILINGQFPGPNINSTSNNNVIVNVFNNLDEPFLITWAGIQHRKNCWQDGTAGTMCPIPPGQNFTYHFQPKDQIGSYFYYPTTAMHRAAGGFGGLRVNSRLLIPVPYADPEDDYTILINDWYTKSHTQLKKFLDSGRTIGRPDGILINGKSGKTDGSDKPLFTLKPGKTYRVRICNVGLKASLNFRIQNHKMKLVEMEGSHVLQNDYDSLDVHVGQCFGVIVTADQEPKDYYMIASTRFLKKPLTTTGLLRYEGGKGPASSQLPAAPVGWAWSLNQYRSFRWNLTASAARPNPQGSYHYGKINITRTIKLVNTQGKVDGKLRYALSGVSHTDPETPLKLAEYFGVADKVFKYDTISDNPNPDQIKNIKIEPNVLNITHRTFIEVVFENHERSVQSWHLDGYSFFAVAVEPGTWTPEKRKNYNLLDAVSRHTVQVYPKCWAAILLTFDNCGMWNIRSENAERRYLGQQLYASVLSPEKSLRDEYNMPETSLQCGLVKGKPKVNPYAGA

SEQ ID NO: 9488 - protein, 606 aa, Arabidopsis thaliana
MGGCTSKPSTSSGRPNPFAPGNDYPQIDDFAPDHPGKSPIPTPSAAKASPFFPFYTPSPARHRRNKSRDVGGGGESKSLTSTPLRQLRRAFHPPSPAKHIRAALRRRKGKKEAALSGVTQLTTEVPQREEEEEVGLDKRFGFSKEFHSRVELGEEIGRGHFGYTCSAKFKKGELKGQVVAVKIIPKSKMTTAIAIEDVRREVKILQALSGHKNLVQFYDAFEDNANVYIAMELCEGGELLDRILARGGKYSENDAKPVIIQILNVVAFCHFQGVVHRDLKPENFLYTSKEENSQLKAIDFGLSDFVRPDERLNDIVGSAYYVAPEVLHRSYTTEADVWSIGVIAYILLCGSRPFWARTESGIFRAVLKADPSFDEPPWPFLSSDAKDFVKRLLFKDPRRRMSASQALMHPWIRAYNTDMNIPFDILIFRQMKAYLRSSSLRKAALRALSKTLIKDEILYLKTQFSLLAPNKDGLITMDTIRMALASNATEAMKESRIPEFLALLNGLQYRGMDFEEFCAAAINVHQHESLDCWEQSIRHAYELFDKNGNRAIVIEELASELGVGPSIPVHSVLHDWIRHTDGKLSFFGFVKLLHGVSVRASGKTTR

SEQ ID NO: 9489 - protein, 314 aa, Arabidopsis thaliana
MATCIDTCRTGNTQDDDSRFCCIKNFFRPGFSVNRKIHHTQIEDDDDVWIKMLEEAKSDVKQEPILSNYYYASITSHRSLESALAHILSVKLSNLNLPSNTLFELFISVLEESPEIIESTKQDLIAVKERDPACISYVHCFLGFKGFLACQAHRIAHTLWKQNRKIVALLIQNRVSESFAVDIHPGAKIGKGILLDHATGVVIGETAVVGDNVSILHGVTLGGTGKQSGDRHPKIGDGVLIGAGSCILGNITIGEGAKIGSGSVVVKDVPARTTAVGNPARLIGGKENPRKHDKIPCLTMDQTSYLTEWSDYVI

SEQ ID NO: 9490 - protein, 545 aa, Arabidopsis thaliana
MRHVFVEVLVLISLVILELSYAFAPISSYQWVVSYSQRFILGGNKQVIVINDMFPGPILNATANDIIVVNIFNNLPEPFLMTWNGLQLRKNSWQDGVRGTNCPILPGTNWTYRFQVKDQIGSYFYFPTLLLQKAAGGYGAIRIYPPELVPVPFPKPDEEYDILIGDWFYLDHTVMRASLDAGHSLPNPDGILFNGRGPEETFFAFEPGKTYRLRISNVGLKTCLNFRIQDHDMLLVETEGTYVQKRVYSSLDIHVGQSYSILVTAKTDPVGIYRSYYIFATARFTDSYLGGIALIRYPGSPLDPVGQGPLAPALQDFGSSVEQALSIRMDLNVGAARSNPQGSYHYGRINVTRTIILHNDVMLSSGKLRYTINGVSFVYPETPLKLVDHFQLNDTIIPGMFPVYPSNKTPTLGTSVVDIHYKDFIHIVFQNPLFGLESYHIDGYNFFVVGYGFGAWSESKKAGYNLVDAVSRSTVQVYPYSWTAILIAMDNQGMWNVRSQKAEQWYLGQELYMRVKGEGEEDPSTIPVRDENPIPGNVIRCGKVR

SEQ ID NO: 9491 - protein, 413 aa, Arabidopsis thaliana
MGYYNNVFDECNDQTDIGRVIRDGREVILQAYNWESHKYDWWRNLDGKVPDIAKSGFTSAWLPPPSQSLAPEGYLPQDLYSLNSAYGSEHLLKSLLRKMKQYKVRAMADIVINHRVGTTRGHGGMYNRYDGISLPWDEHAVTSCTGGLGNRSTGDNFNGVPNVDHTQHFVRKDIIGWLRWLRNTVGFQDFRFDFARGYSANYVKEYIGAAKPLFSVGECWDSCNYNGHGLDYNQDSHRQRIISWIDATGQISAAFDFTTKGILQEAVKGQYWRLCDAQGKPPGVMGWWPSRAVTFLDNHDTGSTQAHWPFPSHHVMEGYAYILTHPGIPCVFYDHFYDWGSSIHDQIVKLIDIRRRQDIHSRSTVRVLKAESNLYAAIVGEKICMKLGDGSWCPSGRDWTLATSGHRYAVWHK

SEQ ID NO: 9492 - protein, 372 aa, Arabidopsis thaliana
MSTNDEENGTVIEVKNVPEPSPETWYSVFLRQASVYGVAAGYCLSASLLSIINKWAIMKFPYPGALTAMQYFTSAAGVLLCAQMKLIEHDSLNLLTMWRFLPAAMIFYLSLFTNSELLLHANVDTFIVFRSAVPIFVAIGETLFLHQPWPSVKTWGSLATIFGGSLLYVFTDYQFTIAAYSWALAYLVSMTIDFVYIKHVVMTIGLNTWGLVLYNNLEALLLFPLELLIMGELKKIKHEITDETDWYSLQVVLPVGLSCLFGLAISFFGFSCRRAISATGFTVLGIVNKLLTVVINLMVWDKHSTFVGTLGLLVCMFGGVMYQQSTIKKPNATQEAKPQEQDEEQEKLLEMQENKESNSVDIKETLKSEEKL

SEQ ID NO: 9493 - protein, 212 aa, Arabidopsis thaliana
MNHRRSSIVLLILSILSPVTLSIRYELLSGHTKCISEEIHANAMTIGKYSIINPHEDHPLPSSHKVTVRVTSPQGTAYHESDGVESGQFSFVAVETGDYISCFSAVDHKPETTLIIDFDWRTGIHTKDWSNVAKKSQVETMEFEVKKLFETVNGIHDEMFYLRDREEEMHNLNIATNSKMAWLSFVSLAVCLSVAGLQFWHLKTFFQKKKLI

SEQ ID NO: 9494 - protein, 302 aa, Arabidopsis thaliana
MDGGYDQSGGASRYFHNLFRPELHHQLQPQPQLHPLPQPQPQPQPQQQNSDDESDSNKDPGSDPVTSGSTGKRPRGRPPGSKNKPKPPVIVTRDSPNVLRSHVLEVSSGADIVESVTTYARRRGRGVSILSGNGTVANVSLRQPATTAAHGANGGTGGVVALHGRFEILSLTGTVLPPPAPPGSGGLSIFLSGVQGQVIGGNVVAPLVASGPVILMAASFSNATFERLPLEDEGGEGGEGGEVGEGGGGEGGPPPATSSSPPSGAGQGQLRGNMSGYDQFAGDPHLLGWGAAAAAAPPRPAF

SEQ ID NO: 9495 - protein, 530 aa, Arabidopsis thaliana
MGDSTGEPGSSMHGVTGREQSFAFSVQSPIVHTDKTAKFDLPVDTEHKATVFKLFSFAKPHMRTFHLSWISFSTCFVSTFAAAPLVPIIRENLNLTKQDIGNAGVASVSGSIFSRLVMGAVCDLLGPRYGCAFLVMLSAPTVFSMSFVSDAAGFITVRFMIGFCLATFVSCQYWMSTMFNSQIIGLVNGTAAGWGNMGGGITQLLMPIVYEIIRRCGSTAFTAWRIAFFVPGWLHIIMGILVLNLGQDLPDGNRATLEKAGEVAKDKFGKILWYAVTNYRTWIFVLLYGYSMGVELSTDNVIAEYFFDRFHLKLHTAGLIAACFGMANFFARPAGGYASDFAAKYFGMRGRLWTLWIIQTAGGLFCVWLGRANTLVTAVVAMVLFSMGAQAACGATFAIVPFVSRRALGIISGLTGAGGNFGSGLTQLLFFSTSHFTTEQGLTWMGVMIVACTLPVTLVHFPQWGSMFLPPSTDPVKGTEAHYYGSEWNEQEKQKNMHQGSLRFAENAKSEGGRRVRSAATPPENTPNNV

SEQ ID NO: 9496 - protein, 522 aa, Arabidopsis thaliana
MGSTDEPGSSMHGVTGREQSYAFSVDGSEPTNTKKKYNLPVDAEDKATVFKLFSFAKPHMRTFHLSWISFSTCFVSTFAAAPLIPIIRENLNLTKHDIGNAGVASVSGSIFSRLVMGAVCDLLGPRYGCAFLVMLSAPTVFSMSFVSDAAGFITVRFMIGFCLATFVSCQYWMSTMFNSQIIGLVNGTAAGWGNMGGGITQLLMPIVYEIIRRCGSTAFTAWRIAFFVPGWLHIIMGILVLTLGQDLPGGNRAAMEKAGEVAKDKFGKILWYAVTNYRTWIFVLLYGYSMGVELSTDNVIAEYFFDRFHLKLHTAGIIAACFGMANFFARPAGGWASDIAAKRFGMRGRLWTLWIIQTSGGLFCVWLGRANTLVTAVVSMVLFSLGAQAACGATFAIVPFVSRRALGIISGLTGAGGNFGSGLTQLVFFSTSRFTTEEGLTWMGVMIVACTLPVTLIHFPQWGSMFFPPSNDSVDATEHYYVGEYSKEEQQIGMHLKSKLFADGAKTEGGSSVHKGNATNNA

SEQ ID NO: 9497 - protein, 305 aa, Arabidopsis thaliana
MAAQVEIEDQESVTNLDNGEIINPISDNAPNFSGDATILLREATFEHNLIKNCFLSGMGSFATETTIVTVRKILTQRLITTKAKFAVFKLFTEAMKRKNNGYANIRYGWYSGSKEEIDRVITYGFSNREIKKVENDVGSHGVGIHLVHHRYSLAAALVGEGDEEGIKNILLCRVILGKPEQIVTGSKQSYPSSNQFDSGVDNLENPRKYVIWSCNMNSYILPTYIVSFKSHLLRGLIGRARSPCVSFSVLMSILSKSLDAARMNLILTSYDDFRKRKLRREQLVRKIREVVGDNLLFKILKNQRR

SEQ ID NO: 9498 - protein, 572 aa, Arabidopsis thaliana
MSSCLLPQFKCPPDSFSIHFRTSFCAPKHNKGSVFFQPQCAVSTSPALLTSMLDVAKLRLPSFDTDSDSLISDRQWTYTRPDGPSTEAKYLEALASETLLTSDEAVVVAAAAEAVALARAAVKVAKDATLFKNSNNTNLLTSSTADKRSKWDQFTEKERAGILGHLAVSDNGIVSDKITASASNKESIGDLESEKQEEVELLEEQPSVSLAVRSTRQTERKARRAKGLEKTASGIPSVKTGSSPKKKRLVAQEVDHNDPLRYLRMTTSSSKLLTVREEHELSAGIQDLLKLERLQTELTERSGRQPTFAQWASAAGVDQKSLRQRIHHGTLCKDKMIKSNIRLVISIAKNYQGAGMNLQDLVQEGCRGLVRGAEKFDATKGFKFSTYAHWWIKQAVRKSLSDQSRMIRLPFHMVEATYRVKEARKQLYSETGKHPKNEEIAEATGLSMKRLMAVLLSPKPPRSLDQKIGMNQNLKPSEVIADPEAVTSEDILIKEFMRQDLDKVLDSLGTREKQVIRWRFGMEDGRMKTLQEIGEMMGVSRERVRQIESSAFRKLKNKKRNNHLQQYLVAQS

SEQ ID NO: 9499 - protein, 462 aa, Arabidopsis thaliana
MAVATHCFTSPCHDRIRFFSSDDGIGRLGITRKRINGTFLLKILPPIQSADLRTTGGRSSRPLSAFRSGFSKGIFDIVPLPSKNELKELTAPLLLKLVGVLACAFLIVPSADAVDALKTCACLLKGCRIELAKCIANPACAANVACLQTCNNRPDETECQIKCGDLFENSVVDEFNECAVSRKKCVPRKSDLGEFPAPDPSVLVQNFNISDFNGKWYITSGLNPTFDAFDCQLHEFHTEGDNKLVGNISWRIKTLDSGFFTRSAVQKFVQDPNQPGVLYNHDNEYLHYQDDWYILSSKIENKPEDYIFVYYRGRNDAWDGYGGAVVYTRSSVLPNSIIPELEKAAKSIGRDFSTFIRTDNTCGPEPALVERIEKTVEEGERIIVKEVEEIEEEVEKEVEKVGRTEMTLFQRLAEGFNELKQDEENFVRELSKEEMEFLDEIKMEASEVEKLFGKALPIRKVR

SEQ ID NO: 9500 - protein, 645 aa, Arabidopsis thaliana
MDTNTSGEELLAKARKPYTITKQRERWTEDEHERFLEALRLYGRAWQRIEEHIGTKTAVQIRSHAQKFFTKLEKEAEVKGIPVCQALDIEIPPPRPKRKPNTPYPRKPGNNGTSSSQVSSAKDAKLVSSASSSQLNQAFLDLEKMPFSEKTSTGKENQDENCSGVSTVNKYPLPTKQVSGDIETSKTSTVDNAVQDVPKKNKDKDGNDGTTVHSMQNYPWHFHADIVNGNIAKCPQNHPSGMVSQDFMFHPMREETHGHANLQATTASATTTASHQAFPACHSQDDYRSFLQISSTFSNLIMSTLLQNPAAHAAATFAASVWPYASVGNSGDSSTPMSSSPPSITAIAAATVAAATAWWASHGLLPVCAPAPITCVPFSTVAVPTPAMTEMDTVENTQPFEKQNTALQDQNLASKSPASSSDDSDETGVTKLNADSKTNDDKIEEVVVTAAVHDSNTAQKKNLVDRSSCGSNTPSGSDAETDALDKMEKDKEDVKETDENQPDVIELNNRKIKMRDNNSNNNATTDSWKEVSEEGRIAFQALFARERLPQSFSPPQVAENVNRKQSDTSMPLAPNFKSQDSCAADQEGVVMIGVGTCKSLKTRQTGFKPYKRCSMEVKESQVGNINNQSDEKVCKRLRLEGEAST

SEQ ID NO: 9501 - protein, 151 aa, Arabidopsis thaliana
MASLLDKAKDFVADKLTAIPKPEGSVTDVDLKDVNRDSVEYLAKVSVTNPYSHSIPICEISFTFHSAGREIGKGKIPDPGSLKAKDMTALDIPVVVPYSILFNLARDVGVDWDIDYELQIGLTIDLPVVGEFTIPISSKGEIKLPTFKDFF

SEQ ID NO: 9502 - protein, 324 aa, Arabidopsis thaliana
MGYCQDDQLVNKICDLYEKISKLETLKPCEDVDTLFKQLVSTCIPPNPNIDVTKMSENIQEMRSNLIKICGEAEGYLEHHFSSILTSFEDNPLHHLNLFPYYNNYLKLSKLEFDLLEQNLNGFVPRTVAFIGSGPLPLTSVVLASSHLKDSIFHNFDIDPSANMVAARLVSSDPDLSQRMFFHTVDIMDVTESLKGFDVVFLAALVGMDKKEKVKVVEHLEKHMSPGALLMLRSAHGPRAFLYPIVEPCDLEGFEVLSVYHPTDEVINSIVISRKLGEDANGVVHDHIDQASDLACNCSKIHVIMNKKKSIIEEFAGANEEQLT

SEQ ID NO: 9503 - protein, 310 aa, Arabidopsis thaliana
MPISEKSSATNTRLVVKKLFARQLHEGFGAVVRRSIGRFEFRYFDPFLVLDEFSVSAPAGFPDHPHRGFETVTYMLEGEILHEDCEGHKGVIREGGLQWMTAGKGIVHSEMPSSNSNGITHNKGLQLWINLSSRQKLVEPSYQEIESKDIAETEKDGVRVRVIAGEWNGVKSKICTRTPTMYLDFTLSPGSRISQPIPLHWNAFVYVLQGHGHFGDSKLQHSAAAAHHLLVLGLGGDMLEAWNGSDSGLPLRFILVAGEPIGEPMVQFGPFVMNTQEEIDETIDDFENFRNGFEKARHWKSQAASALGLF

SEQ ID NO: 9504 - protein, 355 aa, Arabidopsis thaliana
MVAEALPKCPEAPLVLGLQPAALIDNVAPVDWSLLDQIPGDRGGSIAVQKDELEHMLKELDAHISVAPLKKMAGGSVTNTVRGLSVGFGVATGIIGAYGDDEQGQLFVSNMGFSGVSISRLRKKKGSTAQCVCLVDDSGNRTMRPCLSSAVKIQADELSKEDFTGSKWLVLRYAVLNLQVIQAAIRFAKQEGLSVSLDLASFEMVRNSKSELRQLLESGNIDLCFANEDEAAELLRGEQEAGPEAALEFLGRHCRWAVVTLGSKGCIAKHDKEVVHISAIGETVATDATGAGDLFASGFLYGLIKGLSLEECCKVGSCSGGSVIRALGGEVTPENWQWMHKQLQLKGLPVPDIHN

SEQ ID NO: 9505 - protein, 225 aa, Arabidopsis thaliana
MRRGRGSSAVAGPTVVAAINGSVKEIRFRGVRKRPWGRFAAEIRDPWKKARVWLGTFDSAEEAARAYDSAARNLRGPKAKTNFPIDSSSPPPPNLRFNQIRNQNQNQVDPFMDHRLFTDHQQQFPIVNRPTSSSMSSTVESFSGPRPTTMKPATTKRYPRTPPVVPEDCHSDCDSSSSVIDDDDDIASSSRRRNPPFQFDLNFPPLDCVDLFNGADDLHCTDLRL

SEQ ID NO: 9506 - protein, 455 aa, Arabidopsis thaliana
MSFRSIVRDVRDSIGSLSRRSFDFKLSSLNKEGGKSRGSVQDSHEEQLVVTIQETPWANLPPELLRDVIKRLEESESVWPARRHVVACASVCRSWRDMCKEIVQSPELSGKITFPVSLKQPGPRDATMQCFIKRDKSNLTYHLYLCLSPALLVENGKFLLSAKRIRRTTYTEYVISMHADTISRSSNTYIGKIRSNFLGTKFIIYDTQPAYNSNIARAVQPVGLSRRFYSKRVSPKVPSGSYKIAQVSYELNVLGTRGPRRMHCAMNSIPASSLAEGGTVPGQPDIIVPRSILDESFRSITSSSSRKITYDYSNDFSSARFSDILGPLSEDQEVVLEEGKERNSPPLVLKNKPPRWHEQLQCWCLNFRGRVTVASVKNFQLIAANQPQPQPQPQPQPQPLTQPQPSGQTDGPDKIILQFGKVGKDMFTMDFRYPLSAFQAFAICLSSFDTKLACE

SEQ ID NO: 9507 - protein, 379 aa, Arabidopsis thaliana
MSTTGQIIRCKAAVAWEAGKPLVIEEVEVAPPQKHEVRIKILFTSLCHTDVYFWEAKGQTPLFPRIFGHEAGGIVESVGEGVTDLQPGDHVLPIFTGECGECRHCHSEESNMCDLLRINTERGGMIHDGESRFSINGKPIYHFLGTSTFSEYTVVHSGQVAKINPDAPLDKVCIVSCGLSTGLGATLNVAKPKKGQSVAIFGLGAVGLGAAEGARIAGASRIIGVDFNSKRFDQAKEFGVTECVNPKDHDKPIQQVIAEMTDGGVDRSVECTGSVQAMIQAFECVHDGWGVAVLVGVPSKDDAFKTHPMNFLNERTLKGTFFGNYKPKTDIPGVVEKYMNKELELEKFITHTVPFSEINKAFDYMLKGESIRCIITMGA

SEQ ID NO: 9508 - protein, 423 aa, Arabidopsis thaliana
MERLTSPPRLMIVSDLDETMVDHHKDPENLALLRFNSLWEDAYRHDSLLVFSTGRAQTMYKKLRKEKPLLTPDVIITSVGTEIAYGNSMVPDDNWVEILNKKWDRGIVQEETSKFPELTLQGETEQRPHKLSFNIDKSKVKAVTKELSPRLEKRGVDVKFIFSGGNAFDVLAKGGGKGQALAYLLKKLKTEGKLPINTLACGDSGNDTELFTIPNVYGVMVSNAQEELLEWYAENAKDNANIIHASERCAGGITQAIGHFKLGPNLSPRDVSDFLECKADNVNPGHEVVKFFLFYERWRRGEVENCTTYTSSLKASCHPSGVFVHPSGAEKSLRDTIDELGKYYGDKKGKKFRVWTDQVLATDTTPGTWIVKLDKWEQTGDERKCCTTTVKFTSKEGEGFVWEHVQQIWSEETEIKDDSNWII

SEQ ID NO: 9509 - protein, 130 aa, Arabidopsis thaliana
MVDQSPRRVVVAALLLFVVLCDLSNSAGAANSVSAFVQNAILSNKIVIFSKSYCPYCLRSKRIFSQLKEEPFVVELDQREDGDQIQYELLEFVGRRTVPQVFVNGKHIGGSDDLGAALESGQLQKLLAAS

SEQ ID NO: 9510 - protein, 227 aa, Arabidopsis thaliana
MVNGESSTSTSYSDSNNDTNDQGGDFECNICFELAQDPIVTLCGHLFCWPCLYRWLHHHSHSQECPVCKAVVQDDKLVPLYGRGKNQTDPRSKRYPGLRIPNRPTGQRPETAAPPPQPEAASNFFNYGIGLMGGIMPMMATTRFGNFSMGFGGLLPSLFNFQFHGFHDATLYGSTPGYPYGGYHNGFRGVPPRGQERPMARGGNQSDAFLKNILFFVGICVVIFLIW

SEQ ID NO: 9511 - protein, 474 aa, Arabidopsis thaliana
MARTHLLFLLFVLLSLATSSTSTKEQEEDRIKALPGQPKVGFSQFSGYVTVNESHGRSLFYWLTESSSHSPHTKPLLLWLNGGWIFFLPTFPRPGCSSIAYGASEEIGPFRISKTGCNLYLNNFSWNTEANLLFLESPVGVGFSYTNTSSDFEESGDERTAQENLIFLISWMSRFPQYRYRDFYIVGESYAGHYVPQLAQKIHEYNNAYKNPVINLKGFMVGNPEMDKNNDRLGTITYWWSHAMISDASYNRILKNCDFTADRFSKECDSAIYVAAADFGDIDQYSIYTPKCVPPQDQTNQTKFEQMMQMHTTKRFLEDQYDPCTENYAEIYYNRPEVQRAMHANHTAIPYKWTACSDSVFNNWNWRDSDNSMLPIYKELIAAGLRIWVYSGDTDSVIPVTATRYSLGKLNLRVKTRWYPWYSGNQVGGRTEVYEGLTFVTVRGAGHEVPFFQPQSALILLRSFLAGNELSRSY

SEQ ID NO: 9512 - protein, 425 aa, Arabidopsis thaliana
MIKALPGQPQVGFSQFSGYVTVNESHGRSLFYWLTESPSSSHTKPLLLWLNGGPGCSSIGYGASEEIGPFRINKTGSNLYLNKFTWNTEANILFLESPAGVGFSYTNTSSDLKDSGDERTAQENLIFLIKWMSRFPQYQYRDFYIVGESYAGHYVPQLAKKIHLYNKAFNNTPIINLKGFMVGNGDMDKHYDRLGAAMYAWSHAMISDKTYKSILKHCSFTADKTSDKCNWALYFAYREFGKVNGYSIYSPSCVHQTNQTKFLHGRLLVEEYEYDPCTESYAEIYYNRPDVQRAMHANLTSIPYKWTLCNMVVNNNWKDSEFSMLPIYKELTAAGLRIWVFSGDTDAVVPVTGTRLALSKLNLPVKTPWYPWYSEKQVGGWTEVYEGLTFATIRGAGHEVPVLQPERALTLLRSFLAGKELPRSY

SEQ ID NO: 9513 - protein, 368 aa, Arabidopsis thaliana
MAMLVEPPNGIKQQGKHYYSMWQTLFEIDTKYVPIKPIGRGAYGVVCSSINRETNERVAIKKIHNVFENRVDALRTLRELKLLRHVRHENVIALKDVMLPANRSSFKDVYLVYELMDTDLHQIIKSSQSLSDDHCKYFLFQLLRGLKYLHSANILHRDLKPGNLLVNANCDLKICDFGLARTSQGNEQFMTEYVVTRWYRAPELLLCCDNYGTSIDVWSVGCIFAEILGRKPIFPGTECLNQLKLIINVVGSQQESDIRFIDNPKARRFIKSLPYSRGTHLSNLYPQANPLAIDLLQRMLVFDPTKRISVTDALLHPYMAGLFDPGSNPPAHVPISLDIDENMEEPVIREMMWNEMLYYHPEAEISNA

SEQ ID NO: 9514 - protein, 456 aa, Arabidopsis thaliana
MMERRRTALVLFVVVVVLTWQEGVLGKWLESTAKEKTGSWAGWVSDKITTGFGTKKEETGIYQKSKDEARKAAQAAENYAYDKANYVKDSAYDNAGYAKDFAENKAEYAKDFAYDKAGDAKNMAYENAGYAKDFAYDKAGDAKDMAYEKAGHAKDFAYDKAGNAKDMAYETAGYAKDFAYDKGGYAKDVAYDKAGNAKDMAYEKAGNAKDMAYEKAEHIKDFTYDKVGSAYGSAQSMMDSGYDKAGDAKDMAYEKAGIVKDMAYDKAGDAKDVAYEKAGIAKDMAYDKAGNAKDMAYDKVGSAYGSAQKAKDSGYEKAGEAKDYAYKKAGNAKDIAYEKAQDAKDFAYDKAGYGYDKAGDVIRMATDKSGEAYEGAKEKSKSAKDTAGEAMDDSIDYMKDKSHNAKDGATRGFEEAMEKVGEKYGVAKESTKYAYETAKKKASQVAGEIRDRYAEL

SEQ ID NO: 9515 - protein, 196 aa, Arabidopsis thaliana
MSRVYVGNLDPRVTERELEDEFRSFGVIRSVWVARRPPGYAFLDFEDSRDARDAIREVDGKNGWRVEQSHNRGGGGGRGGGRGGGDGGRGRGGSDLKCYECGESGHFARECRSRGGSGGRRRSRSRSRSPPRYRKSPTYGGRRSYSPRARSPPPPRRRSPSPRGRNYSRSPPPYRARDEVPYANGNGLKDVRRSRS

SEQ ID NO: 9516 - protein, 395 aa, Arabidopsis thaliana
MDGGSGQPAADTEMTEAPGGFPAAAPSPQMPGIENIPATLSHGGRFIQYNIFGNIFEVTAKYKPPIMPIGKGAYGIVCSAMNSETNESVAIKKIANAFDNKIDAKRTLREIKLLRHMDHENIVAIRDIIPPPLRNAFNDVYIAYELMDTDLHQIIRSNQALSEEHCQYFLYQILRGLKYIHSANVLHRDLKPSNLLLNANCDLKICDFGLARVTSESDFMTEYVVTRWYRAPELLLNSSDYTAAIDVWSVGCIFMELMDRKPLFPGRDHVHQLRLLMELIGTPSEEELEFLNENAKRYIRQLPPYPRQSITDKFPTVHPLAIDLIEKMLTFDPRRRITVLDALAHPYLNSLHDISDEPECTIPFNFDFENHALSEEQMKELIYREALAFNPEYQQ

SEQ ID NO: 9517 - protein, 413 aa, Arabidopsis thaliana
MDNVRGSIMLQPLPEIAESIDDAICHELSMWPDDAKDLLLIVEAISRGDLKLVLVACAKAVSENNLLMARWCMGELRGMVSISGEPIQRLGAYMLEGLVARLAASGSSIYKSLQSREPESYEFLSYVYVLHEVCPYFKFGYMSANGAIAEAMKDEERIHIIDFQIGQGSQWIALIQAFAARPGGAPNIRITGVGDGSVLVTVKKRLEKLAKKFDVPFRFNAVSRPSCEVEVENLDVRDGEALGVNFAYMLHHLPDESVSMENHRDRLLRMVKSLSPKVVTLVEQECNTNTSPFLPRFLETLSYYTAMFESIDVMLPRNHKERINIEQHCMARDVVNIIACEGAERIERHELLGKWKSRFSMAGFEPYPLSSIISATIRALLRDYSNGYAIEERDGALYLGWMDRILVSSCAWK

SEQ ID NO: 9518 - protein, 262 aa, Arabidopsis thaliana
MDKRWSLQGMTALVTGGASGIGHAIVEELAGLGARIYVCDISETLLNQSLSEWEKKGFQVSGSICDVSSHSERETLMQTVSKMFDGKLNILVNNVGVVNPKPTIEYVAADFSFSISTNLESAYHLSQLSHPLLKASEFGSIIFISSVGGVVSMECGSIYSLTKGALNQLAKTLACEWARDGIRANSVAPNFIYTAMAQPFFKDADYEKSLVSRTPLGRAGEPNEVSSLVAFLCLPAASYITGQTICVDGGLTVNGFSYKPQA

SEQ ID NO: 9519 - protein, 294 aa, Arabidopsis thaliana
MASSSRLCDSCKSTAATLFCRADAAFLCGDCDGKIHTANKLASRHERVWLCEVCEQAPAHVTCKADAAALCVTCDRDIHSANPLSRRHERVPITPFYDAVGPAKSASSSVNFVDEDGGDVTASWLLAKEGIEITNLFSDLDYPKIEVTSEENSSGNDGVVPVQNKLFLNEDYFNFDLSASKISQQGFNFINQTVSTRTIDVPLVPESGGVTAEMTNTETPAVQLSPAEREARVLRYREKRKNRKFEKTIRYASRKAYAEMRPRIKGRFAKRTDSRENDGGDVGVYGGFGVVPSF

SEQ ID NO: 9520 - protein, 539 aa, Arabidopsis thaliana
MAVPFLSSSLQLTPTSPILFTKVTPTPIIHNHRSTCTIPTKPRLRLLRRSAVAGTAVSDQTEGGGDVLLNPEEEKRVEVADYDWTEEWYPLYLTKNVPEDAPLGLTVYDRQIVLYKDGEGTLRCYEDRCPHRLAKLSEGQLIDGRLECLYHGWQFEGEGKCVKIPQLPASAKIPKAACVKTYEVKDSQGVVWVWMSTKTPPNPEKLPWFENFARPGFFDISTTHELPYDHSILLENLMDPAHVPISHDRTDFTAKREDAQPLVFEVTERSNRGFAGTWGREKEGGKGSNLLRFDAPCVLQNNREFEGKDGVKNYFSGLFLCRPTGQGKSMLIVRFGVTKRSPLVSVLPQWFWHQNACKVFEQDMGFLSSQNEVLMKEKVPTKDLYLNLKSSDTWVAEYRKWMDKVGHGMPYHFGHRTISLPKVPPVVEHAPAGLIAALSASYPAKGGIGTMHAPNLANRYFRHIIHCRSCSNVIKSFELWKNILSATAVALTALAILVVSRQWKAVLLGSAALCSAAAYTCLRAINLNTNNFIRTHRRL

SEQ ID NO: 9521 - protein, 271 aa, Arabidopsis thaliana
MDYDPNTNPFDLHFSGKLPKREVSASASKVVEKKWLVKDEKRNMLQDEINRVNSENKKLTEMLARVCEKYYALNNLMEELQSRKSPESVNFQNKQLTGKRKQELDEFVSSPIGLSLGPIENITNDKATVSTAYFAAEKSDTSLTVKDGYQWRKYGQKITRDNPSPRAYFRCSFSPSCLVKKKVQRSAEDPSFLVATYEGTHNHTGPHASVSRTVKLDLVQGGLEPVEEKKERGTIQEVLVQQMASSLTKDPKFTAALATAISGRLIEHSRT

SEQ ID NO: 9522 - protein, 828 aa, Arabidopsis thaliana
MVSFLTLTSFFFICFFIHGSSAVDTISGDFTLSGDQTIVSSDGTYEMGFFKPGSSSNFYIGMWYKQLSQTILWVANRDKAVSDKNSSVFKISNGNLILLDGNYQTPVWSTGLNSTSSVSALEAVLQDDGNLVLRTGGSSLSANVLWQSFDHPGDTWLPGVKIRLDKRTGKSQRLTSWKSLEDPSPGLFSLELDESTAYKILWNGSNEYWSSGPWNPQSRIFDSVPEMRLNYIYNFSFFSNTTDSYFTYSIYNQLNVSRFVMDVSGQIKQFTWLEGNKAWNLFWSQPRQQCQVYRYCGSFGICSDKSEPFCRCPQGFRPMSQKDWDLKDYSAGCVRKTELQCSRGDINQFFRLPNMKLADNSEVLTRTSLSICASACQGDCSCKAYAYDEGSSKCLVWSKDVLNLQQLEDENSEGNIFYLRLAASDVPNVGASGKSNNKGLIFGAVLGSLGVIVLVLLVVILILRYRRRKRMRGEKGDGTLSAFSYRELQNATKNFSDKLGGGGFGSVFKGALPDSSDIAVKRLEGISQGEKQFRTEVVTIGTIQHVNLVRLRGFCSEGSKKLLVYDYMPNGSLDSHLFLNQVEEKIVLGWKLRFQIALGTARGLAYLHDECRDCIIHCDIKPENILLDSQFCPKVADFGLAKLVGRDFSRVLTTMRGTRGYLAPEWISGVAITAKADVYSYGMMLFELVSGRRNTEQSENEKVRFFPSWAATILTKDGDIRSLVDPRLEGDAVDIEEVTRACKVACWCIQDEESHRPAMSQVVQILEGVLEVNPPPFPRSIQALVVSDEDVVFFTESSSSSSHNSSQNHKHSSSSSSSKKMTNDNSSA

SEQ ID NO: 9523 - protein, 347 aa, Arabidopsis thaliana
MGKGRALSDGVIKKIILSYTYVAIWIFLSFTVIVYNKYILDKKMYNWPFPITLTMIHMGFCSSLAVILIKVFKVVEPVSMSRETYLRSVVPIGALYSLSLWLSNSAYIYLSVSFIQMLKALMPVAVYSIGVLLKKETFKSQTMTNMLSISFGVAIAAYGEAKFDGWGVFLQLGAVAFEATRLVLIQILLTSKGINLNPITSLYYVAPCCLVFLSVPWIFVEFPVLRDTSSFHFDFVIFGTNSVCAFALNLAVFLLVGKTSALTMNVAGVVKDWLLIAFSWSVIKDTVTPINLFGYGLAFLGVGYYNHCKLQALKAKDAQKKVQASDDEAGKLLEERESEAKRNETQD

SEQ ID NO: 9524 - protein, 1065 aa, Arabidopsis thaliana
MVAGSYRRYEFVRNRDDSDDGLKPLKDLNGQICQICGDDVGLTKTGNVFVACNECGFPLCQSCYEYERKDGSQCCPQCKARFRRHNGSPRVEVDEKEDDVNDIENEFDYTQGNNKARLPHRAEEFSSSSRHEESLPVSLLTHGHPVSGEIPTPDRNATLSPCIDPQLPGIYQLLLLPVRILDPSKDLNSYGLVNVDWKKRIQGWKLKQDKNMIHMTGKYHEGKGGEFEGTGSNGDELQMVDDARLPMSRVVHFPSARMTPYRIVIVLRLIILGVFLHYRTTHPVKDAYALWLTSVICEIWFAFSWLLDQFPKWYPINRETFLDRLALRYDRDGEPSQLAPVDVFVSTVDPMKEPPLVTANTVLSILAVDYPVDKVACYVSDDGSAMLTFEALSETAEFSKKWVPFCKKFNIEPRAPEFYFSQKIDYLKDKIQPSFVKERRAMKREYEEFKVRINILVAKAQKIPEDGWTMEDGTSWPGNNPRDHPGMIQVFLGHSGGLDTDGNELPRLIYVSREKRPGFQHHKKAGAMNALIRVSAVLTNGAYLLNVDCDHYFNNSKAIKEAMCFMMDPAIGKKCCYVQFPQRFDGIDLHDRYANRNTVFFDINLKGLDGIQGPVYVGTGCCFNRQALYGYDPVLTEEDLEPNIIVKSCFGSRKKGKSRKIPNYEDNRSIKRSDSNVPLFNMEDIDEDVEGYEDEMSLLVSQKRLEKRFGQSPVFIAATFMEQGGLPSTTNPLTLLKEAIHVISCGYEAKTDWGKEIGWIYGSVTEDILTGFKMHARGWISIYCVPSRPAFKGSAPINLSDRLNQVLRWALGSIEILLSRHCPIWYGYNGRLKLLERIAYINTIVYPITSIPLLAYCMLPAFCLITNTFIIPEISNLASLCFMLLFASIYASAILELKWSDVALEDWWRNEQFWVIGGTSAHLFAVFQGLLKVFAGIDTNFTVTSKASDEDGDFAELYVFKWTSLLIPPTTILLVNLVGIVAGVSYAINSGYQSWGPLMGKLLFAFWVVAHLYPFLKGLLGRQNRTPTIVIVWSALLASIFSLLWVRINPFVSTTGVMSNSFMGE

SEQ ID NO: 9525 - protein, 366 aa, Arabidopsis thaliana
MTSTENNNNGSDETQTTKLHFEDADESMHDGDDNNADVADDITSADYYFDSYSHFGIHEEMLKDVVRTKSYQDVIYKNKFLIKDKIVLDVGAGTGILSLFCAKAGAAHVYAVECSQMADTAKEIVKSNGFSDVITVLKGKIEEIELPVPKVDVIISEWMGYFLLYENMLDTVLYARNKWLVDGGIVLPDKASLYVTAIEDAHYKDDKVEFWDDVYGFDMSCIKRRAITEPLVDTVDGNQIVTDSKLLKTMDISKMAAGDASFTAPFKLVAQRNDHIHALVAYFDVSFTMCHKKMGFSTGPKSRATHWKQTVLYLEDVLTICEGETITGSMTIAQNKKNPRDVDIKLSYSLNGQHCNISRTHFYKMR

SEQ ID NO: 9526 - protein, 378 aa, Arabidopsis thaliana
MESDLIDLFEGAKKAADAAALDGVTSSGPEVSQCIDALKQLKKFPVTYDTLVATQVGKKLRSLAKHPVEDIKSVATDLLEIWKKVVIEETAKAKKTEGTNGCKEAKVNKMDVEKPSNPAPVKVQKLQRGDSAKSIKVERKEPDNKVVTGVKIERKVPDIKVTNGTKIDYRGQAVKDEKVSKDNQSSMKAPAKAANAPPKLTAMLKCNDPVRDKIRELLVEALCRVAGEADDYERESVNASDPLRVAVSVESLMFEKLGRSTGAQKLKYRSIMFNLRDSNNPDLRRRVLTGEISPEKLITLSAEDMASDKRKQENNQIKEKALFDCERGLAAKASTDQFKCGRCGQRKCTYYQMQTRSADEPMTTYVTCVNCDNHWKFC

SEQ ID NO: 9527 - protein, 283 aa, Arabidopsis thaliana
MYKDRSGGGIMGGGGSSRSEILGGAIDRKRINDALDKHLKKSSPSTSRVFTSKDKDSVPSTSTAKSQLHSRSPDVESDTDSEGSDVSGSEGDDTSWISWFCNLRGNEFFCEVDEDYIQDDFNLCGLSGQVPYYDYALDLILDVESSNGDMFTEEQHEMVESAAEMLYGLIHVRYILTTKGMAAMMEKYKNYDFGRCPRVFCCGQSCLPVGQSDIPRSSTVKIYCPKCEDIYYPRSKYQGNIDGAYFGTTFPHLFLMAYGNMKPQKPAQNYVPKIFGFKVHNKQ

SEQ ID NO: 9528 - protein, 136 aa, Arabidopsis thaliana
MAGKGGKGLLAAKTTAAAANKDSVKKKSISRSSRAGIQFPVGRIHRQLKQRVSAHGRVGATAAVYTASILEYLTAEVLELAGNASKDLKVKRITPRHLQLAIRGDEELDTLIKGTIAGGGVIPHIHKSLVNKVTKD

SEQ ID NO: 9529 - protein, 776 aa, Arabidopsis thaliana
MQPNSHIFVIITISSLIITVSAYGSTGTIAAAFGENGFFCAIDASGKQEVICWDRGNTNRSLNRPPGEISGYSPPMTSLSGGEGFLCAITSNTSRAFCWNLEDPSENLVPRAFQYNSYLQIASGNNHVCAISGLYYSGPDYGPVHCWEYSDNTNFTSGLLWNSSFHNPYIDSLMFRKIVSGDGFSCGVTKDGDLVCWGPKSNLLNFSNNEEFEVLASGRNSVCGVSKDSGQLHCFGDETEFGSLPNRPRFIALSAGANHYCGIREDDHGVECWGRNLNSSSSSSAPNTSGFVAISSSDSTTCGVRELDLVLDCWRVHDSSKADYSPPLELCSPGMCSPRGNCGDGWFAFNASILKESELTSLCSFHNLNICLRCGISCLEGYFPSSTCNPNADRVCTPCSLCQNSSCYGICKIRATKSKEHEQKEQREVRRLVIIIGCSVLGFLVMLIGLSFIPKMTKGSKRDDEERSKMTCCFCFDKNSVEADPDPVPHQSVLLPTAVSLGETKIFRLSELKDATHGFKEFNELGRGSFGFVYKAVLSDGIHVAVKRANAATIIHSNNRGFESELEILCKIRHNNIVNLLGYCSEMGERLLVYEYMPHGTLHDHLHGDLSQLDWSMRLKIMLQAARGLDYLHNEVDPPIIHRDVKTSNILLDGEMCARIADFGLVSSNERDSSNSDREGDVYDFGIVLLEILSGRKAIDRESDPAGIAEWAVPLIRKGKAAAIIDRNICLPRNVEPLLKLAELAELAVRENSNERPNIRNILCFLDLIVKSGLTF

SEQ ID NO: 9530 - protein, 479 aa, Arabidopsis thaliana
MNSASVSGESSLSDMIQTVHFSSGNPRIGETRGVMHLISDNAVSSSSSSSSSNLPIGRNPLVCVLGVPNHMTYADFCQFCGSFIQHILDMRTVRNDDIENRYSILIRFDSQESTDTFFQHFRGKQFNSLDEDVCRLLFALDVQFTGYSGSIDHTQPSAAGPIEQPTCPVCLERLDQDTGGILTTMCNHSFHCSCISNWPDSSCPVCRYCQQQPENSVCCVCQTTENLWMCVICGVVGCGRYKEGHARRHWEETEHCYSLELETQRVWDYAGDNYVHRLIQSKTDGKLVELNSHGSLSKDGCGSCEYSDSGMTDALLNSKVDMIISEYNELLQAQLENQKQYFEKLLQNVKEETEQKISEAASKAISQRLQKLQTRFDRCVKEKQFLEDLNENLVKNKDVWSTKITEMKEREKKAVRAKDEKIQGLEEQLGNLMAQMDGESEVSETKEVQDATVSTTNTSSSGAGNVIHANKKKSNRRKG

SEQ ID NO: 9531 - protein, 345 aa, Arabidopsis thaliana
MEELKVEMEEETVTFTGSVAASSSVGSSSSPRPMEGLNETGPPPFLTKTYEMVEDPATDTVVSWSNGRNSFVVWDSHKFSTTLLPRYFKHSNFSSFIRQLNTYGFRKIDPDRWEFANEGFLAGQKHLLKNIKRRRNMGLQNVNQQGSGMSCVEVGQYGFDGEVERLKRDHGVLVAEVVRLRQQQHSSKSQVAAMEQRLLVTEKRQQQMMTFLAKALNNPNFVQQFAVMSKEKKSLFGLDVGRKRRLTSTPSLGTMEENLLHDQEFDRMKDDMEMLFAAAIDDEANNSMPTKEEQCLEAMNVMMRDGNLEAALDVKVEDLVGSPLDWDSQDLHDMVDQMGFLGSEP

SEQ ID NO: 9532 - protein, 383 aa, Arabidopsis thaliana
MGLLCSRSRHHTEDTDENTQAAEIERRIEQEAKAEKHIRKLLLLGAGESGKSTIFKQIKLLFQTGFDEGELKSYVPVIHANVYQTIKLLHDGTKEFAQNETDSAKYMLSSESIAIGEKLSEIGGRLDYPRLTKDIAEGIETLWKDPAIQETCARGNELQVPDCTKYLMENLKRLSDINYIPTKEDVLYARVRTTGVVEIQFSPVGENKKSGEVYRLFDVGGQRNERRKWIHLFEGVTAVIFCAAISEYDQTLFEDEQKNRMMETKELFDWVLKQPCFEKTSFMLFLNKFDIFEKKVLDVPLNVCEWFRDYQPVSSGKQEIEHAYEFVKKKFEELYYQNTAPDRVDRVFKIYRTTALDQKLVKKTFKLVDETLRRRNLLEAGLL

SEQ ID NO: 9533 - protein, 179 aa, Arabidopsis thaliana
MVAATVNLANMTWTSLNSNPAISFSMLSGIRNLGMLPFRRCLKPTVIGIASWPPLRCSSVKAMSSSSSSSGSTLEETVKTTVAENPVVVYSKTWCSYSSQVKSLFKSLQVEPLVVELDQLGSEGSQLQNVLEKITGQYTVPNVFIGGKHIGGCSDTLQLHNKGELEAILAEANGKNGQT

SEQ ID NO: 9534 - protein, 596 aa, Arabidopsis thaliana
MDSAKGWFQKRQMRGGSRYKGASGGAGGGGSNGSADEHNVETDEEAVSNTTKQKVAAAKQYIENHYKEQMKILQERKERRSMLEQKLADADVSEEDQNNLLKFLEKKETEYMRLQRHKLGVADFDLLTMIGKGAFGEVRVCREKTTGQVYAMKKLKKAEMLRRGQVEHVRAERNLLAEVDSNYIVKLYCSFQDDDHLYLVMEYLPGGDMMTLLMRKDTLTEEEAKFYVAETVLAIESIHRHNYIHRDIKPDNLLLDRYGHLRLSDFGLCKPLDCSAIGENDFSNNSNGSTEQEAGSTAPKRTQQEQLEHWQRNRRTLAYSTVGTPDYIAPEVLLKKGYGMECDWWSLGAIMYEMLVGYPPFYSDDPMSTCRKIVNWKSHLKFPEEAILSREAKDLINSLLCSVRRRLGSKGADELKAHTWFETVDWDTIFDMDAAFVPEVNDDLDTQNFEKFDESESETQTSSKSGPWRKMLSSKDINFVGYTYKNFEIVNDYQVPGMGTHLLDHCGVEEEEKVDATNGQVTLRYPTTSFTGPKFGYFHVNLEYNGSSETSDSSETTSRPPCDRPPPAPPVVQGSFLKLLPPELEVRPKQEGSEAC

SEQ ID NO: 9535 - protein, 515 aa, Arabidopsis thaliana
MNNLGNFGVWGFGFFSLSIWFAVLQQANGLRPIRETARSWGDEWLFGKKEKGGAGPFSAWNITGTYRGTWKFLDTVNSSSKFPDFRKESGNSVIELVTSPTKITGVHYVQGAVVFHDVFDNEHNVGGAQIKVEGLEDDYLLSNPYHLVMPDLGIFSSQVFQESPRDRILKQKTSPIYEMEKHCNIEIAAQISQSTSSENNGDKDRYQIEGLMESPAVDDEVDCFSPLSLNATSINVEVYYNKAVNYTLMKRLDANFWMTLLVYKGAAKVSIVMIGQQAIMDSYLCLLHLTAGILVESLFNAFATAAFFKFVVFSIFEMRYLLSIWKATRPSTSDGILLGGILLMYEFHNYMRPILLLMYSFWIPQIVANVVRDSRKPLHPYYILGMTVTRLAIPLYVFGCPKNFMRVEPSKAWCVSLCAFMGFQAGVLLLQHYFGSRCFVPRKLLPEKYSYYRRLDHNVNRSRDCVICMTTIDLRHRINDCMVTPCEHIFHSGCLQRWMDIKMECPTCRRPLPPA

SEQ ID NO: 9536 - protein, 259 aa, Arabidopsis thaliana
MASSQRYFALLALFAVSLKFCYCQNETIDVAGSGTAGVTWYGEPFGAGSTGGACGYGSAVANPPLYAMVSAGGPSLFNNGKGCGTCYQVVCIGHPACSGSPITVTITDECPGGPCASEPVHIDLSGKAMGALAKPGQADQLRSAGVIRVNYKRAACLYRGTNIVFRMDAGANPYYISFVVEYENGDGDLSNVEIQPAGGSFISMQEMRSAVWKVNSGSALRGPFNIRLTSGESHKVIVAYNVIPANWKPDESYRSIVNF

SEQ ID NO: 9537 - protein, 214 aa, Arabidopsis thaliana
MVRGKTQMKRIENATSRQVTFSKRRNGLLKKAFELSVLCDAEVSLIIFSPKGKLYEFASSNMQDTIDRYLRHTKDRVSTKPVSEENMQHLKYEAANMMKKIEQLEASKRKLLGEGIGTCSIEELQQIEQQLEKSVKCIRARKTQVFKEQIEQLKQKEKALAAENEKLSEKWGSHESEVWSNKNQESTGRGDEESSPSSEVETQLFIGLPCSSRK

SEQ ID NO: 9538 - protein, 317 aa, Arabidopsis thaliana
MAVKATKAEKKIVYDSKLCQLLNEYSQILVVAADNVGSTQLQNIRKGLRGDSVVLMGKNTMMKRSVRIHADKTGNQAFLSLLPLLQGNVGLIFTKGDLKEVSEEVAKYKVGAPARVGLVAPIDVVVQPGNTGLDPSQTSFFQVLNIPTKINKGTVEIITPVELIKKGDKVGSSEAALLAKLGIRPFSYGLVVESVYDNGSVFNPEVLNLTEDDLVEKFAAGVSMITALSLAISYPTVAAAPHMFLNAYKNVLAVALATEYSFPQAENVKEFLKDPTKFAVAVAAPVSGESGGAVVAVAVEEEAAEESDGDMGFDLFG

SEQ ID NO: 9539 - protein, 226 aa, Arabidopsis thaliana
MSFTGTLDKCKACDKTVYVMDLLTLEGNTYHKSCFRCTHCKGTLVISNYSSMDGVLYCKPHFEQLFKESGNYSKNFQAGKTEKPNDHLTRTPSKLSSFFSGTQDKCATCKKTVYPLEKVTMEGESYHKTCFRCTHSGCPLTHSSYASLNGVLYCKVHFNQLFLEKGSYNHVHQAAANHRRSASSGGASPPSDDHKPDDTASIPEAKEDDAAPEAAGEEEPEPVVES

SEQ ID NO: 9540 - protein, 190 aa, Arabidopsis thaliana
MAEEQKTSKVDVESPAVLAPAKEPTPAPVEVADEKIHNPPPVESKALAVVEKPIEEHTPKKASSGSADRDVILADLEKEKKTSFIKAWEESEKSKAENRAQKKISDVHAWENSKKAAVEAQLRKIEEKLEKKKAQYGEKMKNKVAAIHKLAEEKRAMVEAKKGEELLKAEEMGAKYRATGVVPKATCGCF

SEQ ID NO: 9541 - protein, 166 aa, Arabidopsis thaliana
MASADEKVVEEKASVISSLLDKAKGFFAEKLANIPTPEATVDDVDFKGVTRDGVDYHAKVSVKNPYSQSIPICQISYILKSATRTIASGTIPDPGSLVGSGTTVLDVPVKVAYSIAVSLMKDMCTDWDIDYQLDIGLTFDIPVVGDITIPVSTQGEIKLPSLRDFF

SEQ ID NO: 9542 - protein, 382 aa, Arabidopsis thaliana
MGNSSEEPKPPTKSDKPSSPPVDQTNVHVYPDWAAMQAYYGPRVAMPPYYNSAMAASGHPPPPYMWNPQHMMSPYGAPYAAVYPHGGGVYAHPGIPMGSLPQGQKDPPLTTPGTLLSIDTPTKSTGNTDNGLMKKLKEFDGLAMSLGNGNPENGADEHKRSRNSSETDGSTDGSDGNTTGADEPKLKRSREGTPTKDGKQLVQASSFHSVSPSSGDTGVKLIQGSGAILSPGVSANSNPFMSQSLAMVPPETWLQNERELKRERRKQSNRESARRSRLRKQAETEELARKVEALTAENMALRSELNQLNEKSDKLRGANATLLDKLKCSEPEKRVPANMLSRVKNSGAGDKNKNQGDNDSNSTSKLHQLLDTKPRAKAVAAG

SEQ ID NO: 9543 - protein, 569 aa, Arabidopsis thaliana
MTSSAVPSLFRLSFLLFTLQVMNIGRIGAATRFYQFKVQTIRLTRLCQTNEIVTVNKKFPGPAISAQEDDRIVIKVINMTPYNTTIHWHGIKQKRSCWYDGPSYITQCPIQSGQSFTYNFKVAQQKGTFLWHAHFSWLRATVYGPLIVYPKASVPYPFKKPFNEHTILLGEYWLKNVVELEQHVLESGGPPPPADAFTINGQPGPNYNCSSKDVYEIQIVPRKIYLLRLINAGINMETFFTIANHRLTIVEVDGEYTKPYTTERVMLVPGQTMNILVTADQTVGRYSMAMGPYESAKNVKFQNTSAIANFQYIGALPNNVTVPAKLPIFNDNIAVKTVMDGLRSLNAVDVPRNIDAHLFITIGLNVNKCNSENPNNKCQGPRKGRLAASMNNISFIEPKVSILEAYYKQLEGYFTLDFPTTPEKAYDFVNGAPNDIANDTQAANGTRAIVFEYGSRIQIIFQNTGTLTTENHPIHLHGHSFYVIGYGTGNYDQQTAKFNLEDPPYLNTIGVPVGGWAAIRFVANNPGLWLLHCHFDIHQTWGMSTMFIVKNGKKVQESLPHPPADLPKC

SEQ ID NO: 9544 - protein, 590 aa, Arabidopsis thaliana
MAVDSNLSSPLGPPACEKDAKALRFIEEMTRNADTVQENLLAEILARNADTEYLRRFNLCGATDRDTFKTKIPVITYEDLQPEIQRIADGDRSPILSAHPISEFLTSSGTSAGERKLMPTIKEELDRRQLLYSLLMPVMNLYVPGLDKGKGMYFLFVKSETKTPGGLPARPVLTSYYKSEHFRSRPYDPYNVYTSPNEAILCPDSFQSMYTQMLCGLLDRLSVLRVGAVFASGLLRAIRFLQLHWSRFAHDIELGCLDSEITDPSIRQCMSGILKPDPVLAEFIRRECKSDNWEKIITRIWPNTKYLDVIVTGAMAQYIPTLEYYSGGLPMACTMYASSECYFGLNLNPMSKPSEVSYTIMPNMAYFEFIPLGGTKAVELVDVNIGKEYELVVTTYAGLCRYRVGDILRVTGFHNSAPQFHFVRRKNVLLSIDSDKTDESELQKAVENASSILHEECGSRVAEYTSYADTSTIPGHYVLYWELLVRDGARQPSHETLTRCCLGMEESLNSVYRQSRVADNSVGPLEIRVVRNGTFEELMDYAISRGASINQYKVPRCVNFTPIVELLDSRVVSAHFSPSLPHWTPERRRR
